United States Patent 9,782,462 (MODIFIED POLYNUCLEOTIDES FOR THE PRODUCTION OF PROTEINS ASSOCIATED WITH HUMAN DISEASE) - sequence listing, part 67

SEQ ID NO: 128338 - DNA, 2637 bp, Artificial Sequence
  Description of Artificial Sequence: Synthetic coding sequence
atggccagcgtccccgtttactgcctgtgtcggttgccatacgacgtaacccgattcatgatcgagtgcgatatgtgccaggattggttccacgggtcctgcgttggtgtcgaggaggaaaaggcggccgatatcgatctgtaccactgtcccaattgcgaggtattgcacggtccaagtatcatgaagaaaaggaggggaagttcaaaagggcatgacacccataagggaaagccagtgaaaacagggtctcccacatttgtaagagagctgagatcccgtacctttgacagttctgatgaagtcatcctgaaacccaccggcaatcagctgaccgtcgaattcttagaagaaaactcattttcggtgcccattttggtgctgaaaaaagacgggcttggaatgacgttgccctccccaagcttcaccgtgcgggatgtggagcattacgttggatctgacaaggaaattgacgtaattgatgtcactcgacaggcagactgcaagatgaagcttggcgacttcgtgaaatattattactcagggaagcgcgaaaaggtcctgaatgttatctctctggagttctcagataccaggttgagcaatctcgtcgagacaccaaagatcgttcgaaagttgtcatgggtagagaacctatggcctgaggagtgcgtctttgaacggccaaacgtgcagaaatactgcctgatgagcgtgcgggacagctacacagatttccatatagatttcggggggactagtgtgtggtaccacgttttgaaaggggaaaagattttctacctgatacgccccacaaacgcgaacctgacactgttcgagtgttggtcctctagctcaaatcagaacgagatgttctttggagatcaagtcgataagtgctacaagtgcagcgtcaagcaggggcaaaccctctttatcccaactgggtggatccatgcggtgcttactcctgttgattgtctcgcctttgggggtaatttcctgcactctcttaacatcgagatgcagctgaaggcatacgagattgaaaagcgtctgtccacagctgacctctttaggtttcctaatttcgagaccatttgctggtacgtcggaaaacatattctggatatcttcagggggctcagagaaaacagaagacaccccgcaagctaccttgttcatgggggcaaagctctaaatcttgcatttcgggcctggacacgtaaggaggcactgcccgaccatgaggacgagatccctgaaacggtgcggaccgttcagttgataaaagacttggcacgtgaaatcagactcgtcgaggacatatttcagcaaaacgttggcaagactagcaacattttcggccttcagaggatattcccagctggatcaattcccctgacccgacccgcccatagcacgtccgtgagtatgtcccgtctctccttgccgagtaaaaacgggagcaagaagaagggcctgaagccgaaggagctgtttaagaaggctgagcggaagggtaaagaatcgtctgctctcggccccgcaggacagcttagctataacctgatggatacctacagccaccaggcactgaagactggatcgttccagaaggcaaaattcaacatcaccggggcatgtctgaatgattcggatgatgatagccctgacctagatctcgacggcaacgaatcaccacttgctctcttgatgtctaacgggagcacaaagcgggtcaaaagcctcagtaagtcccggcggacaaagatagctaaaaaagttgataaggcaagactcatggccgaacaagtgatggaagatgagtttgacttggactccgacgacgagctccaaatagacgaaaggcttggaaaggagaaggccactctgatcatccgaccaaagtttccacgcaaactccctagggctaaaccctgctcagaccccaatcgagtccgagagcctggcgaggtggaattcgatatcgaagaagattatacaactgacgaagatatggtggaaggggtggagggttatcagacagctacacccgcccccgcccaaggcgcttccgaagcccctgcgtctcccagcacgcaggaagcgattcagggtatgctgtgtatggccaatctacagagctccagcagtagccctgccaccagcagcctgcaggcctggtggaccggcgggcaagatagatcaagcggctccagcagctccgggctcgggaccgtatccaacagtccagcatctcagcgaacaccgggcaaaagacccataaagcgccccgcctactggcggaccgagagtgaggaggaggaagagaacgccagtctggatgaacaggactccctcggggcatgcttcaaagacgccgagtacatctatccctcactggagtctgatgatgatgatccggccctcaaaagccgacccaagaagaaaaagaatagcgatgacgccccgtggagcccaaaggcgcgggttactccgaccctccccaaacaggatcgccctgtccgagagggtacgcgcgtagcatcaatagagacaggtctggctgcagcagctgctaaactggcccagcaggtgaagaagatgaagctgagcctaactgacagcggatag

SEQ ID NO: 128339 - DNA, 417 bp, Artificial Sequence
  Description of Artificial Sequence: Synthetic coding sequence
atgaaactccccatttttatcgctgacgccttcactgctagggctttccgcgggaaccccgccgccgtgtgcctactggaaaatgagctggatgaggacatgcatcagaaaattgcgcgcgagatgaatctaagcgaaacagcttttattcgaaagctccatcccaccgataattttgctcaaaagaatatgaatagtactctcacctttgtgacgctgtccggcgagcttcgggcgcgccgagcggaggacgggattgtccttgacctgcccttatacccggcccacccccaggattttcatgaagtcgaggacctgattaagacagcaatcgggaacacactggtgcaggacatttgctactctcccgatacccagaaactcctggtgaggttgagcgatgtgtacaaccgctag

SEQ ID NO: 128340 - DNA, 867 bp, Artificial Sequence
  Description of Artificial Sequence: Synthetic coding sequence
atgaagctgccaatttttatcgccgatgcttttacagcaagagctttcagagggaaccccgctgccgtctgcctgctcgaaaatgaattggatgaggacatgcaccagaagatcgcaagagaaatgaatctgtccgaaaccgccttcatcagaaagctacatccaactgataatttcgctcagtcctcctgcttcggcctccgttggttcactccggcgtctgaggtgcctctgtgcgggcacgcaacactggccagcgccgccgtcctttttcataaaatcaaaaacatgaacagcacacttacattcgtcacactctcaggcgagctcagagccaggcgggctgaggacgggatcgtgttggacttgccgctctatccagctcaccctcaggatttccatgaagtcgaggatctgattaagacagcaatcggtaataccctcgttcaggatatctgctattctcctgatacgcagaaattgcttgtcaggctgtccgatgtttacaataggtccttcctggagaacctgaaagtgaataccgagaatcttctccaagtcgagaatactggaaaggtgaaggggttgatcctgaccctcaaaggagagccaggtgggcagacccaggcttttgacttctactctcgatacttcgcaccctgggtcggtgtggcagaggacccggtaactggatcagctcacgcagtgcttagcagttattggagtcaacacttaggcaagaaagaaatgcacgcctttcagtgtagtcataggggaggagaactgggaatttccctgcggcctgatggaagagtcgatattcggggcggcgcagccgtcgtactcgagggcaccctgaccgcttag

SEQ ID NO: 128341 - DNA, 768 bp, Artificial Sequence
  Description of Artificial Sequence: Synthetic coding sequence
atgcatcagaaaatcgcgcgagaaatgaacctcagcgaaactgcctttatccgcaagctccaccccaccgataatttcgcccaaagcagctgttttgggctgagatggttcacaccagcctcggaggtcccactctgtgggcacgccacactcgctagcgcggctgtgttattccacaagattaaaaatatgaattctactctgacttttgttaccctgtcgggcgagctcagggcccgccgcgccgaggacggcatcgtcctggatctgcctttataccccgcacaccctcaagactttcacgaggtcgaggaccttattaaaaccgctataggtaacaccctcgtgcaggacatttgttattcaccagacactcagaagttgctggtgagactgtccgatgtgtacaataggtctttcctcgaaaacctgaaggtcaacacagagaacctgctgcaggtcgagaatacgggtaaagtgaagggcctgattctgactctcaaaggcgaaccaggaggacagacacaagccttcgacttctacagtaggtactttgccccatgggtgggggtcgccgaggaccctgtgacaggatcagcccacgctgttctgagctcttactggagccagcacctcggcaaaaaagaaatgcacgcattccaatgtagccaccgcggcggggaattggggattagcctccgccccgacggcagagtggatatcagagggggtgccgcagtcgtactcgagggcacattgaccgcctag

SEQ ID NO: 128342 - DNA, 867 bp, Artificial Sequence
  Description of Artificial Sequence: Synthetic coding sequence
atgaagttgccaatctttatcgccgacgccttcaccgctcgcgctttccgcgggaatccagctgctgtgtgcctgttggagaacgaactggatgaagatatgcaccagaagatagcccgagagatgaacctgtcagagaccgccttcattcgaaagttacatccaaccgataactttgcccagtccagttgttttggcctcaggtggttcacccccgcaagcgaagtgcctttgtgtggccacgcgacactggcctcggccgcggttctgtttcataagatcaagaacatgaactccactctgacctttgtcacattgtcaggcgaactcagagcacgtagagcagaggacggaatcgtcctcgatctcccactgtaccctgcccatcctcaggactttcacgaagtcgaggacctcatcaaaactgccatcggtaatacactggtgcaagacatctgctattcccctgatacccagaagcttttagtgcgtctgagcgacgtctataatagatccttcttggagaacctgaaggtcaacacagagaacttgttgcaggtggaaaatacaggaaaggtaaagggactaatcctgactctcaagggggagcctggcggccagacccaagccttcgatttctacagtcgctactttgctccgtgggtgggggtggcggaagatccagttacaggaagtgcccacgccgttctgtctagctactggtcccaacatctgggcaagaaggaaatgcatgccttccagtgctcccaccggggcggagaactcggaattagccttagacctgatggccgcgtggacattcgtggcggggccgctgtggtgcttgagggaaccctcacagcatag

SEQ ID NO: 128343 - DNA, 843 bp, Artificial Sequence
  Description of Artificial Sequence: Synthetic coding sequence
atgaagctgcctatctttatcgctgacgcatttacagctagggcatttcgggggaaccctgccgctgtgtgcttgttagagaacgagctggatgaggatatgcatcagaagatcgcccgtgagatgaatcttagtgaaacagctttcattcgaaagcttcaccctacggacaatttcgcccagtccagttgctttggtctaagatggtttacccctgcaagtgaagtccctttatgtgggcatgccacacttgcctcagccgccgtgctgtttcataagatcaagaacatgaacagcactctgaccttcgtgacattgagtggcgagctccgtgctcggagagcagaggacggtatcgtgctggatctgcccctctacccggcacaccctcaagacttccacgaagtcgaggacctgataaagaccgcaattggaaataccctggttcaggatatttgctactccccagacacacagaagctcctggtcaggctgagtgacgtgtataataggtccttcctagagaacctcaaagtcaacaccgagaacctcctacaggtcgaaaatacgggcaaggttaagggactcatcctcacactaaaaggcgagcccggaggtcaaacccaggcctttgatttttacagcagatatttcgctccctgggtcggggtggccgaggaccccgtcaccggcagtgcgcacgctgtcttgtcatcgtactggtcgcaacacctgggtaagaaggagatgcacggccgaacagcgctgtaccagtttttgttctatctgccaaactcaaaactggtgtttctcctgatatgtactatccctttgaagatgtag

SEQ ID NO: 128344 - DNA, 1356 bp, Artificial Sequence
  Description of Artificial Sequence: Synthetic coding sequence
atggtaggcagcgccctgcgacggggcgcccatgcctacgtgtatctcgtgagtaaggcctctcatatctcccgcggccaccaacaccaagcctgggggtccaggccacctgctgccgagtgcgctacacaacgggctcccggctccgtcgtggagctgctggggaaatcgtacccacaagacgatcactctaatctaacacggaaggtgctgacacgcgtcggtcggaacctgcacaatcaacagcatcatccactatggctgattaaggagagggtgaaggagcatttttacaagcaatacgtggggcggttcggtactccactgttcagcgtgtatgacaatctcagccccgtggtgacgacatggcagaatttcgattcgcttctgatccccgccgaccatccctcccgcaagaaaggcgataattactacctcaataggacacacatgctgcgggcccatactagtgcccaccagtgggatctgttgcacgcggggcttgatgcatttctggtcgtcggtgatgtataccggagagatcagatagatagtcagcactacccaatatttcatcagctggaggccgtgcggctgttcagtaaacatgagctgttcgccggtatcaaggatggggagagcttgcaactgttcgagcaaagctcccgctcagctcataaacaggaaacgcacacaatggaggctgtcaagttggtcgaattcgatctaaagcaaactctgacacgcctcatggcacacctgttcggagacgaactggagatccgctgggtagactgttattttccgtttacccaccctagctttgagatggagatcaacttccacggcgaatggctggaggttttagggtgtggggtgatggaacaacagctcgttaactccgcaggcgcgcaagatagaatcgggtgggcctttgggctgggactcgagcgcctcgcaatgatcctgtacgatatcccggacatacggcttttttggtgtgaggatgagcgctttttgaaacaattttgcgtgagtaacattaatcaaaaagtgaagtttcagcctctgagcaagtatcccgccgttatcaatgatataagcttctggctgccgagtgaaaactatgccgagaacgatttttacgatctcgtgcggaccatcggcggcgacctggttgagaaggtggatctgattgacaaattcgttcacccgaagacccataaaacttctcattgttaccggataacttatcggcacatggagcggacattaagtcagagagaggtgagacatatccaccaagctttacaggaggccgccgtgcagttgctgggagtggaaggaaggttttag

SEQ ID NO: 128345 - DNA, 1356 bp, Artificial Sequence
  Description of Artificial Sequence: Synthetic coding sequence
atggtggggtccgcccttcgaagaggcgctcacgcttacgtgtaccttgttagcaaagcttcacacatctctcgcggccaccaacaccaggcctgggggtcacggcctcctgcagcggaatgtgccacccaaagggcccccgggagtgtggtggagctgctgggtaagagctatccacaggacgaccatagcaacctgacacgcaaagtcctgactcgggtgggtaggaacctgcataaccagcaacatcacccactatggcttatcaaggaaagggtaaaagagcacttctataagcagtacgtcggccgcttcggcacgcccctgttttccgtgtatgacaacctatcacctgttgtgaccacgtggcaaaacttcgattccctgctgatcccagcagaccacccttcaagaaaaaaaggggacaactactatctgaacagaactcatatgctgagagctcacaccagcgcacatcaatgggatctgctgcacgccggcctggacgccttcctggtcgtgggcgacgtatatcggcgtgaccagatcgacagccaacactacccgatcttccatcagctggaggcagttagattattcagtaagcacgaactttttgcgggcatcaaggacggggaatcgctgcagctctttgaacaatcttctagatctgcacacaaacaggagactcacacaatggaagcagtgaagctcgtagagttcgatcttaagcagactctcaccaggctaatggctcatctcttcggcgacgagttggaaatcagatgggttgattgttattttccttttacacaccctagttttgaaatggaaatcaattttcacggcgagtggctcgaagtcttgggctgcggagttatggagcaacaattagttaactctgccggtgcccaagatcggattggctgggcatttgggctgggtctcgagaggcttgctatgatactgtatgatattcctgacatccggctgttctggtgcgaggatgaacggtttctaaagcagttttgcgtgagcaacatcaatcagaaagtgaaattccagccactgagtaaataccccgctgtcataaacgatatatctttctggttgcctagtgagaattacgctgaaaacgatttctatgatctggtccgaacaataggcggcgacctggtggaaaaggttgacttgattgacaagtttgtgcatcccaagacccacaagacatcccattgctaccgcataacgtatcggcatatggagagaacactcagccagcgagaggtccgccatatccaccaagccctccaagaggccgcagtacaactactgggcgtcgaagggagattttag

SEQ ID NO: 128346 - DNA, 468 bp, Artificial Sequence
  Description of Artificial Sequence: Synthetic coding sequence
atgctcagagcccacacttccgcacatcagtgggatctactccacgctggcctcgacgcctttctcgtagtcggtgacgtgtaccggcgtgaccagatcgattcccagcattatccaatctttcatcaacttgaggccgttaggctctttagtaaacatgagttattcgcggggattaaggacggagaatcccttcagttattcgaacaatcctcaagatccgctcataaacaggaaactcacacgatggaggcggtgaagctggtcgagtttgatcttaaacaaaccttgacccgtctgatggcccacctgttcggcgatgagctcgagatcagatgggtcgactgctactttccctttactcacccttcattcgagatggaaataaatttccacggtgaatggttggaggtgttgggctgcggtgtgatggagcagcagctagtgaattccggcggtgccacctag

SEQ ID NO: 128347 - DNA, 306 bp, Artificial Sequence
  Description of Artificial Sequence: Synthetic coding sequence
ttgttcgctggaatcaaggacggggagagtctccaattgttcgaacagtcttcccgatcagctcacaagcaagaaactcacacaatggaggcagtcaagctggtcgagttcgatttgaagcagaccctcacgcggttgatggcacacctgtttggagacgaactcgagattcgatgggtcgactgctactttcctttcacacatccaagcttcgaaatggagatcaattttcacggtgaatggctggaggtgctaggctgtggtgtgatggagcagcagctcgtcaactctggcggcgccacttag

SEQ ID NO: 128348 - DNA, 849 bp, Artificial Sequence
  Description of Artificial Sequence: Synthetic coding sequence
atgagtggcgctgatcgttcaccaaacgctggggccgctcctgactctgctccagggcaggccgccgtcgcgtcggcctaccagcgctttgaaccccgcgcttacctgcgaaacaattacgcacctccacggggcgacctttgcaatccgaacggggtagggccatggaagctgcgatgtctcgcacaaacctttgccaccggcgaggtctcagggaggactctaattgacattggcagcggcccgacagtataccagctgctttcagcctgtagccacttcgaagacattacaatgaccgactttctcgaggtaaacaggcaagagctgggacgctggctccaagaagaacccggagccttcaattggtccatgtactcacagcacgcctgtcttatcgaggggaaaggcgagtgctggcaggataaagagcgacagcttagggctagggtgaaaagagtcctgcccatcgatgtgcaccagccccaaccattaggcgcaggaagtcctgctcccttaccagcggatgcattggtttctgcattttgcttggaggccgtctcgccggatctggctagctttcagagggctctcgaccatattactactctactgcgacctgggggacatttgctgctcatcggcgccttggaggagtcctggtatctcgcaggtgaagccaggctaaccgttgtgcctgtctcggaggaggaggtgagagaagcacttgtgcggagtgggtacaaagtgcgcgacctgaggacgtacataatgcccgcacacctgcagaccggcgtagatgatgtcaagggagttttcttcgcatgggcccagaaagtcggtctgtag

SEQ ID NO: 128349 - DNA, 555 bp, Artificial Sequence
  Description of Artificial Sequence: Synthetic coding sequence
atgactgatttcctggaagtcaacagacaggagctcggcagatggcttcaggaggagccaggagcctttaactggtcaatgtactcccaacacgcatgtcttatcgagggcaagggggagtgttggcaggataaagagaggcaactccgtgcacgcgttaaaagagtgctgcctatcgacgttcaccagcctcagcccctgggcgcagggagccctgcccccctgcctgcggatgctctagtcagtgccttttgcctggaggccgtctcccccgacctcgccagctttcagcgtgctttggatcatataacaactttactgagacccggaggacacctactccttataggcgctctcgaggaaagctggtacctggcgggtgaggcccgcctgacagtcgtgccagtctctgaggaagaagtgcgagaggccctggtgagaagcggctacaaagttcgggaccttcgaacatatattatgcccgctcatctccagaccggcgtggacgacgtcaagggggtgttttttgcttgggcacagaaggtaggactgtag

SEQ ID NO: 128350 - DNA, 741 bp, Artificial Sequence
  Description of Artificial Sequence: Synthetic coding sequence
atggaagaggcgaaatcacagagtctggaagaggactttgaaggtcaagctacgcataccgggcccaaaggggtcattaatgattggagaaagtttaagttagagagccaagactctgactctatccctccctccaaaaaggagattctccggcagatgtcctctcctcaatcccggaacggtaaggattcgaaggagcgagtcagccggaaaatgagcattcaggagtatgagctgattcataaggagaaggaggatgaaaactgtctgaggaaataccggcgccagtgcatgcaagacatgcaccaaaaactgtcttttggccctcgctacggctttgtatacgaactcgagactggaaagcagtttctagaaacgattgaaaaggaactgaaaattacaactatagtggtacacatctatgaagacgggatcaagggatgtgacgctttgaacagttctcttacttgtctcgccgctgagtatccgattgttaagttctgcaagatcaaggccagcaacaccggggccggtgatagattcagtctggatgtcctgcccactcttttgatttataaagggggtgagctgatatctaacttcataagcgttgccgaacagtttgcggaggagttctttgcgggagatgttgagtccttcctcaacgaatacgggcttcttcctgagcgggaggtgcacgtcttggagcacacaaagatagaggaggaagacgtggaatag

SEQ ID NO: 128351 - DNA, 741 bp, Artificial Sequence
  Description of Artificial Sequence: Synthetic coding sequence
atggaagaagcaaaatcgcaatccttagaggaggactttgagggacaggctacccacacagggcctaaaggggttattaatgattggcgcaaattcaagctggagtcccaggacagcgatagcataccgccctctaagaaagagatcttgcgacagatgagttcaccgcaaagcagaaatggcaaggattctaaagaaagagtgagccgaaagatgtctattcaggagtatgagctcattcacaaggagaaggaggacgaaaattgtctgaggaagtatcggcgacaatgtatgcaggatatgcaccagaaactctctttcgggccaagatatgggtttgtgtacgagctggagacggggaagcagttcctggaaactattgagaaagaactgaagattacaactatcgtggtgcatatttacgaagacggaattaaaggctgtgatgcactcaatagctccctgacatgcctcgccgcagaatacccaattgtcaaattttgcaagatcaaagcatccaatactggcgccggcgatcgattttctcttgatgtcctgccaaccctgctgatatacaaaggaggggagctgattagcaattttatttccgttgcagaacagttcgccgaggaattctttgcgggagatgtcgagtcattcctgaacgaatacggcctcctgccggaacgcgaggtgcacgtcctcgagcatactaagatagaagaagaggacgtagagtag

SEQ ID NO: 128352 - DNA, 585 bp, Artificial Sequence
  Description of Artificial Sequence: Synthetic coding sequence
atgtccagccctcaatcccggaacggaaaggactccaaagaacgggtctctagaaagatgtccattcaagagtatgagttaatccacaaggagaaagaggacgaaaattgtctgaggaagtatagacggcagtgcatgcaggatatgcatcagaaattaagctttggtcctcggtatggatttgtctacgaactcgaaacaggcaagcagtttctggaaaccattgaaaaagagctgaagattaccaccatagtggtacacatttacgaggatgggatcaagggctgcgacgcccttaatagtagcttaacatgtctggctgccgagtacccgatcgtcaagttctgcaagatcaaagccagcaatacaggggccggcgatcgctttagtctcgatgtcctcccaactctgctcatttacaaagggggcgagctcatcagcaacttcatctcagtggccgagcaatttgcagaggagttttttgcaggcgatgtggaatctttccttaatgaatatggtctgcttccagaacgggaggtgcacgtacttgagcataccaagatagaggaagaggatgtcgaatag

SEQ ID NO: 128353 - DNA, 585 bp, Artificial Sequence
  Description of Artificial Sequence: Synthetic coding sequence
atgagctcaccacagtctcgcaacggaaaagactcgaaggagcgcgtttctagaaaaatgtccattcaggagtacgagctgatccataaagagaaggaggacgagaattgccttcgtaaataccggcgacagtgcatgcaggacatgcatcaaaagctgagcttcggcccgagatacggctttgtgtatgaactggaaacgggaaaacagtttctcgagaccatcgagaaagagctcaagatcaccaccatagttgtgcacatttacgaagacgggattaaaggatgcgatgctctcaatagtagcttgacatgcctcgctgccgaatatccgatcgtaaagttctgtaagattaaggcctcaaataccggtgccggcgaccgattcagcctcgacgtgctgccaacactgctgatctataagggtggagaacttatctcgaattttatctccgtagccgagcagttcgccgaggaatttttcgcaggcgatgttgagtccttccttaacgagtatgggttgctccccgagcgcgaagttcatgtgctcgagcacaccaaaattgaggaggaggacgtggagtag

SEQ ID NO: 128354 - DNA, 906 bp, Artificial Sequence
  Description of Artificial Sequence: Synthetic coding sequence
atgactaccttggacgataagttgctgggcgaaaagctgcaatactattactccagttcagaagacgaagactcagatcacgaggataaggacaggggccgctgcgcaccagcaagttcctctgtcccagctgaagccgagctcgctggtgagggaattagtgtgaacacgggcccaaaaggggttatcaacgactggagacgcttcaaacagcttgagaccgagcagcgggaagaacaatgccgcgagatggagaggttgattaagaagctgagcatgacatgcaggagtcatttagacgaggaggaggagcagcagaaacagaaagatctccaagaaaagatttccgggaaaatgacgcttaaagaattcgctattatgaacgaagaccaggatgatgaggagttcctgcaacagtacagaaagcagagaatggaagagatgaggcagcaacttcacaaagggccccaatttaaacaagtgtttgagatttcttctggcgagggttttctggacatgatcgacaaagagcagaagtctatcgtcatcatggtgcacatctatgaagacggtatccccggtaccgaagcaatgaacggatgtatgatctgcctagccgcagagtatcctgcggtgaagttctgtaaagtgaaaagcagtgttataggggccagctcccagttcacaagaaacgccctgcctgccttacttatctataagggaggtgagcttatcggaaacttcgtgcgcgtgactgatcaactgggggatgactttttcgccgtggaccttgaagcctttttacaggagttcggcctgctccctgaaaaagaggtcctggtgcttacctctgtgcgtaattcagcaacctgccactctgaagacagcgacttggaaatcgactag

SEQ ID NO: 128355 - DNA, 330 bp, Artificial Sequence
  Description of Artificial Sequence: Synthetic coding sequence
tgattgcagtactactatagcagctctgaggatgaagacagtgatcacgaagacaaagacagagggcggtgtgccccagcctcaagcagcgtgcctgctgaagccgaactcgcaggagaaggcatctcagtaaacaccggacccaagggagtgattaacgactggaggagatttaaacagctggaaaccgaacagcgagaggaacaatgcagggaaatggaacggctgatcaagaaactctccatgacctgtcggtcgcatctggacgaggaggaggaacagcagaaacaaaaggacctgcaggaaaagatcagcggcaaggaacgctag

SEQ ID NO: 128356 - DNA, 276 bp, Artificial Sequence
  Description of Artificial Sequence: Synthetic coding sequence
tagtgtgccccggcctctagctccgttccagctgaggctgagctcgcgggcgaaggcatttcagttaatactggacccaagggagtgattaatgactggcgaagattcaagcaactagagaccgagcaaagagaggaacagtgtcgcgaaatggagcgtctgatcaagaagctgagcatgacctgtagatctcaccttgacgaggaggaagaacagcagaaacagaaggaccttcaggagaagatctcaggtaagaaatcttgggccatcctgtag

SEQ ID NO: 128357 - DNA, 726 bp, Artificial Sequence
  Description of Artificial Sequence: Synthetic coding sequence
atgcaggaccctaatgaggataccgagtggaacgacattctgcgggatttcggcatcctgccccctaaggaggaatcaaaggacgagatcgaggaaatggtcttgcgactccagaaagaggccatggttaaacccttcgaaaaaatgacattggcccagctcaaggaggccgaggatgaatttgacgaggaggacatgcaagcagtggagacatacagaaaaaaaagactccaggagtggaaagctctgaagaaaaaacagaaattcggggaacttcgggaaattagtggtaatcagtatgtgaatgaggtcacaaacgcggaagaagatgtgtgggtgataattcatttatatcgtagcagtattcccatgtgtctgctggtgaatcaacacctttccctgctcgctcgaaagttcccagagaccaaattcgttaaagcgatcgtgaatagctgtattcagcactaccacgataactgcctgccaactatcttcgtctataaaaatgggcaaatagaagccaagttcatcggtattatagaatgcggtggaatcaacttgaaactcgaggagctggagtggaagctggctgaagtcggcgccatccagaccgacctggaggagaaccccagaaaggacatggttgatatgatggttagttcaatacggaatactagtatccatgacgactccgactcttcaaactccgataacgatactaagtag

SEQ ID NO: 128358 - DNA, 720 bp, Artificial Sequence
  Description of Artificial Sequence: Synthetic coding sequence
atgcaagatccaaacgcggacacagaatggaatgatatcctccgtaaaaaaggcatcctgcccccaaaagagagcctgaaagaattagaagaggaagctgaagaggagcagcgaattctgcagcagtccgtggtgaagacgtacgaggatatgacactcgaggagttagaagatcacgaagatgaattcaatgaagaagatgagagagccattgagatgtatcggagaagacggctagccgaatggaaagccactaagctgaagaacaagttcggagaagtgctcgagatctcggggaaagattacgttcaggaggtcacaaaggcgggtgagggcctttgggttatcctccacctctataagcaagggattcctctgtgcgctcttataaatcagcacctcagcggcctagcacgcaaattcccagatgttaagttcatcaaggccatttcaacgacctgtatccctaactaccccgaccgtaacctgcccacaatctttgtgtacttggaaggggatataaaagcacagtttattggcccgctcgttttcggcggtatgaacctgacacgcgatgaactggaatggaagctatctgaatctggcgcaattatgacggacctggaggaaaaccctaaaaagcccatcgaggacgtgttactcagttccgtgcgcaggagcgtcctgatgaagcgagactcagattctgaaggcgactag

SEQ ID NO: 128359 - DNA, 1104 bp, Artificial Sequence
  Description of Artificial Sequence: Synthetic coding sequence
atggatgcccagtgttccgcaaaggttaatgcccgcaagcgcaggaaggaagcccctggtcctaatggtgcaaccgaggaagacggtgtgcccagcaaggtgcagagatgcgcagtgggactgcgccagcccgccccctttagcgatgagatagaggtggatttctctaaaccatatgtcagagtaacaatggaagaggcctcccgcggtaccccctgcgaacgaccggtccgcgtgtacgctgacggaatatttgacctctttcatagcggacacgccagagccctgatgcaggccaaaaacctgtttccaaatacctacctgatcgtaggtgtatgcagcgatgaactgacacacaatttcaaaggcttcactgtgatgaatgaaaacgagaggtacgacgcagtgcagcactgtcggtatgtcgacgaggtcgttagaaatgccccatggactctcacccccgaatttctggctgagcacaggatcgacttcgtcgcgcacgacgacattccttacagctctgctgggtcggatgacgtgtataagcacataaaggaggcgggaatgtttgccccaactcaaagaacggaggggatttctactagtgatattatcacccggatcgtaagagactacgatgtgtatgcccgcaggaatttgcagcgcgggtacaccgccaaggagctaaacgtaagctttattaacgagaaaaagtatcatcttcaggaacgcgtagacaaagtgaagaaaaaagtcaaggatgtcgaagagaagagtaaggagttcgtgcagaaagtggaggagaagagcattgacctgatccagaaatgggaggaaaaatctagagagttcattggaagttttctagaaatgtttgggccggagggcgccctgaagcacatgttgaaggagggtaaaggaaggatgctgcaagctatctcacctaaacagtcaccttcttcctcgccaacccgggagagatctccaagcccttcattccgatggccgttctccggcaaaacctctccgccttgtagtcccgcaaaccttagccgccataaggcggcagcctatgatatctctgaagacgaggaggactag

SEQ ID NO: 128360 - DNA, 882 bp, Artificial Sequence
  Description of Artificial Sequence: Synthetic coding sequence
atggatgcccaatgttcagccaaggtgaacgccagaaagagacgcaaggaggcccctgggccgaatggagctactgaagaggacggtgtaccttcaaaggtacaaagatgcgccgtgggtttacgccagcccgctccgttttctgacgagattgaggtggacttttccaagccctatgtccgcgttacgatggaggaggcctcacggggtactccctgcgagcggccagtccgggtgtacgctgatggcatcttcgatcttttccactcaggccacgccagagccttgatgcaggcaaagaacttgtttccaaatacctacttgatcgtgggtgtgtgtagtgacgagctcacacataacttcaaaggctttaccgtgatgaacgagaatgagcgctacgacgctgtgcaacactgtaggtacgtggacgaggttgtgcgcaatgccccctggaccctaacgcccgagttcctcgcggaacaccgcatagacttcgtggcccacgacgacattccttattcctcagccggaagtgatgacgtctataaacacatcaaagaagcagggatgttcgcacccacacaacggactgagggaatcagcacttcagacataattacccgcattgtgagagactacgacgtgtacgccaggcgcaatttacagcggggatacacagcaaaagagttgaatgtttctttcatcaacgagaagaaatatcacctgcaagaaagggtcgataaggtaaagaaaaaagtgaaagacgtggaggagaagtcgaaggagtttgtgcagaaagtagaggaaaagtctattgacttaatacagaagtgggaagaaaaaagtcgcgagtttattgggtcattcctggagatgttctag

SEQ ID NO: 128361 - DNA, 402 bp, Artificial Sequence
  Description of Artificial Sequence: Synthetic coding sequence
atggacgcccagtgttcagcgaaggtcaacgctagaaagcggcgtaaagaagcccctggcccaaacggcgcaacagaggaggatggcgtcccatctaaagtgcagagatgcgcagtgggactgagacagccggctcctttcagcgacgagattgaagtcgactttagcaagccatatgtgagagtcacgatggaggaggccagcagggggacaccgtgcgagcgccctgtccgggtgtacgccgatggaatctttgatcttttccacagcgggcacgctcgcgctttaatgcaagccaaaaacctgttccctaacacatatttgatcgtgggagtgtgttccgacgagctgacccacaattttaagggcttcaccgtgatgaatgaaaatgagcgttactag

SEQ ID NO: 128362 - DNA, 987 bp, Artificial Sequence
  Description of Artificial Sequence: Synthetic coding sequence
atggatgctcagtgctctgccaaagtaaatgctcgtaaaagacggaaggaagcaccagggcccaacggcgctactgaggaagctagccgaggcacaccatgtgagaggccagtgcgggtctacgcagatgggattttcgatctgttccatagtggacatgcaagagccctcatgcaagccaagaacctcttcccaaatacctatttgattgtgggcgtgtgcagcgatgagcttacacataacttcaaaggatttacagtgatgaacgaaaacgagagatacgatgcggtacagcactgccgctatgttgatgaggtcgtgcgcaacgctccatggacgctcacccctgagtttctggcagaacacagaatagacttcgtagcacacgacgacattccatactcgtccgcgggttccgatgatgtctacaagcacatcaaagaggctggaatgttcgcgcccactcaacgaacagagggcatcagcacttctgacatcataaccagaattgtgagggactacgacgtgtacgcaagacgcaacctccagcgcgggtataccgccaaggagttgaatgtgagctttatcaacgagaaaaagtatcatttacaggagagggtcgacaaggtaaagaagaaggtgaaagacgttgaggaaaagtctaaagaatttgtgcagaaagtggaggaaaagagtattgatttaattcaaaagtgggaggagaaatccagagaattcatcggaagcttcttggagatgttcggccctgaaggagccctgaagcacatgctaaaggaagggaagggaaggatgttgcaggcaatttccccaaaacagtctcctagttcgagcccaactagggagcgctccccttcaccatcctttcgatggcccttctctgggaagacctcccctccttgttcacccgccaacctatctcgccacaaggccgccgcatacgacatctccgaggacgaagaagattag

SEQ ID NO: 128363 - DNA, 1104 bp, Artificial Sequence
  Description of Artificial Sequence: Synthetic coding sequence
atggacgcccagtgctccgccaaggtaaatgcacgaaaacggagaaaagaagccccaggcccgaacggcgctaccgaagaagatggtgttccttctaaagtgcagaggtgcgcagtggggctcaggcagcccgcccctttctccgacgagattgaggttgacttcagtaaaccctacgttcgggtgaccatggaagaagccagccgcggaaccccgtgcgaaagaccggtgcgcgtgtacgcagatggaatcttcgacctgtttcactctggccatgccagagcattgatgcaagctaaaaacctgttcccgaacacctacctaatcgtcggagtgtgtagcgacgaactgactcacaacttcaaaggattcactgtgatgaacgagaatgaaagatacgatgcagtgcagcactgtcggtacgttgatgaggtcgtgagaaacgccccttggactctaacgccagaatttctggccgagcaccggatcgattttgtcgctcacgatgacattccatacagctccgccggctctgacgacgtgtacaaacacataaaagaggcaggaatgttcgcacccacacaacgaaccgagggcatctccacaagcgacataatcacccggatcgtccgtgattacgatgtatatgctagaagaaacctacagcggggctacaccgcgaaggagctgaacgtgagctttatcaacgagaagaagtaccacctgcaggagcgggtggacaaagtgaaaaagaaggtgaaggacgtggaggagaagtcgaaggagtttgtacagaaggtcgaagaaaaatcaatcgatctgatccagaagtgggaggagaagagccgtgagttcataggttctttcctggagatgttcgggcccgaaggagccctcaagcacatgcttaaggagggcaaaggtagaatgctccaggcaattagtccgaaacaatcaccgtcctcctctccaactcgggaaaggtctccaagtccgagttttcggtggcccttctctggcaagacttcgcctccatgctctccggcaaacctgagccgtcacaaggcggccgcttacgatatctctgaagatgaggaggactag

SEQ ID NO: 128364 - DNA, 348 bp, Artificial Sequence
  Description of Artificial Sequence: Synthetic coding sequence
atggatgctcagtgctcagcaaaggtgaatgctagaaaacgtaggaaggaagcaccggggcctaacggcgctactgaagaagatggcgtgccgtctaaggtccagcgttgcgccgttggactgagacagccagctcctttcagcgatgagatcgaggttgatttcagcaagccctatgtacgagtcactatggaggaggcttctcgaggcaccccctgtgaaagaccagtgcgagtgtatgccgatggaatctttgatttgtttcacagtgggcatgcaagagccctgatgcaggccaaaaatctgtttcctaatacgtacctgattgtgggggtatgtagtgactag

SEQ ID NO: 128365 - DNA, 2250 bp, Artificial Sequence
  Description of Artificial Sequence: Synthetic coding sequence
atggaggccgagaccggtagctccgtggaaactggtaagaaggccaatagggggaccaggatcgcgctggtcgtatttgtaggtggcacgctagttttagggacgatactctttctcgtaagccaggggctgttatcactgcaggctaaacaagaatactgtcttaagccggagtgcatcgaggcagcagccgccatcctcagcaaagtcaatctgagtgtagacccctgtgataacttctttcgattcgcatgcgatggctggatcagtaacaaccccattcccgaggacatgccaagttatggcgtgtatccatggctgagacacaacgtggacttgaaactgaaggagctgctcgaaaaatctatctcacggaggcgggacaccgaagcgatccagaaggcaaagattctgtactctagctgtatgaatgaaaaagcgattgaaaaggccgatgctaaacccctcctccacattctgcgccactccccattccggtggcccgtactagaaagcaacatcgggccagagggagtgtggtcagagcggaaattttccttgctgcaaacacttgctactttcaggggacagtattctaacagcgtcttcatccgactctacgtgtcccctgatgataaggcctctaatgagcacattctgaaactggaccaggcaactctgtccttagccgttcgggaagactacctggacaactctactgaagctaaatcctaccgcgacgccctctacaaattcatggtagatactgccgtcctgctaggagccaattcatcgagggctgagcacgatatgaaatcagttctccgcttagaaattaaaattgctgaaatcatgattcctcacgagaaccgcacctcagaggctatgtataacaagatgaacatttccgaactcagtgcaatgatcccccaattcgactggcttgggtatataaagaaagtgatcgataccagactgtacccgcatctgaaggatatcagcccctctgaaaatgtggtcgtccgagtaccccagtacttcaaggacctcttcaggatactaggttcggaaagaaagaagactattgccaactaccttgtatggcgcatggtctactctcgaatcccgaatttgtcacgacgttttcagtaccggtggctcgagttttcccgagttattcaggggacaacaactctgttgcctcagtgggataagtgtgttaacttcattgagtcagcccttccttatgttgttggcaagatgttcgtggacgtctattttcaagaagacaaaaaggagatgatggaagagctggtggagggtgtccgttgggccttcatagatatgttggaaaaagagaacgagtggatggatgctggcaccaagcgtaaagcaaaggagaaggctcgggctgtgctggcaaaagttggctaccccgagttcattatgaatgatactcatgtaaacgaggacctcaaagccatcaaatttagtgaggcagactactttggcaacgtgctgcagacaagaaaatatctggcacaaagcgacttcttttggttgcgcaaggcagttccaaaaaccgagtggttcacgaaccccaccacagtgaatgcattttattctgctagcactaatcagatccgattccccgccggtgaacttcagaaacccttcttctggggcacagaatacccgcggtctttgtcctacggggccattggggttatcgttggccatgagttcacacacggatttgacaataacggccgcaagtacgataagaatggcaacctcgatccatggtggagcacagagagtgaggaaaaattcaaagagaaaactaagtgtatgattaaccaatacagcaactactattggaaaaaggccggcctgaatgtgaaagggaagcgtacattgggagaaaacattgctgacaacgggggactgagggaggccttccgagcctacaggaaatggatcaatgatcgccgccaagggctggaggaacccctcctgcctggcatcacattcacgaataatcaactgttctttctcagctatgctcacgtgcgatgtaattcttatcggccagaggccgctcgagaacaggtccagatcggcgcacactcccctcctcaatttcgggttaacggagccatctccaacttcgaagaattccagaaggcgttcaattgcccgccaaatagtactatgaacagagggatggattcatgtcggttatggtag

SEQ ID NO: 128366 - DNA, 1359 bp, Artificial Sequence
  Description of Artificial Sequence: Synthetic coding sequence
atgattcacttgcctcgaccgcccaaggtcctgggactccagtttgactggctcgggtatataaaaaaggtgatcgatacaagactttacccacaccttaaagacatttcgccttcagagaatgtggtagtgagggtgccacagtatttcaaagatttgttcagaatacttggctcagaacgcaaaaaaacaatcgctaactacctcgtctggagaatggtctatagcagaatccctaatctatcccggcggttccagtaccgttggctagagttttccagggtgatccagggcactacaaccctgctgccccagtgggacaagtgtgtgaacttcatcgaaagcgcactaccatacgtggtgggcaagatgtttgtcgacgtctactttcaggaggataaaaaggagatgatggaggagttagttgagggggtcaggtgggcgtttattgacatgctggagaaagagaatgaatggatggatgcagggactaagagaaaggccaaggaaaaggcaagagcagtgctggccaaagttggctatcccgagttcataatgaacgacacacacgtcaacgaggacctaaaagcgatcaagttcagtgaagctgattatttcggtaatgtgctacagaccaggaaatatctggctcagagtgattttttttggctgcgcaaggcagtgcctaagacagaatggttcacgaatccaaccaccgtgaatgccttttattctgcctctaccaatcaaattaggtttccagccggagaactccaaaaaccttttttctgggggacggagtaccctagatctctgagctatggggctatcggcgtgatagtgggtcatgagttcacccacggattcgacaataacgggaggaaatacgacaagaacggcaacctagacccttggtggtcaacagagagcgaggagaagtttaaagaaaagaccaagtgcatgattaaccagtatagtaactactactggaagaaggcaggccttaacgtcaagggcaagagaaccttgggagagaacattgccgacaatgggggtctccgggaagccttcagggcctatagaaagtggataaacgacagaagacagggtctagaagagcctttgctgcccggcattactttcacaaacaatcaactgtttttcctgtcatatgctcacgtccggtgtaattcctacaggccagaggccgctcgggaacaagttcagattggcgcccattcacctccccagttccgcgtgaacggagccatctctaatttcgaggagttccagaaggcattcaactgtcctcctaacagcaccatgaaccgggggatggactcttgtcggctgtggtag

SEQ ID NO: 128367 - DNA, 1959 bp, Artificial Sequence
  Description of Artificial Sequence: Synthetic coding sequence
atgccttcgtatggcgtctatccgtggctccgacataatgtggatctaaagctcaaggagttgcttgagaaaagtatatcaaggagacgggataccgaagccatccagaaagccaagatcctgtattcatcttgcatgaatgagaaagctatcgagaaagcagacgctaaacctcttctgcatatcctccgccactctccatttcgctggcccgttcttgagtctaatattggacccgagggagtgtggtcagagcgcaaattttcgcttctgcagactctcgcgacatttagaggtcagtactcgaatagtgtcttcatccggttatatgttagtcccgatgataaagctagcaatgaacatatcttaaagctggaccaggctacactctctctcgctgtgagggaagattacctcgacaattctacagaggcaaaaagctaccgggacgccctttataagttcatggtggatacagccgttctgttgggggctaacagctcccgtgcagaacacgacatgaagtccgtgctgaggttagaaatcaaaattgcagagataatgataccccatgagaataggacctcagaggctatgtataataagatgaacatctctgaactttcagcaatgatcccacagtttgattggctgggctatattaaaaaagtaattgatactagactgtatcctcacttgaaggacatttccccttctgagaatgtcgtggtaagggttccccagtatttcaaggacctctttagaatactgggcagtgaaaggaaaaaaacgatagccaattacctggtgtggcgaatggtgtactcgcgtattccgaacctcagtcggagattccaatacagatggttagaattttcgcgcgtcatacaaggtaccacaacattgctgccacaatgggacaagtgcgtcaactttatcgaatctgcactaccatatgttgtcggcaaaatgttcgttgatgtgtattttcaggaggataagaaggaaatgatggaagaactagtcgaaggagtccgctgggcctttatagatatgctagagaaagaaaacgagtggatggatgccggaaccaaacgaaaggccaaggaaaaagcacgggctgtcctggccaaagtggggtacccagagttcatcatgaatgacacccacgtcaacgaggacctaaaggcgatcaaatttagtgaggccgactactttgggaacgtgcttcaaactagaaaatacttagcacagagcgacttcttctggttaaggaaggcagtgcccaagaccgagtggttcactaatcctacgactgtgaatgctttttactctgcgagtacaaaccagatccggtttcctgctggagagctgcagaaaccattcttctggggaaccgaatatccccggagcctcagctatggtgccattggagtgattgtgggacacgagttcactcacgggtttgataacaatggtagaaagtacgacaagaacggcaacttagacccttggtggtcaaccgaatccgaggagaagttcaaagagaagactaagtgcatgataaaccagtattctaattactattggaaaaaagccggcctgaatgttaaagggaagcgaacgctcggagagaacatcgctgataacggtggcttgcgcgaggccttccgagcttaccggaaatggattaatgacagacggcagggtttggaggaacccttgctgcctggcatcacgtttactaataaccagttattcttcctgtcctacgcccacgtaaggtgcaacagttaccgcccagaggcggccagggagcaggtgcagatcggagcgcattcacctccacagttcagagtgaatggcgccatatccaattttgaggagtttcagaaggcctttaactgcccccctaactccacaatgaatagaggcatggacagctgccgtctgtggtag

SEQ ID NO: 128368 - DNA, 2088 bp, Artificial Sequence
  Description of Artificial Sequence: Synthetic coding sequence
atggaggctgagacggggtcttccgtggaaaccggcaaaaaggctaatagagggacgcggattgcacttgtggtctttgtcggcgggacattggtcctgggcaccatcctgttcttagtcagtcaaggcttgctcagcctacaggcgaaacaagaatactgcctgaagccagagtgtatcgaagctgctgccgccattctgagtaaggttaacctgtccgttgacccctgtgataacttcttccggttcgcatgcgatggctggatctcaaacaatcccatccctgaggatatgccctcatatggggtgtacccatggttaaggcataacgtcgatttgaagctcaaggagttgctcgaaaagagcattagtagaaggagggacaccgaggctatccagaaggctaagatcttatacagcagctgtatgaatgaaaaagccattgaaaaggctgatgccaaaccattattgcatatcctgaggcactccccgtttcgctggcctgtcctcgagtcgaacatcggtcccgagggggtctggtcagaaagaaagtttagcttactccaaaccctggctaccttcaggggtcaatactcaaatagtgtgttcatccgcttgtacgtgtcgcccgacgacaaggccagcaacgaacatattctgaaacttgaccaggcaaccttgtccttggccgttcgagaggactacctggataattcaactgaggccaaaagctaccgagatgccctctacaagttcatggtggacaccgcggtactgctcggtgccaacagcagcagagccgaacacgatatgaaaagcgttctaagactggagatcaagatcgccgagatcatgatcccgcacgaaaacaggacatccgaggctatgtacaataagatgaatatcagtgagctctctgcgatgatccctcaatttgactggctgggttacatcaaaaaagtcatcgacacgcgtctttacccccatctgaaagacatttccccgtcagagaatgtagttgtgcgagtgccgcagtattttaaggacttattccgcattttggggagcgaaagaaaaaagacaatcgcaaactacctggtgtggagaatggtgtactcccgcatcccaaatctcagtagacgtttccagtacaggtggttagagttttccagggtgatacaggggactaccaccctgctccctcagtgggataagtgtgtgaatttcatcgagagcgctctgccttacgtggtgggcaagatgtttgtggatgtgtattttcaggaggataaaaaggagatgatggaggagttagtcgagggagtaaggtgggcctttatagatatgctggaaaaagaaaacgaatggatggacgctggaaccaaacgaaaagccaaagagaaggcaagagccgtgctcgccaaggtggggtaccctgagttcatcatgaatgacacccacgtcaatgaggatctaaaggctatcaagtttagcgaggctgactatttcgggaacgtcttgcagaccagaaagtatctggctcagtcagacttcttctggctgcgtaaggctgtgcctaagaccgaatggtttaccaaccccaccacggtgaacgcattctactctgcatcaactaaccaaattaggtttccagccggtgagctgcagaaaccattcttctgggggaccgaatacccacggtcgttatcatatggagcgataggagtgatcgtgggccacgaatttacgcatgggtttgataacaatggccgcaaatatgacaagaatggaaacttggacccctggtggtcaactgagagtgaggagaaatttaaagagaaaacaaaatgcatgatcaatcagtacagtaactactactggaaaaaggccggactcaatgtcaaaggaaagcgtaccctgggcgagaacatcgccgataacggaggcctaagagaggctttccgcgcatacagaaaatggattaatgatagacgccaggggctggaagaaccgttgttaccaggtatcacctttaccaataaccaattgttcttcctaagttacgctcacggacagtggtgcaactag

SEQ ID NO: 128369 - DNA, 888 bp, Artificial Sequence
  Description of Artificial Sequence: Synthetic coding sequence
atgccttctcctcgtcggtcaatggaggggcgaccccttggcgtaagtgcatccagcagcagcagctcgcctggatctcctgctcatggggggggtggtggcggaagccgttttgagtttcagtctcttctgagcagtcgagctacagcagtggacccaacatgtgctaggcttagagcctccgaatcacccgtacatcgccggggtagcttcccacttgccgctgccggaccctcccagagtcccgcaccgccactgccggaagaagaccgcatggacttaaacccttcatttctggggatagctctccgcagtctcctggccatcgatctgtggctgtcgaagaaattgggagtctgtgccggtgaatcaagttcatggggttcagtgcggcccttgatgaaactgctggagatctcaggccacggcataccatggttactgggcacactctactgcctctgccgcagtgatagctgggccggtcgcgaagtgcttatgaacctgctctttgccctcttgttggacctgcttctcgtggcattaatcaagggactggtgcggcgacggagacccgcacacaaccagatggacatgttcgttacactgtcagtggacaagtacagcttccccagcgggcatgcgacccgcgctgctttaatgagtagattcatcctgaaccacctcgtcttggccataccattgagggtgttggtggttctctgggcctttgtgctgggtctctcaagagttatgctgggccgccataacgtgacagacgttgcctttggattttttcttggatacatgcagtattccatcgtggactattgctggttgtccccccacaatgcccctgtgctctttctgctctggtctcagagatag

SEQ ID NO: 128370 - DNA, 615 bp, Artificial Sequence
  Description of Artificial Sequence: Synthetic coding sequence
atggaccttaacccctctttcctgggcatcgctctgcgcagcctgctcgcaattgatctttggctcagtaagaaacttggggtgtgtgccggtgaatcatcttcctggggaagtgtgcgccccctgatgaaactactcgagatttccgggcacggcatcccttggctgctgggaacactttactgcttgtgtcggtccgattcttgggccgggcgggaggtcttaatgaacctcctgttcgcccttctgctggacttgctgttggtggcactcatcaaaggtctggtcagacgcagacggcctgcacataaccaaatggacatgttcgtgacattgtcggtggataaatacagttttccatcgggccacgcaaccagggccgccctcatgtccagatttatactgaatcatctagtcttggccatccccctgagagtgcttgtagtcctatgggcgtttgttctgggattatcgagggtgatgcttggacggcacaacgtcaccgatgtggccttcggatttttcctgggatatatgcagtactccatagtcgattattgctggttgagcccgcacaacgctcccgtgctcttcctgctgtggtctcaacgttag

SEQ ID NO: 128371 - DNA, 645 bp, Artificial Sequence
  Description of Artificial Sequence: Synthetic coding sequence
atggaattggctgccgggtctttctcagaggagcagttttgggaagcatgtgctgaactacagcagcctgcattagccggcgctgactggcaattgctagtagaaaccagcggaatttctatctatcgactgctagacaaaaagactggtctgtatgagtataaagtgttcggagtcttagaggactgttccccaacactgcttgctgacatctatatggattcagactatcggaaacagtgggaccagtatgtgaaggaactgtacgagcaagagtgcaatggtgagacagtagtctattgggaggtgaaatacccatttcccatgtcaaaccgcgattatgtttatcttaggcagcgccgggacctcgatatggaaggccgcaaaatacatgtgatcttggctaggagcacaagcatgccacagctgggcgagagatctggtgtgatccgcgtcaagcagtataaacaatctctcgcgattgagagcgatgggaaaaaaggctcaaaggtcttcatgtactactttgataatccaggaggccagatcccctcttggcttatcaactgggccgctaaaaatggtgtgcctaatttcctgaaagatatggccagggcgtgccagaattaccttaaaaagacatag

SEQ ID NO: 128372 - DNA, 582 bp, Artificial Sequence
  Description of Artificial Sequence: Synthetic coding sequence
ctcgcacagggccgatgtttgcaggttaccgcagtacaaattcaaggctcttggaaagtgactggagtacagcctcaaaaaacaggcctgtacgaatacaaggtatttggagtcctggaggactgctcccccacactcctggcagatatttatatggactccgattaccggaagcaatgggatcagtacgtgaaagaactgtacgagcaggagtgcaacggggaaacggttgtgtactgggaagtgaagtatccattccccatgtctaatagagattacgtgtacctacgccagcggcgggacctggatatggaaggcagaaagattcacgtgatcctggcgagatccacaagcatgcctcagttgggggaacgctctggagtcatcagggtcaaacaatacaagcagtctcttgcaattgagtccgatggaaaaaaaggctcaaaagttttcatgtattactttgacaaccccggcggacaaattccgtcttggttaatcaactgggccgcaaaaaacggagtgcccaatttcctcaaagatatggcaagggcctgtcagaactacctgaagaagacctag

SEQ ID NO: 128373 - DNA, 429 bp, Artificial Sequence
  Description of Artificial Sequence: Synthetic coding sequence
atggattctgactataggaaacagtgggatcagtatgtcaaggagctttacgagcaggaatgcaatggagagacagtggtctactgggaggtcaaataccccttcccaatgtctaaccgagattatgtttacttgaggcaaagacgggatctggacatggagggacgtaaaatccacgttattctggccagaagcacctcgatgcctcagctgggggagcgtagtggcgtcatacgagttaagcaatacaagcagagtcttgccatcgaaagcgacggtaaaaaaggctctaaggtctttatgtactattttgataaccctggagggcagatccccagctggctaatcaactgggcggctaaaaacggcgtgccaaactttcttaaggacatggcgcgcgcttgtcagaactatctcaagaaaacttag

SEQ ID NO: 128374 - DNA, 564 bp, Artificial Sequence
  Description of Artificial Sequence: Synthetic coding sequence
atgcctgtggatctttcaaaatggtctggccctctgtcactccaggaggtcgatgagcagccgcaacaccctctgcacgtgacctatgctggcgctgcagtcgacgagttagggaaggtcctgacgcccacccaggtgaagaatcgccccacatccataagttgggacggtctcgacagcggtaagctctacactttggtcctgaccgaccccgatgctccctctcgaaaggatccaaagtatcgagagtggcaccacttcctcgtcgtaaatatgaaaggcaacgacatcagctctggcaccgtgttatcagactacgtcgggtcagggccaccaaagggcaccggcttacacagatacgtatggcttgtttatgagcaggacaggccgctcaaatgtgacgaaccaatcctgagcaacaggtccggggaccaccgagggaagtttaaggtggcctccttccggaaaaagtacgaacttagagctcctgtggctggtacctgttaccaagccgaatgggatgactatgtgcccaaactgtacgagcagctatctggcaagtag

SEQ ID NO: 128375 - DNA, 468 bp, Artificial Sequence
  Description of Artificial Sequence: Synthetic coding sequence
atgccagtggacctgagtaaatggtctgggcccttgagtcttcaggaggtcgacgagcaacctcagcaccctcttcacgttacttatgctggtgctgccgttgacgagctggggaaggttcttacccctacccaggttaagaatcgcccaaccagcattagttgggatggacttgactcaggcaagctgtatacactggtcctgacggatccagatgcaccaagccggaaggatcctaagtatcgggagtggcaccattttctcgtggtgaatatgaagggaaatgatatttcgagcggaaccgtgttgagtgattacgtcgggtcaggaccccctaaaggcaccgggctgcatcggtacgtatggttggtgtatgaacaagatagacccctaaagtgcgatttctcgtgttgtctcgcctttatcattttactaacccactccgatctatgtttcgatcagatctag

SEQ ID NO: 128376 - DNA, 6135 bp, Artificial Sequence
  Description of Artificial Sequence: Synthetic coding sequence
atgtgtccagtggattttcacggtatcttccagctagacgagaggcgtcgggatgcagtgattgccctcggtatcttcctcatcgagtccgacctccagcataaggattgtgtggtcccatacttgttacggctcttgaaggggcttcccaaggtctactgggtggaagaatccaccgcacgcaaagggcggggcgctttaccggtagccgagtcattcagtttctgtctggtcaccctgctctctgatgttgcttatagagatccctctcttcgagacgaaattctagaagtgctcctccaggtgctccatgttctcctggggatgtgtcaggctttggaaatccaggacaaggagtacctttgcaaatatgctataccatgtctcattggcatcagtcgagcgttcgggaggtactccaacatggaagagtccctcctatctaagttattcccaaaaattcctccccatagcttaagggtgctggaggagctggaaggcgtccggaggcgctcatttaacgactttagaagcatcttgccctcaaatttgctcactgtctgccaagagggcaccctgaaaagaaagacgagttcggtgtccagtataagtcaggtttctccagagagaggcatgcctcctccctcttccccaggcgggagtgcctttcactactttgaagcttcttgtctacccgacggcaccgcgttagagccagagtattattttagtacaatctcatcctccttcagcgtgtctccattgttcaatggagtaacttataaggaattcaacatcccactagaaatgctgagagagctcctgaacctggtgaagaaaatcgtggaggaagcagttctgaagtccttagacgctatcgttgcatccgtcatggaggccaacccgtcagccgacttgtactatacatctttttcggatccgctgtatctcacaatgttcaaaatgttaagggacaccctctattacatgaaagacttaccgacttccttcgtgaaggaaatccatgactttgttctggaacagtttaatacgtcccagggcgagctacagaaaatcctgcacgacgctgaccgcatccataacgagttgagcccattgaagttgagatgtcaggccaacgctgcctgcgttgacttgatggtgtgggctgtgaaagatgaacagggggccgaaaatctgtgtatcaagttaagtgaaaagttacagtctaagacatcctccaaagttatcatagcacatctaccactgttaatatgctgcttacaagggttagggagattgtgtgagagattccctgtggtggtgcactccgtgactccttccctgagagacttcctcgtcatcccgtcacctgtgctggtgaagctctacaagtatcacagccagtatcatacggttgccgggaatgacattaaaattagcgtcactaacgagcacagcgagtctaccttgaatgttatgtcaggtaaaaagtcacagccctccatgtatgagcagctgcgcgatattgccatcgataatatctgtcgctgcctgaaggctggtctcactgtggaccccgttattgtggaagcattcctggcctcactctccaaccgcctgtatattagccaagagtctgataaagatgcacatcttataccagatcatacaattagggcacttggccatatagcagtggcactccgcgatacaccgaaagtgatggagcctatcctacaaatactgcagcagaagttctgtcagccccccagcccgctggacgtgctgataatcgaccaactcgggtgtcttgttattaccgggaatcaatatatctaccaggaagtgtggaatctgtttcagcagattagtgtcaaagccagcagcgtagtgtattcggccaccaaggattataaggatcatggctatcgacactgcagcttagctgtaattaatgctctggccaatattgcagccaacattcaggacgagcatttggttgatgaacttctcatgaaccttctggagctttttgtgcaactcggtctcgagggcaaaagggcctccgagcgggcctccgagaagggccccgcgctaaaggccagctcttcagctggcaacctaggcgtgctcatccccgtgattgctgttctaacccggaggttgccacctatcaaggaggctaaacctaggcttcagaagctctttagagatttttggctatactcagtcttgatgggcttcgcagtcgagggtagtgggctgtggcccgaggagtggtatgaaggagtctgcgagattgctaccaaaagccccctactcactttcccctctaaggagcctctccggtccgtcctccagtataatagcgccatgaaaaatgacacagtgacacccgcagagcttagcgagctgcggagtaccatcatcaatctactggatccacctccagaggtctcggcactaattaataagctcgatttcgccatgtccacttatctgctctccgtgtaccgtttggaatacatgcgggtcctccgctctaccgatcctgatcgcttccaggtcatgttctgctattttgaagacaaagcaatacagaaagataagtctggtatgatgcagtgcgtgatcgccgtcgccgacaaggtgtttgatgcctttctaaatatgatggctgacaaggctaagacaaaggagaacgaagaggaacttgagaggcacgcacagttccttcttgtcaatttcaaccacatccataaaagaatcagaagggtagccgataaatatctctccggactcgtagacaaattcccccacctgctctggtccggcaccgtgctgaagaccatgttagacatcctgcagactttgtcacttagcctaagcgctgacattcataaggaccaaccttattatgatattccagacgcaccctatagaattacagtccccgatacatacgaggcccgcgaaagcattgtgaaagactttgcagctcgatgtggaatgatcctgcaggaagctatgaaatgggctcccacagtcactaaatctcacctgcaggaatacctgaataaacaccagaattgggtgagtggcttgagtcaacacaccgggttagcaatggcaactgagtccatactccatttcgcaggatacaataagcaaaacacaaccctgggcgctacccagctgtctgagaggccagcctgtgtgaagaaagattattccaattttatggcgagcttgaatctgcgtaatcggtacgctggtgaggtttatggaatgatccgttttagtggcacaactgggcagatgtctgaccttaacaaaatgatggtccaagatcttcacagtgccctggatcgttcccacccccaacactatacacaagctatgttcaaactgaccgctatgctcatcagcagtaaagactgtgaccctcaactcctgcaccacctgtgctggggacccctgagaatgttcaatgagcacggcatggagacagccttggcttgctgggagtggcttctggcaggaaaggacggagtggaagtgccgttcatgcgggagatggctggcgcctggcatatgacggtggagcagaaattcggcctgttttccgcagaaataaaggaagccgaccccctggctgcctccgaggccagtcagcccaaaccatgcccacctgaagttacgccccactatatctggattgattttctggtgcagagatttgagatagccaagtactgtagcagcgaccaggtggaaatcttcagtagtctgctacagagaagcatgagccttaatatcggaggggctaaaggctcaatgaaccggcatgtggctgcaataggccccaggttcaaattgctaaccctagggctgagccttttgcacgccgatgtcgttcccaatgccaccattaggaatgtgcttagagagaagatctatagtacagcctttgactacttctcgtgtccaccaaagttccccacgcagggggaaaagagactccgcgaagacatcagtataatgattaaattctggaccgccatgttttccgataaaaagtatctcacggccagccagctggttcctccagacaatcaggataccagaagtaacctggatattactgtggggtccaggcagcaagccacccagggctggattaacacataccctctctcttcagggatgtctacaatatcgaagaagtctgggatgagcaaaaaaacaaacaggggctcgcagctccataagtattacatgaagaggcgcaccctgctattgtctctgctggccacagaaatcgagcgtctgattacctggtataatccgctgtccgcgcccgaactggaattggaccaggcaggcgaaaactccgtggccaattggcggtcgaaatatatctccttgtcagaaaagcagtggaaggacaacgtaaatctcgcgtggagtatttcaccatatctcgcggtgcaactgcccgcacggtttaagaacaccgaggccattggcaatgaagtgacaagactggtcagacttgaccctggcgctgtgagcgacgtgccagaggctatcaaattcttagtgacctggcacaccattgatgcggatgccccggagctgtcacacgtcctatgctgggccccgactgatccgcctaccggtctctcatacttttcctcaatgtaccccccccacccactcaccgcccagtacggcgtgaaagttctgcggagtttcccacctgatgctattcttttctatattccacagatcgtgcaggccttgaggtacgataagatgggatatgtccgtgagtatatcctgtgggccgcctcgaagtctcagttactggcgcatcagttcatctggaacatgaaaaccaatatttatctggacgaagagggccatcagaaggatcctgacatcggcgacttattggaccagctggttgaagaaatcacaggctccttatcaggtcccgcgaaagacttctatcagagagagttcgatttttttaacaagattaccaacgtgagtgccattattaaaccttaccccaagggtgatgagaggaagaaagcctgtctgtccgcactgtctgaggtcaaagtccagcccgggtgttatctgccaagcaaccccgaggccatcgttttggatattgattacaaaagcggcactcccatgcagagcgccgcaaaggctccatatctcgccaaattcaaagtgaagcgctgcggggtcagcgagcttgagaaagagggccttagatgtaggtcggacagcgaggatgagtgttccacgcaagaagctgacggccaaaagatctcctggcaggcggctatctttaaagtgggagatgattgcaggcaggatatgctggcactccagattattgacctttttaaaaatatttttcagttggtggggctggatctgttcgttttcccatatagagtggttgcgacagctcctggctgcggggtgatcgagtgcattccagattgcacttctagagatcagctcggtagacagacagatttcgggatgtacgactattttacccggcagtatggagacgaatcaacgctcgcgtttcaacaagccaggtataatttcattcgttctatggctgcgtattccttactcctgttcctgttacaaatcaaggatcgccataacggaaatatcatgctggacaagaagggccacataatccacatagatttcgggtttatgtttgaaagctcccccggtgggaacctcggctgggaaccagacattaagctgacagacgaaatggtgatgatcatgggcggcaagatggaagccactcccttcaaatggttcatggagatgtgcgtgcgcgggtatctggctgtccgaccgtacatggacgccgtggtctccttggtcactctcatgctggacacagggctgccatgcttcagaggtcagaccatcaagctgctaaagcacagattcagcccgaacatgaccgaaagagaggccgccaactttatcatgaaagtaattcaaagctgttttctgtccaaccgaagccgaacctacgatatgatccaatactaccagaacgatataccatattag

SEQ ID NO: 128377 - DNA, 1440 bp, Artificial Sequence
  Description of Artificial Sequence: Synthetic coding sequence
atggacgaaacttctccactggttagccctgaaagagcacagcctcctgactacacatttcccagtggctcaggcgcccactttcctcaagtgccagggggtgccgtgagggtggccgctgcagctggatccgggccttcgccaccaggctcaccgggacacgatagggagcgccagcccctcctggaccgagctaggggcgccgcagcccagggccaaacccaaacagtagcggcccaggcccaagccctggccgcacaggcggcggccgctgcgcacgccgcccaagcgcaccgcgagagaaacgaatttcccgaagatcctgagtttgaagcagtggtgaggcaggccgagctggccatcgagagatgtatatttccagaacggatttaccaggggtcatctggatcctattttgtcaaggatccccaggggaggatcatcgctgtttttaagcccaagaacgaagagccgtacggccacttgaacccaaagtggacaaagtggctgcaaaagctctgctgtccatgctgcttcggcagggattgcctcgtgctcaaccaaggatatctgtcagaagctggagccagccttgtggaccaaaaactggagctgaatattgtgccccggaccaaagttgtttacctcgccagtgagacattcaactattcggctatcgatagggtgaaaagtcggggcaagcgcttggcactcgagaaggtgcccaaggttggacagcgcttcaataggatcggactgccgcctaaagtcggttccttccagttgtttgttgaaggatataaagacgcagactattggctacgccggtttgaggccgagcccttgcctgaaaacacaaaccggcaattactgttacagtttgaaagacttgtcgtgttggattatataatccgtaacacagacaggggaaatgacaattggctgatcaagtacgattgccccatggatagcagcagttcccgggacacggactgggttgtggtgaaggagcccgtcataaaagtcgcggcgatcgacaacggacttgcatttccattgaagcacccagattcctggagagcctaccctttctactgggcctggctgccacaagccaaggtccccttcagccaggagattaaagacctgattcttccgaaaatttcagaccccaactttgtgaaggacttggaagaagacttatacgaactgttcaagaaggacccgggattcgataggggccagttccacaaacagatcgcggtgatgagagggcagatactcaacctcactcaggctttaaaagacaacaagtcgccattgcatttagtccagatgccccctgtgatcgtggagacagccaggtcccaccaacgatcctctagcgagagctatacacagagtttccagagcaggaagcctttcttttcctggtggtag

SEQ ID NO: 128378 - DNA, 1350 bp, Artificial Sequence
  Description of Artificial Sequence: Synthetic coding sequence
atgctgggcccccaggtgtggtccagcgtgcggcagggactcagccgaagtttgagccggaacgtgggagtctgggctagcggcgaagggaagaaggtagatattgctggaatctatccgccagtcaccaccccctttacagcaacggcagaagtcgactacggaaaactggaggaaaacctccacaaacttggtactttcccgttccgaggcgcagtaggtggggtgtgtgcactggcaaacgtgttgggggcacaggtatgtcaacttgagcggctctgttgcacagggcagtgggaagatgcccagaagctacagcatcgcctaatcgaacctaacgccgcacgaatcatcgccgtgtttaaaccgaagaacgaagagccctacggccacttgaaccccaaatggaccaagtggcttcagaagctttgctgcccctgttgttttgggcgggactgcttggttctcaaccaaggttacttgtccgaggccggggcatcactggtggatcagaaactcgagctgaacatcgtgcccagaactaaggtagtttatctggcctcggagacattcaattactccgcgattgatagagtaaagtcaaggggaaagcgcctcgctttagagaaggttcccaaagtcggacagcgatttaaccggattggtctgccaccaaaggttggctctttccaactgttcgtcgaagggtataaggacgctgattattggttaaggaggtttgaagctgagcccctccccgaaaacaccaatcgccagctgttacttcagtttgaacgcctggtggttctggattacattattcggaacactgaccgcgggaacgacaattggcttattaagtacgactgccccatggatagctcttctagtagggatacggactgggtggtcgtaaaagagcctgtgataaaagttgccgccattgataacggcctggccttcccgcttaagcatccagatagctggcgggcctatcccttctattgggcctggctccctcaggcgaaggtgcctttctctcaagaaattaaggatctgattctgcccaagatatcagaccccaatttcgtgaaggaccttgaggaggacctgtatgaactctttaaaaaagatcctgggttcgatcgcggccagttccataagcagattgccgttatgagaggacagatattgaatctcacacaggcgctcaaggacaataaatcccctcttcacttggtccagatgcccccagtgattgtcgaaaccgctaggagtcaccagcgatcaagctccgagtcctatacccagtcttttcaatctcgcaagccattcttctcctggtggtag

SEQ ID NO: 128379 - DNA, 1446 bp, Artificial Sequence
  Description of Artificial Sequence: Synthetic coding sequence
atggaggatccgtcagaacctgatagacttgcttccgccgacggtggaagtccagaggaggaggaagacggcgagcgcgagccgttgcttcccagaatcgcatgggcccacccacggcgcggcgcccccggcagcgcagttcggttgttggacgccgcaggggaggaaggcgaagccggagacgaggagctgccactcccgcccggcgacgtgggtgtttctaggtcctctagcgccgaactggaccgctcacgcccagctgtgtcagtgactatcggcaccagcgaaatgaatgcatttctggacgaccctgagttcgctgatatcatgctgagggccgagcaggccatcgaggtgggcattttcccagagcgtatcagccagggcagttccggatcctactttgtgaaagaccccaagcggaagattattggagtgttcaagcccaagtcggaggagccatacgggcagttgaacccaaagtggacaaaatacgtccataaggtttgctgcccatgctgctttggacgaggatgcctgatccccaaccaggggtatcttagcgaagcaggggcctatttagtcgacaacaagctgcatctgagcattgtgcccaagaccaaggtggtgtggctggtgtccgaaacttttaactataacgcaatcgacagagcgaaaagcagggggaaaaaatacgccctggaaaaggtcccaaaagtgggtcgcaaatttcaccggatcgggctcccacccaagattggcagctttcaactcttcgtagagggatacaaggaggctgaatactggctgagaaagtttgaggccgatccactgcctgaaaatatcaggaaacagttccagtctcaattcgagcggctcgtgattttggactacatcattagaaacactgataggggaaatgacaattggctcgtccggtacgagaaacagaagtgcgaaaaggagattgaccacaaggagtcaaaatggatcgatgatgaagagtttcttataaagatcgccgcaattgataatggactcgccttccccttcaaacaccccgacgaatggagagcttatccatttcattgggcatggcttccccaggccaaggtgcctttttctgaggaaatacgcaatctcatcttgccatacatttctgatatgaatttcgttcaggatttgtgcgaggacctgtatgagttgttcaagaccgacaagggctttgacaaggctactttcgaatcccaaatgtccgtcatgcgcggacagatcctgaacctgactcaggcacttcgggacggaaagagcccatttcagctcgttcagataccatgtgtcatcgtggaaagaagccagggcggttctcaggggagaattgtgcacctgagcaattctttcacgcagactgtaaattgcagaaaacctttcttctcaagctggtag

SEQ ID NO: 128380 - DNA, 1353 bp, Artificial Sequence
  Description of Artificial Sequence: Synthetic coding sequence
atggaggacccttccgagcctgaccggctggcttcagcggacggtggaagcccagaagaggaggaggatggcgagcgcgagcctctcctccccagaatagcctgggcccaccctcggcgaggcgccccgggttctgcagtgcgactcctggacagaagcagacccgccgtgtctgtgacaattggcacgtctgagatgaatgccttcctcgacgacccggaattcgctgatatcatgctgcgcgcggagcaagctatcgaggtggggatcttccctgagcgaattagtcaggggtctagcggctcatatttcgttaaagatcctaagcgcaaaattatcggggtgttcaagcctaaatcggaagaaccctatggccaactgaatcctaaatggacgaagtacgtgcacaaagtgtgttgtccctgctgctttggacggggttgcctcattccaaatcagggctatctttcagaagctggggcgtacctggtcgacaacaaactgcatttgtcaattgtgccaaaaaccaaggtcgtctggctcgtgagtgagacatttaattacaacgcaatcgatcgcgctaaatcccgcggaaagaagtacgcgcttgagaaggtccctaaagtggggaggaaatttcaccgtattggactgccacccaaaataggctcattccagctgtttgttgagggctacaaggaggccgaatactggctccggaaatttgaggccgatccacttcctgagaatataagaaaacaattccaatcacagtttgagcgcctcgtcattcttgactatatcatcaggaataccgacaggggtaacgataactggctggtaagatatgaaaagcagaagtgcgagaaagagattgaccataaggagagtaaatggatcgacgacgaggaattcctaattaaaatcgctgctatcgataacgggttggccttcccttttaaacatccagacgaatggcgcgcatacccattccactgggcctggctccctcaggccaaggtaccattctcggaagaaatacggaatctaatactgccctacatctccgatatgaacttcgtgcaagatctgtgtgaggatttgtatgagctctttaagaccgataagggatttgacaaggccacatttgagagccaaatgtccgtgatgcggggtcagattttgaatctaacacaggcgctgagagacggaaagtccccgtttcagctcgtgcagatcccgtgcgttatcgtggaaagaagtcagggtggcagccaggggaggattgtgcatctttcaaactcatttacacagacagtgaactgtcggaaaccatttttttcttcgtggtag

SEQ ID NO: 128381 - DNA, 6135 bp, Artificial Sequence
  Description of Artificial Sequence: Synthetic coding sequence
atgtgtcctgtggacttccacggcattttccagctggacgagaggaggcgtgatgccgttatcgccctcggcatcttcttgatcgagtcggatttacaacataaagactgtgttgttccatatctgcttcgtctgctcaagggacttcccaaggtttattgggtcgaggagagtacggctcggaaaggtcggggcgcactcccggtggccgagagcttcagtttttgcctggtgaccctgctcagtgacgtggcctatagggacccctccctccgagatgagattctggaagtcctacttcaggtgcttcatgtgttacttgggatgtgccaggccctggagatccaagataaagaatatctttgcaagtatgccataccgtgcctgataggtatttcaagagcgttcggacggtattccaatatggaggaatcattactgtccaaactttttcctaaaatacccccacatagcctgcgcgtcctcgaagaacttgagggagttagaaggcggtccttcaatgatttcaggagcattctccccagcaacctccttacggtttgccaggagggaacgctcaaaagaaagacctctagtgtaagttcaatatcgcaggtgtcaccggaaaggggtatgccgcctccatcttctcctgggggcagcgctttccattattttgaggcttcgtgcctgccagatggaactgctctggagccagagtactatttctctacaatcagtagtagcttctccgtgagtccgttgtttaacggggtcacctacaaggagttcaatatccccctcgagatgctgagagagcttctgaatctggtcaagaagatcgtggaggaggctgtcctgaagtcactcgatgcaattgtcgcatcagttatggaagccaatccttcggcagatctgtattatacatcttttagcgatcctctgtacctgaccatgtttaagatgctgcgagacacactatactacatgaaagatctgcctacctccttcgtgaaggagatccatgactttgtgctcgagcaatttaataccagccagggagaactgcagaaaatcctgcacgatgcggatagaattcataacgagctcagccccctgaagttgagatgccaggccaatgccgcctgtgtagaccttatggtctgggcagtcaaggatgaacagggagccgagaacttgtgcatcaagctgagtgaaaaacttcagtccaaaacttccagcaaggtaatcattgctcacctcccactgctcatctgttgccttcagggactagggcgcctgtgcgagcgctttcctgtggtggtgcactccgtgacacctagcttacgtgatttcttagttatcccatcaccggttttagtcaaactgtataagtaccactcacagtaccacacggtagcggggaacgatataaagatctctgtgaccaacgaacattcagagagcacgctgaatgtgatgagtggcaagaagagtcaacctagcatgtacgagcagctaagagatatagcaatagataacatttgcaggtgtttaaaagcaggcttaactgtggaccccgtgatcgttgaggccttccttgccagtctttctaaccggctctatattagccaggaatccgacaaagacgcacacttgataccagatcataccatcagggctctaggtcacatcgccgtagcacttcgggatacacctaaggtgatggaacccatcctgcagattctccagcagaaattctgtcagcctcctagccctctggatgttttaatcatcgaccagttgggctgtctggtgataactgggaatcagtacatttatcaggaagtatggaatctgtttcagcagataagcgtgaaggcatccagcgtggtttactccgcaaccaaagattataaagaccatggctacaggcactgttctctcgccgtgataaatgctctggcaaacattgccgcaaacatccaagatgaacacctcgtagatgagctgctgatgaacctgcttgagctgtttgtgcagcttgggttagaaggtaagagagccagcgagcgggcctctgagaagggccccgcccttaaagcttcttccagtgctggcaacctcggagttttgatacccgttatcgctgttctgactcggagactaccgcctataaaggaggcgaagcctagactccaaaagctgttcagagatttctggctgtattcagtccttatgggcttcgctgtcgaagggtctgggctttggccagaggaatggtatgagggcgtctgtgagatcgccaccaagtctcctttgctgacctttcctagtaaagagcctctgcgctcggtcctgcagtataacagcgcaatgaagaacgacaccgtgacacccgcggagttgtcggagctgcggtctaccattattaatttattagaccccccacccgaggtctccgcacttatcaataaacttgactttgccatgagtacatatctcctgtcggtttaccgtttggagtacatgcgagtcctgagatccacagaccctgatcgctttcaggtgatgttttgctatttcgaagataaagcaatccagaaagataagtcaggcatgatgcagtgtgtgatcgccgtggccgacaaagtattcgacgccttcttaaacatgatggccgacaaagccaagaccaaagagaacgaggaagagttagaaaggcatgcccaatttttgctggtaaatttcaaccacatccacaagaggattcgtagagtggccgacaaatacctttctgggctcgtcgataagttccctcaccttctgtggagtggtaccgtgctgaaaaccatgctcgacatcctccaaacattgtcactgagtctctcggccgatatacataaagatcagccatactatgacattcccgacgcaccctatcgaatcacagtgcccgacacatatgaggcccgggaatcaatcgttaaggacttcgctgctaggtgcggcatgattttacaggaagcaatgaagtgggcaccaacggtgacaaagtcccatctccaggagtacctgaacaagcatcagaactgggtgtctggactgagccagcacacaggcctcgccatggcaaccgagagcatacttcacttcgctggctataacaaacagaacacaactctaggagccacccaattgtcggaacggcccgcctgtgtgaagaaagactatagcaactttatggcctccctgaacctccgcaaccggtacgcaggagaggtgtatggaatgatcagatttagtggcacaacggggcagatgtccgacctaaataaaatgatggtgcaggacctgcacagcgctttggatagatctcatccccagcattacacccaagcgatgtttaagttgacagccatgctgataagctctaaagattgtgatcctcagctgctgcatcatctctgctggggtcctctacgcatgtttaatgaacacgggatggaaaccgccttggcatgctgggagtggcttctagccgggaaggacggcgtggaagttccattcatgcgtgagatggcaggggcctggcatatgacagtggagcagaaatttggcttattttcggccgagattaaggaggccgatcccctggctgccagcgaggcaagtcagcccaagccctgtccacctgaagttacaccacattacatatggatcgacttcctggtacagcgtttcgaaattgccaagtactgctccagcgaccaggtagaaattttctccagtcttttacaacggtctatgtccttgaacataggcggcgcgaagggctcgatgaataggcacgtggccgccatcggccctagatttaagctattaaccctcggcctcagcctcctgcacgcagatgtggtccctaacgccaccattcggaacgtgctcagagagaagatctactccactgcatttgactactttagctgtccaccaaagttccccacccagggggaaaagagactaagagaagacatcagcattatgattaagttctggacggccatgttctcagacaagaagtacctgacggcctcccagctagttcctccggacaaccaggatacccgatcgaatcttgacattaccgtcggctctaggcagcaggctacccaggggtggattaacacataccctctgtcttcagggatgtcaacaatatccaaaaagtcaggaatgagcaagaagacaaaccggggctcacagttgcacaagtactatatgaagcgtcggaccctgctcttgagtctgctggccactgaaatcgagcgactaataacatggtataaccctctgtcagccccggagcttgagctggatcaagctggagaaaacagtgtagcaaattggcggtccaaatatatcagtttaagcgaaaagcaatggaaggataatgtgaacctcgcatggtctatcagcccgtatctggctgtccagttaccagcccggttcaagaacactgaggccattggcaatgaggtaacccgcctggtgcgtctggatcccggagccgtctccgacgtcccggaagccatcaaatttcttgtcacatggcacacaatagacgccgacgctccggaacttagtcatgtgctttgttgggccccaacggacccacccactggactttcgtacttctcgagcatgtatccacctcatcctctgacggctcagtatggcgtcaaagtgctcagaagctttcctccagacgccattttattctacataccacagatagtacaggcactcagatatgataaaatgggttatgtgcgcgagtatatcctgtgggctgcctctaaaagccaattgctggcacaccagtttatatggaacatgaagacgaacatttacctggatgaggagggccaccaaaaggaccccgatatcggtgatttactggatcagcttgtggaggagatcactggatctctgtctggccctgctaaagatttctatcagcgcgagtttgacttctttaacaaaataaccaatgtctccgctattatcaagccctatccgaagggagacgagcgcaaaaaagcctgtctatctgcactttcggaggtcaaggtccagccgggatgttacctgccatccaacccagaagcgatagtgctcgacattgattataagtccggcacacccatgcagtccgccgccaaggctccctacctcgcgaaatttaaagtgaagcggtgtggcgtgagtgaattggagaaagagggcctgagatgcagatctgattctgaagacgaatgtagtacccaggaggctgatgggcagaagatcagctggcaggctgccatcttcaaagttggtgacgactgcaggcaagacatgctcgctctgcagatcatcgatctctttaagaatatcttccagctggttggcctggacctgtttgttttcccctatcgcgtggttgcaactgcacctggctgcggggtgatagagtgtatccccgattgcacgagccgtgatcagctcggcagacagactgatttcggtatgtacgactacttcactcgccagtatggcgacgagagtaccctggcttttcaacaggccaggtataacttcattagatcaatggccgcttattcactactgctttttctgctgcagatcaaagataggcataatggaaatattatgttggataagaagggccatattatccacatcgattttggctttatgttcgaaagctctccaggtggaaatctgggttgggagccagacataaagcttacagatgagatggtgatgattatggggggcaaaatggaagctacccctttcaaatggtttatggaaatgtgcgttcgcggttatctcgcagtgcggccctatatggacgctgtggtgagcctcgttaccttgatgctggataccgggctgccatgctttcgcggacagacgattaagttactgaaacacaggttttcaccaaacatgaccgaaagggaggccgccaatttcatcatgaaggtcatccagagctgctttttaagtaatagatcgaggacttacgatatgatccagtactaccagaacgatatcccatattag

SEQ ID NO: 128382 - DNA, 2565 bp, Artificial Sequence
  Description of Artificial Sequence: Synthetic coding sequence
atgcgtgagatggctggggcgtggcatatgacggtcgagcagaaatttgggctattctccgccgaaattaaagaggcagatcccctggctgcaagtgaagcgagccagcccaagccctgtcctcccgaggtaactccacactacatttggatcgacttcttggtgcaacgtttcgagatagccaagtactgtagttcagaccaggtggagatattcagcagcttgttgcaacgaagcatgtcattgaacatcggaggagccaaggggtccatgaacaggcacgtcgctgccatcgggccaaggtttaagctcctgacactcggcctgagtctgctccatgccgacgttgtgccaaacgctaccatccggaatgtactccgagagaagatttacagcacggcctttgactacttttcctgtccacccaaattccctacacaaggcgagaaaagactaagagaagatatcagcattatgattaaattctggacagccatgttttctgacaagaaatacttgacagcttcacagctcgtccctcctgacaaccaggatacgaggagtaacttggatatcacagtgggaagcaggcagcaggcaactcaggggtggatcaatacttaccccttgtccagtgggatgtcgaccatatccaaaaaatcaggcatgtccaagaagacaaatcgggggtctcaactccataagtactacatgaagcggcgtaccctcttgcttagccttctggccactgagattgagcgtttgataacttggtacaatcccctatctgctccagagttggaactggaccaagctggagaaaatagtgttgcaaactggcgctccaagtatatctcattgagcgagaaacaatggaaggacaacgtgaacctggcgtggtcaatctccccatacttggccgtccagctgcccgctcggtttaaaaataccgaagccatcggaaacgaagtaacccgcctggtgcgacttgatcctggagcggtgagcgatgtgccagaggccattaagttcttagtgacttggcataccatcgacgctgatgcgcccgaactttcccacgtcctatgttgggcccctactgatccccctacaggtctcagctatttttcatccatgtaccccccgcatcccctgaccgcacagtacggggtcaaggttctgcgctcatttccaccagacgccattctcttttacatcccccaaattgtccaggccctgcggtatgataaaatgggatacgttcgagagtacatcttgtgggccgcttccaaatcccaactgctggcccatcagttcatctggaatatgaagaccaatatttacctcgatgaagaggggcaccagaaggatccggatatcggcgatctgctcgaccagctagtcgaagaaatcacaggtagcctgtcaggaccagcgaaagatttctatcaacgagaattcgatttctttaacaaaatcaccaatgtgtcggcaataattaaaccatacccaaagggggacgagcgaaaaaaagcatgtctgtcagccctcagtgaggtgaaagtccagcccggctgttatcttcccagcaatcccgaggcaatagtgcttgatatcgactacaagagtgggaccccaatgcagagtgcagccaaggcgccatacctagcaaaatttaaggtgaagcgttgtggggtctccgaactggagaaggaaggtctgcggtgccgctccgactccgaagacgaatgtagtacccaggaagctgacggacagaagatatcatggcaggctgccatatttaaggtcggtgacgattgtcgtcaggacatgttagcgctccaaatcatagacctcttcaagaatatcttccagctggttggactggatctctttgtgtttccctaccgagtggtcgctacggcccctggctgcggcgtaattgagtgcattcccgactgtacaagccgcgaccagctgggaaggcagacagatttcggaatgtacgactacttcacacggcagtatggagacgagtccacgttggcctttcaacaagctcgatacaattttataagatcaatggcagcttactctctcttactattcttactgcagattaaggatcgacataacggtaatatcatgttggacaagaagggacacatcatccacatcgacttcggatttatgtttgaatcctctcctggagggaacttaggctgggagccggatatcaaactgactgatgagatggtgatgataatgggtggcaagatggaggctacaccttttaaatggttcatggagatgtgtgtgaggggctatctcgccgtgcggccctatatggacgctgttgtgtcactggtaacactgatgctggatactggactcccctgcttccgggggcagacaatcaaattacttaagcataggtttagccctaacatgaccgagcgcgaagcagccaacttcataatgaaggtgatccagtcatgctttctgtcgaaccggtctaggacctacgacatgatccagtattatcagaacgacatcccatactag

SEQ ID NO: 128383 - DNA, 264 bp, Artificial Sequence
  Description of Artificial Sequence: Synthetic coding sequence
atgtgccccgtggattttcacggcatcttccaattggatgaacgcagacgggatgcagtgattgctctcggcatatttttgatagagtccgatttgcagcacaaagactgcgtggtgccttatctcctgaggctgcttaaggggctgcccaaagtctactgggtagaggaatcaacagcacgaaagggccggggtgccctccccgtggcagagagttttagcttctgcctcgtcacgctcctttccgatgtggcatacagatag

SEQ ID NO: 128384 - DNA, 1959 bp, Artificial Sequence
  Description of Artificial Sequence: Synthetic coding sequence
atgagcggccagtctttgaccgatcgcatcaccgcggcccagcattcagtaacaggctcagctgtctctaagacagtctgtaaggcaaccacacatgaaatcatgggcccaaagaagaaacacctggactacctcatacagtgcacaaatgagatgaatgtgaacattccccagctcgcggactctctgtttgagcgcacgaccaatagtagctgggtagtcgtgttcaaatccctgattaccacccaccacctgatggtttatggcaacgagagatttattcagtatctcgcgagcagaaacacgctgttcaacctctcaaatttcttggataagtcaggactgcagggctatgatatgagcacttttattagaagatattcccggtacctcaatgagaaggcagtgtcctaccggcaagtggcctttgacttcactaaagtaaagaggggggccgacggagtgatgcggacaatgaacactgagaagctcttgaagacagtgccaattatacagaaccagatggacgcgctccttgactttaacgtgaatagtaatgagctgactaacggtgttattaacgcagcctttatgctgctgtttaaagacgctatacggcttttcgcagcctacaacgaaggaatcattaacctgctcgaaaaatacttcgatatgaagaagaatcagtgtaaagaggggttggacatatacaagaagttcctgactcggatgactcgcatctctgagttcctcaaggtggccgaacaagttggcatagatcggggagacatccccgatcttagccaagccccgtcaagcttgctcgacgccttagagcaacatctggcttctctggaaggcaaaaaaattaaggactctacggcggctagtcgcgctactactctgagcaacgcagtgtcttctctcgcgtccaccggccttagccttacgaaggtggacgaacgcgagaagcaagccgcattggaagaggaacaggctcgactgaaggcactaaaggagcagagactaaaagagttggctaagaaaccacacacaagtcttacgacagctgcatctcccgttagcacatcagcaggtgggatcatgactgcccccgctatcgacatcttttctactcctagcagttcaaattctacatctaaactccccaatgacctccttgatctgcagcagccgaccttccatccctctgtccaccccatgagcacggcatcccaggtggcaagtacctggggtgatcccttcagcgctacagtggatgctgtagatgacgcgatccccagcttaaacccattcttgaccaagtcgtctggggatgtgcatctgtcaatttcaagcgacgtgagtacatttacaaccaggactcctacacacgaaatgttcgtaggatttacccccagccctgtggcccagccacatccgtccgctggccttaatgtggatttcgagagtgtatttgggaacaagtcaaccaacgtgatagttgattccggtggcttcgacgagttaggcgggctgctcaaaccaacagtagctagccagaaccagaacttaccggtggccaaacttccgccctcgaagctggtgagcgatgacctcgattctagcttggcaaatcttgttggaaacttaggcatcggaaacggaacaacgaaaaatgatgtgaactggtcccagcccggcgaaaaaaagcttaccggcggcagcaactggcaacccaaggtcgcgcctactaccgcctggaacgctgccactatggctcctccggtgatggcctatcccgcgacaaccccaacgggtatgattggctacggcatacccccgcagatgggctctgtaccggtcatgacccagccaaccctcatctacagccaaccagtgatgcgtcccccaaatccctttggaccggtttctggggcacaaatccagtttatgtag

SEQ ID NO: 128385 - DNA, 1959 bp, Artificial Sequence
  Description of Artificial Sequence: Synthetic coding sequence
atgtcaggccagagcttaactgacagaatcacagcggcccagcactccgtgaccgggtccgctgtgagtaaaactgtctgtaaagcgacaacacacgagatcatgggcccaaagaagaaacacctggattacctgattcagtgcacaaacgaaatgaacgtcaacattccacaactcgctgactctctattcgagcggaccacgaacagctcatgggttgttgtttttaagtcactcatcaccacccatcatctgatggtgtacggaaatgagagatttatccaatacttggcctcccgcaacactctctttaatctgagtaattttttagacaagagtggtctgcagggctatgatatgtcaacttttatcagacggtacagtaggtatctgaacgagaaggcggtatcataccgtcaggttgcttttgacttcactaaagtcaaaagaggagcagacggggtgatgagaaccatgaacaccgagaaactactgaagacagtaccgatcatccaaaatcagatggacgcgctgttagactttaacgtgaattccaacgagctcactaatggtgtgattaatgcggcgtttatgctgctgttcaaagatgctattagactgtttgctgcctataacgaagggatcattaacctgctcgagaaatactttgacatgaaaaaaaaccagtgcaaggaaggtctcgatatatataagaaatttctcacccggatgacacgcatctccgaattcttgaaggtggcggagcaggttggcatcgatcgcggggacattccggatctcagccaggcccccagctcactgctggatgcactggagcagcacctggccagcctggaagggaagaaaatcaaggactcaacggccgcttcgagggcaacaaccctaagtaatgccgtttccagtctggcaagcaccgggctgtccctgaccaaggtggatgagagagagaagcaggcagcgctggaggaagagcaagcccgcctgaaggcgctaaaagagcagcgcctgaaggagctggctaaaaaaccccacaccagccttaccaccgccgcttctccagtctccactagcgctggggggatcatgacagcacccgcgatcgatattttctccacaccctcttcttccaattcaacctctaaattacctaacgatctgcttgacctgcagcagcctaccttccaccccagtgtccatccgatgagtaccgctagtcaagtcgcttccacatggggcgatccatttagtgccacagtcgacgccgttgatgacgccataccctcactgaaccccttcttgacaaagtctagcggcgacgtgcacctgtccattagctcggatgtctcgaccttcaccactcgtacgcccacgcacgagatgttcgtcggttttacaccaagccctgtggcgcagccacacccatcagccggcttgaacgtggatttcgaatctgtctttggaaacaagagtaccaatgtgatcgtggactccggcggttttgatgagctgggaggcctgttgaagcccactgtagcctctcagaaccagaacctgccagttgcgaaattgcctcccagcaagttggtttccgatgacctcgactcatcactggcaaatctggtcggaaacctgggcattgggaatggaactaccaagaatgacgtgaactggtctcaacccggagaaaaaaagctgaccggaggctcgaactggcagcccaaggtagctccaaccactgcgtggaacgccgccaccatggctcctccggtgatggcatatcctgcaaccacaccaacaggcatgatcggctacggaatcccaccacaaatggggtcagtgccagtgatgacacagcccacattgatatattcccagccagtaatgcgacctcccaacccttttgggcccgtttccggcgctcagattcagtttatgtag

SEQ ID NO: 128386 - DNA, 1938 bp, Artificial Sequence
  Description of Artificial Sequence: Synthetic coding sequence
atgtccggacagtccttaacggaccgcatcacggccgcacaacattctgtcaccggttctgccgtgtcaaaaaccgtgtgcaaagccaccacccatgaaataatgggacctaaaaagaaacacctagattacctgatccagtgcaccaacgagatgaatgtaaacattcctcagctcgccgattctctttttgaaaggaccaccaacagctcttgggtggtggtcttcaagagcctcatcactactcaccatttgatggtttatggaaatgagcgttttatacaatacctagccagtaggaacaccttattcaatcttagcaactttctggacaagtctggcctgcagggctatgatatgtccacatttataaggcgttactcaaggtatctcaatgagaaggccgtgagctatcgccaggtagcctttgactttaccaaggtaaagcgtggagcagacggggttatgcggacaatgaacacagagaaactactgaaaaccgtccccatcattcaaaatcagatggatgcactacttgattttaatgtcaactcgaacgagttgactaatggggtgattaatgccgcatttatgctgctcttcaaagacgctatccgcctttttgcagcttacaatgaaggtattattaatttgctggaaaaatactttgacatgaaaaaaaatcaatgcaaagaaggtctagacatttataagaagttcctaacccgcatgactaggatctctgaatttcttaaggttgccgaacaggtgggcatcgatagaggggacattccggatctgagccaggccccatcctccctgcttgatgcactagagcaacaccttgcaagtctggaaggcaaaaaaatcaaggactctactgccgcttccagggctacgacactgagcaacgcagtaagttccctcgcatctaccggcctaagcctgactaaggtggacgaaagagagaagcaagctgccctcgaagaagaacaggccagactgaaagcattgaaggagcagaggctgaaggagctggctaagaagccccatacatctctcactacagctgcttctccagtctctacatcggccggcggaattatgaccgctccagcaatagatattttcagtaccccttcgagctctaattctacgtcaaaattacctaatgatctcctggatctgcaacaacctacattccaccctagtgtgcaccccatgtccactgcaagtcaggttgcaagtacctggggtgacgcagtggacgatgcgattccttccttgaacccatttctaactaagagcagcggcgatgttcacctgtccattagtagcgacgtctctactttcactacacggacacccacccacgagatgttcgtgggtttcacaccctctcctgttgcgcaacctcatcccagcgcgggtttgaatgtggatttcgaaagcgtgttcggcaacaagtctacgaacgtgatagttgactcaggcggattcgacgagctgggagggctcctcaaaccaactgtggcctctcagaatcagaatctgcctgttgccaagctgccaccgtccaagctcgtatccgacgacctggatagcagcctggctaacctggtgggaaacctggggattggaaacggaacaacgaagaacgacgttaactggagtcagccaggggaaaaaaagctcactggggggagcaattggcagccaaaagttgctcctacgactgcttggaatgctgccaccatggcgccgcccgtcatggcctaccccgcaaccacacctacaggcatgatcgggtatgggattcctccccaaatgggaagcgtacccgtgatgacccaacccactcttatttattctcagcccgtgatgcgaccccccaacccctttggccctgtctctggtgctcaaattcaatttatgtag

SEQ ID NO: 128387 - DNA, 1833 bp, Artificial Sequence
  Description of Artificial Sequence: Synthetic coding sequence
atgtccggccagagtcttacagaccgcataactgcagcccaacacagcgtaacaggtagtgctgtgtcaaaaacagtatgcaaggcaaccacacacgagatcatgggacctaaaaaaaaacacctagattacttgatccagtgcactaatgaaatgaatgtgaatatccctcagttagccgacagcctgttcgagcgaacgaccaactcttcttgggtggtggtattcaagtcccttattaccacccaccatcttatggtctacggtaatgagcgatttatacagtacttggctagcaggaacaccctttttaaccttagcaactttttggacaagtccgggttgcagggctacgacatgagtacattcatcaggcggtatagtagatatctcaacgaaaaagctgtgtcgtaccgccaggtcgccttcgatttcactaaggtgaaacgaggggctgatggcgtaatgagaacaatgaataccgaaaaactccttaagaccgtgccaatcatccagaatcagatggatgctctactggactttaatgtgaactctaatgagttaaccaatggagtaattaacgctgccttcatgctgctctttaaggatgctattagactgtttgcggcctataatgagggaatcatcaatctgctcgagaagtacttcgacatgaagaaaaatcaatgcaaagagggcctcgacatatacaagaaattcctcacgcgaatgacgagaatttctgagttcttgaaagtcgccgaacaagtgggtatcgaccgcggcgatatacctgatctctcccaggccccttccagcctgcttgacgcactggaacagcacctcgcctctctggaggggaaaaagatcaaggactctaccgcagcttcccgggctacaaccctgtcgaacgcagtgagttctctggcctcaactgggctgagcttgacaaaagtggatgaacgcgagaaacaggccgcactggaggaggagcaagctaggcttaaagccttaaaggagcagaggctcaaagagctggccaaaaaacctcacacgtctctgaccaccgccgcctcccctgtttcgacctccgccggaggaatcatgaccgctcccgctatcgatatcttttccactccgtcctccagcaatagtacttccaaactgcccaatgatctgctggacctgcagcaacctacattccacccaagcgtccaccccatgtccactgcctctcaggtagcatcaacctggggagggttcacgccttcaccggtggctcagccccatccatcggctggcctgaatgtagactttgagtctgtattcggcaacaaatctacaaacgtgatcgtggatagtggcgggttcgacgagctcggggggctgctgaagcccaccgtggccagtcaaaaccagaacttaccagtggccaaattgcctcccagcaagctggtgtctgatgacttagattccagcctggctaacttggttggaaatcttgggattgggaatggcaccactaaaaatgatgtaaactggagtcagcctggagaaaagaagctgacaggcggcagcaattggcagcccaaggtcgcccctacaactgcttggaacgcagccaccatgaatgggatgcactttccacaatacgcccctcccgtaatggcctacccagcgacaaccccgaccggcatgatcggctatgggatcccccctcagatgggcagcgtgcccgtcatgacccagcctactctgatttattctcaacccgtgatgaggcctcctaacccatttggccccgtgtcaggcgctcaaatacagtttatgtag

SEQ ID NO: 128388 - DNA, 1656 bp, Artificial Sequence
  Description of Artificial Sequence: Synthetic coding sequence
atgaacgtcaacatcccgcagctggcagacagcctgtttgagaggaccaccaactctagctgggtcgttgtgtttaagtctctgatcaccacccaccacttgatggtctacggcaacgagagatttatccagtacttggcgtcgcggaatactttgtttaatctgtccaactttcttgacaagagtggccttcagggctacgacatgagcacttttatccggcgttacagcagatacctgaatgagaaggccgtttcctacaggcaggttgcatttgatttcacgaaagtgaagcggggtgcagacggcgtcatgcggactatgaacactgagaagcttctcaagactgtaccaatcatccaaaatcagatggacgccctactggatttcaacgtcaattctaatgagctaactaacggtgtaattaatgccgcatttatgttgttgttcaaagatgccattagacttttcgccgcttacaatgaaggaattatcaacttgctcgagaaatactttgatatgaagaagaaccagtgcaaggagggcctagacatttataaaaagtttctaaccaggatgacacgtatatctgagttcctgaaggtcgctgaacaggtcggtatcgaccgaggagacataccagacctcagccaggctccaagcagcctgctggatgcactcgagcagcacctggcttcactggaaggaaagaaaatcaaagactcaacggctgctagccgtgccacgaccctgtcgaacgccgttagctccctggcctccacaggtctctcccttaccaaagtcgacgagagagagaagcaagccgcccttgaagaagagcaggccaggcttaaggccttgaaggagcagcgtttaaaggagcttgcaaagaagccccatacaagtttgaccacggccgcgagtcctgtttccacttcagcgggcggaataatgacagcccccgccatcgacattttcagcaccccctcttctagtaactccacttcaaaactgcccaatgacctgctggacttgcagcagcccacgtttcacccctctgtccatcctatgtctactgcttctcaggtcgcctctacttggggaggcttcaccccatcccccgtggcacaaccacatccttcagccggacttaatgtggacttcgaaagtgtcttcggtaacaagtctactaatgtgattgtggactcaggtggattcgatgaattggggggactgctgaaacctaccgttgctagtcagaatcagaacctccccgttgccaaattgccccctagtaagcttgtgagcgacgacttggattcgagcctggctaatcttgtggggaatctgggcatcggcaatggcactaccaaaaatgacgtgaattggtcacagcctggtgaaaagaaacttacgggaggcagtaattggcagcctaaggtagctcctaccacagcatggaacgctgctacaatggctccgcccgtgatggcttatccggccaccactcccaccggcatgatcggctacggaatcccaccacagatgggctcagtgcctgtcatgacccagccaaccttgatctactcccagcctgtgatgcggcctccaaacccatttgggcccgtctcaggagctcaaattcagttcatgtag

SEQ ID NO: 128389 - DNA, 1455 bp, Artificial Sequence
  Description of Artificial Sequence: Synthetic coding sequence
atggcctgccggggtggcgcaggcaatgggcaccgtgctagcgcaaccctctcacgggtgtcacccgggagcttgtatacctgccgaactcggacccacaacatatgtatggtgtcagatttcttctatcctaatatgggaggagtggaatctcatatttaccagctttcccagtgcctcatcgagcgcggtcataaggtcatcatcgtaacccacgcctacggcaataggaaggggattagataccttacttcaggcctcaaagtatactacttacctctgaaagtcatgtacaaccagagcacagccaccaccttgttccattctcttccattattgcgttacatcttcgtaagggagagggtcaccatcatccactcccatagcagcttcagcgcaatggcccacgatgctctgttccacgccaagactatggggctgcagaccgtgttcacagaccattcactttttggctttgccgatgtgagtagtgttctcaccaataagctgctgacagttagcctctgcgataccaaccatattatttgcgtgagttacacaagcaaagagaatacagtcctgcgcgctgcattaaacccagagattgtgtccgtgattcccaacgcggtagaccccactgatttcacaccagatcccttccgccgacacgattctatcacaattgtggtcgtctctagactcgtatatcgcaaaggaatagacctcttatctggaatcatcccagaactgtgtcagaagtaccccgacttgaactttataatcgggggagagggccccaagcggataattcttgaggaggtccgagaacggtaccagcttcatgaccgcgtccggttgctcggagctctggaacacaaagacgtccggaatgttctggtacagggtcacattttccttaatacatcattgacggaggctttttgcatggccattgtggaagccgcttcctgcggcctgcaggtggtttcaacccgcgtggggggaatcccagaggttttgcctgaaaatctgatcatcctctgtgaacctagcgtcaagtccctgtgcgaaggtctggaaaaggctatctttcagctgaagtcggggacactcccagcgcctgagaacatacataatatagtgaagaccttctacacatggcggaacgtcgccgagaggaccgaaaaggtttacgaccgtgtttctgtggaggctgtgctccccatggataagagactggaccggttgatctcgcactgcgggcctgttaccgggtacatcttcgctttgctcgctgtgttcaacttcctgttcctcatattcctgcggtggatgactcccgatagtattatagatgtcgccatcgacgcaacaggccccaggggcgcatggacgaataactattctcactcaaaacgtggaggggaaaataatgagatttccgagaccaggtag

SEQ ID NO: 128390 - DNA, 510 bp, Artificial Sequence
  Description of Artificial Sequence: Synthetic coding sequence
atggccattgtggaggcagcttcctgcggactgcaggttgtttccacgagggtgggtgggattccggaagtgctccccgaaaacttgataattctttgtgaaccttccgtcaagtccctctgtgaaggcttagaaaaggctatttttcagcttaagagcggcacattgcctgcccccgagaatatccacaacatcgtgaaaacattctacacttggaggaacgtggccgagcggacagaaaaagtttatgatcgggtatctgtcgaggctgtgctgcctatggataagcggctggatcgcctcatcagtcactgcggacctgtgacaggctacatcttcgccctgctcgcagtctttaacttcctgtttctcatcttcctgagatggatgaccccagacagcatcattgatgtcgccatcgatgctacagggccaaggggcgcttggacgaataattatagccactctaaacgcggcggcgagaataacgaaatttccgaaacgcgctag

SEQ ID NO: 128391 - DNA, 753 bp, Artificial Sequence
  Description of Artificial Sequence: Synthetic coding sequence
atggagctcacggggatcgacttactgagtggcattatccccgaactttgtcagaagtatcccgacctcaactttattataggaggcgagggtccgaagcggattatcctagaagaggtgagggaacggtaccagctgcacgatcgggtgcgacttctgggagcgctggagcacaaggatgtgcgaaacgtccttgtgcagggccatattttcctgaacacttcactcaccgaagcattttgcatggcgatcgttgaagcggcctcctgtgggctgcaggtcgtgtcaacccgtgtgggtggtatacccgaggtgcttcccgaaaacttgattatcctttgtgagcccagtgtcaaatccttgtgcgaggggctcgagaaggcaatcttccagctgaagtcgggcaccctgccggcgccagagaacatccacaacatcgtgaaaacattctacacttggcgcaatgtggccgagcggactgagaaggtgtacgacagagtctcggttgaagcagtgttgccgatggataagcgtctcgatcggctgatatctcattgcgggcctgtcaccggctatatctttgcgcttttggcagtgttcaactttctgttcctcatttttctccgctggatgacccctgactccataatcgatgttgccatcgatgccacgggccctcgcggagcgtggacgaataactactcacatagtaagcggggaggcgaaaataatgagatttctgagacaagatag

SEQ ID NO: 128392 - DNA, 1665 bp, Artificial Sequence
  Description of Artificial Sequence: Synthetic coding sequence
atgcgtcgtccactgagcaagtgcgggatggaacctggtggaggagacgcgagcctgacactgcatggactccagaataggtcccatgggaagataaagttgcgcaagcgcaaaagtaccctgtacttcaatacacaagaaaaaagtgcccgcaggcgaggggacttactcggggagaacatctacctcctactctttacaattgcattgcgaatcctgaattgttttctggtgcaaaccagctttgtgccagacgagtactggcagtcactcgaggtgagtcaccacatggtgttcaactacggctacctcacttgggaatggacggagagattgcgatcatacacgtatcccctcatctttgcatcaatctacaagatactgcatctgctgggaaaggactcagtccagcttctgatctggattcctcgactcgcacaagccctcctctctgctgtagcagacgtgagattgtatagtttaatgaagcaattagagaaccaggaggtggcccggtgggtctttttttgtcaactctgttcctggtttacatggtattgctgcactagaaccctgacaaataccatggaaaccgtgctgactatcatcgcgctgttctactaccctctcgaggggtcaaagagcatgaactcagtgaaatactccagcctcgtcgcactcgccttcatcatcagaccaaccgcagtgatcctttggacacccttactcttcagacacttttgccaggagccaaggaagctcgatctgattctgcaccacttcctgcctgtcggcttcgtaaccctcagtctctcactcatgatagatcggatattttttggccaatggacactcgttcagtttaactttctgaagtttaatgttctacaaaactggggcacattttatggctcccacccatggcactggtacttctctcagggtttccctgttatactaggtacgcatctgccctttttcatccacggatgctacctggccccaaaacggtataggatcctacttgtgacagtgctttggaccttgctcgtctattcaatgttgagtcataaggaatttcgattcatttatcctgtcttgccattttgcatggtcttttgcggctactccctcacccacctaaaaacttggaagaaaccggccctgtccttcctgttcctaagcaacctgttcctggctctttacacaggattggttcaccagaggggcacattggatgtgatgtctcacatccagaaggtctgctacaacaatcctaacaaaagcagcgcatcaatttttatcatgatgccttgtcattcaacgccatactactcccatgtgcactgccccttacccatgcggtttctccagtgccctccagacctgacagggaagtcacattatctagatgaagcagacgtcttctacctcaatcctcttaactggttgcaccgcgagtttcatgacgacgccagccttccgactcacctaatcaccttctcaatactggaggaagaaatttcggccttcctgatcagcagcaattacaagcgaacagccgtcttttttcacacacatctgcccgagggccgtatcgggtctcatatctacgtgtatgaacgtaagcttaagggcaagttcaatatgaagatgaagttctag

SEQ ID NO: 128393 - DNA, 1080 bp, Artificial Sequence
  Description of Artificial Sequence: Synthetic coding sequence
atggaaacagtgctgaccatcatcgcactcttctactatccattagaggggtctaagtccatgaattctgtgaagtactcatcccttgtcgcccttgcattcatcatccgaccgacagctgttatactgtggaccccgctgctattcaggcatttctgccaagagcctagaaaactcgacttgatactccaccactttctgcctgtgggctttgtgaccctgtccctgtcactcatgatagatcgcatctttttcgggcagtggactcttgtccagttcaatttcctcaaatttaatgtgctgcagaattggggtaccttttatgggagccatccctggcattggtattttagccagggatttccagtgatcctgggaacacacctcccctttttcatacatggctgctatctggcccccaagcggtaccgcatcctcctggtgaccgtcctgtggacattgctggtatattcaatgctgtcgcacaaggagtttaggttcatttaccctgtgctaccattttgtatggtgttttgcggttactctttaactcaccttaagacctggaaaaagcccgcactctcctttctcttcctcagcaatttgttcctggcgctttacacaggactggtccaccagcggggaactctggacgtgatgagtcacattcagaaggtgtgctacaacaatcccaataagtcgtccgcatccatctttatcatgatgccatgccactcaacgccttattactcccacgtgcactgccctttacctatgagattcctgcagtgccccccagatctgactgggaaatctcattatttagacgaggctgacgttttctacctgaatcctctgaactggctccaccgtgaatttcacgatgatgccagtctccctacacacctgattacgttcagtattctggaggaagagatatctgcctttctgatatccagtaactacaaacgcacagctgtgttttttcacacccatctccctgaaggacgtattgggtcacacatctacgtctacgagagaaagctgaaggggaagttcaacatgaagatgaaattctag

SEQ ID NO: 128394 - DNA, 894 bp, Artificial Sequence
  Description of Artificial Sequence: Synthetic coding sequence
atgtatgcacaacctgtaacgaacacaaaagaggtcaagtggcagaaagtgctctatgagagacagccatttccggataattacgtggacagaagattccttgaggagctgagaaagaatattcatgcacgcaagtaccaatattgggcagtggtgttcgagtcatctgtcgtgatacagcaattatgttcagtgtgcgtatttgtcgtcatttggtggtatatggacgagggtctactcgcgccacactggctgcttgggactggcctcgcatcctctttaataggctacgtgctgtttgacctgatcgacggcggggagggacgcaagaaaagcgggcaaacaaggtgggctgatttgaaatccgccctcgtatttataacctttacgtacggtttctcgcccgtgctgaaaaccctgactgaatccgtctccacagatactatctatgcaatgtccgtgttcatgcttctaggccacctgatatttttcgattacggcgcaaatgccgccatcgtgtcaagcacactctccctgaacatggctattttcgcctctgtgtgcctggcttcccgtctgccaagatccctccatgcatttatcatggtgacgttcgccatccaaattttcgctctctggccaatgttgcagaagaaactcaaggcctgcactccacgaagctatgtgggggtgacactgctgttcgctttcagcgctgtagggggactgctgtccatctcggcagtgggggcagtgctgtttgctctcttactaatgagcatctcctgcctgtgccccttttacctgataaggcttcagctttttaaagagaatatccatgggccatgggacgaggctgagattaaggaggacctcagtcggttcttgagctag

SEQ ID NO: 128395 - DNA, 894 bp, Artificial Sequence
  Description of Artificial Sequence: Synthetic coding sequence
atgtacgcccagcctgtgacgaacaccaaggaagttaagtggcaaaaggtgttatatgaacggcaaccttttcctgataactatgtcgaccgcaggtttctggaagagttgcggaagaatatacacgcgcgaaagtaccaatactgggcagtcgtattcgaatcatcagtggtgatccagcagctgtgttcagtgtgcgttttcgtagttatttggtggtatatggatgaggggctgctagcccctcattggctactgggcaccggactggcatcttcgttgattggatacgtgctcttcgacctgatagatgggggcgaaggcaggaagaagagtgggcagaccaggtgggcagatctgaagtccgctctggtgttcataacattcacatacgggttttctcccgtcctcaagaccctgaccgagagcgtctcgacagataccatttatgcaatgtccgtatttatgttgctgggtcacctgatcttctttgattacggggctaatgcggctatagtatcctcaactctgagcctgaatatggcgattttcgcaagcgtttgtcttgcttccagactccctcgatcacttcatgcatttatcatggtgaccttcgcaatacagattttcgctctgtggcctatgcttcagaaaaagcttaaggcatgtacgcccaggtcttacgtgggggtgactctgttgtttgcatttagcgcagtgggcggtctgctgagcatctccgccgtgggcgcagtgttgtttgcccttttgctgatgtccatcagttgcctttgccctttttatcttatcaggctgcagctctttaaagaaaacattcacggcccatgggacgaagccgagatcaaggaagacctctctaggttcttatcttag

SEQ ID NO: 128396 - DNA, 894 bp, Artificial Sequence
  Description of Artificial Sequence: Synthetic coding sequence
atgtacgcgcagccagtgaccaacaccaaagaagtgaagtggcagaaggtactgtacgagcggcaacctttccccgacaactatgtagatcgcaggttcctagaggagcttaggaaaaacatccatgctcggaaataccagtattgggcagtcgtctttgagagttctgtagtcattcagcaactttgtagcgtatgtgttttcgtcgtgatttggtggtatatggacgaaggactgctagctccacattggttactgggtacaggtttggcttcaagcttgataggctatgtgctctttgatttgattgatggcggagaggggcgtaaaaagtccggccagactagatgggcggacctgaaatccgccttggtgttcattacttttacttacgggtttagccccgtattgaaaacgttgactgagtcggtgagcaccgacaccatatatgcaatgtcagtatttatgctgttaggtcatttgattttctttgattacggcgccaacgccgcaatcgtttcgtcaaccctcagccttaacatggccatctttgcgtcagtttgcctagcatcaaggctgcctcggtcattacacgcctttatcatggtcacctttgcgatccaaattttcgcactgtggccaatgctgcaaaagaagctcaaagcttgcacgccaaggtcctacgtaggagtaactctgctcttcgccttctcagcagtgggcggactgctctctatttctgcggttggtgcagtgctgtttgccctgctccttatgtctatctcatgtctgtgccccttctacttaatcagacttcagctgtttaaggaaaatatacacggcccttgggacgaggccgaaattaaggaagacctgagcagatttctgtcctag

SEQ ID NO: 128397 - DNA, 660 bp, Artificial Sequence
  Description of Artificial Sequence: Synthetic coding sequence
atgaaggacaatgatatcaaaagactcctgtacacccaccttttatgtatcttttcaattattctctctgtgttcatcccatccctgtttttggagaatttcagcatactcgaaacccacctgacctggctgtgcatttgttctgggtttgtgacagccgtgaatctggtcctgtacctcgtggtcaaacccaatacatcgagtaaacgctcctccttgtcccacaaggttactggcttcctgaaatgttgcatatactttctaatgtcctgtttcagtttccatgtgatctttgtactctatggcgctccccttattgaactggccctggagaccttcctgtttgcggtgatcctgtctacgttcactacagttccatgtctatgcctgcttgggcccaacctcaaagcatggcttagggtgttctcacgaaatggggtcacaagtatctgggagaactctctgcaaatcacaacaatatcgtcattcgtcggggcatggctgggcgctcttcccattccgcttgattgggaacggccatggcaagtgtggccaatctcctgtacccttggagctacttttgggtacgtggctggtctagtaatatctcccctctggatttattggaatcgcaagcaactgacctataagaataattag

SEQ ID NO: 128398 - DNA, 621 bp, Artificial Sequence
  Description of Artificial Sequence: Synthetic coding sequence
atgaaggacaatgatataaaaaggctactctacacacatctcctgtgtatattcagcattatcttgtcggtcttcattccgagcttattcttggaaaacttttccatcctcgagactcatcttacatggctgtgcatttgttcaggctttgtgactgctgtcaatcttgttctttacctggtggtaaaacccaacacctcttccaagagatcctccctgtctcacaaggtgaccggatttctgaagtgctgtatttacttcttaatgtcatgcttttcattccacgtgatctttgttctgtacggcgctcctttaattgagctggccttagagactttcctgttcgccgtcatcttaagcacttttacgacagtcccgtgcctgtgcctcctcggaccaaatttgaaagcctggctccgggttttctcaagaaacggagttacgagtatctgggaaaattctttgcagattactaccattagctcatttgtcggtgcttggctaggggctctgcccataccactggattgggagcgcccatggcagatgacggttgagcgaaaaaggtccacttaccgcagcctgcatgtcccgtgtcgggggctcgggaccgttaagtag

SEQ ID NO: 128399 - DNA, 150 bp, Artificial Sequence
  Description of Artificial Sequence: Synthetic coding sequence
atgaaggataacgacataaagaggttactttacacccatctgctgtgtatcttctctatcatcctgtccgtctttatacccagcctgttcttagaaaactttagcattctcgaaacccatcttacttggttgtgtatctgctctggatag

SEQ ID NO: 128400 - DNA, 999 bp, Artificial Sequence
  Description of Artificial Sequence: Synthetic coding sequence
atggcggtgacggactctctaagccgcgcagcaactgtactggccaccgtactattgctctccttcggctccgtggcggccagccacatcgaggatcaggcagaacagtttttcagaagcgggcacaccaacaattgggccgtgctggtgtgcacatcaaggttctggtttaattatcgccatgtagcaaataccctttcagtgtatcgaagcgtgaagagactcggaattcctgactctcacatcgtgttaatgctcgctgacgatatggcctgcaatcctcggaaccccaaacccgcaacagtcttcagccacaagaatatggagctgaatgtgtacggggacgacgtggaagtggattacaggtcttatgaagttactgtcgaaaacttcttgcgagttctcaccggacgtattccgccatccactccacgttcaaaacgcttattatccgatgatcggtcgaacatccttatctatatgacggggcacgggggcaacggtttcttaaagtttcaagactcagaagagatcacaaatatcgagctggcagacgctttcgagcagatgtggcagaaaagaaggtataacgagttgctgttcattatcgacacctgtcaaggtgcgtcaatgtatgaacgattctactcaccaaatataatggctttagcgtctagtcaggtaggggaggattctctgtcccatcagcctgatcccgctatcggggtgcacctgatggatcgatacacattctacgtgttggagtttttagaagagataaatcctgcgtcacagaccaacatgaatgacttattccaggtatgccccaagtcactgtgtgtgtcgacacccgggcacagaacagacctgtttcaaagggacccaaagaatgttttaatcacggacttcttcgggtccgtgaggaaggtcgaaataacaactgaaacaattaagttacaacaggacagtgagatcatggagtcgcgatacagtagctag

SEQ ID NO: 128401 - DNA, 1188 bp, Artificial Sequence
  Description of Artificial Sequence: Synthetic coding sequence
atggcagtgaccgactcactgagcagggccgcgaccgtccttgccaccgtactgctgctctcttttggaagtgttgctgcgagccacatagaagaccaggctgagcaattcttccgctctggtcacaccaacaattgggctgtgctggtgtgtacctcaaggttttggttcaattaccgacatgttgctaatacgctgtcagtgtatagatccgttaaaagactcggcatccccgactcacacatagtgctgatgcttgccgatgatatggcttgtaacccaaggaaccccaaacctgccacggtcttctcgcataagaatatggagctcaatgtttatggcgacgatgtcgaagtggactaccgctcttacgaggtgacagtggaaaacttccttagagtcctcacagggaggatcccgccgtcaactccccgctctaagcgtctgctgtcagacgatcgaagcaacatactgatctacatgacaggacatggaggcaacggattcttaaaattccaagacagcgaggaaatcacaaacattgagttagctgacgccttcgagcagatgtggcagaaaaggcggtacaatgaattgttgttcatcatcgacacatgtcagggggcttccatgtatgagaggttctactcgccaaatatcatggccctggcaagctcacaggtgggagaggattctctcagtcatcagccggaccccgccatcggcgtgcacttgatggaccgctacacgttttacgtgctggagtttctcgaagagatcaatccggcgtcgcaaactaatatgaatgacttattccaggtgtgtcctaaatcactgtgcgtgtcaacccccggccaccgcactgatttgttccagagagaccctaaaaacgtgctcattaccgactttttcgggtccgtccggaaggttgaaataaccactgaaaccataaaacttcagcaggactcagagataatggagtcttcttacaaagaagatcaaatggacgagaaactcatggagcccctaaaatacgcggagcagctgccagtggctcagatcatccaccaaaaaccaaagctcaaagattggcaccctcccggcggatttattctcggtctgtgggcactgatcattatggtattctttaaaacgtatggcatcaaacatatgaagtttattttttag

SEQ ID NO: 128402 - DNA, 960 bp, Artificial Sequence
  Description of Artificial Sequence: Synthetic coding sequence
atggcagtgacggactccttatcaagggctgcaaccgtgttagctacagttctgcttctgtcttttgggtcagttgctgcgtcgcatattgaggaccaggcggaacagttctttagaagcggacacactaataactgggccgtgctcgtgacagtggagaactttctgcgggtgctaactggtagaattcctccttctacaccaaggtcaaagcggctgctgtcggatgaccggtctaatatcctgatctacatgacaggtcacggaggaaacgggtttcttaaattccaggattctgaggaaattacaaatattgagttggctgacgcttttgaacagatgtggcagaagagacggtacaacgagctgctgttcatcatagatacttgccaaggcgcttcaatgtatgagcgcttctatagccctaacatcatggcactagcctctagtcaggtgggcgaagacagcctgtctcatcaaccagaccctgccatcggcgtccacctaatggataggtatacattttatgtgctggaatttctggaggagattaaccctgcctcacaaacaaatatgaacgatttgttccaagtgtgccccaaaagtctgtgtgtgtctactcccggtcaccgtacagatcttttccagagggatcccaaaaatgtgctgattaccgacttttttggatccgttcggaaggtggaaatcacaacagagaccattaagctccaacaagacagtgaaatcatggaatcatcctataaagaagatcagatggacgagaaacttatggagcccctaaagtacgcagaacagttacccgtcgcacaaattatccaccaaaagcccaaacttaaagactggcacccacccggcggcttcatcctcgggctgtgggcccttatcatcatggttttttttaaaacatacggaattaaacatatgaagtttatcttttag

SEQ ID NO: 128403 - DNA, 906 bp, Artificial Sequence
  Description of Artificial Sequence: Synthetic coding sequence
atggcagtcactgacagcctgagccgggcagcaactgttctggccactgttctgctgttgtctttcggttccgtggctgcgagtcatatagaggtcacagtggaaaactttttaagagtcctaactggcagaattccgccttcgacaccacgctctaaacgacttctctcagatgaccgatctaatatcctcatctacatgacaggtcatggcggtaatggcttcctgaagtttcaggacagtgaggagattacgaatatcgagcttgccgacgcgttcgaacagatgtggcagaagcgccgatataatgagctgctgtttataatcgatacatgtcagggcgcatctatgtacgaacgattctatagcccaaacatcatggccctggcctcctcccaggtgggcgaagactctctctctcaccagcccgatcccgcgattggcgtgcacctcatggaccgctatactttctacgtgctggaattcttggaggaaattaatcctgctagccagaccaacatgaacgacctgttccaagtatgtcccaaatccctctgcgtgtcaacacccggccacaggactgacttattccaacgtgaccccaagaatgttctgatcactgacttctttggctctgtccggaaggtcgaaatcaccactgagactattaagctccagcaggacagcgaaattatggaaagctcttataaggaggaccagatggacgagaaactcatggagcccctgaagtatgctgaacagctgcctgtggcccagatcattcaccagaaacctaaactgaaagactggcatccccccggggggttcatccttggactgtgggctctgatcataatggtcttctttaaaacatacgggattaagcacatgaagtttatattttag

SEQ ID NO: 128404 - DNA, 558 bp, Artificial Sequence
  Description of Artificial Sequence: Synthetic coding sequence
atgggaaaaaagcagaataagaaaaaggtggaagaggtcttagaggaagaggaggaggagtacgtcgtggaaaaagtccttgacaggcgcgtggtgaaagggaaagtcgagtatcttctgaagtggaaaggcttctcggacgaggataacacttgggagcctgaggagaacctggattgtccagatctaattgccgaatttctgcagtctcagaaaactgcccatgagacagacaaaagtgaaggaggtaagaggaaagccgacagtgacagcgaggacaaaggagaagagtctaagccaaagaagaagaaggaagagtctgaaaagccaagaggcttcgcccgcgggctggaacctgaacggatcatcggtgccaccgactcctcaggcgagctaatgttccttatgaagtggaagaatagcgacgaggcagatctggtgccagcaaaggaagcaaatgtgaaatgccctcaggtcgtgatcagcttttatgaagagagattgacctggcattcctatccctctgaggacgatgataaaaaggatgacaaaaactag

SEQ ID NO: 128405 - DNA, 735 bp, Artificial Sequence
  Description of Artificial Sequence: Synthetic coding sequence
atggaagctatgtggcttctgtgtgttgcccttgccgtgctggcttggggctttctgtgggtgtgggattcctccgaaaggatgaagtcccgcgaacagggagggagactgggcgcggagtctcggacactcttggtcattgcgcaccccgacgacgaagcaatgttctttgcccccacagttcttggcctcgcgcgcctgcgtcactgggtttatctgctgtgctttagtgcgggtaactactacaatcagggggagacccgtaaaaaagagctcctgcaatcgtgtgacgtgcttggcatccccttatcttcagtgatgattatcgacaatcgggatttcccggacgacccaggcatgcagtgggatacagagcacgtggcaagggtccttctgcagcacattgaggtgaacgggattaatttggtggtgactttcgatgcgggaggagtgtccggccatagcaatcacatagctctttatgccgcggtgcgggtgctgtgcgctcacgccagcgtgtgcgagtgtgcggcccaagtccatctaccatcaggctccgccctggttagcgcctcctacgccggatgtcctctgcgggctcagcagcaaagaagtggtaccgggcaggagagtcatgtcctgcctccacagcccgccccactggttccacccccattacactacctgctgccagtgcatgaaaatcagctcacagaactcccactaaagccctag

SEQ ID NO: 128406 - DNA, 1272 bp, Artificial Sequence
  Description of Artificial Sequence: Synthetic coding sequence
atgggatcaactaagcattggggagagtggctactcaacctgaaggtggcaccagctggggtcttcggtgtcgccttcttggccagagtagctctggtgttctatggcgttttccaggatagaacacttcatgtgcgttacaccgatattgactatcaggtgtttacggatgccgcgcgctttgttactgaaggccggagcccttaccttcgcgcaacgtacagatatacacccctgttaggctggttacttaccccaaatatctacctgagtgagctgttcggcaaatttctgtttatcagctgcgatcttctgactgcctttcttttatatcgacttttactgctcaagggtctggggcggcggcaggcttgcggatattgtgtgttctggctgctcaaccccttgccaatggcagtgtcatcacgcggcaatgcggactctattgtggcctccctggtcctgatggtgttatacctgatcaagaaaaggcttgtggcctgtgcggcagtgttctatggctttgccgtacatatgaagatctacccagtgacatacattcttccaataaccctgcacctacttccagatcgtgataatgacaaaagcctgaggcaatttaggtataccttccaagcatgcctctacgaattgctaaaaagactctgtaatcgcgcagtgcttctgttcgtggctgtggccggactgacgtttttcgccctaagcttcggtttctactacgagtacggctgggaatttttagagcacacctatttttaccacctgactcgtcgtgacattaggcataacttcagcccttacttttacatgctctaccttacagcagaatctaaatggagttttagtctggggatcgctgctttccttcctcaactgatactgctgagcgccgtttccttcgcgtactaccgcgacctagttttctgctgcttccttcacactagtattttcgtgacgttcaacaaggtgtgcacctctcaatattttctctggtatctttgtctgttgcctctcgtaatgcctctcgtaaggatgccctggaagcgggccgttgtgctgttgatgctgtggtttatcggacaggccatgtggctggcccccgcttatgtgcttgaatttcagggaaagaacacgttcctgttcatctggttggctggattatttttcctgctcataaactgttccattttgatccagattatcagccattacaaggaggaacctctgaccgaaagaataaagtacgactag

SEQ ID NO: 128407 - DNA, 2796 bp, Artificial Sequence
  Description of Artificial Sequence: Synthetic coding sequence
atgctgcttttctttacgttggggctgctgatccattttgtttttttcgcatccatttttgacatttattttacctccccccttgtacacggcatgacaccccaattcaccccactgcccccacccgctagacggctggtgttgttcgtggctgatggtctccgtgccgatgcactgtatgaactggatgaaaacgggaactcccgagccccctttatccgcaatattatcatgcacgagggctcgtggggaatctcccacacccgggtgcctacagagagccgaccaggtcatgtggcccttatcgccggattttatgaagacgtctctgccgtggccaaggggtggaaagaaaatcccgtcgagttcgactccctattcaatgaaagcaagtatacatggtcttggggctctcctgacatactgcccatgtttgccaagggcgccagcggggaccacgtgtacacttattcctatgatgccaagcgcgaagactttggtgcccaagacgccactaagctggacacatgggtgttcgataatgttaaggactttttccaccatgcacggaataaccagtctctattttcaaagattaatgaagagaagatagtttttttcctccacctactgggtattgatacaaacggacacgcgcataggccctctagccgtgactacaaacataacatcaaaaaggtcgatgacggagtaaaggaaattgtgagtatgttcaatcatttttacggcaatgacggtaagactacgtttatcttcacctccgatcatggtatgactgattgggggtcacatggggcaggccacccatctgagaccctgacacctctcgtgacctggggcgccggtatcaagtatcctcagcgcgtgtcagctcaacaattcgacgacgcctttcttaaggagtggaggctggaaaattggaagcgcttggacgtgaaccaagcggacattgcccctctgatgacaagtctaatcggcgtccctttccctttaaactcagtcggcattctacctgtcgactatttaaacaatacagacctgttcaaagcagaatccatgtttacaaacgccgtgcaaatcctggagcagttcaaagtcaaaatgacccagaagaaagaggtaaccctgccatttctgttcacaccatttaagctgttgtcagattcgaagcaatttaatattttaagaaaggctcgctcgtacatcaagcatcgcaagtttgatgaagttgtgtctctctgcaaagaacttatacatctggccctgaaggggctttcctactaccatacctacgatcggttctttctgggggtaaacgtggttatcgggttcgtcggctggatttcctatgccagtctgctaatcataaaaagccactccaacctcatcaagggtgtctcaaaagaggtcaaaaaaccttcccatctgctcccgtgttcttttgtcgctattgggattctcgtggctttcttcttgctgattcaagcttgcccatggacatactatgtgtatggcctgttgcctctaccgatctggtacgcagtcctgcgtgagtttcaggtcattcaggatcttgtggtctcggtattaacctatcccctgtcccactttgtcggctatctgctcgctttcacactgggaattgaggtgttagtgctgagttttttctatcggtatatgctgacagcaggtctaacggcctttgctgcttggccctttctgacacgtctttggacgagagccaagatgacctccctgtcatggacattcttttcactgctgctggcagtgtttccgctcatgcctgtagttggacggaagccagatatctctctggtaatgggagcaggcctccttgtcctacttctgagcctctgtgtcgtgacaagcctgatgaaacggaaggactcgttcattaaagaggagctgctcgtgcacctgcttcaagtcctcagcacggttctcagcatgtatgtggtctactcaacacaaagtagtctccttaggaagcaggggctgcctttgatgaaccagatcatctcttgggccacgctggcctcttcactggtagtccctctgctgagcagcccagtactgttccagcggctgttcagcatcttgctgagcctgatgtcaacttatctcctgcttagcacaggctatgaggcactgttcccactggttctgagctgcctgatgttcgtgtggatcaatattgagcaggaaacccttcagcagtcgggtgtttgctgtaaacagaaattgacatccattcagttctcctataatactgacataacccagtttagacagctgtaccttgacgacatccgaagggcgttttttttggtcttctttctggttacagcgttctttgggactgggaacatcgcgagcatcaactcctttgatctggcgtccgtctactgcttcctcacggttttttctccttttatgatgggggctctaatgatgtggaagattctgattccattcgtcctcgtaatgtgcgcgttcgaggcagtccaactgaccactcagctgtcatccaaaagtctcttcctgattgtgctggttatctccgacataatggcattgcattttttctttcttgtgaaggactacggatcttggctggacatcggcacttccatcagccactacgtgatcgtaatgagcatgactatctttctggtctttctgaacggactagcccagctcttgacgactaaaaaactcagactgtgcggcaaacctaagtcacactttatgtag

SEQ ID NO: 128408 - DNA, 2796 bp, Artificial Sequence
  Description of Artificial Sequence: Synthetic coding sequence
atgttactattctttaccctgggacttctgatccacttcgtcttctttgcctccattttcgacatctatttcacctcgccactggttcacggcatgacgccgcagtttactccactgcccccaccagcacgtagactggttctgtttgttgctgatggcctgcgcgccgacgcattgtatgagctcgacgagaatggcaatagccgcgccccatttattaggaatatcataatgcacgagggcagttgggggatcagtcatactagagtgcctactgagagccgcccaggccacgtggccctcatagcaggtttctacgaagatgtctctgcagtagcaaaggggtggaaggaaaaccctgttgagttcgactccctgttcaatgagtctaaatatacctggtcctgggggtcaccagatatcctgccaatgttcgcgaaaggcgcaagcggggaccatgtgtacacttattcctatgatgccaagcgggaggactttggggctcaggacgcaacaaagctggacacatgggtgtttgataatgtgaaggatttctttcatcatgcccgaaacaaccagtctctcttttccaagatcaatgaggaaaaaatcgtcttcttccttcacctgctgggcatcgataccaatggccatgcacacagacccagtagtcgggactataaacacaacattaaaaaggtggacgatggagttaaggagattgtctccatgtttaaccacttctacggtaatgatgggaaaacaacttttatcttcacatctgaccacggcatgaccgattggggcagtcatggcgctggccatccatcagaaacattgaccccactggtgacatggggagccgggatcaaatatcctcagcgcgtgagtgcccagcagtttgatgatgcgtttctgaaggagtggcgactcgagaactggaagagactggatgtgaaccaggcggatatcgctcccctgatgacatcactgattggtgtgccgttcccactgaactcagtggggatactccccgtagattatctcaataatacagatctctttaaagccgagagcatgttcaccaacgcagtgcaaatcctcgagcagtttaaagttaagatgacacaaaaaaaggaggtcaccttgccatttctctttacgccctttaaattgctgagtgactcgaagcagtttaacatcctccggaaagccaggtcttacattaagcatcggaaattcgatgaagtggtgagtctgtgtaaagagcttatccaccttgcccttaaggggctcagttactatcatacctacgataggttcttcctcggggttaatgttgtaattgggttcgttggatggatcagttacgcctccctgctcatcattaagagtcactcaaacctgattaagggcgtttccaaggaagttaaaaaaccttctcacctgctcccctgtagcttcgtcgctattggcatcctggtggccttcttcctgctgatccaggcgtgcccgtggacctattatgtttacgggctgttacctcttcccatatggtacgcagtccttcgcgaatttcaggtgattcaagatttggttgtgagcgtgctgacttatcccttatctcatttcgtggggtacctgctggctttcacgctgggtattgaggtgcttgttctgtcatttttttatcgttacatgcttacagccggccttacagcctttgccgcatggccctttctgactcgcttgtggacccgagcaaaaatgacttctctgagctggacattcttctctcttttgctggcagtgttccccctgatgccggtagtggggaggaagcctgacatttcgctcgtcatgggcgctggtcttcttgtgcttctcctctctctctgcgtcgttacctccctgatgaaacggaaggatagtttcatcaaggaggagctgctggtgcatctcttgcaggtcctgtctacggtgctgagcatgtacgttgtgtacagcacacagagctcccttcttagaaagcaggggttaccacttatgaatcagatcataagttgggccacactggcatcatctctcgtggttccgctcctgagcagtcctgtacttttccaacgcctcttctcaatcctactctccctgatgagcacttatctgttgctgagcacaggctacgaggccctcttccctctcgtactgagctgtctgatgttcgtctggatcaatatcgagcaagagactctgcagcagagtggcgtgtgctgcaagcagaaactgacgagtatccaattttcatataacactgacattacccagtttcgccagctctacctggatgacattagacgggcctttttcctagtgttttttctggtcaccgctttcttcggaacaggaaacatcgcttcaataaactcgtttgacttggccagcgtgtattgttttctgacagtgttttcaccctttatgatgggtgcgcttatgatgtggaagatcctgattcctttcgtgctagtgatgtgtgccttcgaggctgttcagctgacgacgcagctctcttccaagtctctttttctgatcgtgttggtaatttccgacataatggctctgcatttttttttcctcgtcaaagactacggatcatggttggacatcggaacgtccatatcacattatgttatcgtcatgtctatgacaatttttctggtgttccttaacggcctcgcacagttgctcacaaccaaaaagctcaggctgtgcggcaagccaaagagccatttcatgtag

SEQ ID NO: 128409 - DNA, 405 bp, Artificial Sequence
  Description of Artificial Sequence: Synthetic coding sequence
atggtggagaacagccccagcccgctgccagaaagggctatttatggcttcgttttgttcctctcatctcagttcggcttcatactgtatctggtgtgggcatttatacccgaatcgtggttgaattcactgggccttacctactggcctcagaagtattgggctgtggccctcccagtgtatttgctaatagccatcgtgatcggttacgtgctgctcttcggcattaatatgatgtcaaccagcccactcgatagcattcacactataaccgacaattatgccaagaatcagcagcaaaagaagtaccaggaggaggccatccctgcactgcgcgatatctcaatttccgaggtcaatcagatgtttttccttgcagcaaaggagctgtacactaagaactag

SEQ ID NO: 128410 - DNA, 327 bp, Artificial Sequence
  Description of Artificial Sequence: Synthetic coding sequence
atggtcctgtatcttgtgtgggccttcatccctgagtcgtggctcaactcactcgggttgacgtattggcctcagaaatattgggccgttgccctgcccgtctacctgctgatcgccatcgtgattggttacgtgctcctattcggcatcaatatgatgtctacgtctcccttggattctatccacaccataaccgacaattacgccaagaatcagcaacagaagaagtaccaagaagaagcgatcccggccctccgcgacatttccatatcggaggtgaaccagatgttcttcctggccgcaaaggaactatacaccaagaactag

SEQ ID NO: 128411 - DNA, 405 bp, Artificial Sequence
  Description of Artificial Sequence: Synthetic coding sequence
atggtggagaactcccctagcccactgcctgaaagggctatctacggatttgttctgttcctgagtagtcagtttgggttcatcttgtaccttgtctgggccttcatccccgagtcctggcttaacagcctggggttgacgtactggccccagaagtactgggctgtggccctcccagtgtacctactaatcgcgatcgtgatcggttacgtacttttattcggaatcaatatgatgagtacctctccccttgactcgattcacacgattacggataactacgctaagaaccagcaacaaaagaagtaccaggaggaggccataccagcgcttcgggacatcagcatttctgaggtgaatcaaatgttcttcctcgctgcaaaggaactctataccaagaattag

SEQ ID NO: 128412 - DNA, 405 bp, Artificial Sequence
  Description of Artificial Sequence: Synthetic coding sequence
atggtggaaaacagtccatccccccttccagagagggcaatctatggatttgtgttgttcctcagcagccaattcgggttcattctttatctggtatgggcctttattcccgagtcgtggctaaattcacttgggttaacctactggccgcagaaatactgggccgttgccctccctgtgtatctcttgatcgccatcgtgattgggtatgtactcctttttggaattaacatgatgtctacaagccctctggacagcattcacaccatcacagataattatgccaaaaaccagcaacagaagaagtatcaggaagaggcaatcccagcacttcgggacatctccatttccgaagtgaatcagatgttctttctggcagccaaagaactatacactaaaaactag

SEQ ID NO: 128413 - DNA, 78 bp, Artificial Sequence
  Description of Artificial Sequence: Synthetic coding sequence
atggtgctgtatctggtatgggccttcattccagagtcgtggctcaattctttgggccttacctactggccacagtag

SEQ ID NO: 128414 - DNA, 477 bp, Artificial Sequence
  Description of Artificial Sequence: Synthetic coding sequence
atggtgccccgatcgaccagcctggccttgatcgtgttcctctttcaccggttgagtaaggcgcccggaaagatggttgaaaattctccaagtccactgcctgaacgggcaatatacgggttcgtactgtttcttagctcccagtttgggttcattctgtacctggtctgggcattcattcctgaaagctggcttaacagtctcggactcacatattggccgcaaaaatactgggcggtggctctacccgtgtacctacttatagccatagtgattggctacgtactcctgttcggcattaatatgatgtcaacctcccccctcgattctatccacacaataacagataattatgccaagaaccagcagcagaagaagtatcaggaagaggccatcccagccctgagagatatctcgatttccgaggtcaaccaaatgttctttctggcagctaaagagctttacacaaagaactag

SEQ ID NO: 128415 - DNA, 1848 bp, Artificial Sequence
  Description of Artificial Sequence: Synthetic coding sequence
atggcgcgagcgtgtctgattcaaaggctgcctatcaaaagagactgtacgcctgtcttcgtaagaggtctgtcatctccaagtgcagccatggcactgctgagtgaaggcctggatgaagtccctgccgcgtgcctgtcgccttgtggtcccccaaatccaacagaattattctcagagagcaggagactggctctggaggagctggttgccggtggacccgaggcatttgctgccttcctgcggcgggaacgacttgcccgttttttaaatcctgatgaggttcatgcaatattaagggcagcggagcggccaggtgaagagggagctgccgccgcagcggcagcagaagattctttcggtagttcccacgactgcagcagcgggacctatttccctgagcagtccgacttggaaccccctttgctggaactggggtggcctgcattttaccagggcgcttaccgtggagcgacaagagtcgagacccattttcagcctaggggtgcaggcgagggggggccatacggctgtaaagatgccctcagacaacagctccggagtgctagagaggttattgctgtcgtgatggatgtgtttaccgacattgatattttccgtgatctccaagaaatttgccgcaagcagggggttgccgtttatatactgctcgaccaagcgctgctctctcagtttcttgatatgtgtatggacctgaaggtacacccagagcaggaaaagttgatgaccgtgcgcactatcaccggaaacatctactacgcccgtagcgggaccaagatcattggcaaagtgcacgagaagtttaccctgattgacggcatccgggttgcgaccggatcatacagctttacatggacagatggcaagctcaactcctcaaatctggtaatcctgagcgggcaggtggtggagcactttgatctcgagtttaggatactgtacgctcagtcaaagccgatctccccaaaactcctttcccacttccaatcatctaataaatttgatcacctgactaacaggaaaccccagagcaaggaactgacacttggcaacctgctgcgcatgcgtctggctaggttaagctcaaccccccgaaaggctgacctagacccagagatgcccgcagaaggaaaggctgagaggaagccgcacgactgtgagagttccactgtgagcgaggaagactatttttcatcacacagggatgagttgcagtccaggaaggcaatcgacgcggcaacccagacggaacccggcgaggaaatgcctggcctcagcgtcagtgaagtcggcacacagacaagtatcaccaccgcatgtgctggcacacagaccgctgtgatcacccgcattgcctcaagtcagacaactatctggtctcgttccaccacaacacagaccgacatggacgagaacattctgtttcctcgaggcactcagtctaccgaggggagtccagtgagcaaaatgtcagtctctcggtcatctagcctgaagagcagcagctcggtgagttcgcaaggctctgttgcatcaagtaccggatcaccggctagcatccgtaccacagatttccataatcccggctatccaaagtacttaggaacaccccacctggagctctatctttctgacagcttgcggaacctaaataaagaaaggcagttccattttgcaggtattcggagccgacttaatcacatgttagcaatgctttctcgacggacattatttaccgaaaaccacctgggcctgcactccggcaatttttccagagtgaatctgttggcagtgagggatgtggccctgtatcccagctaccaatag

SEQ ID NO: 128416 - DNA, 1248 bp, Artificial Sequence
  Description of Artificial Sequence: Synthetic coding sequence
atggccgctcctctggtactcgttctagtggtggcagtaacggtcagggcagccctgttccggagctctctcgccgaattcatctccgaaagagtcgaagtggtgagcccactgtcttcctggaagcgggtagttgaaggactcagtcttctggaccttggcgtgagcccatatagcggagcagtcttccatgagatcactgacgccctgactgccatcgctctgtacttcgcaatccaggacttcaacaaggtggtgttcaagaagcagaagctgctactggagctcgaccagtacgccccggacgtggcagagcttattcggacaccaatggaaatgaggtatatccccctcaaagtggcattattttatctactgaatccctacacaattttgtcttgcgtggctaagtctacatgtgcaatcaacaacactctaatcgcattctttatcctgacaaccatcaagggctcagccttcttatcagccattttcctggctctggctacatatcagtctctgtaccctctgaccctgttcgtgcctggtcttctctacttgttgcagcgccaatatattcctgtaaagatgaaatccaaggccttttggatcttttcctgggaatacgctatgatgtacgtgggatccctcgtcgttatcatttgcttgagcttctttctgttgagtagttgggactttattccagctgtctatggctttattcttagtgtgcctgatctcacacctaatatcgggctattctggtatttctttgctgagatgtttgagcactttagtctgttttttgtttgcgtgttccagattaatgtctttttttacacaatccctttggctatcaaactcaaggagcaccctattttttttatgttcatccagatcgcggtgatcgccattttcaaatcctacccaactgttggtgatgttgcgctatacatggccttttttcctgtgtggaatcacctgtataggttcttgagaaacattttcgtcctaacatgtataataatcgtttgttccctcttgtttcctgtgctctggcacctctggatctacgccggatccgctaatagcaatttcttttatgccatcacactgacgtttaatgtcggtcagattcttctgatcagtgactacttctatgcgttcctccgtcgggagtattatctcactcacggtctgtacctaacagccaaagatggcactgaggctatgcttgtcctcaaatag

SEQ ID NO: 128417 - DNA, 513 bp, Artificial Sequence
  Description of Artificial Sequence: Synthetic coding sequence
gtatctgtccccacacatttagtttgtcctcggacaccccttagtcccccagccgccgtgcacacctgcgagaacgaggagcagtccttgctagacttatttctcggagtctgtcatgacattaacgtcttcttttacaccattccactggcgattaagcttaaggagcatcccatattcttcatgttcatccagatcgccgtaattgctatattcaagtcttatcctacagttggtgacgtcgctttgtacatggccttcttcccagtgtggaaccatctttatcgttttctcagaaacatcttcgtgctcacttgtatcattatcgtctgctcacttctctttccagtactgtggcatctgtggatttatgcagggtcagcaaattcaaattttttctacgccattaccctgacattcaacgtgggacagatactcctgattagcgactacttctatgccttcctgcgcagggaatactacctgacccacggcctctatctcactgcctag

SEQ ID NO: 128418 - DNA, 1272 bp, Artificial Sequence
  Description of Artificial Sequence: Synthetic coding sequence
atggcagcacccctggtgctggtgttagttgttgcagtgaccgttcgcgctgctctattccggtccagtctcgctgaattcatcagtgagagggtggaggtagtttcgcccctatccagctggaagagagttgtggagggcctttccctgcttgatctaggcgtttcaccatactccggggcggttttccatgagactccactgatcatatatcttttccacttcctaattgactacgctgagcttgttttcatgataactgatgcattgacggctatagccctgtattttgccattcaggattttaacaaagtcgtgtttaagaaacaaaagcttttgctggaacttgatcagtacgcgcccgatgtggcagagctaattaggaccccaatggagatgcgctatattcccctgaaagtagcactcttttaccttctgaatccgtacaccatcctgtcctgcgtggccaaatctacttgtgccattaataataccctaatcgcattcttcattctaacaaccatcaaggggtctgcttttctttctgccatcttcctggctctcgccacataccaaagtctctacccactgacactatttgtgcctgggttgttgtatctgctccagaggcagtacatcccagtgaagatgaagtccaaggcattctggattttcagctgggagtatgccatgatgtacgttggctctctggtggtcatcatatgtttgtccttcttcttgctctcatcatgggactttatccccgccgtctacggtttcatcttgtcagtaccagatctaacccctaatattggactcttctggtacttttttgccgagatgtttgagcatttcagcttgttctttgtttgtgtctttcagatcaacgtgtttttttacaccatccccctagccattaagcttaaggagcaccccatattcttcatgttcatccaaattgccgtgattgctattttcaaatcatatcctacagtcggcgacgtcgccctgtatatggcctttttccctgtctggaaccacttatacagatttctgcgcaatatatttgtgctcacatgcatcataatcgtgtgttctctattgttccccgttctttggcacctttggatttacgctggtagtgccaattctaacttcttttacgcgattaccttaacctttaacgtggggcagatgggcttctgcggagatcgaatggctggaacctgtcctgaggccatccgggcggcaggcgaccgaactccatcatag

SEQ ID NO: 128419 - DNA, 1482 bp, Artificial Sequence
  Description of Artificial Sequence: Synthetic coding sequence
atgtggccccaggacccttctcgcaaggaggttcttcggttcgccgtgtcatgtaggatcctgacattaatgctccaggctctcttcaacgctataatcccagaccatcatgcagaggccttttctcctcctcggctggccccatcggggtttgtcgaccagctggtggaaggcctgctgggggggctctctcattgggatgccgagcattttcttttcatcgctgagcacggctacctgtatgagcacaattttgccttttttcctggatttcctttggctttactggtcggtacggagctgcttaggcccctgcgcggactcttaagcctgcgctcttgcctcctgatttctgtagcaagtctgaacttcctgttttttatgcttgcggccgtagccctacacgaccttgggtgtcttgtgctgcattgccctcaccagtcattctatgccgctctgctgttctgtctgagtcccgcaaatgtgttcctggccgctggatattctgaagccctgtttgctttgttaactttttccgccatggggcaattggaacgcggccgtgtgtggactagcgtgttgctgttcgcattcgctacaggcgttagatctaacgggcttgtctcggtgggattccttatgcattcccaatgtcagggctttttctcatcactgacaatgctgaaccccctcagacaactattcaagttaatggccagtctctttttgtcggtgttcacccttgggctccccttcgccttgtttcaatactatgcctacacccagttttgtctgccaggatctgcgcgcccaattccagaaccactggtgcagctcgccgtggataagggttaccgcatcgcggagggcaacgaacccccttggtgtttctgggatgtgcccttgatctattcatatatccaggacgtttattggaacgtcggtttcctcaaatattacgagttgaaacaggttcctaatttcctgctcgccgcccctgtcgcaatcctggtagcctgggcgacatggacatacgtcaccacccatccttggctgtgcctgacactcggactgcagcgcagtaagaacaataaaacccttgagaagcccgatttgggattcctttccccgcaagtgtttgtgtacgttgtgcacgcggcagtgctactcctgttcggagggctttgcatgcacgttcaggtattgactcgctttctggggagtagtactccaattatgtactggttccccgctcacctgctgcaggaccaggagccactcttgaggtctcttaagaccgtcccttggaagccgttagcagaggactcacctcccggccagaaagtcccaagaaaccctataatgggtctgttgtatcactggaagacatgttcccctgtgactcggtacatcctgggttatttcctgacgtactggctgttaggtctcctgttgcattgcaatttcctgccatggacttag

SEQ ID NO: 128420 - DNA, 1482 bp, Artificial Sequence
  Description of Artificial Sequence: Synthetic coding sequence
atgtggcctcaggatccatctagaaaagaggtgctgaggttcgctgtttcctgtcggatcctcactctaatgctgcaggccctgttcaatgccatcattcccgaccaccacgctgaagccttctctccaccccgtttagcacccagtggatttgtggatcagctggtcgaggggcttcttggcgggctgagtcactgggacgccgaacacttcctcttcatagccgagcatggatatttgtacgaacacaacttcgctttctttccaggattccccctggcactcttggtcgggactgaactgttaagaccacttcgcggattgctgtctctgcggtcttgtctactgatatcagtagcatcccttaattttcttttttttatgttagcagcagtcgcactccacgacctggggtgtctggtcctccactgccctcaccagtccttctatgccgcactactcttttgcctatctcccgcaaatgtgtttctggccgcggggtattccgaggctctatttgcactgctaactttttcagcaatgggtcagctggaacgtggcagggtatggacctctgtcctattgtttgcttttgccaccggcgttagatcaaatggactggttagcgtaggtttcctgatgcattcacagtgtcagggcttttttagtagcctgacaatgttgaacccgctgcgacaattatttaaactgatggcctccctgtttctgtccgtctttacactgggcttgccattcgccttgttccagtactacgcttacactcagttctgcctgccaggttccgcccggccaattcctgaacctcttgtgcagttggctgtcgataagggatatagaattgccgaaggaaatgaacctccatggtgcttttgggacgtgcccctgatatattcttatatccaagacgtatattggaatgtcggcttcctcaagtattacgagctgaagcaggtgcccaatttcctgctcgccgctcctgtcgccattctcgttgcctgggctacatggacatacgtgacgacacacccatggttgtgtctcactctggggcttcagcgctcaaagaacaataaaaccctagagaaaccagatttgggtttcctctcccctcaggttttcgtctacgttgtccacgccgctgtccttctgctgttcgggggcctgtgtatgcacgtgcaggtgctgactcgattcctcggtagttccacaccaattatgtattggtttcccgcccaccttctccaggatcaggagccactcctccggtccctgaaaaccgtcccatggaagcctctggctgaggattcccctccgggacaaaaagtgcctcgaaatcccatcatgggcctgctataccactggaaaacatgtagccctgtcaccagatacatactggggtacttcctcacctattggcttttgggtctactgctgcattgtaactttctgccttggacgtag

SEQ ID NO: 128421 - DNA, 219 bp, Artificial Sequence
  Description of Artificial Sequence: Synthetic coding sequence
atgtggccacaggatccatctaggaaggaagtactgcggttcgcagtctcttgtagaatcttgactctgatgttacaggcgttgtttaatgccataattcccgaccaccatgctgaggctttttccccaccacgccttgctccttcaggcttcgtggatcagcttgttgaaggcttattagggggcctgtcccactgggatgccgagcacttcttgtag

SEQ ID NO: 128422 - DNA, 366 bp, Artificial Sequence
  Description of Artificial Sequence: Synthetic coding sequence
atgtggccgcaggatccatcgagaaaagaggtgttgaggttcgcagttagctgccgtattctcaccctaatgctccaagcgctgtttaacgctataattcccgatcatcatgcagaggccttctctccgccgcgcctggctcccagtggcttcgtcgatcaactggtggagggcctgctcgggggcctaagccactgggacgcagaacacttcttgtttatcgcagaacacgggtacttatacgagcataactttgcgtttttccccggatttcccctggcactgcttgtggggacagaacttctcaggccgttgagagggctgctgtcactgcgaagctgcctgctcatcagtgtggcatcatag

SEQ ID NO: 128423 - DNA, 798 bp, Artificial Sequence
  Description of Artificial Sequence: Synthetic coding sequence
atgccatcttcacagatcacaatgcagaaaccgtctctgctgctggcatggccacctcaggccctgtggaccaactcatggaaatattacgcttacactcagttttgtctgccaggcagcgcccgtccaattcctgagccgctcgtacagctcgctgttgacaagggctataggatagcagagggtaatgagcccccatggtgtttttgggatgtcccattaatttatagttacatccaggacgtgtactggaatgttggattccttaagtactacgaactgaagcaggtgcctaactttcttttagcagcccctgtagcgatcttggtagcttgggctacctggacatacgtcacaacccacccgtggttatgtctgaccctgggcctgcaaagatcgaagaacaacaagactcttgaaaaacctgacctgggtttcctgagcccccaagtcttcgtttatgtggtgcatgcggctgtgctgctgcttttcggaggactttgtatgcatgtgcaggtcctcacccgattcctcgggagctccaccccaattatgtactggtttcccgctcatcttttgcaagaccaggaacctctcctaagatcgctgaagacagtgccgtggaagcccctagcagaggattccccacctggccagaaggtccccaggaaccctattatggggctgctgtatcattggaagacatgttccccagtaacacgttacattctgggctactttctgacatactggcttcttggactgctgcttcactgtaattttcttccttggacttag

SEQ ID NO: 128424 - DNA, 549 bp, Artificial Sequence
  Description of Artificial Sequence: Synthetic coding sequence
atgtggccccaggatccttctagaaaggaggtactgaggttcgcagtcagctgtcgaattttgacattaatgctgcaggccctgttcaacgccattattccagatcaccacgccgaggcttttagccctccgcggttggccccctctggctttgtggaccaattggtcgaaggcctcctcggaggactgtcccactgggatgcagagcacttcctttttatcgccgagcacggctatctgtacgagcacaattttgccttctttcctgggttccctcttgccctgcttgtgggcacagagctgctaagaccactccggggtctgctgtctctccgaagttgtttgctgataagcgtcgcatcactaaatttcctgttctttatgctggccgcagttgccctgcacgacctcgggtgcctggtattgcactgtccccatcagagcttctacgccgccttactcttttgcttatctcccgccaacgtattccttgccgcaggatacagcgaggcgctatttgccctgttgacctttagtgcaatggggtag

SEQ ID NO: 128425 - DNA, 1515 bp, Artificial Sequence
  Description of Artificial Sequence: Synthetic coding sequence
atgtcagagaagcagatgaaggaagctttcgtgagcaacctgaatgggacgactgtattagagatcacccagggtttgtgttttcccgccttttgtatcctgtgcagggggtttctgatcatcttctcgcagtatctttgttcctttagcccgacatggaaaaccagatttctaacagattttgtggtgctcatcgttccaatggtggccacactgacaatttgggcctcgttcatcctgctggagttgctcggtgtgattattttcggcgcggggctcctgtaccagatctacagacgcaggacgtgctatgcacgtctccctttcctgaaaattctcgaaaagtttctgaacataagcctagagtcagagtataatccggctattagctgcttccgggtcatcacctccgccttcaccgcaatcgcgatcctcgccgtggactttccgctctttcctagacgcttcgccaagactgaactgtacggcaccggtgctatggatttcggtgtcgggggattcgtctttgggtcagccatggtgtgcctcgaagtacgccgccgtaaatacatggagggttcgaaactccactactttactaactctctttatagcgtttggcccctcgtgtttttgggtatcggcagactggcaatcataaagtcgattggataccaggagcatttgactgaatacggtgtgcattggaactttttcttcacaatcattgtagttaaacttatcacgccccttctgttaatcatctttcctctcaataaatcttggatcatcgctttgggcattacagtactataccagttggcattggattttactagcctcaagagacttattctctatggtaccgacgggtcggggacaagggtgggactcctgaacgccaacagagaagggattatttcaactctgggttacgtcgccatccatatggcgggggttcaaacgggactgtatatgcacaagaaccggagccacatcaaggaccttatcaaggtggcgtgtttcctacttcttgccgccattagtctgtttatcagtttatatgtcgtgcaggtgaatgtcgaggcagtgtctaggcggatggccaatttagcattttgcatttggatcgtcgcctccagcctgatcttgttgtcctccctcctgctgggcgacatcatcttgtctttcgctaagttcctgattaaaggggctttagtcccatgctcctggaaactcatacagagccccgtcaccaataaaaaacactcagaatcactcgtcccagaggctgagcgcatggagccctcactgtgtctgatcactgctctcaaccggaagcagctcatattcttccttctctctaatattacgacaggcctcatcaaccttatggtggatacgctgcattccagtacgttgtgggctctgtttgtggttaacctgtacatgtttagcaactgtttgatcgtatatgtcctttacctccaggacaagaccgttcagttttggtag

SEQ ID NO: 128426 - DNA, 318 bp, Artificial Sequence
  Description of Artificial Sequence: Synthetic coding sequence
atgagcgagaaacagatgaaggaagcctttgtgagcaacctgaacgggacgactgttctggagataacccaaggcctgtgttttccagcattttgcattctctgtcggggcttcctgattattttctcccagtacctgtgctccttcagccccacgtggaaaacccggtttcttactgatttcgtggtcctgatcgtaccaatggtcgcaacactgaccatttgggcgtcttttatattgctggagcttctcggtgtcataatattcggggctggcctgctgtaccaaatctaccgaaggaggacgtgctacgcatag

SEQ ID NO: 128427 - DNA, 831 bp, Artificial Sequence
  Description of Artificial Sequence: Synthetic coding sequence
cttgcagcccgagtggctgccgtccgcgctgccgcctggctcctgcttggtgccgccacgggcctaaccaggggcccagccgctgcattcaccgccgcaagatcagatgcagggatccgagcaatgtgttccgagataattctgcggcaggaagtgctgaaggatggcttccacagggacctcctcataaaggtcaaatttggtgaatctattgaggacctccatacttgtcgcttattgatcaagcaggacatccctgctggcctctacgtggatccctacgagctcgcctcattgcgtgaacgcaatatcacagaggccgtcatggtgtctgagaattttgacattgaagctcccaattacctgtctaaggagtccgaagtactgatttatgccaggagggactcccagtgcattgattgtttccaggcgttcctgccagttcattgcagatatcaccgtccccactcagaggacggagaggctagcatagtcgtcaataaccctgacctgcttatgttttgcgaccaggcgggcagccgacgtatgattagatttcgtttcgattcttttgataagactattgaatttccaattctcaagtgctgggcacactctgaagtcgcggccccgtgcgcactggagaacgaggatatatgtcaatggaacaagatgaaatacaagtcggtatacaagaatgtcatcttgcaggtgcccgtcggactcacggtgcacacctctcttgtctgttctgtcactcttctgattacaattttgtgctcaactttaatcttagtggccgttttcaaatatggacatttcagcctgtag

SEQ ID NO: 128428 - DNA, 654 bp, Artificial Sequence
  Description of Artificial Sequence: Synthetic coding sequence
atgtgctccgagatcattctacgtcaggaggtgctgaaagacggattccaccgggatttactcatcaaggtcaagtttggggagagcatcgaagacctgcacacatgtagactgttgatcaaacaggatataccagccggactgtacgtcgacccttacgagctagctagcctgcgtgagagaaatattacagaggctgttatggtctcagaaaacttcgacatagaggccccaaattacctgtccaaggagagcgaagttctgatttacgcccgacgcgattctcagtgcattgattgcttccaggccttcctccctgtgcactgccgttaccaccggccccactccgaagacggtgaggcaagtatcgtggtcaacaatccagatcttctgatgttttgcgaccaggagttcccaattctgaagtgttgggcgcacagcgaagtggccgccccttgcgcactcgaaaacgaagacatttgtcagtggaacaagatgaaatataagtcagtttataaaaatgtaatattgcaagtgccagtcggtcttacggtacacacaagtttagtttgttcagtgactctcctgatcaccatactctgtagcaccctcattttggtcgcggtgttcaagtatggccactttagcctatag

SEQ ID NO: 128429 - DNA, 777 bp, Artificial Sequence
  Description of Artificial Sequence: Synthetic coding sequence
ctggcagcccgcgtggcggccgtacgggcagccgcttggcttctgctgggcgctgcgactgggctgacgagggggccagctgccgccttcactgcagctagatccgacgccggtatcagggctatgtgctcagagattatcctacggcaggaggttctgaaagatggtttccacagggacctgctcattaaggtcaaattcggggaatccatagaagacctccacacatgccgcctgcttattaaacaggatatcccggcgggattgtatgtcgacccatatgaattggcctccctgcgagagcggaacatcacggaggccgtgatggtgagcgagaacttcgacatcgaggctccaaactatctgagcaaggagagcgaagtgctaatatatgccaggagagattctcagtgtatagattgctttcaggccttcttaccagtgcactgcaggtaccatcgccctcacagtgaagatggggaggctagcattgtggtgaacaaccccgacttgctcatgttctgcgatcaggaatttccaattctaaaatgctgggctcacagcgaagtcgcggccccctgcgcattggagaacgaggacatttgtcagtggaataaaatgaagtataaatcagtgtacaagaatgtcatactgcaggtacctgtaggattaaccgtgcacacatcccttgtgtgttcagtaacactgctgattactatattgtgttccactcttatcttagtggccgtgtttaagtacggacacttctctctttag

SEQ ID NO: 128430 - DNA, 507 bp, Artificial Sequence
  Description of Artificial Sequence: Synthetic coding sequence
atggtttcagagaactttgatatcgaagccccgaactacctcagtaaagagtcagaggtgctcatctacgcacgtcgggatagccagtgcatcgactgtttccaagcctttttgcctgttcactgtagataccaccggccccatagcgaggatggggaggcctctatcgttgtaaataacccggatctcctaatgttttgtgaccaggcaggcagtcgccgaatgattcggtttagattcgattcttttgataaaaccatcgaattcccgattcttaaatgctgggcacactctgaagtcgccgccccatgcgcactagaaaatgaggacatctgtcagtggaataagatgaagtataagtccgtatataaaaatgtaatcttgcaggtgcctgtgggcctcactgtgcacacttcactggtatgcagtgtgaccctgctgataacaatcctgtgcagcaccttgatcctggtagctgtattcaagtacgggcacttctctctgtag

SEQ ID NO: 128431 - DNA, 1740 bp, Artificial Sequence
  Description of Artificial Sequence: Synthetic coding sequence
atgcagatatgtggctctagtgtcgcgagcgtggcggccggtacctcttttcaggtgctaggtcctgtgtgctggcaacaactggatctgaagatggccgttagagtgctgtggggggggttatccctactgagagtattgtggtgtcttctgccacagacagggtacgtgcacccagacgagtttttccagagccccgaagttatggccgaagacatactgggagtgcaagcggcccgtccatgggaattttacccttcatccagttgcagaagcgtgctcttccctctgctgatctctggcagtacgttctggctgctccgactgtgggaggagcttggaccatggcctggattggtgagtgggtatgctcttctggtggggccacgactccttctaacggccctgagtttcgccctggatggggctgtttaccacctggccccccctatgggagcggaccggtggaatgctctcgccctcctatccgggtcttatgtcactctggtgttttataccaggacatttagtaatactatcgagggcttactgtttacttggttgcttgtgttagtgtcgtcccacgtcacttgggggcctactaggaaagagcccgcaccaggtcccaggtggcgctcctggctgctgggaggaattgtagccgccggattttttaacaggccaacatttctggcttttgcagttgtgcccctctacctctggggcacccggggagccaccaacccaggattaaagagcttaactagggaggccttggtgttactccccggtgccgcgctgactgcagccgtcttcgtcgccactgattcctggtacttttctagtcctgctacgagccggaatctcgtgcttaccccagtgaatttcctccattataatcttaatccccagaacctcgcacgccacgggacccatgccaggttgacccatctagccgtgaacgggtttctgctttttggagtgctacatgctcaagcattacaggccgcatggcagaggctgcaggtagggctgcaggcgtccgctcagatgggcttgctgagagccttgggggccagaagtctgttgtctagtccgcgaagttatctgcttctcctctactttatgcccctagctctgctgagtgctttcagccatcaggaggctcggttcctaatccctctcctggtgcctctggtgctgctgtgtagcccgcagacccagcctgtgccgtggaaggggaccgtggtgctcttcaacgcacttggcgcgctgctgtttggctgtctgcaccagggcggattggtgcctggactcgaatacctggagcaggtcgtccacgcacccgtcttgcctagcacaccgacgcactatacgctgctgttcacacatacctatatgcctccccgccacctgctacatctgccagggctcggagctcccgtggaggtggtagacatggggggtaccgaagactgggctctgtgtcagacgcttaaatccttcaccagacagcccgcatgccaggttgccggcggcccttggctgtgcagactcttcgtggtgacccccggcaccacgaggcgggctgtcgagaagtgttcctttccgtttaagaatgagaccctcctctttccccatctcacactggaggatcctccagctctgtcctccttgctctccggagcctggcgcgatcaccttagcctccacattgtggagctgggggaagaaacgtag

SEQ ID NO: 128432 - DNA, 813 bp, Artificial Sequence
  Description of Artificial Sequence: Synthetic coding sequence
atggttctgctgaaggaatatcgcgttatcttacctgtttcagtcgatgagtaccaggtcgggcagctctactctgtggctgaggcatctaaaaatgagaccggcgggggagaaggcgttgaggtgttggtgaacgagccctacgaaaaggatggagaaaagggccagtacacccacaagatctatcacttgcagagcaaggttccaacttttgtgcggatgctggcacccgaaggagccttgaatattcacgagaaagcctggaacgcgtatccatattgtagaacagtcattactaatgaatacatgaaagaggacttcctcatcaaaatcgagacatggcacaaaccagatttgggaacccaggagaacgtacacaagctcgaaccagaggcatggaaacacgtcgaggcggtctatatagacatcgcggatcggagccaagtactctctaaggattacaaggcggaagaggaccctgccaagtttaagtccataaagacaggacgcggtcctctggggcccaattggaaacaagagctggtaaatcagaaggattgtccatacatgtgcgcctataagctcgtgacagtcaagtttaaatggtggggactgcagaacaaagtcgaaaattttattcacaaacaggagagacggctctttacaaactttcaccggcagcttttctgttggctggacaaatgggtggacctgactatggatgacattcgtcggatggaagaagagaccaagcggcagctggatgaaatgaggcaaaaagatcctgtcaagggtatgaccgccgacgattag

SEQ ID NO: 128433 - DNA, 813 bp, Artificial Sequence
  Description of Artificial Sequence: Synthetic coding sequence
atggtactcctcaaagaataccgggtgatcctccctgtgtctgtagatgaataccaggtgggacagttgtactcagtcgctgaagcctctaaaaacgagacgggagggggcgaaggggttgaggtcctcgttaacgagccttacgaaaaggatggcgagaagggccagtacacacataagatctaccatttgcagtctaaagttcctacatttgttcgcatgctggctcccgagggggctttgaacatccatgaaaaggcatggaatgcgtacccctattgtaggaccgtgcttcctaatgagtatatgaaggaggacttcttgatcaagatcgagacctggcacaagccagatctcggaacacaagagaacgtgcacaagctcgaaccagaagcatggaaacacgtggaggctgtatatatcgatattgcagaccggagccaggtcttatcaaaggattacaaggcagaggaggatcctgccaaatttaagagcatcaaaactggtagaggaccattgggacccaattggaaacaggaattggttaaccagaaggattgcccatacatgtgcgcatacaaactggttacagttaaatttaaatggtggggactgcagaacaaggtggagaattttatccataaacaagaacgtcgattattcacaaatttccatcgacagctcttttgctggctggataagtgggtagatttgaccatggatgatattcggcgcatggaggaagagacaaagcggcaactggacgagatgcggcagaaggatcccgttaaagggatgaccgccgacgactag

SEQ ID NO: 128434 - DNA, 594 bp, Artificial Sequence
  Description of Artificial Sequence: Synthetic coding sequence
atgctggccccggaaggggctcttaatattcacgagaaggcctggaatgcatacccttactgcagaaccgtgcttcccaacgaatatatgaaagaagattttttgattaagatagaaacatggcacaagccagatctgggaacccaggagaacgtgcacaagttggagcccgaagcctggaaacatgtggaagcggtttacatcgacatagctgaccgaagtcaggtgttaagcaaggattataaagctgaagaggatccagccaaatttaagtctatcaagaccggtagggggcctctcgggccgaattggaaacaggaactggtgaaccagaaggactgcccctatatgtgtgcatataagcttgtgactgtcaagtttaagtggtggggcctccagaacaaagtcgagaattttattcacaaacaagagcggcggctgtttactaatttccataggcaactcttttgctggctcgacaagtgggtcgatctgacgatggatgacattcggaggatggaagaggagactaagcggcagctggatgagatgcgccaaaaggatcccgtgaaaggaatgacagcagacgattag

SEQ ID NO: 128435 - DNA, 819 bp, Artificial Sequence
  Description of Artificial Sequence: Synthetic coding sequence
atggtgttgatcaaggagttcagagtcgtgctcccatgttcagtgcaggaatatcaggtgggtcaactgtatagcgttgccgaggccagcaagaatgagactggggggggcgagggaatcgaagtgctgaaaaacgaaccatatgaaaaggacggcgagaagggtcagtatacccacaagatctatcacctgaagtccaaagtgccagcattcgtgcgcatgatcgcacctgaagggagcctagttttccatgaaaaggcctggaatgcgtatccatactgtcgaacaatcgtgaccaacgaatatatgaaggatgattttttcattaagatcgaaacatggcataaacccgacctgggcacactggagaatgtgcacggccttgaccccaatacttggaaaaccgttgagatcgttcacattgacatcgcagaccgctctcaggtggagcccgctgattacaaggccgacgaggatccagccctgtttcagtctgtaaaaaccaaacggggccctctggggcccaattggaaaaaggaactggcaaactcccccgactgcccccagatgtgcgcatacaaactcgtgaccattaaattcaaatggtggggtctgcagtctaaggtcgaaaattttatccagaagcaggagaagaggatttttaccaactttcataggcagctgttttgctggatcgataagtggatagatctgacaatggaggacatccgaaggatggaggatgaaactcagaaagagcttgagacactgaggaaccagggccaagtccgcggaacctccgcagcttcagatgaatag

SEQ ID NO: 128436 - DNA, 816 bp, Artificial Sequence
  Description of Artificial Sequence: Synthetic coding sequence
atggtcctgattaaggaattccgagtcgtgcttccctgctccgtgcaagagtatcaggtgggccagctgtattccgtcgccgaagccagcaaaaacgagaccggtgggggggaggggatcgaagtgcttaagaatgaaccatacgaaaaggacggggaaaagggccagtacactcacaagatctaccatttaaagagtaaggtgccggcgtttgtgaggatgatagcccccgagggctctttagtctttcacgagaaggcctggaacgcctacccctattgccgtacgatcgtgacaaacgagtatatgaaagacgatttttttattaagattgaaacttggcacaaacccgacctgggtaccctcgagaacgttcacgggctggaccccaatacatggaagacggttgaaatagttcacatagatattgcagacagaagtcaggtggagccagcggattacaaagcggatgaggatcccgcgttgttccagagtgtaaagactaaacgcggtccccttggacccaactggaagaaagaactggccaactcacccgactgtccacagatgtgtgcttacaaactggtcacgatcaaattcaagtggtgggggcttcagtctaaggtagagaactttattcagaaacaggagaagcgaatcttcacaaattttcatcggcagttattttgttggatagataagtggatcgatctgaccatggaggatatcagacggatggaggatgagactcaaaaagaactggagaccatgcggaaacggggttctgtgcgcggaacctctgccgctgacgtctag

SEQ ID NO: 128437 - DNA, 363 bp, Artificial Sequence
  Description of Artificial Sequence: Synthetic coding sequence
atgatcgcgcctgaaggttcattggtcttccacgagaaagcctggaatgcctatccgtattgcagaaccattgtgaccaatgagtatatgaaagatgacttctttataaaaattgaaacatggcacaaacctgatctcggaaccctcgagaacgtacacggtctggaccccaatacatggaagacagtagaaattgtccacattgatatcgcagataggtcacaggtagaaccggccgactataaggccgatgaggatcctgcactgtttcagagtgtcaaaactaagagaggccctctggggcctaactggaagaaagagttggccaattcacctgactgtccacagatgtgcgcctactag

SEQ ID NO: 128438 - DNA, 507 bp, Artificial Sequence
  Description of Artificial Sequence: Synthetic coding sequence
atgggcgacttactgatggaaaagtgtagagttgtgcttccgtgttctgtgcaggagtaccaggtagggcagctgtatagtgtggccgaggcttcaaagaacgaaaccggaggaggggaaggtatcgaggtgctaaaaaacgagccttacgagaaagatggtgagaagggccaatacacccataagatataccacctcaagtccaaagtcccggcttttgtccggatgattgccccggaagggtccctcgtgttccatgagaaggcatggaatgcctacccgtattgcagaacgatcgtgacaaatgaatacatgaaagacgactttttcattaaaatcgaaacttggcataagcccgatctggggaccctggaaaacgttcatggcctggacccgaatacttggaaaaccgttgagatcgtgcacattgacatagccgatcggtctcaggttgagccagcagattacaaggccgacgaggatccagcattgttccagagtgtgtag

SEQ ID NO: 128439 - DNA, 822 bp, Artificial Sequence
  Description of Artificial Sequence: Synthetic coding sequence
atgggcgatctactgatggagaagtgtagagtagtgcttccctgttccgtacaggagtatcaggtaggtcagctttattcagtagccgaggcctcgaaaaatgaaactggaggtggcgaaggaattgaagtgctgaagaatgaaccatacgagaaagacggggaaaagggccagtacacccacaaaatctatcatctgaaaagcaaggtgccagctttcgtgagaatgattgcccctgagggatccctggtctttcacgagaaagcatggaacgcatacccctactgccgcacaattgtgactaatgaatacatgaaagatgactttttcatcaaaatcgagacatggcataaaccggatcttggaactctggagaacgtgcatggattagatcctaatacttggaagaccgtggaaattgtccacattgacattgctgataggtcccaggtggaacctgccgactataaagccgatgaagaccctgcactgtttcagtctgttaagactaaaagggggcctctcggtccaaactggaagaaagaacttgcaaattcccccgactgtccgcagatgtgcgcttacaaactggtgactataaaattcaagtggtgggggttacaaagcaaggtggagaacttcattcagaaacaggaaaagcggatattcaccaatttccatagacaacttttttgctggatcgataagtggatcgatctgaccatggaggatattaggagaatggaggacgaaacccaaaaagagcttgagaccatgcgcaagagaggctccgtgaggggcacctctgccgccgatgtctag

SEQ ID NO: 128440 - DNA, 4980 bp, Artificial Sequence
  Description of Artificial Sequence: Synthetic coding sequence
atggaggcaccctcgggatccgagcctggcggcgatggcgccggagattgcgctcatcccgaccccagggcaccgggagccgccgcacccagttcaggtcccggtccatgcgccgccgcccgggaaagtgaaagacagttgagactgaggctctgcgtgctcaacgagatcctaggcaccgaaagggactacgttggcaccctgcgtttcctgcaaagcgcgttcctgcacaggatcaggcagaatgtcgccgattccgtggagaaaggactcaccgaggagaatgttaaggtgctcttttccaacatcgaagatatcctggaggtgcataaggatttcctggccgctctggagtactgcctgcacccagagccacagagccagcacgaactgggcaatgtgttccttaagttcaaggacaagttttgcgtgtacgaagagtactgttctaaccacgagaaggccctgcgcttgctcgtagaattgaacaagatccctacagttagagcattcctgttatcctgtatgcttctgggcggccggaagaccacagatatccccctggaaggatatctgttatcacctatccaacgcatctgtaagtatcctctgctattgaaagagctcgcaaagcgaactcccgggaagcacccggaccatcctgccgtgcagagtgcccttcaggctatgaagacagtatgctctaacataaatgagacaaaacgccaaatggaaaagcttgaagctttagaacagctccagagccacatcgagggatgggaaggcagcaacctcaccgacatttgtacccaactactgctccaaggtacactcctgaagatttctgcagggaatatccaggaacgcgctttcttcctgttcgataacctcttagtgtactgtaaaaggaaaagcagggtgacgggctctaagaagagcactaagcgcacgaagtctattaatggctccctctatattttccgcggtcgaatcaacactgaggtgatggaagtggagaatgtggaagatgggacggccgattaccacagcaatggttatactgtgaccaatggttggaagatacacaacactgcaaagaacaagtggttcgtctgtatggcaaagaccgccgaggagaagcagaaatggctggacgcgatcattagggagcgcgaacagcgggaatcactcaagcttgggatggagagagatgcgtacgttatgattgccgaaaaaggcgaaaagctgtaccatatgatgatgaacaagaaggtgaatctcataaaagaccggcggaggaaactgagcactgtccccaaatgttttctgggaaatgagttcgtggcttggctactagagataggcgaaatcagtaagaccgaggaaggagtgaacctgggccaggccctcttggagaacgggatcatccatcacgtctcggataaacaccaatttaagaatgaacaggtgatgtacaggtttaggtacgacgatggaacctacaaagctagaagcgagctggaggacattatgtctaaaggagtgagactgtactgccggctccactccttgtatacacctgtgatcaaggaccgcgattaccaccttaagacttataagtcggtgctccctggtagtaagctggtcgactggttgctggcccagggcgactgtcagaccagagaggaagcggtggctttaggcgtagggctctgcaacaacggattcatgcaccatgttctggagaagtccgaattcagagacgagtcacagtatttccgttttcacgccgatgaagagatggagggcaccagctctaaaaataagcagctgaggaacgatttcaagcttgtggagaacattcttgccaaaagactgctgattctgcctcaggaggaggactacggcttcgacatagaagaaaaaaataaagccgttgttgtcaagagcgtgcagagaggctcactcgcggaggtggctggccttcaggtcgggcgcaagatctactccatcaacgaagatttagtattcctgcgaccattttctgaggtcgagagtatactgaaccagtctttctgtagccgccggccattgcgtttactagttgcgaccaaggctaaagagatcatcaaaatcccagatcaacccgatacactttgttttcagattagaggtgcagcccccccctatgtgtatgcagttggacgggggagcgaggccatggctgccggactgtgtgccggccaatgtatcttgaaggtaaatggatcgaatgttatgaacgatggcgcaccagaggtgctggagcatttccaggcctttcgctctcgaagagaggaggcgctggggctttatcagtggatttaccacacacatgaagacgcgcaagaggcccgtgccagtcaagaggcatcaacggaggaccccagcggtgaacaggcacaagaggaggaccaagcagacagtgccttccctttgctgagcctcggccctcgattgtcactgtgtgaagatagtcccatggtgaccctgacagtcgacaatgtccatctggaacatggagtggtttatgaatacgtgagtactgccggcgtccggtgccacgtgctggaaaagatagtggaacccaggggttgcttcggcttgactgctaaaatattggaggccttcgcagccaacgacagtgtttttgtcgagaactgccggaggctaatggccctaagctccgcgatcgtgactatgccccatttcgagttcagaaatatctgtgacacaaaattagagtctatcggccagcggatcgcctgctatcaggaatttgccgctcagttaaagagccgcgttagcccgccgttcaagcaggcacccttggaaccccaccctctgtgtggcctcgacttctgccccaccaactgtcatatcaacctgatggaggtgtcctatcctaagactaccccttccgtgggtcgatccttctcgatacgtttcggacgcaagccatctctaatcggccttgatccagagcaaggccacctgaatcccatgtcttatacccagcactgtatcaccacaatggcggccccctcttggaaatgtttgcccgcagccgaaggcgatccacagggtcagggcctgcacgacggaagttttggccctgccagtgggactctgggacaggaagatagaggtctgtccttcctcctgaagcaggaggaccgcgagattcaggatgcatacttgcaactatttactaagctggacgtggcgctcaaggagatgaaacagtacgtgacacagattaatcggctgctgtctactatcacagagcctactagcgggggatcatgcgacgcctcccttgccgaggaggccagctccctgcccttagtatcagaggaaagcgaaatggatcgatctgaccacgggggaattaagaaggtgtgttttaaagtagcggaggaagatcaggaggactccgggcacgacacaatgtcttatagggacagctatagcgagtgcaatagcaacagggacagtgtcctgtcctatacatctgtgcgatcaaacagcagctacctgggatctgacgagatgggtagtggggacgagctgccctgtgatatgcgcatcccatccgacaagcaggacaagttgcatggctgtctggaacacctattcaaccaggtcgactctattaacgccctgctgaagggacccgtcatgagtcgagccttcgaggaaaccaagcatttcccaatgaaccattcccttcaagagtttaagcaaaaggaagagtgcaccattcgcgggcgatccctgatccagatctccattcaggaagacccatggaacctgccgaacagcatcaagaccctggtggacaacatccagaggtatgtcgaggatggtaagaatcaattactgctggccttactcaaatgtactgacaccgaattacaactgaggagggatgccattttttgccaggccttggtcgccgcggtctgtacattcagtaagcagctgcttgccgcgctcggatacagatacaacaacaacggagaatatgaggaatcctcacgcgacgcatctagaaaatggctggagcaggtggccgctaccggagttttgttgcattgccagtccctgctatcccctgccactgtgaaagaggaacgcacaatgctggaagatatctgggtaaccctttccgaactggacaacgtcaccttttctttcaagcaactcgacgagaactatgtggccaatacgaatgtgttctaccatatcgagggctctagacaggcactcaaggtcatcttctacctggactcataccattttagtaagctgcctagtagactggagggaggtgctagcttacggctacatacagccctgttcactaaggtgctggagaatgtggagggtctgccaagcccaggctcacaagccgcagaggatcttcagcaagatataaacgcccagagcttggagaaagtgcaacagtattatcggaagctcagggcattttatcttgagaggtctaatctgcccactgatgcctctacgaccgccgtgaagattgaccaattgatccgtcccataaatgcgctggacgagctgtgccggctcatgaagagcttcgttcatcctaaaccaggagcggccggctccgtgggggccggcctgattcccatctcctccgagctgtgctatagattgggtgcctgccagatggtaatgtgcggcacaggaatgcagcggagtacactgagtgtatccctggaacaagcagccatactagcccgctcccatggactcctgcctaaatgcattatgcaggccacagacatcatgaggaagcaaggtccccgggttgagattctcgccaagaacctcagggtaaaggaccagatgccccagggggctccaaggctctatcgcctctgccaacccccagtggatggtgatctgtag

SEQ ID NO: 128441 - DNA, 4686 bp, Artificial Sequence
  Description of Artificial Sequence: Synthetic coding sequence
atggaagcgcccagtggtagtgaacccggcggtgatggtgccggagactgtgcccacccagaccctagggcgcccggcgcagccgctccctctagtggaccaggcccctgcgctgcagcgcgtgagtctgagaggcagttgcggctgcgcctctgcgtgcttaacgagattctggggacagaacgagattacgtgggtaccctgagattcttgcaatctgcttttctccatcgcattcgacagaatgtagccgacagtgttgagaagggacttaccgaggaaaacgtaaaggttctgttttccaatatcgaggatatattggaagtccataaggattttttggcagcactagagtattgccttcaccctgagccccaatcgcagcatgaactcggtaacgtcttcttgaagttcaaagataagttttgtgtgtacgaggagtactgttctaatcacgaaaaggccctgcggttactggtggaactcaacaaaataccaaccgtaagagcgttcctcttgtcctgcatgctgttgggcgggcgtaaaacgacggacattcccctggagggataccttttgagccctatccagcgaatctgcaaatacccacttctgctgaaggagttggccaaacggactcctggcaagcaccctgatcatccagccgtgcagagcgccctacaggccatgaaaacagtgtgttcaaatatcaacgagacaaagagacagatggagaagttagaggctctagaacaattgcagtcgcatatcgaaggttgggaaggttcaaacttaaccgacatatgcacccagctcctgctgcaggggactctgctgaaaatttctgcgggcaatatccaggagcgggcattttttctgttcgataatctgctcgtgtactgcaaacggaaaagccgcgtgaccggctcaaagaagtcgacaaagaggaccaaatcaattaatggatctctgtacatattcagaggaagaattaatacagaagtaatggaggtagagaacgtggaggacggcactgctgattatcattctaacgggtacaccgtcaccaatggctggaagatccacaataccgcgaagaacaaatggtttgtttgtatggcaaagaccgccgaggaaaagcagaaatggctggatgccattatccgagagagggaacaacgcgaaagcctaaagttgggcatggagagagacgcctatgtaatgattgccgagaaaggcgagaagctgtaccacatgatgatgaacaagaaagtaaacctgatcaaggataggcgacgcaaactgagcactgtgcccaaatgtttcttaggcaatgagtttgtagcctggttgctggagattggagaaatctctaaaacagaagagggagtaaatctgggccaggcactgctggaaaatgggatcatccaccacgtctctgataaacatcagttcaagaacgagcaagtgatgtatcggtttcgttatgacgatggtacttataaggccaggtccgaacttgaagacataatgtctaagggcgtccgtctttactgcaggctgcactctctatatacgccagtgataaaggatcgggattaccaccttaaaacctacaagtctgtactccctggatcaaagctagtggactggctgctggcccaaggcgactgccagaccagggaagaagccgtggcactgggtgtggggttgtgcaacaacgggtttatgcatcacgtgctggagaaaagtgaatttcgggacgagagccagtacttccgcttccatgcggacgaagaaatggaaggtacatcttcaaagaacaagcagttgagaaatgatttcaaactagtagagaacatcttggccaaacgacttctaatactgccccaggaggaggattatggattcgacattgaagaaaagaacaaagccgtggtggtgaagtcggttcagcgcggttccctcgcagaagtggctggcctacaggtgggccgtaagatctacagtatcaatgaggaccttgtttttctgcgaccattcagcgaggtagagtctattcttaatcaaagcttctgcagtagacgccctctgaggcttctggtagccacaaaggctaaagaaattattaaaatccccgatcaaccagacactctgtgctttcaaattagaggcgcggctccaccatacgtgtatgcagtcgggcgcggctctgaggctatggccgctgggctttgtgcgggccagtgcattttaaaggtcaatgggtccaatgtgatgaatgatggggcgcccgaagtgttggagcactttcaggccttccgatcccgtcgagaagaggccctggggttgtaccaatggatctaccatacccacgaagatgcacaagaagcccgtgcatctcaagaagcctctacggaggaccctagtggcgaacaagcgcaagaagaagaccaggctgacagtgcttttcctctccttagtctgggtcccagactatccctgtgtgaagactctcctatggttaccctcaccgtcgacaacgtccatctggagcatggagttgtgtacgagtacgtttcaactgctggagttcggtgccatgttctcgagaagattgttgaaccacggggttgcttcggcttgactgctaagatcttagaggcttttgcagccaatgatagcgtcttcgtagagaactgtaggaggctgatggcactgtcctccgccatagttaccatgcctcacttcgagtttagaaacatttgtgacaccaaactcgaaagcataggacagcgtatcgcctgctatcaggaatttgcagcccagctcaaatcccgggtgtccccacccttcaagcaggctcccctggaaccccaccccctgtgtggtctcgacttttgccccacaaactgccacattaatctaatggaggtctcatatccgaagacaaccccctcagtggggagatcattttctatccgctttggaaggaagccatcccttatcggacttgaccccgaacagggccacctcaaccccatgagctacacccagcactgtataaccactatggccgctccctcctggaagtgcttgccggcggctgagggtgatcctcagggacagggcctccatgacggttcattcggccctgcctctggtactcttggacaggaagatcgcggcctctctttcctgctcaagcaggaggacagagagattcaggatgcttatctccaactctttacaaaactagatgtggcactcaaggagatgaagcagtacgtgacacaaataaatcgtctcttgtctacaatcaccgagccaacatctggtggctcctgtgatgccagtcttgccgaagaggccagttccctgcccttggtatccgaggagtccgagatggaccgcagcgaccacgggggcattaaaaaagtgtgctttaaagtagcagaagaggaccaggaggactctgggcacgatacaatgagctacagagattcctactccgagtgcaactccaatagagactcagtcctgagttacacctcagttaggagcaacagttcatatcttgggagcgacgaaatgggctctggtgacgaactgccatgtgacatgcgtatccctagcgataaacaggacaaacttcacgggtgtctcgagcatcttttcaatcaggtggattccattaatgcactgttgaaggggccggtgatgtctagggcctttgaagagactaagcacttccccatgaatcacagcctgcaagagttcaaacagaaagaggaatgcacaattcgcgggagatctcttatccagatctcaatccaggaagatccctggaacctgcccaactctattaagaccttggtggacaatattcagaggtacgtggaggacggcaagaaccagcttctgctcgcactgctaaagtgtacggacacagaattgcagctacggcgagacgcgatcttctgccaagcactcgtcgccgccgtttgtacattcagcaagcagcttctggccgccctgggatacagatacaacaacaatggagagtatgaggaatcatcccgtgacgcatccagaaaatggctcgagcaagtggccgcaactggagtacttctgcattgccagagcctgcttagccccgctaccgttaaagaggagcggactatgctcgaagatatctgggttacgctgagcgagctcgataatgtgactttctctttcaaacagctcgatgagaattacgttgcgaacacaaacgtgttctaccatatcgaaggctccagacaggcgctaaaagtaatcttctatctcgactcttaccacttttcaaagttgccatcacggttggagggaggtgcatccctgcggctgcataccgctttgtttactaaaggggaactccaagcctggggtcgtgaggaccacggaggacgcgccaaagccaccaagcacaccgggtcacaaccgcctgcacggcctcgccatctcccctcgcaatgttggaggacttggagaggctgtcttctgcaagccgctagaccacgtcgcatctgcagtagaacctccactaggtccccctggaggaaatttagcagtatcactgcaaactctggtcatttcacatggtccggcctcacctgcccgcggatgccagcgcctagacgttag

SEQ ID NO: 128442 - DNA, 4821 bp, Artificial Sequence
  Description of Artificial Sequence: Synthetic coding sequence
atgtctgaggactccagaggagattccagagctgaatcagcgaaagacctggagaagcagctacggctgcgagtctgcgttctatcggaactgcagaaaactgagagagattatgtaggcacactggagttcctggtctccgccttcttacatcgcatgaaccagtgcgctgcatcaaaagttgacaagaacgttacagaggagacagttaagatgctcttcagtaatatagaagacattctggctgtccacaaggaattcttgaaagtcgtcgaagagtgcctgcaccctgagcctaacgcccagcaggaagtcggaacatgcttcctccattttaaggataagtttcgcatctatgatgagtactgctccaaccacgagaaagcccagaagcttctgctggagctgaataagataagaaccatacgcactttcctccttaattgcatgctcttaggcggacgaaagaatacagatgttccattggagggctacctggtaacccccattcagcgcatctgtaagtatccactgatcctgaaggagctcctgaagcgaacgcccaggaagcattcagactacgcggctgtgatggaagcattgcaggccatgaaggcggtgtgcagcaacatcaatgaggcaaagagacaaatggagaaactggaggtgctcgaggaatggcaatctcacattgagggctgggaaggatccaacatcacagatacttgcactgagatgctgatgtgcggtgtgctacttaaaatttcaagcggaaacattcaggagagggtgttctttttattcgataatctgctggtgtattgtaagcgcaagcaccggcgactgaaaaacagcaaggcgagcactgacggacaccgctatctattccggggtagaatcaacacagaggtaatggaagttgagaatgttgatgacggaacggccgacttccattcctccgggcatatcgtggtcaacggatggaagattcataacactgccaaaaataaatggtttgtgtgcatggctaagacgcccgaagagaagcacgagtggttcgaggcaatccttaaggaaagagaacgccgcaaaggcttaaagcttggtatggagcaggacacatgggtgatgatatccgaacagggtgagaagctatataagatgatgtgccgccagggtaatctgattaaggaccgcaagcgcaaacttaccacattcccgaaatgttttttagggtccgagtttgtgagctggcttctggagattggcgaaattcataggcccgaggagggcgttcacctcgggcaggcactgttagagaatgggatcatccatcacgtgactgacaagcatcagtttaagcccgaacagatgttgtaccgctttaggtatgatgacggcacgttttacccccggaatgagatgcaagatgtgatttcaaagggagtgcgactgtattgtcggcttcactcattgttcacaccagtgataagggataaagactatcatctgcgaacttataaaagtgtagtcatggccaacaaactgattgactggctcatcgcacagggagattgtcggaccagagaggaggcaatgattttcggagtaggtctttgtgataacggtttcatgcatcatgtgctcgagaagagcgaatttaaagacgagccgctcctgttcaggtttttcagcgacgaagagatggaggggtctaacatgaaacatcgcctcatgaaacatgacttgaaagtggttgaaaacgtgattgccaagtccctactcattaaaagtaatgagggttcctacggttttggcctggaagacaaaaacaaagtaccgatcatcaaactagtggaaaaggggagcaacgcggagatggctgggatggaagtgggtaaaaaaattttcgcgatcaatggcgatcttgtgttcatgcgtccttttaatgaagtcgactgctttttgaaatcatgtttaaactctagaaagccactgcgggtgctggtatctaccaagccacgggaaaccgtaaagatcccagacagtgccgatggattaggattccagataagaggcttcgggccttccgttgtgcacgctgtcggccgtgggacagtggctgctgcagctggtctgcatccagggcagtgcattattaaagtgaatggtattaacgtgtctaaggagacccatgcctccgttatcgcgcacgtaactgcctgtcgtaagtataggaggcccactaaacaagactccatccagtgggtgtataactctattgagagtgcacaggaggacctgcagaaatcacattcgaaaccaccaggagacgaagcgggggatgcgttcgattgcaaagtggaggaggtgatcgataaattcaacacaatggccataattgacggcaagaaagaacatgtgagcttgacagtggataacgtgcacctagaatatggcgtggtttacgaatacgacagcaccgctggcattaagtgcaacgtggtggaaaagatgattgagcctaaggggttttttagtctcacagctaagatcctggaagccttggccaagagcgacgagcactttgttcagaactgcacctcgctgaactctcttaatgaggtcattcctacagacctacagtccaaattctcagcactttgctccgagagaatcgaacacttgtgccaacgcatcagctcatataaaaagtttagccgcgtgctcaaaaatagagcttggccgacttttaaacaagctaaaagtaaaataagtccattgcactctagtgacttctgccctacgaactgtcatgtaaatgtaatggaagtatcttacccaaagacatcaacatctttggggagcgcctttggcgttcagctagacagtcgcaagcacaattcccacgataaggagaacaagtcatccgagcagggtaaactgagtcccatggtatatatccagcataccattactactatggctgccccgagcggactcagtctcgggcagcaagacgggcatggtctgcggtacctgctaaaggaggaagatctcgagacccaggacatttaccagaaactcctcggcaagctccaaaccgccctgaaggaagtggagatgtgtgtatgtcagatcgatgacctcctctcaagcatcacctactccccaaaactagagagaaagacgagtgagggcatcatacctaccgactcagataatgagaagggagaacggaactctaagagagtgtgtttcaatgtcgctggggatgagcaggaggattctggccacgataccattagtaatcgggactcctacagcgattgcaactccaacaggaattcaatcgcgtctttcacttccatctgcagctcccagtgttctagctattttcatagcgacgagatggactccggagatgagctgcccctctccgtcaggatcagccacgataaacaggataagatacattcatgccttgaacacctcttctctcaagttgactcgatcactaacctgcttaaagggcaggcagtggtgagggcttttgaccaaacaaagtatctgaccccgggccgggggctgcaggagtttcagcaggagatggaaccaaaattatcttgtccgaagcggcttaggctgcacataaagcaagacccctggaacctcccctctagcgtgaggacgcttgcgcagaacattcgcaagtttgtggaagaagtcaaatgccggctcctcctcgcacttctggaatatagcgactccgagacacagctaaggagagacatggtgttttgccagacactcgttgccactgtgtgtgccttcagcgagcaattgatggccgcactgaatcagatgttcgataacagtaaagaaaatgaaatggagacgtgggaagcgagcagacgatggttggatcagattgcgaatgcgggcgtcctcttccatttccagtcactcctcagcccgaacctaacagacgaacaggccatgctggaggacaccctggtggcattgttcgacctagagaaggtgtctttctacttcaaaccttcagaggaggaaccccttgtcgcaaatgtcccgctgacttaccaggctgagggcagtagacaggcgctgaaagtgtacttttatatcgattcctatcacttcgaacaactgccacagagactgaaaaatggcggaggcttcaagatacaccccgtgctcttcgcacaggcgctggaatcgatggaaggatattactaccgggataatgttagcgtagaagaattccaggcccagatcaatgctgcaagtttggaaaaagtcaaacagtataatcagaagctgagggccttctatttagacaagtccaattcaccaccaaactcgacttccaaggcagcgtacgtagacaagttgatgcgacccctgaacgctctagatgagctgtaccgcctggtagcatcattcatcagatctaagcgcacagccgcctgcgccaatactgcctgttccgcgagcggtgttggattactaagcgtttcaagtgagttgtgtaatcgacttggcgcctgccatattatcatgtgctcttccggcgtccacagatgcactctcagtgtgaccttggagcaggctataatcctggcccgttcacatggcttgcctcctaggtacatcatgcaggcaactgacgtgatgcggaagcagggagccagagtccagaacactgccaagaacttgggcgtaagagaccgtaccccccagtccgcgccaagactgtataagctctgcgagccacctcccccagccggtgaagaatag

SEQ ID NO: 128443 - DNA, 3525 bp, Artificial Sequence
  Description of Artificial Sequence: Synthetic coding sequence
atgtcagaggatagtcggggtgatagtagggcagagagcgctaaggacttggagaaacaattgcgactgagagtctgcgtactgagtgagctgcagaaaaccgagcgagactacgtgggaacattagagtttcttgtcagcgcattccttcacagaatgaatcagtgcgccgcatccaaagtagacaaaaatgtgactgaagaaaccgtgaaaatgctgtttagtaacattgaggacatactggcagtccataaggagtttctgaaggtggtcgaggagtgtctgcaccccgagcctaacgcccagcaggaagtcggcacatgctttctgcattttaaagacaagttccgcatctacgatgaatactgtagcaatcatgagaaggcgcaaaaattgctgctggagctgaataaaatcagaactatcaggacattcctgctcaattgcatgctgctcggaggccgaaaaaacacggatgtgccactcgaagggtacttggtgacgcccatccaacggatctgtaaatacccgctgattctcaaggaattgctgaaacgtaccccaagaaaacacagtgattacgctgccgttatggaagccctgcaggctatgaaggcagtatgttccaatattaacgaggccaagaggcagatggagaagttagaagttctggaggaatggcagtctcacatcgaaggctgggagggctccaatatcaccgatacctgtacagagatgctcatgtgtggcgtgctgttgaaaatcagcagtggaaacattcaagagcgggtcttcttcctgtttgacaacctacttgtgtattgtaagagaaaacacaggcggctgaagaattccaaggcatcaacagatgggcatcgatacctctttcgcggccggataaataccgaagtgatggaggtcgagaacgtggacgatggcacggcagactttcacagcagtgggcacatcgtcgtgaatggctggaagattcacaacaccgctaagaacaaatggtttgtgtgtatggccaaaacccctgaggaaaagcatgaatggtttgaagctattctcaaagagcgggagagacgcaaaggcctgaagctcggcatggagcaggatacctgggtaatgatttcagaacaaggcgaaaaactctacaaaatgatgtgtcgccaagggaacctcattaaggacaggaaacggaagctgaccaccttcccaaaatgtttcctcggctccgaattcgtaagttggttgctcgagataggggagattcaccgacccgaagaaggggtacacctaggacaggcccttttagagaatggaatcatccaccatgtgaccgataagcatcaatttaagccggagcaaatgctgtaccgattccgctatgacgacggaaccttctatcctcggaatgagatgcaggacgtcatttctaagggagtccgcctgtattgcagattgcattctttgttcacccccgttatccgggacaaagactaccacctgaggacatataagagtgtggtcatggcgaataagctaatcgattggctgattgctcagggagattgccggacacgggaagaagctatgatatttggagtgggactttgcgataacgggtttatgcatcacgtgctcgagaagagcgagtttaaggacgagcccctcctgttcagattctttagtgacgaagagatggagggctctaacatgaaacaccgtctcatgaagcatgatctcaaggtggtagaaaacgtgatcgcaaaatctctactcatcaaaagtaatgagggaagctacggatttggcctggaagacaaaaataaggtgccaatcattaaactcgtagagaagggcagcaacgcagaaatggctggaatggaagtggggaagaagatattcgctattaatggcgatctggtgttcatgcgaccttttaatgaggtcgattgctttcttaagagttgcctcaactcacggaagcctcttcgcgtactcgtgagcacaaagccccgggagactgtgaagatacctgactcggccgacggcttgggatttcagatccgcgggttcggcccctcagttgtacacgccgttggccgcggcactgtcgccgctgccgctgggctccaccctggccaatgcattattaaagtcaacgggattaatgtctcaaaggagacccatgcatcagtgatcgcccacgtaaccgcttgccggaagtaccgtcggcctactaagcaagattcaatccaatgggtgtacaacagcatagagagtgcccaggaggacctgcaaaagtcacactctaagcctccaggagatgaagctggcgatgcctttgactgtaaggtggaggaagtcatagataagtttaacaccatggcaataatcgatgggaaaaaggaacacgtttcactgaccgtggataatgttcacttggagtacggggttgtctatgaatacgattctacggcgggcattaagtgcaacgtagtggaaaagatgatcgaaccgaaggggtttttcagtctaaccgccaaaattctagaagcattagctaagtcagacgaacatttcgtacagaactgtacatcactcaattcattgaacgaagtgataccaacagacctgcaatctaagttttcagccctttgttccgagaggatagaacacctctgtcagagaatcagttcgtacaagaaggtaagtgtgctgcttatcctctataccattattgtcgaaatgtatcattttaccgaaatgattactctgtacaatattttggaacttgttcggccacccaactccgagttttttttttcatttttgccgacaaaaaggatgaagacacttaatcagaagaaagtgactcacatgaaaaagaccaacattcagttgcagttctctcgcgtgcttaagaaccgagcttggccgaccttcaaacaggctaaatccaaaatttctccacttcattcttccgacttctgtccaaccaactgccacgtgaacgtgatggaagtgtcctacccgaaaacatcgaccagcctgggcagcgcttttggggtccaatggaaactgtcaccgatggtgtacatccagcatacaataacgacaatggctgccccctccggcctctcacttggccaacaagatggtcacggattgcgctatctcctggaaagaaaaactagcgagggcattatccccaccgactccgataatgaaaaaggagaacggaattcgaagagggtttgctttaatgtggcaggagacgaacaggaggactccggacacgatacaatcagtaaccgcgattcttactcattcagcgactgcaactctaaccggaacagcatcgccagctttacttcaatctgctctagccagtgtagtagttacttccactcggacgagatggacagcggctccgacgaattgccactgtccgtgaggatcagccacgataagcaggataagatccactcttgtttggagcatttattctcccagtag

SEQ ID NO: 128444 - DNA, 1650 bp, Artificial Sequence
  Description of Artificial Sequence: Synthetic coding sequence
atggcttccgccagttctggtccgagctcttctgtgggtttcagttcttttgaccctgctgtgccatcttgcactttaagcagtgcctccgggatcaagcggcccatggcctctgaggtcccatatgcatccggcatgcccattaagaaaatcggacaccgctccgtggattcaagcggggagactacatacaaaaagacgacatcttcggcattgaaaggagccatccagctaggtattactcatacggtgggctcactttcaactaaacccgaacgcgatgtcctgatgcaggacttctatgtggtggagtctatattctttcccagtgaagggagcaaccttacacctgcccaccactacaatgattttaggttcaaaacatacgcaccagtagcattcagatattttcgcgagctgttcggtatccgtcccgatgactacttgtactccttatgttctgagcccctgatagagctgtgtagttccggggcatcaggcagtttgttttacgtctccagcgacgacgaatttatcatcaagacagtgcagcataaagaggccgagtttcttcagaagctcctccctggttactatatgaacctgaatcaaaacccaaggaccctcctgcccaaattttacggcctctattgcgtacaggctggcgggaaaaacatccgtatcgtggtgatgaacaacctgctgcctcggtctgtgaagatgcatatcaaatacgatttaaagggcagcacctacaaaagacgtgcgtctcagaaggagcgggagaagccactgcccacgttcaaagatctggactttctgcaggatatccctgacggcttgttcctggacgcagatatgtataatgccctgtgcaagacacttcagcgcgactgccttgtgttgcaaagctttaagattatggattactccttgctaatgtctatccataacatcgaccatgcccagcgcgagcccctgtctagcgagacccagtacagtgtggatacaagacggccggcacctcagaaagccttatactccacagctatggaaagtattcagggtgaagctcgccggggcggcactatggagacagacgaccacatgggcgggattcctgctcggaactcgaaaggggaacggcttctgttgtatattgggataattgacatcctgcaatcctacaggttcgttaagaagttagaacactcttggaaggctttggtgcacgatggggatactgtgtccgtacacaggcctggcttttatgccgagcggttccagcgttttatgtgtaatactgtcttcaaaaaaatccccctaaagccgtccccatcaaaaaagttcaggagcggtagcagcttcagccgtcgagcgggatctagtggaaactcatgtattacatatcagccgtcagtgagcggggagcacaaagctcaggtgaccacaaaagccgaagtcgagccaggggttcacctggggaggcctgacgtgctgccgcagacaccacctctggaagaaattagcgagggtagtccaatcccagatcccagtttcagccccctggtcggagagacacttcagatgttgacaacttcaactactctggaaaaactggaggtggctgaaagtgagttcactcattag

SEQ ID NO: 128445 - DNA, 1689 bp, Artificial Sequence
  Description of Artificial Sequence: Synthetic coding sequence
atggcgtccgctagtagtgggccttcctcgagtgtgggattctcaagctttgatccggccgtccctagttgtactctctcgagtgccgcaagcgggatcaaaagacccatggcttctgaagtgctcgaagcccgccaggattcctacattagcctggtcccatacgcaagcggtatgccgatcaaaaagatcgggcaccggagtgttgattccagcggggagaccacctataagaaaaccacttcatctgccctgaaaggagcaatccagctgggcatcacacacaccgttggatctttgtcaacaaagcccgagagggatgtgctgatgcaggatttctacgtggttgagtcaatctttttccccagcgaggggagcaatctgactcctgctcaccactataacgacttcaggtttaagacctacgcccccgttgcgtttcggtatttccgcgagttgttcgggatccgcccagacgactacctgtattccttgtgttctgagcctctgattgaactctgttcatccggggcttccggaagtcttttctacgtttcttcagacgatgagtttatcatcaagacggtacagcacaaggaggcggaatttctccagaagctcctccctggttattacatgaatctcaatcagaatcctcggacccttttgcccaaattctacgggttgtactgcgttcaagcgggaggcaagaatatacggatcgttgtgatgaataacctgctacccagatccgtaaagatgcacatcaagtacgatctgaagggctctacatacaagcgaagggcctcacaaaaggagcgtgagaagccactcccaacgtttaaagatttagatttcctgcaggacatccctgacgggctttttctggacgccgatatgtacaatgcactgtgcaaaactctgcaaagggattgtctcgtgttgcaaagctttaagattatggattatagcctccttatgagcatccataatatcgaccacgcacagagagaaccactctctagtgaaacccagtatagcgtcgacacaaggagacccgcaccacagaaggcattgtactcaactgccatggaatctatccaaggcgaggcccgccgaggcgggacaatggagacggacgatcacatgggaggcatcccagcaaggaactccaagggcgagcggttactgctttacatcgggattatcgacatcctgcagtcttacagattcgtaaagaagttggaacactcatggaaggctctggttcacgacggcgacactgtctcagtgcacaggccaggattttacgctgagcgctttcagcggttcatgtgtaatacagtattcaagaagattcctctgaagccttctccaagcaaaaaatttcggtcgggtagctcgttctcaagaagagccgggagcagtggaaacagttgtattacctatcaaccctctgttagcggggaacataaggctcaggtgacaacaaaggctgaagtagaaccgggagtccacctgggccggccagatgttttaccacaaacaccacctcttgaagagatatccgaggggtccccgattcctgacccatctttctcacccttggtcggtgagaccctgcaaatgttgacgactagcactaccctagaaaagctcgaggtcgcggagtccgagtttacgcattag

SEQ ID NO: 128446 - DNA, 1503 bp, Artificial Sequence
  Description of Artificial Sequence: Synthetic coding sequence
atggccagtgcttccagtggccccagttctagtgttggattttcctctttcgaccccgccgtgccttcatgtacgttgagcagcgcatcgggaatcaagcgtccaatggcctcagaagtcccttatgcttcaggaatgccgattaagaagatcgggcatcgcagcgtcgattcctcgggagagacaacctataagaagactaccagcagtgcgctaaaaggggccatccagctaggaattacccatactgtgggaagcctgagtacaaagccagagcgggatgtactgatgcaggatttttacgtcgttgaaagtatattttttccttcagaaggcagtaatttaactccagcgcatcattataatgacttcagattcaagacctatgctcccgtagcgtttaggtacttccgagagctgtttggtattcgacccgatgactatctctacagtctttgcagtgaaccactgatcgaactgtgctccagcggggcctccggcagccttttctacgtcagtagcgacgatgaatttattattaaaaccgtgcagcacaaggaagccgagtttctacagaagctcctgccaggctattacatgaacctgaatcagaatcccagaacgctccttcctaaattttacgggctctattgcgttcaggccggcggtaagaacatcagaatcgtcgtaatgaataacttgctaccacggagtgtgaagatgcacatcaagtacgacctgaagggtagtacatacaagcggagagcttctcagaaggaaagggaaaagccccttcctactttcaaggacctcgactttctgcaggacatcccagacggtctgtttttagacgccgatatgtacaacgcactttgtaagacactgcagagagactgtcttgttctgcaatcatttaaaatcatggactatagtttgcttatgtccattcataatatagatcatgcccagagggaaccacttagtagtgagacacagtatagtgtggatacgaggcggcccgctcctcagaaagcattgtattctactgcaatggaaagtatccaaggggaggctaggagagggggcacgatggaaacagacgatcatatgggcggaatacctgctcgaaattctaaaggtgagaggctgttactttatattggaattattgatatcttgcagtcttaccggttcgtgaaaaagttggagcattcgtggaaggctttggtgcacgacggagacacagtgtctgtgcaccgacctgggttctacgctgaacggttccagaggttcatgtgtaataccgtttttaaaaagataccctgtgtgcatctggggagacctgatgtgttgccacaaacccctccattggaggagatctctgagggatcccctattcctgacccatcgtttagtccactggtgggtgaaaccctccaaatgttaaccacttctacaacacttgaaaaactcgaggtcgcagaatccgagttcactcactag

SEQ ID NO: 128447 - DNA, 1653 bp, Artificial Sequence
  Description of Artificial Sequence: Synthetic coding sequence
atggcaagtgcctcatcaggcccttccagctccgtcggtttcagttcatttgaccctgccgtgccctcctgtacactctcttctgcagcaagtggcatcaaacggccgatggcgagcgaagtcccgtatgcttctggaatgccgattaaaaagatcggacaccgatctgtggatagtagcggtgagacaacctataagaagacaacctcttctgctttgaagggggctattcaactgggaattacgcacacggtgggtagcctctcaacaaagccggagagagatgtccttatgcaagacttctacgttgtggaatccatatttttcccatctgaaggatccaatttgactcccgcccatcactacaacgatttccgatttaaaacatatgcccccgtggcgtttaggtatttccgagagctgttcgggataagacctgatgactatttgtatagtttgtgtagcgaacccctgatcgagctgtgttcttccggtgcctcagggagcttgttctacgtaagcagcgacgatgagtttataattaagaccgttcaacataaagaggccgaattccttcagaagttgctgcccgggtactacatgaatctgaatcaaaatccgcgcaccttgctccccaagttctatggcctgtactgtgtccaggcgggaggtaaaaacatacgcatcgttgtaatgaacaatcttctgccacgcagtgtgaagatgcacatcaagtatgatctgaaagggtccacctataaacgtagggcgagtcagaaggaacgagagaagcctttaccgacctttaaggacctagattttttgcaggatattccagatggactgttcctagacgccgacatgtacaacgcgctctgcaaaactctgcaaagagattgtctggtactgcagagcttcaagatcatggattattccctcctaatgtctatccacaacattgaccatgcccagcgcgagcctctgtcgagcgaaacccagtacagcgtagatactcggcggccggccccacagaaggctttatactccacagcaatggaaagtattcagggggaggccagacgaggaggaacgatggagaccgatgatcatatgggcgggatacccgcccggaatagtaagggagaacgcctcctcctctatattgggatcatcgatattttgcagagctaccggtttgttaagaagttggaacactcctggaaggcactggtgcacgacggtgacacagtctctgttcatcgcccggggttctacgcagagcgcttccaacgattcatgtgtaacacagtcttcaaaaagatccctttgaaaccttcacccagtaagaaatttcgctccggcagctcattctctcgccgcgctgggagcagcgggaatagctgcattacctatcagccctcagtctccggtgagcataaggcccaggtgactactaaagccgaggtggagcctggcgtgcatctcggtaggccagacgtacttccccagactccccctttggaagagatctccgagggtagcccaatcccggatccttcctttagcccactggtgggagagacactccagatgctgaccacatctacgacgctggaaaagctggaagtggccgagtctgaatttactcattag

SEQ ID NO: 128448 - DNA, 597 bp, Artificial Sequence
  Description of Artificial Sequence: Synthetic coding sequence
atgtacaacgctttatgtaaaaccctgcagagagactgtctcgtgttacagtcttttaagattatggactatagtctgctcatgtcaatacataacattgaccacgcacagcgggaaccgctcagtagtgagacccaatactccgtcgacacccggcgtcccgctccccagaaagcattgtactcaaccgccatggagagcatccagggcgaggctagacggggaggtaccatggagacggatgaccatatggggggcattcccgcacgtaactcaaagggggagaggttactgctatatatcggtatcatagatatactgcagagttaccggttcgttaaaaagttggagcattcctggaaggcactggtccatgacggtgatacagtctccgtgcatcgacctgggttttatgctgaaaggttccagagatttatgtgcaacaccgtgttcaaaaagattccactgcagccttggaagtctctaaagctccagagccagtcttctcctatcaagcgaaaggcttcagaagatctggaacaagactcagctatctccgttattcccagatgccagcccctcccccaacagtgttag

SEQ ID NO: 128449 - DNA, 261 bp, Artificial Sequence
  Description of Artificial Sequence: Synthetic coding sequence
atggcatctgaagttttggaagcccgccaggactcatacatttccttggtaccttatgccagcggcatgcccatcaaaaaaatcggacaccgttcagttgattccagtggggagaccacttataaaaagacaacttctagcgcactcaaaggagccattcaactgggaattacacacactgtggggagcctcagcaccaagccggagcgagatgttctgatgcaggacttctatgtggttgagagtatctttttcccatag

SEQ ID NO: 128450 - DNA, 1569 bp, Artificial Sequence
  Description of Artificial Sequence: Synthetic coding sequence
atggcgtccgctagcagcggcccctcttcatcagtgggctttagttcctttgacccagcagtccctagctgtaccttgagcagtgctgcatcaggtattaaacggcccatggcctccgaagtaccctacgcctccggaatgcctatcaagaagatcgggcatcgttcagtggactctagcggggagaccacttacaagaaaacaactagttccgccctgaagggagcaattcagctgggcatcacacataccgtaggcagcctctctactaagccagagcgagatgtgctcatgcaggatttctacgtggtggagagcatcttcttccctagcgagggctcaaacctcaccccagctcaccattataacgatttccgattcaagacctacgcccctgtggccttcaggtatttccgggaacttttcggcattcgcccagatgattatctctattcactttgctccgagcctctcatagagctatgctcctctggagcttctggatctctattctacgtttcatccgacgatgagtttatcattaaaactgtccagcacaaagaagcagaatttctgcagaagctcttgccagggtactatatgaacctcaaccaaaaccctcgcactttgcttcccaaattctatggcctgtattgtgttcaagcaggaggtaaaaacataaggattgtagttatgaacaacctgctgcctaggtcggttaaaatgcatattaagtacgatctcaaagggtccacatataagcgtcgcgcatcccaaaaagaaagggaaaaacccctacctaccttcaaggatctggactttctccaggatatcccagacggcctctttctggacgctgatatgtataatgccctgtgcaagactcttcaacgggactgtctggtgctacaaagcttcaaaattatggactatagtttgctgatgtccattcataatattgaccatgctcaaagagagcccctgtcctcagaaacgcagtattccgttgatacaagaaggccggcccctcagaaggccctttacagcacagccatggaaagcatacaaggcgaggctcggaggggtgggaccatggagaccgacgatcagttcgtgaaaaagctcgaacacagctggaaagctttggtacacgacggcgacaccgtctccgtgcaccgccccggcttctacgcggagcgttttcaaaggtttatgtgtaatactgtgttcaagaagatccctctgaagccaagcccctcaaaaaagttccgctctggtagttctttcagcaggcgcgcggggtcgtccggaaattcttgtattacctaccaaccatcagtgtctggtgagcataaggcccaagtgacgaccaaggcagaggttgagccgggtgtgcacctgggacggcccgacgtgctcccccagacgccacctctcgaggagatatccgagggcagtcccattcccgatcccagcttcagtccactggtgggggagaccctgcagatgttaaccacgagcaccacattggaaaaactagaggtcgccgagtcggagtttacccattag

SEQ ID NO: 128451 - DNA, 1623 bp, Artificial Sequence
  Description of Artificial Sequence: Synthetic coding sequence
atgagttccgctgcagagaacggcgaggcggctcctggaaagcagaacgaggaaaaaacttataaaaaaactgcttcatctgccatcaaaggggcaattcaactcggcatcggctacacggtaggaaacttaactagtaagcccgagagggacgttctgatgcaagatttctacgttgtcgagtccgtgttcctgccatcggagggctccaatctaacgcccgcccatcactacccggattttaggtttaaaacctacgcccctctcgcgttcaggtattttcgagaactctttgggatcaaaccagacgactatctctattctatctgttcagagcctctaattgagctgtcgaatcctggtgccagtggctcactgtttttcgtgacaagcgacgacgagtttatcattaagacagttcagcataaagaagctgagtttctgcaaaaactgttgcccggttactacatgaatctaaaccaaaatcctaggaccctgctgccaaaattctacggcctgtattgtatgcagtcagggggcattaacatcaggatcgttgttatgaataatgttcttcccaggtcaatgcggatgcactttacctacgacctgaagggctcaacatataaaagacgcgctagcaggaaggaacgggagaagtccaaccccacattcaaggacttagatttcctacaggatatgcatgaggggctttacttcgacaccgaaacatataatgccctcatgaaaacgctccagagggactgcagagtgcttgagtcctttaaaatcatggattacagtctgctgttaggcatccacttcctggatcacagcttaaaagagaaggaggaagagactccgcagaatgtccccgacgcaaaacgaaccggaatgcagaaggttctgtactcaacagcaatggaatcgatccaagggcctggtaaatctggggacggaatcatcaccgaaaatcccgataccatgggaggcatccctgctaagtcacaccgcggagagaaactattgctgttcatgggcatcatcgacattttacagtcctaccgcctcatgaaaaagctggaacacagctggaaggccctggtgtacgacggagacacggtgagcgttcaccggccgagcttctacgctgataggtttctgaagtttatgaacagtcgtgtcttcaagaaaattcaggccctcaaagccagtccctccaagaagcgctgcaattctatcgcggctctgaaggcaacgtcacaagagatcgtctcttctatcagccaggagtggaaggacgagaaaagagacctcctaacagaaggtcaatcgttttcatccctggatgaggaggccctgggctcccgccacaggccggatctggtgcccagcacccctagcctgttcgaagcagccagccttgctacgaccattagcagctcatccctttacgtcaatgaacactacccccacgaccggcctactttgtactctaattcaaaggggctgcccagtagttcaacattcaccctcgaggagggaacgatctacctaaccgccgagcccaatacgttagaggttcaggacgataacgcctctgtgttggatgtctatctgtag

SEQ ID NO: 128452 - DNA, 312 bp, Artificial Sequence
  Description of Artificial Sequence: Synthetic coding sequence
atgagttcggccgccgagaacggcgaggccgctcctggaaaacagaacgaagaaaagacctacaagaagactgcttcctcagctattaaaggtgcgattcagctagggatcgggtacaccgtcgggaacttgacaagtaaaccagagagagatgtgttgatgcaggacttttatgttgtggagtctgtgtttcttccatcagaaggttccaacttgacacccgcacatcactatcctgattttcgattcaagacatatgcacccctggcgttcaggtactttagggaattatttggcatcaaacccgattag

SEQ ID NO: 128453 - DNA, 1623 bp, Artificial Sequence
  Description of Artificial Sequence: Synthetic coding sequence
atgtcttccgcggcggagaacggcgaggccgcccctggcaaacaaaacgaggaaaaaacttacaaaaagacggcatcgtccgctattaagggggctattcaacttggtattggctacacggtcgggaacctcacctccaaacctgagcgtgatgttctgatgcaggacttttatgtagtggaaagtgtgttcctgccctctgaagggtcaaatttgacccctgcacatcactaccccgatttccggttcaaaacatatgcacccctggccttcagatatttccgggagctattcggaattaagcccgatgactacctgtacagcatttgcagtgagcccctgattgaactcagcaacccaggtgcctctgggtccctcttctttgtgactagcgatgacgaattcattattaagactgtgcaacacaaagaggccgagtttcttcagaaactgctgccagggtattacatgaatctgaatcagaacccccgaaccctgcttcccaagttttacgggctctactgtatgcagagcggcggtattaatatacggattgtggtgatgaataacgtacttccaagaagcatgcgcatgcactttacatacgacctgaagggaagcacgtataagcggcgggcctctcggaaggagagggaaaagagcaatcccacctttaaagaccttgatttcctccaggacatgcatgagggcctgtactttgacacagagacatacaatgcactaatgaagaccctccagcgagactgccgtgtccttgagtcctttaagatcatggattatagcttgctcctcggtattcatttcctggaccactcattgaaagagaaggaagaggagacccctcagaacgtgcccgacgcaaaacgtactggaatgcagaaggtgctgtattctacggctatggaatccattcagggccctggaaaatctggggacggcataatcaccgaaaacccagataccatgggcggcattccagctaagtcgcaccgcggcgagaaattgctactcttcatgggcattatcgatatccttcagagctatcggctgatgaagaaactcgagcatagttggaaggctcttgtgtacgacggggacactgtcagcgtgcataggccttctttctatgccgatagattcctcaagtttatgaattctagggtcttcaagaagatccaggcactcaaagcctccccatcaaaaaagaggtgtaacagcatcgcggctctgaaggccacttcacaggaaatagtaagttctatcagtcaggagtggaaggatgagaaaagggatctcctgacagaaggtcagtctttcagttcactggatgaggaggccctcggcagtcgccaccgcccggatctggttccgtcaactcccagcctcttcgaagcggcctccctcgccactacgataagcagttcctccctctacgtcaacgagcactatccccatgatcggccaaccctttacagcaactccaaaggtttgccaagcagttccaccttcacattggaggagggcacaatatatttaaccgccgaaccgaacaccctggaggtgcaggatgataacgcgagtgtcttggacgtctatctgtag

SEQ ID NO: 128454 - DNA, 1350 bp, Artificial Sequence
  Description of Artificial Sequence: Synthetic coding sequence
atgcaggatttctacgtcgtcgaatctgtattcttgccttctgaaggatccaatctgacaccggcacatcactaccctgactttagatttaaaacatacgctcccctggcctttcggtacttcagagagctttttgggataaagccagatgactatctctattcgatatgcagtgagcctctcatcgagctctccaaccccggggcctccgggagcctgttcttcgtaacctctgacgacgagtttattatcaaaaccgttcagcataaggaagccgaatttttacagaaactgttacccggatactacatgaacttgaatcagaatcctcgaactctcctgcccaagttttacgggctatactgcatgcagagcggcggcatcaatataaggatcgtggtgatgaacaacgtgctgcctcggagcatgcgaatgcattttacttatgacttaaagggctccacatacaagcgaagggcatcacgtaaagagagagagaaatccaatccaaccttcaaggacctggactttctacaggacatgcacgaaggactgtacttcgacacagaaacttacaacgctttgatgaaaaccctgcaaagagactgtcgtgtcctggaatccttcaaaattatggactattcactcctcctggggattcattttctggatcattctctgaaggagaaagaggaggaaaccccacaaaacgtacccgatgcaaagcgcactggcatgcagaaggtgctgtactctactgccatggaaagtatccaagggccaggaaaaagcggcgatggaatcatcactgagaatcccgataccatgggcggcataccggccaagtctcataggggggagaagctactcttatttatgggcatcattgacatcctccagagctatagattaatgaagaaactagaacactcctggaaggcattggtgtatgatggagataccgtctccgtgcaccgcccctccttttacgcagaccggtttctaaaatttatgaacagtcgggtgtttaagaagatccaagctctgaaggcttccccaagtaagaaaagatgtaattccattgcggcactcaaggcaacctcccaagagatcgtaagctcgatcagtcaggagtggaaggatgagaagcgcgacctgttgaccgaaggccagagcttctcatcgctggacgaggaggccctgggatcaagacatcggccagatctcgttcccagcactccaagcctgttcgaagccgcctcactcgctacaacaatttcaagctccagcttatacgtgaacgagcattacccgcatgaccgccctactctgtatagtaatagtaaatag

SEQ ID NO: 128455 - DNA, 489 bp, Artificial Sequence
  Description of Artificial Sequence: Synthetic coding sequence
atgagctctgccgccgagaatggagaggcagcaccaggtaagcagaacgaggagaagacatacaagaagaccgcttcctcagccataaaaggcgctatacaactgggaatcggctatacagtgggcaacttgacctccaaacccgagcgtgacgttctcatgcaggatttttatgtcgtggaaagcgtgtttttaccttccgaaggctcaaatctgacccctgctcaccactatccagattttagattcaagacatacgctcccttagcatttagatacttcagagaacttttcggtatcaaaccagatgactacctttatagtatttgctcggagcctctaatcgaattgtctaatcctggcgcatctggctccttgttcttcgtcacaagcgacgatgagttcatcattaagaccgtccaacataaggaagccgagtttctccagaaattgctaccaggatactatatgaacctgaaccagaactag

SEQ ID NO: 128456 - DNA, 474 bp, Artificial Sequence
  Description of Artificial Sequence: Synthetic coding sequence
atgtcctccgcagctgaaaatggcgaggccgctccgggaaagcagaatgaagagaaaacatacaagaaaacagcctcctcagcaattaaaggcgctatccagcttggtattgggtacacagtgggtaacctgaccagtaagccagaacgggatgtgctgatgcaggatttctatgtagtggagagcgtattcctgcccagcgagggcagcaatctcactccagcgcaccattaccctgactttcgcttcaaaacttatgcacccctggcgttcaggtatttccgcgagctgtttggtattaaacctgacgattacttgtactcgatttgctctgaacccttgattgaactgtctaaccccggggcttcaggttctctgttctttgtaacctccgacgacgaattcattataaagacggtgcagcacaaggaagcagagtttctgcaaaaactgctgcctggttattacatgtag

SEQ ID NO: 128457 - DNA, 1509 bp, Artificial Sequence
  Description of Artificial Sequence: Synthetic coding sequence
atgagcagcgctgcggagaacggcgaggcggctcctggtaagcaaaatgaggagaaaacttataagaaaactgcaagctccgccatcaaaggcgcgatacagctgggtattggctataccgtgggaaacctgacgagtaagccagaaagagatgtcctgatgcaggatttttacgtcgtagagtctgtgttccttcctagcgaaggatccaacctcacacccgcccaccactaccccgatttcaggttcaaaacttatgcaccactcgcctttcgatactttagggaacttttcggaattaagcccgacgactacctgtattcgatctgctcagaacccttgatagagcttagcaacccgggagcgtccgggagtctgtttttcgtgacatcggacgatgaattcattatcaagaccgtacagcataaggaagcggagttcctccagaagttactgccaggctactacatgaatcttaaccaaaaccccaggactctgctgccgaagttttacggcctctattgtatgcagtcaggcggcatcaacatcagaattgttgttatgaacaacgtactgcctaggtcaatgcgaatgcattttacatatgacttaaagggatctacgtataagcgcagagctagtcgcaaagagagagaaaagtcaaaccccacctttaaggaccttgattttcttcaggacatgcatgaaggactgtacttcgacaccgaaacatacaatgcccttatgaagacacttcagcgcgactgtagggttctggaatcgtttaagattatggactactcacttctgctgggcatacacttccttgatcactctctgaaagaaaaagaagaagagactccccagaatgtacctgacgcaaaacgaaccggaatgcaaaaggtgttgtacagtactgctatggagtccattcagggcccaggtaagtccggggatggcattattactgagaatcctgacacaatgggaggtatccctgccaaatcccatagaggcgaaaagcttctgcttttcatgggcataatcgatatccttcagtcctaccggcttatgaagaagctcgaacatagttggaaagctttagtctacgatggcgacacagtcagcgtgcaccggccatcattctacgcagacagatttcttaaattcatgaatagccgcgtatttaagaaaatccaggcattgaaagcttccccttccaagaaaaggtgtaacagcatcgcagcacttaaagctacttcacaggagatcgtcagcagtatctcccaggagtggaaagacgagaaaagggacctgttgaccgagggccagtctttcagctcattggacgaggaggcattagggtcccggcacaggcccgacctcgttccgagcaccccttccttattcgaagcagcttctctagcaacaacaatatcctcttccagcttgtacgttaacgagcattatccccacgataggccaactttatactccaattccaaatag

SEQ ID NO: 128458 - DNA, 2007 bp, Artificial Sequence
  Description of Artificial Sequence: Synthetic coding sequence
atggagcttgaggttcctgatgaggcagagagcgcagaggccggcgccgtgccatctgaagcagcatgggctgctgagagtggcgccgcagccggccttgcacaaaaaaaagccgctcccaccgaggtgctctctatgacagcacagcccggacccggtcatggcaaaaaactgggacatcgaggagtggatgcttcaggcgaaaccacatataagaagaccacgagttcgactctgaagggggcgatccagctaggcattggatatactgtcggacatttgtcaagcaaacctgaaagggatgtgcttatgcaggatttttacgtagtggaatccatttttttcccaagtgagggaagcaacttaaccccagcacaccactttcaagatttccgctttaaaacctacgctcccgtggcctttaggtacttccgagagctgttcgggatccgaccagacgattacctttatagcttatgcaatgagcctttgatagagcttagcaatcccggcgccagtggaagcctattctacgtcacctccgatgacgagtttattatcaaaaccgtaatgcacaaggaggctgaattcctgcagaaactgcttcctggatactacatgaaccttaaccaaaaccctaggaccctcctaccaaagttctatggcctgtactgcgtgcagtccggagggaagaatattagagttgtcgtgatgaataacattctcccccgagtagtcaaaatgcacctgaagttcgacttgaaaggctctacttacaagcggcgggccagcaagaaggaaaaggaaaaatcttttccgacttataaagacctggactttatgcaggacatgcccgagggtttgctgctcgacgccgatacattcagtgccctggtaaaaactcttcagcgcgactgcttggtcctggaaagctttaaaattatggactatagtctcctgctcggtgtgcacaatattgaccagcacgagcgggaacgccaggcacagggggcccaatcgacctccgatgagaaacgccctgtgggccagaaagccctgtattccactgctatggagtccatacagggcggtgccgcgcgcggagaagctatcgagagcgatgatactatgggaggaatcccagccgtgaacggaagaggagagcggctgctcctgcacataggaatcattgacattctgcagagctacaggtttatcaagaagctggaacacacctggaaggcccttgtgcacgatggtgatactgtctctgtccatcggccatcattttacgcagagcgattttttaagttcatgtcgaatacggtgttccgcaagaactcttccctcaaaagtagcccatcaaagaaagggaggggaggggcccttcttgctgttaagcctctaggccctaccgccgccttttccgcatcccagattccctctgaacgcgaagaagctcaatacgacctgagaggagcacggagttacccaaccctggaagatgaagggcgtccagatttactgccgtgtacaccgccctccttcgaggaggccacaacagccagtatcgccaccaccttgtcgtccacctccctgagcatacctgaacgatcccccagtgagacttccgaacagccacgctaccgtagaagaacacaatcatcgggccaggacggcaggccgcaggaagagccaccggccgaagaagacctgcagcaaatcaccgttcaggtggagccagcatgttcagtagagatagttgtgccgaaggaggaagacgcgggcgtggaggctagtccagctggggcgtctgccgcagtcgaagtggagacggcaagccaagcttcagatgaggagggggcacctgcctctcaagcctctgacgaggaggacgcacccgctactgatatttactttcccacagacgagagatcttgggtctattcccctctgcattattctgcgcaggctcctcccgctagcgacggagagagcgacacgtag

SEQ ID NO: 128459 - DNA, 2103 bp, Artificial Sequence
  Description of Artificial Sequence: Synthetic coding sequence
atggaactcgaagttcctgacgaagccgagagtgctgaagcaggtgcagtgccctcagaagcggcttgggccgcagagtctggcgcagctgccggactggctcaaaagaaagccgctcccaccgaagtgctgtctatgacagctcagcccgggcccgggcacggtaaaaaattgggacatcggggagtggatgcctccggtgaaacaacttacaagaagaccacctcctcaacgctaaagggggcaattcagctggggatcggctatacggtggggcatctgtcaagcaagcccgaacgcgacgtcctgatgcaagatttttatgtcgtggaatcaattttcttcccgtcggagggaagcaatctgactcctgcccaccacttccaagatttccgttttaagacatacgccccggtggcttttcgctattttagggagctgttcgggatccgacccgatgattatctctactcactgtgtaacgagccgctcatcgaactatcgaatccaggcgcctctggatctcttttttacgttacatctgacgatgagtttattatcaagaccgttatgcataaggaagctgaattcctgcaaaaactcttgccaggctattacatgaatctcaaccaaaatccgcggacccttcttcctaagttttacgggctgtactgtgttcagtccggcggcaaaaacatccgggttgtcgtcatgaataatatcttgccccgcgttgtcaaaatgcacctgaaatttgacctgaagggttcaacatacaagaggcgggctagtaaaaaagagaaagaaaagtcctttccaacgtataaagaccttgattttatgcaagatatgccagaaggactactcctagatgcggacactttctccgccctcgtcaaaaccctacagagggactgccttgtgctcgaaagcttcaaaatcatggactactcccttctcctcggggtccacaatatcgatcagcacgagcgggagcgacaggcccagggagcgcagagcacttctgatgaaaaacgacctgtcgggcagaaggctctgtatagtacagctatggaaagtatccagggtggggccgcccgtggcgaggccatcgaaagcgatgatacaatgggcggaatccctgcagtgaacggccgcggagaacggctcctgcttcatattggaataattgacatccttcagagttatcgatttattaagaaactcgaacacacgtggaaagcattggttcatgacggagacaccgtgtctgtccaccgccctagcttttatgccgagagatttttcaaattcatgtcaaacaccgtgtttagaaagaattcttccctgaaatcgagcccctccaagaaaggcagagggggggccctgttggccgtcaaaccactgggacctactgccgcctttagtgcctcacagataccgagcgaacgagaagaggcccagtatgacttaagaggagctcggtcttacccaaccctggaagacgagggcaggccagacctgttgccatgcaccccaccgtcatttgaggaggccacgaccgcgtcaatcgctactacactctcgtcaacgtcactgagcattcccgagagatcccccagtgagacttctgagcagccgcgataccgacggagaactcagagctcaggccaggatggacgcccacaggaagagcccccagcggaggaagacctgcagcagattacggtgcaagtggagcctgcctgctctgtcgagatcgtggtgcctaaggaagaagacgcgggcgttgaggcctcccctgcaggggccagcgccgcggtggaagtggagaccgcctcccaggcatctgatgaggaaggagcacctgcaagccaagcatcagatgaggaagacgcccctgcaacagatatatatttctggcgcctgtgggggcctcacgcacctacctggccttggcggcgggaaggccgggcggcatgtttatgcccatatcccccccatgtggtcacaccgtttccggggacgggcttatgcgcctcttggagcccagacgggacgggcggattaggggcaatgagctgttgtgtctccgtatcctag

SEQ ID NO: 128460 - DNA, 1923 bp, Artificial Sequence
  Description of Artificial Sequence: Synthetic coding sequence
atggaactggaagttccggacgaagcagaaagtgctgaagcaggagccgtccccagcgaagcggcttgggcggccgagtcaggcgccgccgccggtctggctcagaagaaggcagccccaaccgaggtactctctatgactgcgcagcctgggcccggccatggcaagaagctaggacaccggggcgttgacgcatcaggagagaccacctacaaaaaaacgacaagttcaacgctcaagggtgccattcaactcgggatagggtacaccgtcggccatctctcaagcaagccagaacgtgatgtcttgatgcaggatttctacgttgtagagtccatcttcttccctagcgagggttctaacctgacccctgcacaccacttccaagacttccgcttcaagacatatgcaccagtcgctttcagatatttccgcgagttgttcgggattcgccccgatgactacttgtatagcctgtgtaatgagccgctaattgaactaagtaatcccggggcgtcaggaagcttattctacgtgacatccgacgatgagtttataattaaaaccgttatgcacaaggaagcggaattcctccaaaaactgctccccgggtattacatgaatctcaatcagaatcctcgcacgttgctaccaaaattctatgggctttactgtgtgcagtctgggggaaagaatattagggtggtggttatgaacaatatattgccacgagtggtgaagatgcaccttaagtttgacctaaagggatccacctacaagaggagagctagcaaaaaagaaaaggagaagtcgttccccacatacaaggatctcgactttatgcaggacatgcctgagggattgctgctcgatgctgataccttctctgcactggtgaagactctgcaaagagattgtttagtactcgaatcgtttaaaatcatggattattccctcttgttgggcgtccataacatcgatcaacacgagagggaacgacaagctcagggggcgcagtcaacctcggatgagaagcgtcccgtgggacaaaaagcactatattccactgctatggagtctatccaaggaggcgctgcaagaggcgaagcgattgagtcagacgacacgatggggggtattcctgcagttaatggacgcggtgagagacttctgctgcacatcgggataatcgacatactgcaatcttacaggttcatcaaaaagctggaacacacttggaaggctttagtgcacgatggagacaccgtatcagtccacaggccttcattttacgccgaacgctttttcaaattcatgtctaatactgtgttcagaaaaaatagttcactgaaatcatccccttcaaagaaggggcggggcggcgccctgctggctgtaaaaccacttggtccgactgcggcctttagcgcatcgcagattccttcagaaagagaagaagcccagtacgacttacgaggcgctagatcatatcctacactagaggatgagggccggcctgacctgctgccatgtactccgccgagcttcgaggaggctacgactgcatccatcgccaccactctgtcgagtacgtccctgtccatcccggagcgttccccctcggagacgagtgaacagccccgctacagacgcaggactcagtccagtgggcaggatgggcggccccaggaagagccgcccgctgaagaggacctgcagcagatcactgtccaagtggagccagcatgtagcgtggagatagtggtgccgaaggaggaagacgccggggtggaggcatctcctgccggtgcatcagcagccgtcgaggttgagactgcttctcaggcctccgatgaggaaggcgctccagcgtctcaagcatccgacgaagaagatgcaccggctaccgatatatatttttag

SEQ ID NO: 128461 - DNA, 576 bp, Artificial Sequence
  Description of Artificial Sequence: Synthetic coding sequence
atgcagagtgtgttctatcctgcaggacggattagtgagcggtacgacattaagggctgcgaagtctcacgctgggtggaccccgcgccagagggatctccactagtgctggtgttaaaggacctgaacttccaaggcaagaccatcaacttggggccacagagatcctggttcctgcggcagatggagctggacaccaccttcctcagggagttgaacgtactggattacagtttgctcatagcgtttcagcgcctgcacgaagatgagcgcggccccgggagctcgttgatcttccgcactgctcgatcagttcagggtgcccagagccccgaggagtctcgcgcgcagaatagacgcttacttcccgacgccccgaacgctttgcatatccttgatggccccgagcagcgctatttccttggcgtggtcgacttggcgactgtctacggcctccgaaaaaggctagagcacctctggaaaaccctccgctatcccgggcggaccttttctactgtgtcccccgcaagatatgcacgtcggttgtgtcagtgggttgaagctcataccgagtag

SEQ ID NO: 128462 - DNA, 1185 bp, Artificial Sequence
  Description of Artificial Sequence: Synthetic coding sequence
atggccgcccctagtcccggcccacgggaagtgctcgccccatcccccgaagctggatgcagggctgtcacctccagtcgccgggggctgctatggagacttagggataaacaatctcgactcggattgtttgagatctcccccggtcatgagctgcacgggatgacatgtatgatgcaggccggcctgtgggccgctactcaggtgagcatggaccatcctcccactgggccaccgagtagggacgatttttctgaggtactgactcaggttcacgagggatttgaactgggaacgctggcgggtcctgcctttgcttggttgcggaggagcctaggcctggctgaggaggattatcaggcagcactcggaccaggtgggccgtacctccagtttctcagtactagtaaatctaaggcaagtttcttcctgtctcatgatcaacggttcttcctcaagacacaggggagaagggaggttcaggccctgctggcccatctaccacgttatgtgcagcaccttcagagacatccccacagtctcttagctagactgcttggcgtacatagcttgcgggtggaccgcggtaaaaaaacatattttatagtgatgcagagtgtgttttacccagccggtcggatcagtgaaagatacgacatcaagggctgcgaggtctctagatgggtggatcccgcaccagaaggtagtcccctagtgctggtgcttaaggacctgaactttcagggaaagaccatcaacttagggccgcagcggagttggttcttaaggcaaatggagctcgatacaacctttttgcgcgaactgaacgtgctcgactactccttgttgatcgccttccagaggctacatgaagacgagcgcggcccaggtagtagcctaatttttaggaccgccaggtcagtccagggggctcagtctcctgaagaatcccgggcgcagaacaggcgcctgcttccagacgccccgaatgctctgcatatcctggatggccccgagcagaggtatttccttggcgtggttgatctggcaactgtctatgggttgcgcaaacgcctggaacacttatggaaaaccttgcgatatccaggccggaccttctctactgttagtcctgcacggtacgctagaaggctgtgccagtgggtggaggcccatacagaatag

SEQ ID NO: 128463 - DNA, 1128 bp, Artificial Sequence
  Description of Artificial Sequence: Synthetic coding sequence
atgatgtgccaatcggaagcccgccagggccccgaactccgcgcggcaaagtggttgcacttccctcagctcgccttgcgacggcgtttagggcaattgagttgcatgtcccgcccggccctgaaactgcgttcttggcccctcaccgtcctgtactacctgcttccatttggcgcactaaggcctctgagccgggtcggctggagacccgtcagcagagttgctctctacaagtcagttcccactaggctgttaagccgcgcttggggccggcttaaccaggtcgagctaccacactggcttcgccgaccagtctactcattgtacatctggaccttcggtgtcaatatgaaggaggcggccgtggaagatctgcatcactatcgcaacctcagcgagtttttccgccggaaactcaaaccccaggccaggcccgtttgcggcttgcactctgtaatatcaccatctgatggccggatactcaatttcgggcaggtgaaaaactgcgaggtggagcaggtcaaaggtgttacttactccctggagtcgttcctggggcccaggatgtgtaccgaagaccttcctttccctcccgccgccagctgtgattcattcaagaaccagttagtgaccagggaaggcaacgaactgtaccattgtgtaatctacctcgcgcctggggattaccattgcttccacagtcctaccgattggacagtgtcacatagaagacattttcctggatccctcatgagcgttaacccaggaatggcaagatggattaaggaattgttctgtcacaacgagcgagtcgttcttacaggagattggaaacacgggttctttagtctcaccgctgtcggagctacaaacgtggggagcattcgcatctactttgaccgggacctccacacaaactccccccgccactcaaaggggtcatacaatgatttctccttcgtcactcataccaatagggaaggcgtgccaatgcgtaaaggagagcatctcggggaattcaacctagggagcactatcgtgctgatctttgaggcacctaaggacttcaacttccagctgaagactgggcaaaaaatcagatttggggaggcattgggttctttatag

SEQ ID NO: 128464 - DNA, 1227 bp, Artificial Sequence
  Description of Artificial Sequence: Synthetic coding sequence
atggccaccagcgtgggacaccgctgtttgggattacttcacggagtagcaccctggagatcttcccttcacccctgcgagataaccgcactgtcccagtctttgcagcctctgcgcaaattgccgttccgggcattcaggaccgatgcccgtaaaatacatacagcgcctgcacgcacgatgttcctccttcggccgttgcccatcctgctagtaaccggggggggctacgctggttacaggcaatatgaaaagtaccgggaacgggagcttgagaaattggggcttgagatcccccccaaattggccggacactgggaagtggccctgtacaagtcagttcccaccaggctcctgtctagggcatgggggagactcaaccaggttgaacttccgcactggctgaggcgccccgtgtacagtttgtacatctggacctttggcgttaatatgaaggaggcagcagtggaggacctacatcactaccgcaacctcagcgaattttttcgccgtaagctgaaaccccaagcccgtccggtttgtggtctgcatagtattagtccctcagatggccggatactgaactttggtcaggtgaaaaattgcgaggttgagcaggtgaagggtgttacctactcactcgagtcattcttgggtcctcggatgtgtactgaggatctaccttttcccccagctgccagctgcgacagcttcaagaaccaactcgtgactagggaggggaatgagctctaccattgcgtgatttacctggctcccggagattaccactgttttcattctccgaccgactggactgtctcccaccggcgacatttcccgggctcattgatgtctgtgaatcccggtatggcaagatggattaaggaactgttttgtcataatgagagagttgtacttactggcgattggaaacacggttttttcagcctaacggctgtcggggctaccaatgtcggatccatccggatctactttgaccgagatcttcacactaatagccctcggcactccaaggggtcctataacgacttcagtttcgtcacccatacaaacagggaaggcgtgcccatgcgtaaaggggagcatctgggcgagtttaacctcggatccaccatcgtcttaatctttgaagcccccaaagactttaattttcagctgaagacgggtcagaagattcgatttggagaggccctggggtcactttag

SEQ ID NO: 128465 - DNA, 1128 bp, Artificial Sequence
  Description of Artificial Sequence: Synthetic coding sequence
atgatgtgtcagtctgaggctcgacaaggaccggagctgcgggctgcaaaatggctccacttcccccagctcgctctgagacgtcgcttgggtcagctctcctgcatgagcagacctgccttgaaactgcggagctggcccctcactgtgctgtactatttgttaccttttggtgccctcaggccactctctagagttgggtggaggccggtgtcccgcgtcgccttgtataagagcgtcccaaccaggctgctgtctcgcgcatggggccggcttaatcaagttgagctcccacattggcttcggaggcccgtgtacagtctgtacatctggacgttcggggtgaatatgaaggaagccgctgttgaggatctccatcactatcggaacctgtccgagtttttcaggagaaaacttaaaccgcaagcgcggcccgtgtgtggcctgcatagcgtcatctccccttctgacggtcggattcttaacttcggtcaggtgaagaactgtgaggtagagcaggtaaaaggggttacgtacagcctagagtcgtttttgggcccccggatgtgtaccgaggatctccctttccccccagcagcgtcttgtgactcgttcaagaaccagttggtcactcgggagggtaacgaactctaccattgtgtcatttatctggcccccggggactatcactgcttccactctcccaccgactggacagtcagtcatagacgccacttccctggcagtcttatgagtgtaaatccaggtatggcacgatggattaaagagctattttgtcacaacgagcgggtggtacttactggagactggaagcacgggtttttctccttaaccgccgtcggggctacaaacgtcggcagcatcaggatctattttgacagagaccttcatactaactccccaaggcacagcaaaggaagctataatgacttttccttcgtcacccataccaatagagaaggagtcccaatgaggaaaggtgagcacttgggtgagtttaatttgggatcaaccatcgtgctaatctttgaggcccccaaggatttcaatttccagctgaagacgggccagaaaatccggttcggggaagctctcggttctctgtag

SEQ ID NO: 128466 - DNA, 789 bp, Artificial Sequence
  Description of Artificial Sequence: Synthetic coding sequence
atgatgtgtcagtccgaagctcggcaggggcctgagctgcgggccgctaagtggcttcacttcccacagctcgcgctgcgccggaggctcgggcagctttcctgcatgagtagaccagcacttaaactgcgttcatggcccctgaccgtcctgtactatcttctgccatttggagccctgaggcctctctcaagggtcgggtggaggccagtcagccgagtggcactatataagagtgtaccaaccaggctgctgagcagggcatggggacggctcaatcaagtggaactgccccactggttaaggagaccagtatacagcctctacatatggacgtttggtgtaaacatgaaggaggccgctgtcgaggatttgcatcattatcggaatctgtctgaatttttccggcggaaactcaaacctcaggcccgtccggtgtgcggcctccattccgtgatcagcccttcagacggtagaatcctgaatttcgggcaggtgaagaattgtgaagtagaacaggttaaaggggtgacttacagtctagagagtttcctgggaccgcgaatgtgcacagaagacctgcccttcccaccagccgctagttgtgactcctttaagaaccaactggttactagggagggaaatgaactgtatcattgcgtgatttacttagccccaggggattaccactgcttccacagtccaactgattggacagtcagtcataggcgccacttccctggcccagcccacaagcagcctaaagcacagcaaggtctcctccagtag

SEQ ID NO: 128467 - DNA, 687 bp, Artificial Sequence
  Description of Artificial Sequence: Synthetic coding sequence
atgatgtgccaaagtgaagctagacaggggccagaacttcgggcagctaaatggttacacttcccccagctggcactgcgccgccgcctcggccagctttcctgcatgagtagaccagcactgaagctccgtagttggcccctcactgtgctgtattatctcctacccttcggagctttaaggccactctcacgtgtggggtggaggcccgtatccagagtggcgctgtataagtcagttcccacgcgccttttgagtagggcatggggccgcttaaaccaggtggagctgcctcactggctcagaaggccggtgtattccctgtatatctggactttcggagtgaatatgaaggaggctgccgtagaggacctgcatcactacagaaacttaagcgaattttttcgccgcaaacttaagccccaggcccggcctgtatgcggattacatagtgtgattagcccgtcagacggaaggattttgaattttggccaggtgaagaattgcgaagttgagcaggtgaagggagtcacgtactctctagaaagctttctgggaccccgcatgtgcacggaggacttgccattcccccctgccgcttcttgtgattccttcaaaaatcagttagtgactagggagggtaatgaactgtatcactgcgtgatctatcttgcccctggcgattag

SEQ ID NO: 128468 - DNA, 222 bp, Artificial Sequence
  Description of Artificial Sequence: Synthetic coding sequence
atgatgtgtcagagtgaggcgcgccagggccccgagctgagagcggccaaatggctacacttccctcagttggccctacgtagacggttgggccaattaagctgtatgtcacgcccagctttgaaactcaggtcttggccactcaccgtcctctactacctgctgcccttcggcgcactgcgtccactgagtcgggtgggttggaggcctgtctccagatag

SEQ ID NO: 128469 - DNA, 222 bp, Artificial Sequence
  Description of Artificial Sequence: Synthetic coding sequence
atgatgtgtcagtctgaggcgcgacaggggccagagctgagagccgccaagtggctgcatttcccccagctcgcattaagacgacgcctcgggcagctaagctgtatgagccgaccagccttaaagctgcggtcatggcctctgaccgtcctttattacttgcttccattcggagccttgcggcccttgtcccgagttggatggagaccggtgtcccgctag

SEQ ID NO: 128470 - DNA, 1230 bp, Artificial Sequence
  Description of Artificial Sequence: Synthetic coding sequence
atggctacatctgttggtcaccgatgcttgggtctgcttcacggcgttgccccatggagatcatccttgcacccctgcgagattactgccctgagccagagtctgcagcccttacgcaagctgccctttcgcgcctttagaaccgacgcccgcaaaatccacacggccccagccaggactatgtttctgctcagaccactaccaattctgctggtgaccggcggagggtacgccggttacaggcagtacgagaaatatagggagcgggagctagaaaagcttggcttagaaattccacctaagctcgcaggccactgggaggtcgccctctacaaatccgtccctaccagattgttaagcagagcatggggacggcttaatcaggtcgaactcccgcattggcttcgccgcccggtttactccctttatatttggaccttcggggtgaatatgaaagaggctgctgtggaggacctgcatcactataggaatttgagcgagtttttcagaaggaagctcaagcctcaggcccggcctgtctgtggcctgcactccgtgattagcccttctgacgggagaatcttaaactttggacaagtgaagaactgtgaggtggagcaggtgaaaggagtgacttatagcctagagtcgtttttgggtccacgcatgtgtacggaggacctcccattcccaccagctgcctcatgcgactctttcaagaatcagctggtgacccgggaagggaacgagctgtatcactgtgttatctacctggcccccggcgactatcattgttttcacagccctacagactggactgtctcacaccggcgccatttcccgggctccctgatgtccgttaacccaggaatggctcggtggatcaaggaactgttttgtcacaacgagcgcgtggtgcttacaggggattggaagcatggcttctttagcctcacggcagtgggagcgactaacgtgggtagcatacgtatatatttcgaccgggatctacataccaactctcccaggcattccaaaggcagttataatgatttctccttcgtgacccacaccaatcgcgagggcgtgcctatgcggaagggggagcatctgggagaatttaatcttggctctacaatcgtgcttattttcgaggcccctaaggatttcaattttcagctgaagaccggacaaaaaatacgctttggcgaggcccttggctcactgtag

SEQ ID NO: 128471 - DNA, 246 bp, Artificial Sequence
  Description of Artificial Sequence: Synthetic coding sequence
atgatgtgccagtccgaggcgaggcagggtccagaactgcgggctgcgaaatggttgcatttccctcaattagcactccgtcggcgactgggacaactcagctgtatgagtcgtcccgccttgaaattgcgctcttggccactgacagtcctctattatctgctcccttttggcgcacttcgtccactgtctcgtgtaggatggcggcccgtttcaagggtcgccctgtacaagtctgtgccttag

SEQ ID NO: 128472 - DNA, 981 bp, Artificial Sequence
  Description of Artificial Sequence: Synthetic coding sequence
atgatgtgtcaatcggaggccagacagggccccgagctacgcgctgccaagtggcttcattttccacagctggccctccggaggcgactaggccagttgtcttgcatgtcccgccctgccttaaaactcagatcttggccactgacagttctgtactatctgctgccattcggcgcgctccggccacttagtcgagtggggtggaggccagtgagccgcgttgccctttataagtcagttcccacacggctactgagccgcgcctggggcagactcaaccaagtggagctgcctcactggttgcgtcgccccgtctatagcctatacatatggacgtttggagtaaacatgaaagaggctgctgttgaggatttacaccactataggaacctgtcggagtttttccgtcgaaaactgaagccacaagcacgacccgtctgtggtctccattcggtgatctcaccaagcgacggaaggatcctaaattttggtcaagtgaaaaactgtgaagtggaacaggtcaagggtgttacgtattcgctggagtccttcctaggcccacgcatgtgcacggaagacttgccttttcctccagccgcttcctgcgactcctttaagaatcaactcgtgacacgcgagggcaacgaattgtatcactgtgtgatctacctcgccccaggggattatcactgtttccactccccgactgattggaccgtctcccaccgcaggcacttcccgggaagtttgatgtcagtaaacccaggcatggccaggtggattaaagaactcttttgccataacgaacgcgtcgtgttgaccggagattggaagcacggattcttttctttgaccgctgtaggtgctactaatgtgggttcaattcgcatatatttcgatagagacttacacactaactctccacggcacagtaaggggagctacaacgacttctctgtcgtggggtcgctgaccagatag

SEQ ID NO: 128473 - DNA, 984 bp, Artificial Sequence
  Description of Artificial Sequence: Synthetic coding sequence
atggagtacgccgtaaactgccatgttattacttgggagagaattattagccactttgatattttcgcttttggccacttctggggctgggcaatgaaagcattgctgattcggagctacggtttgtgttggacaattagcatcacttgggaactcacagagcttttcttcatgcacctgctacccaactttgccgagtgttggtgggaccaggtgatcttggacatcctcctgtgcaacggcggagggatctggctcggaatggtggtgtgcagatttctggaaatgcgcacgtatcattgggcctcattcaaggatattcacaccactaccggcaagattaagagggctgtcctccagttcactcccgcctcatggacgtatgtcagatggtttgatccaaaaagttccttccagcgggtggctggtgtgtacctctttatgatcatctggcagttaactgagctcaataccttttttctgaagcacatctttgtattccaggcttctcaccctctgagctggggccgcattctgtttatcgggggaatcaccgccccgactgtgcgccagtattatgcataccttacggatacacagtgcaaacgtgtgggtacacagtgttgggtatttggggtgattggttttctcgaagcgatagtatgcattaagttcgggcaggacctgttttccaaaacccagatcctatacgtggtactatggttgctttgtgtggcttttacgactttcctttgtttgtatggaatgatctggtatgccgaacattacggccatagagagaagacatacagtgagtgcgaagacggaacatatagcccggagatctcctggcatcaccggaagggcacaaaaggatcagaagacagcccaccaaaacacgcgggcaacaacgagagccattcttcaagaagacgcaacagacattcgaagagcaaagttacaaatggagtggggaagaagtag

SEQ ID NO: 128474 - DNA, 1422 bp, Artificial Sequence
  Description of Artificial Sequence: Synthetic coding sequence
atggccagctgtgtgggcagccgtacgctgagcaaggacgatgtcaattacaaaatgcacttcaggatgatcaatgaacagcaagtggaggacattactattgattttttctaccggcctcatacaattacattactcagctttactattgtctcacttatgtatttcgcattcacccgggacgattccgtacccgaggacaatatttggagaggcatactgagtgtgattttcttcttcctcattattagcgtcctcgcatttcctaacggacccttcacaaggccacacccggccctctggcgcatggtgtttggtctgtctgtgctctactttctctttctcgtgttcctgctgttcctaaatttcgagcaggtgaaatcacttatgtactggctcgaccccaatctgcgctatgccaccagggaagctgatgttatggagtatgcggtgaactgtcatgtcatcacctgggagcgaattatcagccattttgatatttttgcttttggccatttctggggatgggcgatgaaggccctgctgattaggtcctatgggctgtgttggacaattagtatcacctgggaacttactgagctcttctttatgcacttgctccctaattttgccgaatgttggtgggaccaggtgatcttggatattcttctttgcaacggtggcggaatttggctaggaatggtggtgtgcaggtttttggaaatgagaacatatcattgggcctccttcaaggacatccacaccacgacaggcaagatcaagcgggcagtcctgcagttcaccccagcttcttggacttatgtccgctggttcgatcccaagtcttctttccagcgtgttgcaggggtgtatctgttcatgataatctggcagctcacggaattgaatacttttttccttaagcacatcttcgtgttccaggcgtcacaccctctgtcctggggtcgcattttattcatcggaggcattacagcgccaactgtgaggcagtattacgcgtaccttacggacacccaatgtaagagagtgggaacccaatgttgggtcttcggggtaatcgggttcctggaggctatagtgtgcataaagttcgggcaggacctattcagcaagacccaaatcctgtacgttgtactctggctcctctgcgtggccttcacgacctttctctgcctctatgggatgatttggtatgcagagcattacggccacagggagaaaacttactccgagtgcgaagatggaacgtattcgcctgaaatttcctggcatcaccgcaaggggacgaagggtagtgaagactcaccccccaaacacgccgggaacaacgagagtcacagcagcagacgccgaaataggcactcaaagtctaaagtgacaaacggagttgggaagaagtag

SEQ ID NO: 128475 - DNA, 1464 bp, Artificial Sequence
  Description of Artificial Sequence: Synthetic coding sequence
atgcgacgcggggagagacgggatgccggagggcccaggcctgagtcacccgtcccggccggtcgcgcctctttggaagagcctcctgacggcccaagcgcaggacaggccaccggacctggcgagggcaggagatccaccgagagcgaagtctacgatgacgggactaacacattcttttggcgcgcccatacattgacagtgttattcatcttgacatgcacccttggatacgtgactctgctcgaagaaaccccgcaggatacagcttacaataccaaacggggcatagtagccagcatcctcgtcttcctctgctttggagttactcaggccaaggatggtcctttctctcgcccacacccagcttactggcgcttttggctgtgcgtgagcgttgtatacgagcttttccttattttcattctgttccaaacagtgcaggacggaagacagtttctgaaatacgttgaccccaagctcggggtacctctgcccgaacgagactacggtggcaactgtctaatctacgacccagataatgaaactgacccatttcacaatatctgggataaactggatggattcgtgcctgcccatttcctggggtggtacctaaagaccctcatgattcgagactggtggatgtgtatgattataagtgtcatgtttgaattcctggaatacagcctcgagcatcaactgcctaatttctcggaatgctggtgggatcactggatcatggacgtcctcgtttgcaacggcttaggcatctattgcgggatgaagacactcgaatggttgagtttgaaaacctacaaatggcaaggcctgtggaatatacctacatataaaggcaagatgaaacggatagctttccaattcacaccctactcctgggttcggtttgagtggaagccagcatcaagcctgagacgatggctcgccgtatgcggtatcattctggtgttccttctcgccgagttgaacacattttatctcaaatttgtgctttggatgccacctgagcattacctcgtgcttctgcggctggtctttttcgtgaacgtgggaggcgtcgctatgagagaaatttatgactttatggatgaccccaagccgcataagaaactgggtcctcaggcgtggttggtcgctgcgatcaccgccactgagttactgattgtggtgaaatacgatccccatactctcaccctcagcctgccgttctatatctcgcagtgttggaccctaggctccgtgttagccctgacatggacagtgtggaggtttttcctgcgtgatatcacgctgcgctataaggagacacgctggcagaaatggcagaacaaggacgaccaaggtagtactgtcggtaacggcgatcagcacccactaggcctcgacgaggacctgcttggtcctggtgtcgccgaaggggagggagctcccacacctaactag

SEQ ID NO: 128476 - DNA, 2802 bp, Artificial Sequence
  Description of Artificial Sequence: Synthetic coding sequence
atggccgcctcacgcctggactttggcgaggtggagacctttctcgaccgccacccagagcttttcgaggattacctcatgaggaagggcaagcaggaaatggttgaaaaatggctgcagcggcatagccaggggcagggagcgcttgggcctcgcccgtcattagcaggcacttcgtctcttgcccactccacatgcaggggaggctcttcagtcgggggggggacgggcccaaacggcagcgctcactcacagccgttacctggcgggggcgactgtggaggcgtgccactctccccatcatgggccggcggtagtcgcggagatggaaatctccagcgtagagcctctcagaaggagcttcgcaagtcattcgcacgatctaaagcaattcacgtgaaccgaacctatgatgagcaggtgacaagcagggcccaggaaccactttctagcgtcagacgtcgggcgctactccgcaaggcctcgagtctcccgccaacgacggcgcacatcctctccgcccttttagagagtcgcgttaacttgcccagataccctcctacggcgatagattacaaatgccacctgaagaagcacaacgaaaggcagttcttccttgagctagtgaaagatatcagcaacgacctggacctcacgtccttatcttataagatccttattttcgtgtgcctaatggtcgacgccgaccggtgttccctctttctggttgaaggcgccgctgctgggaagaagactctcgtgagtaagttctttgatgtccatgccggtacccctcttctcccttgcagcagtaccgaaaatagcaatgaggtccaggttccctggggcaaaggaattatcggatacgtcggagagcacggagagacagtaaacatccccgacgcgtaccaggatcgtcgcttcaacgacgagattgacaagctgactggatacaaaacaaaaagcctgctatgcatgccaatccggtcatcagacggagagattatcggtgtggcacaggcaattaataaaattcccgagggagcacctttcaccgaggatgacgaaaaggtaatgcagatgtatctgccattttgtggaatcgccatctccaatgctcagctgtttgcagcgtcaaggaaggaatacgaacgctcccgggccctcctagaggttgttaatgacctgtttgaggagcagacagacctggagaagattgtaaagaagatcatgcacagggctcagacacttctcaaatgtgaaagatgttcagtcctcctgctggaagacatcgaaagccctgtcgtgaaattcaccaagagctttgaactgatgagccccaagtgttcagccgatgcggaaaactcattcaaggagtcaatggaaaaatcctcatactcagactggctgatcaacaatagtatcgctgaactggtggcctctaccggtttgcccgttaatatctcagatgcctaccaggaccctagattcgatgctgaggccgatcaaatctcagggtttcatatcagaagtgtgctgtgtgtgcccatctggaattcaaaccaccaaattatcggcgtggcgcaggttcttaatcgtttggatgggaaaccttttgatgacgcggatcagcggttgtttgaggctttcgtcattttctgcggtttagggatcaataacactatcatgtacgaccaggtcaagaaaagttgggctaagcagagtgtagccctggatgtcttgagttatcacgccacctgctccaaggcggaggtcgacaagttcaaggcagcgaacatcccattggtaagtgagctcgcaattgacgacattcacttcgacgatttttccctcgacgtagatgcaatgattactgctgctctgaggatgtttatggaattgggtatggtacagaagtttaaaattgattatgaaaccctgtgcagatggctgctgacagtccggaaaaactaccgcatggtcctataccacaattggaggcacgcattcaatgtgtgtcagttgatgtttgccatgcttacaaccgccgggttccaagatattcttaccgaagttgaaattctcgcggtgattgtgggttgtctttgccatgatttagaccacaggggtactaataatgccttccaggctaaaagtgggtctgctctagctcagctctacgggacctcagccaccctggagcaccatcactttaaccatgctgtgatgattctgcagtcagaagggcataacattttcgcaaacctgagttctaaggaatactcggacctgatgcagcttctcaagcagtctatcctcgctacagatctgaccttatacttcgagcgccggacagagttctttgagctcgtttcgaaaggtgaatacgactggaatataaaaaatcaccgggatatcttcagatcgatgctcatgacagcctgtgaccttggtgcagttactaaaccatgggagattagccgacaggttgccgagctcgttactagcgagttctttgagcagggcgaccgggaacggcttgaactgaaactcaccccttccgccatatttgatcggaacagaaaggacgagcttcccaggctgcaactggagtggattgacagcatttgcatgcctctgtatcaggcactcgtgaaagtcaacgtaaagctgaaacccatgttggatagtgtggccacaaaccgtagcaagtgggaagaactgcaccaaaagcggctcctggcttccaccgcaagttcaagcccagcctctgtgatggtggccaaagaagatcgaaattag

SEQ ID NO: 128477 - DNA, 2052 bp, Artificial Sequence
  Description of Artificial Sequence: Synthetic coding sequence
atgctcaagcaagcccgaaggcccttatttcgaaacgttctgtctgccacccaatggaagaaagtgaaaatcacacgactcgtacagattagcggcgcatctctcgctgagaagcaggagaagcatcaggactttttaattcagaggcagaccaagactaaagacaggcgctttaatgatgaaatcgacaagttaaccgggtacaagacaaaatctcttctctgcatgccaattcgctcatccgacggcgagattatcggcgtggcacaggctattaataagattccagagggcgccccattcacagaggatgacgagaaggtgatgcagatgtacctcccattctgtggcattgcaatcagtaacgcccaattgttcgcagcttctcgaaaagaatacgagcgcagtagggccctgctcgaggtggtcaacgacctgtttgaggagcaaactgacctcgaaaaaatcgttaagaagattatgcaccgcgcccagacactgcttaagtgcgagcgctgttcggttctgttactagaggacattgaatctcccgtcgtgaagttcacgaaatcatttgaactaatgagccccaagtgttccgcagatgccgagaatagtttcaaagagtccatggaaaagagctcgtatagtgattggctgatcaacaacagcattgctgagttggtggcctccaccggtctgcccgtgaatatatcggatgcgtaccaggaccccaggttcgacgccgaagctgatcagatctcggggtttcacatccgcagtgttctctgcgtgcccatatggaatagcaatcatcagatcataggggtcgcccaggtactgaataggcttgatggcaagccattcgatgatgctgaccagcgtttgtttgaggcattcgtgatcttttgcggcctggggataaataacaccataatgtatgatcaggtcaaaaaatcctgggcaaagcagtccgtcgcacttgacgttctctcataccacgctacctgttccaaagccgaagtggataaatttaaggcagcaaatataccgcttgtgtctgaactggccatcgacgacatccacttcgatgacttcagcttggacgtagatgctatgatcactgccgccctgcgcatgttcatggagctggggatggtgcagaagttcaaaatcgactatgagaccttgtgtagatggttgctaactgtcaggaagaactaccgaatggtactctaccacaactggagacatgcatttaatgtgtgtcaactcatgttcgccatgctgactactgctggtttccaggacatactgacagaagtggaaatcctggccgtcattgtggggtgcctttgtcacgaccttgatcatcgaggaacaaataacgcctttcaagccaaatcaggctccgcactagctcagctgtatggaactagcgctacactggagcaccaccacttcaaccatgctgtgatgatactgcaaagtgaaggccacaacatctttgcaaacctttcgtcaaaagagtattctgatttgatgcagctccttaaacagtctatcctggcaacagatcttacactgtacttcgagaggcgtacagagttttttgagcttgtgtccaagggagagtacgattggaatataaagaatcacagggatatatttagatccatgttgatgactgcctgcgaccttggcgcggtcacgaagccatgggaaatctcacgacaggtcgcagaacttgttacttccgagtttttcgaacagggcgatcgggaaagactggagctgaagctgaccccttctgctatctttgataggaacagaaaggatgagctgcctcggctacaactagagtggattgattccatttgcatgcctttatatcaagcgctggtgaaggttaacgtgaagcttaagcccatgctggactccgtggcaacgaataggagcaagtgggaagagttgcaccagaaaaggctgctggcttcaacagcctccagctcgcctgctagtgtgatggtagctaaggaggaccggaactag

SEQ ID NO: 128478 - DNA, 1470 bp, Artificial Sequence
  Description of Artificial Sequence: Synthetic coding sequence
atgagcccgaaatgctccgccgacgcagagaactccttcaaagaaagcatggagaaatcctcttactcagactggctgataaacaacagtatcgccgagctggtggctagcaccggccttcccgttaacatttcagacgcctatcaagacccacggttcgatgctgaagccgaccaaatctccggtttccatatccgcagcgtgctgtgtgttccgatatggaattctaatcatcagattatcggcgtggcacaggtactaaatcgcttagatggcaaaccgtttgatgatgccgatcagcgcctgtttgaggcgttcgtgatcttctgcgggctgggaattaacaatacaattatgtacgaccaggtgaaaaaaagttgggccaaacagagcgtcgctttggatgttctgtcctatcatgcaacctgttcaaaggccgaagtggataaattcaaagctgcgaatattcccctggtcagcgagctggctatcgatgatatccactttgatgatttttctctagacgttgacgccatgatcaccgcagcactgcggatgttcatggaactcggcatggttcagaagttcaagatcgactatgagactctgtgccgctggttgttgacagtgcgcaagaactacaggatggtgctttatcacaattggaggcacgcctttaacgtgtgccagctcatgttcgccatgcttacaactgctgggtttcaggacatcttaaccgaagtggaaatcttagcggtgattgtgggttgcctctgtcacgatctagaccatcgcggcacaaacaatgcgttccaggctaaatcaggctctgctctggcacagttgtatggtacttcagccacacttgagcatcatcatttcaaccacgcagtgatgatattacagagtgagggccacaacattttcgcaaacttatctagcaaggaatatagtgatctgatgcaactgctcaagcaatcaatacttgcaaccgatctaacactttatttcgaaaggaggactgagttttttgagctggtgtctaagggagaatacgactggaacatcaaaaatcatcgggacatttttaggtcaatgctgatgaccgcgtgtgacctgggcgccgtgacgaagccttgggagatcagtcgacaggttgcagagctggttaccagcgaattcttcgaacagggggacagagagagactggaattgaagctgacaccctccgctatattcgaccggaacaggaaggacgagctcccccgactgcagctggaatggatagactccatctgtatgccactgtatcaggccctggtgaaggtgaatgttaaattgaagcctatgctggacagtgtcgcaacgaacagatctaaatgggaggaactccaccaaaagcggctgttagcgagtacagcgtcaagcagccccgctagcgtgatggtcgccaaagaggatcgtaattag

SEQ ID NO: 128479 - DNA, 1728 bp, Artificial Sequence
  Description of Artificial Sequence: Synthetic coding sequence
atgcagatgtacttgcctttctgcggaattgccataagtaacgcccagttattcgccgccagtcggaaagaatacgaacgctcaagggcattgctggaggttgtcaacgatctttttgaggagcagacagacttggaaaaaatcgtcaaaaaaatcatgcatcgggctcagacactgctgaagtgcgaaaggtgctccgtgttactgctggaggacatagagtcacctgtcgtcaagttcacaaaaagtttcgaactgatgtctccaaagtgttcagcagacgctgaaaacagttttaaagaatctatggagaaatccagttattccgactggttgatcaacaattctatcgcagagctggtggcttctacgggcctccccgtgaatataagcgacgcataccaggacccaaggttcgatgccgaagcagatcagatatcagggtttcacatcaggtctgtactgtgtgtacccatctggaactctaaccaccaaatcatcggggtagcacaggtcctgaatcgcctagacggaaaaccatttgatgatgcagaccaaaggctcttcgaggcattcgtcatattctgtgggcttggcatcaacaataccatcatgtacgatcaggtcaagaaaagctgggctaagcaaagtgtcgccctagacgttctgagttaccatgccacctgttccaaggctgaagtcgacaagttcaaggcagcaaacatacctctggtgagcgagctcgcgatcgacgatatccattttgatgacttttccttggacgttgacgctatgatcacagccgctctgcgcatgttcatggagttgggtatggtacagaagtttaaaatcgattatgagacattgtgccgatggctactgacagtgaggaaaaattacaggatggttctgtaccacaactggcgccacgcatttaacgtgtgccagcttatgtttgccatgttgactaccgcggggttccaagacattctgacagaggtcgaaatactagcagtaattgtggggtgcctgtgccatgacctggaccatagagggacaaataacgctttccaggcaaagtccggatcagcattggcccagctgtatgggacctctgctaccttagaacaccaccactttaaccatgcagtgatgatcctacagtcagagggtcataacatttttgcaaatttaagctctaaggaatattccgacctgatgcagctactcaaacagagcattctggccacagacttaacactgtactttgagcgtagaacggagtttttcgagctggtgtccaaaggcgaatacgattggaatataaaaaaccatcgggacatcttccgctcaatgctcatgacagcatgtgatctcggggctgtaaccaagccttgggaaatctcccgccaggtagctgagctcgtcactagcgaattcttcgagcagggtgacagagagcggctggagcttaagctgacacccagtgcgatctttgataggaataggaaagatgaacttccacggcttcagctggagtggattgactctatatgcatgccactgtaccaggctctcgtaaaagtaaatgtgaaattaaagcctatgctggattccgttgccactaatcggtctaagtgggaggagctccaccaaaagcgccttctggccagtacggcttcctcctccccagcctcagtaatggtcgcaaaggaagacaggaactag

SEQ ID NO: 128480 - DNA, 393 bp, Artificial Sequence
  Description of Artificial Sequence: Synthetic coding sequence
atgccaattagaagtagtgacggggagatcatcggggtggctcaagccatcaacaagatccccgagggggcccctttcaccgaggacgatgagaaagtgatgcagatgtatctccccttttgtggaatagccatttccaacgcccaactcttcgccgcgagccggaaagaatacgagcgcagccgagccctgttggaagtagtcaacgatctgtttgaggagcagaccgacctggaaaagatcgtaaagaaaataatgcacagagctcaaacgctgctgaaatgcgaacggtgctccgtgctgctgctcgaggacatcgagtccccagtggtgaagtttactaaaagctttgaactaatgtcgcccaagtgcagtgccgatgctgagaactag

SEQ ID NO: 128481 - DNA, 1728 bp, Artificial Sequence
  Description of Artificial Sequence: Synthetic coding sequence
atgcagatgtacctgcccttttgtgggattgccatctccaacgcacagctgtttgccgcatccagaaaggagtacgagagaagtagggcactactagaagtggttaacgatctgtttgaggagcagactgacctggaaaaaatagttaagaaaattatgcacagagcccagacactgttaaagtgtgagcgctgcagcgtactgctccttgaagatattgagagtccggtggtgaagttcaccaagtcctttgagctgatgtcaccgaagtgctcagccgatgctgaaaattctttcaaggagtcaatggaaaaatcatcttactccgattggctcatcaacaactctatcgcagagctggtggcaagcaccggactgccagtgaacatatctgacgcttatcaggaccctaggtttgacgcagaggcggaccagatttctggattccatatcagaagcgtgctctgtgtccctatttggaactccaatcatcaaattatcggggtcgcccaggtcttgaatcgactggatggaaagccctttgatgatgctgatcagaggctgttcgaagcttttgtcatcttttgcggtttagggatcaacaacaccatcatgtacgaccaggtaaagaaaagctgggccaagcagagcgtggcgctggacgtgctgtcgtatcacgccacgtgctctaaggcagaggtggacaagttcaaggctgccaacatccctctagtttctgagttggcaattgacgacatccattttgacgacttcagcctcgatgttgacgccatgattaccgcagcactgcgtatgttcatggaactgggaatggtgcagaagtttaagatagactacgagacactctgcaggtggctgctgactgtcagaaaaaattacagaatggttctttaccacaattggcgccacgctttcaacgtctgccagctcatgtttgctatgttaaccacagctggattccaggacatcctgacagaggtggagattttggctgttatcgtcggatgtttgtgccacgacctcgatcatagaggtaccaataatgcctttcaagctaaatctggatcggctctggcacagctgtacggcacctcagctacactggagcaccaccacttcaaccacgctgtaatgatcctccagtccgagggacataatatttttgcaaacctcagttccaaggagtactccgatctaatgcagctcttgaagcagtcaatcctcgctacagaccttacgctgtatttcgaacgacgtacagagttctttgaactggttagcaaaggagagtacgactggaatataaagaaccaccgggatatcttccgctcaatgctgatgaccgcatgcgatttgggtgctgtgacaaagccttgggaaattagcaggcaggtcgccgaactggtcacttcggaattttttgagcagggggatagagaacgcctggagctcaagctgacgccatcagctatctttgataggaacaggaaggacgagctccccaggttacagctggaatggatcgatagcatttgcatgcctttataccaagctctcgttaaggtgaatgtgaagctaaagcccatgctggattcagttgcaacaaatcgctccaaatgggaagaactacatcagaagagactgttggcctcaaccgccagcagctcacctgcatcagtgatggtggctaaagaggataggaactag

SEQ ID NO: 128482 - DNA, 375 bp, Artificial Sequence
  Description of Artificial Sequence: Synthetic coding sequence
atgttgatgacggcatgcgacctgggcgccgtgactaagccatgggagatcagtcggcaggtggctgaactagtcactagcgaattctttgagcaaggagaccgcgaacgactcgaactgaagcttaccccttcggcaatttttgaccgaaaccggaaggacgagttgccccgattgcaactggagtggattgactctatctgcatgccgttataccaggctctcgttaaggtgaatgtcaaattgaagcccatgcttgactccgttgccacaaacagatctaagtgggaggaattgcaccagaagaggctcttggcatccacagcgtcaagctcccccgcctctgttatggttgccaaagaggaccggaattag

SEQ ID NO: 128483 - DNA, 1638 bp, Artificial Sequence
  Description of Artificial Sequence: Synthetic coding sequence
atgggaagctcggcaaccgagattgaagaactggaaaatactacattcaagtacctgactggcgaacagacagaaaagatgtggcagagattaaagggaatcctgaggtgtctcgtgaagcagctagaaagaggagatgtcaatgtggtcgacctgaagaaaaatatagagtacgctgcctcagtgctggaggcagtctacatcgacgagactagaaggctcttggacacagaagacgagctgagtgacatccagacggatagcgttccttcagaagtgagggactggcttgcgagtacttttactcgtaagatgggaatgaccaagaaaaagcccgaggaaaaacctaagtttaggtctattgtgcacgccgttcaggccggtatcttcgtcgagcggatgtaccgcaagacatatcacatggtcggtctggcctaccccgcagctgtcatagttaccctcaaggacgtggacaaatggtcattcgatgtcttcgcgctgaatgaggcctccggagagcactctttgaaattcatgatatacgaactgttcacgaggtacgatctcattaaccggtttaagatccccgtgagttgcctgataaccttcgcagaagctctggaggtggggtattccaagtacaagaacccctatcataacctgatccacgcagcagatgtgacccaaactgtgcactacatcatgctgcacacgggcatcatgcattggctcaccgagctggagattctggccatggttttcgcagctgcaattcacgactacgagcacactgggacaaccaacaattttcacatccagaccaggtctgacgtggcaatactgtataatgacaggagtgtgctggagaaccatcacgtgagcgctgcctataggctaatgcaagaagaagaaatgaacattctgataaatttgagcaaggacgattggcgcgacctgcggaacctggttattgaaatggtactgagtacagatatgtcgggccattttcagcagatcaaaaacatcaggaactcactacagcagcccgaaggaatcgacagggctaaaacaatgtccctaatcctgcacgcagccgatatttcccaccccgctaaaagttggaagctgcattacaggtggaccatggcccttatggaagagtttttcctccaaggggacaaagaagcagagctgggcctgcctttcagtccactatgcgatcgtaagagtactatggtggcgcagtcccagattggctttattgattttatcgtcgagcccacctttagtctgctgaccgacagcacggaaaaaattgtgatcccactgattgaggaagcctcaaaggccgaaacctcttcctatgttgcctcaagcagtactacaattgtagggcttcatattgctgatgcacttcggaggtccaacactaagggaagcatgagcgacggttcatactcacccgattacagcctggcagcagtggatctcaagagctttaagaacaatctggtcgacattatacagcagaacaaggaaagatggaaagaattggctgcccagggtgaaagcgatctccataaaaactctgaggatctcgtcaacgccgaggagaagcacgatgaaacacatagttag

SEQ ID NO: 128484 - DNA, 1536 bp, Artificial Sequence
  Description of Artificial Sequence: Synthetic coding sequence
atgggcaagaagattaacaaactcttctgttttaactttctcgtgcagtgtttcagaggaaaatccaagcctagcaaatgtcaaattcggaagaaggtcaagaatcatattgagaggttgctcgataccgaggacgaattgagcgacattcagacagactccgtgcccagcgaagtaagggactggttagcgagcacatttactcgaaagatggggatgaccaagaagaagccagaggagaagcccaagtttaggtctatcgttcacgctgtccaagccgggattttcgtagaacgcatgtatagaaaaacttaccacatggtcgggctggcatatccagctgctgtaatagtcaccttgaaggacgtagataagtggtcttttgacgttttcgccctgaacgaggcctccggcgagcattccctgaagtttatgatctacgagctgtttactcgctacgacttgatcaataggttcaagatcccagtctcgtgtctcattacattcgccgaggcgctggaggttgggtactccaagtataagaacccataccacaacctcattcatgctgcagatgtgacacaaacggtccattacattatgttacatacaggtatcatgcattggttaacggagcttgagattctggctatggtcttcgcggctgcaattcacgattacgagcatactgggaccaccaacaactttcacatccagacgcgttctgatgtggccatcctatataatgatagaagcgtattggaaaatcaccacgtctcggcagcctatcgactcatgcaagaggaggaaatgaacatcttgataaacttgagtaaagatgactggagagacctgaggaatcttgtaatcgaaatggttctgagcacggacatgagcggacacttccagcaaatcaaaaatattcgtaactcactgcagcagcccgaaggcattgatcgagctaaaaccatgagcctgatcctgcatgccgccgatattagccaccccgccaaaagctggaaactacactatagatggacgatggctcttatggaggagttctttctgcaaggggacaaggaagctgagctggggcttcctttctcaccactatgtgaccgaaagagcactatggtggcccagagtcagattgggttcatcgacttcatagtggaaccaacattctccctacttactgatagtactgagaaaatcgtgatcccgttaatcgaggaagcttccaaagctgagactagtagctatgtggctagttcatcaaccaccattgtcggcctgcatattgccgatgcgctcaggcggtcaaacactaaaggctcgatgtcagatggatcctattccccagactacagcctcgctgcagtggatttgaagtcttttaaaaataacttggtggatataatccagcagaacaaagagcggtggaaagaactggccgcacagggggagtccgacctccacaaaaacagcgaggacttggtgaacgctgaagagaagcacgacgaaactcacagctag

SEQ ID NO: 128485 - DNA, 1560 bp, Artificial Sequence
  Description of Artificial Sequence: Synthetic coding sequence
atggatgatcacgtgactattagaaagaaacatctgcagaggccaatcttccgactccggtgtctggtcaagcagttagagagaggcgacgtgaatgtagtagatctgaaaaagaacattgaatacgctgcttccgtactagaagcagtgtacatcgatgaaaccaggcgcctactggatactgaggacgaattatccgacatccagaccgactcagtaccatctgaggttcgtgactggcttgccagcactttcacccggaagatgggcatgaccaaaaagaaaccagaggagaaacctaagtttagatcgatcgtgcacgctgttcaagccggcatttttgttgaaagaatgtaccgaaagacttaccatatggtcggcctggcatatcccgcagccgttatagtgacactgaaagacgtcgataagtggtcatttgatgtgttcgctctgaacgaggcctcgggtgagcactcattaaaattcatgatttacgagctatttaccaggtacgatctaataaatcgcttcaagatcccagttagttgtctcatcactttcgccgaggcactggaagtagggtattccaaatataaaaacccctatcacaacttaatccatgctgccgatgttactcagaccgttcactatattatgctgcacaccggaatcatgcattggcttacagagcttgagattctggccatggtatttgccgctgctatccatgactatgagcataccggaacgacaaacaactttcatatccagacacgatccgacgtggccatcctatacaatgatcgtagcgtactggagaatcaccatgtgagcgctgcgtaccggctgatgcaagaggaggagatgaacatcctaatcaacctaagcaaggacgattggcgagacctcagaaacctcgtcattgaaatggttctgagtacagacatgtcagggcattttcagcagattaaaaacatccggaacagcttgcagcaacctgaaggtattgatcgggccaagacaatgagtctcatcctgcatgccgccgacatttcccacccggccaaatcctggaaactgcattataggtggaccatggcattgatggaagagttcttcctccagggagacaaagaggccgaactcggtctccctttctccccactgtgcgaccgaaagtccaccatggtagcccagtcacagatcgggtttatcgatttcatcgttgaacccacgttttctctgcttacagatagtacggagaagattgtgatccccctgattgaggaggccagtaaggccgagacatccagctacgtagcaagttcttctactaccatcgtaggcttacacattgccgatgccctaaggcgtagtaacactaagggctctatgtcggatggcagctactcccctgactatagcttggcggccgtggatctgaagagctttaaaaacaatctcgtggatatcattcagcagaacaaagagcgctggaaagaactggctgcacaggaggccagaaccagcagccagaaatgcgagtttattcaccagtag

SEQ ID NO: 128486 - DNA, 1608 bp, Artificial Sequence
  Description of Artificial Sequence: Synthetic coding sequence
atgggctcgagcgcgacagaaatagaagaactcgagaataccacgttcaagtatttaaccggtgagcagactgaaaagatgtggcagagattgaaaggcatcctgcgctgcctggtgaagcagctagagcgcggcgatgtgaacgtggtggacttgaaaaaaaatatcgaatatgcggcttcggtcctggaggctgtatatatcgatgaaacccgcagactcttagataccgaggacgaactgagtgacatccagacagactctgtgccatcagaagtccgcgactggttggctagcacattcaccaggaagatgggcatgaccaagaagaaacctgaggaaaagcccaaatttcgaagcatcgttcatgctgtccaagctggcatctttgtggaacgcatgtaccgcaaaacttaccacatggtcggccttgcttaccccgctgcagtgatcgtaaccctgaaagatgtggataagtggtcatttgatgtctttgcactgaacgaggcttccggcgagcactccttaaaattcatgatttatgaactgttcacccgctacgatttgatcaaccggttcaagattccggtcagctgtcttatcacctttgcagaggctttggaagtgggctatagcaagtacaagaacccctaccataacctcatccatgccgctgacgtcactcagacggtccactacatcatgctgcacactggtatcatgcactggctgaccgagctcgagatcctggctatggtgttcgcagccgcgattcacgactatgagcataccggcacaactaataacttccatattcagaccagatccgatgtggcaatcctctataatgaccgcagtgtactcgagaaccaccatgtatcggccgcatatcggctgatgcaggaagaggaaatgaatattcttatcaatctgagcaaggacgattggagagacctccgcaaccttgtgatcgagatggttttgagtactgatatgtctggacatttccagcagattaagaatatccgaaatagcctgcagcagccggagggtattgatcgcgcaaaaacgatgtctctgatactgcacgctgcagacatctctcacccagcaaagagctggaaactacattacaggtggactatggcccttatggaggagttttttctccagggcgacaaagaggccgaactgggccttcctttctcgccgctgtgtgatcgtaagagcactatggtggcacagtcacagattgggttcattgatttcatcgtggaaccaacgttttctcttctgaccgatagcactgaaaagatcgtcattccattaattgaggaggcatcaaaagcagagacgagttcgtatgtggcgtcaagttccactactatcgtggggctgcatatcgcagatgccctgcgccggtccaatactaaggggtccatgtctgacggctcctattctcccgactattctcttgccgccgttgatctgaagagttttaagaataatctggtggacatcattcaacaaaacaaggagcgatggaaggaactggccgcccaagaagcgcgtacaagctctcagaagtgcgaattcatccaccaatag

SEQ ID NO: 128487 - DNA, 1590 bp, Artificial Sequence
  Description of Artificial Sequence: Synthetic coding sequence
atggatgaccatgtgacaatcagaaagaagcatttacagcgacctatttttcgcctgcgctgccttgtgaaacaattagagcgtggagatgttaacgtggtcgatctcaagaaaaacatcgagtacgctgccagcgtgctggaggccgtgtatatagacgaaacaaggaggctcctggacaccgaggacgaattgtcggatattcagacggattcggtcccttcagaggtgagggactggttggcctcaacttttacgagaaagatgggcatgaccaagaagaagcctgaagagaaacccaagtttcggtccatcgttcatgccgtgcaggctggcatctttgttgaacgtatgtacagaaaaacatatcatatggtggggctggcttacccggcagcagtcattgtcactctcaaggatgtggacaaatggagctttgacgtgttcgctctgaatgaggcgagtggcgaacattcgctgaagttcatgatttacgaactgttcacgcgatatgacttgatcaatcgatttaaaattccagtgtcatgtctgataacctttgccgaggccctggaggtggggtattctaagtacaaaaatccatatcataacctcatacacgccgctgatgtcacccagacagtgcattacattatgctgcatacggggataatgcattggctcactgagctcgagattttggccatggtttttgccgcagctatccacgactacgaacacacggggacgaccaataactttcacatccaaaccaggagtgacgtggccattctgtataatgacaggtccgttctggaaaaccaccatgtatcagccgcgtatcgactcatgcaagaagaggagatgaatattctgatcaatctgtccaaggacgattggcgagatctcaggaacctggtaatagagatggtcctcagcacagacatgagtggccacttccaacagatcaagaacattcggaacagcctacaacagcccgaggggatcgatcgcgccaaaacaatgtcactgatcctgcacgccgctgatataagtcatcctgctaagtcctggaaactccactaccggtggacaatggccctgatggaggagttctttctccagggggataaggaggcagagctcggactgcccttcagccccctgtgtgacaggaagagtactatggtagcccagtcccaaatcgggttcatcgacttcattgttgaaccaacgttcagtctgttgaccgacagcacagagaagattgtcatacctctcatcgaggaagctagcaaagctgaaacttcctcctacgtcgcttccagttcaaccacaattgttggactgcacatcgctgatgcattgagaagatccaacacaaagggaagtatgtctgacggttcatactcaccagattatagcctcgcagcagtggacctaaagagcttcaaaaataaccttgtcgacataatccagcagaataaagagcgatggaaggagctcgccgctcaaggagagtcggatctgcacaagaattccgaggacttggttaacgccgaggagaaacatgatgagacacacagctag

SEQ ID NO: 128488 - DNA, 1608 bp, Artificial Sequence
  Description of Artificial Sequence: Synthetic coding sequence
atggggtcttccgctaccgagatagaggagctggagaacaccacatttaaatacctgactggggagcaaaccgagaagatgtggcagaggctgaagggaatcttacgatgtctggtgaagcagctcgagcgtggggacgtcaatgtagtcgatctgaaaaagaacatcgagtacgccgctagcgtgctagaagccgtatacatcgacgagacaaggcgactgctggacaccgaagatgagctcagtgatattcagaccgattctgttccaagcgaggtcagagactggctggcctccaccttcacccgtaagatgggcatgaccaagaaaaagccagaggagaagcctaagtttcgaagtattgtccacgctgttcaggctggcatctttgtggagagaatgtatcgtaaaacttaccacatggtaggtctggcttaccccgcggccgttattgtgactctcaaagacgtggacaagtggagttttgatgtcttcgccctcaacgaggctagcggtgaacattcactaaagtttatgatttacgagctattcacaaggtacgacctgataaatagattcaagataccggtttcttgcctgattaccttcgccgaagccctggaggtaggctactctaaatacaaaaatccataccacaacttaatacacgctgccgacgtcactcagacggtacactacataatgctccacactggcatcatgcattggctgacagaattggaaatcctggctatggttttcgcagctgcgatccacgattacgagcacacagggactaccaacaactttcacatacagacgcgttccgatgtggcaatactctacaacgaccgatcagtcctggaaaaccaccacgtatccgcagcgtacagactcatgcaggaagaggagatgaacatcctaatcaatctgagcaaggacgattggcgggacctgcggaaccttgtgatcgagatggtgcttagtaccgatatgtctggccactttcagcagatcaaaaacataagaaattcactgcaacagccagaaggcatcgaccgggctaagaccatgtccctcattttacacgctgcagatatctcccatccggcaaagtcttggaaactacactatcgctggaccatggcactgatggaagaatttttcttacagggcgataaagaagcagaattgggattgcctttcagtcccctgtgtgacaggaagtcaacaatggtggcccaatcgcagattggttttatagacttcattgtagagccaacattctccctgctcaccgattctactgagaagatcgtgataccactcatcgaagaggccagcaaagcggagacaagttcctatgtcgcttcaagcagcactactattgtgggtcttcacatcgctgatgctctccggcgctcgaacacaaaaggctcaatgagcgatgggtcttatagcccagactattctctagctgccgtggacctgaaatccttcaagaataacctcgtggatatcattcaacagaacaaagagcgctggaaagagcttgcggcacaggaagctcggacttcatcacagaagtgtgagttcattcatcagtag

SEQ ID NO: 128489 - DNA, 1638 bp, Artificial Sequence
  Description of Artificial Sequence: Synthetic coding sequence
atggggagcagtgcgaccgaaattgaagagctggaaaacaccactttcaagtatctaacaggcgaacagaccgagaagatgtggcaacggctgaaaggaattcttcgctgcctggtcaaacagctcgagcgcggagacgtgaatgtcgtggacctgaagaagaacatcgagtacgctgcctcagtccttgaggctgtctatatcgatgaaactagaagacttctggacaccgaagatgaactaagcgacatccagaccgactccgtaccatctgaggtgagagactggttagcctctacttttacgcggaaaatgggtatgacaaaaaagaaacctgaagaaaagccaaagttcagaagcattgtgcacgccgtgcaggccggcatctttgtggaacgcatgtaccggaagacataccacatggtagggttagcgtaccctgcagccgtcatcgtgaccctcaaggacgtggacaagtggtcctttgatgtgttcgcactcaacgaagcttccggtgagcactccctgaagttcatgatttacgaactgttcacccgttacgatctaattaataggttcaagatccccgtttcctgtctaataacattcgccgaagcactcgaagtcggctatagcaagtataagaacccgtaccacaaccttatacacgcggccgatgtgacccagacagttcactacattatgctccacaccggtatcatgcactggttgaccgagctcgaaatactggccatggtctttgccgccgcaatccacgattatgaacatactggaaccaccaacaactttcacatccaaactagatctgatgtcgccatcctatacaacgatcgctcagtcctggagaaccatcatgtgagtgccgcatacagactgatgcaggaggaagaaatgaatattctcataaacttgtctaaggatgattggagggacctacggaacctggtgatcgaaatggtgctgtccactgatatgagcggtcatttccaacagatcaagaatattcgcaattcactccagcagcccgagggcatagaccgtgccaaaacaatgtcactgatcctgcatgctgccgacatctcccatccagcgaagtcttggaaactgcactaccgatggaccatggctttaatggaagagttttttctccagggtgacaaggaggccgaactcggcctccccttttcacctctctgcgatcgaaaatcaaccatggtagctcagagccagatcggctttattgacttcatcgtggaacctacgttctctctgctcacagatagcacggaaaaaattgtgatcccgcttatagaggaagccagcaaagccgaaacttcctcttacgtggcctccagctctactactattgtggggcttcatatagccgacgcactgcgtcgttccaatacaaagggatctatgtccgacgggtcttacagcccagactacagtcttgccgctgttgacctcaaaagttttaagaacaatctggtggatattattcagcagaataaggagcgatggaaagagttagctgcccaaggcgagagcgatttgcataagaattccgaagatctagtgaacgctgaagaaaaacatgatgaaactcattcctag

SEQ ID NO: 128490 - DNA, 1659 bp, Artificial Sequence
  Description of Artificial Sequence: Synthetic coding sequence
atgggatcctccgcaactgaaatcgaagagcttgagaatacaactttcaagtacctgactggggagcagacagaaaagatgtggcagcgactcaaaggcatcctgaggtgtctcgtgaaacagcttgaaaggggggacgtgaacgtggtggatctaaaaaagaacatagagtatgccgcctcggttcttgaggcagtgtatatcgacgaaactagaagacttctagataccgaagacgaactttccgacatccaaacagacagtgtgccatcagaggtccgagactggctcgcctcaacctttacacgcaagatgggcatgaccaaaaaaaagccggaggagaaacccaaattcaggagtattgtgcatgctgttcaagctggtattttcgtggaaagaatgtatcgcaagacatatcacatggtgggcctggcttatcctgccgccgtgattgtcaccctgaaagacgtggataaatggagtttcgatgtatttgcactgaatgaagcttccggggagcatagcctcaagttcatgatttacgaactgttcaccagatatgacctgatcaaccgcttcaagatacctgtcagctgtctgatcacctttgctgaagctttagaagttgggtactctaagtataaaaacccctatcataatctgatccacgctgccgacgtgactcagaccgttcattacatcatgttgcacactggcatcatgcactggcttacagagttggaaatcctggccatggtcttcgctgccgctatccatgactacgagcacacaggaacaactaacaattttcatatccagacacgaagtgacgtcgctatcctatacaacgacaggtctgttttggagaatcatcacgtgagtgccgcctataggcttatgcaggaagaagagatgaacattctgattaacttgtcaaaggatgactggagggaccttagaaacctggtgattgagatggtcctgagcacggatatgagcggacattttcagcagatcaagaatatccgcaactcattgcaacaacctgagggaatcgaccgggctaaaaccatgtctctgattctgcacgcggccgatatttctcatccggctaagagttggaagctccattataggtggactatggcgctgatggaggagtttttccttcagggcgataaggaagccgaactaggactaccattttccccattgtgtgaccgcaaaagcactatggtagcccagagtcagataggcttcatcgattttatagtggagccaactttttctctgctgactgattcaacagaaaaaatagttatccccttgatagaggaggcatcaaaggctgaaactagcagctatgtcgcctcttcatctaccactattgttggacttcacatcgcagacgccctacgccgcagcaacactaaagggagcatgtcggatggaagctactctcctgactatagtctggccgctgtcgacctgaaaagctttaagaataatctagttgacatcattcagcagaacaaggaacgctggaaagagttagctgcccagggtagcgtggtctatgaagccttactcccttcattgagtgtatttacttcgccgcttcgagtgtggatcacctcatcccggttccttctgctctag

SEQ ID NO: 128491 - DNA, 1326 bp, Artificial Sequence
  Description of Artificial Sequence: Synthetic coding sequence
atgggaatgaccaagaagaaacctgaagaaaagccgaagtttcgtagcatcgtacacgctgtgcaggcaggaatctttgtggaaagaatgtaccgtaagacctaccacatggttggcctggcgtacccagccgctgtcatcgtgacgctgaaagacgttgataagtggtcattcgacgtgttcgcattaaatgaagcgtccggggaacactccctcaaatttatgatatatgaattgttcacccggtacgacttaataaatcgctttaagatacccgtcagctgcctcataactttcgctgaggcattggaggtgggctatagtaagtacaagaatccctatcacaatttgatccatgctgcagacgtgacgcagaccgtgcactacattatgctccacacagggatcatgcactggctgacagagctggaaatactagctatggttttcgccgccgcgattcacgactacgagcatacgggcaccacaaataacttccacatccagactagatcagatgtggccatattgtacaacgataggtctgtgctggaaaatcatcatgttagcgcagcataccgcctgatgcaggaggaggagatgaatatcctgatcaatctgtctaaggacgattggcgggatctgaggaatctcgttatcgagatggtgctgtcaaccgatatgagcgggcattttcaacaaatcaaaaacatcagaaactccctgcagcagccagagggaattgatcgtgctaaaacaatgagcctgattttgcacgccgcggatatctcccacccagccaagagctggaaactccattaccgatggacaatggctctcatggaggaattttttctgcaaggagataaggaagcagagctgggactgcctttcagtcctctgtgtgatcgtaaaagcacgatggtggctcagtctcagatcggctttatagattttatcgtggaaccaaccttctccctgcttacagactctactgagaaaatcgtgatcccactgattgaggaggcctccaaggccgaaacgagtagctatgtggcgtcctcctcaacaaccatcgtagggctgcacatagccgacgccttgcgccgaagcaatacgaaaggctcaatgtccgatgggtcctactcacctgattattctctggcagccgtcgacctgaagtcattcaagaacaacctcgtcgatataatccaacagaacaaagagaggtggaaagagctggctgcacagggtgagtcagatttgcacaagaactcggaggacctagtcaacgctgaagaaaagcacgacgaaacccatagctag

SEQ ID NO: 128492 - DNA, 1611 bp, Artificial Sequence
  Description of Artificial Sequence: Synthetic coding sequence
atggaactcagtccgcggagccccccagagatgttagaagaaagtgactgccccagtcctctagagctgaagtcggcgccctctaagaaaatgtggatcaaactgagatcccttctgcgctatatggtgaagcagctggaaaacggcgaaattaacatcgaggagctgaaaaagaacctcgagtacaccgcctcacttctcgaagcagtgtacattgacgaaacgcgacaaattctggatactgaggatgagttacaggaacttaggtcagatgctgtgccaagcgaggtgcgtgattggctcgcttctaccttcactcagcaggcccgggcaaagggacggcgggcagaggagaagcctaaatttcggagcattgtgcacgcagtacaagcaggcattttcgtagagcgcatgttcaggcggacctacacttctgtgggcccaacctactctactgccgtgcttaactgcctcaagaatctggatctctggtgttttgacgtcttctccctgaatcaggctgcggacgaccatgctctcaggaccatagtgtttgaactgctcactcggcataatctaatctctcggtttaaaatccctactgtcttcttgatgtcttttttggacgccctggagaccggctatggcaagtataaaaatccgtaccacaaccaaatccatgccgcagatgtgactcagaccgtgcactgctttttgttgcgaaccggaatggtgcattgcctgtcagagatagaactgctggctatcattttcgcggctgcaatacacgattacgagcatactggcacaaccaattctttccacattcagacaaaatcagagtgcgccatcgtgtacaacgataggagtgttcttgagaaccaccacatttcctctgtgttccgattgatgcaagatgacgagatgaacatctttataaatctcacaaaagatgagttcgtggaactcagagcacttgtgatcgagatggtactagcgacagatatgtcttgtcatttccagcaggtgaaaaccatgaagactgccctgcagcagctggagaggattgataagcccaaggcactgagcctgctgctccatgccgcggatatcagccatcctaccaagcagtggttggtccatagtaggtggaccaaggccctgatggaagagttcttccgacagggggacaaagaagccgagctgggcctgccattcagcccgctctgtgaccggacctccaccctggtggcccagagccagatcggctttatcgattttatcgtcgaaccaaccttctcagtgttgacagacgtggctgaaaagtccgttcagcccctcgctgatgaagacagtaaatccaagaatcagccgtcattccaatggagacagccgtcgctggacgtcgaagtcggagacccgaacccagacgtcgtgtcattccgtagtacttgggtcaagcggatccaagagaataaacaaaagtggaaagagagagccgcctccggcatcacaaatcagatgagtattgatgagctgtcaccttgcgaggaagaagcccctccttcacccgcggaggacgagcataatcaaaatggaaacttagactag

SEQ ID NO: 128493 - DNA, 1488 bp, Artificial Sequence
  Description of Artificial Sequence: Synthetic coding sequence
atggtgaagcagctagaaaacggcgaaattaacattgaggagctgaagaaaaacctggaatataccgcctccctgttagaagcagtgtacattgatgaaaccaggcaaatcctggatacggaagatgaactccaggagcttcggagcgacgctgtcccgtccgaggtccgtgactggctcgcatctacctttacccagcaagctcgagcgaagggaagaagagccgaggaaaaacctaagtttcggagcatagtgcacgcagtgcaagccggaattttcgtggaacgtatgttcagacgcacctatacatctgtcggacccacctattctacagcggtgttgaattgcctgaagaatctcgatctttggtgctttgacgttttcagcctgaatcaggccgctgacgaccatgcactgcgcaccatcgtgttcgagttgctcacccgccataacctgatatcaaggtttaaaataccaacagtttttttgatgtcctttctagacgcgctggagacagggtacggaaaatacaagaatccctaccataatcaaatccatgctgcagacgtgacacagactgtccactgcttccttctgcgcactgggatggttcattgtctcagcgagattgaactcctggcaatcatcttcgctgccgccattcacgactacgaacatacgggtaccaccaacagctttcatattcagaccaagtctgagtgcgccattgtgtacaatgacagatccgtccttgaaaatcatcacatttcaagcgtgttcagattgatgcaggacgatgagatgaacatatttattaatctgacaaaagatgagtttgtcgagctgcgcgcactggtgatagagatggtgttagcaactgatatgtcctgccatttccagcaggtgaagacaatgaaaaccgcactccaacagcttgaaagaatcgataaacccaaagccctctcactgctgctccacgccgcagatatctcccacccgactaagcagtggctggtgcattcgcggtggaccaaagcacttatggaggagttctttaggcaaggcgacaaggaggcggaactgggactccctttttctccgctctgcgatcgtacaagcactctcgtcgctcagtcccagattggattcatagacttcatcgtggagcctacgttctcagtactcacagacgttgctgaaaaaagtgtgcaaccacttgcagacgaagattccaagtcaaaaaaccagccgagcttccaatggcggcaaccctccctggatgtagaagtgggtgatccaaacccggacgtggtaagctttagatctacatgggtcaagagaatccaagagaacaagcagaagtggaaagagagagctgcctctggaatcacgaatcagatgtccatcgacgagctgagtccttgcgaagaggaagctcctcccagccccgccgaagacgagcacaatcaaaatggcaatctcgactag

SEQ ID NO: 128494 - DNA, 1551 bp, Artificial Sequence
  Description of Artificial Sequence: Synthetic coding sequence
atggctaatcccgtgccagtgcaaaggagccacctgcagggccccattttacgcctgagatacatggtgaagcaactagagaacggggagattaatatagaggagcttaagaaaaacctggaatatacagcttctctgctggaggccgtatacatcgacgaaaccagacagatcctcgacaccgaggacgagctgcaggaacttcgctctgatgctgttccatctgaggtccgcgactggctggcgagtactttcacacagcaggcacgcgcaaaagggagaagggccgaagagaaacctaagttccggtcaatcgtgcacgccgtgcaagcagggatcttcgttgaaagaatgtttaggcgcacctatacaagcgtaggacccacctactctacagcagtgttgaattgtcttaagaacttggacctttggtgctttgatgtcttctccctgaatcaggccgcggacgaccacgctctaagaaccatcgtgttcgagctcctgactagacataatctcatctcacgcttcaagatccctaccgtattcctgatgagttttcttgacgccctggagaccggctacgggaagtacaagaatccttaccataatcagatccacgcagccgacgtgacacagactgtccactgctttcttcttcggaccggcatggtccactgtctcagcgaaattgaactgttggcgatcatctttgctgctgccatacacgattacgaacacaccggaaccacgaattcttttcatatacagaccaagtctgagtgtgcgatcgtgtataatgatcgtagtgtcctggaaaatcatcatatctcctctgttttccgcctaatgcaagacgatgaaatgaacatttttattaatctgacaaaagacgaattcgtggagcttagggccttggtgatcgaaatggtccttgctactgatatgtcttgccattttcagcaggtgaagaccatgaagaccgcgctccagcagcttgagcgcattgacaaaccaaaagccctcagcctgttactgcacgccgccgacatctcacaccccaccaagcaatggctagttcattcacgatggaccaaggccctcatggaagagttctttcgccagggggacaaggaggcggaactcgggctgcccttctctcctctatgtgacaggaccagcacactggtggcacaaagtcaaataggttttattgactttatcgttgaaccgactttctcagtgctgaccgatgtggctgaaaagagcgtgcagccccttgcagacgaggatagcaagagcaaaaaccaaccgagtttccaatggagacagccttccctggatgttgaagttggagaccctaaccccgatgtggtatcattcagaagcacatgggtcaaaagaatccaggaaaacaagcaaaaatggaaggaacgagctgcttccggcatcacaaatcagatgtctatcgacgaactctctccctgcgaggaggaggctcctccttccccagcggaggacgaacacaatcaaaacggtaatctcgactag

SEQ ID NO: 128495 - DNA, 2310 bp, Artificial Sequence
  Description of Artificial Sequence: Synthetic coding sequence
atgacagatgctggtaatcgaaaggaaggatttaaaaagtgccgcagcgccactttctctatcgacgggtacagcttcaccatagtcgcgaacgaggccggtgacaagaacgcccggcctcttgcccggtttagtcgatcaaaaagtcagaactgcctgtggaactccctgatcgatgggctgacggggaacgtcaaggaaaagcctagaccgactattgtgcatgacccacggcccccggaagagatactggctgatgaattgccgcagctagacagttctgaggtgctggtgaagaccagctttagactgcgcagcctggtgaaacaactggaacgtggtgaagcaagtgtcgttgacctgaagaaaaatctggagtacgccgctaccgtcctcgaaagtgtgtacatagacgagactcgccgtctgctcgatactgaggacgagctcagcgatatccaaagtgacgctgtgcccagcgaggtcagggactggctggcatccaccttcacccgccagatggggatgatgcttcgccgctcagatgagaaaccacgtttcaagagcatcgtacacgccgttcaggcgggcattttcgtcgaaaggatgtatcgccggaccagtaatatggtcggcctttcatacccaccagctgtgattgaggctctgaaggacgtagataaatggtccttcgatgtgttttcgctaaatgaagcctccggcgatcatgccctcaagtttatcttctatgaattgctgaccagatacgatttaatctcgcggtttaaaatccccattagcgcccttgtatcttttgtcgaagccctggaagtgggttactctaaacataaaaatccataccacaatctgatgcacgccgctgacgtgacacagaccgtgcattatttgctgtacaaaacaggcgtggctaactggctaactgagctggaaatctttgcaatcatcttctctgcagctatacacgattacgaacacactgggaccactaataatttccacatccagaccagatctgacccggctattttgtacaacgatcgatctgtgctggaaaatcaccatctgagtgccgcttataggctgctacaggacgatgaggagatgaatattctcatcaatctttctaaggatgattggagagagtttaggacgctggtgatcgaaatggtgatggccaccgatatgtcctgccactttcagcaaattaaggctatgaaaaccgctctgcagcagccagaggctattgaaaaacccaaggcattgagcctgatgttgcatacagctgacatttcccaccctgccaaggcttgggatcttcaccatcgatggacaatgtcccttctggaagaattcttccggcagggcgaccgggaagctgaattgggtctgccattctcacctctgtgtgaccgaaaaagtactatggttgcccagtcccaggtgggcttcattgattttattgtggagcctaccttcaccgtgttgaccgacatgactgagaaaattgtcagtcccctgattgacgaaacgagccagaccggcgggacaggccaaaggaggagctcacttaacagtatctcctcctccgatgccaagcgcagcggcgtgaagacatcaggttctgaaggttctgcccccatcaataactccgtcatcagtgtcgattataagagctttaaggccacctggaccgaagttgtacacataaatagagaacgctggcgtgctaaggtccccaaggaggaaaaggctaagaaggaagccgaagaaaaggcccgactcgctgcagaggagcagcagaaagaaatggaagcgaagtcccaggccgaggaaggagctagcggtaaggctgagaagaagactagcggcgaaacaaagaaccaagtcaatgggacgcgcgccaataagtcggacaatccacgcggaaaaaactctaaggctgaaaaatcatcaggcgaacagcagcagaacggggactttaaggacggtaaaaataagaccgacaagaaggatcactccaacatcggtaacgacagtaagaagaccgatggaacaaaacagcgatcacacggcagcccagctcccagcacatcaagtacatgtcggctgaccctgccagtgatcaagcctccactgcggcatttcaaaaggcctgcatatgcgtcttcttcttatgcccccagtgtgtccaagaagacagatgaacaccctgcgaggtacaagatgctggatcaacggatcaaaatgaaaaaaattcaaaacatctctcataattggaatcgtaaatag

SEQ ID NO: 128496 - DNA, 2130 bp, Artificial Sequence
  Description of Artificial Sequence: Synthetic coding sequence
atggaatcgcccaccaaggaaatcgaggagtttgaaagcaactcactcaagtacttgcagcccgagcagatagagaagatttggcttaggctgagagggctgaggaaatataaaaaaactagccaacggctccggtcactggttaaacagctcgaaaggggcgaggcttcagtggtggacctgaagaagaatctggaatacgccgcaacagttctggagagtgtgtacatcgatgagacccgacggctgctggataccgaggatgagttgtcagacatccagagcgacgcggtcccaagtgaagtgcgagactggcttgcctcgacctttaccagacaaatggggatgatgttacgcagatcagatgaaaagccccgtttcaagtctatcgtgcatgccgtccaggctggcatattcgtggagagaatgtatcgcagaaccagcaatatggtggggctttcctatcctcccgccgtgatcgaggccctgaaagacgttgacaaatggtcttttgatgtattctcactaaacgaggcaagcggtgaccatgccctgaaatttatattctatgaacttcttactcgatacgatctgatcagccgcttcaaaattcctatttctgcacttgtctcgtttgtggaggctctggaagtgggctatagtaaacacaagaatccctaccacaaccttatgcacgcggccgacgttacccagacagttcattacttactgtacaagaccggcgtggccaactggcttactgagcttgagatctttgccattatcttttcagctgctatccacgactatgagcataccggaacaactaataattttcacatacagacacggtcggaccctgccatcctttacaacgaccggagtgtgctggagaaccaccacctgtcggcagcgtaccgcttactgcaggatgatgaggaaatgaacatcctgatcaacctttccaaggacgactggagagagtttaggactctggtgattgaaatggttatggccaccgatatgtcttgtcactttcaacagatcaaggcaatgaaaactgctctccagcagccggaagccatcgagaagccaaaagccctgagcctcatgttgcatacagccgacatctcccaccccgctaaggcttgggatctccaccatcggtggaccatgagtctgttggaggagttctttcggcagggtgacagagaggccgagctgggacttcctttttctcctctgtgcgatcgtaagagcaccatggtggctcagagtcaagtgggtttcatagattttattgtcgaacccacctttactgtgctgactgatatgacggagaagatcgtttcccctttgatcgacgaaactagccagacaggagggacaggccagagacgatcgtctcttaattctatctcttcgagcgatgcgaaaagatcaggagtgaagacgtccggatccgagggtagcgccccaattaacaactccgtaattagtgtagattataaatcattcaaggccacctggacagaagttgtgcatatcaacagggaaagatggagggccaaggtgcccaaagaagagaaagccaaaaaggaggcagaggagaaagccagactggctgcagaagagcaacagaaggaaatggaagcaaaatcccaggctgaggagggagcttccggcaaagctgaaaagaagaccagcggtgagaccaaaaaccaggtgaacgggacgagagctaataagagcgacaaccccaggggaaaaaacagtaaggcggaaaagagctccggagagcagcagcagaatggcgattttaaagacggcaaaaataagacggacaaaaaggaccactctaatatcggtaatgactctaagaagactgatggcaccaaacagagaagccatgggtcccccgctcccagcacttcttctacttgccgtcttacattaccagtcatcaagccgccactcagacatttcaagcgacccgcctatgcctctagcagttacgcaccctcagtgtctaagaagaccgacgagcatcccgcacggtacaagatgctcgatcagaggatcaaaatgaaaaaaatccaaaatatcagccacaactggaaccggaagtag

SEQ ID NO: 128497 - DNA, 1905 bp, Artificial Sequence
  Description of Artificial Sequence: Synthetic coding sequence
atggaatctcccacgaaggaaattgaggaatttgaatccaactccctcaagtacctgcaacccgaacaaattgaaaagatatggctgagacttagggggctgcgcaagtacaagaagacatcccagaggctgcgcagtttggtgaagcagctggaaaggggtgaggcctctgttgtggacttaaaaaagaacctggagtacgcggccactgtccttgagtccgtatacatcgatgagacaaggagacttcttgataccgaagatgaattaagtgacatccagtctgatgccgtcccatccgaagtcagggactggctggcgagtaccttcactcgacagatggggatgatgttacgtagatccgatgaaaagccccgcttcaaaagcattgtgcatgcggtgcaggctgggatttttgttgagcgcatgtatcggagaacaagcaatatggttggtctttcctatccaccggccgtaattgaggctctaaaagatgtggacaaatggtccttcgatgtcttttccctgaacgaggctagcggcgatcacgccttaaagttcatcttttatgaactgctgacaaggtacgacctcattagcagattcaaaatcccgatttcagccctcgtgtcgtttgtggaagccctcgaggttggctatagcaaacacaagaatccataccacaaccttatgcatgcagccgatgtcacacagacggtgcattacctgctgtacaagacaggcgtcgcaaactggctgacagagctggaaatatttgctatcatattctccgcggcgattcatgattacgaacacacggggactacaaataatttccatatacaaacccggtctgaccccgctatcctgtataacgatcgctcggtgctggagaaccaccacctgtccgccgcatacaggctactacaggacgatgaggaaatgaacatcctgatcaacctcagtaaagacgactggagagagtttagaacactcgtaatcgaaatggtgatggcaacagacatgtcctgccactttcagcagattaaagccatgaaaactgcgcttcagcagccggaggcaatcgaaaaacccaaagcactgtcgctcatgctgcacacagctgacatctcccaccccgcaaaggcctgggatctccaccaccgctggactatgagcttgttagaggaatttttccggcagggagacagggaggccgagctggggctgcctttttcaccgctgtgcgataggaagagcactatggtggcccagtctcaagtcgggttcatcgactttattgttgaacccacctttaccgttctgacagatatgacggaaaagattgtatcaccactcatagatgagacatcgcagactggcggcacaggacagcgaaggtcttcgcttaattcaatctccagcagtgatgccaaacgaagtggagtcaaaacctctggttcagagggttctgcccctattaataattccgtcatatctgtggactacaagagcttcaaggcaacatggacagaggtggtccacataaatagagaacggtggcgggcgaaggttcctaaagaagaaaaggcaaagaaggaggccgaggagaaggcccgactcgccgccgaagaacagcagaaggaaatggaggctaaatcacaggcggaggaaggtgccagtggaaaagcagaaaaaaagacctcaggggagacgaaaaaccaggtgaatggaactagagccaacaagtccgacaaccccagaggaaagaattcgaaagcagagaagtctagtggcgagcaacagcagaatggcgatttcaaggacggaaaaaacaagaccgacaaaaaggaccacagtaatatcgggaacgattctaaaaaaacagatgactcacaggaatag

SEQ ID NO: 128498 - DNA, 1905 bp, Artificial Sequence
  Description of Artificial Sequence: Synthetic coding sequence
atggagtccccaacaaaagagatagaggaatttgagtctaactctctgaagtatctccaaccggagcagatcgagaagatctggctcaggctgcgtggtctcagaaaatacaaaaaaaccagccagcgactgagatctctggtcaaacagcttgagcgcggagaagcgtccgtggtggacctgaaaaagaaccttgagtatgcggcaaccgtgctcgagagcgtgtatatcgatgagacacggcgtttactggacactgaggatgagttgtccgacatccagagcgatgccgtgccttctgaggtccgcgattggctcgccagtacattcacacgacagatgggcatgatgcttcgtagatcagatgagaaacctcggtttaagtcgattgtacacgctgtgcaggcaggcatttttgtcgaacgaatgtatagaaggaccagcaatatggtcggcctgtcttaccccccagcagtgattgaggcgcttaaggatgtggataaatggtctttcgatgtcttttcacttaatgaggcttccggggaccatgccctgaaattcattttctatgaattgcttacccggtatgaccttatttcacggtttaaaataccgatttccgccctggtcagttttgttgaggcccttgaggtcgggtattccaaacataaaaacccttaccacaacctaatgcatgccgcagatgtgacccaaaccgtgcactatttactgtataagaccggcgttgccaactggttgaccgaactagagatctttgcgataatctttagcgccgctatccatgactatgagcatactgggacgactaataacttccacattcagactcggagtgacccagccatcttgtacaacgatcggtccgtgctcgagaatcaccacctgagcgctgcatatagattactgcaggatgacgaggaaatgaacatactcatcaacctatcaaaggatgattggagggaattcaggaccctggtgatcgagatggtgatggccacagatatgtcgtgtcacttccaacaaatcaaagcgatgaaaaccgccctgcagcagcccgaagctatagagaagccgaaagctttgtccctcatgctgcacaccgccgatatctctcatcctgcaaaggcatgggacctgcaccaccgttggaccatgtcgctcctagaggaattcttcaggcagggggaccgggaggcagagttggggctgcctttctccccgctttgtgaccggaaatcaactatggtggcccagagtcaggttggctttatcgacttcattgtagagcccacatttacagtactgaccgacatgaccgaaaagattgtcagccctctgatcgatgagacttcccagaccggtggcacaggccagcggagatcctcgctgaactctattagtagctcagatgccaagcggtcaggggtcaagacgtccggaagtgaaggaagcgcccccataaacaactctgttatatctgtggattataagtcttttaaagctacgtggaccgaagtggtgcatatcaatcgtgagagatggagggctaaagttcccaaggaggagaaagcaaagaaagaggccgaggaaaaggcccgcctggctgccgaagaacaacagaaggagatggaggctaaaagtcaagccgaggagggtgcctccggcaaagcagaaaagaaaactagtggggaaacgaagaaccaggtgaatggaacccgcgccaacaaaagcgataaccctaggggtaaaaacagcaaggcagagaagtctagtggggaacaacagcagaacggagattttaaggacggaaagaataaaactgacaaaaaagatcattcaaacattggcaacgactccaagaagaccgacgatagtcaagagtag

SEQ ID NO: 128499 - DNA, 141 bp, Artificial Sequence
  Description of Artificial Sequence: Synthetic coding sequence
atggaatcccctacaaaagagatagaggagttcgagtcaaattcgctcaaatacctgcagccagagcagatcgaaaagatctggctgcgtctcagaggactgagaaagtataaaaagacgtctcagcgcctcaggtcatag

SEQ ID NO: 128500 - DNA, 2130 bp, Artificial Sequence
  Description of Artificial Sequence: Synthetic coding sequence
atggaatctcccacaaaggagatcgaagaatttgagtccaacagtcttaaataccttcagcctgaacagattgagaagatttggcttcggctacgaggcctgcgaaagtataagaagacaagccagcgcttgcgatccttggtgaagcagctcgagagaggcgaggcatccgtcgtggacctgaaaaagaatttggagtatgccgccacagttttggaatcagtgtacattgacgagacccgccgcctgctcgacaccgaggacgagcttagcgatattcagagcgatgccgtgccctctgaagttcgtgactggctggcatctacgttcacacgccagatgggtatgatgctgcggcggagtgatgagaagccaaggttcaaaagcatcgtgcacgcagtgcaggcaggaattttcgtggagcggatgtatcggcgcacctccaatatggtaggactgtcatatcctcccgcagtgattgaggcactcaaggatgttgataaatggagctttgatgtgttttctctcaacgaggcaagcggagatcacgccttaaagtttatcttctacgaactcctgaccagatatgatctgatatcgagatttaagatccccataagcgcgctggtgtctttcgttgaggcattggaggtcgggtatagcaagcacaagaatccataccataatctcatgcacgccgccgatgtcacccagaccgtgcactatcttctgtataagacgggagtggccaactggctgaccgagctcgaaattttcgctattatattcagcgcagccatccatgattacgagcacacggggaccacaaataactttcacattcagacaaggagcgatcctgctattctttacaatgaccggtcagtgttggaaaatcatcacttgtccgccgcttaccgcctgttacaagacgatgaagagatgaacatcctaatcaacctgtccaaggacgactggagggagttccgaactctggtaatcgagatggtgatggccactgacatgtcatgtcattttcagcaaatcaaggccatgaagaccgcgttgcagcagccagaggcaatagagaagcctaaggccctgtccctgatgcttcatactgccgatatttctcatcccgctaaagcctgggacctgcaccaccgatggaccatgtctctgctggaggagttcttccgccagggggacagggaagcggaactggggttacctttcagcccactgtgcgatagaaaaagcactatggtcgcacagtctcaggttggcttcatagactttattgttgagccaaccttcactgtgttaactgatatgaccgaaaagattgtgagcccgttgatcgacgagacaagtcagactggcggcacaggccagagacggtcatcactcaacagtataagcagctctgatgcgaaaagaagcggggtcaagacctctggttctgagggctcagccccgatcaacaacagcgtcatctccgtggactacaagtcctttaaagccacctggacggaggttgtgcacatcaacagggagcgctggcgcgctaaagtccccaaggaagaaaaagccaaaaaggaggctgaagagaaggcaaggttggccgctgaggagcagcagaaggagatggaagcgaaatcacaagctgaggagggggcctccggcaaggctgaaaagaaaacttccggcgagactaagaaccaggtgaatgggacacgggccaataagtccgataacccccgcggaaagaatagcaaagccgaaaaaagctctggggagcagcagcaaaatggggacttcaaggacggcaagaacaaaaccgacaagaaggaccacagcaatatcgggaatgattctaagaagaccgacgggactaagcaacgcagccatggctctcccgccccttcaaccagttcaacatgtagacttacgctgccagtgattaagccaccactgcggcacttcaaaaggcccgcctatgcctcaagctcctacgcacctagcgtttctaagaaaacagacgagcatcctgccagatataagatgctcgatcagagaatcaaaatgaagaagatacaaaacatcagccacaattggaaccggaaatag

SEQ ID NO: 128501 - DNA, 3339 bp, Artificial Sequence
  Description of Artificial Sequence: Synthetic coding sequence
atgcgccgggatgagagagacgcgaaggcaatgaggtccctgcaaccaccagacggcgcaggcagccctcccgagtctctgcgtaatgggtatgtgaaatcctgcgtgtcaccactgcgccaagatcctccaagaggcttcttcttccacctgtgcagattctgtaacgtcgaacttagaccacctccggcatctcctcaacaacctcgcaggtgctcgcccttctgtagggcccgcctgagcctcggtgcacttgctgccttcgtcctggctctgctcctgggggcagaaccagagagttgggcggccggtgccgcttggttacgcacactgttgagcgtttgttcacacagtctctctccactgtttagcattgcatgcgctttcttttttctaacatgctttctaacacgaacgaaaaggggacccggcccaggtcggtcctgtggaagttggtggttgctggcactccccgcttgctgttatctgggggacttcctggtctggcagtggtggagctggccttggggggacggagatgcaggcagcgctgctcctcacacaccgcctgaggcagcagcaggacgactgcttctagtgcttagctgtgtgggactgctgctgaccctggcccacccactgaggctgcggcactgcgtgctcgtgctgctgcttgcctctttcgtatggtgggtgagcttcaccagcctcggttcattgccctctgctttacggcccctcttaagcggtctggtcgggggcgcaggatgcctgttggccctaggactggatcatttcttccaaattcgcgaggcgccactgcacccgagactgtcatcagctgccgaagagaaagtgccagtgatccgaccgcgccgtcggtcatcatgtgttagtctcggagagacagccgcaagctactacggttcctgcaaaatattcagacgaccatccctgccttgcatcagcagagagcagatgatcttgtgggattgggacctaaaacaatggtataaacctcattaccaaaattccggtggtggtaacggcgtcgatctgagtgtacttaatgaggcccggaatatggtgtccgatctgctgacggatccatccctacctccacaggtgatcagctccctacggtccatctcctcacttatgggggctttcagcggctcatgtagacctaaaataaaccccctgacacccttccccggattctacccgtgcagcgagattgaagacccagcagagaaaggcgaccggaagcttaacaaggggctaaaccggaatagtctgccgacccctcagctcagacggtcctctggcacatccggactgctcccagtggaacaaagcagccgatgggaccggaacaatggcaagcgaccgcaccaagagtttggcatctctagccagggctgctacctgaatggtcccttcaattccaatctgctgacaatacccaaacagaggtcctcttccgtttccctgactcaccacgtcgggctgcgacgcgccggtgttctgtccagcctttcaccagtgaactcttctaaccatggccctgtcagcacggggagtctgaccaacagatctccaatcgaatttccggacacggccgactttctgaataagccttctgtcatcctgcagagaagcctgggaaatgcccccaacactcctgacttttaccagcaactgaggaattccgactcaaatctgtgtaactcttgtggacaccagatgctgaaatatgtgtccacctcagaaagtgacggtacagattgttgctcagggaagtcgggagaggaagaaaatatattcagcaaggaatcctttaagctgatggagacccagcaggaggaagaaaccgaaaagaaggacagtcggaagctttttcaggaaggcgacaagtggctgactgaagaagctcagtccgaacagcagaccaacattgagcaggaggtcagccttgatctgatcctggtggaagaatacgattctctgatcgaaaagatgagcaattggaactttcctatcttcgaactggtcgagaagatgggtgagaagtccggacgcattctttctcaggtgatgtacacactcttccaggacactgggcttttggagatcttcaagattcccacgcagcagtttatgaattactttcgagccctggaaaacggctacagggatataccttatcacaatagaatccatgctacggacgtactgcatgccgtctggtacctcacgacccgccccgtgccaggcctccagcagatccacaatgggtgcggaacggggaacgagaccgatagcgatggcaggataaaccacggacggatcgcgtacatctccagcaagagttgctccaaccctgatgaaagctatggctgcctctcgagcaacattccggctctggagctgatggcattatatgttgcggccgctatgcacgattacgatcaccctgggcgcacgaacgcgttccttgtggccacaaacgctcctcaagccgtgctctataacgatcggagcgtgctggagaaccaccacgctgctagcgcctggaacttgtatctgagcaggcctgagtacaactttctcttgcacctggaccacgttgagttcaagagatttcggttcttggtaatagaagcaattttggccaccgacttaaagaagcattttgatttcctggccgaatttaatgcaaaggccaatgatgtcaactccaacgggatcgagtggtctaacgaaaacgatagactcctcgtctgtcaagtgtgcattaaactggctgatatcaatggacccgcaaaggtccgggatctgcacctcaagtggacagagggaatcgtgaacgagttctacgaacagggtgacgaagaagcaaacctcggcctgcctatctccccctttatggaccggtcatccccgcagcttgcaaagcttcaagaatcttttataacgcatattgtgggccccctgtgtaatagctatgatgctgcaggactgcttccagggcagtggctggaggcagaagaagacaacgacaccgaaagtggcgacgatgaggatggcgaagagttggatacagaggatgaggaaatggaaaacaatttgaatcccaaaccaccaaggagaaaaagcagaagaaggattttctgccagctcatgcatcacctgactgaaaatcataaaatctggaaggagatagtagaagaggaggaaaaatgtaaagctgatgggaacaaactgcaagtcgagaactcttcgctgccccaggctgacgaaatccaggtgatcgaggaagccgacgaagaagaatag

SEQ ID NO: 128502 - DNA, 3186 bp, Artificial Sequence
  Description of Artificial Sequence: Synthetic coding sequence
atgcgccgggacgagcgagatgcaaaagcaatgcgcagtctgcagccacctgatggagcaggaagcccacctgagtcccttcgcaacgggtatgtgaagtcctgtgtttcaccgctccgtcaagacccccctagaggatttttcttccacttgtgccgcttttgcaacgttgaactgcgtccccccccagcatcgccccagcagcctcggaggtgcagcccgttctgccgggccaggctgtctctaggggcacttgctgccttcgtcctagctctgctgctgggagcagagcccgaatcctgggctgcaggcgcggcctggctgcgaaccctgctgtccgtctgctcacactctttatcgcccttattcagcatcgcatgcgcttttttttttctgacgtgttttcttacaaggacgaagagaggccctggaccaggacggtcctgtggtagctggtggttgctggcactgcctgcctgctgttacctgggcgacttcttggtctggcagtggtggtcgtggccatggggtgatggagacgccggatccgcagctcctcatactccacccgaagcagctgcaggacgactgctgcttgtgctcagttgtgtggggttgctgttgactctagcccacccgctgcgcttgagacattgtgtcctggtgctgcttctggcctcttttgtgtggtgggtgtcttttaccagcctgggatcactgccaagcgccctgaggcccttgctctccggactggtaggaggcgccggctgtttactggccctgggtcttgatcacttcttccagatccgcgaggcaccactccatccccggctgtcttctgcagctgaagagaaagttcccgtgattagaccccgccgccggtcctcctgcgtgagcttaggagagaccgctgccagctattatggaagttgcaagatcttccggaggccctcccttccctgcatctcccgcgagcagatgattctgtgggattgggatctgaagcagtggtacaagccacactaccagaattccggcggaggtaatggtgtggatctttccgtgcttaatgaggccagaaacatggtgtccgacctgctgactgacccgtccctcccaccacagggcctgaataggaacagtctacctaccccgcagctgaggcggtcatctggcacttctggacttctgccagtcgaacagagcagccggtgggacagaaataacgggaaaaggccccaccaggaattcggcatatcctctcagggctgttaccttaacggcccttttaactcgaatctcctcacaatcccaaaacagcgcagcagtagcgtgtctctgactcaccatgtcgggctcagaagagccggtgtgctgagttcactaagtcctgtgaattcgtccaaccacggccctgtatctacaggatccctgacaaacaggagccctatcgaattccccgataccgctgattttctaaacaagccctcagttattcttcagaggtctctcgggaacgcacctaatactccagacttctaccagcagcttcggaattctgatagcaatctgtgtaacagctgcggtcatcagatgctgaaatacgtgagtacaagtgaaagcgatggcaccgactgctgctctggaaaatctggcgaagaggagaatatattttccaaggaatcgttcaagctgatggagactcagcaagaggaggaaaccgaaaaaaaagatagcaggaagcttttccaagagggcgataagtggctgaccgaggaggcccagtccgagcaacaaactaacatcgagcaggaagtcagcttggatctcatcttggttgaggagtatgattccctcatcgaaaaaatgagtaattggaactttcccatatttgaattggttgagaaaatgggagagaagagcggacgtattctgtcgcaggtcatgtacaccctgttccaggataccggcttattggaaatcttcaagatcccgactcagcaattcatgaattatttccgcgctctagaaaacggctatagagatataccatatcacaatcgcattcatgctacagatgtcctccatgcagtgtggtatttgacaacccgacctgtccccggtctgcagcagattcacaacgggtgtggtacaggtaacgagactgacagcgacggccggatcaatcacggtcgcatcgcttatatttcgtcaaagtcttgctcaaatcccgatgaatcgtacggctgtctgtctagcaacatcccagcactggagctcatggctctctacgtcgccgccgcgatgcatgactatgatcacccagggcgtacaaacgcttttctcgtagccacaaacgcgcctcaggcagtgctgtataatgaccgatccgtactcgaaaaccaccacgccgcgagcgcctggaacttgtacctcagccggcccgagtacaacttcctcctgcatctcgaccatgtcgaatttaaacgctttcggtttttggtgatcgaggcaatcctagccaccgacctgaagaaacacttcgactttctggcagaattcaacgcaaaggccaatgatgtgaactccaatggaatcgagtggagtaatgaaaatgaccgcttgttagtatgtcaggtctgcatcaaacttgccgatatcaatggtcctgctaaagttagggatttgcacctcaagtggactgaagggattgttaatgagttttatgagcagggagacgaagaggctaatctgggtctgccgatctcacccttcatggatcgcagctcacctcagttggcgaaattgcaagagtcattcatcacacatatcgtgggacccctgtgcaacagctatgatgcagccggcctgctaccgggtcagtggctggaggccgaggaggataacgacacggaaagcggggacgacgaagacggcgaagaacttgatacagaagatgaggagatggagaacaacctgaatccaaagcccccacggcgaaagtccaggcgccggatcttttgtcagcttatgcaccacctaactgagaaccacaagatctggaaggagattgttgaggaggaagagaaatgcaaggccgacggaaataagttgcaggtggagaactcttctctcccccaggcagatgagatccaagtaatcgaggaggcggacgaagaagagtag

SEQ ID NO: 128503 - DNA, 2583 bp, Artificial Sequence
  Description of Artificial Sequence: Synthetic coding sequence
atggcaaggccacgcggccttggtcggatcccagaactgcagctggtggccttccccgtagccgtggctgcggaggacgaggcttttttgcccgagccgttggcacccagagcccctagacgtccccggtcgccccccagctcgcccgtgttcttcgccagcccctcccctacctttaggcgaaggttaaggttacttagatcttgccaggatcttggcagacaggcatgggctggcgcggggttcgaggcagagaatggccccactccttcccccggccggtcccctctagattctcaggcatctcccggactagtcctccacgcaggcgctgctacctctcagagacgagaatcctttctttaccgctcggactccgactacgacatgagtccaaagacaatgtcacgcaactcttcggtgaccagtgaagcccatgccgaggacctgatcgtgacccctttcgcccaggtgctggcgagtttaagatccgttagatccaactttagcctcctgaccaacgtgccagtcccaagcaacaaaagaagcccactcggaggacctactcccgtgtgcaaagcaactctctccgaagaaacctgccagcagttggcccgagagacactggaggaattggactggtgcctagagcagctcgaaaccatgcagacataccggtccgtgtccgagatggccagccacaagttcaaacgcatgctcaaccgagaactgacacatctcagcgagatgagcaggagcggtaaccaggtgtctgaatatatatctaccacctttttggataaacagaacgaagtggaaatcccttccccaaccatgaaagaacgtgagaaacaacaggctcccaggccccgtccaagtcagccaccaccacctccggtaccccatcttcagccgatgtcacagatcactggtctgaagaaacttatgcatagcaatagcctgaataatagcaacatcccccgctttggcgttaagaccgatcaggaggagctcctggcccaggagctcgagaatctcaataaatggggactgaacattttttgcgtgagcgattatgccggcggacgtagtcttacctgtatcatgtatatgatttttcaagagcgcgacctgctaaaaaagttcaggattcccgtcgacaccatggtcacctacatgctgaccctggaggatcattatcatgctgacgtcgcataccataattcactccacgccgccgatgttctccagtcaacacacgtgctcctcgcgacgccagctttggatgccgtcttcacagatcttgaaatcttggccgcactcttcgctgccgctatacatgacgtggatcaccctggtgtatctaaccagtttctgatcaataccaacagcgagctggccctgatgtataacgacgaaagtgtgctggagaatcaccacctagccgtaggcttcaaactgctccaggaagacaattgcgatatcttccagaacctttcaaagagacagcgtcagtccctgcgaaaaatggtgattgatatggttctggctactgacatgagcaaacacatgaccctgctcgcagatctcaaaaccatggtcgagacaaagaaagttacaagttctggggttctgctcctcgataattatagtgataggatccaggtattgcgaaatatggtccactgtgcagatctgagcaatcccaccaaaccgttggagctgtacagacagtggaccgatcgaattatggccgagttctttcagcagggcgatcgagagagggaacgcggcatggaaattagcccgatgtgcgataaacacactgctagcgtggagaaaagtcaagtgggtttcatagactacatcgtgcaccctctgtgggagacttgggccgatcttgtgcaccccgatgctcaggagatcttggacaccttggaggacaatagagattggtattattcggctatcaggcagtctccatccccccctccggaagaggagagtagggggcccgggcatccccctctgcctgacaaattccaatttgagcttaccctagaagaagaagaggaggaagagatttccatggctcagattccctgcacggcacaggaggctttgaccgcacagggcctgagtggtgtggaggaggctctagatgccacaattgcttgggaggccagccccgcccaagagagcctggaggtcatggctcaagaagctagtctggaagctgagctcgaggcagtttatctgacccaacaggcacaatccacgggtagtgcacctgttgctcccgatgagttttcctcccgcgaggaattcgtcgtggccgtatcacactctagcccctcagcactggcactgcagagtccactgttgcccgcctggcgcacactgtccgttagtgagcacgcgcctggattgcccggactgcccagtacagccgcagaggtggaagcacagagagaacaccaagcggccaagcgtgcctgctcagcttgcgccggcaccttcggggaggatacctccgctctcccggcccccggtggcggcggcagcggaggcgaccctacctag

SEQ ID NO: 128504 - DNA, 1944 bp, Artificial Sequence
  Description of Artificial Sequence: Synthetic coding sequence
atgccactggtggatttcttttgtgaaacctgctccaaaccatggctagtcgggtggtgggatcagtttaaacgtatgctgaatagggagctcacgcatctgtccgagatgtctcgatcagggaaccaagtgtctgagtacatctcaactacatttctggacaagcagaacgaggtggagatccctagcccaactatgaaggaacgcgaaaagcagcaggcaccgagacctaggcctagccagcctccccctcctcctgttccgcacttgcagccgatgtcacaaattacaggtctgaaaaaattgatgcactcaaactcccttaacaactctaacatccccaggttcggagttaaaacagaccaggaagaattgctggcccaggaactagaaaatctcaacaaatggggtcttaatattttttgcgtgagcgattacgccggcgggcggtcactgacttgcataatgtacatgatattccaggagcgcgacctcctcaagaaatttagaattcccgtggatactatggttacctatatgctcaccctggaggatcattaccatgccgatgtcgcatatcataacagtctgcacgcagcggacgtcctgcagagtacccatgtactgctcgctacacctgccctagacgccgtgttcacagatttagagatcttagccgctttattcgccgccgctatccatgatgtagatcatcccggagtatctaaccagtttctgatcaatactaattccgaactcgcactgatgtacaacgacgaaagtgtgctcgaaaatcaccaccttgccgttggattcaagctacttcaggaagataactgcgatatcttccagaacttatccaaacgccagcgtcagtctcttcgtaagatggtgattgacatggtgctggccactgacatgtctaagcacatgaccctactggccgatctcaaaacaatggtcgaaaccaagaaggttaccagtagcggcgtgctcctgctggacaactattcagatcggattcaagtcctccgaaatatggtgcactgtgctgatctgtctaatcctactaagcccttggagctgtaccggcagtggactgatcgcattatggctgagttctttcaacagggagacagagaaagagagaggggcatggagatctcacccatgtgcgataaacacacagcgtcggtcgagaaatcgcaggtcgggttcattgactatatcgtgcatcccttgtgggaaacctgggccgacttggtgcatcccgacgcccaggaaattctggatactctcgaagataaccgagactggtactacagcgcaattcgacagtcacccagccccccacctgaggaggaatccagaggtcctggacacccacctctgccagacaaattccaatttgagctcactctcgaggaagaggaggaagaagagatttcaatggcgcagattccttgcaccgctcaggaagctctcaccgcacagggcttatcgggagtggaggaggccctcgatgcgaccatcgcttgggaagcgtcacctgcccaggagtcactcgaggttatggcgcaggaagcatccctagaggctgaactggaagccgtgtatcttacccagcaagctcagagcaccggaagcgccccagttgctcccgatgaattctcctcacgagaggaattcgtcgtcgccgtaagccatagttctcctagcgccttggctctgcagagtccccttctccccgcctggagaactttgagcgtctcggagcacgcaccgggacttccaggtcttccaagtaccgccgcagaggtcgaggcacagcgagagcatcaggctgccaagagagcctgttccgcgtgtgccggcaccttcggggaggacacttccgcattgccagctccaggcggcggtggttccggaggagatcctacctag

SEQ ID NO: 128505 - DNA, 2661 bp, Artificial Sequence
  Description of Artificial Sequence: Synthetic coding sequence
atggagccgccgacagtgccgtctgagcgaagcctttctctgtccctgcctggtccacgggagggacaggcaacgctcaagccgccgcctcagcatctgtggaggcagccccgtaccccaatccgtatccagcagcgagggtacagcgactcggctgagagagcagagagagagcgccagcctcatcgtccaatcgagcgagccgacgccatggacaccagtgacaggccagggctgcgcaccacacggatgtcatggcccagttccttccacggcacagggactggcagtggcggtgccggagggggctcgtcacggaggttcgaagctgaaaacggtcccactccgtcacccgggcgttcgccactggactcacaggcctcccccggactggtgttgcatgcaggtgccgctacgtcccagagaagggagtcatttctttatcgatcagacagcgattacgatatgtctccgaagaccatgtcgcggaacagcagcgtaacctccgaggcccacgctgaggacctaatcgtcacccccttcgcacaagtccttgcaagtctgagatcagttagatctaacttcagtctgttgacaaacgtacctgttcccagcaacaaacgctctccgctcggcggtcccacacctgtctgcaaagccactctttcggaggagacgtgccaacagctggcccgcgagacgttggaagaacttgattggtgcctcgagcagctggagacaatgcagacgtaccggtctgtctctgagatggcctctcataaatttaaacgaatgctgaaccgcgaattgacccacctatccgaaatgagtcggtcagggaaccaggtgtccgagtatatcagcacgaccttcctggataagcaaaacgaagtagagatcccaagcccaacgatgaaagagagagagaaacagcaagcgccaaggccgcgacccagccaaccacctcctccgcccgtaccccacctccagcccatgtcccagatcacaggcctgaaaaaattgatgcacagtaattctctcaacaacagcaacatcccaaggttcggcgtcaagaccgaccaagaggaactactagcccaggaattggaaaatcttaacaagtggggcctcaatattttttgcgtctcagattacgctggggggcgaagtttgacctgcatcatgtatatgattttccaggagagggatctgctgaaaaagttccgaatcccagtggatacgatggtgacctatatgctgaccttagaggatcactaccacgcagatgtggcataccacaattccctgcacgccgctgatgttctacagtcaactcatgtgttgctcgctacacctgcacttgacgctgtcttcactgacctggagatcctggctgctctgtttgccgctgccatccatgacgttgaccatcctggagtgagcaaccagttcctgattaatacgaatagcgaactagccctcatgtataatgacgaatctgtcctagaaaatcatcatttagcggttggtttcaagctcttgcaggaggacaattgcgacatcttccaaaatcttagtaaaagacagcgccagagtcttaggaagatggtgatcgatatggtactggcaaccgacatgtccaagcatatgacactccttgcagatctgaaaaccatggttgagacaaaaaaagttacaagcagcggcgtgctgctgctggacaactactcagacagaatccaggtgcttagaaacatggttcactgcgccgatttatctaaccccacaaaacctctggagctttatcgccagtggacggacagaattatggctgagtttttccagcaaggagatagagagagagagcgaggcatggaaatctctcctatgtgtgataagcatactgctagtgtcgagaaatcccaggtgggcttcatcgactacatcgttcacccactttgggagacatgggctgatctggtgcatcctgatgctcaggagatccttgacactcttgaggacaatagggattggtactactcagccataagacagtcgccgtcgccccctccggaggaagaaagcagggggcctggtcatcccccccttccagacaagttccagttcgaattaactctggaggaagaggaagaggaagagatcagcatggctcagatcccatgtacagcccaggaagctctgaccgcccagggcctgagtggcgtggaggaagcactagatgccaccatcgcttgggaggcgtcccctgcccaggaatcactagaagttatggcccaggaggcgtctctcgaggccgaactggaggccgtgtatctgacgcagcaggcccagagcacaggctctgccccagttgccccagacgagttctcttctagagaggaattcgtcgttgccgtttcacacagctctccaagcgcgctggctctgcaaagtcctctgttacccgcctggcgtactctgtccgtctctgagcatgctcctggcttgcctggactgccttctaccgcagcagaagtagaggcccagcgagagcaccaggcagccaagcgggcgtgctctgcctgtgccggtacctttggagaagacactagtgccttgcccgcaccaggcggcggcggatctgggggtgatcctacctag

SEQ ID NO: 128506 - DNA, 972 bp, Artificial Sequence
  Description of Artificial Sequence: Synthetic coding sequence
atggtcttgccctctgatcagggatttaagctgctgggcaacgtgctccaaggcccagaaccataccgcctgcttacttccggactacgattacatcaagagctcgagaatctcaacaaatgggggttgaatatcttctgcgtcagcgactatgcggggggccggtcgctgacatgcattatgtacatgattttccaagaaagggatctgctaaaaaagttcagaatcccagtcgataccatggtgacctatatgctgactcttgaagatcactaccacgccgatgtggcctaccacaacagcctccacgccgccgacgtgctgcagtccacccatgttctcttggctaccccagccttagatgccgtgttcaccgatctggagattctggccgcgcttttcgcagctgctattcacgacgtcgatcatccaggcgtatctaatcagttcctgattaacactaacagcgaattagccctgatgtacaatgatgagtccgtgttggagaatcaccatctggctgtgggcttcaagttactacaggaagataattgcgacatttttcagaacctttccaagcgccagcgacagtcgctcaggaagatggttattgacatggtattggccaccgatatgtctaagcatatgacccttttggcagacctgaagactatggttgaaacaaagaaagtgaccagctcgggggtcctcctcttggataactattccgaccggatccaggtcctgaggaacatggtccactgcgccgatctaagcaaccccacgaagccccttgagttatacaggcagtggacggaccggatcatggccgagttcttccaacagggagacagagagagagagagaggaatggagatttctcccatgtgtgacaagcacacagctagtgtcgaaaaaagccaggtgcaggcccgcggcatcgacgggcgagcgcagggagaattctattag

SEQ ID NO: 128507 - DNA, 2595 bp, Artificial Sequence
  Description of Artificial Sequence: Synthetic coding sequence
atgaaacggtccaggtcagccctgagcgtggccgggaccggtgacgaaaggtctcgggaaacccccgagagcgaccgggctaacatgctcggggcagacctgaggagacctcgtcgacggctaagtagcggacctgggctgggctgggctcaacctgagccctccgatcctggggtccctttaccacctagacctacgactttgccacttctgattcctcccagaatcagcatcacccgggctgagaacgactcttttgaggctgaaaacggacccaccccttcacccggaagatcccccctcgattcacaggcttccccaggcctggtgctgcatgccggagcagccacctcacagcggcgggagagcttcctctacagaagcgactccgactacgatatgagccctaaaaccatgagcagaaactcttcagtcacttccgaggcgcatgctgaggatttgatagtgacacccttcgcgcaagtactagcctctctccggagcgttcggagcaacttcagtttgttgactaatgtgcctgtaccaagcaataaacggagccccctgggcggacctactccggtgtgcaaagcgacacttagcgaggagacgtgtcagcaactggcaagggaaacactggaggaactggactggtgcctcgagcagcttgaaacaatgcaaacatatcgtagcgtctccgagatggcaagccataagtttaaaaggatgctcaatcgagaactcactcacctcagcgagatgtcccgctcagggaaccaggtctcagagtatatttctacgacatttctggataaacagaatgaggtcgaaatcccctcccctaccatgaaagagagagagaagcagcaagccccccggccaagacctagccaaccgcctccaccccctgtgccacaccttcagcctatgagccagatcacgggtctcaagaagttgatgcatagtaacagcctcaacaacagcaatattccacggtttggcgtgaaaacggatcaggaggagctcttggcgcaggagctcgagaacctgaataagtggggcttaaacatattctgtgtatcagactacgccgggggacgatccctgacttgtatcatgtacatgatattccaggagcgggatttgctgaaaaagttccgaatcccagtcgataccatggtcacttacatgctgacattagaggaccattatcacgccgacgtcgcctatcataactccctgcatgcagccgacgttctgcagtccacacacgtgctgttagccactcctgcgcttgatgcagtgtttaccgacttggaaatccttgccgcgctgttcgctgctgcaatccacgatgttgaccacccaggcgtaagcaaccagttcctcatcaataccaattccgagctggccttaatgtacaatgacgagagtgtgctggagaaccaccacctggccgttggatttaagctgcttcaggaggataattgtgacatatttcagaacctgagcaagcgccaacgtcaaagcctcaggaagatggtcattgatatggtgctcgccacggatatgtcgaaacacatgacactgctcgcagatctgaagacgatggttgagaccaaaaaggtgacttcctctggagtcctgctgttggacaactatagcgatcgcatccaggtgcttcggaatatggttcactgcgctgatctgtcaaaccccacaaagcctttggagctttataggcagtggactgacagaattatggccgagttttttcagcaaggtgatagagaaagagaaagggggatggagatttcccccatgtgcgacaagcacactgcgtctgtggagaagtcccaggttggttttatcgactacatcgtgcatcccttgtgggaaacctgggccgacctggtgcatcccgacgcccaggaaatccttgatacactagaggacaatagagactggtactatagcgccatccggcaatccccaagtcccccccccgaagaggagtcccgcggccccggccacccaccgttgcccgacaagttccagtttgagctgacattggaggaagaggaggaggaagagattagtatggcccaaataccatgcaccgcccaagaggctctgaccgcccagggtctcagcggagtggaggaagccttagatgcgaccattgcttgggaagcgagcccagcacaggagtcactcgaggtgatggctcaggaagcatcccttgaagccgagctcgaagccgtatatctcacgcagcaggcgcagtccactgggtcagcccctgttgcacccgacgagttcagctcccgcgaggagtttgtcgtggctgtcagtcattcaagcccgtcagctttagcgctgcaatcaccccttctccctgcctggaggactttaagcgtctcggagcacgcgcctggcttacccggcctccctagcaccgccgcagaagtggaggctcaaagagaacatcaggcagctaaaagggcctgctccgcatgtgcgggaaccttcggcgaggatacttcagctcttcctgctcccggaggcgggggcagtggtggagatcccacttag

SEQ ID NO: 128508 - DNA, 309 bp, Artificial Sequence
  Description of Artificial Sequence: Synthetic coding sequence
atggtggagaccaagaaggtgacaagcagtggggttctgttgctggataattactctgatcggatccaggttctgcgcaatatggtgcactgtgccgatctgtccaaccccaccaagccactggagttatataggcagtggaccgatagaattatggccgagttcttccaacagggtgacagggagagggaacgcgggatggaaattagccctatgtgcgacaaacatacggcaagcgtggagaaatcccaggtgggttttatcgactatatcgtccaccccctgtgggaaacctgggctgatctgtag

SEQ ID NO: 128509 - DNA, 2478 bp, Artificial Sequence
  Description of Artificial Sequence: Synthetic coding sequence
atgcgcagtggcgctgcacctcgcgcaaggccacgtcccccggccctcgcactgccacctactggtccagagtcattgacccacttcccattttcagatgaagatacaaggcggcaccctcctggtcgtagcgtgtctttcgaggctgaaaacgggccaacgcccagccctggaaggagtcccctggatagccaggctagccctggcctggttctgcacgccggcgctgctacgtctcagcggagagagtcgtttctctacagaagcgattcagactacgatatgagcccgaaaacgatgagtcgaaattcctctgtgacgagcgaagctcacgccgaagacctgattgtcacacccttcgcacaggtgctggcctcattgcgatctgtcagatctaatttttccctgcttactaacgtgccagtgccttccaacaagcggtcgcccctgggcggacctacacctgtttgcaaggctaccttaagcgaagaaacatgtcaacagctggcccgcgagacactggaggagctcgattggtgcctggaacaactggagactatgcagacctacaggagcgtctcagagatggcatctcataagttcaagcggatgctgaaccgggaactgacgcacctctccgagatgagcaggagtgggaaccaggtgtcggaatacatttcaactaccttcctagataaacagaacgaggtcgaaattccgtcgcccaccatgaaggaacgggagaaacaacaggctcccagacccaggccttctcagccccctcctccccccgtgcctcaccttcagcctatgagtcagattactggcctaaagaagcttatgcatagcaactctctaaacaatagcaatattccgcgatttggggtcaaaaccgaccaggaagaactgctcgcgcaggagctggaaaatttaaataagtggggtttaaatatcttttgcgtgtctgactatgccggtggcaggagcttgacctgcatcatgtatatgattttccaggagcgagacctcctgaagaagttccgtatacctgtggacacgatggtaacctacatgcttacactggaggatcactaccacgccgatgtcgcttatcataatagcctccacgctgccgacgtgctgcagtcaactcacgtcctgctcgccacccccgctctggatgccgtgtttacagacctggagatcctggcagcactgtttgcagccgccattcatgacgtagaccacccgggggtttccaaccagtttctgatcaatacaaacagcgagctggccctcatgtacaatgacgaatccgttctcgagaatcatcatctggccgttggctttaagctccttcaagaggataactgcgacatcttccaaaacctatctaagcgtcagcgccagagcttgaggaaaatggtaatagatatggtactggcgactgatatgagcaagcatatgactctcttggcagacctgaagacaatggtggagaccaaaaaagtcacttctagcggagtcctgctcctcgacaactatagcgatcgaatacaggtgttgaggaacatggtgcactgcgctgatctttctaatcctacaaaacccctggagctgtaccgacagtggaccgatcgcattatggccgaattcttccagcagggggatcgcgagagggaacgcgggatggaaattagccctatgtgcgataagcacactgcctctgtcgagaagtctcaggtgggcttcattgactacatcgtgcacccactctgggaaacctgggccgatctggtacatcccgacgcccaggagatcctggatacactggaagataaccgagactggtactatagtgccattagacagtccccttcccctcccccagaggaggaaagtaggggacctgggcaccctcccctgccagacaagtttcagtttgagttgacccttgaagaagaagaagaagaagaaatatctatggcccagattccatgcaccgcacaggaagctctcacagcccagggtctgagtggggtcgaggaggctctggatgctaccatcgcatgggaagctagccccgcacaggaatctttggaagtgatggcccaagaagcttctttggaggccgagctggaggccgtgtacttgacccagcaagcacagtcaacaggctctgcccccgtcgctcctgacgagtttagttctcgggaagaatttgtcgtggccgtttctcactcatcgccaagtgcactggccctacagtccccactgcttcccgcgtggagaaccctgtccgtgagcgagcatgctccgggcctcccgggcttgccaagcacggcggcggaagtggaggcacaacgggagcaccaggcagccaagagggcgtgctctgcctgtgcagggactttcggtgaggatacgagcgcattacctgcccccgggggcgggggctcgggtggggatccgacatag

SEQ ID NO: 128510 - DNA, 2211 bp, Artificial Sequence
  Description of Artificial Sequence: Synthetic coding sequence
atgaaaaaatctaggagcgtgatgacggtaatggctgacgataatgtaaaggattactttgagtgctctctgagtaaaagctactcctcaagtagtaatactctggggattgacctgtggcgggggcggcgctgttgcagcggtaatctgcagctgccaccgttgagtcagcggcagagtgaaagggcccgaaccccagagggcgatggtatttcacgccccaccactctgccattgacgacgctgcccagtatcgcaattaccactgtctctcaggagtgcttcgacgtggaaaacggcccatcaccgggacgaagccccttggacccacaggcctcctctagcgccggtctggtgctgcatgcaacctttcctggccactcccagcggagggagtcctttctgtaccggtccgacagtgactacgatttaagccccaaagccatgagtcggaattcgtccctcccctcagagcaacacggtgatgatttgatagtgactccctttgcgcaggtactggcctctctgaggtccgtgcggaacaatttcacgattcttactaatcttcacggcacctccaacaaacgatcccctgccgcctcacagccccccgtctctcgagtgaaccctcaggaggaaagctaccagaaactggctatggaaacactggaggagttagattggtgtttggaccagctagaaaccattcaaacgtacagatcagtcagtgagatggccagcaataagtttaaacgcatgttaaatcgggagctcacgcatctgtcggagatgtcgagaagtgggaaccaggtctctgagtatatctcaaatacattcctggataaacaaaacgatgtggagataccttcacctacccaaaaggatcgagaaaagaaaaagaagcagcaactgatgacacagatttcaggtgtaaagaagctaatgcatagctcttccttgaataacacatccatctctaggtttggcgtaaatacagaaaacgaggaccatctggcaaaagaacttgaggatctcaacaagtggggcctcaacatcttcaatgtcgcgggctactctcacaaccggccacttacttgcattatgtatgccatcttccaggagcgagatttgctcaagacatttaggatcagcagcgatacctttatcacctacatgatgacgctggaagaccactatcactcagacgtggcgtaccataatagtctccacgctgccgacgtcgcgcagagcacgcatgtgctgttgtcaacacccgccctggatgccgtcttcacagatctggagattttggccgcaatctttgctgccgcgattcatgacgtcgaccatcctggcgttagtaaccagttcctcattaatacaaattccgaattagcgctgatgtataatgatgaatctgtcctggagaaccaccatctggccgttggatttaagctccttcaggaggaacattgcgatatatttatgaacctgacaaagaagcagcgccaaacactgaggaagatggtgatcgacatggtcctggctacagacatgtctaagcacatgtctctgctggccgacctgaaaaccatggtagagaccaagaaggtcacatcaagtggagtcctgctgctggacaactatactgaccgcatccaggtgttgaggaacatggtacattgtgccgatctgtctaatcctactaagtccttggagctgtaccgacaatggacagatcggataatggaggagttctttcagcagggggataaggagcgcgaaaggggaatggagatctctccaatgtgcgataagcacaccgcctctgttgaaaagtcacaagtgggtttcatcgattatatcgtacacccgctgtgggaaacatgggctgatttggtgcagccggacgcgcaggatattctcgacacactggaagataatcgcaactggtaccagagcatgattcctcagagtccaagccctcctttggacgaacagaatcgggactgccagggcttaatggagaagtttcagttcgagctgactctggacgaggaagactccgaaggccctgagaaagaaggtgagggtcattcatatttctctagcaccaaaactttatgcgtgatcgatccagagaaccgcgactctctgggggaaacagatatcgatatcgcgaccgaagataagtcacccgtcgatacgtag

SEQ ID NO: 128511 - DNA, 2211 bp, Artificial Sequence
  Description of Artificial Sequence: Synthetic coding sequence
atgaaaaagagcagatccgtaatgactgtgatggccgacgataatgtgaaagactattttgagtgctctctgagcaaaagctactctagttccagtaatactctgggcatcgatctgtggcgcggccgcagatgctgttcgggaaacctgcaattgccccctctatctcagagacagtccgagcgtgcgcgaactccagagggagacggtatttctagaccaaccactctgccattaaccacactgccctctatcgcaattaccacagtctctcaggaatgttttgatgtcgagaatgggcctagccccgggcggagtccactggatccccaggcctcgtcatccgcgggactagtactgcatgcgacttttcccggccatagtcagaggcgcgagtcgttcctttatcggagcgactccgattacgacctttcgcctaaagccatgtcccgaaattcttcccttccctcagagcagcatggggacgacttaattgttacgccgtttgctcaagtgttggcttcacttaggtccgtaaggaataattttaccatcctgactaacttgcacgggacctccaataagcgaagtcctgctgcaagccagcctccagtgtcacgagtaaaccctcaggaagagtcttatcagaagctcgcgatggagactcttgaggaactcgactggtgtctggaccagttggagacaatacagacatacaggtccgtttccgagatggcttccaacaaattcaagaggatgctcaacagggaattaacccacctttctgagatgtctcgctccgggaatcaggtgtcagaatacatttctaatacctttctggataaacagaatgatgtggagattccctcacctactcagaaggacagagagaaaaagaagaagcagcagctaatgacgcagattagcggcgttaagaaactcatgcactcttcctccctgaacaatacctcaatctcaaggttcggggtaaacaccgagaacgaggaccatctggcaaaggagttggaggatctgaacaaatgggggctcaatatctttaacgtagcaggctactcgcataaccggccactgacctgcatcatgtatgccatattccaggagcgagacctccttaagaccttcaggattagctctgacacttttatcacgtacatgatgactctggaagatcactaccactccgacgtcgcttatcataattctctacacgctgctgacgtggctcagtccacacacgtgctgctttcaacaccagctttagatgctgtctttaccgacttggaaatactggcagcgatcttcgccgcagcgattcatgatgttgaccatccaggggtctctaaccaattcctcatcaatacaaattctgagctggcactgatgtacaacgacgagagcgtactagagaatcatcacctggcagtgggatttaaacttctccaggaggagcactgtgacatcttcatgaacctcaccaaaaagcaacggcagactctgcgtaagatggttatcgatatggtgctcgctaccgatatgagcaaacacatgagcttgttggccgacctcaaaactatggtcgaaaccaagaaggtgacaagcagtggagttctgctgttggacaactatactgatcgcatccaggtgctgcggaacatggtccactgtgccgacctgtccaacccaaccaaatccctagagctctaccgtcagtggacagaccgaattatggaggagttctttcagcagggtgataaggaacgagagcgggggatggagatcagccctatgtgtgataagcatacagcctcagtagagaaatctcaggtgggatttatcgactacatcgttcaccccctgtgggaaacttgggctgatttggtccagcccgatgcacaggatattctcgatacactggaagacaatagaaactggtaccagtcaatgattccgcagtctccgagtccccccctggatgagcagaacagagactgtcaaggcctgatggaaaagttccagttcgagctcaccttggacgaggaagatagcgaaggaccagagaaggagggcgaaggtcatagctattttagttctacaaaaacgctgtgtgtgatagaccccgaaaatagggactctttgggggaaacagacattgatatagccacagaagacaagagtccggtggatacatag

SEQ ID NO: 128512 - DNA, 1695 bp, Artificial Sequence
  Description of Artificial Sequence: Synthetic coding sequence
atgaaggagcatggagggaccttttcttccacaggaatatcaggggggtccggcgactcggcaatggatagcctacagccattacagcctaattatatgccagtctgtctcttcgccgaggaatcctaccagaaacttgccatggagactcttgaggaactggattggtgtctggaccagctggaaaccattcagacatacaggagtgtgagtgaaatggccagcaataagtttaagcgcatgctgaatagggaacttacccacctgtcagaaatgtccagaagcggaaatcaggtttcagaatatatttctaatacattcctggacaagcagaatgatgtggaaattcccagccctactcagaaggatcgcgaaaaaaagaagaagcagcaactgatgactcaaatcagcggcgtcaagaaactcatgcactcctcttctctgaataacacctctatttctaggtttggagtcaacaccgagaacgaagatcacctggcaaaagagctcgaggacctcaacaagtggggtttgaacattttcaacgtggcaggatattcacacaataggcccctcacctgtattatgtatgctatcttccaggagagggatttgcttaagacatttcggatcagctcggacacttttattacatacatgatgacactcgaagaccactatcatagcgatgttgcataccataactctctgcacgccgccgatgtggctcaatcaacccatgtcttgctgagcactccagccttagatgcagtctttacagatctggaaattctcgctgccatctttgccgctgctatccacgacgtcgaccatccaggagtctctaatcagtttctaatcaacacaaattccgagttagctttaatgtacaatgacgagtccgtgctggagaatcatcacctggcagttggcttcaagcttctccaagaggagcactgtgatatttttatgaatctcacaaagaagcagcgacagactctgcgcaagatggtcatcgacatggtgctggcgaccgatatgtccaagcacatgtcgcttctcgcagatctcaaaaccatggttgaaactaaaaaagtgaccagcagcggtgtgctgctcctggacaactatactgaccgaatccaggtgttgcggaatatggttcactgcgccgacctgtctaaccctacgaagtcgcttgagttgtatcgccaatggactgacagaatcatggaagaatttttccagcaaggggataaggagagggagagaggcatggaaatctcccccatgtgcgacaagcacacagcaagcgtggagaagtctcaggtgggctttatcgattatatcgtacatccactgtgggagacatgggcggacctcgtacagcctgatgctcaggacatcttagacaccctggaggacaaccgcaactggtatcagtccatgatccctcaatccccatcgccaccccttgacgaacagaatagggactgccaaggcctgatggagaaattccaattcgagctgacactggatgaagaagactctgagggtcctgagaaggagggtgagggccattcttacttcagctccaccaagacactctgcgttattgatcctgagaatagggatagtctaggcgaaaccgatatagacatagccacggaggataagtcaccagtggatacctag

SEQ ID NO: 128513 - DNA, 2211 bp, Artificial Sequence
  Description of Artificial Sequence: Synthetic coding sequence
atgaagaaatcgcgctccgtgatgaccgtgatggccgatgacaacgtcaaggactactttgagtgcagcttgagcaagagttactccagctcaagcaatactttgggaatagatttgtggagaggacggaggtgttgtagcggaaatctgcagttaccaccgttatctcagcgccaatcagagcgggcccggacacctgaaggtgacggcatttcacgccccacaacactccccctgacaaccctgccgtccatcgctataacaacagtcagtcaagaatgcttcgatgtggaaaatggcccctcccctgggaggtctcccttggatccacaggccagcagctctgctgggcttgtccttcacgccacatttcccgggcattcgcagaggagggagtcctttctgtatcgctccgactctgactatgatctctccccaaaagcaatgagccgaaattctagtctgccctccgagcaacacggcgacgatttaattgtgactcccttcgcccaagtgctcgcctcccttcgatccgtcagaaacaatttcacgatcttgaccaatttgcacggcacaagcaacaaacggtcaccagccgctagccagccaccagtgagcagggtgaacccgcaggaggagtcgtaccagaagttggcaatggagacactggaagagttagattggtgcttggatcaactcgagaccatccagacttaccgctctgtctccgagatggcctcaaataagttcaaacggatgctaaaccgggagttaacgcacctgtctgaaatgagccgcagcgggaaccaggtgtccgagtacatttccaatacttttctggataagcagaacgacgtagaaattccctctccaactcagaaggacagggagaaaaagaagaaacaacagcttatgacccagatatcgggagtgaaaaaactgatgcactcctcgagcctaaataacacctcaatcagccgattcggcgttaacaccgaaaacgaggaccaccttgccaaggaactggaggaccttaataagtgggggctcaacatttttaacgtggccggctattctcacaaccgcccccttacctgcataatgtacgccatcttccaggaacgcgatcttttaaagacctttaggatttctagtgatacgtttatcacgtacatgatgacactcgaagaccactatcactctgacgttgcctatcataattctcttcatgccgcggatgtggcgcagtctacacacgtactcttgtccactcctgctctggacgccgtgttcactgatctggaaatcctggcagccatattcgctgctgcaattcatgacgtggatcaccctggagttagcaatcaattcttaattaacacaaattccgagctcgccctgatgtacaatgacgagtccgtgctggagaaccatcatctagctgtggggtttaaattgctccaggaggagcactgtgacatcttcatgaacttgactaaaaagcaacgacagacactgcggaagatggtgattgacatggtgttagccaccgacatgagcaagcacatgtccttgctagccgatctgaagacaatggtggaaacaaaaaaagtgacatccagtggagtgcttctactggacaattacaccgatcggattcaggtacttagaaacatggtacactgcgcagatctgtcgaatcctacaaaaagcctggagctctaccgacaatggaccgacaggattatggaagagttttttcagcagggcgacaaggagagagagagggggatggaaatctctccgatgtgtgacaaacacaccgcctctgtggagaagtcgcaggtggggttcattgactacatcgtgcatccactgtgggagacatgggccgatctggtgcagccagacgcccaggatatcctcgataccctggaggacaataggaattggtaccaaagtatgatcccgcagagcccctcccctcctctcgatgagcagaaccgggactgccaggggcttatggaaaagtttcagtttgagctgacccttgatgaagaggatagcgagggccccgaaaaggagggcgaggggcattcgtacttcagcagtacgaagacactctgtgttatcgatcccgagaaccgcgactctttgggggaaacagatatcgatatagctactgaagataaatcacctgtcgatacttag

SEQ ID NO: 128514 - DNA, 2166 bp, Artificial Sequence
  Description of Artificial Sequence: Synthetic coding sequence
atgaccgccaaggattcaagcaaggagctgacggcgtccgaacccgaagtgtgtattaaaacctttaaagaacaaatgcatctggagttagagcttccacgtttgcccggaaaccgccccacatcccctaagatatcaccccggtcttctccaaggaactccccttgcttctttcggaagcttctcgttaacaagtctataagacagaggcgcagatttaccgtagcccatacctgcttcgacgtggagaatgggccatctccagggcgatctccactggacccacaggcatcatccagcgcagggcttgtgttgcatgcaacctttccaggtcattcacagcgacgggagtccttcctatacaggagcgacagtgactatgacctgagccccaaggctatgtccaggaatagctcgcttccctccgaacagcatggcgacgacctaatcgtgacaccctttgcgcaggtcctggcctccttgcggtctgtgcgaaacaattttacaattttaaccaatctccacgggacctccaacaagagatcccctgcagcctctcagcccccagtatctcgggtaaacccccaggaggagagttatcagaagttagctatggaaactctcgaggagctggattggtgcctggatcagctcgagaccatacaaacatacagatccgtgagcgagatggcgtctaataagttcaaacggatgcttaatcgcgaactgacgcacctgagcgaaatgtctaggagcggaaatcaggtgtccgaatatatttcgaacaccttcctggataaacagaatgacgtggagatccccagccctacccagaaagaccgcgaaaaaaagaaaaagcagcagctaatgacccaaatctctggcgtcaaaaagttaatgcatagctccagcctgaacaacaccagcatttccaggttcggagtaaacaccgagaacgaggaccacctggccaaggaactagaggacctaaataagtggggcctgaacatcttcaatgtcgcaggttacagtcacaatcgacccctgacgtgtatcatgtacgcgatttttcaggaacgggacctattaaaaacctttcgtattagcagcgatacttttataacatacatgatgacattggaagatcattatcactctgacgttgcctaccacaattccctccacgcagctgacgtggcccaatcaacccacgttctcctttctacccccgctctggacgctgttttcacggatctggagattctggcggctatcttcgcagcagcaatccatgatgtggaccaccctggagtctctaatcaatttctcattaatacaaacagtgagctcgctctaatgtacaacgacgagagcgtgcttgaaaaccatcatctggccgtggggttcaaactgttgcaggaggaacattgtgacatctttatgaatctaactaagaagcagagacaaaccctgcgaaaaatggtcatcgatatggtcttagccaccgacatgagtaagcatatgtctcttttagcggatctcaaaactatggtggaaactaagaaggtcacctcatcaggagtcctattgttggataattacaccgataggatccaggtgctgcgcaacatggttcactgtgccgatctgtccaacccaaccaagtctctggagttataccgccagtggactgatagaatcatggaggaattttttcagcaaggcgataaggagcgtgagcggggcatggaaatttccccaatgtgtgacaagcatacagccagcgttgaaaaatcacaggtaggtttcatcgattatatagtgcacccgctttgggagacctgggccgatttggtacagcccgatgcccaggacatcctggatacactggaggataataggaactggtaccagtctatgatcccgcagagccccagtccgccattagacgagcagaatcgcgactgtcagggcctgatggagaaattccagttcgaactgactttggacgaggaggattctgaaggtcccgaaaaagaaggcgagggacatagctacttcagctcgactaaaacactgtgtgtgattgacccagaaaatcgcgactccctgggtgaaactgatattgacattgctaccgaggataagtctccagttgacacatag

SEQ ID NO: 128515 - DNA, 2043 bp, Artificial Sequence
  Description of Artificial Sequence: Synthetic coding sequence
atgcagggccctccagcccccgcgcccgtacccgggcccggatcaccaaggggaagccctaggggaagccccggtctgtttaggaagcttttggtgaatcagagcatccggctccagaggcgatttacagtcgcccatccactctgcttcgatttagagaacggtttatcttgtggccgtagagcactcgatccacagtcttcaccaggcctgggtagaattatgcaggcacccgttccgcattcccagaggcgagagagttttctctacagaagcgattcagactacgaactctcccccaaagccatgagtcgaaattcttccgtggcgtccgacttacatggagaggacatgatcgtcacgccattcgcacaggtgctggcttcactgcggaccgtgcggagcaacgtagctgccctcgctaggcagcaatgcctgggagccgcaaagcagggtcccgtcggcaacccaagctctagtaaccaactgccccccgcagaagataccgggcagaaactcgcactggagaccctcgacgagcttgactggtgtctggatcaactcgaaacccttcagacacgacattccgtcggcgagatggcaagcaacaagtttaagcgcatcttgaatcgggagctgactcatttatctgagacgagccgcagcggaaatcaggtatcagaatacataagccgcacttttcttgatcagcagactgaagtggagctccctaaggtgacggctgaggaggcaccgcagcccatgtctaggatctccggactgcatggcctgtgtcactctgcgtctctgagtagcgctacagtgcctcgatttggggttcagaccgatcaggaggagcagcttgctaaggagctcgaagacaccaataaatggggccttgatgtgttcaaggtggctgaactgtctgggaacagaccactcacagctatcatattcagtatctttcaggaaagggacttattaaagacctttcaaattcccgcggatacacttgcaacctatctgctgatgctggagggccactaccacgctaacgtagcctaccacaactccctgcatgctgccgatgtcgcgcagtccacccatgtcctgttagctacccccgcactagaagctgtctttaccgatctggagattctggccgccttattcgcatcagctattcatgacgtggatcaccccggcgtttctaaccagttcctcatcaataccaactccgaactcgcattgatgtataacgatgctagcgtattggaaaaccaccacctggccgttggcttcaaactgttacaggcggaaaattgtgatatttttcagaatctcagcgccaaacagagactctcactgcggcggatggtgatcgatatggtgctggccacggacatgtccaagcacatgaatctgctggctgacttgaaaaccatggtggaaacgaagaaggtgacctccttgggagtactactgctggacaactattccgaccgaatacaggtcctacagaatttggtacactgtgcagacttatctaaccccacaaagccgcttcctttataccgccagtggacagaccggattatggcagagttcttccagcagggtgaccgtgagagggagtcaggattggacataagccccatgtgtgataaacacacagcttctgtggaaaagtcacaagtaggtttcatcgactatatcgcccacccactttgggagacttgggcggatctggtccatcccgacgcccaggatttgctcgacacgttagaagataatcgagaatggtatcagtctaaaattccacggagtccgtcagatctgactaatcccgagagagacggtccagaccggtttcagtttgagctgactctggaggaagccgaagaggaggatgaggaggaggaagaggaaggagaagaaaccgcgcttgctaaggaagccttagagttgcccgataccgaactgctgagccctgaggccggcccagatcccggagacctccctctggataaccaaagaacgtag

SEQ ID NO: 128516 - DNA, 1281 bp, Artificial Sequence
  Description of Artificial Sequence: Synthetic coding sequence
atggcttctaacaaattcaaacgcatattaaaccgggagctcacccatttgtcagagacatcgaggtctggaaaccaggtctcagagtatatcagccggacatttttggaccagcagaccgaggtggagctcccaaaggtgacagccgaggaagccccgcaacctatgtctcgcatttccgggttacacggactctgtcactcagccagtctgtcttcagcgaccgttcctagattcggcgtgcagaccgatcaggaagaacagctggccaaggagttagaggataccaacaagtgggggctggacgtcttcaaggtggccgagcttagtggcaaccggcccctgactgccataattttctctatcttccaagcagtgttcaccgacctggagatcctggccgccttgtttgcctcagctattcacgatgtggaccatcctggggtcagtaaccagttcttaataaacactaacagcgaactggcactgatgtacaatgacgcttccgtactcgagaatcaccatctggccgttgggttcaagctcctgcaggctgaaaactgcgatatttttcagaacctttctgcgaagcagcggctgtcactgcggcgcatggtgatcgacatggtcctggccaccgacatgtcaaagcacatgaatctgctagctgacctgaaaactatggtagagacaaagaaggtgacctcactgggcgtgctcctgctggacaattattctgataggattcaggtacttcagaatcttgtgcactgcgccgacctaagcaatcccaccaaaccccttccgctgtacaggcagtggaccgatagaattatggctgagttcttccagcagggggatagggagagggaatccgggttggatatttctccaatgtgcgataaacacaccgctagcgtggagaaaagtcaagtcgggtttatcgactatatcgctcatcccctctgggaaacatgggccgacctggttcatccagacgctcaggatctgcttgacaccctggaggataatcgcgagtggtaccagtctaagattcccaggtctccaagtgacctgaccaacccagagcgcgatgggcccgacagattccagttcgaactgaccctggaagaggccgaggaagaagatgaggaagaagaggaggagggtgaagagacagccttggcgaaagaagccttggaactgcccgacaccgagctgttgtctcccgaggccggtcccgatcctggcgacctgcctctggataaccaaaggacttag

SEQ ID NO: 128517 - DNA, 2139 bp, Artificial Sequence
  Description of Artificial Sequence: Synthetic coding sequence
atggagaacttgggagtcggagaaggtgcagaggcgtgctcgcgattaagccgatcccgtggtcgacatagcatgacacgcgcccccaaacacctatggaggcaaccacgcaggcctattcggatccagcagcgtttctacagcgatcccgataagagcgccggctgtcgggagcgcgacctaagccctcgtccagagctccgtaaaagtcgcttatcatggcctgtctccagttgcagaaggtttgatctggagaatggtctcagctgtggccgtcgtgcattagacccccagtcctctcccggactggggagaattatgcaggcgcccgtgccacattctcagcgaagggaatcgtttctctacaggagtgattcagattacgagctctccccaaaagccatgtctaggaactcctcggtcgcttccgatctgcatggtgaagacatgattgtgaccccatttgctcaggtgctggcaagtctgcgcaccgtgaggagtaatgtggccgcactggccagacaacagtgccttggcgcagcgaagcaaggtccagtgggaaatccaagtagcagcaaccagctccctccagccgaggatacggggcagaaactggcccttgagacgttagacgaattggactggtgtcttgaccagctagaaactttgcagacccggcactcggtgggcgagatggcatccaataaattcaagcgcatcctcaacagagagctgacacacctgtccgagacctcaagatccggaaatcaggtcagcgaatacatttcaaggacttttctcgaccagcagacagaggtcgagttgccaaaggtaacagccgaagaggctccccagcctatgtcccgtatttctggcctgcatgggttgtgtcatagtgcctccctctcctctgcaactgtgccacgatttggcgtccagacagatcaggaggagcagctcgcaaaagagcttgaggacacgaataagtggggactggatgtgttcaaggtagccgagttgagtggaaatcgtccgctgaccgccatcatcttctctatcttccaggagcgcgatttgctgaaaactttccagattccagccgacactctggcgacctacctcctgatgctggagggtcactaccacgccaatgtggcttaccacaatagtctccacgcggctgatgtggcccagtcgactcatgtcctgcttgccaccccagccctcgaagccgtatttacagatctggaaatcctcgccgccctatttgctagtgctatccacgatgtcgaccatcccggagtgtcgaatcagttcctgattaacaccaactcagagttggcactaatgtataatgatgccagtgtactggagaatcatcacctcgctgttgggttcaagctgctgcaagctgagaactgcgacattttccagaacctcagcgctaagcaaaggctgtctctgagacggatggtgatagatatggtcttggccacagatatgtctaagcacatgaatctgcttgccgatttaaaaaccatggtggagactaagaaggtcacatctctcggggtgcttctcctagacaattacagtgatcgaattcaggttctacagaatctggtgcattgcgctgacttgtctaatcccaccaaacccttgcccctgtatcgacagtggacagaccgcattatggcagaattcttccagcagggggatagagaacgagagtcaggactggacatctctcccatgtgcgataaacacaccgccagcgttgagaagtctcaggtggggttcatcgattacattgcccaccctctgtgggagacttgggccgatctggtccatccagatgctcaggatctgcttgataccttggaggacaaccgcgagtggtatcagtccaagattccccgctcaccctctgatctgaccaacccggagagggatggaccggaccgcttccagttcgaactgacactggaggaagcggaggaagaggacgaagaagaggaagaggagggcgaggagaccgccctggctaaagaggctctagagttgcccgatacggagctcttgtcccctgaggcgggaccagatcccggcgacttaccactggataaccagagaacttag

SEQ ID NO: 128518 - DNA, 1821 bp, Artificial Sequence
  Description of Artificial Sequence: Synthetic coding sequence
atgcaggcccctgtccctcactcccagaggcgtgagtcatttctgtatcggagtgactcagactatgagttgtcacctaaggcaatgagccgcaattcatcagttgcttctgacctgcatggagaggatatgatcgttaccccattcgctcaggtattagccagcctccggaccgtccggagcaacgtggccgccctggcaagacagcagtgcttgggtgccgccaagcaggggccagtcggtaacccatcttcatcaaaccaactgccacctgctgaggataccggtcaaaagttggcgctggaaaccctggacgagctcgactggtgtctggatcaactggaaactctgcaaaccagacactcagtgggggagatggcgtctaataagtttaagagaattctcaacagggagctgacccacttatcagagactagcagaagcgggaatcaggtgtccgagtacatttctaggactttcctggaccagcagactgaggtggagctcccaaaagtgactgctgaggaggctccacagccaatgtctagaattagcgggctccacggcctgtgccatagcgcgagcttgagctctgcaactgtgccacgtttcggtgtccaaaccgaccaggaagagcagctcgcgaaggaactggaggatacgaataaatggggactggatgttttcaaagtggcagagctgtcaggcaatcgccctctaaccgccattatcttctcaatcttccaggagagggacctgctcaaaacgttccagataccagcggatacactcgctacttacctgcttatgcttgaaggccactaccatgcgaacgttgcttatcacaattcactccacgccgccgacgtggcccagtccacgcatgtgctgctagccacacccgcactggaagccgtcttcacagacttggaaatcttagccgcactgttcgcgtctgccatccatgatgtagaccacccaggagtgagtaaccaattcctcattaacactaattctgagcttgcactgatgtataatgacgctagtgtgctggaaaatcaccatctcgccgtgggtttcaaactccttcaggcagagaattgcgacatcttccaaaatctgtccgctaaacagaggctctccttgagaaggatggtaattgacatggtcttggccacagatatgtcgaaacacatgaacctgttagcagacctaaagacaatggtggagacaaagaaggtcacgagtctgggtgttctgctgttggacaattactcagaccgcattcaggttctgcaaaatctggtacactgtgctgatctgagcaaccctacaaagcccctccccttgtatcgccagtggaccgatagaattatggccgagttctttcagcagggcgaccgtgaacgggagtctggactcgatattagcccaatgtgtgataagcacacagcatctgtcgagaagtcccaagtcggttttatagattacatcgcccatccactgtgggagacatgggctgacctggtgcatccggatgctcaggatctacttgatactctggaagataacagggaatggtatcagtctaaaattccaaggtctccctcggatcttacgaatcctgagcgggacgggcctgacaggtttcaatttgagttaacgcttgaggaggctgaagaggaggacgaagaggaagaagaagaaggtgaagaaacggcactagcaaaggaggccctggaactgccggacacggagctgctaagccctgaagccgggcccgaccctggagatttacctttggataatcagaggacctag

SEQ ID NO: 128519 - DNA, 2376 bp, Artificial Sequence
  Description of Artificial Sequence: Synthetic coding sequence
ggcacccaggccggccttcggtccggcgcccctagcgggcataggcagctattgggggtcggacccaccttgtccccatctagcaccttctaccggttctcaacatcaggtgcggactcatccagtctcagccctcccctccctgccctcggcagaacgcgggaacagactctcctgggggcccgtagtagggggagggtcctcctaccagccattcccgaccccttcctatggcgaatggagaacttgggcgtgggggagggagcagaggcctgttcccggttgtcacggtctcgtggccgccactctatgacacgagcccctaagcacctttggaggcagccgagaaggccaatacggatccagcagagattttactccgatccagataagtcagccggctgccgggaaagggacctgtcaccccgtcctgaactgaggaagagtcgcctctcatggccggtctccagctgcagaagatttgacctggaaaacggattaagctgtgggaggcgtgccctggacccccagtcttcccctggcctgggccgaatcatgcaagcgccagtcccccattcccaacggcgcgagtcatttctctacagatccgacagtgactacgagctctcccccaaggctatgagccggaattccagcgtagccagcgacttgcacggcgaagacatgatcgttactccttttgcccaggttctggcctccctccggacagtgcggtctaacgtggccgcccttgctcggcagcagtgcctgggtgcagccaagcagggcccagtgggaaacccatcctcatcaaaccagctgccacccgctgaggacaccggccagaagttagctctagaaacattggacgaacttgattggtgcctggaccagctggaaacactgcagacccgccactccgttggcgaaatggcctccaacaaattcaaaagaattcttaaccgcgaattgacacacctgagcgaaacctcgcgttccggcaaccaggtttccgagtacatctctaggacattcctggatcaacaaacagaagttgaactcccaaaagtgactgctgaggaagcgccacaaccaatgtcacgcatttctggtcttcacggcctctgtcatagtgcatccctctcctccgctactgttccccgatttggcgtgcagaccgaccaggaggaacagttggccaaagagctggaagacacaaataaatggggactggacgtgtttaaagtagccgagttgtctggtaatagaccacttaccgccattatcttcagcatatttcaggaacgggatctccttaagacattccagatccctgccgacaccctggcgacctacctgctcatgctagaaggccattaccacgctaacgtggcctatcacaattctctgcacgcagctgacgttgcgcagagcacccacgtcttgctggccacaccggccctggaagccgtcttcactgatctagagattctggccgcactcttcgcgtcagcaatccacgacgtcgaccaccctggggttagcaaccagtttctgattaacaccaactcagagctggctcttatgtacaatgatgcgagcgtgcttgaaaaccaccacctagcagtaggtttcaagctgctgcaagccgagaactgcgacatctttcaaaacctcagcgctaaacaacgtttgtccctgagaagaatggtgatcgatatggtcctcgccaccgatatgtcgaagcacatgaatctcttggcggatcttaagaccatggtcgaaactaaaaaggttaccagccttggcgttctcctgcttgacaactacagcgatcgcattcaggtgttgcaaaacctggtgcactgcgcagacctgtcgaaccccacaaagcctctcccattgtaccgacagtggaccgaccgcatcatggcagagttttttcaacaaggtgatagggaaagagaatccggccttgacattagccccatgtgcgacaagcatactgccagtgtggaaaaaagtcaggtagggttcatcgattatatcgcccacccactatgggagacatgggccgatttggtacacccagatgcccaggacttgttggacactctcgaggacaatagagagtggtatcagagcaaaattccaagatcccctagcgatttgactaatcccgaacgcgatggacccgatcgatttcagttcgaactgacactcgaagaagccgaggaggaggacgaagaggaagaggaggagggagaggagaccgcactggctaaggaggcccttgagctgccggataccgagctcctcagcccagaggcagggcccgacccaggagatctgcccctcgacaaccagagaacctag

SEQ ID NO: 128520 - DNA, 2103 bp, Artificial Sequence
  Description of Artificial Sequence: Synthetic coding sequence
gctgtgcagaagcggagccgcgccgcgggagccaggtcaagtctgcacgctgtgttggctatgcaggggccacctgctccggcacctgtgcctggaccagggtcgcctcggggttccccccgcggaagtccaggcctcttcaggaaactgctcgtcaaccaaagcatcaggctacaacgtagattcactgtcgcccaccctctgtgtttcgaccttgaaaacggcctcagttgcgggcggcgcgcactggaccctcagtcgagccccggactgggcaggatcatgcaggcccctgtgccacattcacagcgccgggagtcattcctgtacaggtccgatagcgactacgagctctctcctaaagcgatgtcaaggaatagttcagttgcaagtgacctccatggggaggacatgatcgtaacccctttcgcgcaggtcttggcctctctgcgcaccgtcagaagtaatgtggctgctttggcacgtcagcagtgtttgggagccgcaaagcaggggccagtgggaaatcctagctcatctaatcagctgccacctgcggaagatacagggcagaagctggcacttgaaactctggacgaacttgactggtgtttggatcagcttgagacactccagacccggcactcggtaggtgagatggcatcaaacaaatttaaacgcatattaaaccgtgaattaacacatctttcagagacctcccggtccggtaatcaggtatctgagtatattagcagaacgttcctggaccagcaaaccgaggtggagctgcccaaagttactgctgaggaggctccacagcccatgagccggatttctgggctgcacggcctctgccactccgcctcactgagctcggccactgtcccacggtttggggtgcagacagatcaggaagaacagttggcaaaagaactcgaggatacaaacaagtgggggttggacgtctttaaggtcgcagagctgtccgggaatcggcccctaacagctattatcttttccatctttcaggagagagatctactgaagacgttccagatcccagctgatacactagccacatatcttctcatgctggaaggccactatcatgccaatgtcgcatatcacaacagtctgcatgccgccgacgtggcgcagtctacacacgttttgctcgcaacaccagccctggaggctgtctttactgatctggaaattctagctgctctgtttgcaagcgccatccatgacgttgaccaccctggagtatctaatcagtttctcattaacacaaactcggaactggctctgatgtacaatgatgcgtccgtcctcgagaatcatcacttggccgtgggtttcaaactcctgcaggctgaaaactgtgatatcttccaaaacctgagcgccaaacaacggctgagccttaggcggatggtgatcgacatggtgctggccacagatatgtccaagcatatgaatctcctggcggatctgaagaccatggtggaaacaaaaaaggtgaccagtctgggggtactgctgctggataattactcggatcggattcaagtattgcagaatctggtgcattgcgctgacttgtccaaccctactaagccattgcctctctaccgccagtggaccgatcggattatggccgaattcttccaacaaggagaccgcgagcgcgaatctgggttggatatttctcctatgtgcgataagcataccgcgagtgttgagaagtctcaggtggggtttatcgactacatagcacacccactgtgggagacatgggctgatctcgtgcaccctgacgcccaagatctactggacacattggaagataaccgggaatggtaccagtctaaaatcccaaggtcgccctctgatctgaccaaccccgaacgagacggtccagacagattccagttcgagttgactctggaagaggctgaggaagaagatgaagaggaggaggaggagggggaggagacggcgctcgctaaggaagcgctggagttgcccgacactgagcttctgagtccagaggctggacccgaccctggcgacctccctctggataatcagagaacgtag

SEQ ID NO: 128521 - DNA, 1446 bp, Artificial Sequence
  Description of Artificial Sequence: Synthetic coding sequence
atggcttccaataaatttaagcgcatacttaatcgggagttgacgcatctgagtgagacaagtcggtctggcaaccaagtcagcgagtatatctcccgcaccttcctcgatcagcagaccgaggtggaacttccgaaagtcaccgccgaagaggctccacaacctatgtccaggatttcgggtctgcacggcttatgccacagcgcaagcctgtcatccgccacagttcccaggttcggggtccagaccgaccaagaggaacaactcgctaaggagctcgaggataccaacaagtggggcctcgatgttttcaaagttgctgaattaagcggcaaccgccctctgactgccattatcttcagcatatttcaggagagagatttattgaagaccttccagatccctgctgacacactggcgacctacctcttgatgctggagggccattaccacgccaacgtcgcttatcacaattcgttacatgcagcggacgtcgctcaatctacgcacgtcctcttagccaccccagccctcgaagccgtgttcacagacctggagatcctcgccgctctgttcgcctctgctatccatgacgtggatcaccccggagtctccaaccagttcctcattaataccaactctgaactcgccctaatgtacaacgatgcttctgtgctggaaaaccatcacctggcggtcggctttaagctactgcaagccgaaaattgcgatatatttcagaacctgtctgcgaagcagaggttgagcctaaggcgaatggttatcgacatggtactggccaccgatatgtcaaagcacatgaatctccttgccgatctgaaaaccatggtggaaactaagaaggtgacctcactcggcgttctactgctggataattactcggatcgaatccaagttctccaaaacttggtccactgtgctgacctctccaacccaactaaaccattacctctctatcgccagtggactgaccgcatcatggcggaattttttcagcagggagaccgagagcgggaaagtggtctcgatatatcaccaatgtgtgacaaacataccgcttctgtcgagaaatcccaggtgggttttatcgactacatcgctcatcccctctgggagacatgggcggatcttgtgcacccggacgcacaagacctgctcgatacactcgaagataacagggaatggtatcagtctaaaattccgcggagcccgtctgacttgactaacccggaaagggatggccctgatcgctttcagtttgaacttaccctggaggaagctgaggaggaggacgaggaggaagaggaggagggcgaggagacagctttagcgaaggaggcgcttgagctgcctgataccgaacttctgtctcctgaggccggccctgaccccggagacctgccccttgataaccaaaggacgtag

SEQ ID NO: 128522 - DNA, 2466 bp, Artificial Sequence
  Description of Artificial Sequence: Synthetic coding sequence
atgcagagatataggggtagacagacggtatttggcgctggggttctcgggggggtctcctcagcaccctcattcaatacgcccagtcccagatctagccccctgttctacccgagtgccccttccggccaccgccagctgttgggagtaggcccgacactgtcaccctctagtaccttttaccgattctcaacgagcggcgcagacagctcttcactatcccctcccctacccgcactgggcaggacccgggagcagacgctgcttggagcacggtctcgcgggcgagtgttgctgcctgccatacccgatcccttcctgtggagaatggagaacctgggggtgggcgaaggtgctgaagcgtgttcccgcctgtcccggagtcgggggcggcacagcatgactagagctcctaaacacctatggcggcagccccgcaggccaatccgcatccagcagcggttctactcggaccctgataaaagcgccggatgtcgcgagagggatctgtctccacggcctgaactacggaagagtcgtctctcctggccggtgtcttcatgtaggagatttgacttggaaaacggcctgagctgtggaaggcgggcactcgacccacaatcatcaccagggctcggaaggatcatgcaggcacccgtgccccactcacaaagacgggaatccttcttgtatagatctgattcggactatgagctaagcccgaaggccatgagcaggaactcatcagtggcaagcgacctgcatggggaggatatgatagtcacaccctttgcgcaggtcctggctagtttgcgtacagtcagatctaacgtggctgcactggcccgtcagcagtgtctgggagccgccaaacagggtccagtcgggaacccgagctcttccaaccagctgcctcccgccgaagacactgggcagaagctcgcccttgagacactagatgagcttgactggtgtcttgaccagctggaaacactgcagacccggcactctgttggagagatggctagtaataagttcaaacggatcctcaaccgagagcttactcatctgagtgagacgagtcggtctgggaaccaagtctccgaatacataagtcggacattcctcgaccaacagacggaggtcgagctccccaaggtgaccgccgaagaggctcctcagccaatgagtcgaatctcaggtcttcatggtttatgccactccgcatcgttaagtagtgcaaccgtcccccgattcggagtgcagaccgatcaggaggagcaactcgccaaggagctggaagacacaaacaaatgggggctagacgtatttaaagtggctgagctatctggtaatcgccccttgaccgcaatcattttttctatctttcaggaaagggatctcttaaagacttttcaaatacccgcagataccctggcgacatatttgctgatgctggaaggccactaccatgccaacgtggcttaccacaatagtctgcatgccgcagatgtagcacaaagtactcatgtgctgctggccacgcctgccctggaggccgtgtttactgacctcgagatcctggccgcactgtttgccagtgccatacacgatgtcgatcatcctggagtgagtaaccagtttctgatcaacactaattccgagctggccctgatgtacaatgacgccagcgtgctggagaatcaccacctcgccgtaggcttcaaactgctacaggccgaaaattgcgatatcttccagaacctgtcagccaaacaaagattgtctctgcgcaggatggttatcgatatggtcctggctacagatatgtccaagcacatgaatctccttgcagacttaaaaacaatggtggagactaagaaagtcacctctcttggggttctcctgctcgacaactattcagaccggatccaggtattacaaaatcttgtgcactgcgcagacctcagcaatcctactaagccattgcctctgtacaggcaatggactgacagaatcatggcagaattctttcaacagggtgatagggagcgtgagagtggtctcgacatcagcccaatgtgtgataaacataccgcatcagtcgaaaaaagccaagtcggatttatagactacattgcacaccctctgtgggagacgtgggccgaccttgtgcaccctgatgctcaggacctcctggacaccctggaagacaacagggaatggtaccaatccaagatacccagatcgccctcagatctgacaaaccccgaaagagacggcccagatcggtttcagtttgaactcacccttgaagaagccgaggaagaggatgaggaggaagaggaggaaggcgaagagacggcgttggccaaggaggcgctggagttgccggacacagagcttttgtcacctgaggcaggaccagatccaggcgatttgcctctcgacaaccagcgaacgtag

SEQ ID NO: 128523 - DNA, 1557 bp, Artificial Sequence
  Description of Artificial Sequence: Synthetic coding sequence
ccgctgagaatcagaccattactccctaccgcatatcacctgctccctactgggcctgggcaatcagcagacaggtccgagcagcgggggggaccctgcccacccgcaatgccccgatcctctcaatttaaaaggatcctgaatcgggagctgacacacttatctgagacttcgcgctccgggaatcaagtgtcagagtacatcagtagaacctttctggatcaacaaaccgaggttgaactgcccaaggtgactgctgaagaagcaccacaacctatgagtcggatctcaggtttgcacggtctgtgtcattctgcttcactgagctctgccactgtgccccggtttggggttcagacagatcaggaggaacagctagctaaggagctcgaggatacgaataagtgggggctggatgtgttcaaagtggcagagctgagtggaaatagaccactaactgcgatcattttcagcatcttccaggaaagagacttactcaaaaccttccaaatccccgccgacacactcgccacgtacttattgatgctggaaggccactaccatgcgaatgtcgcctatcacaacagccttcatgctgccgacgtggcccagagcactcatgtgctactggcaacacccgccctagaggctgtcttcacagacctcgagattttagccgcacttttcgcaagtgcaattcacgacgtcgatcacccaggcgtctcaaatcagttcctgattaacactaattctgaactcgctctgatgtataatgacgcctctgtgctggagaaccatcacctggcggtgggcttcaaactgttacaagccgagaattgcgacatttttcagaatttgtccgcaaagcaacgcttgagccttcggcgaatggtcatcgatatggtgctggccacagacatgagcaagcacatgaacctgctggccgatctgaaaactatggtggaaacaaagaaagtgacctctctcggagtgctgctgttggataactattcagaccggattcaagtactgcaaaacctagtccactgcgctgatctgagcaaccctacaaaaccccttccgctttaccgccagtggactgatcgcataatggcagagttcttccagcaaggtgaccgcgagcgggagtccggcctagatatctcccctatgtgcgataaacacacagcctccgtagagaagtcccaggtgggcttcattgattatattgcacaccctttatgggaaacctgggctgacctcgtacatcccgacgcccaggaccttctggataccctcgaggataaccgcgagtggtaccagtccaagatccctcggtcacctagcgaccttaccaaccccgaaagagacggccccgatagatttcagtttgaactgacactcgaggaggcagaagaggaagacgaggaagaagaagaggagggcgaggagacagctctagcgaaagaagcgttggagttgcccgatactgagctcctgtctccagaagctggtccggatcctggcgacttgccgctggacaatcagaggacttag

SEQ ID NO: 128524 - DNA, 6723 bp, Artificial Sequence
  Description of Artificial Sequence: Synthetic coding sequence
atggagcaaacatggacacgcgattactttgctgaagatgacggcgaaatggtgccccgcactagccacaccgccgctttcctgagtgatactaaggacaggggccctccggtacaatctcagatctggagaagtggtgaaaaggttcctttcgtacagacatacagccttagggccttcgaaaaacctccgcaggtgcagactcaagccttgcgcgattttgagaagcacctgaacgaccttaagaaggaaaacttcagcctgaaactgcgtatctattttctcgaagaaaggatgcagcagaaatatgaggccagccgcgaagacatctataagcgtaacatcgaactcaaagttgaagtggagtctctaaagagggaactgcaagacaaaaagcagcacttggataaaacctgggcggacgtggagaacctaaactcacagaatgaggcggagctgagacgccaattcgaggagcgccagcaggaaactgagcacgtttacgagttgttagagaataaaatccagttactgcaggaggagtcgagactagccaagaacgaagccgctcggatggcagctctggtggaagccgaaaaggagtgcaatttggagctctccgaaaaactcaaaggggtcaccaagaactgggaggacgtgcccggtgatcaggttaagccagatcagtacaccgaggccctggctcagcgagacaagcgcatcgaggaactcaaccaaagtttggcagcccaggaaagattggtggagcagctcagccgcgagaagcaacagttacttcatctgctggaggagccaacctctatggaggttcagcccatgactgaagagctcctcaagcagcagaaactcaatagtcacgagactacgatcacccaacagagcgtcagtgactcacacttggccgagcttcaagaaaagatccaacaaaccgaagctactaacaagatcctacaggaaaaattgaatgaaatgagctatgagctgaagtgtgctcaggagtcttcacagaagcaggacgggaccattcagaacctcaaggaaaccctgaagtcgcgagagagagaaacagaggaactataccaggttattgagggccagaacgacacaatggccaagcttcgcgagatgctgcatcagtcacagttggggcaacttcactcttcggaaggcacatcccctgcccagcagcaggtggctttgctcgatttacagtccgctctgttttgctcccagctggagatccagaagcttcagcgggtcgtgcgccagaaggagcgacagctcgccgatgccaaacagtgtgtgcagttcgtggaagccgcggcccacgaatctgagcaacagaaagaggcgtcatggaaacacaatcaggagttaagaaaggcactccaacagttgcaagaggaactgcagaacaagtcccagcagttaagagcctgggaagctgagaagtataacgaaattagaacacaggaacagaacattcagcaccttaatcattctctcagtcacaaagaacaactgctgcaggaatttagagagctgcttcaataccgtgacaactcggacaaaacccttgaggcgaatgagatgctgctggaaaaacttcgccagagaattcacgacaaggcggtcgccctggagagggcaatcgacgagaaattttcagccctggaagaaaaagaaaaggagctgaggcagctgaggttggctgtgcgcgagcgcgatcacgatcttgagcggttacgggacgttctgtcttccaatgaggcaactatgcagagtatggagtcccttctgcgagctaagggacttgaggtagagcaactgagtaccacatgccagaatctgcagtggttgaaagaagagatggaaactaagttctctaggtggcaaaaggaacaggaatccattattcagcaattgcagacttcattgcatgataggaacaaagaagtcgaagacctgtctgcgactttactgtgcaagctggggccaggtcagagcgagatcgctgaggaactgtgtcaaaggctgcagcgtaaggagcgaatgctgcaagatttactatccgaccggaacaagcaggtgttggaacatgagatggagatccagggactgctccagagcgtgtctaccagagagcaggaatcacaggccgcagccgagaaacttgtgcaagccctgatggagagaaacagtgagttgcaggctctccgacagtatctgggaggacgcgacagtcttatgtcccaggccccaatcagcaaccagcaggcagaagtgactccgacgggctgtctgggaaaacagacggatcaggggagcatgcagattccttccagagatgattcaacgagcctgacagccaaggaggacgtctccatccctcggtctacgctcggcgatctcgacactgtcgccggcctcgaaaaggagctcagtaatgccaaagaggaactggaattaatggccaagaaagagagggagtcccagatggagctgtctgccttgcaatccatgatggctgtgcaagaagaggagctgcaggttcaggctgctgacatggaatcgttgacacggaacattcaaatcaaggaggatttaattaaggacctgcagatgcagcttgtcgacccagaagatattcccgcaatggagagactaacccaggaagtgcttctgcttagggagaaagtcgcatcagtggaatcccaagggcaggagatcagtggtaacagaagacagcaattgctcctcatgctggagggactcgtagatgagcgctctcgcttgaatgaggcactccaggcagagaggcagttatacagctcactcgtgaaatttcacgcgcatcccgagagctcggagagggatcgaaccctccaggtggaactcgaaggtgcacaagtcctgcgctccagactggaagaagtacttggcaggtcacttgagcgcctgaaccgcctagaaacactagccgctatcggaggtgccgctgctggggacgatactgaggacacatccacggagtttactgacagtattgaagaagaagcagcgcatcattcccaccagcaacttgttaaggtcgccttggagaagtccctagccacggtggaaactcaaaacccatcctttagccctccctcacccatgggtggtgattccaaccgatgcttgcaggaggaaatgctgcatttacgcgccgagtttcatcaacacctggaagagaagcgtaaagcagaagaggagcttaaagagctgaaggcccagatagaagaggccggattcagctcggtgagccatatacgaaatactatgttgagtttgtgtttggaaaatgccgaactgaaggaacaaatgggagaggcaatgtctgacgggtgggaaatcgaggaagataaggagaaaggagaactcgataatcagagtcaaccccgggatccagggccccagtcagccttctcgctgcccgggtcgacccaacacctccggtcacagttaagccagtgcaagcagaggtatcaggatttgcaggagaagttgctcttgagcgaagctaccgtgttcgcccaagccaatgagctggaaaagtatagagtgatgttgactggcgaatctctggtcaagcaggacagtaagcaaatacaggtggaccttcaggatttgggctatgaaacttgcggacgtagtgagaatgaggcagaacgggaggagactacctccccagagtgtgaggaacataattctctgaaagaaatggtactgatggagggcctgtgctctgagcagggacggcggggttcaactttggcctcatccagcgagcgtaaacctctagaaaatcagttgggaaaacaggaggaatttcgtgtgtacggaaagtccgagaatatacttgtgttgaggaaagacattaaagacctaaaagctcagctccagaacgctaataaggtgattcaaaacttgaagtcaagggtgcggtccctctcagtcacatccgattacagcagctcattagaacggccttggaagctcagggccgtgggcactctcgagggatcatctcctcattctgtcccagacgaggacgagggctggctgagcgatggaactggcgcattttatagtccaggcctccaggccaagaaagatttggaatcacttatccagcgcgtgagtcagctggaagcgcagctaccaaagaatggtctcgaggaaaagctggcagaagaactacgttccgcttcatggcctggcaagtatgactccctcatccaggatcaagctcgggagctatcatatctccgtcagaaaatccgagagggccgcggaatttgctacctgatcacacgacacgcgaaggataccgttaagtcattcgaagatctgttacgcagcaatgacattgactattatctcggacagtcgttccgggaacagttggcccagggatcacagcttacagagcggctcaccagcaaactctcaaccaaggaccacaaatcagaaaaggaccaggcaggactggagcccctggccctgaggctttcacgggaactacaggagaaggagaaagtgatagaggtgctgcaggccaagctcgatgcccgtagtttgaccccatcaagcagccatgctctgtccgattcacacagatccccctcgtcaacgtcgtttctgtctgacgagttggaggcctgcagtgacatggatatagtctctgaatacacccattacgaagagaaaaaggcctcacctagccactctgactccatccatcactccagccatagtgcagtacttagcagcaagccctcaagtacttcagcatcccaaggcgctaaggcagaatccaattccaacccgatttcactgcccacaccccaaaacacccccaaggaggccaaccaagcgcatagcggagccagcactgtaccccctgcttctacagctaccctgctgtccaatgatctggaagccgacagtagttattatctgaactcagctcagccacactcccctcctcgcggcaccatcgaactggggagaatcctcgaaccaggatacctaggctcctccggaaaatgggatgtgatgagaccccaaaagggatcagtctccggtgatttgtcttctgggagcagtgtctaccagctgaattcaaaacctaccggtgcggatctgctcgaagaacaccttggtgaaatccgaaatcttaggcagagactggaggagagcatctgtattaatgatagactgagagagcaactcgagcacaggctgacttcaacagctaggggacggggaagtacaagcaacttttatagccagggactggaaagcattccccaattgtgcaacgagaatcgggtgctgagagaggacaataggagactgcaggcccagctctcacacgtctctagggaacatagtcaggagactgaatccctgcgggaggcactgctgtcctctagaagccatctgcaggagctggagaaggagctcgaacatcaaaaggtggagaggcagcagctgttggaagatctgcgggagaaacagcaagaggtccttcactttcgagaggagaggttgagtttgcaagaaaacgattcacgtcttcagcataaactggtcctcttacaacagcaatgcgaagagaaacagcagctctttgagtctctccagagcgagctgcaaatatacgaagcactctatgggaatagcaaaaaagggctgaaggcctactcgcttgatgcctgccatcagatccccctatcaagtgatctgagtcacttggtggcagaggtgcgggcccttaggggacagctggagcagtccattcagggcaataattgtttgaggctccagctccagcaacagttagagtccggcgctggaaaagccagtctttcacccagctccatcaaccagaactttcccgccagcacggatccgggtaataagcaactcttgctgcaagactcggcagtatccccaccagttcgggacgtgggcatgaactcaccggcattggtgtttccatcaagcgctagctccacccccggatccgaaacccccatcattaaccgtgcgaacggcctcggactcgacacatcacccgtgatgaagaccccaccgaagctcgagggtgatgcgaccgacggttcgtttgccaataaacacggtaggcacgtcattggtcacattgacgactattcagccctgcgacagcaaatcgccgaggggaaactgttagtcaaaaagatcgtttcgctggttcggtctgcgtgcagcttcccaggtttagaggcacaggggaccgaggtgcttgggtcaaagggtatccacgaactgcgctcatctacatctgccctgcaccacgcactcgaggaatccgcctctctactaacaatgttctggagggcagcattaccatcaactcatatccctgtgctgcccggcaaagtgggtgaatctacggaacgggaacttcttgagttgaggacaaaggtctccaaacaggaaagactcttgcagtctaccactgagcatctcaagaatgccaaccagcagaaggaatctatggagcagttcatcgtttctcagctcacaagaacccatgacgttctgaaaaaggcccgcactaatttggaagtcaaaagtctgcgggcattgccttgcaccccagcactatag

SEQ ID NO: 128525 - DNA, 3399 bp, Artificial Sequence
  Description of Artificial Sequence: Synthetic coding sequence
atgaaggaaatatgtaggatttgtgcacgtgaactgtgtgggaatcagcgccgctggattttccacaccgcttccaagctgaacctccaggtcttgctcagccatgttctgggaaaagatgtgcctagagacggaaaggcagaatttgcttgttcaaagtgtgcattcatgctcgacagaatctacaggtttgacactgtcattgcccgaatagaggccctgtcgattgagaggctgcagaagctgttgctcgaaaaggatcggctgaagttttgcatagcctcaatgtatagaaaaaataatgatgactctggcgcggagattaaagctggcaatgggaccgtggatatgagcgtcctgccagacgcccgctatagcgcgttgctgcaggaagactttgcatactctggctttgagtgttgggtggaaaatgaggatcaaatccaggagccacacagctgccacgggtcagaaggtcctggaaatcgacctcggagatgccggggatgtgctgccttgcgcgttgctgacagcgattatgaggccatctgcaaagttcccagaaaggtggctagatctatatcctgtggcccaagctccagatggtctactagcatctgcaccgaggaaccggctttatcagaggttggacctcctgacctggcgtcgaccaaagtccctccggatggcgagagcatggaggaagagacacccggaagcagcgtggaatcactcgacgccagcgtgcaggcatctccccctcagcaaaaagacgaagaaaccgaaagatctgccaaggagctgggaaaatgcgactgctgttccgacgatcaggctccacagcacggatgtaatcataaattagaactggcactgtcaatgataaagggcttagattacaaaccaatccagtctccccgggggagccggctgcccatccctgttaaatccagtctacccggtgcaaagcctggtcctagcatgacagatggcgtgtccagtggatttttaaaccgcagtctgaagcccctctataagaccccagtgtcctaccccctagagcttagtgatctgcaggagctttgggatgacctctgcgaggactacttgcctctaagggtgcagcctatgaccgaagaactgctgaagcagcaaaagctcaattcccacgagactactattacacaacaatccgtttcagatagccacctggctgaactccaagaaaaaatacagcagaccgaggccacaaacaaaatcctgcaggaaaaactgaacgaaatgtcctacgagctgaagtgcgcccaggaatcttcacagaaacaggacggtacaatccagaacctgaaggagacactgaagagccgagagcgcgagacagaagagctgtatcaggtgattgagggacagaatgacaccatggccaaactgagagaaatgctgcatcagtctcagttgggccagttgcactcctcggaaggcacctccccggctcaacagcaggtcgcccttctcgatctgcagagtgccctcttctgttcccagctcgagattcagaaactgcaacgcgtcgtacgccagaaggaaagacaactggctgacgcaaaacagtgtgtgcagttcgtcgaggctgccgcacacgagagcgaacaacaaaaggaggcaagctggaagcacaatcaggagctgaggaaagctctacagcagctgcaggaggaacttcagaataagagtcaacaactgcgggcttgggaagctgagaagtataacgaaataaggacccaggagcagaacatacagcacctcaatcacagtctatcccacaaggagcagctcctgcaggagttcagggaactgctccagtaccgtgacaattcagacaaaacgctagaggccaatgaaatgctgctggaaaagctcagacaaagaattcacgataaggctgtggccctggagcgggctatagacgagaagtttagtgcccttgaagaaaaagaaaaagagctgcgtcagcttaggttggctgtgcgcgagagggatcacgacctggagcggctgagagacgtcctgagtagcaacgaggcaacaatgcaaagtatggaatctttacttcgtgctaagggattagaagtcgaacagttaagtaccacatgccagaaccttcagtggttgaaggaagagatggaaaccaaattcagtcgctggcagaaagaacaagagtctatcatccagcagctacagacatcattacatgatcgtaataaagaggtcgaagacctctctgccactttgttgtgtaagctgggcccaggtcagagtgagatcgccgaggagctctgccaacggctccagcgcaaggagcgtatgttgcaggatctgctcagcgatcggaataaacaggtcctcgaacacgaaatggagatacaaggcctgctgcagagcgtgagcacaagagaacaagagagtcaggctgctgccgaaaaactggtccaagccctcatggagcggaattctgagctgcaagcgctccggcagtacctgggtgggagagatagcctgatgtcacaggctcctattagcaatcagcaggccgaggtgaccccgacaggctgtcttggaaagcagaccgatcagggaagcatgcagattcccagtcgcgacgactctacctcgctcactgccaaggaggacgtgtccattccgcgcagtaccctgggcgatcttgacaccgtggccggccttgaaaaagaactgagcaatgctaaagaggaactggagttgatggccaagaaagagcgagagtcccagatggaactgagtgcgctacagagcatgatggcagtgcaagaagaggagctgcaggttcaggcagccgacatggaatcattgacccgtaacattcaaatcaaggaggacttgatcaaggatctgcaaatgcaacttgtggatcccgaggatatacccgctatggagcgactgacccaggaggtcttactcctgcgtgaaaaggtggcctctgtcgaaagtcagggccaggagatctccggtaaccgaagacaacagctactgctgatgttagagggcttggtcgatgaacgctcacgcctcaacgaggccttgcaggctgaacgccagttgtatagttcactagtgaagtttcatgcccaccctgaaagcagcgaacgagacaggacgctccaggtagagctggagggggcccaagtgctgcgctccagactcgaagaagtcctgggtcggtcactcgaacggctgaacagactcgagacgctggctgccattggtggggctgcggcaggagatgacacagaggacactagtaccgagtttacagattcaatcgaagaggaggcggcccaccattcacaccagcagctgtag

SEQ ID NO: 128526 - DNA, 522 bp, Artificial Sequence
  Description of Artificial Sequence: Synthetic coding sequence
atgtcaaacggctacaggaccttgagtcagcacctcaacgaccttaagaaggaaaacttttcgctaaagttgcgaatatatttcttggaagagagaatgcagcaaaagtatgaagcatctcgggaagacatctataagcgcaacatcgaactgaaggttgaggtggagagtctgaaaagagagcttcaggacaagaagcagcaccttgataagacctgggctgatgtggaaaatttgaattctcagaacgaggctgagctgaggaggcaattcgaggagaggcaacaagagaccgagcatgtttatgagctcctggagaacaaaattcaactgctccaagaagaatctcgcttagcaaaaaatgaggcagctaggatggcggcactggtggaagctgaaaaggagtgcaatctcgagttgtctgaaaaacttaaaggtgtgacgaagaattgggaggacgtccctggggaccaggtcaagccagaccagtacacagaggcccttgctcagagggacaagtag

SEQ ID NO: 128527 - DNA, 933 bp, Artificial Sequence
  Description of Artificial Sequence: Synthetic coding sequence
atgaaagggacagactccggcagttgctgcaggagacgttgcgatttcggctgctgctgtcgtgcctccagacgtgcccattatacgccctatcgcagcggcgatgctacaaggactccacaatcccctcgtcaaactcctagtcgcgaaagaaggcgacctgagcccgcgggctcttgggccgccgcagccgaggaggaagaagccgctgccgccgccactccatggatgcgagattacttcgctgaggatgatggcgagatggttccccgtacgtctcataccgcagccttcctgagcgatacaaaggaccgcggaccacctgtgcaaagtcagatctggaggtccggtgagaaagtgccgtttgtgcagacctattcactgcgggcatttgaaaagccccctcaggtgcaaacccaagctctgcgcgacttcgaaaagcatctcaacgaccttaaaaaggaaaatttttccctcaaattgcgaatttactttctggaagaacggatgcagcagaaatacgaagcgtcaagagaggacatttacaagcgcaacatcgaactgaaggtcgaagtggagagcctcaagcgtgaacttcaggacaagaagcagcacctcgataaaacgtgggcagacgtggaaaacctgaacagtcaaaatgaagctgagctgcggcgccaatttgaggaacgacagcaggagactgagcacgtgtacgaacttctggagaacaaaatccaactgttgcaagaggagtccagactcgctaagaatgaggcagccaggatggccgccttggtggaggccgagaaggagtgcaacctagaactgagtgaaaagttaaaaggagtgaccaaaaattgggaggatgtccctggcgaccaagtgaagccagaccagtataccgaggctctggcacaacgcgataagtag

SEQ ID NO: 128528 - DNA, 2910 bp, Artificial Sequence
  Description of Artificial Sequence: Synthetic coding sequence
atgtccaacggatacaggaccttgagccagcacctgaacgaccttaagaaggaaaacttttccctgaaactacggatttattttctggaagagcgtatgcagcagaaatacgaggccagtcgagaggatatctataagaggaacatcgagctaaaggtcgaagtggagagtctgaaacgcgagctccaagacaaaaaacagcaccttgacaagacgtgggccgacgtcgagaacttaaactcccagaacgaggcggagctacggaggcagtttgaggaacggcagcaggaaactgaacacgtgtatgaattactcgaaaacaaaattcagctgctccaggaagagagtcgacttgccaagaatgaagccgcccggatggccgcactggtcgaggccgagaaagagtgtaatctggaactgtcagagaagctcaaaggcgtgacaaagaactgggaagacgtgcctggcgaccaggttaagcccgaccagtacacagaggccttagcccaacgggataagcgtattgaggaactcaaccagagcctggctgcacaggagcggctcgttgaacagctcagtagggagaagcagcagctcttgcatctcctggaggagccgaccagtatggaagtgcagcccatgaccgaggagttactcaaacagcaaaagctgaattctcacgaaactacaatcacacagcagtctgtatccgattcacacttggccgagctgcaggagaagatccaacagaccgaggccaccaacaagatactccaggagaagcttaacgaaatgagctatgaactaaagtgcgcccaggaatccagccagaaacaggacgggacaatccagaacctgaaggagacattaaaaagcagggagagagagactgaggagctatatcaggtgattgagggccagaatgataccatggctaaacttcgcgagatgctccatcagtcgcagctcggtcaactgcactcatcagaggggacctcaccggctcaacagcaggtcgcactcttagatctgcagtcagctttattctgctcgcagttggagattcaaaagctgcaacgggtggttcggcaaaaggagagacagctggccgacgccaaacagtgtgtacagtttgtggaagccgccgctcacgagtcagaacagcagaaggaagcaagctggaaacacaaccaggagctcaggaaagccctccagcagctacaagaagagttgcagaataagtcacagcagctgcgagcttgggaagctgagaaatacaatgagatcaggacgcaggagcagaacatccagcacctcaaccattctttgtcacataaagaacaattgcttcaggagtttagggagctgcttcagtatagagacaactcggacaagactttagaggccaacgagatgctactcgagaaactgcggcaaaggatccacgacaaggccgtcgcattggaaagggcaattgatgagaaattttccgcccttgaggagaaggagaaggaactccggcaacttagactcgcggtgagagagagggatcacgatctggagagactgagggatgtgttaagctccaacgaggcaaccatgcagtcgatggagagtctgctgagagcaaaagggctggaggtggagcaattgtctacaacctgccagaatctgcagtggctgaaggaggaaatggagacaaagtttagcaggtggcagaaagaacaggaatctattattcagcagctgcagacgagcttgcacgatcgaaacaaagaagtggaagatctcagtgctaccctgctttgcaagttagggcccggacagagcgagatagcagaagagctctgccagcgattgcagaggaaggagagaatgctgcaagatctgctatctgacaggaataagcaggtgctcgaacacgagatggaaattcaagggcttttacaatccgtgtcaacaagggagcaggagtcacaggccgcagccgagaagcttgttcaggccctgatggagcgaaattccgagctccaggcacttaggcagtatttaggggggcgggattcccttatgagccaggctccaatatcaaaccagcaggccgaagtaaccccaaccggttgcctggggaaacagacagatcagggaagcatgcagatcccttccagagacgactcaacatctttgaccgctaaggaagatgttagtattccgcgaagcactcttggtgatctggacactgtggcggggttagaaaaagagctcagtaacgctaaagaggaactggagctgatggccaaaaaagagagggaaagccaaatggaattatctgcattgcagtctatgatggcagtgcaggaggaggagctccaggttcaggctgctgatatggagtccctcacccggaacatccagatcaaagaagacctaatcaaggaccttcagatgcagttggtggatcctgaggacatccccgcaatggaacggcttacacaggaagtgctgctgctgcgcgagaaagtagcctcggtggagagccagggacaggagattagcggaaatcggaggcagcaactccttctgatgcttgagggtttggtggatgagaggagcaggctcaacgaggctctgcaggcagagcgacagttatacagcagccttgtcaagttccatgctcaccccgagtcctccgagcgggatcgtacgctgcaagttgagcttgagggtgcccaggttctccgtagccggcttgaagaggtgctgggccgctccctcgaaagactcaaccgcttggagaccctcgctgccatcggaggagccgctgccggggatgatacagaagatacatctacagagtttacggactccattgaagaggaggctgcccatcattcacaccagcaactctag

SEQ ID NO: 128529 - DNA, 2967 bp, Artificial Sequence
  Description of Artificial Sequence: Synthetic coding sequence
atgtctaacggctataggactctgtcccagcacctcaatgacctaaaaaaagagaacttctcactaaaactgaggatatacttcctggaggagaggatgcaacaaaagtacgaagcgagccgggaggacatttacaagcggaatatcgagctcaaggttgaggtggaaagcctcaagagggaattacaagataaaaagcagcatctggacaagacctgggctgacgtcgaaaacctcaattcccaaaacgaagctgagttacgtcgacaattcgaggagcgtcaacaggagacagaacacgtgtatgaactgcttgagaacaagattcagctgctgcaagaggaaagtcggctcgctaaaaatgaggccgccagaatggcggcgttggtggaagctgaaaaggaatgcaatctggagctttctgagaagctgaagggagtgactaaaaattgggaggatgtacccggcgatcaggtgaagcccgaccagtacaccgaggcacttgcccagcgcgataagcggatcgaagagctgaaccagtcactagcagcacaagaacgcttggttgaacagctttcacgagagaagcaacaactcttgcatttgctggaggaaccaaccagcatggaggtgcagcctatgacagaagagcttctcaagcaacagaagctgaatagccatgaaactacaattacacagcagtctgtgtcagattcccatcttgccgaactgcaggaaaaaatacaacagacagaggctaccaataaaattttgcaggaaaaactcaatgagatgagttacgaactgaaatgcgcacaggagagttcccagaaacaagatggcaccattcagaatcttaaggagaccctgaaaagccgggaaagggaaaccgaggagctgtaccaagtgattgaggggcagaatgatacgatggccaagcttagagaaatgctccaccagagccagttaggccagttacattcctctgagggaacatctccagcccaacagcaggtagctctccttgatctgcagagcgccctgttttgttctcagttagagatccagaaacttcagagggttgtccggcaaaaggaaagacaattggctgacgctaagcagtgtgtccaatttgtagaagcagctgctcacgagtccgaacaacagaaggaggccagttggaagcacaaccaggagctgagaaaggccctccagcagctgcaagaggaactccaaaacaaaagccagcagctgagggcatgggaggccgaaaaatacaatgagatacggacccaggagcagaacattcaacacctgaatcacagcttatcacataaggaacagctactgcaagagttccgggagctcttgcagtatagagataattccgataagactctcgaggctaacgagatgcttctggagaaactgaggcagagaatccatgataaagcagtggctttagagagagcaatcgacgagaaattttctgctctggaagagaaagagaaggaattacgacaattacggttggccgttcgcgaaagagaccatgacttagaacggttacgagatgtgctctcttctaatgaggcaactatgcagtcaatggaatctctactgagggctaaaggtctcgaggttgagcaactgtccacaacctgccagaacttgcaatggctgaaagaggaaatggagacgaagttcagtagatggcagaaagagcaagagtccattatccagcagctgcagacgtcactccatgaccgtaacaaagaggtcgaggacctctctgctacattactttgtaaactagggcctgggcagagtgaaattgcagaagagctgtgccagcgcctgcaacgaaaggagcggatgttgcaggatctcctgtctgatcgtaacaagcaagttttggagcacgaaatggaaattcagggccttctgcagagcgtctccaccagggagcaggaatctcaagctgctgctgaaaaattagttcaggctttaatggaacggaattctgagttacaggctctaagacaatatcttggcggaagagattccctgatgtctcaagcacctatctccaatcagcaggccgaagtgacaccgacggggtgtttgggcaagcagaccgaccagggctctatgcagatccccagccgcgatgactcaactagcctgacagccaaagaggacgtgtctatccctcggagtaccttgggcgaccttgacacggtggccggactggagaaggagctgagtaatgccaaagaggagctggaactgatggctaagaaagaaagggagagccagatggagttaagcgctctccagtctatgatggcggtccaggaggaggagttgcaggtccaggcagccgacatggaaagtcttacaaggaatattcagattaaggaagacctgattaaggatctgcagatgcagctggtggacccggaggacatcccagcaatggaacggctcacgcaggaggttctcctcctcagagagaaggtggcctcagtcgagagccaggggcaggagattagcggcaaccgtaggcagcagctgcttctgatgttggagggcctggttgatgaacggtcgcggctcaacgaagcacttcaggccgaaaggcagctgtactcctctttagtgaagtttcatgctcatccggaatcatccgagagggaccgtacgttgcaagtggaattggagggggctcaggtgctccggtcaagattggaggaggttctgggcagatctttagaacggctgaataggttggagacccttgccgccattggtggtgccgcggctggggacgacacagaggacacgtctacagagtttaccgattcaattgaggaggaggcagcccatcatagccaccagcaggtgagccagtgccagggtttgggcctccccggctggactgcccactctccaagtgaggtctag

SEQ ID NO: 128530 - DNA, 3396 bp, Artificial Sequence
  Description of Artificial Sequence: Synthetic coding sequence
atgaaagaaatttgccgtatctgtgcccgcgagttatgcgggaaccagcggcgatggatcttccacaccgcctccaagctgaacttgcaggttctgttatcccacgtgctgggcaaggatgtgccgagagatgggaaagctgagtttgcttgcagcaagtgcgcctttatgctggaccgcatctaccgcttcgatacagtgatcgcccggatcgaagcgctgagcattgagcggttgcagaaattgctgttggagaaagaccgtctaaagttctgtattgcttctatgtacagaaagaacaacgatgactcaggagctgagatcaaggccggcaacggaaccgtcgacatgtccgtcctgcccgatgccaggtacagcgcactgctacaggaagatttcgcttattccggcttcgaatgctgggtggaaaacgaggatcaaatccaggagccacattcgtgccacggaagtgagggtcccgggaatcgtccacggagatgcagaggctgtgccgcactgagggtggccgattcagactacgaggccatatgcaaagtgcctagaaaagtggccagaagcatctcctgcgggcctagctctagatggtccacatctatctgcacagaggaacctgcgctatcagaagtaggtcctcccgaccttgcctctaccaaggtgcccccagatggggagagcatggaagaagagactccggggagcagcgttgagtcgttagatgcctccgtccaggcatccccgccccagcaaaaggacgaggaaacggaacgttcagctaaagaactcggcaagtgcgattgctgtagtgatgaccaggcaccacaacatgggtgcaaccacaaattagaactggccctcagtatgataaagggcctagactataagcctatacagagcccaagagggtcacgcctcccaatccctgtgaagtcatcgctgcctggcgccaaacccgggccatctatgacagatggggtgtcatcggggttccttaatcgatctttgaaacctctgtataaaacgcctgtgtcctatcccctggaactatctgatctgcaggaactctgggatgatctgtgcgaagattacctgccactgcgggttcagccaatgactgaagagcttttaaaacagcagaaactgaattctcatgagacaaccatcactcagcagtcagtcagtgactcacacctcgccgaattgcaagagaaaatccaacagaccgaagccaccaataaaattcttcaggagaagctcaatgaaatgtcttacgaacttaagtgcgctcaggaaagtagccagaaacaggatggcacgatccagaacctcaaggagaccctaaaatcccgagagagagaaaccgaggaactgtaccaggtaatagaaggacagaatgatactatggcgaagctgagagaaatgctgcatcagtcccagctgggccagctccactcttccgaaggtacatcacccgctcaacaacaggtcgcactacttgatcttcaatctgccctgttttgctcccagttggagatacagaaactgcagcgagtggtgcgccagaaggaacgacagcttgcagatgcaaaacagtgtgtgcagttcgtggaggcggcagcgcatgaatctgagcagcagaaagaggcctcttggaagcacaaccaggagctccggaaagctctacagcagcttcaggaggagctccagaataaatcccagcagcttcgtgcctgggaagctgagaaatataacgagatccgcacccaggaacagaacatccaacacctcaaccacagtttatcccacaaggagcagctgctgcaggaattcagagagttgctacagtacagggataattccgataaaacactcgaggcaaacgagatgctgctcgagaagctgcgtcagaggatccacgacaaggccgtggcactggagagagctattgatgaaaaattttcggccttggaggaaaaggagaaagagctgagacagctgcgcctggctgtccgtgaaagggatcatgatctggaacgactgagggacgtcctttccagcaatgaggctaccatgcagagcatggaatcccttcttagggcaaagggcctggaggttgagcagctcagcactacttgccaaaacctccagtggctgaaggaggaaatggaaactaagttctcacgctggcagaaggaacaggagagcattattcagcagcttcagacttcactgcacgacaggaataaggaagtcgaagatctgtccgcaaccctgctgtgcaaactcggacctgggcagtcagagatagcagaggagttgtgtcagagactccaaaggaaggagaggatgctacaagatctacttagtgaccggaataagcaagtgctagaacatgaaatggagatccagggcctgctgcagagcgtctcaactcgggagcaggaatcccaggccgccgcggagaaactggttcaggccctcatggagagaaattctgagctccaagccctgcgccagtaccttggcggcagagactccctgatgtctcaggcacctatcagcaaccaacaggctgaagtcacacccaccggatgcctgggcaagcagacagatcaaggctctatgcagattccttcccgcgatgattctacaagcctgaccgctaaggaggatgtgagcattccgcgaagtacccttggtgatttggataccgtggctggactcgaaaaggagctttcaaacgcaaaagaggaactagagctcatggccaagaaagagagagaatctcagatggagctctcagctctgcaatccatgatggccgtccaggaagaggagctgcaggtccaggctgccgacatggaatccctgaccagaaacatacaaattaaggaggacctcatcaaggacctccagatgcagttggtcgatcctgaagatatccccgctatggagaggttgacccaagaagttctcctgttgagagaaaaggtggccagcgtggagtcccagggtcaggagatttcaggaaaccgtcggcagcagttgcttctgatgctggaaggcttggtggatgagagaagtcgactgaacgaggccctacaggctgagagacaactgtattccagcctggtcaagtttcacgctcatcccgaaagctcagagcgtgatcgaacgcttcaggttgagcttgaaggtgcacaggtcctgcgcagcaggttggaggaggtcctcggccgctctctagaacgtctgaatcggttggagacattagcagccattggcggtgcggctgcaggcgacgacacagaagataccagtacagagttcaccgactctatagaggaagaagccgctcatcattcacaccagcagtag

SEQ ID NO: 128531 - DNA, 7041 bp, Artificial Sequence
  Description of Artificial Sequence: Synthetic coding sequence
atgagcaacgggtatcgtacactgagccagcatctcaacgacttaaaaaaggagaatttcagcctcaaattacgtatctacttcctggaggagcgcatgcaacagaagtatgaggcttctcgagaggacatttataagaggaacattgaactgaaagtggaagtcgagtctcttaaaagagaactccaggacaaaaagcagcacttggataaaacttgggcagacgtggagaacttgaattctcagaacgaggctgaactgcggcgccagtttgaggagcgtcaacaggagacggagcacgtctacgaactactggaaaataaaattcaacttttgcaggaggagtcccgtctagcgaaaaacgaggctgcaaggatggccgcgctcgtggaagctgagaaggagtgcaatttagaactctctgagaagctgaagggtgttaccaagaactgggaggacgtccctggagatcaggtgaagcccgaccagtatactgaggcgctcgctcagagggacaagagaatcgaagagctcaatcagagtcttgcagctcaggaaagattggtagaacagctttctcgagaaaaacagcagctgctccatctgctggaagaacccacatctatggaggtccaacccatgactgaggaactcctcaagcagcagaaacttaattctcatgagaccaccattactcaacagtcggtctccgattctcacttagccgagcttcaggagaagattcagcagacggaagcaaccaacaagatcctacaggaaaagcttaacgaaatgtcttacgaattgaagtgtgcgcaggaatcctctcagaaacaggacggcaccatccagaacctcaaggagacactcaagtctagagaaagggaaaccgaggagctgtaccaggttatcgaaggacaaaacgacaccatggcaaaactccgcgagatgcttcaccagtcccagctgggacagttgcatagctctgagggtacctctccagcacaacaacaagtcgcgctcctggatctgcagtccgcgttgttctgctcccaactcgagattcagaaattgcagcgggttgtgcgtcagaaagagagacagctcgctgatgcaaagcaatgtgtgcagttcgtagaagctgctgcccacgagtctgagcagcagaaggaagcctcgtggaagcacaatcaggaactgaggaaggcgttacagcagctgcaggaggagctgcagaacaagagccaacagttaagggcatgggaagcggagaagtacaatgaaatcagaacccaggaacagaacattcagcatctgaaccattctttatcacataaggaacagcttctccaggaattcagggaacttttgcagtatcgggataatagtgacaaaaccctcgaagcaaacgaaatgcttctagaaaaactaagacagaggatccacgataaagcggtcgcattagagcgagctatcgacgagaagttctctgcccttgaggaaaaagagaaggaattacggcagctgagattggccgtcagggaacgggatcatgatctcgagagactcagggatgtgctcagcagcaatgaggccaccatgcagagcatggagagccttcttcgcgctaagggtcttgaagtggaacaactgtcaacaacctgtcagaatcttcagtggctcaaggaagaaatggagactaagttttctagatggcagaaagagcaggagagcatcattcagcaacttcagacttctctacatgatcgaaacaaagaggtagaggacttgagtgctacactcctttgtaaattaggtccaggccaatcagagattgccgaggagctctgtcagcggctccagcgcaaagagaggatgctgcaggacctgctgagtgatcggaataagcaagtgctggaacacgaaatggaaatccaaggccttttacaatccgtgagcacccgggaacaagaatctcaggctgccgccgaaaagctggtccaagctctgatggaacgcaatagtgagctgcaagcgctacggcagtatctggggggcagagactctctcatgagtcaggctcccatttccaatcaacaggctgaggtgacgcctacaggctgcttggggaaacagacagaccaggggagcatgcagattccttctagagatgattctacctcgctgaccgccaaagaagacgtctccatacctcggagtaccctcggagatctggacactgtcgcgggcctggaaaaagagttgtctaatgctaaggaggaactggagctgatggccaagaaggaacgggaatcccaaatggagctctcggctctccagtctatgatggccgttcaggaagaggagcttcaggttcaagctgccgacatggaatcattaacacgcaacatccagatcaaggaggatttaatcaaagatctacaaatgcagttagtcgatcctgaggatattccagctatggagcgcctgacacaagaagttttgctgcttcgtgaaaaggtggcaagcgtggaatcgcaaggccaggagattagcggtaatcgtcgccaacagttgttgttgatgctcgaggggctagtggacgaacggtcccgactcaacgaggcactgcaagccgagagacagctgtactcatcattggtgaagtttcacgcacatcccgaatcttccgagcgagatagaaccctgcaagttgagttagaaggggcccaagtcctgagatccagacttgaagaagttttgggccggtcgttggagcgtctgaatcggctggagacactggccgctatcggcggcgctgcagccggagatgacacagaagatacttccactgagtttacagattccatcgaggaggaggcggcacatcattctcatcaacagctggtcaaggttgcattggaaaaaagcctggccaccgtggagactcaaaaccctagttttagccccccttctcctatgggtggggattcgaaccgttgtctgcaggaggagatgctccatcttcgtgccgaatttcatcagcacctggaggaaaagcgtaaagctgaggaggaactgaaagagttaaaggcacagattgaggaggctggcttcagctctgtgtcacatattcggaacacaatgctttcgctctgtttagaaaatgccgaactcaaggaacagatgggagaggccatgtctgacggctgggagatcgaagaggataaagaaaaaggggaggtgatggtggaaacggtggtcaccaaggaggggctcagtgagtcgagcctacaggcagaattcaggaaactacaggggaagctcaagaatgctcacaacattataaacctgctgaaagagcaattggttctcagctcaaaggaggggaacagcaaactgacaccggaacttttggtgcatctcacatcaacaattgagcggattaacacggaactcgtcgggtcacccggcaaacatcagcatcaggaggagggtaatgtcactgtgcgccctttccctcgaccacaatctctggacttgggtgctacattcaccgtggacgcccaccagctggacaatcagtctcagccaagagaccccggccctcagtctgcctttagcttgccgggcagcactcagcaccttcgaagtcaactgtcccagtgtaaacaaaggtaccaggacctgcaagaaaaactgttgctgtcggaagctacagtgtttgctcaggctaatgaattagagaaatacagggtcatgctgaccggagagtctctggtgaaacaggactccaaacagatccaagttgatctgcaggatctgggctacgagacttgcggccggagcgaaaacgaggcggagcgtgaagagacaacctcgccagaatgtgaagaacacaacagcctcaaggaaatggtgcttatggaagggttgtgctccgagcagggccgaagggggagtacacttgcctcaagctcagaaagaaagccgttggagaatcagctcgggaaacaggaggagttcagggtctacggaaaatctgagaatattctagttctgaggaaggacattaaggacttgaaagctcagctccagaacgccaataaggtcattcagaacttgaagagtagggtacgctctctttctgtgacttctgattacagctctagccttgaacgcccctggaagctgcgcgccgtgggcacactagaaggaagctctcctcacagcgtcccagatgaggatgaaggatggctgtccgacgggaccggggctttctattctccaggcctgcaagcaaagaaagatttagaatctcttatccagcgagtttctcagctggaggcccagctgcccaagaatggtctagaagaaaaattggccgaggaactacgtagtgcatcatggcctgggaagtatgattccctgattcaggatcaggctcgcgagctgagctacttgagacagaagataagagaagggagaggcatctgttacttgatcacacggcacgcaaaggacaccgttaagtcatttgaggacctcttgcgctccaacgacatagactactaccttggtcaatcctttcgagagcagctggcccagggtagtcagttaacagagaggttgacctccaagctgagcacaaaggatcacaaatcggagaaggatcaggcaggtctagaaccacttgccctaaggttatcccgggagttgcaggaaaaagagaaagttatagaggtccttcaggcaaaacttgacgctagatcactgacacctagcagctcccatgctctaagcgacagtcacaggtccccaagttcgacgagctttctcagcgacgaacttgaggcctgttccgacatggacattgtgtccgagtatacccactacgaggagaagaaggctagtccgtcgcactcggattcgattcaccatagctcacacagtgctgtgctgtcttctaagccaagctcgacttctgctagccagggagctaaggcagagtctaactccaaccctatctctcttccgaccccgcagaataccccaaaggaggccaatcaggcacactccggtttccacttccattccattcccaagctggccagtctgccccaggcccctctgccttcggcccccagctccttcttgcctttcagcccaacaggtccacttctccttggatgctgcgaaacacccgttgtttcactcgccgaggcccagcaggagctccagatgttgcaaaagcaactgggggagtcagcctccacagtgccacccgcgtctacagcaacgctcctctctaatgatctggaggcagacagttcttattacttgaattcagctcaacctcacagtcccccaaggggcacaatcgagcttgggcgcatcctggaaccaggttacctgggaagctcgggaaagtgggatgtgatgcgcccacagaagggctccgtgtctggcgacttgtcatccggctcctccgtgtaccaactaaactccaagcctacaggagccgatctgctagaggaacacttgggagagattcgtaacctcaggcagcggctggaagaatctatatgcatcaatgatcgcctgcgcgagcagctcgaacaccggttaacctcaacagcaaggggtagggggtccacatctaatttctatagccagggactggagagtattccccagctctgcaatgagaatcgagtcctgcgagaggataatcgacgactgcaagcacagttgtcacatgtcagcagagaacactcacaagagactgagtcattgcgcgaagctctacttagctctaggtcgcacttgcaggaactcgagaaagaactggaacaccagaaggtcgagagacaacagctcctcgaagacctgcgggaaaagcagcaggaggtgctccacttccgagaggagaggctcagcctacaggaaaacgactccaggctgcagcacaaactggtactgctacaacagcagtgtgaagagaagcagcagctgttcgagtctctgcagagcgagctgcagatctatgaggccctctatggtaattctaaaaagggtttaaaggcatacagcctggacgcctgccaccagatccccctgagcagtgatctgtcacacctagtggccgaggtacgagccttgagagggcagctggagcaatccattcagggcaataactgccttaggctccaacttcagcagcagttggagtccggcgccggcaaggctagtttaagtccttcgtccatcaaccagaactttcctgcatctactgatccggggaacaaacaattattgctgcaggatagcgccgtgtccccaccggtcagagacgtgggcatgaactccccggccctcgtgttcccgagtagtgcctcctctacgcctggaagcgagactcccattattaacagggcaaacggacttggactggacacatcaccggtcatgaaaacgccaccaaagctagaaggcgatgccacggacggctcttttgcaaataagcacgggagacatgtaattggtcacatagatgattattccgcattaagacagcaaatcgcagaggggaagcttctggtgaagaagatcgtgagcctggttagaagtgcttgctccttccccggtttggaagctcaaggaacggaggttttaggtagcaagggaattcacgagctgagatcgtcaacatctgcgctgcatcacgcactcgaggagtcagcgtcccttctcactatgttctggcgagccgcattacctagcacccatatcccagtactcccagggaaagtaggggagagcacagagcgggaattgcttgaactaaggactaaggtgtcgaagcaggagagactcctacagtccacgaccgagcacctcaaaaatgccaaccagcagaaagagtctatggagcagtttatagtgtctcaactgaccagaacccacgatgtcctcaaaaaggcaaggacaaacttggaagtaaagagtctccgcgctttaccttgcactccagccttgtag

SEQ ID NO: 128532 - DNA, 7089 bp, Artificial Sequence
  Description of Artificial Sequence: Synthetic coding sequence
atgtccaacggataccggaccctctcccagcacctgaatgatctgaaaaaggaaaactttagtctcaaacttagaatatacttcctcgaagaaaggatgcagcagaaatacgaggcctccagagaagacatttataagcggaatatcgagctcaaagtggaggtggagagtctgaaacgtgaactgcaggacaaaaagcaacatctcgacaaaacatgggctgatgtcgagaatttaaactcccagaacgaggcggaactgcggcggcaattcgaagaacgccagcaggagaccgaacatgtctatgagttactggaaaataaaatccagctgcttcaggaagaatctagacttgctaagaatgaagccgctagaatggccgccttggtcgaggccgagaaggaatgtaacttggaactgagtgagaagttgaaaggcgtcactaagaactgggaggacgtgcccggtgaccaggtaaagccggatcagtacacagaagcactcgctcagcgggataaacggatcgaggagcttaaccagtcattggcagcccaggagcgtctagtcgagcaactatcaagagagaaacagcagttacttcatcttcttgaagagcccacatcgatggaagtccagccgatgacagaagagttgctgaagcagcaaaagttgaattcacacgagactaccataactcagcagagcgtctccgattcccacctggccgaattacaagagaagatccagcagactgaggccaccaataagatactccaggaaaagctgaatgagatgtcttatgagctgaagtgtgcacaggaatcttcacagaaacaggacggaacgatacagaatctgaaagaaaccctcaagtccagagagagagagacagaggagctctaccaagtgattgagggccagaacgacacaatggcgaagctgagggagatgctgcatcagtctcagctggggcagctgcatagctcagagggaacgtcccccgcccagcagcaggttgccttgctcgacttgcaatccgctttattctgttcccaactggagatccagaagcttcagcgagtggtgcgccaaaaggagaggcaactggccgacgcaaaacagtgtgtgcagtttgttgaggcagccgcccacgaatctgagcaacagaaggaggcatcctggaagcacaaccaagaactacgcaaggctctccagcagctgcaggaagagctgcagaataaatcccaacagctcagagcctgggaagccgagaagtacaatgagataaggacccaagagcagaacatccagcacctgaatcattccctctctcacaaagagcaactgctccaagaatttcgcgagttgcttcaataccgtgacaatagtgacaagactcttgaggccaatgaaatgctgcttgaaaaactgagacagagaatacatgacaaagccgtggcgctcgagcgggctattgacgaaaagtttagcgcattggaggagaaggagaaggaactgagacagctgcggctggcagtgcgtgagcgcgaccatgacctggagagactcagggacgttttgagctctaacgaagctaccatgcagagtatggaatccctcctccgggctaagggattggaagtggagcagctgtccaccacatgccaaaatctgcagtggttgaaggaggagatggagaccaagtttagccggtggcaaaaagaacaggagtccataatccagcaacttcagacaagcctccacgatagaaataaagaggttgaggacctttccgctactctgttatgtaaactggggcccggacagtctgaaatcgccgaggagctgtgtcagcgacttcaacggaaagaacgaatgctacaagatctgctgagtgaccggaataaacaggtgctggagcacgaaatggagatccaaggtctcctgcagtctgtctccactagggaacaagaatcccaggcggcggctgagaagctcgttcaggctctgatggaaaggaattccgagctgcaagcccttagacagtacttggggggccgcgacagcctaatgtcccaggcccccattagcaaccaacaggccgaggtaaccccaacgggttgcctcggcaagcaaaccgaccagggctctatgcagattccctctagggacgacagcacatccttaacagctaaagaggatgtatcaattcctagaagtaccctgggagatctagacaccgtcgccgggctggaaaaggaattgtccaatgcaaaggaggagctggagcttatggctaagaaggaaagagaatcccaaatggagctgtcagcccttcagagcatgatggctgtccaggaagaagagttacaagtgcaggcagcagacatggaatcgctgacccgaaacatacaaattaaagaagacctgatcaaggacctacagatgcagctggtggaccctgaggacatccccgccatggagcgactgacgcaggaggtgctgctacttagagagaaggttgcatccgtggaaagccaggggcaagaaatcagcggaaacaggaggcagcagcttcttctgatgcttgagggtctggtcgacgagcgctcccggttaaacgaagcactccaggcagagcgccagctttactcctcacttgtgaagtttcatgcccatcctgaatcctcagagcgggatcgtacgctgcaggtggagcttgagggggcacaggtcctgcggagtcgtctcgaggaggtgttgggtaggtctctcgaacggctcaaccggctggaaactctggctgccatcgggggtgcagcagctggtgacgacaccgaggatacctctactgagtttaccgatagcatcgaggaagaagctgctcaccattcgcaccagcagcttgtgaaagttgcactggagaaaagtctagctacggttgagacgcagaacccttcttttagccctcccagccccatgggcggcgacagtaatcgttgtcttcaagaagagatgctgcacttgcgcgccgagtttcatcagcacctcgaagagaagagaaaagccgaggaggagctcaaggaacttaaggcccagatcgaagaggctggcttctcaagtgtatctcatatcagaaatacaatgctgtcactgtgtttagaaaatgccgagctgaaggagcagatgggggaggccatgagcgatggatgggagatagaagaggataaggagaagggggaggtgatggtggagaccgttgtgacgaaggaaggtctctcagagtcctccctgcaggccgagttccggaagctccagggcaagctcaagaacgcccacaatatcatcaacttgctgaaagaacagctggtgctaagtagcaaggaaggaaattccaagctcactcctgaattgctggtgcacctcactagtactatagaacgaatcaacaccgaactggtgggatcccctggtaaacatcagcatcaggaagaggggaatgtgacagtgcgaccctttccccgtccacaaagtttggacctcggcgccacattcacagtggatgctcaccaactggacaaccagtcccagccaagggaccccggtcctcaatccgcatttagcttgccaggaagcacacagcacctacgatcgcagctgagtcagtgtaagcagcggtaccaagatcttcaggaaaagttgttattgtctgaagcgactgtttttgctcaggccaatgaactcgaaaaatatagggtaatgttaacaggcgagagtctcgtaaaacaggattcaaagcagattcaagtggacctgcaagacctcggttatgaaacatgcgggaggtctgagaacgaggctgagagggaagaaaccacttcaccagagtgtgaagaacataatagtttgaaggaaatggtactcatggagggactctgttctgagcaaggtcggcggggttccacactcgccagtagtagtgagaggaagcccctcgagaaccaactgggcaaacaggaagagtttcgagtgtatgggaaatcagaaaacattctggtcctccggaaggacattaaggacctgaaagcccagcttcagaacgctaacaaggtcatccagaatttaaagtcccgagtgcggtcactgagtgtgacaagcgattactcttcatctctagaaaggccgtggaagctgcgagccgtggggactctcgagggtagttccccacattctgtccctgacgaggatgagggatggctgagcgatggcaccggagcattctactcacccggcttgcaggctaagaaagacctggaatccctgattcaacgcgtgagtcaactggaggctcagttgcccaaaaatggattagaggaaaagctcgctgaggagttgcgctccgcctcatggccagggaagtacgacagcctcatacaggatcaggcccgagagttgagctacctccgacaaaagatccgggaaggtagaggcatttgttacctaataaccaggcacgctaaagataccgtcaaatctttcgaagatctcctgaggtctaatgacatcgactactaccttggacagagcttccgggaacagttagcgcagggatcccaactcactgaaagacttacttctaaattatccacgaaagaccataagtctgaaaaggatcaggctgggctggagcctctggcactgagacttagcagagagttgcaagaaaaagagaaggtcattgaagtgctccaggccaagcttgatgccaggagcttaacacctagcagtagtcatgccctttccgactctcaccgaagtcctagtagtacttcatttttaagcgatgagctcgaagcatgttccgatatggacatcgtaagtgagtatactcactacgaagaaaagaaggcatctccgtctcactcagatagtattcatcatagcagtcattctgcagttcttagttcgaagcccagctctacctctgcctcacagggggcaaaggctgaatccaatagcaatccaatctcccttccaactccacaaaatacccctaaagaagcaaaccaagcacactcggggtttcacttccatagcatcccaaagctggcaagtctcccccaagccccacttccaagtgcgccttccagcttcctaccatttagcccaactggacctttgctgctcggctgttgtgaaacccccgttgtgtctctggcagaagcacagcaggagctgcaaatgctgcaaaagcaactcggggaaagcgcatctaccgtgccaccggcttctaccgctaccttattgtctaacgacttggaggccgactcttcatactacttgaattcggcgcagccacatagtccgcctaggggaactatcgaattgggtcggatacttgaacctggctatttaggaagcagtgggaaatgggacgtgatgcggcctcagaagggaagtgtgtccggtgatctgtcatcaggttcgtccgtataccaattgaattcaaagccaacgggtgccgacctgctggaagaacacctgggagagatccggaacttgcgccagcgccttgaagaatccatatgcatcaacgatcggctgcgcgaacagctagagcatcgactaacatctaccgcccgcggcagaggtagcacctccaacttttactcccagggattggagtcaatcccccagttgtgtaatgagaatcgcgtgctccgggaggacaaccggcgcctgcaggcacagctctctcacgtgagccgcgaacattctcaggaaactgaatctcttcgcgaagctttgctgtcatccaggagtcatttacaggaattagaaaaggaactcgaacaccaaaaagttgaaaggcagcagttgttggaggacctccgcgagaaacaacaggaggtccttcattttagggaggaacgcctaagcctgcaagagaatgattctcgtcttcagcacaaacttgtgcttttgcagcagcagtgcgaggaaaagcagcaattgttcgaaagtcttcagagcgaactccagatctacgaggctctgtatggcaatagcaagaaaggcttaaaggcatacagccttgatgcctgtcaccaaatccctttatcttcagatctctcacacctcgtcgcggaggtccgggccctacgaggacaactggaacagtcaatccagggcaataattgtcttcgcctgcaacttcaacagcagctggaatccggcgccggaaaagcctctctgtccccctcatccattaaccagaatttcccagcttcaaccgacccaggaaacaaacagctcctgctgcaggactctgcagtctccccccctgtcagggacgttggaatgaattctcctgcactcgtgtttccctcttctgcatcatccacccccggcagcgagacgcccattattaatcgcgctaacggactcggccttgatacatctcccgtgatgaagacacctcctaagctggagggtgatgccaccgatggatctttcgctaataagcatgggagacacgtgattggacacatcgacgactactcagccctgcgacaacagattgcggaggggaagctcttagtcaagaaaatagttagcctggttcgctcagcctgctctttcccgggactggaagcacagggcaccgaagtactgggatctaagggcatccacgaactgaggagttcaactagcgccctgcaccacgcccttgaggaatccgcgagcctgctgacaatgttctggcgagccgccttaccaagtacacacatccccgtgctgcccggcaaggtgggtgagtctaccgagcgggagctgttagagttgaggaccaaggtgtcaaagcaggagagactgcttcagtcgacgaccgagcatctgaagaacgccaaccagcagaaagaatcaatggaacagttcattgtgtctcagctcacccggacccatgatgtgctgaagaaagcacggactaatctggaagaaccctgtaagaagcgcagccaccagaaaagcttgaaacagcaagagagatgggcctgccccccatttgtgcagctgcctatatgttag

SEQ ID NO: 128533 - DNA, 1557 bp, Artificial Sequence
  Description of Artificial Sequence: Synthetic coding sequence
atgccggaggctaactatcttttgtcagtgagctggggttacatcaaatttaaaaggatgctcaaccgtgagctcacacatctcagcgagatgtcccgctcgggcaatcaggtgtccgagtttatcagcaacacatttctcgacaaacaacacgaggtcgaaatacccagtcccactcagaaggagaaggagaagaaaaaacgcccaatgtcccagatttccggagtgaaaaaacttatgcactcctcttccttgacaaattcctccataccacggttcggcgtcaagactgaacaggaggatgtgttggcaaaggaactggaagacgttaataagtggggattacacgtgtttaggatcgccgaactgtcaggaaacagaccactgacagtgatcatgcacaccatcttccaggaaagggatctgctgaagacctttaagatccccgtcgacactctgataacatacctcatgacattggaagaccactatcacgccgatgtggcctaccataacaacatccatgctgctgatgtggttcagtcaacacatgtgctgctgtctactccagctctcgaagctgtgtttacggatttggaaatcttggccgccatttttgcaagtgctatacatgacgtggaccacccgggagtgtcaaatcaattcttgattaacacaaactccgagctggcgcttatgtataatgattcgagtgtgctggagaaccatcatctagctgtcggctttaagctgttgcaggaggaaaactgtgacatctttcagaacttgacaaagaagcagagacagtccctgaggaagatggtcattgatattgtcctcgccaccgacatgagtaaacacatgaatctgttagcagatttaaaaaccatggtggagaccaagaaagttacgtcttccggagttttactgctggataattattccgacaggatacaagtgctgcaaaacatggtgcactgcgccgatttgtctaatccaacgaagccactgcaactctatcggcagtggaccgatagaattatggaggaattcttccggcagggggatagggagcgcgagcgaggcatggaaatctctccaatgtgtgacaaacataacgcatctgtggagaagagtcaggtagggttcatcgattacattgtgcaccccttgtgggagacctgggccgacttggtacaccccgacgcccaggatattttagataccctagaggataatcgcgaatggtaccaaagcacaattccacaatccccttctcccgctcccgatgacccggaggaagggcgtcaaggtcagaccgagaagttccagttcgaactaactctagaagaagatggtgagagcgacaccgaaaaggattcaggatctcaggtcgaggaagacacgtcctgctccgattccaagactctgtgcactcaggatagtgagtctacagagattcccctcgatgagcaagtagaagaagaggcggtgggcgaggaggaggagtcacagcctgaggcctgcgttatcgatgacagatctccagatacatag

SEQ ID NO: 128534 - DNA, 2430 bp, Artificial Sequence
  Description of Artificial Sequence: Synthetic coding sequence
atggaggctgagggaagctcggcacccgcgagggcaggctccggcgaaggctcggactcagcagggggtgccacacttaaggcacctaaacatctgtggagacacgaacagcaccaccaataccccctgcggcagccccagttccggttgttgcatcctcaccaccatcttccgcctccgccccctccttcccctcagccacagcctcagtgtccgctgcaaccccctccgcctcctcccttaccgcctcctcctcccccaccaggagcagccaggggccgatacgcaagctccggtgcaacagggcgtgtgcgccatcggggatattctgacactgagaggtatctgtactgtcgagccatggatagaacaagctacgccgtggagacgggtcatagacctggcctcaaaaaatctcgcatgtcctggccttcctccttccagggactgcgaaggttcgacgtggataacggtacatctgctggcaggtctccactcgacccgatgacgtctcctggaagcggccttatcttacaggcaaacttcgttcactcacaacggcgcgagagcttcctttaccgctctgattcagactatgacctcagtcccaagtctatgagccgtaactcctcaatcgcaagcgatatccacggcgatgacctaattgtgaccccatttgcccaagtgttggcatctctgcggacagtccggaataacttcgccgccctcactaacttgcaggacagggccccgagcaaacggagccccatgtgtaatcaaccatcgatcaacaaggctaccatcacggaagaagcctatcagaaactggcctcagaaaccctggaggaattggactggtgtttagaccagctggagacacttcaaaccaggcacagcgtctcagagatggcttcaaacaaatttaaaaggatgctaaatcgtgaactgacccatctttctgaaatgtccagatctggcaatcaagtttctgaatttatctcaaacactttccttgacaagcaacacgaagtagaaattcccagtcccacacagaaggagaaggagaagaagaagcgcccgatgagccagatctctggggttaaaaagctgatgcacagcagttcactaaccaatagcagcataccccgctttggtgtgaagaccgagcaggaggatgtgctggccaaggagctggaagatgtgaacaagtgggggcttcacgtgttcagaattgccgaattgtcagggaaccgaccacttacagttatcatgcacaccatctttcaggagcgcgacttgctcaaaacattcaagattcctgtcgacactctgatcacttatctaatgactctcgaagaccattaccacgcagatgtggcctaccacaataatattcatgctgccgacgtagtccagtccacccacgtgctgctctcgaccccagccctcgaagcagtcttcaccgatttagagattttagcagcaatttttgcgtctgctatccatgatgtggatcatccgggtgtcagtaaccagttccttattaacaccaattctgagttggcgctgatgtataacgactcatcagtgctggagaaccatcacctcgccgtcggctttaagctgctccaggaggagaattgtgacatctttcagaacctcaccaagaagcagagacagtccctccgcaagatggttatcgacatagtgctagccactgacatgagcaagcatatgaatctcctggcagacctaaagacaatggtggagaccaagaaggttacgtcctctggagtcctgctcctcgataattactccgatcgcatccaggtgctgcagaacatggtgcattgcgcagacctcagcaaccccaccaaaccactacagctgtacaggcagtggaccgatagaatcatggaagagttcttccgacagggagatagagaaagggaacgaggcatggagatatccccgatgtgtgacaaacataacgcttccgtcgaaaaatcccaggtgggatttatcgattacatcgtccaccccctgtgggaaacttgggccgatctggttcacccagacgctcaggatatcctggatacccttgaggataatagggaatggtaccagtcaacaattccacaaagccccagtccagcccctgacgacccagaagaggggcgccagggccaaacagaaaaattccagttcgaattaactctcgaggaggatggggagtccgacacagaaaaagacagcggctcccaggttgaggaagacacatcttgctccgattcaaaaaccctgtgtacccaggatagcgagagtacagagatcccactggatgagcaagttgaagaagaggcagttggcgaggaggaggagtcgcaacccgaagcatgtgtgatcgacgatcgatcacctgatacctag

SEQ ID NO: 128535 - DNA, 2037 bp, Artificial Sequence
  Description of Artificial Sequence: Synthetic coding sequence
atgttcatctactccttcaacaagttctttttcaaaacaacacattgctgggccataatatcctttgatgtcgacaacggcaccagcgcgggtaggtcacctctggatccaatgaccagccccggctctggactaatcctccaggcaaacttcgtgcattcacaacgtagagagtctttcctttaccggagcgacagcgattatgatctctcccctaagagcatgagccgtaattcctccatagcctcagatatacacggggacgatctgatcgtcacacccttcgcacaagtcttggcgtccctgcggactgtccgcaataactttgcggcgctaacaaatctgcaagacagagcaccttctaaacgatccccaatgtgtaatcagccttcaatcaacaaggccaccattactgaagaggcctatcagaaactcgccagtgaaactttggaggaacttgattggtgcctcgatcagctagagacactgcagaccagacatagcgtttctgagatggccagcaataaattcaagagaatgctgaatcgagaactgacacacctgtcagagatgagccggagcgggaaccaagtttccgaatttattagtaataccttcctcgataagcaacacgaggtcgagattccctcccctacccagaaggagaaagagaaaaaaaaacgccctatgtcccagatttcaggagtgaagaaactgatgcactccagtagcctgaccaacagctcaattccgcgtttcggggtgaaaacagagcaggaagacgtattggctaaggaactggaggacgttaacaagtgggggctccatgtgtttcgcattgccgagctgagcggaaacagaccccttaccgtaattatgcacacaattttccaagagcgagacctactcaagaccttcaaaatacccgttgacaccctgattacgtaccttatgacactggaagaccactaccacgccgacgtcgcataccacaataacattcatgcagccgacgtggtccagtctacgcacgtcctgctgtccacccccgcactggaggctgtgttcacagacttggagattttggctgccatcttcgcaagtgctattcatgatgtcgatcatccaggcgtgtccaatcagtttctcatcaacactaactctgagctcgcactaatgtacaacgatagctcagtcctggaaaatcaccatcttgccgtgggattcaaactcctgcaggaggaaaattgcgacatattccagaatcttactaaaaaacaacggcagtccttaagaaagatggtcatcgacattgtgctggccaccgacatgagtaagcatatgaacctgctggccgaccttaagactatggtagaaaccaaaaaggtgacctcaagtggtgtgctccttctggacaattatagcgatcggatccaggtgctgcagaatatggtgcattgtgcagacctgtctaatccgacaaagccattacagctctacaggcaatggacggaccgcattatggaggagtttttccgtcaaggagatcgggaacgagaaagggggatggaaatctcaccaatgtgcgacaaacacaatgcctcagtggaaaagtcccaagtcggtttcatagactacattgtgcacccgctctgggaaacctgggcggacttagtccaccccgacgcccaggacatcttggacacgctcgaggataatcgtgaatggtatcagtccactatcccacaaagtccatctcctgcaccggacgatcctgaagaagggcggcaaggacagaccgaaaagttccagtttgaattgacccttgaagaagatggcgagagcgacaccgagaaagattctgggtctcaggtggaggaggacacttcatgctctgactccaagacgctctgcacacaggatagcgaatctaccgaaatccctttagacgagcaagtcgaggaagaagctgtgggcgaggaggaggaatcgcagcctgaggcatgcgtcatcgatgataggagtcctgatacctag

SEQ ID NO: 128536 - DNA, 1524 bp, Artificial Sequence
  Description of Artificial Sequence: Synthetic coding sequence
atggcttctaacaagtttaaaagaatgcttaaccgagaactcacccacctgagcgagatgtcacgcagtggtaaccaggtgtctgaattcatctctaatacctttctggataagcaacatgaggtggaaatccctagtccgactcagaaggagaaagaaaaaaagaaaagacccatgtctcagattagcggcgtgaagaaactaatgcactcgtctagcctgaccaactcgagtattccccggtttggagtgaagactgagcaagaggatgtcctggcgaaagagctggaagatgtgaacaagtggggtctgcacgtgtttaggatcgctgagctgtctggaaaccggccattaaccgtgatcatgcacacaatttttcaggaaagagatctcttaaaaacatttaagatacccgtcgacacattaatcacctacctgatgacactggaagaccactaccacgccgacgtcgcctatcataataacattcatgctgctgacgtggtccagagtacacatgtactgttgtcgactcctgcgttggaagcggtgtttaccgacttggaaatcctggctgccatcttcgcgtcagctatacacgatgtggatcatcctggagtatccaaccaattcctgataaatacaaactcagaactggctctaatgtataacgattctagcgttctggagaaccatcaccttgctgtggggttcaagctcctgcaggaggagaactgtgacatcttccaaaatctgacgaagaagcagagacagagtctaagaaaaatggtgattgacatcgtccttgcgactgacatgtcaaaacatatgaacctcctggctgacttgaaaacaatggtggaaaccaaaaaggtgacgtcgagcggcgtgttgttactggacaactacagtgatcgcatccaagtgctgcaaaatatggttcactgtgctgacctctcgaaccccaccaagcctttacaactatatcgccagtggaccgaccggattatggaggaatttttccgtcagggagacagggaaagagagaggggcatggaaattagccctatgtgcgacaagcataatgccagtgttgagaagagccaggtcggcttcattgattacattgtgcatccactgtgggagacatgggctgatctggtccaccctgatgcccaagacatactggatacactcgaggataacagggagtggtaccagtccactattccacagtctcccagccctgctcccgacgatcccgaagagggtagacagggacagacggagaaattccaatttgaactgactttggaagaggatggtgagagcgacacagaaaaagatagcgggtctcaggtcgaggaagataccagctgctccgactccaagaccttgtgcacccaggactcggagtcaaccgaaatcccgctggacgaacaggtggaagaggaggctgtcggagaagaagaagagagccagcccgaagcttgtgtcatcgacgatagatcaccagatacttag

SEQ ID NO: 128537 - DNA, 2022 bp, Artificial Sequence
  Description of Artificial Sequence: Synthetic coding sequence
atgatgcatgtgaataactttccctttcggagacacagctggatttgcttcgatgttgacaatgggacctctgctgggaggagtcccctcgatcctatgacctcccccggatctggcctgattctacaggccaacttcgtccacagccaacgccgcgaaagcttcctctaccgcagtgatagcgattacgatctgagtcctaaatcaatgagcaggaactcatcaatcgcttctgacattcacggtgacgacctcattgtgacgccatttgcgcaggtgctagcttcactacggactgtgaggaataatttcgctgccctcacgaacctgcaggacagggcaccgtcgaaaagaagccccatgtgcaaccaaccaagtattaacaaggccaccatcactgaggaggcctatcaaaaattagcatccgagactcttgaggagctggactggtgtctggaccagttggagacactccagacccgtcactcagtgagcgagatggccagcaacaagtttaagagaatgttgaacagagagttgacgcatttgagcgagatgtctcgctcagggaaccaggtgagcgaattcataagcaacacattcctagacaaacagcacgaagtcgaaattcctagtcctacccagaaggagaaggagaagaaaaagagaccaatgagccagatatctggtgtcaagaagctgatgcactcaagcagcctgactaatagctctattcccaggtttggagtcaagactgagcaggaagatgttttggctaaggagctggaggatgttaataaatggggacttcacgtatttcggatcgcggagctgtccgggaatcggccactgacggtcattatgcacaccatttttcaggagcgtgatctgttgaagacattcaagatccccgtggacacacttatcacgtatctcatgacattagaggatcactaccatgccgatgtagcttatcacaacaacattcacgccgcagacgtcgtccagagcacacacgtactgctctctactcctgccttggaggccgtgttcacagacctcgaaatactggctgcgatatttgcatccgcaatccatgatgttgatcacccgggtgtcagcaatcagttcctcattaacaccaatagcgagctggctctgatgtataatgatagttccgtcttagaaaatcatcacttggctgttggcttcaagctattacaagaagagaactgtgatatctttcagaatcttactaaaaaacaacggcagagcctgagaaagatggtgatcgacatcgtgctggcaacagacatgagcaagcacatgaatctccttgccgatctaaagaccatggtagaaaccaaaaaggtcacctccagcggcgtgctgcttttagataattattccgaccggattcaggtgctgcagaacatggtacattgcgctgacctaagtaatcccacaaagccgcttcagctatatcgtcaatggacagaccggattatggaggagttttttaggcagggagaccgcgagagagagaggggaatggaaattagccctatgtgtgacaagcataacgccagcgttgagaagagccaggtcggcttcatcgactacattgtgcacccactctgggagacctgggccgatctggtgcatcctgatgctcaggatattctggacaccctggaagacaacagagaatggtaccaaagtactattccacaaagtccgtctcctgctcctgatgacccggaagaaggcagacaggggcagactgagaaatttcagttcgagctgactttagaagaggatggcgagtccgatactgaaaaggactccggcagccaggttgaggaagacactagttgcagcgatagtaaaacactctgcactcaggatagcgagtccacagagatccccctcgatgagcaagtagaggaggaggccgtaggcgaggaagaagagtcccagcctgaggcatgtgtgatcgatgatagatccccagatacgtag

SEQ ID NO: 128538 - DNA, 2064 bp, Artificial Sequence
  Description of Artificial Sequence: Synthetic coding sequence
atggcgttcgtatgggatcccttaggcgcaactgtgcctgggccatctactcgggccaaaagcagactgcggttttctaaaagctactcttttgatgttgacaatgggactagcgccggcaggagtccccttgaccccatgacttccccagggagcggactgatccttcaagctaattttgtccactcccagaggcgcgagtcctttttgtaccggtcagatagtgattatgacttatcccccaaatctatgtctagaaactccagcatcgccagcgacatccatggagacgacttgatcgttactccctttgctcaggtcctcgcctccctacgcaccgtacggaacaacttcgccgcattgaccaacctgcaggacagagcgccgtcgaagcggtctccaatgtgcaatcagcctagtattaataaagcgaccatcacagaggaggcgtatcagaagctagcgtccgaaacactagaagagctggattggtgtctcgatcagctagagacactgcaaacccgacactcagtttccgagatggcctctaacaagttcaagagaatgctgaacagggagctgacccatctgagcgaaatgtcaagatcggggaaccaggtttctgagttcatttcaaatacattcctcgataagcagcatgaagtggaaataccctcaccaacacagaaagagaaagaaaaaaagaagaggcccatgtctcaaatcagcggtgtcaaaaagctcatgcacagctcttctcttaccaactcctcaatcccacgcttcggtgtcaaaaccgagcaggaggatgtcctggctaaggaactggaggacgtgaataagtgggggttgcacgtgtttcgcattgctgagctgagcggtaaccgccctctgaccgtcattatgcacacgatctttcaagagcgcgatcttctcaaaactttcaagattcctgtggacactctgatcacctatcttatgacactcgaggaccactaccatgcggatgtcgcttaccacaataacatacacgccgctgacgtggtacagagtacccatgtgctgctgtctacgcccgcgctggaggctgtgtttactgacctagaaatcttggccgccatctttgcttccgccatccatgatgtggatcaccccggcgtgagtaatcagttcctgatcaatactaacagcgagctagctctgatgtacaacgatagttcggtactcgaaaaccatcacctagccgtgggcttcaaactcctgcaggaagaaaactgtgacatcttccagaatttgactaaaaagcagcgccagagtctgcggaagatggtgatcgacatcgtacttgccacagatatgtccaaacacatgaacctcctggccgacttgaagaccatggtagaaacaaagaaggtgaccagtagcggcgtgcttttgctggacaattatagtgataggatccaggtcctccagaatatggtgcattgcgctgacttgtccaacccaacaaagccacttcaactgtaccgccaatggacagataggatcatggaagagttcttcagacagggagacagggaacgcgaaaggggaatggagatttctcctatgtgcgacaagcataatgcctcagtcgagaagagccaggtcggctttatcgactacatcgtccaccctctatgggagacttgggctgacctcgtgcaccccgacgctcaggacattttggataccctcgaggataacagagaatggtaccagtctacgataccccagagtccatcccctgctcctgatgaccccgaggagggacggcaagggcaaactgagaagttccagttcgagctgacgctggaggaggatggggagtccgacacagagaaagattccggctctcaggtcgaggaggatacttcatgctcagactctaaaactctgtgcactcaggattcagaaagtactgagatccctttagatgaacaggtggaggaggaggccgtcggagaggaggaggaaagccagccagaggcttgcgtgatagacgatcggtcccccgatacatag

SEQ ID NO: 128539 - DNA, 2247 bp, Artificial Sequence
  Description of Artificial Sequence: Synthetic coding sequence
atgaaacgcaacacttgcgatctactctcccggtctaaatccgcctcggaagagactcttcatagcagcaatgaggaggaggaccctttccgcggcatggagccctatttagtacggcgcctcagttgccgcaatatccagttgcctcccttagccttccgtcagttagagcaagcggatctgaagtcagaatctgaaaacatacagcggcctacaagtctacctctgaaaatccttcccctcatagcaattaccagtgctgagtctagcggctttgacgtcgacaatggcacctccgctgggcgctctccgcttgacccgatgacctcacccggatccggcttgatcttgcaggccaacttcgtacattcccagagaagggagagtttcctgtatagaagcgactctgattatgatctttcccccaagagcatgagtaggaactcaagtatagcctcagatatccatggagatgacctaatcgtgacaccgtttgcacaggttctggcctcccttcgaaccgttcggaacaatttcgcggccctgacgaatctgcaggacagggcaccttcaaaacggagcccaatgtgtaaccagccatcgattaacaaggccaccatcaccgaggaagcctaccaaaagctggcgtcggaaactctcgaagagcttgattggtgccttgaccagctggaaacactgcagacccggcactctgtttccgagatggcctcaaacaaattcaagaggatgctgaatcgcgagctgactcacctcagcgagatgtctcgatcaggcaatcaggtgtcggagttcattagcaatactttcctggacaaacaacatgaagtagagatcccatcaccaacacagaaggagaaagaaaagaagaaaaggccaatgtcgcagatcagcggggtgaagaagttaatgcactctagctccctgactaattctagtatccccaggttcggtgttaaaaccgagcaggaggacgtgcttgctaaggagctggaggatgtcaacaagtggggactgcacgttttccggattgccgagctgtccggaaaccgccctctgaccgtgatcatgcacaccatcttccaggagcgggatctgctcaaaacgttcaagatcccagtcgacactcttatcacatacctgatgactctggaggatcactatcatgccgacgtggcttaccataacaacattcacgccgcagatgtggttcagagtacgcatgtcctattgagtaccccagcactagaggcggtgtttacggacctggagatccttgccgcaatttttgcttccgccattcatgatgtggatcaccccggggtatcgaaccagtttctgattaataccaattctgagctggccctcatgtacaacgacagctctgtcctggagaaccaccatctggccgtgggcttcaaactgctacaggaagagaattgcgacattttccagaacctcaccaaaaagcagcgtcagagtctgcggaaaatggtgattgacatcgtgctggccactgatatgagcaagcacatgaacctacttgcggatctaaagaccatggtggaaacaaaaaaagtgacctcctctggggtcttgctgctcgacaactacagcgacagaatccaggtactgcagaacatggtgcattgtgcggacttatcaaaccccacaaagccgttgcagctgtaccgccagtggactgatagaataatggaggagtttttcaggcagggggaccgcgaaagagaaaggggtatggagatcagtcccatgtgcgataagcataatgcatcagtcgagaagtctcaagtcggctttatcgactacatcgtccaccccctctgggaaacatgggccgaccttgtccatcccgacgcacaggacatactggacacactggaagacaatcgggaatggtatcagagcacaattccacagtctccaagtcccgccccagatgaccctgaagaaggccggcaaggccagaccgagaaattccagtttgaactcaccctggaggaagacggcgaatccgataccgagaaggatagcggcagccaggtggaagaggatacctcttgctcggattctaagactctgtgtacgcaggactccgagagcacggaaataccactcgatgagcaggtggaggaggaggctgttggcgaagaggaggagagccagccggaagcctgtgtaattgacgatcgaagcccagacacttag

SEQ ID NO: 128540 - DNA, 660 bp, Artificial Sequence
  Description of Artificial Sequence: Synthetic coding sequence
atggcgcaacagaccagtcccgacacccttacagttcccgaagtggataatcctcattgccccaacccatggctgaatgaagatctggtcaagtcacttcgagaaaatctcctccaacacgaaaagtccaaaaccgccagaaaatccgtgtcccccaagctaagccctgtcatcagtccccggaacagccctcggttgctgagacggatgttgttatcgagcaatattcctaagcaaagaaggtttactgttgcccacacttgcttcgacgtggacaatggcacgtcagccggacgaagccctctcgacccaatgacatcacccgggtcaggtctgatacttcaagccaattttgtacatagccagcgacgggaaagctttctctacaggtctgactctgactacgatctgtcccctaaaagcatgagcaggaactcaagcatagcttccgacatacatggagatgacctgatagtgacgcccttcgcacaggtcctggcttctttgagaaccgtccgcaacaacttcgctgctctgactaaccttcaggaccgagccccatctaaacgcagcccgatgtgtaaccagccttcaataaataaagccacaataaccggctcttggatggaacttaacccatacaccctgctggatatgtag

SEQ ID NO: 128541 - DNA, 2040 bp, Artificial Sequence
  Description of Artificial Sequence: Synthetic coding sequence
atgagcattatcatgaaacctagaagtcggtctacatctagtctgcgaaccgccgaggcggtatgctttgacgtcgataatggcacctctgcagggcgcagtcctctcgatccaatgacttcccccggcagtggccttatcctgcaggccaactttgtgcacagtcagcggagggaatcctttctatataggtcagattccgattatgatctatccccaaagtctatgtctcgcaacagttcaatcgccagtgacatccacggcgatgatctgatcgtgactccttttgctcaagttctggcaagtctccgaacggttcgtaataactttgccgctttgaccaatctccaagacagagcaccttctaaacgcagccccatgtgtaatcagccctccataaacaaggcaacaattacagaggaggcataccagaaactggcatccgagacattagaagagttagactggtgtttggatcagctggagactctccagaccaggcattcggtttctgagatggcatctaacaagttcaagaggatgctaaacagagagctgacccatctgagcgaaatgtcaaggagcgggaaccaagttagtgagtttattagcaatacctttctggataaacagcacgaggtggaaatccccagtccaacgcagaaagagaaagagaaaaagaaacggccgatgagtcagatttctggagtgaaaaagctaatgcactcatccagcttgactaactcttctattcccagatttggtgtgaagactgaacaagaagacgtgctcgcaaaggaactggaggatgttaataagtggggactgcatgtgtttcgtatagctgaactgtccggtaaccgccccttgactgttattatgcacacgatctttcaggaaagggatctgctgaagacgtttaaaattcctgtcgatacacttatcacgtaccttatgacgctggaggaccactatcacgcagatgtggcttaccataacaatattcatgccgccgacgtggtccagtctacccatgtgctccttagtacaccagccttggaagcagtctttaccgatctggagatcctcgcagcaatcttcgccagcgccattcatgacgttgaccacccaggtgtctctaatcagttcttaatcaacactaattcagagcttgcattgatgtacaacgactcctctgtcctcgagaatcaccacttagctgtgggattcaagctcctccaagaggaaaactgcgacatcttccagaatcttactaaaaagcagcgccagtccctgaggaagatggtcattgacatcgtgctagccaccgacatgagcaagcacatgaatctgctggcggatctcaaaaccatggtggagacgaagaaggtgacctcttcaggcgtgctgctgctggataactattctgatcgcatccaggtacttcagaacatggtgcactgcgcggatttgtccaatccaacgaagcccctccagctgtaccgacagtggacggatcgcattatggaggagttctttcggcaaggagatcgcgagcgagaacgcggaatggagatctcgcccatgtgcgacaagcataatgcatcagtcgagaagtcgcaagtcggatttattgactacatcgtccatcccctctgggagacgtgggcggacttggtgcacccagacgcccaggatattcttgacactctggaagacaaccgagagtggtaccagtcaacaatcccgcagagcccttcccctgctcctgatgacccagaagaggggcgccagggccagaccgaaaagttccagttcgagctcactttagaggaagacggggagagcgatactgaaaaagacagcggcagccaggttgaagaagatacgtcctgctctgattccaagaccctgtgcacccaggatagcgagagtacagagatccctctagacgaacaggtagaggaagaggccgttggcgaggaggaggagtctcagcctgaggcctgcgtcatcgatgataggtctccagatacctag

SEQ ID NO: 128542 - DNA, 1269 bp, Artificial Sequence
  Description of Artificial Sequence: Synthetic coding sequence
atggcttccaacaaattcaaacggatgctgaatcgggaactgacacatctgtctgagatgagccggtcggggaaccaagtgagcgaatttatcagtaatacttttttagacaaacagcacgaagtcgaaatcccctctcccacccaaaaggagaaggagaaaaaaaaacgccctatgagccaaatctcaggcgttaaaaagctaatgcattcctcaagcttgactaactccagtatcccgagattcggggtgaagacagaacaggaggacgttttagccaaagagttggaggacgttaataagtggggactgcacgtgtttcgcattgctgagctttccggcaataggcccctgacagtaatcatgcacaccatttttcaagaacgagatttactgaaaacttttaagatccccgttgacacactgattacttatttgatgacactcgaagaccactaccatgctgacgtcgcttaccacaataatatccatgccgccgacgttgttcaatctacacatgtgctcctatctacccccgccttagaagctgtgttcacggatctggagattctcgctgcaatcttcgcatctgctattcatgacgttgaccatcccggcgtatctaaccagttcctcatcaatactaacagcgagctagccctcatgtacaacgactcctctgttctggagaaccaccatctagccgtagggttcaagctgcttcaagaagagaattgcgatatctttcaaaatctgacaaagaaacagcggcagtctctgagaaaaatggtaatcgacatcgtactcgccactgatatgtccaagcatatgaacctgcttgcggatttgaagacaatggtggagacaaaaaaagtgacatcaagtggcgtgctgctgctggacaattattctgaccgcattcaggtgctccaaaatatggttcattgtgcggacctcagcaacccaacaaagccgctccagttgtaccgccagtggacggaccgaatcatggaagagttcttcaggcaaggggaccgggagcgtgagagaggcatggaaatctcacccatgtgtgataaacacaatgcaagtgtggaaaaaagccaggtggggttcattgattatatcgtgcatccactgtgggaaacttgggcagacctggtgcacccagatgctcaagacatattggacaccctcgaggacaatcgcgaatggtaccagagtaccatcccacagagcccttcccctgccccagatgacccagagtag

SEQ ID NO: 128543 - DNA, 246 bp, Artificial Sequence
  Description of Artificial Sequence: Synthetic coding sequence
atgaaacggaatacttgtgacctgttgtcccggtccaaatccgcaagtgaggaaaccctgcattcatccaacgaggaggaagatcccttcagagggatggagccttacttggttcgcagattatcctgtcgaaacatacagctcccgccactggctttcagacagctcgagcaagcagacctcaagagcgaatcagaaaacatccagcggccgacctctctgcccctgaaaatcctccctctgtag

SEQ ID NO: 128544 - DNA, 2238 bp, Artificial Sequence
  Description of Artificial Sequence: Synthetic coding sequence
atggctcagcaaacctcaccggacactctgaccgtgcccgaagtggacaaccctcactgtccaaatccttggctgaacgaggatctggttaaaagtctgagagagaatctgctccaacatgagaagtcaaaaaccgcaagaaaatctgtgtcgccaaagctgagcccagtgatttcccctcggaactcacctaggctgctgcgccgcatgttgctttcctctaatattccaaaacagcgccgctttaccgtggcccatacgtgctttgatgttgataatggcacatctgctggacgcagtcccctggatcccatgacctctcccggctctggacttattctgcaggccaactttgtgcattcgcagagacgtgagagttttctctatcgtagcgattctgactatgatctgtcacctaaaagtatgtcccgaaactcgagcatcgcaagtgacattcacggtgatgatctaattgttaccccatttgctcaggtcctggcaagcctgcggaccgtccggaacaactttgccgcccttaccaacttgcaggatagggcccccagcaagaggagtcccatgtgcaatcagccttctatcaacaaagcaacaatcaccgaggaagcctaccagaagctggcttcagaaactctggaggagctggactggtgtcttgaccagctcgagacacttcaaacaagacatagtgtttcagagatggcaagcaataaattcaagagaatgctgaatcgcgagttaacccacctatctgagatgtctaggtccggcaatcaggtgagtgagttcattagtaacacgtttcttgataagcagcacgaagtcgagattccaagccccactcagaaggagaaggaaaaaaagaagagacctatgagccagatcagtggagttaaaaaactgatgcactcttcctctctgactaactcgtcgatccccagattcggggtgaagacggaacaggaggacgtactagctaaagaactcgaagatgtgaacaaatggggcttgcacgtgtttaggattgcagagctctccggcaaccggcccctaactgtaataatgcacacaatctttcaggaaagagatctgttaaagacatttaagattccagtggacaccctgatcacgtaccttatgaccctagaagaccactaccacgcagatgtggcataccataataacatccacgcggccgacgtggtgcagtcaacacacgtactgctgagtaccccagccctcgaggccgtcttcaccgacctagagattctcgccgctatctttgcctccgctattcatgatgtggatcatccaggggtgtcaaatcagtttcttatcaacaccaattcagagctggcattaatgtataacgacagttctgtgctggaaaatcaccacttggccgttggatttaaactgcttcaggaggagaactgtgacattttccagaatctcacgaaaaagcagcgtcaaagcctgcggaagatggtgatagacatagtgctggcgacagatatgagcaagcatatgaaccttctagcagacctgaaaacaatggtggaaacgaaaaaagtaacttcatctggggttctcctcttagataactatagtgaccggattcaggtattgcagaacatggtgcattgcgcagaccttagcaacccaaccaaaccactccagctttatcggcagtggactgacagaattatggaagagttctttaggcaaggagacagagagagagaaagaggcatggagataagtcctatgtgtgacaagcacaacgctagcgtcgaaaagtcccaagtggggtttatcgattatattgtgcatccactgtgggaaacctgggctgatctggtgcaccctgacgcacaggacattcttgatacactggaggacaacagggaatggtatcaatcaacgattcctcagtcaccatccccagcaccagatgacccggaagaaggaaggcagggacagaccgagaagttccaattcgagctgactctggaagaagacggggagagtgatactgaaaaagattccggaagtcaggtagaagaagacactagttgtagtgactccaagacactatgtacacaggactccgagtccacagagatcccgctggacgagcaagtcgaggaggaagcggtcggcgaggaggaggagagtcagccagaagcttgcgtgattgacgatagatcacctgatacttag

SEQ ID NO: 128545 - DNA, 228 bp, Artificial Sequence
  Description of Artificial Sequence: Synthetic coding sequence
atgaagcgtaatacctgtgacctgctgtcacggagcaaatctgctagcgaggaaacactccactcatccaacgaggaggaggatccttttcgaggcatggagccatatctggtgcgaaggctatcatgccgcaatatccagctccctccactggccttcagacagttagagcaagccgatctaaagtcagaatccgagaacatccagaggcccacctctttgccctag

SEQ ID NO: 128546 - DNA, 2247 bp, Artificial Sequence
  Description of Artificial Sequence: Synthetic coding sequence
atgaagaggaatacttgcgatctcttgtccaggtccaagagcgcctctgaagagactcttcacagttcaaacgaagaggaagacccttttcgcggtatggaaccctacctggtacgaaggttgtcttgtcgcaacatccagctccctccattggcctttcgtcagttagagcaggccgatctgaagtcagaaagcgaaaatatccagcgccctacatccctccctctgaagattctgcccctgatcgcgattacgtctgccgagtctagtggctttgatgttgataacggcacatctgccggccgctctccactggatcccatgacatcacccggctctgggctaattctgcaggctaacttcgtgcatagccaaagacgcgaatcttttttgtacaggagcgacagtgactacgatctgtcccccaaatctatgagtcggaactcttctatagcatccgacattcacggcgacgatctgatagttacccccttcgcacaggtgctggctagccttaggaccgttcggaacaacttcgctgctctgacaaatctccaagatcgagcgccatccaaacgctctcccatgtgcaatcagcccagtataaataaggccaccattacagaagaggcctaccagaaactagccagcgaaactctggaggaactcgactggtgcttggaccagctcgagactcttcaaacccgccattccgtgtccgagatggcctcaaacaagtttaagcggatgttaaaccgcgagctaacacacctcagtgaaatgagtcggtctggcaatcaggtgtcagagtttatctctaacacattcctagacaaacagcacgaagtggagatcccttctcctacccagaaggagaaagaaaagaagaaacgccccatgagccagatttccggggtgaaaaagctcatgcattcttcgagcttaaccaactcaagcatcccccgattcggggtcaagactgagcaagaggatgttctcgccaaggaattggaggatgttaataaatggggattacatgtattcagaattgccgagttaagcggcaacaggcctctcaccgtgattatgcacactattttccaggagcgagaccttctgaaaacttttaagatacctgttgacacacttattacttatcttatgactctcgaggatcattaccatgcagatgttgcataccacaacaatatccatgcggcagacgttgtccagtctacccatgtgctcctgagcacccccgcactagaggccgtgttcactgatctcgaaattctggcagcaatcttcgcctccgctatacatgatgtcgatcatcccggggtgtccaatcagtttcttattaatacaaactcagaactggccttaatgtacaatgacagttctgtgctcgagaatcaccatctcgcggtgggctttaaacttttacaggaagagaactgtgatattttccagaacctcaccaaaaagcagaggcagtctttacgtaagatggtgattgacatagtactggccacagatatgtctaaacacatgaacctgctggctgacctgaagaccatggttgagactaagaaagtgacttcctcaggcgtgttactgctcgataactatagtgaccggatccaggtgctgcagaacatggtgcattgcgctgatctatccaatccaactaagcctctacaattataccgccagtggacggaccgtattatggaagagttcttccggcagggtgatagagagagggaacgtggcatggagatcagtcccatgtgcgacaagcataacgccagcgtggagaaaagccaggtggggttcattgactacatcgtgcaccctctctgggagacatgggcagacctcgtgcacccggatgcccaggacattcttgatacccttgaggataaccgcgagtggtaccagtctactatacctcagtccccttccccagcccccgacgaccccgaagaaggcaggcagggtcagacggagaaattccagtttgaactgacactagaagaagacggtgaaagcgacaccgagaaagattccggttcccaggtggaggaggataccagctgctcggatagcaagaccctatgcacccaggatagcgaaagcactgagattccgttagatgaacaggtggaagaggaagctgtcggcgaggaggaggagtcgcagccagaagcttgcgtcatcgacgaccggtcccctgatacctag

SEQ ID NO: 128547 - DNA, 2502 bp, Artificial Sequence
  Description of Artificial Sequence: Synthetic coding sequence
atgctcccctttggagacaaaacacgcgaaatggtcaacgcttggtttgcagagagagtgcacacgatcccggtttgcaaggaggggatacggggccataccgaatcatgctcttgccccctgcaacagtctccgcgggccgataactctgctcccggaacccctactcgtaaaatatcagcatccgagttcgatcggccgctgcggcccatcgtggtcaaggactctgagggaaccgttagtttcctgagcgacagtgaaaagaaagaacagatgcccttgacacctccccggttcgatcacgacgagggcgatcaatgttcacgactcctcgagctcgtaaaggatattagtagtcatttggatgttaccgcactctgtcacaagatttttctccacattcacggattaatctccgccgacaggtattctctgttcctggtgtgcgaggactcttctaatgacaagtttctgattagcaggcttttcgacgtagccgagggatccacattagaagaggtgagcaataactgtatacggctagaatggaataaaggaattgtggggcatgtcgcggccctgggggagcccctgaatatcaaagacgcgtacgaagacccgagatttaatgcagaagtggatcaaattacaggctataagacacagagcatcctctgcatgcccatcaagaaccacagggaggaagtggtaggtgtcgcacaagcaatcaataagaagagcggaaatggtggcacatttaccgaaaaagacgagaaggactttgcagcctatctcgcattctgtggcatcgttctccacaacgcacagctctacgagacgtctcttctcgagaacaagcgaaaccaggtgcttctcgatctagcttccctgatctttgaagaacagcagagcctcgaagtcatcctgaaaaagattgccgccactatcatctcattcatgcaagtccaaaaatgtaccatcttcattgtcgatgaggactgttcagattcattctccagcgtgttccatatggaatgtgaagagctcgaaaagtccagtgacaccttgacccgcgagcatgacgctaataagattaactatatgtatgcccaatacgtcaagaacaccatggagcctctcaacattccggatgtttcaaaggacaagcgcttcccatggaccactgaaaataccggaaatgttaatcaacagtgcatacgttcactgctatgcaccccgattaagaatggcaaaaagaacaaggtgatcggtgtgtgtcagctagtgaacaagatggaggagaacaccggaaaagtgaaaccctttaatcgaaatgatgaacagttccttgaagctttcgtgatcttttgcggactgggcatacagaatacacaaatgtacgaagccgtggagcgggctatggctaaacagatggtcacgcttgaggtccttagttatcacgcctcggccgctgaagaagaaactcgggaactgcagagtttagccgccgccgtagtcccttccgcccagactctgaaaattactgactttagtttttcagatttcgaactttccgatctggaaactgccctctgtacaattaggatgtttacggatctgaatttagtccagaattttcagatgaagcacgaggtgttgtgcagatggattctaagcgtcaaaaagaattacagaaaaaacgtggcctatcataattggcggcatgccttcaataccgcgcagtgcatgttcgcagccctcaaagccgggaaaatccagaacaaattaacggacctcgagattctcgctttactgattgccgccctctcacatgatctcgaccatcggggcgtaaataactcttacatacaacgatctgaacaccccctggctcagctttattgtcatagcattatggagcatcaccactttgatcaatgcctaatgatacttaatagtccaggtaaccagattttgtccggcctgtcaatcgaggaatacaagaccactctcaaaatcatcaaacaggcaatccttgctaccgatctagccctgtatataaaacgacggggggagttcttcgaactcattcgtaagaatcaattcaaccttgaagatccacaccagaaagaactgttcctggcgatgctgatgaccgcttgcgacctgtcagctatcaccaagccctggcccatacagcagcgcattgccgagttagtagccacagaattcttcgaccagggcgaccgagagaggaaggagctcaacattgaaccaaccgacctgatgaaccgcgagaagaagaacaagatccccagtatgcaggtcggcttcattgatgccatctgcctgcagctgtatgaggctctgactcatgtgagtgaggactgttttccattgctagatggttgtaggaaaaaccggcaaaaatggcaggcccttgccgaacagcaggagaagatgctgattaacggagaaagcggccaagctaaaaggaactag

SEQ ID NO: 128548 - DNA, 2628 bp, Artificial Sequence
  Description of Artificial Sequence: Synthetic coding sequence
atggagcgggccgggcctagcttcggacagcagagacagcagcaacagccccaacagcaaaaacagcagcaacgtgaccaagattccgtggaggcctggctagacgaccactgggattttacctttagttattttgtccggaaggccactcgcgagatggttaacgcctggttcgccgagcgcgttcataccatcccagtatgcaaggaaggcatacgaggacatactgaatcttgctcctgtcccctccagcagtcacctcgggccgacaattcagctccaggaactcccacaagaaaaatatccgcaagtgagtttgaccgtccacttcgccccatagtggtaaaagacagcgaaggcaccgtgtcattccttagtgacagcgagaaaaaagagcagatgcctctcacccctccacgctttgatcatgacgagggagatcaatgcagccgcctgctggagctggtcaaagatatctcaagccatttggatgtcaccgctctgtgtcacaagatatttctccacatccacggactcatcagtgctgataggtactctctcttcctcgtatgcgaggacagcagcaacgataaattcctgatttcccggctgtttgacgtcgctgagggatctacattggaggaggtttctaacaactgtattcgtctcgagtggaacaaagggatcgtgggccacgtggccgccctcggtgagcccttgaacatcaaggatgcatatgaggatccacgtttcaacgcagaggtagaccagattacgggctataagacccagagcattctgtgtatgcctatcaaaaatcaccgggaagaagtggtgggcgtggcccaggctattaacaaaaagagtggaaatggtgggacgtttacagagaaagatgaaaaggactttgccgcctacctggccttctgtggcatcgtgctgcacaacgcccagctgtacgaaaccagtcttctagaaaacaaacgtaatcaggttctgctcgatctagccagtttaattttcgaagagcagcagagcctagaggtgattctcaagaagattgccgcgacaatcatttccttcatgcaagtgcagaagtgcacaatcttcatcgtggacgaagattgctcagattcgttcagtagtgtcttccacatggaatgcgaggagctggagaagtccagcgacacactcacaagagaacatgatgccaataagattaattatatgtatgctcaatacgtgaagaacacgatggagccccttaatatcccagacgtgtcaaaggacaagagattcccttggactacggagaatactggaaatgtaaatcaacagtgtatccgcagcctcctgtgcacacctatcaagaacggtaagaagaataaagtgataggcgtgtgtcagctggtcaacaagatggaagagaacacaggtaaggttaaaccattcaataggaacgatgagcagttcctggaagcatttgtcattttttgcggcctgggcattcagaatacccagatgtacgaggcagtggaaagggccatggcaaagcagatggttactctggaggtgctgtcatatcatgcctctgcagctgaggaagagacgagagaacttcaaagcctggctgctgcagttgttccgagcgcgcagacgctgaaaatcacagacttttcttttagcgactttgagctgagcgacttagagaccgccttgtgtactatacgaatgttcaccgacctgaatttggtgcagaacttccaaatgaagcacgaggtcctgtgtcgctggatcctttccgtcaaaaagaattatagaaagaatgtcgcataccataactggcggcacgcgttcaataccgcccagtgtatgttcgcagctttaaaggcaggaaagattcaaaataaactcactgatctcgaaatcctggcccttttgatcgccgcactcagccatgatctagaccaccgcggcgttaataatagttatatccagagaagcgaacacccgctggcccagttatactgtcattcaatcatggaacatcatcacttcgaccagtgcctgatgattctgaatagtcctggaaaccagatcctcagcggactctccattgaggagtacaagactacactcaagataattaagcaggccatcctggcgaccgatctggcactgtacattaaacgaaggggtgaattcttcgagctcatccgcaagaatcagtttaatttggaggatccacaccaaaaagaacttttcctggcaatgctcatgaccgcctgtgacctgtctgccattacaaagccctggccgatccagcagcgtattgctgagttggtggcgaccgagttttttgaccagggcgatagggagcggaaagagctgaacatcgagcccaccgacctcatgaacagagagaagaagaacaagatccctagtatgcaggtgggattcatcgatgccatatgcctacagctgtatgaggctctgactcacgttagcgaagactgctttcccctgctagatggctgtcgaaaaaatcgccaaaagtggcaggccctggctgagcagcaggagaagatgctcatcaacggagaatctggacaggccaagcgaaattag

SEQ ID NO: 128549 - DNA, 2472 bp, Artificial Sequence
  Description of Artificial Sequence: Synthetic coding sequence
atggtgaacgcatggtttgctgagagagtgcacactatcccagtctgcaaagaaggcattaggggccataccgagagttgttcctgcccccttcagcagtcccctcgggccgacaactctgctccagggacacccactcgcaaaatcagcgcaagcgagttcgaccggccactccggcccattgtggtcaaagacagcgagggaaccgtgagcttcttaagcgattctgaaaaaaaggagcaaatgccattaacaccacctcgatttgatcacgacgaaggcgaccagtgcagccggctgcttgaactagtgaaggacatcagttcacatctggatgtcaccgccctgtgtcataagatcttcctgcacattcatggactaatctctgcggaccggtactccttgttcctggtgtgcgaagattcttcgaatgacaagtttctgatttccaggcttttcgatgtcgccgagggatcaacgctcgaagaggtgtccaacaactgcataagactcgagtggaacaagggtattgtggggcatgtggctgccctcggagagcctctcaacatcaaagatgcctacgaagatcctagatttaacgctgaagttgatcagataaccggctacaagacccagagcattctctgcatgccaattaagaaccaccgggaagaagtggtcggagtcgcgcaggcaatcaataagaaatctgggaacggtggcacattcactgagaaggacgaaaaagactttgctgcctacttagccttttgtgggattgtgttgcataacgcgcagctgtacgaaacaagtttattggaaaacaagagaaatcaggtgctactggacttagcctctctgatcttcgaagaacagcagagtctcgaggtcattctcaaaaagattgctgctacaataattagctttatgcaagtccagaaatgtactatcttcatcgtggacgaggattgctcagattcctttagtagtgtgttccacatggaatgcgaagaattagagaagtcatccgacacacttaccagggagcacgacgcgaataagattaactacatgtatgcccagtatgtgaaaaacaccatggagccactgaatattccagacgtgtcgaaagacaagaggtttccctggacaaccgagaatactggcaatgtgaatcagcaatgcatcaggtctctcttgtgcacccccattaagaatggtaagaaaaataaagtcatcggagtgtgccaattggtgaacaagatggaagagaacacaggtaaggtaaagcccttcaatcgaaatgatgagcagttccttgaggcgtttgtcattttctgtggcctcggcattcagaatacccaaatgtatgaagccgtcgagcgcgctatggctaagcaaatggttacgctggaagtgctgtcatatcacgcttctgccgcagaggaggagaccagggagttgcaatcgcttgcagccgccgtcgtgccctccgcccaaaccctcaaaatcacggatttctcattttctgactttgagctctctgacttagagacggccctctgtacaattaggatgttcaccgacctgaatttggtgcagaatttccagatgaagcacgaggtcttgtgccggtggattctgagtgtgaaaaaaaattataggaaaaatgttgcctaccacaattggcgccacgcatttaacacagcccagtgcatgtttgcagcccttaaagccggcaagatccagaataagctgaccgacctagagatactggccttgcttatcgccgcactctcacacgacttggaccatcggggtgtgaataacagctacatacagcgctctgaacatcctctcgctcagctgtattgtcattcaatcatggagcatcatcacttcgatcaatgtctgatgatattaaactccccaggcaaccagattcttagtgggctgtcaatcgaggagtataagaccacactcaagatcatcaagcaggccattctcgccactgacctggcactgtatattaagcgtagaggggaattttttgaacttatccggaagaatcagtttaatctggaggacccgcatcagaaagaactcttcctcgccatgctcatgaccgcctgtgatctgtctgcaattaccaaaccatggcccatacagcaacggatcgcagagttggtggccaccgaattctttgaccaaggtgaccgagaacggaaggagttaaatatcgagcccaccgacttaatgaatcgcgagaagaaaaataaaatcccaagcatgcaggtgggctttatcgacgctatttgcttgcagctgtacgaggctctcacccatgtgtctgaagattgtttccctctcttggatggatgccgcaaaaataggcagaaatggcaggctttggctgagcaacaagaaaaaatgctgattaatggagagtcaggccaagctaagagaaattag

SEQ ID NO: 128550 - DNA, 2583 bp, Artificial Sequence
  Description of Artificial Sequence: Synthetic coding sequence
atgggagaggtcactgccgaggaggtcgaaaagttccttgatagtaatatcggcttcgcaaaacaatactataacctgcactaccgagccaagctgatttctgacttgctgggcgctaaagaagcagctgtcgatttctcgaactatcatagcccatcgtctatggaggaatccgaaataatcttcgatctgctgagagacttccaggagaatttacagaccgagaaatgcatttttaacgtaatgaagaaactgtgcttcttgctgcaggctgacaggatgtctttgtttatgtataggactcgcaacggcattgctgaactggccactcgtttatttaatgtccataaggacgcagtgctagaagattgtctggtgatgcccgaccaagagatcgtgttcccgctggatatgggcatcgttggacacgttgcccattccaaaaaaattgccaacgtccccaataccgaggaggacgaacatttctgcgattttgtcgacatcttaaccgagtacaagacaaagaatatacttgcaagtcctataatgaacggcaaggacgtagtcgccataattatggcggtgaataaagtcgacgggagccacttcacaaagagggacgaagagattttacttaagtatctgaatttcgccaacctcatcatgaaagtctaccatttatcatatcttcataactgcgagactaggcgggggcagatattgctgtggagtggcagtaaggtcttcgaggagctcacagatattgagcgccagttccacaaggccctgtataccgtccgtgccttcctgaactgtgataggtactctgttgggctcttggacatgacaaagcagaaagagttctttgatgtctggcccgtactgatgggggaggtgcccccttactctggcccccggacacctgacggcagagaaattaacttttataaggtcatcgactacattctgcacgggaaagaggacatcaaggtcattcccaacccacctcctgaccattgggctcttgtgtccgggctccctgcctacgtggcccagaacggcttaatctgcaacatcatgaacgcccctgctgaggattttttcgccttccaaaaggagccgctagacgagtccggctggatgatcaaaaatgtgctgtcaatgccaatagtgaacaagaaggaggagatagtaggtgtcgccacattttacaacagaaaggacgggaaaccctttgacgagatggacgaaaccctgatggagtcacttacccagtttctcggatggtcagttcttaacccagatacctacgagagcatgaacaagttagagaaccggaaagatatcttccaagatatcgtgaaatatcatgtaaagtgtgataatgaagagatccagaagatccttaaaacacgggaagtgtatgggaaagagccatgggagtgcgaggaagaagagctcgctgaaatactccaggccgagctgccggatgctgacaaatatgaaatcaataaatttcatttcagtgatctgccccttacggagctggaactcgtcaagtgcggtatccagatgtattatgaattgaaggtggtcgataaatttcatatcccacaggaggcactcgtccggttcatgtactcattgagcaagggctatagaaaaatcacataccacaattggcgtcacggctttaatgtagggcaaacaatgtttagcctgctggtcactggaaagctcaagagatactttacagatcttgaagcccttgcgatggtgacggcagccttctgccatgacatcgatcatagaggcacaaacaacctatatcagatgaaatcgcagaacccgcttgcaaaactgcacggatctagcatcttagaacgtcaccatttggagttcggtaaaacactcctgcgcgacgagagtctgaatattttccagaatcttaacaggcgccaacacgagcacgccattcatatgatggacatcgccattattgccacggacctggccctctatttcaagaagaggacaatgttccagaaaattgtggaccagagcaaaacttatgagtcagaacaggagtggacccagtatatgatgcttgaacagactagaaaggaaatcgtgatggctatgatgatgacggcgtgtgacctaagcgccattaccaagccctgggaggtgcagagtcaggttgctcttctggtggctgccgagttctgggaacagggcgatcttgagcgaacagttctgcagcagaacccaatcccgatgatggacagaaataaagccgatgaacttcccaagctgcaagtgggtttcattgatttcgtctgcacatttgtctataaggaattcagcaggtttcacgaagagattacccccatgctggacggtatcactaataataggaaggagtggaaagcattagccgatgagtatgacgctaaaatgaaagtccaagaggagaagaagcaaaagcagcagagtgccaaaagcgccgcagccggaaatcaaccgggtggaaatccatccccggggggggccactaccagcaagtcctgctgcatacagtag

SEQ ID NO: 128551 - DNA, 1728 bp, Artificial Sequence
  Description of Artificial Sequence: Synthetic coding sequence
atgaccaaggaaaaggagttcttcgacgtttggtcagttctcatgggagaaagccaaccatactccgggccccgtacccctgatggcagggaaattgtgttttataaggttatcgactatgtgctccacggtaaggaggaaatcaaagtgatccctacaccttctgccgatcactgggcactcgccagcgggctccctagctacgtggcagaatctggattcatctgtaatattatgaatgcgagtgcagatgagatgtttaagtttcaggagggtgccctagatgactcaggttggttgatcaagaatgtgctgtcaatgcccatcgtgaataaaaaagaagagattgtcggcgttgctacgttctacaaccgaaaggatggcaaaccatttgacgaacaagacgaggttctcatggagtctctgactcagttccttggttggtccgtaatgaataccgacacatatgacaaaatgaataagctggaaaacaggaaagacatagcccaggatatggtgctctaccacgtcaagtgcgaccgagatgaaattcaacttatcctgcccacgagagctcgcttgggcaaggagcccgccgattgtgatgaagacgaactgggagagatacttaaggaagagttgccagggccaacaacatttgacatctatgaattccacttttcggatttggagtgtacagagttggatttagtcaaatgtggcatacagatgtactacgaactaggagtcgtccgtaaattccagattccacaggaagtcttagtgagatttttattttccatttctaagggctaccgccggataacataccacaactggcgtcacggtttcaatgttgcacagaccatgtttactcttctcatgacaggcaaattgaaatcttattacacggatctggaagcttttgcaatggtaacagctggtttatgtcatgacattgatcatagaggtacaaataacctgtaccagatgaagagccagaatcccctggccaagctccacggtagctcaatcctggaacgtcatcatctggaatttggcaaatttcttctgtctgaagaaaccttgaacatctaccaaaacctaaatcggcgccagcacgagcatgtgattcacttgatggatattgccattattgcaaccgatttagccctatacttcaaaaagagggccatgtttcagaagatcgtggatgaatctaaaaactatcaggataagaaatcctgggtagaatatctgtccctggaaaccacacgcaaggagatcgtgatggccatgatgatgaccgcatgtgacctgtctgcgattacaaagccgtgggaagtgcagtccaaggttgcacttcttgtggcggcagaattttgggaacagggcgatcttgagcgcacagttctcgaccagcagcctattccaatgatggatcggaacaaggccgctgagctccctaagctccaagtgggcttcatcgactttgtgtgcacttttgtttacaaagaattctcccggtttcatgaggagatcctccccatgttcgatcggctccagaataaccggaaagaatggaaagccctcgccgacgagtatgaggccaaagtgaaggccctggaggaaaaggaggaggaagagcgcgttgccgccaagaaagtaggcacagaaatctgcaacggtgggcccgcaccaaagagttccacctgttgcattctctag

SEQ ID NO: 128552 - DNA, 2562 bp, Artificial Sequence
  Description of Artificial Sequence: Synthetic coding sequence
atgagtctctccgaggagcaggcccggagctttctggatcagaatcccgactttgcacgtcagtattttggaaagaaactatctccggagaatgtcgcggccgcatgcgaggacggctgcccccccgattgtgactcccttcgcgacctctgtcaagtcgaggagtcgaccgccctgctcgagttagtccaggacatgcaagagtccatcaatatggaacgcgtcgtctttaaggtattgaggagactctgcacactgctgcaggctgatcgatgcagcctgtttatgtacaggcagagaaacggagttgccgagctcgctacacgtttgttttctgtgcagcctgactcggtccttgaggactgcctcgtcccacctgactctgagatcgtatttcctctggatatcggtgtggtcggtcacgtggctcagaccaaaaagatggtgaacgtggaagatgtggccgagtgcccacactttagcagcttcgcggatgagctgaccgattataagacaaaaaatatgcttgccacccctattatgaacggcaaagatgtcgtcgccgtgattatggccgtgaacaaacttaacggaccttttttcacctctgaagatgaggacgtgttcctgaaataccttaatttcgcgacgctttacctcaaaatataccacctgtcctacctgcataattgtgaaactcggcggggccaggtgctgctgtggagcgccaacaaggtgtttgaagaactgactgacattgagcggcagttccacaaggcgttttatacggtgagagcgtacctcaattgcgaacgatattctgtcggcctcttggacatgactaaagagaaagagttctttgacgtgtggagcgtcctgatgggtgagtcccagccatattccgggcctagaacaccggacggacgcgaaatcgttttttataaggtgattgactatgtgctacatggcaaagaggaaataaaggtcatccccaccccgtctgccgaccactgggccttggcatcagggctgccctcctacgtagcagaatctgggttcatttgcaatattatgaacgcttcggcggatgagatgtttaagttccaggaaggagccctagatgatagtggctggcttatcaagaatgtgctatctatgcccatcgtgaacaagaaggaggaaattgtaggtgtggccaccttttataatagaaaggatggcaagccctttgacgaacaagacgaggtgctcatggagtccctaacacagtttctcggctggtccgtcatgaatacagacacctacgataaaatgaataaactggagaataggaaggacatagcacaggacatggtactgtaccatgttaaatgtgacagagatgaaatacagctgattttgcccacacgggctcggctaggcaaggaacctgcagactgtgacgaggatgagctgggcgaaattcttaaggaggagctgcctggacctacaacgttcgatatctacgaattccacttttccgatctggagtgcaccgagctggacctggtgaagtgtggcatccagatgtattacgagttgggcgttgtacggaaatttcagataccccaggaggtgttagtgagatttctcttttcaatctcaaaagggtataggagaatcacatatcacaactggagacatgggtttaacgtggcccaaactatgtttacgcttttgatgaccggaaaacttaaatcatattacacagatctggaagcgtttgctatggtgacggcaggcctatgtcatgatattgaccaccgaggcacaaacaacttgtatcagatgaagtcacagaatcccctagctaagttgcatgggagttctattctcgaacggcatcacctggaattcggaaagtttctactcagcgaagagactctcaatatttatcagaatctaaatcgacgccaacatgaacacgtcatacacctgatggacattgcaatcatcgccaccgacctagcactttacttcaagaaaagagcgatgttccaaaagatcgtggacgaatcaaagaattaccaagacaagaagagttgggtcgaatacctgtcacttgaaaccacacggaaagagattgtcatggcaatgatgatgacagcctgtgacctcagcgctattacaaaaccatgggaagtacagtccaaggtggcattgcttgtagcagccgagttctgggagcagggcgatctggagcggacggtgctggatcagcagcccattcctatgatggatcgcaacaaagccgcagagttacccaagttgcaggtgggctttatcgacttcgtgtgcacatttgtgtataaggaattctcccgttttcacgaggaaattctgccgatgtttgatcggctgcaaaacaaccgtaaagagtggaaagcattggctgacgaatatgaggccaaagtcaaagccctggaggagaaggaagaagaggagcgggttgctgcgaagaagggcaccgaaatatgcaatggagggcccgcgccaaaatcttccacgtgttgcatcctgtag

SEQ ID NO: 128553 - DNA, 2565 bp, Artificial Sequence
  Description of Artificial Sequence: Synthetic coding sequence
atgtctctatccgaggaacaggcccgatccttccttgaccagaatccggactttgcacggcagtacttcgggaagaaactgagtccggagaatgtggccgccgcttgcgaggatgggtgccctccagactgtgactcactgagggacctgtgccaggtggaggagagcacggcgcttctggagttagtgcaggacatgcaggagagcatcaacatggaaagagttgtgttcaaggtgctgcgaagactttgtaccctgctccaggcagaccggtgctccctgtttatgtacagacagagaaatggagttgccgagctcgctacacgactgttctcggtgcaacctgattccgtactggaagattgtctagttcccccagatagcgagattgttttccccttagatattggggttgttggccatgtcgcacagaccaaaaagatggtgaacgtagaagacgttgctgagtgtccccatttttcgtctttcgcggatgagctgactgattacaagacgaaaaacatgctggctaccccaattatgaatggtaaagatgtcgtcgcagtaatcatggcagtaaacaagctgaatgggcctttctttacaagcgaggatgaagacgtctttctgaaatacctgaactttgcaacactgtatctgaagatttaccaccttagctacctgcacaattgtgaaaccagaaggggccaagtgcttctgtggagcgctaacaaggtgtttgaggaactgactgatattgaaaggcagttccataaagctttctatacagtgagggcctatctcaactgcgagcgctattcagtcggactgttagatatgacaaaggaaaaagagtttttcgatgtctggagtgtcctaatgggagaaagccagccctacagtgggcccagaacgccagacggtcgggagattgtattttataaagtgatagattatgtcctgcacggaaaggaggaaatcaaggttatccctaccccctcagcggaccactgggcactggctagcgggctgccatcatatgtcgccgaatcaggatttatctgcaatatcatgaatgccagcgcagacgagatgtttaaattccaggaaggagccctagacgattctgggtggctaataaagaatgtgctttccatgcctatcgtcaacaaaaaggaggagatcgttggagtcgcaaccttttacaaccgaaaagacggaaagccctttgatgaacaggacgaagtgctgatggagtcacttacccagtttcttggttggtctgtaatgaatacagatacctacgacaagatgaataaactggaaaataggaaggacattgcccaggatatggtgctgtaccatgtgaagtgtgatagagacgagattcagttgattttaccgaccagggccaggttgggcaaggaacctgcagactgcgacgaagacgaactgggcgagatactaaaagaggagcttcctggaccaactacattcgatatttacgagtttcacttcagtgatttggagtgtacagaactggatttagtgaagtgtggcattcagatgtactacgagctgggcgtcgtgagaaaattccagataccccaggaggtgctggtgaggtttcttttcagtatcagcaaagggtatcggcggataacctatcataattggcggcatggcttcaatgtggcccaaaccatgttcactttgctcatgactgggaaactcaagtcatattacaccgacctggaggctttcgccatggtaaccgccggtctatgtcacgacatcgatcatcgcgggacaaataacttgtaccaaatgaaatcacagaacccccttgccaaattgcacggctccagcatcttagagcgacaccatctcgagtttggaaagtttcttctgtccgaggagacactgaacatctaccaaaatctcaacagacgacagcatgagcatgttatacatcttatggacatcgccatcatagccaccgaccttgctctgtacttcaaaaaacgagccatgtttcagaagatcgtcgacgagtcgaaaaactaccaggacaagaaatcttgggtggaatacctgtccctggaaacaacacgcaaggaaatcgtgatggccatgatgatgacagcatgtgacctatccgcaatcaccaaaccgtgggaagtgcaatccaaggtggccttgctagtggctgcagaattctgggaacagggtgatctggagaggactgtgcttgaccagcagcccattcccatgatggacaggaacaaagctgcagaattgcctaagctgcaggtggggtttattgacttcgtatgcaccttcgtgtacaaggaattttctcggttccacgaggagatcttacctatgttcgataggttgcagaacaacagaaaggagtggaaggcactggcagacgaatacgaagccaaggtgaaagcactggaggagaaggaagaggaggaaagggtggccgccaaaaaagtgggtaccgagatctgtaacggtggccctgcccctaaaagcagtacatgctgtattctatag

SEQ ID NO: 128554 - DNA, 2577 bp, Artificial Sequence
  Description of Artificial Sequence: Synthetic coding sequence
atgggcgaaattaatcaagtggctgtcgagaagtatctcgaagagaacccacaatttgccaaagagtatttcgaccgaaagttaagagtggaagttctgggcgaaatttttaagaatagccaggttcctgtgcagagctccatgtctttttcagaacttacccaagttgaggagtccgctctgtgcctggaactgctgtggactgtgcaggaggagggcggaactcccgagcagggggtacatcgcgctctgcaacggctcgcccatctgctgcaggcagatagatgcagtatgtttctatgcagatctcgcaatggcattcctgaagtggcgtctagactgttggacgtgacgccaacaagcaagtttgaggacaacttggttggacccgacaaggaagtcgtgtttcccctggacattggtattgtaggctgggccgcacacacaaagaaaacgcataatgtacctgatgttaagaaaaattctcacttcagtgatttcatggacaaacagacaggatatgtgactaaaaatctgcttgcgacccccatcgtcgtggggaaggaggtgctcgcggtgatcatggcggttaataaggttaatgcatccgaattctctaagcaggatgaggaggttttcagcaagtacttgaatttcgtctccatcatcctacgcctgcaccacacttcctacatgtacaacattgagagcagacggtctcaaatacttatgtggtcagccaataaggtctttgaagagctgactgatgtcgaaagacagtttcacaaagccttgtatacagtcagatcataccttaactgtgagcggtattcgataggactgctggacatgactaaggagaaggagttttacgatgagtggcctataaagctcggcgaagttgaaccatacaagggccccaaaacccctgatggacgcgaggtgaatttttacaagatcatcgactacatcctacacggaaaagaggaaattaaggtgataccgaccccacctgcagatcattggacactgatcagcgggctacctacatatgttgcagagaacggattcatctgcaatatgatgaacgccccagctgacgaatactttacatttcagaaaggtccggtcgacgaaacagggtgggtcataaagaacgtgctgagcctgccgattgttaacaaaaaggaagacattgttggtgtggcgacattttataatagaaaggatgggaaaccattcgacgagcacgatgagtacatcaccgagaccctcacccaattcctcggatggtcactgctgaatacagatacttacgataaaatgaacaaattggaaaaccggaaagacatcgcacaagagatgctaatgaaccaaactaaagccacacccgaggagattaaatcgatcttgaagtttcaggagaagctcaacgtggatgtgatcgacgattgcgaggaaaagcagctggtggcgatcctcaaagaggacttgcccgacccccgttccgccgagctctacgaatttcggttctcagattttcctttgacagagcatggcctgattaagtgtgggatccgattattttttgagataaacgtcgtagaaaagttcaaagtcccggtcgaggtcttgacccggtggatgtacactgtcagaaaaggctaccgcgccgtgacataccataattggcggcacggatttaacgtgggtcagacgatgttcaccctgctgatgaccgggcggcttaaaaagtattacacagacctggaagcatttgccatgctcgcagctgccttttgtcatgacatcgaccaccgtggcacgaataatctctaccagatgaaaagtacatctcctctcgctaggctgcacggctcaagcatcctcgaaaggcaccacctggaatattccaaaaccttactgcaagatgaatcattgaacattttccagaacttgaataagcgacagttcgaaacggttatccacctgttcgaagtagctattatcgccacagaccttgccctctatttcaaaaagcggaccatgttccaaaagattgtggatgcctgtgaacagatgcagactgaggaggaggccatcaagtacgttacagtggaccccactaaaaaagagatcattatggccatgatgatgaccgcatgtgacctatcagctattactaaaccctgggaagtgcagagccaggttgcactgatggtggcaaatgaattctgggagcaaggagacttggagagaacagtgttgcagcagcagcctatccccatgatggacagaaacaagagagatgagttgccgaagctgcaggtgggattcatagactttgtctgcactttcgtctacaaggaattttccaggtttcacaaagaaatcacccctatgctttctggcctgcaaaacaaccgtgtggaatggaagagcctggctgatgaatatgatgcgaaaatgaaggttatcgaagaggaggccaaaaagcaggagggcggggcagagaaggcagcggaggactctgggggcggcgacgacaagaagtctaaaacctgcctaatgctgtag

SEQ ID NO: 128555 - DNA, 453 bp, Artificial Sequence
  Description of Artificial Sequence: Synthetic coding sequence
atgtcagccaaagatgagagggcaagagaaatcttaaggggcttcaaactaaactggatgaatctccgtgacgccgagacaggcaaaatcttatggcagggcaccgaggatctttcggttcccggcgtggaacacgaagcacgagtgcctaagaagattctaaagtgtaaggcagtgtcgagagagcttaattttagctccactgaacagatggaaaagtttcgcttagagcaaaaggtatatttcaaagggcaatgtttagaggagtggtttttcgagtttggcttcgtgattccgaacagtacaaatacgtggcaaagcctgattgaggcagccccggagtctcagatgatgccagcttcggtgctgaccggaaacgtcattatagaaactaaattcttcgacgatgatttacttgtatcaacatcgagagtgcgtctattctatgtttag

SEQ ID NO: 128556 - DNA, 414 bp, Artificial Sequence
  Description of Artificial Sequence: Synthetic coding sequence
atgaaacagcgtgacaagggtcgcggctggcaccccgcagagggaggccctgctctaacggcccaaccgcctgaaaccagaccggcgctggaccgctctagacgggaatcaagaagtcaagggtgtagaggcgtgtccgtgagccttacaatgaacttagagccccccaaggcagagttccgcagcgccacgcgggtagcgggaggcccagtaacgcccagaaagggtcctcctaagtttaaacaacgacagacacgccagtttaagtctaagcccccaaagaagggtgtccaggggttcggagacgacatcccgggaatggaggggcttggtactgacattaccgtcatttgcccctgggaagcttttaatcacttggaactgcacgagttggctcagtatgggatcatttag

SEQ ID NO: 128557 - DNA, 264 bp, Artificial Sequence
  Description of Artificial Sequence: Synthetic coding sequence
atgaatctggaacctcctaaagccgagtttcggtccgccacaagagtagcgggcggcccggtaacacctagaaagggtccaccaaaattcaaacagcgccagactaggcagttcaagtctaaacctcccaagaaaggtgtgcaaggtttcggcgatgacataccaggaatggaggggctgggaacagacatcacggtcatttgcccttgggaagcttttaaccacttagagctccacgaactggcccagtacggaatcatctag

SEQ ID NO: 128558 - DNA, 252 bp, Artificial Sequence
  Description of Artificial Sequence: Synthetic coding sequence
atgtcggataacacaacgttaccagcccctgctagtaatcaaggcccgacaacaccacgaaaggggcctccaaaattcaagcagaggcaaacccgacaatttaaatccaaaccccctaagaaaggtgtcaaaggattcggcgacgatattcccggaatggaggggttgggaacagacattacagtgatctgcccatgggaggcttttagtcacctggagctccatgagttggctcaattcggaatcatctag

SEQ ID NO: 128559 - DNA, 1371 bp, Artificial Sequence
  Description of Artificial Sequence: Synthetic coding sequence
atgggcataacactgatctggtgcttagctctggtgttaatcaagtggatcaccagcaaaaggaggggagctatttcctacgatagctccgaccaaaccgccttatacattaggatgctgggtgacgtccgcgtgcggtctcgtgccggctttgagagcgagcgccgtggatctcacccatatattgacttccgcatctttcactcgcaaagcgagattgaggtatcagtctctgcaaggaatattcgtaggttgttaagcttccagcggtaccttcgaagctcaaggttttttcgagggacagcggtcagtaattcccttaatattctcgacgacgattataacgggcaggccaaatgtatgctggagaaggttggcaactggaacttcgatatattcctgtttgatcgattgacaaacggcaatagcctggtgtctctgactttccacctgtttagcctgcatggcttgatagagtattttcatttggatatgatgaaattaaggagattcctggtaatgattcaagaagactaccacagtcaaaatccttatcataacgccgtacatgcggcggacgtaactcaggctatgcactgctacctgaaggaacccaagttagctaacagtgtcaccccctgggacattctgttgtcactgatcgctgcagcaactcatgacttggatcaccccggagtgaaccagccattcctcatcaaaacgaaccattacttggctacactgtacaaaaacacatctgtgcttgaaaatcaccattggcgatctgccgtagggctactacgagagagcggactctttagccacctcccattggagagcagacagcagatggaaacacaaattggcgcactgatcctagcaacagacatatctcgacagaatgagtacctcagcttatttcgtagccacctcgataggggtgatctgtgtttggaggatacacggcacaggcatctggtgctgcaaatggccttgaagtgcgccgacatatgcaatccttgtcggacttgggagctctctaagcaatggtcagagaaggtgaccgaagagttcttccaccagggggacattgagaaaaaatatcatctaggcgtgagcccactttgcgatagacacaccgagagcatcgccaacatacaaatcggcttcatgacatatcttgttgagccccttttcaccgaatgggcacgcttttctaatacgcggctgtcacaaacgatgctagggcacgtcggcctaaataaggcttcgtggaagggcctacaaagggagcaaagctcttccgaagataccgatgccgcattcgagcttaatagccaacttctgccgcaggaaaataggctgagctag

SEQ ID NO: 128560 - DNA, 1275 bp, Artificial Sequence
  Description of Artificial Sequence: Synthetic coding sequence
atggaagtctgctaccagctccctgttctgccgctggatagaccagttcctcagcatgttctgagtcgcagaggggcaatttcatttagcagttcaagtgctctgttcgggtgcccgaatcccaggcagctgagccagagacgcggcgcaatctcatatgactcatctgatcagacagccctgtacattcggatgttaggagacgtacgggtccgttcacgcgcagggttcgaatcagaacggcgggggagtcacccctatattgactttcgcatattccatagtcagagcgaaattgaagttagcgtttcagctcgcaacattaggcggctgctttcttttcagcgatatctgaggagcagtaggtttttccggggcacagctgtttccaattccctcaatatattggatgatgactataatggtcaggccaagtgcatgctcgagaaggtcggcaactggaattttgatatattcctgtttgatcgcttaaccaatggaaattctcttgtgtcattgaccttccacctcttttctttgcatgggctcatcgaatatttccatctcgatatgatgaagctgcggcgcttcctggtgatgatccaggaagactatcacagccagaatccatatcacaatgctgtccatgctgctgatgtcacccaagctatgcattgctatctgaaggaacccaagttagccaattcagtgacaccctgggacattctgctctccttgattgccgcggctacccatgacctggatcacccaggcgtaaaccaacccttccttatcaaaactaaccattaccttgctacgttgtataagaacacatctgtactcgagaatcatcattggcggtccgccgtgggcctgcttcgggaaagtggcttattttctcatttgccattggaatcaagacagcagatggagacccagatcggcgccctgattttagccactgacatcagtaggcagaacgagtacctttcactgttcagatcacaccttgatcgcggcgacctgtgcctggaggacacaagacatcgccacctcgtgttgcaaatggccctcaagtgcgcagatatctgtaacccctgcagaacatgggagcttagcaagcaatggagcgaaaaggtgactgaagaattcttccaccagggcgacattgagaaaaagtaccatctgggcgtgagccccctgtgtgacagacacactgagtccattgccaatattcagatcgggaactatacttatctggatatcgcaggttag

SEQ ID NO: 128561 - DNA, 1449 bp, Artificial Sequence
  Description of Artificial Sequence: Synthetic coding sequence
atggaggtttgttatcagctgcccgtactgccactggatcgcccagtgccccaacacgtgctctcccgacgcggcgcaatctcattctccagcagttcagccttgttcgggtgccctaacccccggcaactgtcacagagacgtggcgcaatctcatacgattccagcgaccagacagccctgtacatcagaatgttaggagacgtgcgcgtccgctctcgagccgggttcgagagcgagcgacggggctctcacccctatattgatttcaggattttccatagccagtccgagatcgaagtcagtgtgtccgcacggaatattaggcgactgctctccttccagagatatctcagatctagtcggtttttccggggcaccgctgtctccaactctttaaacatcctggacgacgactataatggccaggccaagtgcatgttagaaaaagtagggaattggaactttgatatcttcctgtttgacagactcacaaacggaaatagtctggtgtcactgacatttcacctgtttagcctgcatgggctgatcgagtatttccatcttgatatgatgaaactccgaagatttctagtcatgattcaggaggattaccatagccagaacccttaccataatgccgtccatgcggcagacgttacccaggcgatgcattgctacttgaaggagcctaaacttgctaattccgtgacaccctgggatatccttctcagcttgatcgccgccgcaacacacgacctggaccatcccggagtgaatcagcctttcctgattaaaaccaaccattacctggccaccctctacaagaacaccagtgtgctggagaatcaccactggcggtctgccgtcggattgctgagagaaagtggcctatttagccatctccctttggaaagccgtcagcagatggaaactcagatcggagccctgatattggccaccgatatttcccgacagaacgagtatctatctctgttccgatctcacctggacaggggggacctatgtttggaggacactaggcaccgccatctcgtgcttcaaatggccttgaaatgcgccgacatttgcaacccttgccgcacatgggagctgagcaagcagtggagtgagaaggtcaccgaagagtttttccaccaaggtgatatagagaagaaatatcaccttggggtgtctcctctgtgcgaccgacacacagaatctattgcaaatattcagattggcttcatgacctatctggtggagcctctattcacggaatgggcccgctttagtaatacaagactgtctcagactatgctgggacacgttggtctgaataaggcgtcctggaaagggttgcagcgggagcagtccagttccgaggacaccgacgcggcgtttgaactgaattcccagctgttgccccaagaaaaccgacttagctag

SEQ ID NO: 128562 - DNA, 2490 bp, Artificial Sequence
  Description of Artificial Sequence: Synthetic coding sequence
atggggtgcgccccatccattcacatctctgagaggctggtggccgaggacgcgccttccccggccgcccctcccctttcctcgggcggcccccgactgccccagggtcagaaaaccgctgccttgcctcgtaccaggggtgcgggacttctcgagagcgagctccgcgatggctcaggaaagaaagttgccgtcgccgacgttcagtttgggcccatgcggtttcatcaggaccagcttcaggtcctgctggtcttcacaaaggaggataaccagtgcaatggtttctgtagagcatgcgagaaagcagggtttaaatgcacagtgacgaaggaagcccaggccgtgttggcatgttttttggacaaacatcacgatatcattatcatcgaccacaggaacccccggcaactggacgctgaggcactgtgcaggagcataaggagctccaaattgagtgaaaacaccgtgattgtcggagtcgtcagacgcgtcgacagggaagaactcagtgttatgccctttatttcagctggatttacgagacggtatgtggagaacccgaacattatggcttgttacaacgagctcctgcaactggagtttggggaggtgaggtctcagttaaagctcagagcttgcaacagcgtcttcactgcactcgagaactctgaggatgctatcgaaatcacttcagaggaccggttcatccaatatgcaaatccagcctttgagaccaccatgggctaccagagtggtgaactgattggcaaggagctcggagaggtacctataaacgagaagaaggcggacctcctggacacaataaactcatgcatccgaataggtaaagaatggcagggcatttactatgctaaaaaaaaaaacggggataacatccagcagaatgtgaagatcattcctgttataggacagggtggaaagatccgacattatgtgagcatcatccgtgtctgcaacggaaataataaggccgaaaagatttcagagtgcgttcaatcagatacgcacacagataaccagacaggaaagcacaaggaccggagaaagggtagcctagacgtgaaagccgttgcctctagagccactgaggttagcagccagaggcgacacagctccatggcacgcattcactcaatgacaatagaggcgcctataactaaagtcatcaacatcattaacgcagcacaagagagtagtcctatgccagttaccgaggccctcgacagagttcttgagattctaagaactaccgaactgtattccccgcagtttggggctaaggacgatgatccccatgcgaacgatctggtagggggactgatgagcgacggattaagacgtctctctggcaacgaatacgttctcagtacaaagaatacacagatggtcagctccaacattatcacgcctatctccctggatgacgtgccgccccgcatcgccagagctatggagaacgaagagtattgggattttgatatttttgaacttgaggctgccacgcataatcgtcccttgatatacctggggcttaagatgttcgcgcggtttggcatatgcgaattcttacactgcagcgaatccacgcttcggtcttggttacagatcattgaagcaaattatcactcatctaatccatatcacaactctacccattcagctgacgtcctgcacgccactgcgtatttcctctccaaggaaagaataaaagagactctcgatccaattgacgaggtggccgctctgatagccgcaaccattcatgacgtcgaccatccaggacgaacaaacagcttcttgtgtaatgccggttcggaactggccattctctacaatgatacagcggtgctggagtctcatcatgccgctctggcctttcagcttacaacaggggacgataaatgtaacatattcaaaaatatggagcgcaatgactaccgtacattgagacagggtatcattgatatggtgttagcgacagagatgacaaaacactttgagcacgtgaataagtttgtcaactcaattaataagccactagccacccttgaggaaaatggtgagacggacaaaaatcaggaagtgatcaatacaatgctaagaacccccgagaacagaacactgatcaaaagaatgctaatcaagtgcgccgacgtttccaatccttgccgacccctccagtactgcattgagtgggcagccagaatttccgaggagtatttcagccaaaccgacgaggagaaacaacaagggctgcctgtcgtcatgcccgtattcgatagaaacacatgtagcataccaaagtcccagatatcgtttatcgattatttcattactgatatgtttgacgcctgggatgcatttgtcgacctgcctgacctaatgcagcatctcgacaataacttcaaatactggaagggcctggatgaaatgaaattgcgcaatctgcgccccccccctgagtag

SEQ ID NO: 128563 - DNA, 2352 bp, Artificial Sequence
  Description of Artificial Sequence: Synthetic coding sequence
atggggtgtgcaccgtccattcatatcagcgagcgactggtggcagaagatgcacctagccctgccgctccgcctttgagtagcggcggcccacgcctgcctcaaggtcagaagacggccgctctgccgaggacgcggggcgctggactgctagaaagcgaattgagggacggatccgggaaaaaggtggctgtagccgacgttcagtttggcccgatgcggtttcaccaggatcagctgcaggtcttacttgttttcactaaggaagataaccagtgtaatggcttctgtagagcgtgtgagaaagcgggttttaagtgtacggtgacaaaggaggcgcaggcagtacttgcctgcttcctggataagcaccacgacatcattataatcgatcacaggaacccaaggcagttggatgctgaagccttatgtcgaagtattaggtctagtaaactttcagagaacaccgtaatagtgggcgtcgtgcgcagggtcgacagagaagagctgagtgtaatgccttttattagtgctggcttcacacggaggtatgttgaaaatcctaatattatggcatgttacaacgaactccttcagctggagtttggggaggtgcgttctcaactcaaactaagggcgtgtaattccgtgtttaccgccctagaaaactccgaggatgctatagaaattacatcggaagatagattcattcaggaatggcaggggatatactatgcgaaaaagaagaacggagataatattcaacagaacgttaaaataatccccgtcattggtcaaggaggaaaaattcggcactacgtgtcaattattcgcgtttgtaacggaaataacaaagcggaaaagatcagtgagtgtgtgcagagtgatacccacacagataatcaaaccggcaagcacaaggatcgccggaaaggaagccttgacgtcaaagcagtcgcctcacgggctacagaagtaagttcacagaggcggcattcatctatggccaggattcacagcatgaccatcgaggctccaatcactaaggtgattaacatcattaatgctgcccaggaaagctcacctatgcccgtgactgaggcattagatcgcgtgctggagatcctgcggaccacagagctgtactcaccccagtttggcgccaaagatgatgacccgcacgcaaatgatctcgtgggaggcctcatgtccgacggcttacggcgcttgagtggaaacgaatatgtgctgtcaaccaagaacacgcagatggttagttctaacattatcactcctatttctcttgatgacgtcccaccaagaatcgctcgggccatggagaatgaagaatattgggatttcgacatttttgaacttgaagctgcgacccataaccggcccctgatctatttaggattgaaaatgtttgctagatttgggatctgtgagttcttacattgtagcgagtccactttgagatcctggctgcaaatcattgaagcaaactaccattcctcgaatccttatcataacagcacacacagtgctgacgttctccatgccaccgcctattttctgtccaaagaacggattaaagaaacattggacccaatagatgaggttgccgcccttattgccgctactattcacgacgtggatcaccctggacgcacaaacagtttcctatgtaatgctggaagtgagctggccatcctttataatgatacggcagtcctggaaagccaccatgcggctctcgcgtttcagcttactaccggtgatgataaatgcaacatcttcaagaacatggaacggaatgactatcgaaccctccgccagggcattatcgatatggttctggcgacggaaatgactaaacacttcgagcatgtgaataagtttgtgaactccattaacaagcctcttgccacactagaggaaaatggggagactgacaagaatcaggaagttattaataccatgttacgaactcccgagaatcgtacgcttataaagagaatgctgatcaaatgtgctgacgtctcaaatccttgtagacctttacagtactgcatcgagtgggccgcacgaattagtgaggagtacttctctcagacagatgaggagaagcagcagggattgcccgtggtgatgcctgtcttcgacagaaacacatgctcaattcccaagtcgcaaatatccttcatcgattactttataaccgatatgtttgatgcctgggatgcatttgtggatctaccggatctgatgcagcatcttgacaacaactttaagtactggaaggggctggatgagatgaaacttcggaacctccgtccgccaccagaatag

SEQ ID NO: 128564 - DNA, 2490 bp, Artificial Sequence
  Description of Artificial Sequence: Synthetic coding sequence
atggggtgcgctccaagcatccatatctccgaacggcttgtggctgaggatgcaccttcacctgctgctccaccattaagtagcggaggtcccaggttgccccagggtcaaaaaaccgcagccctgcctcgcacaaggggtgctggattgctggagtcagaactgcgagatgggtcgggcaagaaggtcgcggtggcggatgtgcagttcggaccaatgagattccaccaggatcagttgcaggttctcctcgtgtttacgaaagaagataaccagtgtaacgggttttgccgggcgtgtgaaaaggcaggctttaagtgcaccgtcacaaaagaggcccaggccgtactggcctgcttcctcgacaaacatcacgacatcatcatcatagaccaccgtaaccctcgccagcttgatgctgaggcgctctgtcggagtatcagatcctctaagctatctgaaaatacggtgatcgtcggggttgtccggcgggtggatagggaagagttgagcgtgatgccgttcatcagcgcagggttcactcggaggtacgtcgagaaccccaacatcatggcatgttacaacgaactgttgcaactggagtttggagaggtacgctcacagctaaagctacgggcttgtaatagcgtgtttactgctctggaaaactctgaagacgctattgaaatcaccagcgaggaccgcttcattcaatacgctaaccccgccttcgaaactaccatggggtatcagagcggcgagcttatcggcaaagaactgggcgaggtacccatcaacgaaaagaaggcggatcttttggataccatcaacagctgtatccgcattggaaaagagtggcaaggcatttattacgccaagaagaaaaacggtgataatatacaacaaaacgtgaagattataccagtaattggacagggagggaagatccgccattatgtgtcgatcattcgagtctgtaacggtaataataaagctgagaaaatctctgagtgtgtccagtcagatacccacacagataaccagacaggcaagcacaaagaccgcagaaagggttctttggatgtcaaggcagtggcatcgcgagcaaccgaagtgtcatctcagcgccgtcattcaagtatggcccggatccattctatgacaattgaggcacccatcacaaaagtgattaatataataaacgcagcgcaagaatccagccccatgcccgtaaccgaggctctggaccgcgttctggagatcttgcgcaccaccgagttgtattctccacagtttggagcaaaagacgacgaccctcatgccaatgatctagtcggagggctaatgagcgatggtttacgccgcctgagcggcaatgagtacgtgttgtcgactaagaacactcaaatggtgagtagcaatatcatcacgccaatcagcctcgacgacgtgccgcccaggatcgcccgtgcgatggagaatgaggagtactgggatttcgacatttttgagctggaagcggcaacacacaatcggcccttgatctacctgggtctcaaaatgtttgcaaggttcggcatttgtgagtttctgcactgcagtgagagcaccctgcggagttggctccagattatcgaagctaattaccactcgagcaatccatatcataattccacacatagcgccgacgtgctgcatgccaccgcttacttcctatctaaggagcggatcaaggagacgctggacccaattgatgaggtagctgccctcatagctgcaactattcatgacgtagatcatcctggaagaaccaactcctttctctgcaacgcggggagtgagcttgcaattttgtacaacgacacggccgttctggaatcacatcacgcagccctcgcctttcagctgactacaggggatgataaatgcaatatcttcaaaaacatggaacggaacgattaccgcactttgcgacaaggaatcattgatatggtgctcgctactgagatgacgaaacacttcgagcacgtgaataaatttgtcaactccatcaacaagccactcgccacactggaggagaatggagaaaccgacaaaaatcaggaggtcatcaacactatgctgagaactccagaaaatcggacactgattaaacgcatgctgatcaagtgcgctgatgtttctaacccttgccgacctctacaatactgtatagagtgggccgcgagaatatccgaggaatacttttcccaaaccgatgaggagaagcagcaggggttgccagtggtgatgcctgtgtttgatagaaacacatgttcaattcccaagtctcagatctctttcattgattactttataacggatatgtttgacgcttgggacgctttcgtggacctgccagatctgatgcagcacctggacaataacttcaaatactggaaaggactggacgaaatgaaactgagaaatttacgtccaccgccagagtag

SEQ ID NO: 128565 - DNA, 2274 bp, Artificial Sequence
  Description of Artificial Sequence: Synthetic coding sequence
atgaggttccaccaggaccagctacaggttctcctcgtttttacaaaggaggacaatcagtgcaacgggttctgtagggcttgcgagaaagcaggttttaaatgtacagtcaccaaagaagcccaggccgttctcgcttgtttccttgataaacaccacgacatcatcatcattgaccataggaaccccagacaattggacgcagaggcactgtgcagatcaatcaggagcagcaaactgagcgagaacaccgttatcgtgggcgtggttaggagggtcgacagggaggaactcagtgtgatgccctttattagcgctggctttacacgtcggtacgttgagaaccctaacatcatggcctgctacaacgaactgctgcaacttgagttcggtgaggttcgctctcagcttaagctcagggcttgcaacagcgtgttcacagccctggagaattcagaagacgccatcgagatcacctcagaagaccgattcatccagtacgctaatcccgcattcgaaaccactatgggctatcaaagtggggaattaatcggcaaagagctgggagaagtacccattaacgagaaaaaggctgacctgctcgacaccataaactcatgcattcggatcgggaaggagtggcagggcatctattatgctaaaaaaaagaacggtgacaacatccagcaaaacgtcaaaattattcctgtcattggtcaggggggtaaaatcaggcattatgtttctatcattcgtgtttgtaacggcaataacaaggcagaaaagatctctgaatgtgtccagtctgacacacatactgacaatcaaaccgggaagcacaaggaccggagaaagggcagccttgacgtgaaagctgtggcttcccgcgccacggaggtctcttcccagcgtcgacactctagcatggcacggatccacagtatgaccatcgaggccccgattaccaaagtgatcaatattattaacgctgcgcaggaaagctctccaatgcccgtgaccgaggccctggacagagttttggaaatcctgcgcaccacagagctgtacagtccccaatttggggcaaaggatgatgacccacacgccaatgacctggtcggaggcctcatgtcagatggattgagaaggttgagtgggaatgagtacgtgctctcaacaaaaaatactcagatggtgagtagtaatatcattacccctatatccttagatgatgtgccgccacgcatcgcacgagccatggagaatgaagagtattgggattttgacattttcgaacttgaggccgcaactcacaaccgcccactgatctatctgggactcaaaatgttcgccagatttggtatctgtgaatttcttcattgctccgagtctaccctgagatcctggctccagattattgaagcaaactaccattctagcaacccttatcacaacagcacccactcagccgatgtgctccacgccacagcctattttttgagtaaggaaagaatcaaagaaacgctggatccaattgacgaagtggctgcccttattgccgccactatccacgatgtggatcaccccgggcgcactaactcgtttctctgcaatgcgggaagcgagctcgcaatactgtacaacgacacggccgtgttggagtctcatcacgccgccttggcctttcagctcactactggagacgacaaatgcaatatcttcaaaaacatggaacggaacgactacaggacactcaggcaagggattatcgacatggtgctcgcgacggagatgaccaagcatttcgagcacgtaaacaaattcgtaaacagtataaacaagcctctcgctacactggaagagaacggcgagactgataagaatcaggaagtgatcaacacaatgctgcggacacccgagaaccggactttgatcaaaaggatgctcattaagtgtgcagatgtaagcaacccttgtcgccctctacaatactgtattgagtgggcggcccgcatttccgaagagtacttctctcagaccgatgaggagaagcaacagggcttgccagtggttatgccagtgttcgaccgcaacacctgctctatccctaagtctcagattagttttatcgactacttcattacagatatgttcgacgcttgggatgcatttgtggacctgccggatttaatgcagcacttagacaacaatttcaaatattggaagggattagatgagatgaagctacggaatctgcgcccacctcccgaatag

SEQ ID NO: 128566 - DNA, 2658 bp, Artificial Sequence
  Description of Artificial Sequence: Synthetic coding sequence
atggggtgtgccccctctatccatgtgtcacagtccggtgtgatttactgcagggattctgatgagagcagctctcctcgccagaccacctcggtctcgcagggaccagcagccccactgcccgggttgtttgtgcaaacagatgccgccgacgctattcccccctcccgggcttccggcccaccatccgttgcccgcgtacgccgagccagaacggaactgggctctggtagtagcgctggcagtgctgctcccgcagcgacaacttccagaggcaggcgccgccattgttgctcatctgccgaggctgagacacaaacatgctacacttcagtcaaacaggtgtcaagcgctgaagttcggattggaccaatgaggctgactcaagatccaattcaggtactcctcatttttgccaaagaagacagccagtccgatggtttctggtgggcttgcgacagggctggatatcgttgcaatatcgccaggacccccgaatccgcacttgaatgctttctggataagcaccacgaaatcattgtgatcgatcacagacaaacacaaaattttgacgctgaggcagtctgccggagcatccgtgccactaatccatcggaacacactgtgatcttagcggtggtgtccagggtatccgatgatcacgaggaggcaagtgttctccccctgctgcatgcggggtttaacagacgatttatggagaattcatccattattgcttgctacaacgaattgatccaaatcgagcacggtgaagtgcgaagccagtttaagctgcgggcatgcaattcagttttcactgccctggatcattgccatgaggccatcgagatcacctccgacgatcacgtgattcagtatgtgaatcccgcatttgaaaggatgatggggtaccacaagggcgagctgctcggcaaagaactcgctgacctgcccaagtccgataaaaatcgcgccgacctactggacacaattaacacgtgtataaaaaaagggaaagagtggcagggcgtctactacgctaggcgtaaatccggcgactccatacaacagcacgtaaaaataacaccggtcattgggcaaggaggcaaaattcgccattttgtcagcctgaaaaaactgtgttgcacgacagataacaataagcagatccacaagattcaccgcgactctggagacaactctcagaccgaaccccactcttttcgctataaaaaccggcgcaaagaaagcatcgatgtgaagtcaatcagttcccggggatctgatgccccatctctccagaaccggcgttatcccagcatggcccgcattcattcaatgacaattgaagcaccaatcacaaaagtgattaatatcattaacgctgcccaggagaatagcccggttaccgttgcagaagcactggaccgcgtgctggagatcctgcgcaccactgagttgtactcaccccagctgggcactaaggatgaggatccccacacaagtgacctggtgggcggactgatgacagacgggctgaggagactgagtggcaacgaatacgtgttcaccaagaacgtccaccaatctcactcgcacctggcgatgccgattactattaacgacgtgcccccctgcatttcccagctactagacaatgaggagtcctgggatttcaacatcttcgagttggaggccatcacgcataagagaccccttgtatatcttgggcttaaagttttctctcgcttcggtgtctgcgagttcctgaactgctctgaaacgactcttcgggcatggtttcaagttatcgaagcaaactatcatagctctaacgcataccataactccacccacgcagccgacgtgctccacgctaccgccttctttctggggaaggagagagtaaaagggagcctggatcagctggacgaagtggcagccctcattgccgcaaccgtgcatgatgtggaccacccaggccgaactaactccttcctctgtaacgcggggagcgaacttgccgtgttatacaacgatactgccgttctggaaagtcatcacacagctctggcgtttcaacttaccgtcaaggataccaaatgcaatattttcaagaatattgataggaaccattaccgtacccttcggcaggcaataattgatatggttttagccactgaaatgaccaagcatttcgagcatgtgaataagttcgtcaatagcataaataagcccatggctgctgaaattgagggctccgattgtgaatgcaatcctgctggaaagaatttcccagagaatcaaatactgataaagcggatgatgataaaatgtgcagacgtggctaatccatgccggccccttgatctatgcattgagtgggctggcaggatctctgaggaatatttcgctcagacggatgaggaaaaaaggcagggactgccagttgtaatgccagtgtttgaccgaaacacctgctctattcccaaaagccagatcagtttcattgactactttattactgatatgttcgatgcctgggatgccttcgcacacctgccagctctgatgcaacacttagccgacaactacaagcattggaagaccctggacgatttgaagtgtaaatccctcagactgccctcagattcatag

SEQ ID NO: 128567 - DNA, 2493 bp, Artificial Sequence
  Description of Artificial Sequence: Synthetic coding sequence
atgggatgcgccccctcaattcacgtgtcacagagcggggtgatttattgcagggactcagatgagtctagtagtcccaggcagactacgtcagtgtcgcaggggccagcagcacccctgcctggtcttttcgtccaaacagacgctgccgacgcaattcccccatcccgggcaagcggtcctccatctgtcgcacgcgtgcggagagcccgcaccgagttagggagtggcagcagcgccggcagcgcggctcccgctgcaaccaccagtagaggccgccgaaggcattgctgcagttctgctgaggctgaaacccagacctgctacaccagtgtgaaacaggtgtctagcgcggaggtgagaattgggcctatgcgcttaactcaggacccaatccaggtacttctaatttttgccaaggaggactcacagtccgatgggttttggtgggcctgcgatagggcgggctatcggtgtaacatagctaggacgcccgagagtgctctggagtgctttctggataagcaccacgaaatcattgtcatcgaccaccgacagactcagaactttgatgctgaagccgtctgccgaagtattagggccaccaatcccagcgaacacactgtcattctggcagtggtgtcgcgagtcagcgatgaccacgaggaggcatctgtcttgcccctgctccacgctggctttaaccgtaggttcatggagaacagcagtataatagcctgctacaatgagctgatccagatcgagcacggagaggtcaggtcccaattcaagctcagagcatgtaattctgtctttactgccctggatcactgtcatgaagcaatcgaaattacctctgatgatcatgtgattcaatacgtgaatccagcattcgagaggatgatgggttaccataaaggcgaactgctcggtaaggaacttgcagacctcccaaagtcggacaagaatcgagccgacctgcttgatacgattaacacctgtatcaaaaagggcaaagaatggcagggagtgtattacgcccggaggaaatctggggacagcatccaacagcacgtgaaaataacccctgtgataggacaaggtggaaaaatccgccattttgtgagcctaaagaagttgtgttgtactactgacaacaataaacagatccacaagatacacagagactccggcgataactcacaaacggaaccgcattcctttcggtacaagaataggagaaaggagagcattgacgttaagagtatctcgtctaggggtagtgatgctccttctctgcagaatcgcaggtacccaagtatggctcgaatacactccatgacgatagaggccccaatcaccaaggacgggttacggaggttgtccgggaacgaatacgtgttcacaaagaatgtgcatcaatcccattcccaccttgcaatgcctatcactatcaacgacgtccctccgtgtattagccagctgttggataatgaggagagttgggactttaatatttttgaattagaggccataacacacaagcgtcccctggtgtatctgggactgaaagtgtttagcaggtttggcgtttgcgagttccttaactgttcagagaccaccctgcgtgcttggtttcaagtgattgaggccaactatcactcgagcaatgcctatcacaactccacccacgccgcagatgttctgcacgcaaccgctttctttctgggcaaggagcgcgtcaaaggctcactagaccaactggacgaggtagcagccttaattgccgccacggttcatgacgttgaccaccccggacgcactaattcctttctgtgcaatgccggctcagagcttgccgtgctgtataacgataccgctgtgttggagagtcatcataccgcgcttgcgttccagctgaccgtgaaggatacaaagtgtaacatcttcaaaaatatagatcgaaaccattaccgaacattgcgacaggctattatcgacatggtgttagcaacagaaatgactaaacattttgagcacgttaacaaattcgttaacagcatcaataagcctatggccgctgaaatagaggggtcagattgcgagtgtaaccccgccgggaaaaacttccccgagaatcagatcctgatcaagaggatgatgatcaagtgcgccgacgtggcgaacccttgtcgaccactcgatttgtgtatcgagtgggccggtcgcatatctgaagaatactttgcccagacggacgaggaaaagaggcaaggcctgcctgtagtgatgcccgtttttgacagaaacacgtgtagtattccgaagtcacagatcagttttattgactatttcattactgatatgtttgatgcctgggatgcttttgctcacctgcctgctttaatgcagcacctggcagacaattataagcactggaaaactctagacgatcttaaatgcaagagcctgcgactgcctagcgattcttag

SEQ ID NO: 128568 - DNA, 2517 bp, Artificial Sequence
  Description of Artificial Sequence: Synthetic coding sequence
atgggctgtgccccctccattcacgttagtcagagcggcgtcatctattgtagagactcagatgagagctctagccctcgccagactacttcagtctcacaggggcccgcagcccccttacccggcctgttcgtgcagactgacgctgccgacgccatcccgccatccagagcgtcaggacccccaagcgtggcccgagttcgaagagcccgcacagaactggggagtggctcgagcgcaggatctgccgcacctgccgctactacttctcgcggccgccggaggcattgttgctcttctgctgaggcagagactcagacctgctatacctctgtcaagcaggtctcaagtgcagaagtgaggattgggcctatgcggttaacacaagacccaattcaggtcttgctgatcttcgccaaagaggacagtcagagcgacggcttctggtgggcctgcgatcgagcagggtaccgctgcaacatcgcccggactcccgaaagcgcactggagtgcttcctggataaacatcacgaaatcatcgtcattgaccataggcagacccagaattttgatgctgaagctgtctgtaggtcaatccgggcgaccaacccttctgagcatacagtgatactggccgtggtttctagagtctctgacgaccacgaggaagccagtgtactgcctctgctgcacgctggcttcaatcgcagatttatggagaattcctctatcattgcttgttacaatgaattgatccagatagagcacggtgaggttcgctcacagtttaagctccgggcttgtaatagcgtcttcaccgccctcgaccattgtcacgaagcaatcgagattacttccgacgatcacgtgatccaggaatggcagggggtgtattacgcccgccgtaaaagcggggatagcatacagcagcacgttaagattacccccgtgatcggtcaaggagggaaaatccgccactttgtaagcctgaaaaaactctgctgtactaccgataataataaacaaatccacaaaattcaccgcgattccggagataattcacagacagaaccgcactcgttcagatataaaaatcgccgcaaggaatccatcgacgtgaagagcatcagcagcagagggtctgacgccccaagtttacagaataggagatatccctcaatggcccgtatacattctatgactatcgaggcccccatcacaaaagtgatcaatattatcaatgcggctcaagagaacagccccgttaccgtggcggaagctcttgacagagtcctagagatcctgcgcacgaccgaattgtattctccccagctggggaccaaggacgaagacccgcataccagcgacctcgtgggaggtttgatgacagacgggcttaggcggcttagtggcaatgaatacgtgtttacaaaaaatgtgcatcagtctcatagccatcttgccatgccgataactatcaatgatgtccccccatgtatttcgcagctccttgacaatgaggagtcttgggatttcaacatctttgagctagaggcaattacccataaacgtcccctcgtctatctgggccttaaggtcttttccaggtttggagtatgtgaattcctgaattgctcagagaccactttgagagcttggtttcaggtgattgaggctaactaccactcgtcaaatgcataccataacagtacccatgcagccgacgtgctacatgcaacagccttcttcttgggaaaagagcgcgtcaagggaagccttgatcagctggacgaggtcgccgccttaatcgcagccacagtgcacgatgtggatcaccccggccggactaattcgtttctgtgcaacgccgggtctgagctagccgtcctgtacaatgatactgccgttctggagagtcatcacaccgccctggcgtttcagctgaccgtaaaagatactaagtgcaatatctttaagaacattgaccggaaccattataggacccttagacaggccattattgacatggtactggccacagagatgactaagcacttcgagcacgtaaataaatttgttaacagcattaacaagcccatggccgccgaaatcgagggcagtgactgcgaatgtaaccctgccggcaagaatttccctgaaaaccagattttaatcaaacgtatgatgatcaagtgtgcagatgtagcaaacccatgccgacccctggacttatgtatcgaatgggctggccgaatttccgaggagtattttgcccagacggatgaagagaaacgccagggtctgcccgtggtcatgcctgtttttgatagaaacacctgtagcattcctaaatcacagatatcatttatcgattactttataactgacatgttcgatgcgtgggatgcctttgctcatctccccgcccttatgcaacatttagctgacaactataaacactggaagacccttgatgatctcaaatgtaaatccctgaggctgccatctgacagttag

SEQ ID NO: 128569 - DNA, 2598 bp, Artificial Sequence
  Description of Artificial Sequence: Synthetic coding sequence
atgggctgtgctccatcaatccatgtctctcagtcgggcgtcatttattgcagggacagtgacgaatcaagttctccacgacagaccacaagtgtatcacagggacccgctgcaccattacccgggctctttgtgcagacggacgcggccgacgctattcctccaagccgcgcgagcggccccccctctgtggcccgcgtgcgcagagcacgaacggagcttggatccggatcctctgccggtagcgccgctccggccgccaccaccagcagagggaggcgacggcactgctgcagctccgcagaggcagagacccagacctgctacactagcgtcaaggtcctgctgatctttgctaaagaggactctcaatctgatggattctggtgggcctgtgacagagccggataccggtgcaatattgctcgcacccccgaaagcgccctggaatgttttctcgacaagcaccacgagatcatcgtcattgatcatcgccaaactcaaaacttcgacgcggaggcggtatgtcgttctatcagagccactaatccttcggagcatactgtaatcctggccgttgtgtcccgggtgtctgatgaccacgaggaagctagtgtgttgccgttgctgcacgcaggattcaatcgccgatttatggagaattcctcaatcattgcctgttataatgagctaatccagattgagcatggagaagtgcgctctcaatttaagctcagagcctgcaatagtgttttcacggccctggatcactgccacgaggccattgaaatcacttcggacgaccacgtcattcaatacgtgaatccagccttcgagcggatgatgggctaccacaaaggcgagctgctcgggaaggaactggcagacctgcccaagagtgataaaaatcgcgctgatctgctggatactattaatacctgcattaagaagggtaaggagtggcagggcgtctactatgcccgaaggaagtcgggcgatagtatccaacagcacgtgaagattacgcccgtaattggacaggggggaaagatcaggcacttcgtgtctctgaagaagctgtgctgcaccacagacaataataaacaaatacataagattcacagggatagcggagacaattcccaaactgaaccccacagctttcgctacaaaaacagacgcaaggaatccattgatgtgaagagcatatcctctagagggagtgatgccccctcactgcaaaacaggcgctatccctccatggcgcggattcattcaatgaccatagaggctccaattactaaagtgatcaatattattaatgcagcacaggagaattccccagttaccgtggcagaagcacttgatcgtgtcctggaaatcctcagaaccactgaactgtatagtcctcagctgggcaccaaagatgaggaccctcacaccagtgacctcgtaggcggtctgatgaccgatggattgcgcaggctgtctggcaatgaatacgttttcaccaaaaacgtccatcagtcacatagccacctcgccatgcctataacaattaatgacgtgccaccctgtatttctcaactactagataatgaggagagttgggactttaacatatttgaactggaggcgataactcataaacggcccctagtgtacctcggactgaaagtgttttctcgcttcggcgtgtgcgagttcctgaattgttctgaaaccacactgcgggcctggttccaggtaatcgaggcaaattatcactcatcaaacgcgtaccacaattctacacacgccgctgacgtgctgcacgcaactgcgttcttcctcggtaaagaacgcgtgaagggcagcctggaccaactggacgaggtggcagcgctgattgcggccacggtgcacgacgtcgatcatccgggaagaaccaacagttttctctgtaacgcgggctctgagctggctgtactgtacaacgacacggcagtactcgagtctcaccatacagcactggcatttcaactaacagtgaaggatactaagtgcaacatatttaagaatatagaccgcaatcattaccgcaccctacgacaggctattatcgatatggttctagctacagagatgactaagcactttgaacacgtaaacaaattcgttaactccattaacaagcccatggcagcggaaatagagggatctgactgcgagtgcaacccagctgggaagaatttcccagaaaatcagattctaataaagcgcatgatgataaaatgtgcagatgtcgctaatccatgcaggcccctggatctgtgcatcgagtgggccggcagaatctccgaggagtacttcgcccagacggatgaagagaagcggcaggggctgcccgtcgtgatgcccgtgttcgatagaaatacatgttccattcctaagtctcagattagcttcattgactatttcattacagacatgtttgatgcctgggacgcattcgcccacctcccggccttaatgcaacacctggcggacaactacaaacattggaaaactctggatgacctcaaatgcaagtctctacgactgccatcggattcgtag

SEQ ID NO: 128570 - DNA, 2367 bp, Artificial Sequence
  Description of Artificial Sequence: Synthetic coding sequence
atgggctgtgcaccttccatccatgtctcacaatcaggggtgatttactgtcgggacagcgatgagagctcatcgcctagacagaccacctctgtgtcccaggggccagcagcccctctcccaggcctgttcgtgcagacagatgctgctgacgccatccccccgtccagggcaagcgggccacccagtgtggcccgagttcgtcgcgcccggacagaactgggatccggaagctcagccggctccgcagcccctgctgcgacgacgagcaggggccgtaggagacactgctgttcttccgccgaagctgaaactcagacttgctataccagtgtgaagcaggtttcctcagccgaagttagaatcggaccaatgagactgacccaagacccaatccaggtgctcttgatcttcgcaaaggaggatagccagagcgacgggttttggtgggcctgtgacagagcaggctatagatgcaatatcgctagaacccccgagagtgccctcgagtgttttctcgataagcaccacgaaattatcgtcatcgaccacagacaaactcagaatttcgatgctgaggccgtgtgtagatctatccgcgcaactaaccccagcgagcacaccgtgatccttgcggtcgtgtctcgggttagtgacgaccacgaggaagcatccgtcttgcccctgctgcacgccggttttaataggcggtttatggagaatagctctataatagcatgctacaatgagctaatccagatcgagcacggcgaagtccgatcccagtttaagctgagagcttgcaacagtgtgtttacggcactcgaccactgtcacgaagcaatcgaaattacgagcgatgaccatgtgattcaaattcataagattcaccgtgactctggtgacaatagccagacggagccccatagctttaggtataagaatcggagaaaagagtccattgatgtgaaatctatcagctctcgcggctctgacgcaccttctctgcagaatcggagataccctagcatggcccggatccattccatgacgatagaggctcccatcaccaaggtgatcaatattataaacgcagctcaagagaattcgcctgtgacggttgccgaggcactggacagggtgctggagatcctacggaccacagagctgtacagtccacagctgggcaccaaagacgaggacccccacacgagcgaccttgttggtggactcatgacggacggactgcgcaggctatcagggaacgagtacgtgttcaccaaaaatgtacaccaatcacactcacatctcgcaatgcccataactatcaacgatgtgccaccatgtataagtcagctgctcgataacgaggagtcctgggacttcaacatttttgagcttgaggccatcacacataaacgaccccttgtgtatctagggctgaaagtattctcccggtttggggtttgtgaattcctcaactgtagtgagactaccctgcgcgcatggtttcaagtgatcgaagccaattaccacagtagcaatgcctaccacaatagcacccatgcagctgatgtacttcacgccaccgctttctttctaggcaaggagagggtaaagggatctcttgaccagttagacgaagtcgcagccttgattgccgctacagttcatgacgtcgaccatcctgggcgcaccaattctttcctgtgcaatgccggcagcgagctagcagtgctgtacaacgataccgcagtgctggagagccaccatactgccttggcttttcagcttaccgttaaggacactaagtgtaacatatttaagaacatcgaccgaaaccactatcgcactctccggcaggcaatcatcgacatggtgttggctacagaaatgaccaagcatttcgagcatgtgaacaagttcgttaattccattaataaacctatggcagcggagatcgaggggtcagactgtgagtgcaaccctgctgggaaaaacttcccagagaaccagattctcataaaaagaatgatgatcaagtgcgccgacgttgccaacccatgccgacctcttgatttgtgcattgagtgggctggcaggatttcagaggagtatttcgcccaaaccgatgaagagaagcgccagggattgccggtggtgatgccagtcttcgacagaaatacttgctctattccaaagtcccagatcagttttatcgattacttcattacagatatgttcgatgcctgggacgcattcgctcatttgcctgccctcatgcaacacctcgctgacaactacaaacactggaaaacactggatgatctgaaatgcaagagtctgaggcttccctcagactcctag

SEQ ID NO: 128571 - DNA, 1053 bp, Artificial Sequence
  Description of Artificial Sequence: Synthetic coding sequence
atgcccatcactattaacgatgtcccgccctgtatcagccaactgctggacaacgaggagagctgggatttcaatatcttcgagctagaggccataacacataaaaggcccttagtgtacctgggactaaaagtgttttccaggttcggcgtttgtgaatttctgaactgtagcgagactacgctgagggcatggtttcaggtgatcgaagcaaactaccattcatccaatgcctatcataactccacccacgctgccgacgtgttgcatgctacagccttcttcctgggaaaggagagggttaagggtagtttggatcagttagacgaagtggccgcgttaatcgccgcaaccgtgcacgatgtggaccatcctgggaggaccaactcattcctctgtaatgccggatccgagcttgccgtactgtataatgacaccgcagtcctggagtctcaccacaccgctctagccttccaactcactgtgaaggacacaaaatgcaatatttttaagaacatcgatagaaatcattacaggacattaaggcaggctataattgacatggtgctggcaaccgaaatgaccaagcacttcgagcacgtgaataaatttgtcaacagcataaataagcccatggcagccgagattgagggctctgactgcgaatgcaaccccgccggaaagaatttcccggagaaccagatcctaatcaaacggatgatgatcaagtgcgcggatgttgccaacccatgtagaccactggacctttgcattgaatgggcaggcaggatcagtgaggagtatttcgctcagacagatgaggagaaaagacaaggtctgcctgtggttatgccagtgtttgatagaaacacctgctcaatccccaaatcacagattagctttatcgattattttatcaccgacatgttcgatgcatgggatgcatttgcccatctcccagcactgatgcaacacctcgctgataactacaaacactggaagaccctcgatgacctgaaatgcaagtccttacgtctgccttccgactcttag

SEQ ID NO: 128572 - DNA, 1782 bp, Artificial Sequence
  Description of Artificial Sequence: Synthetic coding sequence
atgggctcaggctctagcagttacaggcccaaggccatctatctggacattgacggccggatccagaaagtgatcttttcaaaatattgcaactcctctgatatcatggacctcttttgcatcgccaccgggcttcccagaaatacaacgattagcctcctcacaaccgatgacgccatggtatccatcgaccctacaatgcctgccaactctgaaaggaccccctacaaagtgaggcccgtcgccataaagcaactatcggccggagtggaggacaagcgcaccacctccaggggccagtccgctgagagaccactgagagaccgacgcgtggtgggcttggagcagcctaggagggaaggagccttcgagtccggccaggttgagccgaggcctagagaaccacagggctgttatcaggaagggcagcggataccacccgaacgcgaagaactcatccagagtgtgcttgcccaagttgccgagcaattcagcagggccttcaaaataaacgagctcaaagcagaggtcgccaatcacctagctgtgctggagaagcgggtggaactggaagggcttaaggtggtggaaatcgagaagtgtaagtcagacattaaaaaaatgagagaagaactggccgcccgcagcagcagaaccaattgcccctgcaagtattcgttcctggataatcacaaaaagctcactcctcgccgcgacgttcctacttaccccaagtacctactatcccccgagaccattgaggcccttcgaaaacccacattcgacgtgtggctgtgggaaccgaatgagatgttatcttgccttgagcacatgtaccacgatctcggactggtgcgagacttctcaataaaccccgttaccctccgcaggtggctcttctgtgtgcacgataactaccgcaataatccattccacaacttcaggcattgtttttgcgtggcacaaatgatgtacagcatggtatggctctgctccctgcaggagaaatttagccaaaccgatattctcatattgatgactgcggctatttgccatgacctagatcaccccggctacaacaatacttaccagattaacgcacgcacggaacttgcagtgagatataacgacatcagtcctctcgaaaaccaccattgtgctgtggctttccagatccttgccgagcctgagtgcaatattttctccaacatccctccagacggcttcaagcaaattcgccaagggatgataacactgatcctggctacagacatggccagacacgcagaaattatggactcatttaaagaaaagatggagaatttcgactattctaacgaggaacacatgactctactgaaaatgattttaatcaaatgttgtgatatttctaacgaagtacgaccaatggaggtggcagaaccatgggttgattgcctgttggaagaatacttcatgcagtccgacagagagaaatcggaaggccttccagtggcgcccttcatggatagggataaagttaccaaggctaccgcccagatcggtttcatcaaatttgtactgatccccatgtttgagacagtcaccaagcttttcccaatggtggaggagatcatgctacagccactgtgggagagtagggatcgttacgaggagctaaaaaggattgacgacgcgatgaaggagctgcagaagaagacagacagcctgacaagcggcgctacagagaagtctcgtgaacgctcaagagatgtgaaaaactcagagggcgactgtgcttag

SEQ ID NO: 128573 - DNA, 1704 bp, Artificial Sequence
  Description of Artificial Sequence: Synthetic coding sequence
atgggctctgggtccagcagttacaggccaaaggctatctacttagacatagatggaagaatacaaaaggtcatatttagcaaatattgcaactcatccgacattatggacctcttctgcattgccacagggctgcccagaacgccttacaaggtgaggcctgttgcaattaagcaactgagcgctggcgtggaggacaaaaggaccacatcacgaggtcagtctgcggaaagaccactcagagaccgccgggtcgtcggactggagcagccaaggagagagggggctttcgagtccgggcaggtggagccaaggccacgcgaaccgcagggatgctaccaagagggtcaacggattcccccggagcgtgaggagctgattcagtcagttctggcccaggtggcagaacaattctctagagcatttaagatcaatgagctgaaggccgaggtagcaaaccacctcgcagtactcgaaaaaagagtagagttggaaggtctgaaagtcgtcgaaatagagaaatgtaagtctgatatcaagaagatgcgcgaggagcttgccgctcgctcatccagaacaaactgtccatgtaagtattctttcctagacaatcacaagaagttgacaccacggagggatgtacccacttaccctaaatacctgcttagtccagaaaccatagaggctctccgaaaacccactttcgacgtgtggctttgggagcccaatgagatgctcagctgcctagaacacatgtatcacgacctgggtttggtccgcgatttctctattaaccccgtaacacttaggagatggttattttgtgtgcatgacaactacagaaataaccctttccacaactttcgtcattgcttctgtgtggctcagatgatgtactcaatggtgtggctttgctctctccaggagaagttctcacagactgacattttgatcctgatgacggcagccatttgccacgatctggaccaccccgggtataacaatacctatcaaatcaatgcacggacagagcttgccgtccggtataatgacatctcgccactggagaatcaccattgcgcggtagctttccagattctggcagagcctgagtgcaacatattttcgaacatcccaccagatgggtttaagcagatccgccaggggatgattaccctgattctggccaccgatatggctagacacgctgagatcatggactcatttaaagaaaagatggagaacttcgactatagcaacgaggaacatatgaccctcctgaaaatgatcttgatcaaatgctgcgatatttctaatgaagtgagaccgatggaggtagccgaaccttgggtggattgccttcttgaagagtattttatgcagtctgatagggagaagagtgaggggctgccagttgcaccattcatggatagagacaaggtgacgaaggctacagcccagataggtttcattaagttcgttcttatcccaatgtttgagaccgtgacgaagttattccccatggtggaggagatcatgttacaacccctgtgggagtcacgagatcgatatgaagagctcaaaaggatagacgatgccatgaaagagctgcagaaaaagactgacagtctcaccagcggggccactgagaagagcagggaaaggagtcgagatgtaaaaaactctgaaggagattgtgcatag

SEQ ID NO: 128574 - DNA, 1476 bp, Artificial Sequence
  Description of Artificial Sequence: Synthetic coding sequence
atgggcagcggaagctcaagttacagaccaaaggccatttatcttgatatcgacgggcgaatccagaaggaacatgaccatctcccagcggaccacaggagacggcacggtttgcaccgcccacaccatgccagagaatttcggactcactccgtccagtcggaaacctgtggccatcaggccaccctccgggcatttaagataaacgagctcaaggccgaagttgctaaccacctggcagtactagaaaagagagtggaactggagggcctcaaagtggttgaaatcgaaaagtgcaagtcagatattaagaaaatgcgcgaagaactggcggcgaggagctcacgtacgaactgtccttgcaagtattcttttctggacaaccataaaaaacttaccccaagacgagatgtgcctacttatcccaaatatttgctgtccccggaaacaatcgaagctcttagaaagcccactttcgacgtgtggctgtgggagccaaatgaaatgctgagttgtttagaacatatgtatcacgacctcgggcttgtcagggatttctcaatcaaccctgtaaccctccgtcgttggttattttgcgtgcatgacaactatcgcaacaatccctttcataatttccgtcattgtttttgcgtggctcaaatgatgtacagtatggtctggctgtgtagcctgcaggagaagttttcacaaactgacattcttatcctcatgactgcagctatctgccacgatctcgaccatccgggctacaataatacataccagattaacgccagaactgaactggcagtcaggtacaatgacatttcccccttggagaatcatcactgtgccgtggcatttcagattttggcggagcccgagtgtaacattttctcaaacatccctccagacggattcaagcaaatacgccagggcatgattaccctgattctggccaccgacatggctaggcacgcggaaatcatggacagtttcaaggagaaaatggagaacttcgactattcgaatgaggaacacatgacccttctgaaaatgatcttgatcaaatgctgcgacatcagtaatgaggttcgaccaatggaggttgcagagccctgggttgactgtttactcgaggaatactttatgcagagcgatagagagaaatccgaaggtctgcctgtggcaccattcatggacagagacaaagttaccaaggctacagcccagatcgggtttataaagttcgtgctcattcccatgttcgagaccgttacaaagctcttccctatggtggaagaaatcatgctccagcctctctgggagagtagagaccggtacgaggagcttaaacggatcgacgatgcaatgaaggagctgcagaaaaagacggatagtctcacgtccggcgccaccgagaaatcacgcgaacgcagtcgggatgttaaaaattcagaaggagattgcgcctag

SEQ ID NO: 128575 - DNA, 1602 bp, Artificial Sequence
  Description of Artificial Sequence: Synthetic coding sequence
atgggaagcgggtcatcgagttacagacccaaagccatctacttagatatagacggccgtatccagaaagttatcttttcaaagtattgcaacagttctgacataatggatttattttgtattgcgactggcctcccccggaacacaaccatttccctgttaactaccgatgatgccatggtctctatcgatccaaccatgccagccaactcagaacggacaccctataaggtgcggcctgtggcaattaaacagctgtcagagcgtgaggaattaattcagtctgtgctcgcacaggttgcagaacagttttctcgggctttcaagattaatgagttaaaggccgaagttgctaaccatctcgccgtgctcgagaagcgtgttgagctggaggggctgaaggtcgtcgaaatcgagaaatgcaaatcagacattaaaaagatgagagaagagttggcagccagaagctcccgcacgaattgcccatgcaagtacagtttccttgacaatcataaaaaacttacaccacgacgggatgttcccacgtaccctaaatacctactgagccctgaaaccattgaagccctgcgcaagccaactttcgatgtgtggctgtgggaacccaatgaaatgttatcgtgtctggagcatatgtatcacgatctcggcctggtgagggacttttccatcaaccctgtcaccctaaggcgctggctgttctgcgttcacgacaattatcgtaataatcctttccataatttcagacactgcttttgtgtggcccaaatgatgtacagcatggtctggctgtgcagcttgcaggagaaattttcacagaccgacatactgatcttgatgactgccgccatctgtcatgatctggatcacccggggtataacaacacctatcaaatcaacgctcggacggagctcgcggtgcgttataacgacataagtccgttggaaaaccatcactgtgccgttgctttccaaattctggcggaacctgagtgtaacatcttctccaatattccacctgatggctttaagcagatccgacagggcatgatcacactcattctggctaccgacatggcacgccacgccgaaatcatggatagtttcaaagagaagatggagaactttgactatagtaatgaggagcatatgacgctcctgaaaatgatcttgattaaatgctgcgacatcagtaacgaggttagaccgatggaagtggccgagccttgggtggactgtcttttagaagagtacttcatgcagtcagatagggagaagagtgaaggactgcctgtcgctcctttcatggaccgagataaggtcactaaggcgaccgcccagatcggcttcatcaagtttgtgctcattcccatgttcgagaccgttaccaaactgttccctatggtggaggaaattatgctccagccactatgggagtctcgggatcgctacgaagagttgaaacgaattgatgacgctatgaaggaactgcagaagaaaacagactctctaacctctggtgccaccgagaagtcaagggagagaagtcgagatgtgaagaactccgagggagattgcgcctag

SEQ ID NO: 128576 - DNA, 1398 bp, Artificial Sequence
  Description of Artificial Sequence: Synthetic coding sequence
atggggtccggatcaagctcctacaggcctaaggcaatttatctggacatcgacggaagaatacagaagcactccgtccagtcagagacatgcggacaccaagctacgctcagggcatttaagatcaacgagctcaaggccgaagtggccaaccatctggcagtcctcgagaagagagtggaactggagggcctgaaggtcgtggagattgagaaatgcaaaagtgacatcaagaaaatgagggaggagttggccgcacgaagttcacgtaccaactgcccctgtaagtattcctttttggacaatcacaaaaagttgactccaaggcgcgatgtaccaacctatcccaagtacctgctctcacccgagaccatcgaggctcttcggaaacctacgtttgatgtctggttgtgggagccaaatgagatgctaagctgcctggaacatatgtaccatgacttaggcttggtcagggactttagtattaatccggtgactctcaggcggtggctgttttgcgtgcacgacaactaccggaataacccatttcacaattttcgtcattgcttttgcgtggcccagatgatgtactctatggtctggctttgcagcttgcaggagaaattctcgcagacagatattctcattctgatgactgctgcaatctgtcatgacctagaccatcctgggtataataacacatatcaaataaatgctcgcacggagctggcagtccgctacaatgatatttcccctctagagaaccatcactgtgcggtagcttttcaaattctggcagagcctgagtgcaatatcttctccaacattccccctgatggttttaagcaaataaggcaggggatgataacactgatcctcgccaccgacatggcaaggcacgcggagattatggattcgtttaaggagaagatggagaacttcgactattctaacgaggagcacatgactctgctgaagatgatcctgataaagtgttgtgacattagcaatgaagtgcgccccatggaagtcgccgagccatgggtcgactgccttctagaagagtacttcatgcaatcagaccgggagaaatctgagggcttgccagtagccccctttatggatagggacaaagtgaccaaggctactgcccagatcgggtttattaagtttgtccttattccaatgttcgagacagtgacaaaattatttccaatggtcgaggagataatgcttcagcctctctgggaaagccgtgaccgctatgaggaattgaaacgcatcgacgatgcaatgaaagagttacagaaaaagactgatagtctgacaagcggtgccaccgagaagagcagggaacgctctagggatgtcaagaactcagagggagactgcgcttag

SEQ ID NO: 128577 - DNA, 1623 bp, Artificial Sequence
  Description of Artificial Sequence: Synthetic coding sequence
atgggcagtgggtcatcgtcctaccgccccaaagccatctacctggacatcgatggacggattcaaaaagtcattttcagtaaatattgtaactcgagtgacatcatggatctcttttgtatcgcaactggacttcccagaaatacgactatttccctcctaacaaccgatgatgctatggtctcaatcgatccgactatgcccgcgaattccgaacggaacgagttgatcttgtacacttcgctgcgtaatctgcttttcctcccaagcaaagagagctgggcttcccatcaacatagcgtccagtcagaaacatgcggacatcaagccaccctgcgggcctttaagataaatgagctgaaggccgaagtggcaaatcacttggctgtgctcgagaaaagggttgagcttgaagggttaaaagtggtggagatcgagaaatgtaaaagcgatatcaaaaagatgcgggaggagcttgccgctcggtcatctaggacaaattgcccgtgcaagtactccttcctcgacaatcacaagaaactaacacccaggcgtgacgttcctacataccccaagtatctgctgagcccagaaacgatcgaggcattgcggaaacccacctttgacgtctggctatgggaaccgaacgagatgttgagttgtctggagcacatgtaccacgatctggggctggtgcgcgacttctctattaaccccgtgacactacggaggtggttgttctgcgtgcacgacaactacagaaacaatcctttccacaacttcagacactgcttctgcgtcgcccagatgatgtattccatggtgtggctatgcagcctgcaagagaaattctctcagacggacatccttatactgatgaccgccgctatttgtcatgacctcgatcacccaggctataacaacacttaccagattaacgcgaggaccgagttggctgtgaggtacaatgacatcagccctctcgaaaaccaccattgcgccgtggcattccagatcttggccgagcccgagtgcaacattttctccaatatcccaccagatggcttcaagcagatacgccagggtatgattactctgatactggctaccgacatggcaagacacgccgagattatggacagttttaaagaaaagatggagaacttcgactactcaaacgaagagcatatgactctcctgaagatgatactgattaaatgttgcgacatctccaatgaggtccgtcccatggaggttgccgagccctgggtggattgtcttctggaggagtactttatgcagtctgatagggaaaagagcgagggtctccctgtcgctccattcatggatcgggataaggtgactaaagcaacagcccagatcggctttattaaatttgtattaatccctatgtttgagacggttacgaaactctttcccatggtcgaggagatcatgctgcagcccctgtgggaaagtagagatcgctacgaggagctgaagaggatcgatgatgctatgaaagagctccagaaaaagactgattctctgacatccggcgccaccgagaagagcagggaaagatctagagacgttaagaacagtgagggagattgcgcttag

SEQ ID NO: 128578 - DNA, 1401 bp, Artificial Sequence
  Description of Artificial Sequence: Synthetic coding sequence
atggatgccttcagaagcaccccctacaaagtgagaccagtagccatcaaacaactcagcgagagggaggagctgattcagagcgttctcgctcaggtggccgagcagtttagccgggcgttcaagattaacgagttgaaggcggaggttgccaaccacttggctgtgctggaaaaacgagtggaacttgagggtctgaaggttgtcgaaatcgagaagtgcaaatccgacatcaagaagatgagagaagaactggccgcaagaagttcacgcacaaattgtccctgcaaatatagctttcttgacaatcataaaaaactcacgccccgaagggacgttcccacctacccgaaatacctgctatcaccggaaactattgaagcccttcgcaaaccaacgttcgacgtctggttatgggaacccaacgagatgctgtcttgtctggagcatatgtatcacgatttgggtctagtccgggattttagcattaatcccgtgacactgcgaaggtggttgttctgtgttcatgacaattaccgcaacaacccgtttcacaacttccgacattgcttttgcgtggcacagatgatgtactccatggtatggctgtgtagcctccaggagaagttctctcagacggatatcctgatactgatgacagctgctatctgtcacgacttggatcatccgggatacaacaacacttaccaaattaacgcccgcaccgagctggccgtacgatacaacgatatttcccccctggagaatcaccactgtgctgtcgcttttcagatactggcagagcctgaatgtaacatattcagtaacatcccccccgacgggtttaagcagataagacaaggaatgatcaccctgatcctggccacagacatggcgagacacgcggagattatggattcctttaaagagaaaatggagaacttcgattatagcaacgaagagcacatgaccctactgaagatgatcctaatcaaatgctgcgacatttctaacgaggtgagacccatggaagtagctgagccgtgggtggattgtttgttagaagagtactttatgcaaagtgatagagaaaaatccgaggggttacccgtagccccgtttatggatcgcgacaaggtgactaaggccacggcacagatcggctttatcaaattcgtactgatccctatgttcgagaccgtgaccaagctgttcccaatggtcgaggagatcatgcttcagccgctctgggaatcacgcgatcgttacgaggaactcaagagaatcgacgacgcgatgaaagagctgcagaagaaaacagattccctgacctctggggcaactgagaaatcccgcgagagaagccgagacgtcaagaatagcgaaggcgactgtgcctag

SEQ ID NO: 128579 - DNA, 1659 bp, Artificial Sequence
  Description of Artificial Sequence: Synthetic coding sequence
atggatgcatttcggcggaatacaacaatttcactactgaccaccgacgatgccatggtatcgattgaccctaccatgcccgcaaattccgagcggacaccttataaagtgcgaccagtggctatcaagcagttgtctgctggggtggaagataagcgcaccacaagccgcggccagtcagccgagaggccattgcgtgacagacgcgtagtcgggctggagcagccccgaagagagggggcctttgaatccggccaggtcgagcctagaccgagagagccgcaggggtgttatcaagaaggccagagaatacctccggaacgcgaggagttgatccagagtgttctggctcaagtagcggaacagttttctcgggcatttaagatcaatgagctcaaggctgaggtggctaatcatcttgccgtcttagaaaaacgtgtcgaattggaaggcctgaaagtggtggagattgagaaatgcaaatccgacattaaaaagatgcgcgaagaactcgcggccagatcatcaagaaccaactgtccttgtaagtatagcttcctggacaaccataagaaattaactccaagacgggacgtgcccacatacccaaagtatctcctgtctcccgaaactatagaggccctgcggaaacctacctttgatgtatggctgtgggagcctaacgaaatgctatcatgcctcgaacacatgtaccatgatctaggacttgttcgcgatttttctatcaatccggtcacactgaggcgctggctattttgcgtgcacgataattaccgcaacaacccgtttcataacttccggcactgcttttgtgtggcacagatgatgtatagcatggtgtggctgtgcagcctgcaggagaagtttagtcagacggacatactaatactcatgacagccgctatatgtcatgatctcgaccacccagggtataataatacatatcagattaacgcacggacagagctcgcggtgcgttacaatgatatctcccccctggaaaatcatcactgcgctgttgcctttcagatattagccgaacctgagtgcaacatctttagtaacattcctcctgacggatttaagcaaatcaggcagggtatgatcacgctgatactggccactgacatggcccgccatgctgagatcatggattcatttaaggaaaagatggaaaattttgattattcaaacgaggaacatatgacgctgcttaaaatgattttaataaagtgctgtgacatcagcaacgaagtgagacccatggaagtcgccgaaccatgggtcgactgcctgctggaggagtactttatgcagtcagacagggagaagagcgaaggactaccggtcgcccctttcatggacagagataaggttactaaggccaccgctcagatcggctttatcaaatttgtcctcatcccaatgttcgaaacagtcaccaaactatttcccatggtagaagagatcatgctgcagccgctctgggaaagtcgggacagatacgaagagctcaaaagaatcgacgacgccatgaaggagctccagaagaaaacggattccctgactagtggggccactgagaaatctcgcgaacgatcgcgtgatgtcaagaactcagagggggattgcgcctag

SEQ ID NO: 128580 - DNA, 1302 bp, Artificial Sequence
  Description of Artificial Sequence: Synthetic coding sequence
atggacgccttcagacgggcctttaagatcaacgaattaaaagcagaagttgccaatcatctggcagtgctcgagaaacgtgtggaattggagggcctcaaggttgttgagatcgagaagtgtaagagcgatattaagaaaatgagagaggaactggcagccaggtcctcccggacaaattgcccttgtaaatattccttcttggacaaccacaagaagcttacgcctaggagggacgtgcctacttaccctaagtacttgctgagtccagagacaatcgaggcgctgcgcaaacctaccttcgacgtttggctgtgggagcccaatgagatgcttagctgtctggaacacatgtaccatgatctcgggctcgtgcgagacttctcgatcaaccctgtaaccctgcggcggtggttgttctgtgtacacgacaactacagaaacaatccatttcacaacttccggcattgcttttgcgttgctcagatgatgtactctatggtgtggctgtgtagcctccaagaaaaattctcccagaccgatattctcattctcatgaccgctgccatctgtcacgatctggatcatcccgggtacaacaatacgtatcaaatcaatgctagaacagaactggctgtcagatacaacgatatctcaccgttggaaaatcatcattgtgcagttgcgttccaaatcctggcggaacccgagtgtaacatcttttcgaatattccacccgatggattcaagcagatccgtcagggcatgatcacactcatcctcgctaccgacatggctcggcatgcagaaatcatggatagttttaaggagaagatggagaacttcgactactccaacgaggaacatatgactttgctgaagatgatcctgattaagtgctgcgacatctcgaatgaggttaggccaatggaggtggccgagccctgggttgactgcctgctggaagaatactttatgcagtcggaccgggagaaaagtgaagggttgcctgtggcccctttcatggacagagacaaggttacaaaggccaccgcacagatcgggtttattaagtttgtcctcatccctatgtttgagacagtgacgaagctgttccccatggttgaagaaattatgttacagcccttatgggagtcaagggatcgctatgaagaactcaaacgcattgacgacgcgatgaaagaattgcagaagaaaaccgatagcttgacctccggagccactgaaaagagtcgcgaacgttctagagacgtgaagaattcagaaggcgattgcgcctag

SEQ ID NO: 128581 - DNA, 1380 bp, Artificial Sequence
  Description of Artificial Sequence: Synthetic coding sequence
atggacgcgttccgtcgtaacacgacaatctcactgctgacgaccgatgacgcaatggtgtccatcgatcccaccatgccagcaaactcagagcgcgcattcaaaattaacgaattgaaggccgaagtggcgaaccacctcgctgttctggaaaaacgcgtggagcttgaaggcttaaaagttgtggaaattgaaaagtgcaaaagcgatattaagaagatgagggaagagctagccgctagaagttcacgaacgaattgtccatgtaagtacagcttcctcgacaaccataaaaagcttaccccaaggagagatgtcccgacttaccccaagtacctgctgtcaccggagaccatagaggccctgcgaaagcccacgttcgacgtttggctttgggagccgaacgagatgttatcctgtcttgagcatatgtatcacgatctgggtcttgtcagggacttcagtataaacccggtgacactgaggcgctggttgttttgcgtgcacgacaactacaggaataacccattccataatttcagacattgcttctgtgtggcccaaatgatgtactctatggtgtggctctgctcgctccaagagaaatttagccaaacggatatcctgatcctcatgaccgcggccatatgccacgacctggatcatcccggttataataatacctaccagatcaacgcccggactgaactggcagttcggtataacgacatttcgccattggagaatcaccactgcgcagtggcctttcagattctggccgagcctgaatgtaatattttttcaaacattccgcctgatgggtttaagcagattcgacagggtatgataacactcattcttgctaccgatatggctcggcacgccgaaattatggactccttcaaggaaaaaatggagaatttcgactatagcaacgaggagcacatgacactgctgaaaatgatactcatcaagtgctgcgatatttcaaatgaagttaggcccatggaggtggcagagccctgggtggattgcctgctggaagagtacttcatgcagtccgaccgcgagaaatcggagggtttgcctgtggctccttttatggatcgtgataaggtgaccaaagcaaccgctcagattggatttattaagttcgtgcttatccccatgtttgaaactgtgactaagctcttcccaatggtcgaagagataatgctgcagcccttatgggagtcaagggataggtatgaagaactgaaacgaatcgacgatgcaatgaaggagctccagaagaaaaccgattccctcaccagtggggcgactgagaagagtcgggagaggtctagagatgtgaaaaattccgagggagattgtgcctag

SEQ ID NO: 128582 - DNA, 1581 bp, Artificial Sequence
  Description of Artificial Sequence: Synthetic coding sequence
atggatgcgttcagatctaccccctacaaggtgcgccctgtcgctattaagcagctgagtgccggcgtggaggataagaggactacctcccggggccagtcagctgagcgacctttgcgtgatagacgtgtcgttggacttgaacagccacggcgagaaggtgctttcgaaagtggtcaggtggaacctaggccacgcgaaccacaaggctgttaccaagaggggcagcgcataccccccgaacgcgaagaacttatacagagtgtcctggcacaggtcgctgaacaattctcacgcgcattcaagatcaacgagctcaaagctgaggtcgcgaatcacctggccgtcttggagaaacgggtggaattagagggactgaaggtcgttgaaatcgagaagtgcaagtctgatataaagaaaatgcgcgaggagcttgccgctcgcagtagccgaacgaattgtccctgcaagtatagcttcctggacaaccacaaaaaattgactccccgtcgcgacgtgccgacttaccccaagtatctcctgagcccagaaactatagaggcacttcggaagcctacgttcgatgtgtggctgtgggaacctaacgagatgctgagctgcctggagcacatgtaccatgacttggggcttgtcagggactttagcattaaccctgtgactctgcgtagatggctattttgtgtgcacgacaactataggaacaacccatttcataattttaggcattgcttctgcgtggcccagatgatgtactccatggtttggttgtgttcactccaagaaaaatttagccagacggacatacttatcctgatgactgctgctatctgccacgacctggaccaccccggatataacaacacctatcaaattaacgcccggaccgagctggccgtcagatacaatgatatctccccgttagagaaccaccattgcgcagtcgccttccagatcctggctgaaccagaatgtaacattttctctaacatccctcccgacggctttaaacagatccggcagggaatgatcaccttgatcctggcaaccgacatggcccggcatgccgagataatggatagcttcaaggaaaagatggaaaactttgactacagcaacgaagaacatatgaccctacttaagatgatcctgattaaatgctgcgatatcagcaatgaggttcgccctatggaggtggccgagccgtgggtcgattgtttactagaagagtacttcatgcaatcggatcgcgaaaaatccgaagggcttcctgtggcacccttcatggacagagataaagtcaccaaagctactgcacagattgggttcatcaagttcgtacttatacctatgttcgagacagtgaccaaactttttcctatggtggaagagatcatgctgcagccactgtgggaatcccgagataggtacgaggagttgaagagaattgacgatgcaatgaaggaacttcagaaaaaaaccgacagtctgacttcaggcgccacagaaaagagtcgcgaacggtctagggatgtgaaaaatagcgaaggcgactgcgcatag

SEQ ID NO: 128583 - DNA, 1479 bp, Artificial Sequence
  Description of Artificial Sequence: Synthetic coding sequence
atggacgcatttcggagaaatacgacaatctctttgctaacgactgatgacgcgatggtgagtatcgacccaactatgcctgcgaactctgaacggaccccatacaaagtaaggcctgtagccatcaagcagttaagcgagcgggaggagctcattcagtctgtgctcgcgcaagtggccgaacagtttagccgagcattcaagattaacgagctgaaggcagaggtggccaaccacctcgctgtgctggagaagcgggtcgaactggagggcctgaaagtcgtggaaatcgagaaatgtaaatctgatatcaagaagatgcgcgaagagctcgctgcacgaagctctagaaccaactgcccttgtaagtatagtttcttagacaatcataaaaaacttactcctcgccgcgatgttccgacctatcctaaatatctgctatcccccgaaacaattgaggcactgcggaaaccaacgtttgacgtgtggctgtgggagccaaatgagatgctgagctgtctcgaacatatgtaccatgacctcgggcttgttcgcgactttagcataaatcctgtcactcttcgtagatggctgttttgtgtgcacgacaactacagaaacaatccttttcataatttccgccactgcttctgtgtagcacagatgatgtacagcatggtgtggctctgcagtctccaggaaaagtttagccaaacagacatactcattctgatgaccgccgccatttgccatgatctagatcatcccgggtacaataatacataccaaatcaacgccagaacggagttagccgtccgatacaacgacatctcacctcttgaaaatcatcattgcgcagtggcctttcagatcctcgccgaacccgaatgcaacatctttagtaatatacctcccgatggcttcaaacagattcgacagggaatgattacactgattcttgcaacggatatggcccgacacgccgagatcatggattcatttaaagaaaaaatggagaactttgattatagcaacgaggagcacatgacactgctgaaaatgatcctaattaaatgttgtgacattagtaacgaagtgcggcccatggaagtggccgagccatgggtggattgcctactggaggaatacttcatgcagagcgacagggagaagtcagaaggtttgcccgtggcccctttcatggaccgcgataaggtgactaaggccacggcccagattggatttattaagttcgtactaattcccatgtttgaaacagtgactaagctgtttccaatggtggaggagattatgctccagcccctgtgggaatctagggatcgttatgaggagctcaagagaatcgacgacgccatgaaagagctgcagaagaagacagatagtctgacctctggtgccacagagaaatcgagggaaagatcccgtgatgtgaagaatagcgaaggcgattgtgcctag

SEQ ID NO: 128584 - DNA, 1524 bp, Artificial Sequence
  Description of Artificial Sequence: Synthetic coding sequence
atgggttcaggttcgtcctcctatagacccaaggcaatctacctggatattgacgggaggattcagaaagtcattttctctaagtactgtaatagttccgacattatggatctcttctgcatcgccaccggcctgccccggactccttacaaggttcgccccgtggcaattaagcagttatcagaaagggaggagctgattcagtctgtgctagctcaggttgccgagcagttttcacgcgcttttaagataaacgaactgaaagctgaggtggctaatcaccttgccgtgctggagaagagggtggagctggaagggctgaaagtggttgagatcgagaagtgtaagtcggacatcaaaaagatgcgcgaagagctggccgcaaggagcagcaggactaattgtccttgcaagtactcttttttagataaccataagaaactgacccctagacgcgacgtacccacgtatccaaagtacctcctgagtcctgagactattgaggcgttgcgaaaacccaccttcgatgtctggctgtgggagcccaacgagatgctatcctgtctagaacatatgtaccacgacttggggctggtacgcgacttcagcatcaatcccgtgactcttcggagatggttgttctgcgttcatgacaattatagaaataaccccttccacaactttcgccattgtttttgcgtggcccagatgatgtactctatggtttggctgtgctccttgcaggagaaatttagccagaccgacatcttaatcctgatgaccgccgctatctgtcatgatctggaccaccctggatacaacaacacatatcagataaacgcaaggaccgagctggccgtgaggtacaatgatatctccccgctggaaaatcaccattgtgcagtcgcttttcagatcctcgccgaacctgaatgcaatatattcagtaacatccccccggatgggtttaaacagattagacaaggcatgatcacgctgattcttgccacggatatggcccggcatgcggagattatggacagtttcaaagagaaaatggagaacttcgactactctaacgaggaacacatgactcttctgaagatgatccttatcaaatgttgcgacatatcgaatgaagtcagaccgatggaggtggccgaaccctgggtggactgcttactggaagaatactttatgcagtcggacagggagaaatccgaagggcttcctgtggccccctttatggaccgcgacaaggtgactaaggcaacagctcagatcgggttcataaagttcgttcttataccaatgttcgagactgtgactaaacttttcccgatggttgaagagattatgctacagccgctttgggaaagccgcgataggtatgaagagctcaagcggatcgacgatgctatgaaagaattgcagaaaaaaaccgactcgctgacaagcggtgccaccgagaaatctagggaacgctccagggacgtgaaaaactctgaaggcgactgtgcttag

SEQ ID NO: 128585 - DNA, 1398 bp, Artificial Sequence
  Description of Artificial Sequence: Synthetic coding sequence
atggatctgttctgcatcgccaccggacttccgagaaatacaaccatctctttgctgaccaccgacgatgccatggttagcattgaccccaccatgcctgccaacagcgagcgcgccttcaaaattaatgagttgaaggcagaggtggccaatcatttagcagtgctcgagaagagagttgaactcgaaggtctcaaggtggtggagattgagaaatgcaaatccgacattaagaagatgcgcgaggaactcgcagcaaggtcttctcgcacgaactgcccttgcaaatactctttcctcgataaccacaaaaaactgactcctcgaagagacgtccctacctaccctaaatacctcttaagccccgagaccattgaggcgctccggaaaccaactttcgatgtctggttatgggaaccgaacgagatgctgtcatgcttggagcatatgtatcatgatcttggtctggttcgtgacttctcgatcaacccggtgactctgagacgttggcttttctgcgtgcacgataattatagaaataacccgtttcacaacttcaggcactgtttctgcgtggctcaaatgatgtacagtatggtgtggttatgctcactccaggagaagtttagccagacagacatattaatcttgatgacagccgccatttgccacgacctggatcaccctggctacaacaatacttatcagatcaatgcacgtacggagcttgcagtgagatacaatgatatttcccctctggaaaatcaccattgcgccgtggctttccagattctagccgaaccggagtgtaacatcttcagcaatatccctcccgacgggtttaagcagattcgtcaaggcatgattacactgattttagccacagacatggcccggcacgccgagattatggattcattcaaagagaaaatggagaactttgactactctaatgaggaacatatgactctgctgaaaatgatcctgattaaatgctgtgacatttccaacgaggttagacctatggaagtcgctgagccatgggtggactgtctcctggaggagtattttatgcagtcagatagggagaagagtgaaggtttaccggtcgccccattcatggaccgcgacaaggtgacaaaggcaaccgcacaaatcggcttcatcaagttcgttcttattccaatgtttgaaaccgtgacgaagttgttccccatggtggaggaaatcatgctgcagcccctctgggaaagccgggatcggtatgaagaactgaaacgtatcgacgacgctatgaaggagctgcagaagaagacggatagcttgactagcggtgccacagaaaagtctagagagagaagcagggatgtgaaaaacagtgagggcgactgcgcttag

SEQ ID NO: 128586 - DNA, 1869 bp, Artificial Sequence
  Description of Artificial Sequence: Synthetic coding sequence
atgccgcctcagctgcagaacggccttaatctgtccgccaaagtggtgcaggggtccctggattcactgccacaagccgtacgggaattcctggagaacaatgcggagttgtgtcagccagatcatatacacatctgcgatgggtcagaagaggagaacggacggctgctggggcagatggaggaagagggcatcctccggcgtctgaagaagtacgacaattgctggctggccctaactgatcccagagatgtcgcgcgcatcgaatccaaaacagtgatcgtcacgcaggagcagagggacactgtgcccatcccaaagacagggctgtctcagttgggccgctggatgagcgaagaagatttcgaaaaggcattcaacgcacgttttcccggatgcatgaaggggcgcaccatgtatgtcattccctttagtatgggcccgctgggatcacccctctccaagattggtattgagctgaccgacagtccgtacgttgtcgccagtatgcggatcatgactcggatggggacgccagttttggaggcagtcggggatggagagtttgtgaagtgtttacactccgtgggatgtccactgcctttgcaaaagccactggtgaacaactggccctgcaaccctgagcttacgcttattgcccacttacccgaccgccgcgaaattatctccttcgggtccgggtatgggggcaactctcttttaggaaagaagtgctttgccctgagaatggcctcacggttggcaaaagaggaaggctggcttgccgaacacatgctgattctgggtatcacaaaccccgagggggaaaagaaatatttagctgcagcctttccctcagcttgcgggaaaacaaacctggcaatgatgaacccaagccttccgggctggaaggtggagtgcgtgggagatgacattgcctggatgaagtttgacgcccaaggacacctgagggccattaatcccgagaacggcttcttcggcgtggcccctgggacttcagttaaaaccaatcccaatgccataaagaccattcaaaagaacaccattttcactaatgtggcggagaccagtgacgggggggtgtattgggaggggatcgacgagccgctggcttctggagtgacaattaccagttggaaaaacaaggaatggtctagcgaggatggagaaccttgcgcacaccctaattctagattctgcactcctgcctcccaatgtccaatcattgacgcggcctgggagagccccgagggggtgccgatagagggcataatattcggaggcaggcggcctgccggagtgccacttgtatatgaggcgctgagctggcaacacggcgttttcgtgggggcggccatgagaagtgaagccaccgccgccgccgaacacaagggtaaaattattatgcacgatcccttcgccatgcggcctttcttcggctacaactttggtaagtatcttgcacactggctgagcatggctcagcatccagcagcgaaactgcctaagatcttccatgtaaactggtttagaaaagataaagaaggaaagtttctatggcctggatttggagagaatagcagggttttggagtggatgttcaaccgcatagacgggaaggcatcaacaaaactcaccccaatcggttatatacctaaggaagatgcactgaacctcaaaggtctcggacatataaatatgatggagctcttctcaatctctaaagaattctgggaaaaggaagtcgaagatatcgaaaagtacctggaagatcaagtgaatgccgacctgccctgcgaaattgagcgagagatacttgccctgaaacagagaataagccagatgtag

SEQ ID NO: 128587 - DNA, 942 bp, Artificial Sequence
  Description of Artificial Sequence: Synthetic coding sequence
atgaccacggggaggacaatgtacgtgataccattttccatgggccccctggggtctcctttgtccaagatcggaatcgagttaacagatagcccctatgtcgtggcatcaatgaggattatgacacgtatgggcacacccgtccttgaggctgttggggatggggaattcgtgaagtgcctgcattccgtggggtgtcctctgcccctccaaaagccactcgtcaacaattggccctgtaacccggagcttactctgattgcacatctccccgacagacgggagatcatttcattcgggtctggatacggcggtaatagcctgctgggaaagaaatgcttcgccctccggatggcatcccggctagccaaagaggagggatggctagccgaacatatgctaattctgggaattactaatcccgagggcgaaaagaaatatctagccgccgcttttccaagcgcctgcggcaaaacaaacctggctatgatgaacccttccttacctgggtggaaagttgaatgcgtgggagacgacattgcctggatgaaattcgatgctcagggacacttacgagctataaatcccgaaaacgggttcttcggggtggctccaggcacttctgtcaaaacgaaccccaacgcaatcaaaaccattcagaaaaataccatctttacaaacgttgccgagacatctgacgggggggtgtactgggagggtatcgacgagcctttagctagcggtgtgaccattacgtcatggaaaaacaaagagtggtcgtcagaagatggggtttccttaccagaggccctggtatgcagagcagctgggaccgcctgcctgagccaggcgcttacatccctctcactcagctacagggggaccctctgcccgccgcaactcgaggtcctgcatccttgtcaaccagtgcctcaccattag

SEQ ID NO: 128588 - DNA, 915 bp, Artificial Sequence
  Description of Artificial Sequence: Synthetic coding sequence
accacgggtcatctgcgggctataaaccccgagaacgggtttttcggtgtcgccccagggacctcagtgaagactaatcctaacgcaataaaaaccattcaaaagaataccatctttacaaatgttgccgagaccagtgatggtggtgtatattgggagggcatcgacgaaccactcgcctccggagtcaccataacctcttggaagaacaaagaatggagtagcgaagacggtgaaccctgcgcccaccccaattctcggttctgtaccccagcttctcagtgtccaataattgacgccgcatgggagtcgcctgagggcgtcccaattgagggtattattttcggcggtaggaggcccgctggcgttcccctcgtgtacgaagctctgagttggcagcatggcgtcttcgttggtgccgcaatgaggtccgaggctacagccgctgctgagcacaagggaaaaattattatgcacgatccctttgccatgagacctttctttgggtacaacttcggtaaatacctggcacactggctgagcatggctcagcatcctgccgccaagctccccaagattttccacgtgaattggttccgtaaggataaagaaggcaagttcctttggcccgggttcggtgagaacagcagggtattggaatggatgttcaataggatcgacggaaaggcttcaacaaagcttacgcccatcgggtacataccaaaagaagacgccttgaatctcaagggcttgggccatatcaacatgatggagctattcagcatctctaaagagttctgggaaaaggaagtggaggatatcgaaaagtacttagaggaccaggttaatgcagacctgccttgcgagattgaacgggagattctggcgctgaaacagcgaattagccagatgtag

SEQ ID NO: 128589 - DNA, 918 bp, Artificial Sequence
  Description of Artificial Sequence: Synthetic coding sequence
atgacgactgggcacctgagagccattaatcctgagaacgggttcttcggagtagcacctggcacatctgtgaagacgaatccaaacgctatcaagactattcagaaaaacaccatatttacgaacgtagcggagactagtgacggtggtgtgtactgggaaggaatcgatgaaccactggcatccggtgtcacgattactagttggaagaacaaggaatggagttccgaagatggcgagccctgtgcccatccaaactcaaggttttgcacccccgccagtcagtgcccgataatcgatgcagcctgggaatccccggaaggagttcccattgaaggtatcatttttgggggtcgccgacccgccggcgtgcctctggtctacgaagcattgtcctggcaacatggtgtgttcgttggtgctgccatgagaagtgaagctactgctgccgcagagcacaagggtaagatcataatgcacgacccgtttgctatgcgccccttctttggctacaacttcgggaagtatctcgcccactggctcagtatggcccagcaccctgcagctaagctgccgaagatattccacgttaactggtttcgaaaagataaagagggaaagtttctgtggcctggcttcggggaaaacagccgagttctagaatggatgttcaatcgtatcgatggtaaggcctccaccaagctgactcccattggctacatcccgaaggaggacgccctcaacctcaaaggccttgggcatattaacatgatggagctcttttccatctccaaagaattttgggagaaagaagtggaagacatcgagaaatacttggaggaccaggtgaacgctgacttaccctgcgagattgagcgagagattttagctctgaaacagcgcatctcccagatgtag

SEQ ID NO: 128590 - DNA, 1674 bp, Artificial Sequence
  Description of Artificial Sequence: Synthetic coding sequence
atgtcagaccctgagatgggctgggtcccggagccccctaccatgacgctgggcgctagcagagtagagctgcgggtgtcctgtcatggcctattggatcgggacactctgactaaacctcacccctgcgttttactcaagctgtactctgacgagcaatgggtggaggttgagaggaccgaagtccttcggtcctgctcgagtcccgttttctcaagggtccttgctttggaatatttcttcgaagagaagcagcctttacagttccatgtgtttgatgctgaggatggcgcgacctcgccccgcaacgacacattcttggggtcaacagagtgtactctcggccagattgttagccagaccaaggtaaccaaaccactcctgcttaagaatggaaagacagctggcaagagcactataactatagtggccgaggaagtgagcggtaccaacgattacgtgcagttgaccttccgggcttacaaactggacaacaaagatctgttttccaagagtgatccctttatggagatttataagacaaacgaggatcaatcagaccaactcgtgtggcgcacagaggtggtgaaaaacaatcttaacccttcttgggaaccattccggctcagcctgcacagcttatgttcttgcgacgttcaccggccacttaagtttctggtgtacgactacgacagttctggaaagcacgacttcattggagaattcactagcaccttccaggaaatgcaggaaggcaccgcgaaccctggccaggagatgcaatgggattgcatcaaccccaagtacagggataaaaagaagaactacaaatcctctggcacagtagtcctggcacagtgcacagtggagaaggtgcacacatttttggattacatcatgggtggatgccagatctcctttactgtggcaatcgacttcactgccagtaacggcgacccaagatcaagtcagagtctgcactgtctgtccccaaggcagccaaaccactacttacaagcgttgcgagcggttggcggtatttgccaggactatgattcagacaaaaggttcccagcattcggttttggcgccagaattcctcccaacttcgaagtttctcacgactttgcaattaattttgaccctgagaatccggagtgtgaggaaatttcgggagtaattgcttcttaccgtcgctgtctgccccagatccagctctacggacccaccaacgtggcacccataataaacagggtcgcagagccggcgcagagagaacagtcaacaggccaagccacaaagtatagcgtccttctggttcttacagacggcgtggtgtccgacatggcagagactaggaccgcaatcgttcgagcttctcgtctgcccatgtctataatcattgtgggagtcggcaacgccgatttctccgatatgcggctcctggacggcgacgatggaccacttcgttgccctcgcggcgtacccgcggcgagagacatcgtacaattcgtacctttcagagactttaaggatgctgctccctccgccttggctaaatgcgtcttggcggaagttccacgtcaggtcgtcgagtactatgcctctcaggggatttcccccggggcgccacggccttgcaccttagccacgaccccatctccctcaccgtag

SEQ ID NO: 128591 - DNA, 1326 bp, Artificial Sequence
  Description of Artificial Sequence: Synthetic coding sequence
atggccgctctatatcgccctggcctgagactcaactggcacggcctgtcaccactgggctggccaagttgccggtcgattcagacccttagggtactttccggagacttaggccagctgccgacagggattcgggatttcgttgagcatagcgcaagattgtgtcagcccgaggggattcacatctgtgatggaaccgaggcagagaatacagccacactaacactgctggaacagcagggcctcatccgcaaacttcctaaatataataattgttggctggctagaacagatcctaaggatgtggccagagtggaaagcaaaactgtgatcgtaactccgtcacaacgggacaccgtgcagctcccgcctggaggggcaaggggacaactggggaattggatgtcccccgccgattttcagcgggccgtggacgaacggttccccgggtgcatgcaagggcggacaatgtacgtgttgccttttagtatggggcctgtcggttctcctctgtcccgtatcggggtccagctgacagactccgcctacgtcgtggcatccatgcgcattatgacacggctggggacgcccgtcctccaggcactgggagacggcgactttgtcaaatgcctccacagcgtgggccagcctctgactggccaaggagagcccgtgtcccaatggccttgtaatccggagaagactctgatcggtcacgtgcccgaccaacgcgagatcataagcttcgggtctgggtatggcggaaactctcttctcggaaagaagtgtttcgcacttagaatcgcttcgcgccttgcccgggacgagggatggctggccgaacacatgctgattcttggcattaccagtcccgctggaaagaaaaggtatgtcgcagctgcatttccctcagcctgtggtaagaccaacctcgctatgatgagaccagctctgcctggatggaaggtggaatgcgtgggggatgacatagcatggatgcggtttgactcagaggggcgattgcgggcaattaatccagaaaatggctttttcggcgttgccccaggcaccagcgctacaacaaaccccaacgccatggctacaatccaaagcaacaccatctttaccaacgtggctgaaacatcagatggtggagtgtactgggagggcatcgaccagcctctacctcctggtgtaacggttacatcgtggttgggcaagccatggaaaccgggcatgtgcggcggtgaaggagtggcccagcccccaggtctgtccacgttgatggtggagaagctttcaccacagcccccgaccattttctag

SEQ ID NO: 128592 - DNA, 1521 bp, Artificial Sequence
  Description of Artificial Sequence: Synthetic coding sequence
atgagccctgccgacttccagagggccgtggacgaaagatttcccgggtgtatgcaggggcgaacaatgtatgtgctcccatttagcatgggcccagtcggttctcctcttagcagaattggcgtccagctgacggacagtgcctatgtggtcgcttcaatgagaatcatgacccgcctggggacccctgtactccaggctctgggagacggagacttcgtgaaatgcctgcacagcgtaggccagcccctcacagggcagggcgaaccagtgtctcagtggccctgcaaccctgaaaagaccctgattggccatgttcccgaccaacgtgaaatcatatccttcggttccggctacggaggcaacagtttactagggaagaagtgctttgccctaagaatagcctcccgactcgctagggacgagggctggctggctgagcacatgctcattttaggcataacgtcccccgctggaaagaaacggtacgtggccgctgcctttccaagcgcttgcgggaaaactaacttagccatgatgagaccagccttaccaggatggaaagtggaatgtgttggggacgacattgcgtggatgcgctttgattctgaaggccggctccgggccatcaatcccgaaaacggattttttggggtggcgccagggactagcgctacaacgaatccaaacgccatggctaccatccagtcgaacactatcttcactaatgtcgccgaaacatcagatggaggagtgtactgggagggcatcgaccagcctttgcccccaggggtcacggttacctcatggctgggcaagccatggaaaccgggcgacaaggagccctgtgctcatccaaattcccgtttctgcgctcctgcacgccagtgcccaatcatggatcccgcgtgggaagctcctgaaggcgtgccgattgatgccatcatttttggaggtcgccggccgaagggtgtccctctggtttatgaggccttcaactggcgacacggcgtgttcgtcggttctgctatgcgaagcgagtcaactgctgcggcggagcacaaaggcaagatcattatgcacgatccgttcgcaatgcggcccttcttcggctataacttcgggcactatctggagcactggctttcgatggaaggtcggaaaggcgcccagttgccccgcatctttcacgtgaactggttccgacgcgacgaggcgggacacttcctgtggccagggtttggcgagaatgcccgggtgctcgactggatctgcaggcggttggagggcgaagattctgcgagagagaccccgatcggtctggtccctaaagagggcgctttggacctcagcggattacgggcgatcgacaccacacaactgttctcactgccgaaagatttctgggagcaggaagtgagggacatcagaagttacctcactgaacaggtgaaccaagatctgcccaaggaggtgctcgcggagcttgaagccctggagcggagagtgcacaaaatgtag

SEQ ID NO: 128593 - DNA, 1521 bp, Artificial Sequence
  Description of Artificial Sequence: Synthetic coding sequence
atgtccccggccgacttccagcgtgctgttgacgaaaggtttccaggctgcatgcagggcagaacaatgtacgtgctgccattcagtatgggcccagttggttcgccattgtcgaggattggagtgcagttgactgacagcgcgtatgtggtggcatccatgagaattatgacccgactggggacccctgtcttacaggcactcggcgacggagacttcgtcaaatgtctgcacagcgtgggacagcctctgacaggccagggggaaccagtgagccagtggccttgtaacccagaaaaaacacttatcggtcatgttcctgatcagcgggaaataatctcattcggctcaggttacggcggcaacagtctgctggggaagaagtgctttgcacttagaattgcctcgcggttagctagggatgaaggatggttagctgagcatatgctgatccttggcattacttcaccagccggtaagaaacgttatgttgccgcagcctttccgtctgcttgtggcaagactaacttagctatgatgagaccagcccttccaggatggaaagttgagtgcgtgggagatgacatcgcatggatgaggtttgactctgaagggagattgcgggccattaatcccgagaatggattctttggcgtggctccgggcacaagcgcaaccaccaaccctaatgccatggcaacaattcaaagtaacactatttttaccaacgttgctgaaacatcagacggaggcgtgtactgggaaggtatcgatcagcctctaccccctggggtgaccgtcacgtcgtggctcggcaagccctggaaaccaggagacaaggagccgtgcgcccacccgaactcacgtttttgcgcaccagctagacagtgtcccataatggaccctgcatgggaggctcctgagggtgtgcctattgacgccattatatttggcgggcggaggccgaaaggagtgcccctcgtgtacgaggcgttcaattggaggcacggcgtgtttgtgggctctgcaatgagaagtgaaagtacagccgcggcagaacataaaggcaaaatcattatgcacgatcctttcgcgatgagaccattttttggctataacttcggccattacctcgaacattggcttagtatggaggggagaaaaggagcccagctcccgagaatttttcatgtcaattggttcagaagggacgaagccgggcacttcctgtggcctgggttcggcgagaacgcgcgtgtgctggattggatctgccgcagacttgagggcgaggattccgctagagaaacccctatcggcctcgtgccaaaggagggggcattagacctgtcaggacttagggcaatagacaccacccaactgtttagtcttccaaaggatttctgggagcaggaagtgcgggacatcaggagctacctgacggagcaggtgaaccaagacctgcccaaggaggtgctggccgaactggaggcccttgagcgccgagtccataagatgtag

SEQ ID NO: 128594 - DNA, 2343 bp, Artificial Sequence
  Description of Artificial Sequence: Synthetic coding sequence
atggcagcagtggacctggagaaactgcgagccagcggggcaggaaaggcaattggagttctaacctccggaggagacgctcagggtatgaacgccgcggtgcgggctgtgacacgtatgggcatttatgttggcgcgaaggtgttcttgatctacgagggttatgagggactggtagaaggcggcgagaatataaaacaggccaactggctgtcggtgagcaacatcatacagctggggggaaccatcatcggttctgctaggtgtaaggcgttcaccacgagagagggacggagggctgcagcttacaatcttgttcagcacggcattacaaacctatgcgtaataggcggagatggatcactcaccggtgctaatatttttaggagcgaatggggtagcctgctggaggaattggttgctgaaggaaaaatttcagagacaaccgcccgtacctactcccacctgaacatcgctgggttggtgggctccattgacaatgacttttgcggtaccgacatgaccattggtaccgatagcgccttacaccggatcatggaagtgatagacgcaatcacaacgacagcccagagtcaccagcggacctttgtgctggaagtgatgggccgccactgtggatacctggccctggtgtctgcactggcaagcggcgctgattggcttttcatccccgaggcacctccagaagacggatgggagaacttcatgtgtgaacgattaggggaaactagaagcaggggcagcaggctgaatatcatcatcatagccgagggggccatcgatagaaacgggaagccgattagttcctcatacgtaaaggatcttgtggtgcagcgcctcggcttcgatactagagtgaccgtcctgggacatgttcaacggggtggcacaccctcagcatttgatcgcatcttatcaagcaaaatgggcatggaggccgtcatggcgctgctcgaggccacaccagataccccagcatgtgtagtgactctgagcggcaatcaatccgttcgcttgcctctcatggagtgcgtgcaaatgaccaaagaagtccagaaagccatggacgataaaagatttgatgaggccacccaactgcgaggtggttctttcgagaataactggaacatttataagctgctcgctcatcagaagcctcctaaagaaaaatcaaacttcagcctggccatcctgaatgtgggcgcccccgcagcaggaatgaatgctgcagttcgaagtgctgtccgcactggtataagccacggccatacggtctatgtcgtgcacgatggattcgaaggcctggccaagggccaggttcaagaagtcgggtggcacgatgtagctggttggctggggcgaggcgggtccatgctgggcactaagaggacattacctaaagggcagctggagagtattgtggaaaacattagaatttatggtatccacgcactacttgtggtgggaggattcgaggcctatgagggagtgctccagctcgtcgaggcccgtgggcggtatgaagaactgtgcatagtcatgtgtgtaatccccgccaccatatcaaataacgtgcctggcaccgatttctcactgggcagcgatactgctgtgaacgctgctatggagtcatgtgatagaattaaacaatccgccagtggcactaagagacgagtcttcatcgtggagacaatgggaggctactgtgggtaccttgctaccgtaacaggcatcgccgtgggcgcggacgcggcgtacgtttttgaggatccctttaatatacacgacttgaaggtgaatgttgaacacatgaccgaaaagatgaaaacagacattcagagggggctggtcctgaggaatgagaagtgccacgactactacactaccgagtttctctacaatctttactcctcagagggtaagggcgttttcgactgcaggacgaatgtgctgggacacttgcagcagggaggcgccccaacccccttcgatagaaactatggaacaaagctgggcgtgaaagcgatgctgtggctgtctgagaaactgcgagaagtgtatagaaagggccgagtttttgccaacgcacccgattctgcgtgtgtcatcgggctgaaaaaaaaggctgtggcattttcccctgttaccgaactaaagaaagacacagattttgaacaccgaatgccaagggaacaatggtggctgtcattacgcttaatgttaaaaatgcttgcgcaataccgtatttctatggccgcctacgtgtcaggggagctggaacacgttactaggcggacgctgagcatggacaagggcttctag

SEQ ID NO: 128595 - DNA, 762 bp, Artificial Sequence
  Description of Artificial Sequence: Synthetic coding sequence
atgaggtctatgtgtaaccagggtcgaggccgggaaagttcacggggcggactccatgttcaggggtcatgccgcgggttgagcagatccccccaacaagaaactggctttgcaaaagcccctgcaggaactgactgctttttccattgtagccccggctcccggggccagggtgaccgtaaagaagaggtcacttccgaaccaggagggacttcaattatgtctagactcgggggcatgaatgctgctgtcagggccgtgacccgaatggggatatacgttggagccaaagtgtttctcatatatgaaggttatgaggggcttgtggagggaggggagaatatcaagcaggccaactggctttccgtctcaaatatcatccagctgggcggcaccatcattggaagtgcccggtgtaaggctttcacaacacgcgaaggccggcgcgctgctgcttacaatctggtacagcacggtatcacgaatctgtgtgtaatcggcggcgacgggtcgctcaccggtgctaacatctttaggagcgaatggggttccctgctggaggagttagttgccgaagggaaaatctcagaaactactgctcgaacctatagccatttgaacattgccggtctggtcggttctatcgacaatgacttctgtggaactgacatgaccataggcacagactcggccctgcatagaattatggaagtgatagacgcgattaccaccaggggtcggttaggagagctgcacgtttag

SEQ ID NO: 128596 - DNA, 2484 bp, Artificial Sequence
  Description of Artificial Sequence: Synthetic coding sequence
atgtgtaatcagggacgggggcgcgaatcaagccgtggcggtcttcatgtgcaagggtcctgccgggggcttagcagatccccccagcaggaaacaggtttcgccaaagccccagccgggaccgactgtttcttccattgctccccaggttcgcgcggccagggcgacagaaaggaagaggtcacatctgagccgggtggtacgagcattatgtcacgactggggggcatgaatgccgccgtgcgcgccgtgaccaggatgggaatctacgtgggggcgaaggtttttttgatctatgaaggctatgaggggctggttgagggcggggaaaatatcaagcaggccaattggcttagcgtttccaacataattcagttgggtggtacaattatcggatctgccaggtgcaaagcctttactacccgcgaaggccgccgtgctgcggcctacaaccttgtgcaacacgggataaccaatctctgtgtgataggcggtgacgggagtctcaccggagccaatatctttcgatcagaatggggatctctgctcgaagaacttgtcgccgagggtaaaatatctgagacgaccgcacgaacatattcgcacctgaacattgctgggctagtcggttctatcgacaatgacttttgtggcaccgacatgacgatcggaactgactctgctcttcatcggatcatggaggtcattgacgcaatcactacaaccgctcaaagccaccagcgtactttcgtcctggaggtgatgggcagacattgcggatacctggctctggtgtcagccttggcgtcaggcgcagattggctgttcattcctgaggccccgcccgaggatggttgggagaactttatgtgcgagagactcggggagactaggagccgggggtccagactcaacatcatcataattgcagaaggcgctatcgatcggaacggcaaacccatttcctccagctacgtcaaggatctggttgtccagcgcttgggtttcgatacccgtgtgaccgtgctggggcatgtgcagagaggtggaacaccatcggccttcgacagaattctgagctccaagatgggcatggaagccgtcatggctctgctggaggcaacccctgacactccagcttgcgtggtgacccttagcggtaatcagtctgtgcgtctgcctctgatggaatgcgtacagatgaccaaggaggtccagaaggccatggatgacaagcggtttgacgaggcaacacagctgcgggggggctcctttgaaaataattggaacatatacaaactgcttgcgcaccagaagccaccaaaagagaaaagcaatttttccctggcaatcctcaatgtgggagcaccagccgctggcatgaatgcagcagtccggtccgcagttcgtaccggcatcagccatggtcataccgtatatgtcgtgcacgatggtttcgaggggctggctaagggccaagtacaggaagtcgggtggcatgacgtcgccggatggctaggacgcggtggaagcatgcttggcacaaaaagaacccttccgaaggggcagctggagagcatcgtggagaacattcgtatttacggcatccacgccctattagttgtcggaggatttgaggcttatgagggcgtgctgcagctggtggaagcgcgaggaaggtacgaggagctatgtatcgtcatgtgcgtgatccccgccactatatccaacaacgtgcctgggaccgactttagcctgggtagcgacaccgccgtaaacgccgcaatggaatcctgtgacaggatcaagcagagcgcatcaggaacaaagagacgcgtgtttatcgtcgagacgatgggaggttattgcggctatttggccaccgttactggcattgcagtgggtgcagacgccgcgtacgtatttgaagatcctttcaatatccacgatcttaaagtcaacgttgagcacatgacagaaaaaatgaaaaccgatattcagagaggcctcgtgctcagaaatgagaaatgccacgactactacacaacagaatttctgtataatctttactcttccgaggggaagggtgtgtttgattgtcgtactaatgtgttgggccacttacagcagggcggggctccaacgcccttcgatcgaaactacggcacgaagctgggcgtcaaggccatgctatggttgagtgagaaattgagggaagtgtaccgcaaagggcgggtgttcgccaacgcacccgacagtgcgtgcgtgattggtctgaagaagaaggctgtcgccttttctcccgtgaccgaattgaagaaggacactgatttcgagcacagaatgccgagagagcagtggtggcttagtctgcgcctgatgctcaagatgttggcccagtacaggatctctatggcagcctacgtatcaggcgagctagagcacgtgactaggagaactctgtctatggataagggattctag

SEQ ID NO: 128597 - DNA, 1722 bp, Artificial Sequence
  Description of Artificial Sequence: Synthetic coding sequence
atggggaggcattgcgggtatctggcgctggtgtctgcccttgcatccggcgccgactggttgttcattccagaagccccgcctgaggatggctgggagaacttcatgtgtgagaggctgggagagactcgaagcagaggcagccggctcaatatcatcataattgccgagggtgcaattgaccgcaatggaaagcccattagcagttcttacgtgaaagatctggtggttcaaaggcttgggttcgacactagggtgactgtcctgggccatgttcagcggggtgggacccccagcgcattcgaccggatcctgtcgtctaagatgggcatggaagctgtaatggcattgctggaggctacgcccgatacgcctgcttgcgttgttactctgtcgggaaaccagtcagtcaggctgccactcatggagtgcgtgcaaatgaccaaagaggtgcaaaaagccatggacgacaagaggttcgatgaagctactcagcttaggggcgggagcttcgagaacaactggaatatttacaaactgctcgcacatcaaaagccaccaaaggagaagagtaatttctcccttgctatcctcaacgtgggagcccccgcagccggaatgaacgctgcggtccgaagtgccgttaggacagggatatcacacggccacaccgtatatgtggtacatgatggattcgagggcctcgccaagggccaagtccaagaagtgggttggcacgacgtggcgggatggctcggcagggggggttctatgctcggaactaagcggacactgcctaagggccagctggagtcaattgtggaaaatatccgtatctacggtatccacgccctgctggtggttggcggatttgaagcgtatgaaggagttcttcagctcgtggaggcgcgaggccgctacgaggaactgtgcatcgtgatgtgtgtgatccctgctaccatttcaaacaacgtgcccggcaccgacttcagcttagggagtgacaccgccgtgaatgccgcaatggagtcgtgtgacagaatcaaacagtcagctagcggcacaaagaggcgggtgttcatcgtcgaaacaatgggcggctactgtggttacctggcgactgtcactggtatagccgtaggggctgacgccgcgtacgtctttgaggacccatttaacattcatgatctgaaggtgaacgtggaacacatgacagagaagatgaaaactgatatccagcggggactcgtcctgaggaacgaaaaatgccacgattattatacgaccgagtttctctataacctgtattcatcagagggtaagggagtgttcgattgtaggacgaacgtactgggccacctccaacagggcggagctccaacaccatttgacagaaattacgggacaaagttaggcgtcaaagctatgctttggctgagcgagaagctccgggaagtctatcgcaagggtcgggtgttcgcaaacgctcccgactccgcgtgtgtgatcggtctcaaaaagaaggcagtggccttttccccggtgactgagctgaaaaaggacacagactttgagcacaggatgcccagagaacagtggtggctcagcttgaggctaatgttaaaaatgttggcccagtacaggatttctatggccgcctatgtgtctggggagttggagcatgtcacaaggcggacattgagtatggacaagggattctag

SEQ ID NO: 128598 - DNA, 2343 bp, Artificial Sequence
  Description of Artificial Sequence: Synthetic coding sequence
atgacacacgaagagcatcacgcagctaaaacgttaggcataggcaaagccatcgccgtgctgacttcgggtggagatgcacagggaatgaatgccgcagtccgcgccgtcgttagggtcggtatcttcacaggagcccgggtgttttttgtccatgagggctaccagggactcgtagacgggggggatcacattaaggaagccacgtgggaatccgtttctatgatgctccaattgggcgggaccgttatagggtctgctcgttgcaaggatttcagagagcgggaggggcgactgagagcagcatacaaccttgttaaacgcgggataaccaatctctgtgtcattggcggagatgggtctctgaccggcgctgacacctttagatctgaatggtcagaccttttgagcgatctgcagaaggccggcaagattacagatgaagaggcgaccaagtcatcatacctcaacattgtgggcctcgtgggctcaatagataatgacttttgtggtaccgatatgaccattggaacagactcggccttgcaccggatcatggagatcgttgatgccattacgacaaccgcacaaagccaccagcgaactttcgtgttagaagtgatgggaaggcactgtggttatctggccctcgttacctccttaagctgtggggcagattgggtgttcatcccagagtgtccccccgacgatgactgggaggaacacctgtgtaggcgcctgagcgagactcggaccagaggctctagactgaacatcattatcgtggccgagggcgccatcgacaaaaatggtaagcccatcacgtcagaggacataaagaatctggtggtgaaacgtctcggctatgacacacgagtcaccgttctcggtcatgttcaacgaggtggcacgccaagcgcattcgaccggattctggggtctaggatgggagtggaggcggttatggctctactcgagggtacccccgacaccccagcctgtgtggtgagtctgtctgggaatcaggctgtgagattgcctctgatggagtgtgtgcaagtgaccaaagatgtcactaaggctatggacgagaagaaatttgatgaggccctgaagctgagggggcgaagcttcatgaacaactgggaggtgtataagctcttagcccatgttaggccacctgttagcaaatcaggctcccatacggtggctgtcatgaacgtcggcgctccagccgccggcatgaacgctgcggtgaggagcaccgtcagaatcggcctgatacaaggcaatagagtcctggttgttcatgacgggttcgaggggctggccaagggtcaaatagaggaagccggctggagctacgttggcgggtggactggacagggcggcagtaagctcgggacaaagcgcaccctgcctaaaaaatcatttgagcagataagcgctaacattactaagttcaatattcagggtctggtcattattggaggtttcgaggcctatactgggggacttgaactcatggaggggcggaagcagttcgacgaattgtgcattccgtttgtggttatcccagccacagtgtcgaacaatgttccaggctcagatttttcagtgggagccgataccgccctcaacaccatctgcacgacatgcgatcggattaagcagtcggccgctggcaccaaaaggcgtgtgttcatcatcgaaacaatgggagggtactgtggctatctagcgaccatggcaggattggccgcaggggccgacgcggcctacatattcgaagaaccgttcacaataagagatttacaagcgaacgtggaacacttggttcagaaaatgaaaactaccgtgaaacgaggactggtgctccggaacgaaaagtgcaacgaaaattacactaccgattttatcttcaacttgtatagcgaagagggcaaggggatttttgactctcggaagaatgttttgggccatatgcagcaggggggaagcccaacgccttttgacagaaacttcgctactaagatgggggcgaaggctatgaactggatgtccgggaaaatcaaagaaagctaccggaacgggagaatttttgcgaacacacccgacagcggctgcgtcttggggatgaggaagcgagcccttgtgttccagcccgtggccgaacttaaggatcagactgactttgaacaccggattccaaaggaacaatggtggttgaagctccgaccaatcctgaaaattctagctaaatatgagattgacttggacacttccgaccatgcccacctcgaacatataactaggaagcggtcaggcgaagccgccgtttag

SEQ ID NO: 128599 - DNA, 2556 bp, Artificial Sequence
  Description of Artificial Sequence: Synthetic coding sequence
atgcataaggatgagtttcaccttaagttttttatgtgtgttattcagagtcgtcagctggtgcggactccacaaagaacagcaggcgaggcatcaacctctagcatgctaatccccaagccacccccaaaaactgacatcctgaaaagtcttgataccatggatgatccggatacagtgggatcaatccccgtgtttaagacagagtggattatgactcatgaggagcaccacgctgccaaaacacttggaataggaaaggccattgccgtcctcacctcaggtggcgacgctcaggggatgaacgctgccgtgagggccgttgtgagggtaggcattttcaccggggctcgggtgttttttgttcacgaaggctaccagggactggtggatggtggcgatcatataaaggaagcgacctgggagtccgtttcaatgatgctgcagctgggcggaaccgtgattggaagtgcccggtgcaaggacttcagggagcgcgaggggagattaagagctgcttataatctggtaaaaagaggcattaccaatctttgcgttatcggcggcgacggcagcctaaccggggcggataccttccgctctgagtggagcgatctactgtccgatctgcaaaaagccgggaagattactgatgaagaggccactaagagctcttacttaaatattgttggactggtgggctccattgataatgatttttgtggaactgatatgaccattggtactgattctgccctccacagaatcatggaaatcgtcgatgccatcaccacaactgcacagagtcaccaacggactttcgtgctggaggtgatgggaagacactgcgggtatctggccctcgtcacaagtttgagttgcggcgctgattgggtgttcatccctgagtgcccgcccgacgacgattgggaagagcacctatgtagaagactcagtgagaccaggacacgaggtagtcgcctaaatattatcatcgttgcagagggagcaatcgataagaatggaaagcccattaccagcgaggatatcaaaaatttggttgtcaagagacttggctacgacaccagggtgacggtgctgggacatgtgcagagagggggaacaccgtccgccttcgatcgaattttgggctctcgcatgggagtggaagcagttatggctctgctggagggcacaccggacactccagcctgcgttgttagcttgtctggaaatcaggcggtaaggttgccgctgatggagtgcgttcaagtgacaaaagatgttacaaaagcaatggacgaaaaaaagttcgatgaggccctcaagctcagaggccgctcctttatgaacaactgggaggtgtataagctgctggcccatgtgcgtccccccgtctctaagagcggctcacacacagtggcagttatgaatgtcggcgcccctgctgccggtatgaacgcagctgtaaggagcactgttaggataggcctcatacagggtaacagagtgctagttgtgcacgatgggtttgagggcctcgcgaaaggacagattgaagaggcagggtggtcctacgtaggaggttggacaggccagggcggtagtaaattaggcaccaagcgcacactccccaagaaaagtttcgagcagataagtgcaaatattacgaaatttaacatccagggcctcgtgattataggcggcttcgaagcttacacaggggggctcgagttgatggagggtcgaaagcagtttgatgaactgtgcataccgttcgtagtcatcccagctactgtttccaataatgtgccaggctccgatttttccgtgggagctgataccgccttaaacacaatctgcaccacatgcgaccgaatcaaacagagcgcagccggtaccaaaaggcgcgtgttcatcatcgaaacgatgggcgggtactgtggctatctggctaccatggctggccttgctgccggggctgacgcagcatatatattcgaagagccatttacgatcagggacctgcaggctaatgtggagcacctggtacagaagatgaagacaactgttaaacgcgggctggttctccgtaacgagaaatgcaacgagaactataccaccgacttcatcttcaatctatactcagaggagggaaagggcatctttgactctcggaagaacgtgttggggcacatgcagcagggaggtagccccaccccgtttgatcgcaacttcgccacaaaaatgggcgctaaagccatgaactggatgagcggtaaaattaaggagagctacagaaacggaaggatctttgcaaacacgccagactctgggtgtgtactcggtatgaggaagagagcccttgtgtttcagcctgtagctgaacttaaggaccagactgactttgaacatcgcatcccgaaagaacagtggtggttaaagctgcggccaattcttaagatcctggcaaaatacgaaattgatctagataccagtgaccatgctcatctcgagcatatcacacgaaaacggtccggcgaggcggctgtgtag

SEQ ID NO: 128600 - DNA, 2343 bp, Artificial Sequence
  Description of Artificial Sequence: Synthetic coding sequence
atgacccacgaggaacatcatgcagccaagactctagggattggaaaagcgattgccgtcctcacatccggtggggacgcacaagggatgaacgctgcggtgagggcagtggtgcgcgtgggaatttttacgggggctcgcgttttttttgttcacgaagggtatcagggactggtagacgggggcgatcatatcaaagaagccacttgggagtccgtgtccatgatgctgcagttaggaggcacggtgatcggaagtgctcgctgtaaagacttccgagagcgcgagggccggctgcgggcggcatacaacctagtaaagcgaggaattactaatttgtgcgttataggaggtgacggatctcttaccggcgccgacacatttcgtagtgagtggtcggacctgctaagcgatctgcagaaagccggcaaaatcactgacgaagaggccacaaagagctcttacctgaacattgtggggctggttggcagcatcgataatgatttctgtggaacagacatgacgataggcaccgactctgcactgcacaggattatggagatcgtcgacgccatcactaccacagcccagtcccaccaacggacattcgtcctggaggtaatgggacgccactgcggctacctcgccttggttacttcactgtcatgcggcgctgactgggtctttatccctgagtgcccaccagatgacgactgggaggaacacctttgccgtagactgtctgagacccgaactagggggtcccgcctgaacataataattgtggcagaaggagccattgacaaaaatggaaagccaatcacatctgaggacattaagaatctcgtcgtgaagagattaggctacgacacaagggtgaccgtactggggcatgtccagaggggaggtaccccctcagcctttgatagaatcttaggcagccgcatgggagtggaagcagtgatggctctgttggaaggtacaccagacactcctgcgtgtgtggtgagcctcagtggcaatcaagcggtgcggctaccactcatggaatgcgttcaggtgaccaaagatgtgacaaaagctatggatgaaaaaaagttcgatgaagcccttaagctaagaggcagaagctttatgaacaactgggaggtgtacaaattgttggcacacgttaggccgccagtgagtaaatcgggaagtcatacggtcgcagtgatgaacgttggcgcgcctgccgcaggcatgaacgccgcagtgcggtcgacggttcggattggtttgatccaagggaatagagtccttgtggttcatgacgggttcgagggactagccaaagggcagatcgaggaagccggatggtcgtacgttggaggctggacgggccaaggtggttcaaaattgggaaccaaacggacacttcccaagaagtcctttgagcaaatctctgccaacatcacgaaatttaacatacaggggctcgtgataatcggtggctttgaggcctataccggtggcctagagttgatggaggggagaaagcagttcgatgagctttgcatccccttcgttgtcattcccgcgacggtgtctaacaatgtgcccgggagcgactttagcgtgggtgcagataccgccctgaacacgatctgcacaacatgtgaccggatcaaacagtctgccgccgggactaagagaagagtcttcattatcgagacgatggggggatattgcgggtacctggcaactatggccggactggctgccggtgccgatgccgcctatatctttgaggagccctttacaatccgagaccttcaggccaatgtggagcatcttgtgcagaaaatgaaaactacagtcaaaaggggactagtcctgcggaacgaaaagtgcaacgaaaattataccacagattttatttttaatctgtacagcgaggaaggcaagggaatcttcgactcccgcaagaacgtgttggggcacatgcaacaaggtggatcacctaccccctttgaccgaaacttcgccacgaaaatgggagctaaagcgatgaattggatgtcaggtaaaataaaagagtcatacaggaatggccggatttttgccaacacccccgactcaggatgtgttctggggatgaggaaaagagcccttgtattccagccagtcgccgagctgaaggatcagactgattttgagcatcgcattccgaaggagcagtggtggctgaagctgcgccctatcttgaagatcctggctaaatatgagatagatctcgatacaagcgaccacgcgcacctggagcacattacgcgcaaaagatctggagaagctgccgtctag

SEQ ID NO: 128601 - DNA, 2250 bp, Artificial Sequence
  Description of Artificial Sequence: Synthetic coding sequence
atgacccacgaagaacaccacgcagcaaaaacactgggaataggaaaggccatcgcagtgctcaccagtggtggcgatgcacagggaatgaatgcagccgtccgggcagtggtacgagttgggattttcactggcgcgcgagtgttttttgtgcatgagggatatcagggcttggttgatggcggtgaccacattaaggaagcaacctgggaatctgtcagcatgatgctccagcttggaggaactgtaatcggtagcgcacggtgtaaggacttccgcgaacgggaaggccggttacgcgcagcctataacctcgtgaagcgcggcattacgaatttgtgcgtcatcgggggtgacggcagcctgactggcgctgacacatttagatcggagtggtccgatctgttgagcgacctgcagaaggctggtaagatcaccgatgaggaggctacgaagagcagctacctgaatatagtggggttagtgggttcaatagacaacgatttttgcggtaccgacatgactattggaacagacagtgctctgcatagaatcatggaaatcgtcgatgcgattactaccactgcccaatcgcatcagcgcacattcgtgctggaggtaatgggtaggcactgtgggtatctcgccctcgtcacgtccctgagctgcggtgcagattgggtgttcatcccagagtgccctccagatgatgactgggaggagcatctgtgtcggagactgtccgaaacacgcactcgagggtctcgactcaatatcattatcgtcgcagagggagctatcgataaaaatgggaagcccatcacttctgaagatatcaaaaacgggagtagaatgggggtggaggctgtgatggccctccttgagggaaccccggatacccctgcctgtgttgtgtccctatctggtaaccaggcagtacggctgcctttaatggaatgtgtccaggtgactaaggacgtaaccaaagcgatggatgagaagaaattcgatgaggcacttaaactgagagggcggagttttatgaacaactgggaggtgtacaaactgttggcccacgtaagacccccagttagcaagtccgggagccacaccgtagctgtgatgaacgttggggcaccagcggcaggcatgaatgcagccgtcaggagcactgtgagaatcggcctgattcagggcaaccgcgtcttagttgtccacgatgggttcgaaggcctggccaagggtcaaattgaggaggcgggatggtcctacgtggggggctggactgggcagggcggctccaagctaggtaccaaacgcaccctccctaaaaaaagctttgagcagatttctgcgaacataacaaagtttaacatacaggggttggtgattatcggaggcttcgaagcctacactggaggcttggaactgatggaggggaggaagcagttcgacgaactttgcattccgtttgtggtgatcccagcaacggtctccaataatgtgccaggttcagattttagtgtgggtgcagacaccgcattgaacaccatctgcaccacatgtgatcgaattaagcagagcgctgccggaacaaagagacgagtcttcattattgaaacaatgggtggctactgcggttacctggccacgatggccggacttgccgcaggagccgatgctgcttacatcttcgaggagccatttacaattagggatctgcaggcaaatgtagaacatcttgtgcagaagatgaagaccaccgtgaagaggggtctcgtactgcggaatgagaaatgcaatgagaattacacaactgactttattttcaatttatacagcgaggagggaaaaggcattttcgatagtcgcaagaatgtcctgggccatatgcagcagggcggatctccgacaccttttgaccgaaactttgccacaaaaatgggcgcgaaagctatgaactggatgtccggcaagattaaagagtcttatcgcaacggaaggatcttcgccaacacgccagactccggctgcgtgctcggcatgcgcaagagagcacttgtattccaaccggttgccgaactgaaggaccagacagacttcgagcaccgaatccctaaagagcagtggtggctgaaactccgacccattctaaaaatactggccaagtacgagatcgacttagacactagcgaccacgcacaccttgagcacattacgcgtaagcggagtggcgaagctgccgtgtag

SEQ ID NO: 128602 - DNA, 534 bp, Artificial Sequence
  Description of Artificial Sequence: Synthetic coding sequence
atgactcacgaagagcaccacgccgctaaaactctgggaattggcaaagcaattgcagtgctcacgagtggaggagacgcccaaggcatgaacgcggcagtgagatctacagtgcgcataggtctgatccaaggaaatcgagtgttggttgtacacgacgggtttgaaggtctggccaaggggcaaatcgaggaagccggctggtcttatgttggcggttggacaggacaaggcggatctaagctaggcaccaaaagaacgctaccgaaaaagagcttcgagcagatttccgcaaatataacaaagtttaacatacagggcctggtgataatcggcggctttgaggcttacacgggcggcctagaactgatggaagggcgtaagcaatttgatgagttgtgtatcccttttgtcgtgataccagccacagtttctaataatgtccctgggtccgacttcagcgtcggagccgacaccgctctcaacaccatttgtaccacctgtgacaggatcaagcaatcagccgccggatag

SEQ ID NO: 128603 - DNA, 2343 bp, Artificial Sequence
  Description of Artificial Sequence: Synthetic coding sequence
atgacccacgaagaacaccacgctgcaaaaacacttggcataggaaaagcaatagcagtccttactagtggaggagacgcccaggggatgaatgccgccgtgagagccgttgtgcgagttggcatttttaccggggctagggtctttttcgtgcacgagggataccagggcctggtggacggcggagatcatattaaagaagccacatgggagtctgtgtctatgatgttgcaactggggggaacagttataggctcggcccgttgcaaagattttcgggagagggagggccgcctgagagccgcgtacaatctagtaaaacggggcattaccaatctttgtgtaatcggcggagacgggtctcttactggcgccgacacattccgatccgaatggagtgaccttctgtctgacctgcagaaagcaggtaaaataaccgacgaggaggctacgaaaagcagctaccttaacatcgtgggtctcgtcggctcaatagacaatgacttttgcggaaccgatatgacgatcggaaccgacagtgccctgcataggatcatggaaatcgtggatgccatcaccaccacagcacagtcccatcaacgcacttttgtactcgaagtaatggggcgtcactgtggatatttggcccttgttactagcttgtcgtgtggcgcagattgggtgtttattccagagtgtccaccagacgacgattgggaggagcacttatgtcggcgcttgtctgagacaaggactcgcggaagcagactgaacattatcatcgtcgcggaaggggccattgataaaaatggcaaacctataactagcgaggatatcaaaaatctggtcgtaaaaaggttgggctatgacactcgggtgacggtgcttggacatgttcaaaggggcgggacgccatcagcctttgatagaatcctaggctcacgcatgggagtcgaggcagtgatggccctgctcgagggcacaccagatactccagcatgcgtcgtctcactttcgggcaatcaggccgtgaggctgcccctgatggagtgcgtgcaggtcacaaaggatgtaacgaaggcaatggacgagaagaagttcgacgaggccctaaagttgcgcggcagatcctttatgaacaattgggaggtttataagttactggcccacgtgagaccccctgtctcaaaatcagggtcccacaccgtggcggtcatgaatgttggagcccctgccgcagggatgaatgcagccgtccgcagcactgtacgcatcggactgatccagggtaaccgggtccttgtggtacacgatggctttgagggcctcgctaaaggtcagatcgaagaagccgggtggtcgtatgtgggagggtggacgggacaaggggggtctaaattaggcactaaacgcacactgccaaagaagagcttcgaacaaatcagcgcaaacataaccaaattcaatatacaaggcttagtgatcatcggcgggtttgaggcatacaccggtggactggaactgatggaaggaaggaaacagtttgacgagttgtgtatcccttttgttgtgatcccggcaaccgtgagcaataacgtccccggttccgacttctctgtcggggccgatactgcgctgaatacgatatgcaccacctgcgaccggattaaacagtctgcggccgggacaaagaggagagtattcatcatcgagacaatgggcgggtattgtggctatcttgccacaatggcagggctggccgccggcgctgacgcagcttatatttttgaagaacctttcaccatacgtgatctacaggcaaacgtagagcacctcgttcagaaaatgaagactactgtcaagcgcggattggtcttacggaatgaaaagtgcaacgagaactacactacagacttcattttcaacttgtattcagaggaaggcaaaggtatcttcgattctcggaagaatgtgctggggcatatgcagcaggggggctcaccaacaccgtttgatcgcaattttgcaacgaagatgggagctaaggcgatgaattggatgagcgggaaaataaaagagagttatcggaacgggaggatttttgcaaacacccccgacagtggctgcgtgttgggcatgagaaaaagagcgctcgtattccaaccagtggcagagctgaaggaccagaccgattttgagcaccggatccccaaggaacagtggtggcttaagttgagacccattctcaagatcttggctaagtacgagattgacctagacacgagtgaccacgctcaccttgagcacattacccggaaacgttctggcgaagccgcggtctag

SEQ ID NO: 128604 - DNA, 354 bp, Artificial Sequence
  Description of Artificial Sequence: Synthetic coding sequence
atgacccatgaagagcatcacgctgccaaaacactgggaatcggcaaagcgattgcagtgctcaccagtggcggagacgcccagggcatgaacgcggccgttagggctgtcgtacgcgtcgggatctttactggggctagagtgttttttgtccacgaaggctaccaagggctggtggacggcggtgaccatatcaaggaggcgacttgggagtccgtgagcatgatgctccagcttggagggactgtgatcgggagcgcccgttgcaaagattttagggaacgagaaggacgcctgcgggccgcatacaacctggtaaaacggggcatcacgaatctctgcgtcattgggtag

SEQ ID NO: 128605 - DNA, 486 bp, Artificial Sequence
  Description of Artificial Sequence: Synthetic coding sequence
atgacacacgaagagcaccacgccgcaaaaactttgggcatcgggaaggccatcgctgtgttgacctctgggggagatgctcagggcatgaacgctgctgttagggccgttgtgcgggtgggtatcttcacaggggctcgggttttctttgtacatgagggttatcagggtctggtggatgggggagaccatatcaaggaagccacctgggaatccgtatctatgatgctccagctcggtggaaccgtgatcggatctgctagatgtaaagactttagggagcgtgaaggccgcctcagagcagcctacaatctagttaagagggggattacaaacctttgcgttatagggggggacggctctctcacaggcgccgacacattccggtccgaatggtcagacctgctgtctgatcttcagaaggctggcaaaataacagacgaggaagctaccaaaagttcgtatttaaacattgtcggactttag

SEQ ID NO: 128606 - DNA, 474 bp, Artificial Sequence
  Description of Artificial Sequence: Synthetic coding sequence
atgacccatgaggaacatcatgccgccaaaaccctgggaatcggcaaagccattgcagtattaacaagtggaggcgacgcccagggcatgaacgcagcagtccgtgctgtggtgagggtgggcatctttactggggcgagagtcttttttgtgcatgagggataccagggccttgtcgacggcggtgaccacatcaaagaagctacatgggaaagtgttagtatgatgctgcagctgggtggtaccgtaatcggttccgcccggtgtaaggactttagagagcgagagggtcgacttcgggctgcatacaacctcgtcaaacgagggatcaccaatctatgtgtcatcggaggcgatgggtccttaacgggcgccgatactttccggtccgaatggtccgacctcctgagtgatctgcagaaagctggtaaaatcacagacgaggaagcaaccaaatcttcttatctgaattag

SEQ ID NO: 128607 - DNA, 258 bp, Artificial Sequence
  Description of Artificial Sequence: Synthetic coding sequence
atgactcacgaagaacatcatgcagccaagacgctgggtattgggaaggctattgcggtgctgacaagcggaggagatgcacagggaatgaacgccgcggtcagagcagtggtgagggtcggtatctttaccggagctcgagtcttttttgtgcacgagggctaccaaggactggtggacggcggcgaccacattaaagaagccacctgggaaagtgtcagcatgatgctgcaactcggagggacggttattggctag

SEQ ID NO: 128608 - DNA, 420 bp, Artificial Sequence
  Description of Artificial Sequence: Synthetic coding sequence
atgacgcacgaggagcatcatgccgccaagacactcggcatcggaaaagccatcgccgtcttgacatccgggggcgatgcccaagggatgaacgccgccgtccgcgctgtggtcagggttggaattttcaccggagcgcgcgtgttttttgtgcatgagggataccaaggactggtcgatggaggtgatcacattaaggaagcaacctgggagagtgtatccatgatgctgcaacttggaggaaccgtgatcggcagtgcccgctgcaaggactttagagagcgtgaagggcgcctccgagctgcctacaatctagtgaagcgaggcataaccaatctgtgcgtcatcggcggcgatgggagcctgacaggggctgacacatttaggtccgaatggtcagatctcctgtctgatctgtag

SEQ ID NO: 128609 - DNA, 2250 bp, Artificial Sequence
  Description of Artificial Sequence: Synthetic coding sequence
atgactcacgaagaacaccacgccgccaagacgctggggatcgggaaggcaatagctgtcctcacttctggcggcgacgcccaggggatgaatgccgccgtgcgagcggtcgtaagggtgggcatattcactggcgctagagtcttctttgtgcacgaaggatatcaaggcctggttgatggaggagatcacatcaaggaagcaacatgggagtccgtcagcatgatgctgcaactgggtggtaccgtcatcggcagtgcacggtgtaaggatttccgggaaagggagggccgcctcagagcggcttacaacctggtaaaaaggggcattactaacctctgcgtgattggaggcgacggatcactgaccggagcagacacatttagatcagagtggtcagatcttctctcggacctgcaaaaggctgggaagataacagatgaggaggctacaaagtccagctatctgaacatagtcgggctcgtcgggtcgatcgataatgatttttgcggaaccgacatgacaataggcacagatagcgctctgcatcgcatcatggaaatcgttgatgccatcacaacaaccgcacaaagtcaccagaggactttcgtgctggaggtgatgggacggcactgtgggtacctggcattggtgacaagcctgtcttgcggcgccgactgggtgttcatacctgagtgcccccccgatgatgactgggaagagcacctgtgtcgccgtctgagcgagacacgcacaagaggttccaggctgaatatcattatcgtcgcagaaggcgcaattgataagaacggaaaacccattacctctgaggatatcaaaaatggatcccggatgggcgtagaagcggtcatggccttgctcgaaggaaccccggatacacctgcttgtgtggtcagtctgtccggcaatcaggctgttcgactcccccttatggaatgcgtccaggtgacaaaagatgtgactaaggctatggacgaaaaaaagtttgacgaggcccttaagctcagaggaaggtccttcatgaacaattgggaagtttacaaactcctggcacacgtgcggcccccagtgtcaaaatccggctctcacacagtggctgtcatgaacgtcggtgctcctgcggcagggatgaacgccgcagtgaggtctaccgtgcgcatcggcctgatccagggaaatcgggtccttgtggtgcacgatggctttgagggactggctaagggacagatcgaggaagccgggtggagttacgtcgggggttggacaggtcaaggaggctcgaaacttggaacaaagcggacactccccaagaagtccttcgagcaaatcagcgcaaatattactaagttcaatatccagggactggtaattatcggtgggttcgaagcctacaccggggggcttgagctgatggaaggccgtaaacaatttgacgagctctgcatcccattcgtggtcattcctgccactgtcagtaataacgttcctggcagcgatttctctgtgggcgctgacaccgccctgaatactatatgtaccacctgtgataggatcaagcaaagcgcagccggtactaagagacgagtgtttattatcgaaaccatgggaggctactgcgggtaccttgccaccatggcgggcctcgccgccggggcagacgccgcatacatctttgaggagcccttcacgataagagacctccaggctaacgtggaacacctcgtccaaaagatgaagacaactgttaagcggggcctggtgttgagaaacgagaaatgtaatgaaaactataccaccgattttattttcaatttatatagcgaagaaggaaaggggatctttgactcccggaagaatgtgctcggtcatatgcagcagggcggctcccccactccgttcgacaggaactttgcaacgaagatgggagcgaaggcaatgaattggatgtcgggaaagattaaagagagctacaggaacggcaggatcttcgctaacaccccagactcaggctgtgtgctgggcatgaggaagcgcgctctcgtattccagcctgttgccgagttgaaggaccaaactgacttcgagcacaggatcccgaaggagcagtggtggctcaagcttagaccaatcctgaaaattctggccaaatacgagatagacctcgacacttccgaccatgctcacctcgaacatatcacgcgcaaaaggagcggcgaagcagccgtgtag

SEQ ID NO: 128610 - DNA, 609 bp, Artificial Sequence
  Description of Artificial Sequence: Synthetic coding sequence
atgggcgggtattgcgggtatcttgccaacatgggcggactcgcggccggggccgatgccgcatatattttcgaagagcctttcgatatccgggacctccagtccaacgtggaacacctgactgaaaaaatgaaaaccaccatacagaggggactcgtattgcgaaatgagagttgctctgaaaactacacaactgattttatctatcaactttacagcgaagagggcaagggggtcttcgactgccgaaagaatgtgctgggccacatgcagcaagggggagctccgtctcccttcgaccgtaactttgggacaaaaatctccgcgcgggccatggagtggatcaccgccaaactaaaagaggccagaggacggggcaagaagttcactaccgatgactccatatgtgtgctgggtattagtaaacgcaacgtgatcttccagcccgtggcggagctcaaaaagcaaacagattttgaacaccgcattcctaaagagcagtggtggctcaaactcaggcccctgatgaaaatcctcgcgaagtacaaggcctcttatgatgtctctgatagtggccagctggagcacgtgcaaccgtggtccgtgtag

SEQ ID NO: 128611 - DNA, 2331 bp, Artificial Sequence
  Description of Artificial Sequence: Synthetic coding sequence
atgtgtggctatgaaagatgcaggccgtgtcggggcgctcacggctatctccggggagggcaaggggtgttacacctccgcggactgccaggccacggtgggaggagactcaaacatcggagaggtcggttgggagagtgtctgcagcaccctgcttccggcgcagtcagaggggactggcgtgagaagcccggatgttggtcacaccgattcccatgccccggcagacatgctctggtgggaggcacaattatcggtagcgcacgctgccaggctttcagaaccagggagggcagattgaaggctgcgtgcaatctgcttcagcggggcatcacgaatctctgcgtgatcggtggtgacggatccctgactggcgcaaacttgtttcgcaaagaatggagcgggctgctcgaagaattggcacgcaacggccaaattgacaaggaggctgttcaaaaatacgcatacctgaacgtggtggggatggtcggttccattgacaacgacttctgcgggaccgacatgaccatcggtacagacagtgctctgcatagaattattgaagtcgtcgatgccatcatgaccaccgcacagagccatcaacgcacttttgtcctggaggtaatggggaggcattgtggttacctcgccctggtatccgccctcgcctgcggagctgactgggtgtttcttccagagagtcccccggaagagggatgggaggagcagatgtgcgtgaaactgagcgagaaccgcgctcggaagaaacgattgaatattatcatcgttgcagaaggagctatcgacactcagaacaaacccataacatccgaaaagatcaaagagctggtcgtcactcaactcgggtatgatacacgcgtcacaatcctgggacatgttcaaagaggcggtaccccgagcgcctttgataggattctcgcctctaggatgggagttgaagccgtgattgccctcctggaggccactcctgatacccccgcgtgtgtggttagtctgaacggaaaccacgctgtcagattaccactcatggagtgtgtacagatgacccaggacgtgcagaaagcgatggatgagaggaggttccaggatgccgtccgccttcgtgggcgttctttcgcgggaaacctcaacacttataaaagactcgctataaagctgccagacgaccagattcctaagaccaactgtaacgtggccgtcatcaatgttggagctcctgccgccgggatgaatgccgcggtgcgatccgccgttcgggtaggtattgctgatggccaccggatgctcgcaatatacgacggcttcgatgggtttgccaaagggcagataaaggagatcggatggacagacgtggggggctggacagggcagggaggctccattctggggactaaacgtgttctgcctggcaagtacctcgaggagatcgccacccagatgcgcacacattcaatcaatgcgttactgattataggcggcttcgaggcttatctgggcttgctagaactgagcgccgctcgcgagaagcacgaggaattttgtgttcctatggtcatggtccctgcaactgtgagcaacaacgttcctggctccgatttttcgatcggagcagacaccgctcttaatactatcacagatacatgtgaccgcatcaagcagtctgcttctggtaccaagcggcgggtctttattatcgagacaatgggcgggtattgtgggtacttggcaaacatgggaggcttggctgccggtgcagatgcggcttacatcttcgaagaaccatttgacatccgtgaccttcagtctaatgtggagcatctaacagagaaaatgaagacaaccatacaaaggggcctggtcttgcgaaacgagagttgcagcgaaaactacaccacagatttcatttatcagctctacagcgaggaaggaaaaggcgtctttgattgccggaaaaatgtgctggggcatatgcagcagggcggcgctccttcaccttttgaccgaaactttgggaccaagatcagcgcccgtgccatggagtggatcactgccaaacttaaagaagccaggggacggggtaaaaagttcaccacggatgattctatttgtgtgttaggtattagtaagcggaacgtgattttccagcccgtcgctgagctgaagaagcagacagacttcgagcaccgtatccctaaagagcagtggtggctgaaactccgccctctgatgaaaatcctggctaagtataaagcttcttatgatgtgtcggattccggacaacttgagcatgtgcagccttggagcgtttag

SEQ ID NO: 128612 - DNA, 2355 bp, Artificial Sequence
  Description of Artificial Sequence: Synthetic coding sequence
atggacgccgatgattcacgtgcacctaaaggtagcctccggaagttcttagaacatctgagtggcgctggcaaagccatcggagtgctcacatccggcggggacgctcaaggtatgaacgctgcagtgcgcgctgtagttaggatgggtatttacgtgggggcgaaagtgtacttcatctacgagggctatcaaggcatggtggacggaggtagcaacatcgcagaagctgactgggagtctgtcagcagtatactgcaggtgggtggaacgatcattggaagtgccagatgtcaagcatttagaacccgtgaaggtaggcttaaggctgcgtgcaatctgctacagcgcgggattacaaacctgtgcgtgatcggtggtgatggtagccttacgggtgccaacttattccggaaagagtggagcggactgcttgaggagctcgcccgtaacggacagatcgacaaagaggcagtgcagaaatatgcctacctgaatgtggtggggatggtcggcagcatagacaatgatttctgcggcacagatatgactataggcaccgactctgccttgcacagaattattgaggtggtcgacgccattatgaccacagcccagtcacaccaacgaacctttgtgctcgaagtcatgggacggcattgtggttacctggctcttgtatccgccctggcttgcggtgcggattgggtgtttttacccgaaagccctccagaggagggctgggaagaacagatgtgcgtcaaactgagtgagaacagggcaaggaagaagcgcctcaacattattatagtggcagagggcgccatcgatacccaaaataagcccatcacttcagagaagattaaggagctggtcgtgactcagctcggctatgacacacgcgtcactatccttggtcatgtgcagcgaggcggaacgcccagcgcctttgataggattttggcctctagaatgggtgtcgaggccgtgatcgcgttgctcgaagcaacgccagatactcctgcctgtgtcgtcagcttgaatggaaaccacgctgtcagacttcccttgatggagtgtgtgcagatgacccaggacgttcagaaagctatggatgaacggcgctttcaggatgccgtacgacttagagggagaagcttcgccggcaatctgaacacttacaagcgcctggccatcaagttaccggatgatcagattcccaaaactaattgtaatgtcgcagtaataaatgtgggagcccctgcagcgggaatgaacgcagcagtgagatcagccgtccgggtgggcatcgctgacggccaccggatgctcgctatatacgatggcttcgacggatttgccaaaggtcagatcaaagaaatcgggtggacggacgttggtggatggacagggcagggagggtccatcttgggcacaaagcgcgtgctgcctggaaaatacttggaagagatcgcaactcagatgcgaacccactctattaacgcactgcttatcatcggcggcttcgaagcatacctcggattgctggaactttctgccgctcgggagaaacatgaggagttttgcgtgccaatggtgatggtccctgccacggtgtccaacaatgtacccggatctgattttagtatcggcgctgatacagcattgaacacaattacagatacctgtgacagaatcaaacaatctgcatctggtacaaagaggagagtctttatcattgagactatggggggatactgcgggtaccttgccaatatggggggcctggccgccggtgcagacgcagcttatatcttcgaggagccatttgatataagggaccttcagtctaatgtagagcatttaaccgaaaagatgaaaactaccattcagcggggactcgtcttaagaaatgaaagttgctcagagaactacacaaccgattttatctaccaactgtactcagaagagggaaagggggtgtttgactgtagaaaaaatgtcctcgggcacatgcagcagggcggtgccccctctccgttcgaccggaattttggaaccaaaataagtgccagagccatggaatggattacagccaagttgaaggaggcccgaggtcgcggtaagaagttcacaacagatgattccatctgtgtgctcggcattagcaaaagaaacgtgatctttcagccggtggccgaactgaaaaaacagaccgatttcgaacaccggatacccaaagaacaatggtggcttaagttaaggccactgatgaagattctggcgaaatacaaagcctcttacgatgtttccgactctggacagctggaacatgtgcagccctggagcgtatag

SEQ ID NO: 128613 - DNA, 2322 bp, Artificial Sequence
  Description of Artificial Sequence: Synthetic coding sequence
tacgaaaggtgccggccctgtaggggcgcacatggctatctccggggggggcagggggtgctccacctgcgaggtctgcccggccacggtggccgccgcttgaagcaccggcgcggccgcctgggagaatgccttcaacaccccgcctcaggagctgtgcgaggcgattggagagaaaaaccaggctgctggtcacatcgcttcccatgtccagggagacacgcactggtaggagggaccatcatcggctcagcccgctgtcaggctttcagaacccgcgaaggtcggctgaaagctgcatgcaacctgttgcagcgtgggattacaaatctgtgcgtgatcgggggagacgggtctctgaccggcgccaacctcttccgaaaggaatggagtggtctgctagaggaactggcgagaaacggacagatagataaggaggccgtccagaagtatgcatatctgaatgtggttgggatggtggggagtattgacaacgatttttgtggaaccgacatgaccattggaaccgattcagctttgcacaggatcattgaggttgttgatgcaatcatgacgaccgcccagtcccaccagaggacattcgttttggaggttatgggccggcactgtgggtatttagcgctggtttccgctctcgcttgtggagcggactgggtgttcctgccagagtctccaccggaagaaggctgggaagagcagatgtgtgtgaaactctctgagaacagggcccgaaaaaaacgtttgaacattataattgtcgccgagggagccatcgacactcaaaacaagcccataacttcagaaaagataaaagagctcgtggtgactcagctggggtacgatacccgggtgaccattctcggacacgtacagcgcggaggaacaccatctgcgttcgaccgaatcctcgcatcccggatgggggtggaggccgtcattgcacttctggaggccacacctgatactcccgcatgcgtcgtcagtctgaacggaaatcacgccgttcgcctcccactcatggagtgcgttcagatgacacaagacgtgcagaaggctatggatgagaggcgcttccaggatgcagttagactgaggggccgcagcttcgcaggcaatctgaacacttacaaacgacttgctattaaactgcctgatgaccaaatcccaaagaccaactgcaacgtagccgtaattaatgttggagcccccgctgcagggatgaatgcagcagttcggtctgccgtaagggttggcattgctgatggccatcgcatgcttgctatatacgatgggttcgatggcttcgccaaggggcagatcaaagaaatcggatggaccgatgtgggcggatggacgggccaaggtggaagcatcctgggaactaagcgagtgctgcctggaaagtacctcgaggaaattgcaactcagatgcggacgcacagcatcaacgcgctcctgatcatcggcgggtttgaagcgtatctagggctccttgaactctctgcagccagagaaaagcacgaggagttctgtgtccccatggtgatggtgcccgccaccgtcagcaacaatgtaccaggttctgattttagcattggagctgacacagccttgaacactatcacggacacatgcgacagaataaagcaatccgcctccggcactaagcggcgagtgtttattattgagacgatggggggttactgtggttacctcgcaaatatgggcgggcttgccgctggagccgatgccgcctacatttttgaagagcccttcgacatccgagatttacaatccaatgtcgagcatctgaccgaaaagatgaagacaaccatccagcggggcttagtcctgcgcaatgagagttgctcagagaattatacaaccgattttatctatcagctgtattctgaggagggcaagggcgtgttcgattgtagaaagaatgtcctgggacacatgcagcagggcggcgcacctagtccattcgaccggaatttcgggaccaagattagcgctagagccatggagtggattacagcaaagcttaaggaggccaggggtagaggcaagaagtttactaccgacgactcgatctgcgtattgggcatttctaagagaaatgtgatctttcagcccgtggccgagctgaagaagcaaacggattttgaacaccgtatccctaaggagcagtggtggctcaagttacgtcctcttatgaagatcctcgcgaaatacaaggcaagttacgacgtttcagacagcggtcagctggaacacgtacagccatggagcgtttag

SEQ ID NO: 128614 - DNA, 633 bp, Artificial Sequence
  Description of Artificial Sequence: Synthetic coding sequence
atgaacgcagccgtgcgggccgtagttaggatgggaatttacgtgggagctaaagtctactttatctacgagggataccaagggatggtggatggtggttccaacatcgcagaggctgattgggagagcgtgtcatccatccttcaggtgggaggaacgattataggaagcgctcgttgccaggcttttcgtacgagagaaggtcgcctaaaggctgcttgtaatttgctacagcgtggcatcaccaacctgtgcgtcatcggtggagacgggagcttaacaggggcaaacctgtttaggaaagaatggagtgggctcttggaagagctggctcgcaacggacaaattgacaaagaagcagtgcaaaagtacgcttacttgaatgtggttggcatggtgggaagcatcgacaatgatttctgtggcactgatatgacaatcgggactgactccgcactgcatcgtatcatcgaagtcgttgatgccatcatgacgaccgcccagagccatcagaggacatttgttctggaggtgatgggcagacactgcggatatctggctcttgtgtctgccttagcgtgcggtgccgactgggtattccttccagaatcaccaccagaagaagggtggtag

SEQ ID NO: 128615 - DNA, 501 bp, Artificial Sequence
  Description of Artificial Sequence: Synthetic coding sequence
taagctgatggccacagaatgctcgccatctacgatgggtttgacgggtttgctaagggccagatcaaagagatcggctggaccgacgtcggcggatggactggccaaggaggatctatcctcggaaccaaacgggtgttgccggggaaatatttggaagaaatcgcaactcagatgcgcacccactcaatcaatgccttactgattatcggtggcttcgaggcgtataagtctgcctgtgacatggccgaagcaagaggccggcaccaggagctgtgcatccccctgtgtgtggtgcctgcaactatctctaacaacgtccccggaaccgagataagtttaggatccgacactggtcttaatgccgttgtcgagacatgtgatcggatcaaacaatcagcttcgggcaccaagagaagagtatttatcattgaaaccatggggggctattgtgggtacctggctaacatgggcgggctcgccgctggggcggatgcatag

SEQ ID NO: 128616 - DNA, 723 bp, Artificial Sequence
  Description of Artificial Sequence: Synthetic coding sequence
atggggcgccactgcggttatttggcgttggtttcagcactcgcatgcggggccgattgggtgttcctgcccgaatcccctccagaggagggctgggaggagcagatgtgcgtgaagctctccgagaatcgcgcccggaagaagaggcttaacataattatcgtggcggaaggggctatcgatacgcagaacaagcccatcacgtccgagaagattaaggagcttgtagtaacccagcttggttacgatacaagagtgacaattctaggacacgtgcagagaggtgggacaccatctgcctttgatagaatcctagccagccgtatgggggtggaagcagtgattgctctcctcgaggcaacccccgacacgccagcttgcgtggtctctctgaatgggaaccacgcagtgcggctgcccttgatggagtgtgtgcagatgacgcaggatgttcagaaagctatggatgaaaggaggttccaagacgcggtgaggctcagggggaggtctttcgcaggcaacctgaatacatacaagcggctagctataaagttacccgacgatcagattcctaaaaccaattgcaatgtggccgtgatcaatgtgggggctccagcagccggaatgaatgctgccgttcgcagcgccgtaagggtaggaatcgctgacgggcataggatgttggccatttatgacggcttcgacgggtttgctaagggctag

SEQ ID NO: 128617 - DNA, 501 bp, Artificial Sequence
  Description of Artificial Sequence: Synthetic coding sequence
atgaatgccgctgtgcgagccgttgttagaatgggcatttatgtcggtgctaaggtatatttcatctacgagggttaccaagggatggtggacggtggatctaatattgcagaggccgactgggagtctgtgagcagcatcttgcaagtgggaggaacaatcatcggctcagctcggtgccaagctttccgcacgcgcgagggcaggttgaaggcagcctgcaatctactccagcggggtattaccaacttatgcgtcatcggaggggatggctctctgacaggcgcgaaccttttccgtaaagaatggagtgggttgctcgaggagctcgccaggaatggacaaattgacaaagaggcagtgcaaaagtacgcctacctgaacgttgtcggtatggtgggatccatagacaacgatttctgcgggacggatatgaccatagggacagattcagctctgcaccgcatcatcgaggtggtcgacgctataatgaccacatag

SEQ ID NO: 128618 - DNA, 312 bp, Artificial Sequence
  Description of Artificial Sequence: Synthetic coding sequence
taattcatctaccagttatatagcgaagagggtaaaggggtgtttgattgccgcaaaaacgtgcttgggcatatgcagcagggcggcgctccttctcccttcgacaggaactttggcactaaaatctccgctagggccatggagtggatcactgccaagctaaaagaggccaggggacgggggaagaaattcaccaccgatgactctatatgcgtcttagggatctcgaaacggaacgtgatatttcagccagtcgctgaactaaagaagcagaccgatttcgagaccgtatccatgcagcccccacgctag

SEQ ID NO: 128619 - DNA, 1743 bp, Artificial Sequence
  Description of Artificial Sequence: Synthetic coding sequence
atgagcgactttgaggagtggatcagcggaacctacaggaaaatggaagagggtcccctgccgttattaacattcgccactgccccctaccatgaccagaagccagggactagcggcttaaggaagaagacatactatttcgaagaaaagccctgttaccttgagaatttcatccagagcatcttcttttccattgaccttaaagacaggcagggatccagcttagttgtggggggcgacggacgctattttaataaaagcgcgattgagaccattgtgcagatggcagccgcaaatgggataggcaggctagtcattgggcaaaatggtattctctcaacccccgcggtgtcctgtattatacgaaagataaaggccattgggggcatcatcctcacggcctcacacaaccctggaggccctaatggtgacttcggaataaaatttaacatttcgaatggagggccagctcccgaggccattaccgacaaaatcttccagatctctaagaccatcgaggagtacgctgtttgccccgatctgaaggtggatctgggcgtgctgggcaagcagcaattcgatttggagaataaatttaagcctttcacggtggagatcgttgattcagtcgaggcctacgctaccatgcttcgctccatctttgatttttcagcgcttaaagaactactgtctggtccaaaccgcctcaagattaggattgacgctatgcatggggtagtaggaccctacgtgaaaaaaattctgtgtgaggaactgggtgcaccggcaaattcagccgtgaactgtgttcccctggaggatttcggcggacaccacccggaccccaaccttacatacgcggcagacctggtggagactatgaagtccggtgaacacgacttcggcgctgcttttgatggggatggggatcggaacatgatcttaggcaagcatggcttttttgtcaacccctccgattccgtcgccgttattgccgccaatatcttttccataccatattttcagcaaactggagttcgcgggttcgcacggtctatgcccacaagcggcgcattggacagagtagcctctgctactaagattgccctgtacgagacgcccaccggatggaagttctttgggaatctcatggacgccagcaagctgagcctttgtggggaggagagcttcgggaccgggtctgaccacatacgggaaaaggacgggttgtgggcggtcttagcctggctaagcattctagctacacgcaagcaaagcgtggaagatattctcaaggatcattggcagaagtatggccggaacttctttacaagatatgattacgaggaggtggaggccgaaggcgccaacaaaatgatgaaggatttagaagcactgatgttcgaccgatcatttgtcggcaaacaattcagcgccaacgacaaggtgtatacggtggagaaggccgataatttcgagtacagcgatccggtggatggttccatctcaaggaatcaggggctgcggttgatattcaccgatggcagccggatcgtttttaggctgtccggaacgggctctgccggggccacgatccggttatacatcgattcttacgaaaaggacgtggccaaaattaaccaagacccccaagtcatgcttgcgcccctgatcagcatcgcactgaaggtgtcacagctccaggagagaaccggacggacagcgccaaccgtgattacatag

SEQ ID NO: 128620 - DNA, 1689 bp, Artificial Sequence
  Description of Artificial Sequence: Synthetic coding sequence
atggtgaaaatcgtgacagtgaaaacccaggcataccaggaccagaagcccggcacgtccggtctcagaaaaagggtgaaagtgttccagtccagcgccaattatgccgagaattttatccaatccattatcagtactgtcgagcctgcacaaagacaggaagcaacactggtcgtggggggcgacggacggttctatatgaaggaggcaattcaactgatcgccaggatcgctgccgctaacggaatcggaagactcgttatcgggcagaacgggatcctgtccacccccgcagtaagctgcatcatacgcaagatcaaagccatcgggggaataatcctaacagcatcacacaatccaggtggcccaaacggcgacttcggaatcaagttcaacatttccaatggcggcccggcgcctgaagctataacagataaaatctttcaaatttctaaaaccattgaggaatatgccgtctgccctgatctcaaggtggaccttggcgttttgggtaagcagcaattcgatctggagaacaagtttaagcccttcaccgtggaaattgtggactccgtggaagcttatgcgacgatgctcaggtctatattcgacttctcagccctgaaagagctcctgtctggccccaaccggctgaagatccgtatcgacgcgatgcacggtgtcgtgggcccctacgtgaagaagattctatgcgaagagctcggggctcctgccaactccgcagtaaactgtgttccgctggaggacttcggaggacatcacccagatccaaatctgacgtacgccgcagatctcgtggaaacaatgaagagcggggagcacgacttcggagccgccttcgatggcgatggggatcgaaatatgatactcggcaagcatggttttttcgtgaacccgtcagactcagtcgccgtgatcgccgctaacatcttctcgattccttatttccagcagacaggggttaggggattcgcacggagcatgcccacttctggggccctcgaccgagtggccagtgccacaaaaatagctctctacgaaactccgaccggctggaagttcttcggtaacttgatggacgcttccaagttatctctgtgcggcgaggagtccttcggaactgggagcgatcatatccgggagaaggatgggttgtgggctgtactcgcgtggctgagcattctcgccactagaaagcaaagcgtcgaagatattctgaaggaccactggcagaaatatgggcgcaacttctttacccgttacgattacgaagaggtggaagccgagggagccaataaaatgatgaaggatctagaggccctgatgttcgaccggtcatttgttggcaagcagttcagcgcaaatgacaaagtttataccgtggagaaagctgacaatttcgaatattccgacccggtcgacggcagcatcagcaggaaccagggcctgcggctgatatttacggacggatctcggattgtctttcgcctgtcgggaaccggaagtgcaggcgctactatccgcctgtatatcgactcctacgagaaggacgtggccaaaatcaaccaagaccctcaggtgatgctggctccacttatctctattgctctaaaagtatctcagctacaagagcgcactggtaggacggccccaacagtgatcacttag

SEQ ID NO: 128621 - DNA, 1617 bp, Artificial Sequence
  Description of Artificial Sequence: Synthetic coding sequence
atggttaaagtattccaaagttctgccaactacgctgagaatttcatccagtccataatcagtacggtggagccagctcagaggcaagaggccacgctggtcgttggcggggatgggcgcttttatatgaaagaggcaattcagttgatcgcccgcatcgcagctgctaacggaatagggcggctggtgattggtcagaacggaatcctctctacgccggccgtctcttgtattattagaaagatcaaggccattggtggcattatcctgaccgcatctcataacccaggcggccctaacggggattttggaatcaagttcaatatctctaacggcggcccagcccccgaggccatcacggataagatctttcagatttcaaagaccattgaggaatatgcggtgtgccccgacttgaaagtggacctgggcgtactgggtaagcagcagtttgacctggagaataaattcaaaccgttcaccgttgaaatagtggacagtgtcgaagcatacgccaccatgttgagatccattttcgacttttcagcactgaaggaactgctctcggggccaaacagacttaaaattcgcatcgatgcgatgcacggtgtggtgggaccgtatgttaaaaaaattctctgcgaagaactgggcgctccagctaactcagctgtcaattgtgtcccactcgaagatttcggtggccatcatccagatccaaacctgacctatgccgcagatttggttgaaactatgaagagcggcgaacatgactttggggcagcctttgatggcgacggcgacagaaatatgattttgggcaagcatgggttcttcgttaatccttccgatagcgtggctgtcattgccgccaacatattctccatcccttacttccagcagacaggggttcgaggattcgccaggtcaatgcccacttctggcgccctggaccgcgtcgcttcagcaacaaaaatagctctgtatgagacgcctaccggttggaagttctttggtaatttaatggacgcatccaagctctccttgtgtggagaagagtcctttggcaccggctccgatcatatcagggagaaagacgggctctgggccgtgctggcctggctgtctattttagcgacccgcaagcagagtgtggaagacatacttaaggaccactggcaaaagtacggcagaaacttcttcacccgctacgactacgaggaggttgaagcggagggcgctaataagatgatgaaggacctggaagcacttatgtttgaccgcagtttcgttggtaagcagttttctgccaacgataaagtttataccgtggagaaagcggacaacttcgagtattctgaccctgttgatggctcaattagccgaaaccaaggccttcgtctgatatttactgatggatcacggattgtgtttcgcctatcggggaccggatccgcaggagcgacaattaggctgtacatcgattcctatgagaaggacgtcgccaaaatcaaccaagacccacaggtcatgttagccccgctgatatctatcgccctgaaggtgtcccagctgcaggaacggacgggccgaaccgcgcccaccgttataacctag

SEQ ID NO: 128622 - DNA, 1098 bp, Artificial Sequence
  Description of Artificial Sequence: Synthetic coding sequence
atgctacgctcgatttttgacttctccgctctcaaagagttactgtctggccccaaccggcttaagattcggatcgatgctatgcacggcgtagtggggccctacgtcaagaaaattctctgtgaggagctgggagcaccagccaattccgcagtgaactgcgtccccctcgaagatttcggcggacaccaccccgatccaaacttgacatacgccgcagacttggtcgagactatgaagtctggggagcatgatttcggagctgcctttgatggcgacggagacagaaatatgatcctgggcaaacatgggttctttgtcaacccgtctgacagcgtggcagtcattgccgcaaacatctttagcattccatatttccagcagaccggagttcgaggatttgctcgctcaatgccaacatccggggctctggatcgggtggctagtgccactaaaattgccctctatgagacgcctactgggtggaaattcttcggtaacctgatggatgcatctaagctatcactgtgcggagaagagtcattcggaacaggatccgaccacatcagagaaaaggatggcctttgggctgttctggcctggctgagtatactcgctacccgaaagcagagcgtggaagacatcttgaaagatcattggcagaaatacggtcggaacttctttactagatacgactacgaggaggtggaagcagaaggtgccaacaaaatgatgaaggacctggaggctttgatgtttgatcgcagctttgtcggaaaacagttttctgctaacgacaaggtatacactgttgaaaaggcggataacttcgagtactctgatcccgtcgatggaagcatcagccgtaatcaggggctgagattaattttcactgacggtagtcgaatcgtctttaggctgtctggaaccggttccgccggggccactatccgactctacattgatagctacgagaaagatgtagctaagattaaccaggatccacaggtgatgcttgcccccctgatctccattgctctgaaagtgtcccagttacaagagagaacgggcagaacagcaccgacggtgatcacctag

SEQ ID NO: 128623 - DNA, 1839 bp, Artificial Sequence
  Description of Artificial Sequence: Synthetic coding sequence
atggctgcgcctgaaggaagcgggctgggggaggatgctaggctggatcaggaaactgcccaatggctgcgatgggacaaaaatagcctgacactggaggctgttaaacgtttaatcgccgagggtaataaagaggaactgaggaagtgcttcggagcaaggatggagtttggtaccgcgggcctgcgggcagctatgggcccaggaatatcccgcatgaatgaccttactatcattcagaccacccagggattttgccgttacttggaaaaacaattcagcgatctgaaacagaaggggatcgtgatatcattcgacgctagggcccacccctctagcggaggatcttccaggcgattcgccaggctggccgcgactaccttcatttcacagggaattcccgtgtacctgtttagcgatataacacctaccccctttgtgccattcactgtgagtcatcttaagctctgtgcgggaataatgattacagcaagccataatccaaaacaagataatggctacaaagtgtattgggacaatggagcacaaattatttctccccatgacaaggggatctcgcaggccattgaggaaaatttggagccttggccacaggcttgggatgacagcttgatcgactcctcacccttgctgcataatccgtccgcaagcatcaacaatgactacttcgaagaccttaagaaatactgctttcaccgatctgtgaaccgcgagacaaaagtcaagttcgtacatacctcggttcatggcgtgggccactctttcgtccagtctgccttcaaggcttttgacttagttcctcctgaggcagtgccagaacagaaagaccccgatcccgaatttccgaccgtaaagtaccctaatcccgaggaagggaagggcgtcttaacactttcatttgccctcgctgataagactaaagccaggatcgtcctggctaacgatccagatgcagacaggctggctgtcgcagagaagcaagattcgggcgaatggagagtgtttagcgggaacgagctgggagcactgttagggtggtggctattcacttcctggaaagaaaagaatcaggatcgctctgcgctgaaggatacttatatgttgtctagcactgtctcgtcgaagatcctgcgtgctatcgcactgaaggaggggtttcacttcgaggaaacactgaccggatttaagtggatgggcaatcgcgcaaaacaactcattgaccagggcaagacggtgctgtttgcattcgaggaggctattggctatatgtgctgccctttcgtgttggataaggacggagtatctgccgcagtcatttctgccgaactggcgtcatttctggcaaccaagaacctttctctgtcccagcagctcaaagctatttacgtggagtatggatatcatatcacaaaggcctcctacttcatctgccacgaccaggagactattaaaaaactcttcgagaatttaaggaactacgatggtaagaataattaccctaaggcttgcggcaagttcgagattagcgctattagggatttgacaaccggctatgacgactctcaacccgataagaaagcagtgttacccacgtccaagagcagccaaatgatcacctttacctttgctaatggaggtgtggcaacaatgcggactagtgggaccgaacctaaaataaaatattatgcagagctgtgtgcccctcccggcaattccgacccagagcagttgaagaaagaattgaatgagctggtctctgctattgaagaacacttctttcagcctcagaaatacaacttgcagcccaaagccgactag

SEQ ID NO: 128624 - DNA, 1359 bp, Artificial Sequence
  Description of Artificial Sequence: Synthetic coding sequence
atgattactgcctcacacaaccctaaacaggataacgggtacaaagtctattgggacaacggcgcccagattatttcacctcacgataaggggatttctcaggcgatcgaagagaacttggaaccatggcctcaggcctgggatgacagcttgatcgattcctctccattgcttcacaacccctcagccagcattaacaatgactacttcgaagacctcaaaaaatattgttttcaccgtagcgtgaaccgggagaccaaggtgaagttcgtccacacatctgttcatggagtggggcacagcttcgtccagagtgctttcaaggctttcgatctagtgccccctgaggccgtgccagaacagaaggaccccgatcctgagtttcccaccgtgaagtaccctaaccccgaagaaggcaagggagttctaactctcagttttgctctggccgacaagacaaaagccaggatagtgttagccaatgatcccgacgcggaccgtttggccgtcgccgagaaacaagattccggggaatggcgggtgttctccggaaatgagctgggtgctctccttggctggtggctcttcaccagttggaaggaaaagaaccaagatagatccgcgctgaaggatacatacatgctttcctctacagtgtctagtaagatcctgagagctattgccttgaaagaggggtttcattttgaagagacccttacggggttcaaatggatgggtaatcgcgcgaagcaattgatagaccaaggaaagaccgtgctgttcgcttttgaagaagcgatcgggtacatgtgctgcccctttgtcctggataaggatggggtaagcgcggcagtgatctctgctgaactggctagttttctcgctaccaaaaatttatcgctttcacagcagctgaaagctatatacgtggagtacggttaccatataacaaaggcatcttactttatctgccatgaccaggaaaccataaagaagctgttcgaaaatctccggaactacgacggcaaaaacaattatcccaaggcatgcggtaaatttgaaatcagcgctattcgcgacctaaccactgggtacgacgactctcagccggacaagaaagccgtcctgccaacttccaagtctagtcaaatgattaccttcacgttcgccaatggtggtgtggctactatgaggacttccggaacagaacccaagataaaatactatgcagagctgtgtgctccaccagggaactcggatcctgagcaactaaagaaagaactgaacgaactggtgtccgctattgaggaacatttttttcaaccccagaaatacaatttacagcccaaagcggactag

SEQ ID NO: 128625 - DNA, 876 bp, Artificial Sequence
  Description of Artificial Sequence: Synthetic coding sequence
atgtcttcccagttgattttgcggccctttacggtatctcatcttaagctctgcgctggaattatgatcaccgcgagccacaaccctaagcaagacaatggctacaaagtctactgggacaatggagctcaaattatttcaccacatgataagggcatcagtcaggccatcgaagagaatctagagccctggccccaggcttgggacgactccctgattgattctagtcccctgctccacaatccaagcgccagtattaacaatgattatttcgaggacttaaaaaagtattgtttccatcgaagtgtaaatcgagagacaaaggtgaagtttgtgcacacctccgttcatggagtgggccattcatttgttcagtccgctttcaaggcttttgaccttgtcccaccagaagccgtccctgagcagaaagacccagatcccgagtttcccaccgtaaaatatccaaaccccgaagaagggaagggggttttgacactgtcgttcgctctggcggataaaaccaaagctcgcattgttctggctaacgaccccgacgcggatcgcctcgccgtggcagaaaaacaggactctggcgaatggagagtcttttccgggaatgagcttggcgccctgcttgggtggtggctgttcacaagttggaaagagaaaaatcaggaccgttccgccctgaaagacacatatatgctcagttccaccgtctcatctaagattttgagagccattgcactgaaggaggggtttcactttgaagagacactgaccggcttcaagtggatggggaatagggcaaaacaactcatcgaccaggggaagactgtcctgtttgcgtttgaagaagccatcggaaaaaaatag

SEQ ID NO: 128626 - DNA, 1869 bp, Artificial Sequence
  Description of Artificial Sequence: Synthetic coding sequence
atggctgagaatactgaaggcgacctcaattctaatctgttacacgccccatatcacaccggtgatccgcagctagacaccgcaatcggacaatggctgcgctgggacaagaatcctaagacaaaggaacagattgaaaacctgctgcggaacggcatgaacaaggagctgagggatagactgtgttgcagaatgacctttggcaccgcagggttgcgctccgccatgggtgcagggttttgctacatcaatgatttgaccgtgatccagtctactcagggtatgtataagtacttggagagatgcttctcggactttaaacaaagaggtttcgtcgtgggatatgacactagggggcaagtgacgtcttcctgctcctcccagcgtctggcaaaacttactgctgccgtgctactggccaaggatgtcccagtgtacttattttcccgctatgtacctaccccatttgtgccgtatgccgtacagaaactaaaggcggtagcaggcgtaatgatcactgcatcacataatcgaaaggaggacaatggatacaaggtgtactgggagaccggcgctcaaattacatcgccacacgacaaagagatcctgaaatgtatagaggagtgcgtggaaccatggaatggcagttggaacgataatctcgtcgacaccagcccccttaaaagggatccccttcaagacatttgcagacggtacatggaggacctgaagaaaatttgtttttatcgtgaactcaatagcaaaacaactctgaagtttgtccacaccagtttccacggagtaggccacgactatgtccaattggcttttaaagtatttggctttaaaccccctattccggtgcctgaacagaaggatccagatccagatttctctaccgtaaagtgcccaaatcctgaagagggagagtcggtgctagagctgagcctgaggctcgctgagaaggaaaacgctcgcgtcgtactcgcaactgatcctgacgcagacaggctggctgcagctgagctccaggagaatgggtgctggaaggtatttacaggtaatgagctcgccgcccttttcgggtggtggatgtttgattgttggaagaaaaacaaatctcggaatgccgacgtcaaaaacgtgtacatgttggccacgacggtgtcttccaagatcctgaaggccatcgctctcaaagaggggttccatttcgaggaaacattacctggattcaagtggatcggatccaggattatcgacttgctcgagaatggaaaagaagttctgtttgcctttgaggaaagtataggattcctgtgcgggacgtctgttctagataaggatggggtgtccgctgcagtggtggttgccgaaatggcttcttaccttgaaactatgaacattacactgaagcagcagctggtcaaggtgtacgagaaatacggttaccacatttcaaagactagctattttctctgctatgagcctcccacaattaagtccatcttcgaacgtcttaggaattttgatagtccaaaagagtacccaaaattttgcggtaccttcgccatcctgcacgttcgggacgtgaccaccggatatgactcaagccagcccaacaagaagagtgtactgcctgtgagtaagaacagccaaatgattacatttacatttcaaaatgggtgcgttgcaacactgagaacaagcggcaccgagccaaagatcaaatattatgccgagatgtgtgccagccctgatcagagcgatactgcacttctggaagaagagttaaagaaactaattgacgccctgatcgagaatttcctccagccttctaagaacggacttatttggcggtcagtttag

SEQ ID NO: 128627 - DNA, 1713 bp, Artificial Sequence
  Description of Artificial Sequence: Synthetic coding sequence
atgggcggcgaatggggccaatccgctatttgccccgaaagcgcccaggaatggacttatcaggtgggccagcatctggttgatatggatttgggggctattactaaatactcagctttgcacgccaagccgaacgggctgattctgcagtacggcaccgccggatttagaacaaaagcagagcacctggatcacgtcatgtttcgcatgggcctccttgctgtgctgagaagcaagcaaacaaaatctactatcggggtgatggtgacggcatcccacaaccctgaagaggacaacggggtcaagctggtggaccctctcggcgaaatgttggcccccagttgggaagagcacgcaacatgcttggctaacgctgaggaacaagatatgcagcgcgtattgatcgatatctcagaaaaggaggctgtgaacttgcagcaggatgccttcgtggtcatagggcgagacacacgtccttcatctgaaaaactgtcccagtcagtgattgatggggtaactgtcctcgggggccaattccatgattatgggctcctcacaaccccccaactacactatatggtttactgtcgaaacacgggcggacgctacggtaaggctaccatcgaaggttattaccagaaactgagcaaggccttcgtggagcttactaagcaggcaagctgctcaggagacgaataccgctcattgaaggtggactgcgctaatggcataggcgccctgaagctgagggagatggaacactatttttcacaagggctgtctgtacagctattcaatgacgggtctaagggtaagctcaaccacctgtgtggcgctgactttgtaaaatctcaccagaagccaccacaaggtatggagatcaagagcaatgagcgctgttgttcctttgacggggacgccgatcgaatcgtgtactactaccacgacgcggacggacatttccacctcatcgacggagacaaaattgcgactctgatcagttcattcttgaaagagctcctggtagagatcggtgagagcctgaatatcggggtggtgcagactgcctacgccaatggtagcagcactaggtacctcgaggaagtgatgaaagtgcccgtgtattgcacgaaaacaggggtgaaacacttacaccacaaggcacaggagttcgacatcggtgtctacttcgaggccaacggtcacggaacggccttgttcagtacagctgtggaaatgaaaattaagcagtctgccgagcagttagaagataaaaaaaggaaggccgccaagatgctggagaacattatcgaccttttcaatcaagccgctggtgatgccatcagtgacatgttggtcatcgaagcaattctcgctctaaaaggcctgaccgtgcagcagtgggatgctttatacaccgacctcccaaacagacaactcaaggttcaggtcgctgaccgtcgggtgatcagcaccactgatgctgagaggcaggccgtcacccctccaggactgcaggaggccataaatgacctcgtgaaaaagtacaaactgtccagggcttttgtccgtccatccgggacggaagacgtcgtgagagtttatgccgaagctgactcccaagaatccgcggaccacttagcccatgaagtctccctggccgtgtttcagctggccggagggattggggaaaggccacaacccggcttctag

SEQ ID NO: 128628 - DNA, 444 bp, Artificial Sequence
  Description of Artificial Sequence: Synthetic coding sequence
atggatctgggcgccatcaccaagtactcagcactccacgcaaagcctaatggcctcattctccaatatggcaccgcgggctttcggacaaaggccgaacatctcgaccacgtgatgtttaggatggggttgcttgccgtgcttcggagtaaacagacaaagagtaccatcggcgtcatggtcactgcatcgcataaccctgaggaggataatggagtaaagctggtggatcctctaggggaaatgctggctccctcttgggaggaacacgccacatgtttagccaacgctgaggagcaggatatgcaacgggtcctgatagatatctcagaaaaagaggctgtcaacctgcagcaggacgcttttgtggtcatcggacgggacacccggccctcatccgagaaattaagtcagtctgtcatcgacggtgtgaccgtgctgtag

SEQ ID NO: 128629 - DNA, 1629 bp, Artificial Sequence
  Description of Artificial Sequence: Synthetic coding sequence
atggatctgggggccataaccaagtatagcgcccttcacgccaagcccaatggattgatcctccagtatgggaccgcggggtttcgaaccaaggcagaacacttggatcacgtcatgttccgcatggggcttctggccgtactgagaagcaagcagactaagagcactataggggtcatggtcaccgcctcccataaccctgaggaggataatggtgttaagcttgtcgatcccttgggggaaatgttagccccatcttgggaggagcacgcaacgtgcctggctaatgccgaagagcaggatatgcaaagggtcctgattgatatttccgagaaagaagcagtgaatttgcagcaggacgcctttgtcgtgatcggacgagataccagaccgagtagcgagaaactctcacaatcagtgatcgacggagtaaccgtcttgggggggcagttccacgattacggcctgcttaccactcctcagttgcactatatggtgtactgtaggaacacggggggcaggtacggcaaggctacaatcgaaggatactaccagaagctctcaaaagcgtttgtggagcttaccaaacaagcttcgtgtagcggggatgaatacaggtcactgaaagttgactgcgctaatggcattggagctctaaaactgagagagatggaacattatttctcacaggggctgtctgtgcagctgtttaacgatggatcaaaagggaaacttaatcacctctgtggagccgactttgtaaaatcacaccaaaaaccccctcagggaatggagattaagagtaatgagcggtgttgctccttcgacggcgacgcggatcgcatcgtatattattatcacgatgcagatggccacttccacctaatcgacggagacaagattgccactctcatatcctcctttttgaaagaactgttggtcgagatcggtgaaagtctcaatattggagtggttcagaccgcctatgcaaatggcagtagcacaagatatttggaggaggtcatgaaggtacctgtttattgtacgaagactggcgtgaagcacctgcaccacaaggcacaggaattcgacatcggtgtatactttgaagctaatggccacgggaccgcactcttctctaccgcagtggagatgaagattaagcagagtgccgaacagctggaggataaaaaacgtaaggctgccaaaatgcttgagaatattatcgatctcttcaaccaggcagcaggggatgccatctctgacatgttggtgatcgaggccatcctggccctcaagggtcttaccgtgcaacaatgggacgctctttatacagacttgccaaacagacaattgaaggttcaagtcgctgataggagagtgatcagtacaactgacgccgaacgccaagccgtgaccccccccggcctgcaggaggccatcaacgatctcgtgaagaaatataaactatctcgcgccttcgttcgcccttccggtaccgaggatgtggtgcgggtctacgctgaggccgacagccaagagtctgccgatcacctggctcatgaagtcagtctcgctgtgttccagctggctggcgggattggcgagcggcctcagcctggcttttag

SEQ ID NO: 128630 - DNA, 1701 bp, Artificial Sequence
  Description of Artificial Sequence: Synthetic coding sequence
atggatcttggggccatcactaaatactccgccctgcacgccaaacccaacggacttatcctgcagtacggcacggccggtttcaggacaaaggccgaacatttggaccatgtaatgttcaggatggggctactggccgtattacggagtaaacaaaccaaaagcactatcggggtcatggtgaccgcaagccataatcccgaggaggataacggagtgaaattagttgatcccttgggcgaaatgctggctccgagttgggaggagcacgcaacttgccttgctaacgcggaggaacaggacatgcaacgagtgctaattgacatatccgagaaggaggcagtgaacctgcagcaggacgcattcgtggttattgggcgcgacacacgaccatccagcgaaaaactgtctcagagcgtgatcgatggagtgacagttttaggtggacaattccatgattacgggctgctaacaactccccaattgcactacatggtgtactgcaggaacaccggaggacggtatggaaaagccacgatcgagggttactaccagaagctttccaaggcgtttgtcgagctgaccaaacaggcaagctgtagtggtgatgaataccgtagtttaaaagtggactgtgctaatggcatcggtgccctgaaactccgcgagatggagcactatttctcacagggactgtctgttcagctcttcaatgatggctctaagggaaagttaaatcacctctgcggtgccgatttcgtgaagtctcaccagaagccaccacagggcatggagataaagtcaaacgagcggtgttgcagttttgacggggacgccgataggatcgtgtactattatcatgacgcagacggacatttccatttgatcgatggcgacaaaattgcgaccctgatcagcagcttcttgaaggaactcctggtggaaatcggagaatcgctgaatatcggcgtagtccagaccgcttacgctaatggaagctcaacgagatacctcgaagaggtcatgaaagtccctgtatattgcaccaaaacaggggtaaaacatctgcaccacaaggctcaagaattcgatatcggggtatactttgaagccaatggacacggaaccgccctcttttcgacagccgtggagatgaagatcaagcagtccgcagaacaactggaagataaaaagcgtaaggctgctaagatgctggagaacatcatcgaccttttcaatcaggcagcaggggacgcaatctccgatatgctcgtcatcgaggcaatccttgctctgaagggcctgactgtgcaacagtgggacgctctgtatacagacttgccgaaccgtcaactaaaagttcaggtggcggatcgacgtgtgatctctacgacagacgctgaaagacaggcagtcaccccgcctggattgcaagaggcaataaatgacctcgtgaagaagtataagctctccagagcattcgtcaggccgtccggaaccgaggacgtggtgagggtttatgcagaagctgactcacaggagtcggccgatcatctagcccatgaggtgagcctggctgtcttccagctggccggtgggatcggggagcggccacagccaggctataaagctgctgagaccactcacaatataaacaacgcttttggacctggaaccgctaatgaacacaccgtaccttag

SEQ ID NO: 128631 - DNA, 720 bp, Artificial Sequence
  Description of Artificial Sequence: Synthetic coding sequence
atggagggctcgcctatccccgtcctcaccgtgcctaccgcaccttatgaggatcagagacccgcaggcggcggcggcctacggcgccctacggggctctttgaaggacagaggaactatttacccaattttatccagagcgtgttatcctctatcgacttaagggaccggcagggttgcacgatggtagtgggatctgacggacgctactttagtcgaaccgcaatagaaatcgtggttcaaatggctgctgccaatgggatcggcaggttaatcatcggccagaatgggatcctctcaactcccgctgtctcttgcataattcgtaaaattaaagcagcaggtgggatcattctcacagcaagccactgtccagggggccccggcggcgagttcggagtgaaatttaacgtggcgaatggcgtagagatcgtggatcctgtggacatttacctgaatctcttacgcacaatcttcgactttcacgccattaaaggtctgctgaccgggcctagtcaactcaagatccgcatagatgccatgcatggagtgatgggaccatatgtgagaaaggtcttatgtgatgaactgggcgcacccgcaaacagcgccataaattgtgtgccccttgaggacttcggtgggcaacatccggaccctaaccttacgtacgcgaccactctgctggaggccatgaaagggggtgagtacggattctag

SEQ ID NO: 128632 - DNA, 1704 bp, Artificial Sequence
  Description of Artificial Sequence: Synthetic coding sequence
atggaggggagtccaatcccagtgttgaccgttccaactgctccatacgaggaccagcgccccgccggcggcggaggcctgcgacggccgacaggcctgtttgaaggtcaacggaattacctgccaaacttcatacagtctgttctgtccagcattgatctacgggatcgtcagggatgtaccatggtggtcgggtcggatggacgctactttagcagaactgccatcgagatcgtggtccagatggccgccgccaatgggatcggaagacttattataggacaaaatggcattctgtctaccccagctgtgagctgcatcatcagaaaaatcaaggccgcaggggggataatcctcactgcctcccattgtcccgggggccctggtggagagttcggagtgaaatttaacgttgccaacggaggccccgcacccgatgtggtgagcgacaaaatttaccaaatttcgaaaaccatcgaggaatatgctatttgcccggacctgaggattgacttaagcagattgggcaggcaggagttcgatctcgaaaataagtttaagcctttccgcgtagagattgtggaccctgtggatatttacctgaacctgctgagaacgatctttgactttcatgcaattaagggcctcctgacgggtcctagccagctgaagattcgcatcgacgccatgcatggcgtgatggggccttatgtccgcaaagtcctgtgcgacgaacttggcgcaccggccaactcggcgataaattgcgtgccacttgaggatttcggcggacagcacccggatccaaatctgacctatgcgacaactttacttgaggctatgaaggggggagaatatggcttcggggccgccttcgacgccgatggcgacagatatatgattctggggcagaatggctttttcgtgtcccccagcgactcactggctatcatcgccgcgaatctatcctgtatcccttactttcgccagatgggtgtcaggggatttgggcgcagtatgccgacatctatggcactagatcgtgtcgctaagtcaatgaaggtgccagtttatgagaccccagccgggtggagatttttttcaaacctgatggacagtgggaggtgtaacctgtgcggcgaagaatccttcggcaccggttctgatcacctcagggaaaaggacggactgtgggccgtcctggtctggctctctataatcgccgccagaaaacagagtgtcgaggaaattgttagagaccattgggctaaattcggtcgccattattactgtcgatttgattatgagggtctggatcccaaaacgacttactatataatgcgcgatctggaagcgctcgtaacagacaagtcctttattggacaacagttcgcagtcggcagccatgtgtattccgtggccaaaactgatagctttgagtacgtggatcctgttgacggcactgtcactaagaagcagggcctgcggatcattttttctgacgcatctcgactcatctttaggctgtctagcagttccggagtgagagcaactctgaggctgtatgcagaaagttatgaaagggacccctctgggcatgatcaggagccccaggcggtgctctcccccctgatagcaatcgcacttaagattagccaaattcacgaacgtactgggcgacggggtcccacagtgatcacttag

SEQ ID NO: 128633 - DNA, 1452 bp, Artificial Sequence
  Description of Artificial Sequence: Synthetic coding sequence
atggcacaggccgacatagccctgatcggactggctgtgatgggccaaaatctgattctgaatatgaatgaccatggctttgtggtatgcgcattcaaccggaccgttagcaaggtggatgacttcttggcaaacgaggccaagggaacaaaggtcgtgggtgcccagtctctgaaggaaatggtgagcaaactgaagaagccccggcgcataattttgttagttaaagcgggacaggcagtggacgattttattgaaaagctggtgcctctgctggatactggcgatataattatcgacgggggaaactccgagtaccgggacacgacacggcgctgccgtgatttaaaggctaagggaatactgtttgtaggatcgggtgtgagtggcggcgaagaaggggcacgctatggaccttctctcatgcctggggggaacaaagaggcctggccacatatcaaaactattttccagggaattgcagccaaggtcgggaccggagaaccttgttgtgattgggtaggcgatgaaggagctggccacttcgtgaagatggtgcataatggcattgaatacggcgacatgcagctcatatgtgaggcctatcacctgatgaaggatgtcttggggatggcccaagacgagatggcccaggcgttcgaggactggaataagacagaattggacagtttcctgatagagattacggccaacatcctcaaattccaggacaccgatggcaagcacctgctaccaaagatccgcgactctgccgggcagaagggcactggaaagtggaccgctatttcagctctggagtatggtgtgcccgtaacgttaatcggcgaggcagtgttcgctagatgtctctccagtctgaaagacgagcggattcaggcctcaaagaagcttaaaggaccacagaagtttcaatttgacggcgacaagaaaagttttttggaggacattcgcaaggctctatatgcctccaagatcattagctatgcgcaggggttcatgctgctgcgccaggcagccaccgaattcggctggacattgaattacggcggaatagctctgatgtggcgaggaggttgcataatccgctccgtgtttctgggaaagatcaaagatgcttttgacagaaacccagaactgcagaatttactgctcgacgacttttttaaatcggcagtcgaaaattgccaagattcctggaggcgggcggtttccacaggtgtgcaggcaggcatacctatgccgtgctttaccaccgctttatccttctatgatgggtatcgccacgagatgcttcctgcctcattaatccaggctcagcgggactactttggtgcccatacctacgaactgctggcgaagcctggtcagtttatccacactaactggaccggacacggtggcaccgtgtcatcttcgagctacaacgcttag

SEQ ID NO: 128634 - DNA, 1413 bp, Artificial Sequence
  Description of Artificial Sequence: Synthetic coding sequence
atggggcaaaatctaatcctgaatatgaatgaccatggctttgtcgtttgtgcatttaatcgcactgtctctaaagttgatgattttctggcaaacgaggctaagggaacgaaggtcgtcggagcccagtccctgaaagagatggtttcaaagctcaaaaaaccccggcgcattatactgctggtcaaggctgggcaggcagtcgacgactttattgagaagctggtccctctcttggacaccggggacatcatcatcgacggaggaaatagcgagtatcgagatacaactcgcaggtgcagagacctaaaggcgaaaggaattctatttgtgggctctggtgtttccggtggcgaggagggagccagatacgggccctcactgatgcccggcggcaacaaagaagcatggccccacataaagacaatcttccaagggattgcagccaaagtagggacgggtgagccctgttgcgattgggtgggggatgagggggcgggtcactttgtcaagatggtacacaacggcatagagtatggcgatatgcaactgatctgtgaggcatatcacctcatgaaagacgtcttaggcatggctcaggatgagatggcccaagcctttgaggactggaataaaacagagctagattccttcttgatcgagattaccgcaaacatcctgaaattccaggatacagacggtaagcacctccttccgaagatacgtgattccgccgggcaaaagggaaccgggaagtggaccgcaatctccgccctggagtacggagtgccggtcactctgattggagaggccgtgttcgcccgatgcttgtctagtctcaaggatgaaagaattcaggcctctaagaaactgaagggtccacagaagttccaatttgatggagataagaagagctttttggaggatattcgcaaagccctctatgcatctaagatcatcagttacgctcagggatttatgctgctgcggcaggcagccaccgaatttggctggactctgaattatggcggcatcgcgcttatgtggagaggaggatgcattatccgatccgtctttcttggcaagatcaaggacgcttttgatcgcaatcccgagctccagaatctgctcctggacgacttcttcaaatccgctgtcgaaaattgtcaggactcatggagacgggcagttagcactggggtgcaagctgggatccctatgccatgttttacgaccgccctgtccttctacgacgggtaccgccacgagatgctccctgcctcccttatccaggcccagcgcgactacttcggcgctcacacgtacgaactactcgcaaaaccaggacagtttattcacactaattggactggtcacgggggcacagttagtagcagttcatataacgcctag

SEQ ID NO: 128635 - DNA, 1386 bp, Artificial Sequence
  Description of Artificial Sequence: Synthetic coding sequence
atggcccaggccgatattgcccttattggcctggcagtcatgggccagaaccttattctgaatatgaatgaccacggctttgtagtgtgcgcctttaaccgcacagtctctaaggtcgatgactttctcgctaacgaggccaaaggcacgaaagtggttggcgcgcagtctctgaaagaaatggtttctaagctcaagaaaccccgcagaattattttacttgtgaaagcaggccaggctgtagacgacttcattgaaaagttacggagatgcagggacctgaaggccaaaggcatcctattcgtcgggtcaggggtgagtggtggggaggaaggggctaggtacgggccaagccttatgccaggaggcaataaggaagcttggccccatatcaaaacgatcttccaagggatcgctgcaaaggtcggaacaggcgaaccgtgttgcgactgggtgggagacgagggagccggccacttcgtgaagatggtgcacaacggtatcgaatacggggacatgcagctgatttgcgaagcctatcacctgatgaaggatgtactcggcatggcacaagatgagatggcacaggccttcgaggactggaacaagactgagctggattcatttctgatcgagatcaccgctaatatattaaagtttcaggatactgatggcaaacatctgctaccaaagattcgcgattctgcggggcagaaaggcacgggaaagtggactgcaatctctgcccttgaatatggcgtgcctgtaacgcttataggcgaggccgtattcgctaggtgtttgagttcattgaaagacgaaaggatccaggcatccaagaagctcaagggacctcagaaatttcagtttgacggagacaaaaagtcctttttggaggacatccggaaagccctatacgcctccaaaattattagttacgctcagggatttatgctgctgagacaagccgccactgaattcggttggaccctgaattatggaggcatcgcgctaatgtggcggggcgggtgtatcatccggtcggtgtttttgggtaagattaaggacgctttcgaccggaacccagagctgcagaatctcctgctggatgatttttttaaatccgcagttgagaattgccaggactcctggcggagagccgtttctaccggagtacaggcagggatccccatgccctgcttcacgaccgcattgtctttttacgatgggtaccggcacgaaatgctacctgcctcactcattcaggcccaacgggactacttcggcgctcacacgtacgaactcctagctaaaccagggcagtttatccacacaaactggactggccacggaggaaccgtgtcttcttcatcatacaatgcctag

SEQ ID NO: 128636 - DNA, 1290 bp, Artificial Sequence
  Description of Artificial Sequence: Synthetic coding sequence
atgaccaccgccttgtggagtgttctactgataggtctcagtccaaagctgatgatcagttggcctatgcggcaagctgtggacgattttattgaaaagctggtgccactgctcgatacaggagacatcatcatcgatggcggcaactcggaatacagagatacaactaggagatgcagagatctgaaggcgaaggggattctcttcgtcggaagcggggtctctggcggcgaggagggtgcacgttacgggcccagcctgatgccaggaggcaacaaagaggcttggccacacataaaaactatcttccaggggatcgcggctaaggtggggacaggagagccgtgctgcgattgggtgggagatgagggggcagggcatttcgtcaaaatggtccacaacggcattgagtatggggacatgcagctgatctgtgaggcttatcatcttatgaaggatgttctgggtatggcccaagacgagatggcacaggctttcgaggactggaataaaactgaactcgattctttcttgattgaaataacagccaacatcctgaaattccaggacacagacgggaagcatcttctgccaaaaatccgggactccgcaggtcagaaggggaccggcaaatggacagctatttccgcactggaatacggagtgcctgttacactgatcggggaggcagtgttcgctcgctgtctatcctcacttaaagatgagcgaatccaggcatccaagaagctgaaggggcctcagaagttccaattcgacggggacaagaaatctttcctcgaagacattagaaaggcattatacgcctctaaaatcatctcctacgcgcaaggctttatgctactacgccaagccgctacagaattcgggtggacccttaactatgggggcatcgcattgatgtggcgcggtggctgcatcattaggtcagtgtttctgggaaagataaaagatgcttttgaccgcaaccctgaacttcagaatctgcttctcgacgatttcttcaaaagcgccgtggagaattgccaggattcctggaggagagctgtgtccactggcgtgcaggccgggatccccatgccctgttttaccacagccctcagcttttacgacggataccggcacgagatgttgccggcttcactgattcaggcacagagagactactttggagcacacacgtacgaactgctggctaagccagggcagttcatccatacaaattggactggacatggaggaacagtgtcctcatcttcctacaatgcttag

SEQ ID NO: 128637 - DNA, 1500 bp, Artificial Sequence
  Description of Artificial Sequence: Synthetic coding sequence
atgactttctggacgcagatgttctttctgcttcaagattgcgaggggctgatcgtgcgctccgctactaaagtgacagcagatgtgattaacgctgccgaaaaactgcaagtggtgggacgcgcgggcacaggcgtggataatgtggatctcgaagccgcaaccagaaagggcatcctagtgatgaacacacctaatggcaacagtctttctgccgccgagctgacctgtggaatgatcatgtgtctggcccggcagataccacaggctaccgcctctatgaaggatggaaagtgggagcgcaagaagttcatgggcacggagttaaacggcaagacactggggattttgggcctgggtaggatcggccgagaagtagccacacggatgcaatcattcgggatgaagacaatcggatatgacccaataatctcgcctgaggtgagcgccagcttcggggtacaacagttaccactcgaagaaatttggccgctgtgcgattttattacagtacatactccgctcctcccatcaaccaccgggctcctaaacgataacaccttcgcacagtgtaagaaaggcgttcgggtggtgaattgcgcacgaggcggtatcgttgacgagggggctctcctccgggccctacagtcaggacagtgcgcgggagccgcccttgacgtgttcacagaggagccccctcgtgaccgggcactagtggatcacgaaaatgtcatcagttgcccacacctgggcgcatctaccaaagaagcccagagcaggtgtggtgaggaaatagcagtgcagtttgtggatatggttaaagggaagagcttaacaggcgtagtcaacgcccaagcactaacgtccgcgttctcccctcacaccaagccctggatcggattggcagaggcactcggtaccttgatgcgcgcttgggcaggttcccccaaaggcaccatccaggtgattacgcaagggacctctctaaagaatgctggaaactgcttatcacctgctgtaattgtgggactcctcaaagaagcctccaagcaggctgatgttaatctcgtgaatgccaagctgttggtgaaagaggctggcctgaacgtcaccacttcacactcgcctgctgcaccgggagagcagggtttcggcgagtgcctgctagcagttgccctggccggtgccccttatcaagccgttgggttggtccagggcactacccctgttttgcagggactcaacggcgccgtctttcggcccgaggtacctcttcggcgtgatctgcccctgctcctcttcaggacgcagacatccgatccagctatgttgcctactatgattggactgctcgctgaagcaggggtacggctcctgagctaccaaacttcactggtatctgatggagagacctggcatgtgatgggcattagctccctgctgcccagcctggaagcttggaagcagcatgtcacagaggctttccaattccacttctag

SEQ ID NO: 128638 - DNA, 1602 bp, Artificial Sequence
  Description of Artificial Sequence: Synthetic coding sequence
atggccttcgccaacctccgcaaggtgttgatttctgacagcctggacccttgctgcaggaaaatcctgcaggatggcggactgcaagtagtggaaaagcagaacttgtctaaggaagaactcatcgccgagttacaggactgcgaggggttaattgttcgcagtgccacaaaggtgaccgccgatgtgatcaacgctgcagagaagctccaagtcgtgggtagagcgggaacaggcgtcgataacgtcgacctagaggcggccacacgaaagggcatacttgtcatgaatacacccaatggaaatagtttgagtgcagcagagctgacatgtggcatgattatgtgtctcgctaggcagatccctcaggctaccgcatccatgaaagacgggaaatgggaaagaaaaaaatttatgggcacagagctcaacggcaagaccctcggtattctcggcctcgggcggatcggcagagaggttgccacacggatgcagtccttcggaatgaagactatcggctatgatcctattatcagtccagaagtgtcagccagtttcggcgtgcaacagcttcccttagaagaaatttggccactttgcgactttattacagtccatacacccctgcttccttcaacaacgggcctgctcaatgataacacctttgcccagtgtaagaagggcgtgagagttgtgaactgtgcaaggggaggaatcgtcgacgagggtgcccttctccgcgcgttacagagtggccaatgcgcgggggccgccttagacgtcttcactgaggagcctccgcgggaccgagcacttgtcgaccacgagaacgttattagctgtccccatctcggtgcttcgactaaagaggctcagtcaagatgcggcgaagaaattgccgtgcagttcgtcgatatggtgaagggtaagagcctgactggcgtagttaatgcccaggctcttacaagtgccttctctccacacaccaagccttggattggattagctgaggccctgggcactcttatgagggcctgggctggttcacccaagggcacaatccaggtgatcactcagggcacctccctgaaaaacgccggcaattgcctttcccctgctgtgattgtgggactgctgaaagaagccagcaagcaggcagacgttaacctggtgaatgcaaaactgctcgtcaaagaagccgggctcaacgtaacaacatcgcactcacccgctgcccctggcgagcaagggtttggggagtgcctgttagctgttgctctcgccggagccccttatcaagcggtcggcctggtacaaggtacaacccccgttctccagggtctgaatggcgccgtcttccgtccggaggtgccactgagaagggaccttcctttgcttctttttagaacacagacctctgatcccgccatgcttcccactatgatcggcttgctggcagaagcgggcgtgcgcttgctgtcctatcaaacatccctcgtgagtgatggcgaaacatggcacgtcatgggtataagctcactgttaccttccttagaggcttggaaacagcatgtcactgaagcctttcagttccacttttag

SEQ ID NO: 128639 - DNA, 291 bp, Artificial Sequence
  Description of Artificial Sequence: Synthetic coding sequence
atgaaaacaatcggctacgaccctattataagtcccgaagtgagcgcttcttttggcgtgcagcagctccctctcgaggaaatatggcccctctgtgattttatcacagtgcatacccctctactgccttcaaccaccggacttctaaacgataacacgtttgcgcaatgtaagaagggggtgcgggtggtaaattgcgctcgcggtggcattgtcgacgagggcgcactcttaagagctctgcagagtggccaatgtgcgggcgcagccctagacgtgttcaccgaatag

SEQ ID NO: 128640 - DNA, 1221 bp, Artificial Sequence
  Description of Artificial Sequence: Synthetic coding sequence
atgaaggacggaaaatgggagcgcaaaaagttcatgggtaccgaactgaatggcaagacactgggtatacttggcctcggaagaatcggccgtgaagttgccacacgtatgcagtcatttgggatgaagaccattggatatgaccctataatttcccccgaggtgtccgctagctttggtgttcagcaattacctctggaagagatatggcccctgtgcgattttattacagttcacactcctctgttaccgtctacaaccggcctgctgaacgacaacacattcgcccagtgtaaaaaaggggtgagagtggtgaactgcgcccggggtggaatagtcgatgaaggcgcattgcttcgggcactgcagtccggccagtgcgcaggggccgctctcgatgtcttcactgaggaacctcctagagatagggcattggtcgaccacgagaatgtcatttcctgcccccatctgggtgcttctactaaggaagcccagagtcggtgtggagaagagatagctgtgcaattcgtagacatggttaagggcaagagtctgacaggggtagtaaacgcccaggcactaacctccgccttctccccccataccaaaccctggattggattggccgaagcactaggaacactgatgagagcgtgggccgggtcgcccaagggtaccatccaggtgatcactcaaggtacctcgttaaaaaatgctggcaactgtcttagtccggccgttattgtcggcttactgaaagaggccagcaagcaggctgacgttaatctggtgaatgccaaacttctcgtgaaagaagccgggctgaacgtgaccacatctcactcaccagccgcccctggcgagcaaggcttcggtgaatgcctgcttgccgttgccctagcaggcgctccttaccaagcagtagggctggtgcagggcaccaccccagtgttacagggactgaacggggctgtgtttagaccagaggtgcccctcaggagggatctgcccttgttattgtttcggacacagacaagcgaccccgccatgctgcccacaatgatcggactgctagctgaggccggcgtgcgccttctaagctatcagacctctctggtttctgacggtgagacatggcacgttatgggcatttctagtttgctaccctccctagaggcgtggaagcagcacgtaaccgaggcctttcagtttcacttctag

SEQ ID NO: 128641 - DNA, 1254 bp, Artificial Sequence
  Description of Artificial Sequence: Synthetic coding sequence
atgtccctgtccaacaagcttacccttgacaagctcgatgtcaaaggcaagcgtgtcgtgatgcgggtcgacttcaacgttcccatgaagaataaccagattactaacaaccagaggattaaagctgccgtgcctagcattaaattttgtctcgacaatggagcaaagtctgtggtcctcatgagtcacctcgggcggcctgatggagtgcccatgcccgacaagtactcattggagccggtggccgtcgaactgaagtcacttttgggcaaagatgtcctcttccttaaagattgcgttggtcccgaggtggaaaaagcttgcgctaaccctgcagcgggtagtgtcatcctcttggaaaatctaaggtttcacgtagaagaggagggcaaagggaaggacgcatctgggaacaaggtgaaagccgaacctgccaagatcgaggcctttcgggcctccctctcaaagctgggcgacgtttacgtgaacgacgcattcgggaccgctcaccgtgcacattcctcaatggtgggagtgaatctcccgcagaaagctggcggatttctgatgaagaaagagctgaattattttgccaaggcgctcgagagccctgaaaggcccttcctggcaatcctgggcggggccaaggttgctgacaaaatacagctcattaacaatatgctggataaggttaatgagatgatcataggcggcggtatggcctttaccttcttgaaagtactgaataacatggaaattggcacatctctgttcgatgaggagggggcgaagatcgtgaaggatttgatgagcaaggccgagaagaacggagtgaagattacactcccggtcgattttgtcaccgccgacaagtttgacgagaacgccaaaaccgggcaggcgacagtggcctctgggatcccagccggatggatgggattagattgtggacccgaatcctctaagaagtatgctgaagctgtcactagagcaaaacagatcgtgtggaatggtccagtgggcgtgttcgagtgggaagcattcgcacgggggaccaaagccctgatggatgaggtcgtgaaagccacctcacgaggatgtattaccattataggcggcggggacacagccacatgctgtgcaaaatggaacactgaggacaaggtgtctcatgtcagtacaggcgggggagcatcattggaactgcttgagggaaaggtgctgccaggagtggatgctttgagcaatatctag

SEQ ID NO: 128642 - DNA, 846 bp, Artificial Sequence
  Description of Artificial Sequence: Synthetic coding sequence
atgtcactctctaataaactcactctggacaagttggacgttaaaggaaaacgcgtggtcatgagagtcgatttcaatgtgccaatgaagaataatcagatcactaacaaccaaagaataaaggctgccgtccctagcatcaagttctgcctggacaacggagcaaaatcagtcgtcctgatgagccacctgggccgacccgacggccggccctttctggcgatattggggggcgcgaaagtagcagacaaaatccagttgattaacaacatgctcgacaaggtaaacgaaatgatcattggtggcggcatggcatttacatttttgaaggtgctgaataacatggagatcggaacaagtttatttgatgaagagggcgccaagattgtcaaggatctcatgtctaaagctgaaaagaatggagtgaagatcacactacccgttgacttcgttaccgcggataagttcgacgaaaacgccaagacgggccaggccactgtggcatcagggatccctgcggggtggatgggacttgattgcggacccgagtcttccaaaaaatatgctgaggctgtcactagggctaaacagattgtttggaatggaccagtgggtgtctttgaatgggaggcattcgcgcggggcaccaaggctctaatggatgaggttgtgaaggctacctcaagaggatgcattacaattattggcggaggggatacggcaacctgctgcgcaaagtggaataccgaggacaaagtatctcacgtgagcaccggcgggggggcatccctcgaacttcttgagggaaaagtgttgcccggcgtcgacgccctgagtaatatatag

SEQ ID NO: 128643 - DNA, 729 bp, Artificial Sequence
  Description of Artificial Sequence: Synthetic coding sequence
atggtcggagtaaacctccctcagaaggcaggggggtttctaatgaagaaggaactgaattacttcgcgaaggcactggagagccctgaaagaccatttttggctatacttgggggggctaaggtcgcagataaaatccagctcatcaataatatgctggacaaggtgaacgaaatgattattggagggggtatggccttcacttttctgaaagttcttaacaatatggaaatcgggacatccctgtttgacgaggagggtgccaagatagtgaaagaccttatgtccaaggcagaaaaaaatggcgtgaaaatcactctacccgtcgacttcgtaaccgcagataagttcgatgagaatgctaagacaggacaagcaaccgttgcaagtggcattcctgcggggtggatgggcttggactgcgggccggaatcctcgaagaagtatgccgaagcagtgactagagctaagcagatcgtgtggaatggccccgtgggcgtctttgagtgggaggcattcgctaggggcacaaaggctctcatggacgaggtcgttaaagcgacctccagaggatgcattacaataattggaggcggcgataccgctacatgctgtgctaagtggaacacagaagataaggtctcgcacgtatcgactggcggaggcgcatccctggaactgttagaaggaaaggtcctacccggcgtcgatgccttgtcgaacatttag

SEQ ID NO: 128644 - DNA, 1170 bp, Artificial Sequence
  Description of Artificial Sequence: Synthetic coding sequence
atgaaaaacaaccagatcacaaacaaccagcgaatcaaggcagcagttccttccatcaaattttgtcttgacaacggagcaaagagcgtggtcctcatgtctcacctcggccggccggatggagtacccatgcctgacaaatactccctggagcctgttgcagtcgagctaaaatccctgctcggtaaggatgtgctgttcctcaaagactgtgtcggacctgaggtggagaaggcatgtgcgaatcctgctgctgggagtgtgatcctccttgagaacctccggtttcatgtggaggaggaagggaaaggaaaggacgcatcaggaaataaagtgaaggccgagcccgctaaaatcgaggcctttagggcatctctgagcaagctgggagacgtgtacgtgaacgatgcttttgggaccgcacaccgcgcacattcttcaatggttggtgtgaatctgcctcagaaggccggaggttttctgatgaaaaaagagctcaattatttcgcgaaggccttagagagtccagagaggccattcctagcaatattgggtggtgctaaagtggccgacaagatccagcttattaacaatatgttagacaaagtaaatgagatgatcatcggggggggcatggccttcaccttcttgaaggtgcttaacaatatggaaatcggaacaagcctgtttgacgaagagggtgctaagattgttaaggatttaatgtctaaggcagagaagaacggcgtgaaaattacgctgccagttgatttcgtgaccgccgacaagtttgacgagaatgcaaagactggccaggcaacagtcgcttccggcattccagctggctggatgggactggactgcgggccagagagcagcaaaaaatacgcagaagccgtgacacgcgctaagcaaattgtgtggaatgggcctgtaggagtgttcgagtgggaagccttcgcccgcggaacgaaggcccttatggatgaagtagtcaaggccactagccggggctgtatcaccatcatagggggtggcgataccgccacgtgttgtgctaaatggaacactgaggataaagtatctcatgtatccacaggcggcggggcgtccttagaactcctggagggtaaagtgttgcctggggtggacgctttgagcaacatttag

SEQ ID NO: 128645 - DNA, 1254 bp, Artificial Sequence
  Description of Artificial Sequence: Synthetic coding sequence
atgtctctaagcaaaaaactgacccttgacaagttggacgtccgaggtaaacgtgttatcatgagagtagattttaatgtgccaatgaaaaaaaaccagataactaataaccagcgcataaaggccagcataccctctattaagtactgccttgacaatggcgccaaggccgtggtgctgatgagccacctgggccgccccgacggcgtacctatgcctgacaaatatagcctcgccccagtggctgtggaactgaaaagtctgctcggaaaagacgtactattcctgaaagattgtgtcggggccgaggttgaaaaggcttgtgccaaccccgcccccggcagcgtgatactacttgagaatcttcggttccacgttgaggaggagggcaagggtcaagatccaagtggcaaaaagattaaagctgagcctgataaaatagaagcttttagagcttctctgagcaagctgggcgacgtgtacgtgaatgacgccttcgggaccgcccacagagcccacagctccatggtcggggtcaatctcccacataaggcgtctgggtttctgatgaagaaagagctggattatttcgcaaaggctctggaaaatcctgtgcgccctttccttgcaattcttggtggagccaaggtggcggataaaatccagctgatcaaaaacatgctcgacaaagtgaacgagatgataattggaggtgggatggcctacacgttcctgaaagtcctgaacaatatggaaatcggggcgagcctcttcgacgaagaaggcgcaaaaatcgttaaggacattatggcaaaagctcagaaaaacggagtgaggatcacattcccagtggacttcgtgactggggataagttcgacgagaacgcacaagtgggtaaggccacggtggcgtccggcataagcccaggctggatgggactggattgcggtcctgagagcaacaagaatcacgcccaagtagttgcgcaagcgagacttattgtctggaatggaccactcggcgtattcgaatgggatgcttttgcaaagggaacaaaggccctcatggatgagatcgtgaaggcgacctccaaggggtgcattaccgtgatcggggggggcgatactgcaacttgctgcgctaaatggaacacagaagacaaggtctctcacgtgagcacagggggcggcgccagccttgagttgctcgagggcaagatcttgcccggcgtcgaggcactctctaacatgtag

SEQ ID NO: 128646 - DNA, 765 bp, Artificial Sequence
  Description of Artificial Sequence: Synthetic coding sequence
atggctgcctacaagctagtgcttatccgccacggggagtccgcttggaacctggagaatagattctcaggctggtacgatgccgatcttagtccagcaggacatgaggaagccaaacgcggcggtcaggctttgagagacgctggttatgaattcgatatttgcttcaccagtgtccagaagcgagccatccggacgctgtggaccgtactggatgccatcgaccagatgtggcttccggtagttaggacctggcgcctcaatgagaggcattatgggggcctcaccggactcaacaaggcagagacggcagcaaaacatggggaggctcaggtaaaaatctggcggagatcatatgacgtgccacccccccccatggagccggatcatccattttactctaatattagtaaggacaggcggtacgccgatctgacggaggatcagctcccgagttgcgaatccctcaaggataccatagctagagccctccccttctggaacgaagagattgtgccgcagataaaagaagggaagagagtgctgatagcggctcatgggaacagcctgcggggaatcgttaagcacctcgagggattgagtgaggaggctatcatggagcttaatttacccaccggcattccaatcgtgtacgagcttgacaaaaacctgaagccaatcaaacctatgcagttcctcggagatgaggaaactgtgcggaaggccatggaagccgtcgctgcccagggcaaagccaaaaaatag

SEQ ID NO: 128647 - DNA, 435 bp, Artificial Sequence
  Description of Artificial Sequence: Synthetic coding sequence
atgccattaatcaggtgtggctgtcacgacgtcccccccccgcccatggaacctgaccacccgttctactctaatatcagtaaagacaggaggtatgccgacctgaccgaagaccagctcccctcctgtgagagtctaaaggacactatcgcgagagccctccctttctggaatgaggaaattgtcccccagattaaagagggaaagcgggtactgatcgcagcacatggaaacagcctgaggggcatcgtaaaacacttggagggcctttctgaagaggcaatcatggaactgaatctcccaacgggaattccaattgtttatgagctggacaagaacctgaaacccattaagccaatgcagttcttaggcgacgaggagaccgtgcgaaaagccatggaggcggttgcagcccaaggtaaagccaagaaatag

SEQ ID NO: 128648 - DNA, 762 bp, Artificial Sequence
  Description of Artificial Sequence: Synthetic coding sequence
atggctacgcatcgcctggttatggttcgccacggcgagtctacctggaaccaggagaacagattctgtgggtggttcgatgctgagctctcagagaaagggacagaagaggccaaacggggcgccaaggccataaaggatgccaaaatggagtttgacatatgctatacatctgtcctgaagagggccataagaactctgtgggccattttggacggcaccgaccagatgtggctgcccgtcgtgaggacttggcgtctaaatgagaggcattacggcggacttaccggacttaataaggccgaaacggctgcaaagcacggagaagagcaggtgaaaatatggcgccgttcctttgatatcccacctccacctatggatgagaagcacccctactataacagtatttctaaagagaggcgatatgccggactcaaacctggtgaactcccaacttgcgaatctctcaaggacactatcgctagagccctgcctttttggaatgaggaaatcgtcccacagattaaggcagggaaacgcgttctcattgcagcccatggcaactcactgcggggaatcgtaaagcacctggaggggatgtctgatcaggcaataatggagttaaatctgcccacaggaatcccaattgtatacgagctgaataaggaactcaaacctactaaacccatgcaatttttgggcgacgaggagaccgtgagaaaggcgatggaggctgtcgcggcccaagggaaagctaagtag

SEQ ID NO: 128649 - DNA, 765 bp, Artificial Sequence
  Description of Artificial Sequence: Synthetic coding sequence
atggcggcctataagttagtgttgatccgacacggcgagtctacttggaacctagaaaacagatttagttgttggtatgacgctgatcttagcccagccggccacgaagaagcaaaaagaggcgggcaggcactgcgggacgctgggtacgagttcgacatttgtctaacgtcagtccagaagcgggtcataaggaccttgtggaccgtgctggatgccatcgatcaaatgtggcttccagtagtgagaacatggagactgaatgaaaggcattacggaggcctaacggggctgaacaaggccgagacagctgccaaacacggggaagcacaagtaaagatatggcgcagatcttatgatgttcctccccctcccatggaacctgatcaccccttttactctaacatcagcaaagatcgaaggtatgctgacttgaccgaagaccagctgccctcttatgagtctcccaaggatacaatcgctagggccctgcccttttggaacgaagaaattgtgccacagatcaaggaaggaaaacgcgttctgattgcggcgcatgggaattctctgcagggaatcgccaaacacgttgaagggctgagcgaagaagctattatggagctaaatctaccaactggcataccgattgtgtacgagctggataagaatcttaagcctatcaagccaatgcagtttttaggcgatgaagaaactgtttgtaaagccatcgaggcggtcgcagcacagggaaaggctaagaaatag

SEQ ID NO: 128650 - DNA, 966 bp, Artificial Sequence
  Description of Artificial Sequence: Synthetic coding sequence
atggccgctgcagaggctgggggagacgatgcacgatgtgttcggctcagtgcagagagggcacaggccctgctcgctgatgtggacactcttctttttgactgtgacggagtcttgtggcggggtgaaacagctgtgcctggcgccccagaggccctgcgcgctttgcgcgcaaggggcaaaaggttaggatttatcaccaataactcatcgaagaccagggcggcctacgcagagaagcttaggcgtcttgggtttggagggcctgcaggccctggtgccagccttgaggtgtttggcactgcatactgcactgcactgtatctgcggcagcggctggccggagctccggcccctaaggcttatgtgctgggctccccagcacttgccgccgagttggaggcagtgggtgttgcatctgtgggggtcgggcctgagcctctccagggagaagggcccggcgactggctacatgcaccgttggaacctgatgtaagagctgtggtcgtcgggttcgacccacacttcagctatatgaagctgactaaggcactgcggtatctgcaacagcctggctgcctcctggtgggcaccaatatggataaccggctgcctctggagaacgggcggtttattgccggtactggctgccttgtgagggccgtggagatggcagctcagcgtcaggctgatatcatcggtaagccatcacggtttattttcgattgcgtgtctcaggagtacgggatcaatccagaacggactgtgatggtaggggatcgtcttgacacagacatattgttgggcgcaacttgtggcctgaagacaatccttaccctaacaggagtctctactttgggagacgtgaagaataaccaggagtcagactgcgtgtcaaagaaaaagatggttcccgacttctacgtcgatagtattgccgatttactccccgcacttcaaggttag

SEQ ID NO: 128651 - DNA, 378 bp, Artificial Sequence
  Description of Artificial Sequence: Synthetic coding sequence
atggcagtggctgacctggcgctcattcccgacgtagacattgactcagatggcgtcttcaagtatgtgctaattagggtacacagcgcgccacggtcaggcgcaccagcagctgagagtaaggaaatagtgcggggctacaaatgggctgaataccatgcggatatatacgataaggtgtctggggacatgcagaaacagggctgtgactgcgagtgcctaggggggggcaggatctctcaccagagtcaggacaaaaagatacacgtgtatggttattcaatggcctatggccctgcacagcacgctatctcaacggagaagatcaaagctaagtatcctgactacgaagtcacctgggctaacgacggctattag

SEQ ID NO: 128652 - DNA, 375 bp, Artificial Sequence
  Description of Artificial Sequence: Synthetic coding sequence
atggcggtggcggacctggcactgattcccgacgtggacattgacagtgacggcgtgtttaaatacgtgctaatccgggtgcattccgctcctagatctggggcccctgcagccgagagtaaagaaatagtccggggttataaatgggccgagtatcatgcagatatttatgataaggtgagtggggatatgcaaaaacagggttgtgactgcgaatgcctgggaggagggcgaatttcacatcagtctcaggacaaaaaaatccatgtctacggctacagcatgatgagacccacatgcgtcccgcttggtgcgtcaggccccaggatccaccaccagggcctttggagctgcccagcccgccattttaattag

SEQ ID NO: 128653 - DNA, 375 bp, Artificial Sequence
  Description of Artificial Sequence: Synthetic coding sequence
atggcagtagctgatctagctctgattcccgatgtggacatcgactccgacggtgtgtttaagtacgttctcattagagtgcattctgccccgagatcaggagctcccgctgccgagagcaaggagattgtccgtgggtacaaatgggctgaataccatgccgatatctatgacaaagtgtctggcgatatgcagaagcaaggttgcgattgtgaatgcttgggcggaggaagaatttcccaccaatctcaggacaagaaaattcatgtctacggatatagtatgatgaggccaacatgcgtgcccctcggggctagcgggccacggatacaccaccagggactgtggtcttgccctgcacgacatttcaattag

SEQ ID NO: 128654 - DNA, 1356 bp, Artificial Sequence
  Description of Artificial Sequence: Synthetic coding sequence
atggctacagacgacaagacaagccctactctggactctgccaatgatctgcctcgaagccccactagtccctctcaccttacccatttcaaacctctgacgcctgatcaagatgagccaccattcaagtccgcttatagttccttcgtaaatctgttccgcttcaataaggagcgtgctgagggcggccagggcgaacaacagcccctttctggctcctggacctctcctcagctgccctcccgcacccagagcgtacgcagtcccaccccctacaagaagcagctgaatgaagagttacaacgccggtcctccgccttaggggacctgcgggcttgtacatactgcagaaaaattgccctaagctatgcccacagcactgatagtaattctataggtgaggaccttaacgcattatctgattctgcttgtagtgttagcgtgctcgatccctccgagccccgaacaccagtgggatcacgtaaggcgagcaggaatatctttttggaggacgatctggcctggcagtcattaatccaccctgacagctccaacaccccactctccacacgattggtttctgtacaagaggatgccgggaagagccccgcacgtaataggtccgctagcatcacgaatttgtctctggacagatccggatcaccgatggtccctagctacgaaacgtctgtgtctcctcaggcgaatagaacctacgtaagaacagagacaactgaagatgaaaggaaaatcctccttgactctgtgcagttgaaggacctgtggaaaaaaatttgtcatcactcaagcggtatggaatttcaggatcaccggtactggctgcgaacccatcctaactgcatagtggggaaggaactagtaaattggctaatacggaatgggcacatcgccactcgagcgcaggcaattgccataggtcaagctatggtggacgggaggtggctcgactgtgttagtcatcacgaccaattgttccgggatgagtatgccctatatcggcccctgcagtcgacagagttctctgagactccatctccggactcagactccgtgaactcagtagagggacatagcgagccatcttggttcaaagatatcaagtttgatgattcagacactgaacagattgcagaagaaggtgatgacaatctggcaaattctgccagtccgtccaagagaaccagcgttagctctttccagagcactgtggattccgacagtgccgcttctatttcgctcaatgtagaacttgacaacgttaactttcatatcaaaaaaccaagcaaatatcctcacgtgccgccccatcctgcggatcagaagggacgcaggtag

SEQ ID NO: 128655 - DNA, 1647 bp, Artificial Sequence
  Description of Artificial Sequence: Synthetic coding sequence
atggccaccgacgacaagacttctcctacccttgattctgcgaatgatctgcctcgctcccctacttcaccttctcatcttacacactttaagcccctgactcctgaccaggacgaaccgccgttcaaatcagcatattccagcttcgtaaatctctttagattcaacaaggaacgcgcagaaggagggcagggtgaacagcagcctttgagcggttcttggacatcccctcagctgccttcgcggactcagtctgtgaggtctccaaccccctacaagaaacagctgaacgaggagttgcagcgccgctcttccgcattggacactagaaggaaagcagaacctacttttggcggacacgatccccgtaccgccgtccagctgagatctctgagtaccgtgctaaagaggctgaaggaaattatggaagggaagtcccaggactctgatctgaagcaatactggatgcctgactcccaatgtaaggagtgctacgactgttcggaaaagtttactacattcaggaggcggcatcattgccggctgtgtggtcagatcttctgtagtcggtgctgcaatcaggagattcccggtaaatttatgggttacacgggcgatctcagggcttgtacgtactgcaggaaaatcgctctatcatatgcccactccaccgattcgaactccattggagaggacctgaacgctctttctgattccgcctgctctgtttccgtgctggacccttccgagcccaggactcccgttggatctcggaaagcatccagaaatatctttctggaagacgacctggcttggcagagtcttattcaccctgattctagcaatacccctctgtctactcgtttagtgtctgtccaggaagacgccggtaagtctccagctcggaatcggtctgcctcgattaccaacctctcactcgatcgtagtgggtccccaatggtccctagttatgaaacaagtgtgagcccccaggccaacagaacatatgtaaggacagagactacagaggacgaacgaaaaatcctcctggactcagtgcagttgaaggacctgtggaagaaaatatgtcatcatagctctggaatggaatttcaggatcatagatattggctgagaacacaccccaattgcatagtgggaaaagagttagtcaactggctgatcagaaacggacatattgcaacacgcgctcaggccattgctatcggacaggccatggtagacggaaggtggttagactgcgtgtcacatcacgaccagctattccgcgacgaatacgcgttgtataggcccctgcaatcaactgagttcagtgagaccccttctccagactctgactcagtgaatagtgtggagggacacagtgagccctcttggtttaaagacattaagtttgatgattccgatacggagcagattgccgaagagggtgatgacaaccttgctaactcagcaagcccttccaagcggacaagcgtgagctccttccagtccaccgtggattccgatagtgccgcttcaatttcccttaacgtggaacttgataatgtgaatttccacattaagaaaccaagcaagtacccccacgttcccccccatccagccgaccaaaagggccggcgctag

SEQ ID NO: 128656 - DNA, 6297 bp, Artificial Sequence
  Description of Artificial Sequence: Synthetic coding sequence
atggctactgatgataagaccagtccgactctcgattctgcgaacgacctgcctaggagtcccacttctccaagccatctgacacactttaaacctctgacgcctgaccaagacgagcccccgttcaagtcagcctattcaagctttgttaaccttttccgatttaataaagagcgggccgaaggtgggcagggtgaacagcaacctcttagtgggagctggacgagcccacagctcccctcccgcacacagtccgtgagaagccctactccatataagaaacagcttaacgaagagctgcagcgaaggagctcagcgcttgacactaggaggaaggcggaaccaaccttcggcggccacgaccctcggaccgccgtccagcttaggagcctgtctacagtgctgaagagattgaaagaaatcatggagggcaagtctcaggattcagaccttaagcagtattggatgcctgactctcagtgcaaggaatgttacgactgtagcgagaaatttacgacttttcgtagacgccaccattgtcggttgtgcggccagattttctgttctaggtgttgtaatcaggagataccaggcaagtttatgggctacacaggagacctgcgtgcttgtacttattgccggaagatagccctgtcatacgcccactccaccgatagcaattctatcggggaggaccttaacgccctgagtgactcagcttgcagtgtgagtgtccttgatccatccgagccaagaacccccgtgggatctaggaaggcaagtcgcaacattttcttggaggatgatctcgcctggcagagtttgatccatcccgatagctcaaataccccactgtccacacgcctggtctccgttcaagaggacgcgggaaagagccctgctaggaaccggtctgccagcatcaccaacttaagcttagatcgttccggctctccaatggtgccctcttatgagaccagcgtctcccctcaggcaaacagaacctacgttagaaccgaaacaaccgaggacgagaggaagatcttattagactccgtccagctcaaggacctgtggaaaaaaatctgccaccattctagcggaatggagtttcaggatcatcgatactggctgcgaacgcacccaaattgcatcgtagggaaggagctggtcaactggctgattcggaacggccacatcgccactagagcccaggctatcgctattggacaggcaatggtcgatggccgttggctggactgtgtgagccatcacgatcaactgttccgagacgagtacgctctctaccggcctctgcagtcgaccgagtttagtgaaaccccttcacccgatagcgacagcgtgaattcagtcgaggggcacagtgagccctcttggtttaaggatatcaagttcgacgattctgacactgagcagatcgccgaggagggcgatgataatctggcaaattctgcttctccctcgaagagaacatctgtctccagttttcagtcgacagtggactcagacagtgccgcctccatctccctgaatgtggagctggataacgttaactttcatatcaagaagccaagcaagtatcctcacgtacctcctcacccagctgatcagaaggaatatcttatcagcgatacggggggtcagcagctcagcatttctgacgcttttattaaggagagcctctttaaccgcagagtggaggagaagagtaaagaactaccctttactcctctgggttggcaccataacaacctggaacttctgagggaagagaacggcgagaagcaggcaatggagagattactgtcggccaatcacaatcacatgatggctctgttacaacaactactgcactctgactctttgagctctagctggcgagatattatagtgtcactggtctgtcaggtggtccaaactgtgagacccgacgtgaaaaaccaggacgatgatatggacatccgacagtttgtgcacattaagaagatccctggcggtaagaagttcgactctgtagtggtgaatggattcgtgtgtactaagaacatagcccataaaaaaatgtcttcctgtatcaagaatccgaaaattctactcctgaaatgttctatcgagtacctttaccgggaggagaccaagttcacttgtattgaccctatagtgctgcaagagagagagttcttgaagaactatgtgcagagaatcgtggacgtgagaccaactctagtgctggtggaaaagacagtttcccgtatcgcgcaggatatgctgctggaacatggcataaccctggtgattaatgtgaaatcccaggtgttggagagaattagccgcatgacacagggtgacctggtgatgagtatggaccaactcctgaccaagccccaccttgggacatgccataagttctatatgcagatcttccagttgcccaatgaacaaaccaagacactgatgttcttcgagggatgccctcaacatttaggttgtactattaaactaaggggcggatctgactacgagctggctcgggtgaaagagatcctgatttttatgatttgcgtggcttatcactctcagctcgagatatctttcctaatggatgagttcgccatgccgccaacccttatgcagaacccgtcgtttcatagtctgatagagggtcgggggcatgaaggggccgtccaggagcaatacggaggcggctccatcccttgggaccctgatatccctccagaatccctaccgtgcgatgacagtagccttctggaactccgtattgtgtttgagaagggcgaacaggaaaataagaacctcccgcaggccgtggcatcagtaaaacaccaggagcatagtaccactgcctgccccgctgggctgccctgcgccttttttgcaccagtgcccgagtccctcctgccactgcccgtggatgatcagcaggatgccctgggatccgagcaacccgaaacactgcaacaaacagtcgtgttgcaggaccctaaatcccaaatccgagccttccgggatcccctgcaggatgatacgggattgtatgtcaccgaggaggtgacctcaagcgaggacaaacgaaagacctattccctggctttcaaacaagagctcaaggacgtaatactctgcatatcgccagtaattacattccgggagcccttcctgctcactgagaagggcatgagatgtagtacaagagattatttcgccgaacaagtctattggagcccactgctgaacaaagagttcaaggagatggagaacaggaggaagaagcaacttctccgcgatctgtccgggctacaggggatgaacggcagcatccaggctaagtccatccaggtgcttccttcccacgaacttgtgtccacaagaattgcagaacatctgggggattcgcagtcgctcggacgcatgctagcagattaccgggcaagaggtggccggattcagcctaagaatagcgacccatttgcccacagtaaggatgcttccagtacttccagcggccagagtggatccaagaacgaaggcgatgaagagcgtgggttaatcttaagcgatgctgtgtggtctacaaaggttgactgccttaaccctatcaaccaccagagattgtgcgtcctgttcagcagttctagtgcccagtcgtcaaacgcccccagcgcctgcgtgtccccatggatagtgaccatggagttttacggaaaaaatgatctcaccttaggaatttttcttgagcggtactgtttcaggcccagctatcagtgtccaagcatgttttgtgatactcccatggtgcatcacataaggcgattcgtgcacggacagggctgtgttcaaataatactcaaggaactcgactcccccgtgcctggctaccagcacacaatcctgacctattcctggtgtcggatctgtaaacaggtgacaccagtggtcgccctgtctaacgaaagttggagcatgtcgtttgccaaatatctcgagcttcgcttctatggacaccagtacacacgcagagctaacgctgagccctgtggtcattctatccaccacgattaccaccagtatttctcctataaccagatggtagcaagcttctcctatagcccaattcgactgcttgaagtgtgtgtgcctctcccaaagatatttatcaagagacaggcacctctaaaggtctccctgctgcaggatctcaaagattttttccagaaggtgtcacaggtgtatgtggcaatagacgagcgcctcgcgagcctgaaaaccgacacattttctaagacacgcgaagagaagatggaagacatcttcgcacagaaggaaatggaggaaggcgagttcaagaattggatcgaaaaaatgcaggccagactgatgagctccagcgtagatactcctcagcagctgcagtccgtgtttgagagcctcatcgcgaagaagcagagcctgtgtgaggtgttgcaggcatggaacaataggctacaagatttgttccagcaggagaagggccgcaagcgcccaagcgtgccgccatcccccggtaggctgagacaaggagaagaaagcaaaatatctgccatggatgcatccccacgaaacataagcccgggcctgcagaatggcgaaaaagaggaccggtttcttaccaccctgtcaagccaatcctccacctcaagcactcacctacagctgccaacaccccctgaggtgatgagcgagcagtcagtgggggggcccccggagctagatacagcaagtagctccgaggacgtgtttgatgggcatctgctgggtagcacagattcccaggtcaaggagaaaagtacgatgaaggctatattcgctaatctgctgccaggcaactcttataatccaattccctttccttttgatccagacaaacactatttaatgtatgaacacgagagagtgccgatcgcggtgtgcgaaaaggagcctagtagcatcatcgcatttgccctcagttgcaaggaataccggaacgccttagaagagcttagcaaggcgacacagtggaattctgcagaggagggtctgcccactaactccacgtctgactccagaccaaaatcaagttccccaattcggctcccagagatgagcggtggtcagaccaatcgaaccacagagactgagcctcagcctacaaaaaaggcctccggtatgctgtctttctttagaggtactgccggaaaaagtccagacttgtccagccagaaacgagagactcttagaggagccgatagcgcatactaccaggtgggacaaacaggaaaagagggaacagaaaatcagggagtagagcctcaggatgaggtcgatggaggcgacactcagaaaaagcagcttatcaatccccacgtggaacttcagttctcagacgctaacgcaaaattttattgcagactgtattacgcaggagagttccataagatgagggaggtcatactggatagttcggaggaggacttcataagatccttgagccattcgtccccttggcaagcccgaggcggaaagtccggagcagctttctacgcaacggaggacgaccgattcatcctgaagcaaatgccccgactcgaggttcagtcctttcttgacttcgctccccactactttaattacataacaaatgccgtccagcagaaacgaccgacagctctagcgaaaatcctaggagtgtacaggatcggctataagaattctcagaataacactgaaaagaagcttgatcttctggtgatggagaatctcttctacgggagaaaaatggctcaagtgtttgacctcaagggatctctgcgcaataggaatgtgaagacggacacagggaaggagtcatgtgacgtcgtgctcctagacgaaaacctcctaaaaatggtacgagataatcccttgtacatccgatcccattctaaagctgtcctacgtacttctatacactccgacagccactttctttcctctcacctaattatcgactactcactgctggtcgggagggatgacacttccaatgagttagtcgtcggaataatagactacattagaacttttacctgggataagaaattagaaatggtcgtgaagtctacaggcatcttaggcggccagggcaaaatgccaacagtggtatcccccgaactatatagaacccgcttctgcgaggcaatggacaaatacttcctgatggtgcctgaccattggactggcctcggtctaaactgttag

SEQ ID NO: 128657 - DNA, 3051 bp, Artificial Sequence
  Description of Artificial Sequence: Synthetic coding sequence
atggaatttcaggaccacaggtactggctaaggacccaccctaattgcattgtcgggaaagagctggtaaattggttgatacggaatggacacattgccaccagagcccaggcgatcgccattgggcaggctatggtggatggacgatggctggactgcgtttcccaccacgaccagttattcagagatgagtacgctctgtacagaccattgcaaagcaccgagttcagcgaaactccatctcctgattcagactccgtgaactctgtcgagggtcattcagaaccctcgtggttcaaggatattaagttcgatgacagtgataccgaacagatcgctgaagagggcgatgataacttggcaaaatacctaatctccgacactggcggccagcagctgtctataagtgatgcatttattaaagaaagcctttttaataggagggtggaggaaaaatcaaaggaactacccttcaccccacttggttggcatcataacaacctcgaactgctcagagaggaaaatggcgaaaagcaggcaatggagcggttgctcagtgccaaccacaatcacatgatggctttgctccagcagctgttgcatagtgattctttgagcagctcatggagagatattatcgttagcttagtatgccaggtcgtacagacagttcggccagacgtaaaaaaccaggatgacgatatggatatccgacagttcgtccacataaaaaagattcccggaggaaagaaattcgactcggttgtggtgaacggatttgtatgtacaaaaaacattgcccacaagaagatgtcctcctgcatcaaaaatcccaaaatactgctgcttaaatgtagtatcgaatatttgtacagagaagaaactaaattcacctgcattgacccaatcgttctgcaagagcgcgaatttctgaagaattacgtgcagcgaatcgtggatgtgcgccccacactggtgctcgtagagaagactgtaagcaggattgcgcaggacatgctgctagagcacggcataaccttggttataaatgtcaaatcgcaggtcctcgagcgcatttcccgaatgacccagggagacctggtaatgagcatggatcagctgctgactaaaccgcacttgggtacatgccataaattttacatgcagattttccaacttccaaatgagcagacaaaaactctcatgttctttgagggttgtccacagcacttgggatgcactatcaagttgagggggggttccgactatgaactcgcacgagtgaaggaaatccttatctttatgatctgcgtcgcctaccactcccagctcgagatttcgttcctaatggacgaatttgctatgccacccacccttatgcaaaacccttccttccattctctgattgaaggtagagggcatgagggggcagtgcaggaacagtacggcggcggatctataccatgggaccctgatattcctcccgaaagcctaccctgtgatgatagtagtcttttagagctgcggatcgtgtttgagaagggggagcaggagaataagaatctgccgcaggccgtggcctctgtgaagcaccaggaacacagcaccacagcttgccccgctggcctgccttgtgcatttttcgcacccgtgccagagtctctgttgccgctacctgttgatgatcagcaggatgccctgggttcagagcagccagagaccctccagcagaccgtagtgctgcaagaccctaagtctcaaatccgggcatttagagaccccttgcaggatgataccggcttatacgtaaccgaggaggtaacatcttccgaggataaacgaaagacatatagcctcgcgttcaagcaggagctgaaagacgtaattctgtgtatcagccccgtgatcactttccgagagccattcttgttaaccgagaagggaatgaggtgctctaccagggactacttcgctgaacaggtatattggagtcctctcctaaataaagaattcaaggaaatggagaacaggagaaagaagcaactgctccgggatctaagtgggttacaaggaatgaatgggtctattcaggctaagagtatccaggtgttacccagtcacgagcttgttagtactcggattgcagaacaccttggggactcccagtcactgggcagaatgctggcagactatcgggctcgaggcggaagaatacagcccaagaactccgacccctttgctcacagcaaggacgccagcagcactagctcaggccagtctggcagtaagaacgagggagacgaggagagagggcttatcctgagcgatgcagtgtggagcaccaaggttgactgtctgaacccgatcaaccaccagcggctctgtgtgctcttttcctcttcatccgctcagtcatcaaatgccccctctgcctgcgtgagcccgtggattgtcacgatggagttctatggaaagaacgacctcacactggggatctttcttgagagatactgttttcgccccagctaccagtgcccctcgatgttctgtgatacacccatggttcatcacattcggaggtttgtgcatggccagggatgcgttcagatcatcctcaaggagttggacagccctgtgccgggctatcagcacacaatattaacatatagctggtgccggatttgcaagcaggtgacgcctgtggttgcactgagtaatgagtcgtggtcgatgtccttcgcaaagtatctggagctccgcttctacggtcatcagtacacccggcgggctaacgctgaaccctgcggacactccatccatcacgactatcaccagtacttttcctacaaccagatggtggcctcattctcttactccccaatcagactgcttgaggtttgcgttcccctgcccaagatatttattaagaggcaggcaccactcaaggtgtctctgctgcaggatctgaaggacttcttccaaaaggtgtctcaagtgtatgtagctattgatgaacgactggcttcactcaagaccgacacgtttagctag

SEQ ID NO: 128658 - DNA, 522 bp, Artificial Sequence
  Description of Artificial Sequence: Synthetic coding sequence
atgcgaccctggtcttctccagcccagctcgtagccggagctcaacccgccgggcggggcgacccacttggtccccgacccatccctccacccagattccgaagggcctcgagccagcgtgagccaccgtaccccagaccagctgagcccgcactggaactggctgggagcaaatgccaaccggacacccctgccgcttcactctgtcctgctgattcgccgtctcaacatcgggtcatgcctcctggtcctgcctcctgggccaatgtgggcagccggccccacaccgttgcaaatggtcatgaattgtttgaagtgtccgaggaacgcgatgaggaggtggcagcattctgtcacatgttagacatcctccgctcgggatcagatattcaggactattttctgactggctacgtgtggtcggcagtgacgcctagtccggaacacttaggcgatgaggtgaaccttaaggtgaccgtgctttgcgatagactgcaggaggcgttgaccttcacctgctag

SEQ ID NO: 128659 - DNA, 4905 bp, Artificial Sequence
  Description of Artificial Sequence: Synthetic coding sequence
atgagctctacccagggcaacggcgaacactggaagtcgctggaatcggtcggcatctctcgaaaagagcttgcgatggcagaagcattgcagatggagtatgatgcgctgagtcgactgcgccacgacaaggaggagaatagggccaagcagaacgctgacccttcccttatttcatgggacgaaccaggagtggacttctattcgaaaccggccggaagaaggaccgacctcaagcttttaagaggccttagcggcagtgacccaaccctcaactataactctctgtctccccaggagggtccacccaatcactccactagccagggcccccaaccaggaagtgacccctggcctaaaggatcgctgtcaggcgactacctgtacatcttcgacggctcggacggaggagtttcatcttccccaggtccgggcgatattgagggttcctgcaagaaactgtctcccccgcctctacccccccgcgccagtatctgggatacaccccctctgccccctcggaagggcagtccgtcgagttccaagattagtcaaccatcagacatcaataccttcagcctggtggagcaactgcctggcaaactcttagaacatcgcattcttgaggaagaggaggtcttggggggtggaggtcaggggcgcctgctgggcagtgtcgactacgacggcattaatgatgcaatcactaggttgaacttgaaatccacttacgacgccgagatgctcagagacgccaccaggggatggaaagaggggaggggacccttggacttttcaaaagacactagtggaaagcctgtggccaggtctaagacaatgcccccccaggtccctcctaggacatatgcctctaggtacgggaatcgtaagaacgctacacctggaaagaaccgaagaattagcgccgccccagtcggatcccgacctcacacagtagccaatggtcatgaattgttcgaggtaagcgaagagcgggacgaggaggtggccgctttctgccatatgctagatattctgcggtccggtagtgatattcaggactactttctgactggctacgtgtggtcagcggtcacccctagtccggagcatttgggggacgaagtgaacctaaaagtgaccgtgttgtgcgatcgcctgcaggaggcactcacattcacctgtaattgttccagcacagtcgacctcctcatttatcagaccctttgttacacccatgatgacctccgaaatgtggacgtgggcgactttgtactgaagccttgtggattggaagagtttcttcagaataaacacgccctcgggtcacacgagtatatccagtactgccggaaattcgatatcgatatccgcctccagttaatggagcagaaggtggtgcggtcagatctcgcccggaccgtcaacgacgaccaatcaccctctacattaaactacctggtccatcttcaggaacggccagtcaagcagacaatcagtcgccaggctctgtccctcctgtttgacacataccataatgaggtggatgctttcctgttggcagatggcgattttcctttgaaggctgaccgcgttgttcaaagcgtcaaagccatctgtaatgcgcttgccgctgtcgaaacccctgagatcacatccgccctaaaccaactgcccccatgcccaagccgaatgcagcctaagatccagaaggacccatccgttcttgctgtaagggagaaccgtgaaaaggtggtggaggctctgactgctgccatcctcgatctggtggaactgtactgcaacacctttaacgcggactttcagactgcggttcccgggtccagaaaacatgacctggtacaagaggcgtgtcatttcgcaaggagcttggctttcacggtttatgcaacacatagaatccctattatctgggccacatcttacgaggatttttacctgtcctgttccctgtcccatggagggaaggagctctgcagcccactccagactcggagagcccatttcagtaagtacctcttccatctgattgtctgggaccagcagatttgtttcccagtccaggtcaatcgcttaccgagggagactctcctgtgtgctacactttatgcattgcctatcccgccaccggggtccagctccgaggccaataaacagcgacgggtccctgaggctctcggctgggttaccaccccccttttcaactttcggcaagttctgacgtgtgggcgcaaactcctgggcctgtggcccgccacacaagaaaacccttctgctagatggtctgctccaaacttccaccagcccgactcggttattctgcagatcgacttccccacctctgcattcgacattaagtttaccagtccacccggcgacaaattctctcctcgctacgagtttggctcactgagggaagaagatcagagaaagctgaaagatataatgcagaaggaaagtctttactggctgacggatgccgacaagaagaggctctgggaaaaaaggtactactgtcactctgaggtatcatcattgcccttggtgctggcatccgcaccctcttgggagtgggcctgccttccggacatctatgtgctactaaagcagtggacccacatgaatcaccaagatgcccttggactcctccacgccacctttcctgaccaggaagttaggcgaatggctgtccagtggattggaagtctgtccgatgcggagctgctcgactacctgcctcagctggtccaggccctcaaatatgaatgttacttggactccccacttgttagatttctcctgaaacgtgctgtcagcgatttgcgggtgacacactatttcttctggcttttaaaggacggcctcaaagatagtcagttcagtattaggtatcagtatctgttagccgccctcctttgctgctgtggaaagggccttcgcgaggaatttaatcgccaatgttggctggtcaacgccctggcgaaattagcacagcaggtccgcgaggccgctccctctgccaggcagggtattctgcgcacagggctcgaagaagtgaagcagttttttgcactgaatggctcctgccgcttgccgctgtctcccagtcttctggtgaaggggatagtacccagggattgtagttactttaactccaacgcggtcccgctgaagctgagttttcaaaatgtggacccacttggggagaacattagagttatttttaaatgtggcgacgatttgcgtcaggacatgctgaccctgcagatgatcagaatcatgtcaaaaatctgggtgcaggaaggacttgatatgagaatggtgatattccggtgcttctccaccggccgaggccggggtatggttgagatgatcccaaacgcggagaccttaaggaaaatccaggtagaacacggagttaccggcagttttaaggatcggcctctggccgattggttgcagaaacacaatcccggagaggacgagtacgagaaggccgtggaaaatttcatttattcttgtgcagggtgctgcgtggccacctatgtcttaggaatttgtgacaggcataatgacaatatcatgctcaaaacgacaggacatatgttccatatcgacttcggtagattcctgggacacgctcaaatgtttggtaatattaagagggaccgggccccgttcgtgttcacatctgacatggcttacgtaatcaacggtggcgacaagccctcctcacgcttccacgactttgtcgacttgtgttgtcaggcatataacctgatccggaagcatactcacctctttcttaacctgctagggttaatgctgagctgcgggatcccagaactaagcgacctcgaggaccttaagtacgtatacgacgccctcagaccccaggataccgaagcaaacgccaccacttacttcactcggttaatcgaaagcagcctgggaagtgtcgcaacgaaactcaatttttttattcacaatctcgcccaaatgaaattcacaggttctgatgaccggcttacactctccttcgctagccgcacgcacacgttaaagtcaagcggcagaatctctgacgtgttcctctgcagacatgaaaaaatattccatccaaataagggttacatatacgtggtcaaggtcatgcgggagaatactcacgaggcaacctatatccagcggaccttcgaggaattccaagagctccacaacaagctcagactgctgttccccagcagccaccttccatccttccctagccgatttgtgattggaaggtccaggggagaggcggttgcagaacgcaggcgagaggagcttaacgggtacatttggcacctcatccatgcccctcctgaggttgccgaatgcgatctggtttacacttttttccatccccttcccagggatgaaaaagcaatggggacctctccggcccctaagagttctgatggaacatgggctcgacccgtcggaaaggtaggtggcgaagtgaaactgtctattagctacaaaaacaataaattatttatcatggtgatgcacatccgcggacttcaactactgcaggacggcaacgacccagacccttatgtgaaaatatacctgctgcccgacccccaaaaaaccacaaagcgcaaaacaaaagtagcccgcaagacctgtaaccccacttataacgaaatgctggtctacgatggaattcctaagggagacctgcagcagcgtgagctccaacttagtgtgttatctgagcaagggttttgggaaaatgtactcctaggcgaggtgaatataaggctcagggaacttgacctggcccaagagaaaacggggtggtttgccctgggaagtagaagccacggcacgctgtag

SEQ ID NO: 128660 - DNA, 360 bp, Artificial Sequence
  Description of Artificial Sequence: Synthetic coding sequence
atgttcggaaacattaagagggacagggccccgtttgtgttcacttcggacatggcatatgtcattaacggaggggataaaccatccagcaggttccatgactttgtcgacctttgttgtcaggcctataatctgatacgcaaacacacacacttgttcctgaacctgctaggattgatgttgagctgtggtattcctgagttgtctgatctagaagacttaaaatacgtgtacgacgccctcagaccacaggacacagaggccaacgcgaccacctactttacccgagtgatattggcctctgtagtcggcgggcgtgaatccaagacgtgttcagctgtgagtagctctggagactag

SEQ ID NO: 128661 - DNA, 396 bp, Artificial Sequence
  Description of Artificial Sequence: Synthetic coding sequence
atgtctagtactcaggggaacggtgagcattggaaatctcttgagtccgtaggaatcagcagaaaagaacttgcaatggccgaggccctgcagatggaatacgacgctctgagccgcttacggcatgataaagaagagaaccgggccaagcaaaacgctgatccctcactgatcagctgggacgaaccaggcgtcgacttctattcaaagcccgcaggcagaaggacagacctgaaactgctgcggggcctctctggatcggaccctaccctgaattataattccctgagcccacaggagggccctcctaatcacagcactagtcaaggaccccagccagggtccgacccatggccaaagggatccctgagtggtgattacctgtatatattttag

SEQ ID NO: 128662 - DNA, 4821 bp, Artificial Sequence
  Description of Artificial Sequence: Synthetic coding sequence
atgagctctacccaggggaacggggaacactggaagtccctggagtccgttgggatctctcgcaaagaactggcaatggctgaggccctgcagatggaatatgatgccttgagtcgactgaggcacgataaggaagagaaccgagctaaacagaacgcggacccatcactcatttcttgggacgaaccaggagttgacttctactcaaagccagccggtcgcaggactgaccttaagctgcttcggggtttgtctggtagcgatcctaccctgaattacaattccctctctccgcaggaggggccacctaatcatagcacctcccagggtcctcagcccggatctgatccatggcctaaagggagcctcagcggtgattatctgtatatctttgacggcagtgacggcggcgtgtcatcatcacccggccccggggacattgaaggcagttgtaaaaaactttcgccacctccccttccaccccgtgcttctatctgggacacacccccgctgccccctcggaaggggagcccatcttcatcaaagataagccagcccagcgatatcaacactttttctctggttgagcagcttccaggcaagctgcttgagcatagaatcctggaagaagaggaagtgctggggggaggcggtcaggggaggctgctcgggtccgtggattacgatggtataaacgacgccattaccagactgaacttgaagagcacctatgatgccgagatgctgagagatgcaactcgggggtggaaggaggggagggggcctctcgacttctcgaaagacacatccggaaagcccgtggcccggagcaaaaccatgcctccacaggtccctcctagaacctatgctagcaggtatggtaaccgcaagaatgccacacctgggaaaaatcgcaggatttccgccgcccctgtgggatcacggcctcacaccgtcgccaatggccacgagctgttcgaagtgagcgaggagcgagatgaggaagtcgctgcattttgccacatgctcgacatcctgcgaagtggaagcgatatccaagattacttcttgactgggtatgtgtggagcgccgtgacaccatctccagagcatctcggcgatgaggtgaacctgaaggtgaccgtgctgtgcgacaggctgcaggaggcattgacctttacatgtaactgctcctctacagtggacctgttaatctaccagaccctgtgttatacccacgatgatcttcgtaacgtggatgtgggcgacttcgtgctgaagccctgcggccttgaagagtttctgcagaacaaacacgctcttgggagccacgaatacatccagtactgtcgcaaatttgatatcgacatccgcttacagctcatggagcagaaagtcgtgcgatcggacctggcccgcacggtcaatgatgatcagtcaccttccacgctgaactacctcgttcacctacaagagcgccctgtgaagcaaaccatcagccgtcaggccttgagcctgctgttcgacacttaccataacgaggttgacgccttcctgctggccgacggagatttccccctgaaggccgacagagttgtacagagtgtcaaagctatatgcaacgcacttgcagccgtagaaacgcctgaaattacctctgcattgaaccagcttccaccatgcccttcccgaatgcagcctaagatccagaaggatccatccgtgctagccgtgagggaaaacagggagaaggtggtggaagcattaacagcagctatcttggatctcgtcgagctgtattgtaacacattcaacgccgacttccagactgctgttcccggctcaaggaagcacgatctggtacaagaagcctgccattttgcaagatcgttggccttcaccgtctatgctacacatcgaatcccgattatctgggcgacaagctatgaggatttttacctaagttgctccctcagccacggcggcaaggaattatgctcacctctgcagacccgtcgcgcacatttcagtaagtacctgtttcacttaattgtctgggaccagcagatatgttttcctgtgcaggtgaaccgccttccgagggaaaccctgctctgcgccactctctatgcgcttcccattcctccgcccggcagttcgtctgaagctaacaagcaacgtcgggtgcctgaggctctgggatgggtcacgacgccgttatttaactttcgccaggtgttgacatgcggccgcaagctgctgggactgtggcccgccactcaagagaatccttccgcccgctggtctgctccgaacttccaccaaccagacagtgtcatccttcagatcgattttcccacctcagcttttgacatcaagttcacttcacctcccggcgacaagttcagtccgaggtatgagtttggatccctccgtgaggaggatcaaagaaagctcaaagacatcatgcagaaggaaagcctgtactggctgacagacgctgataagaagagattgtgggagaaaagatattactgccactcagagtggacccacatgaaccaccaggacgctctgggattattgcatgctacctttcctgatcaggaggtaaggcggatggcggtgcagtggataggctcactttctgatgcagagctcttagattatcttcctcaactggtgcaagccctgaagtatgaatgttatctggattctccactcgtgaggttcctgctcaagagggcagtcagcgatctcagggtgacccactattttttctggttacttaaagatggtcttaaagatagccagttttccatacgctaccagtaccttctggcggcccttctatgttgctgtggcaagggcctgagggaagaattcaataggcagtgctggcttgtgaacgcactcgcgaagctcgctcagcaggtaagagaggccgccccctctgccagacaggggattcttagaactggactagaggaggtcaaacaattcttcgctctcaatggctcctgccggttaccactgtctccctcattgctggtgaagggaatagttccacgcgattgcagttacttcaactccaacgccgtgcctctcaagctgtcattccagaatgtcgacccacttggcgagaacatacgcgtcatcttcaaatgcggtgatgacctccggcaggacatgctgactctccaaatgatccgaattatgtctaaaatctgggtccaggaaggactagacatgaggatggtgatcttccggtgcttcagtactggacgcgggagaggaatggttgagatgattcctaatgcagagacattgaggaagattcaggttgagcacggcgtcaccggctcatttaaagaccggcccctcgcagactggctgcagaagcataatcccggcgaagatgaatatgagaaagccgttgaaaatttcatctatagttgtgccggatgctgcgtagcgacctacgtgctcggaatttgtgacaggcataacgataacattatgcttaagacaacaggccacatgtttcacattgacttcggcaggttcctggggcatgcccagatgttcggaaacattaaacgagatcgggcaccctttgtattcacaagcgacatggcctacgttatcaacgggggagacaaaccatccagcagatttcacgacttcgtggacctgtgttgccaggcgtacaatctgatccgcaaacacacccatctgttcctgaacctgctaggcctcatgctgtcctgcgggattcctgagctctccgacttggaagacctgaagtatgtttacgatgccttaaggcctcaagacactgaggctaacgccacaacctactttacaaggctcattgagtcgtcacttggttccgtcgctacgaagctgaattttttcatccacaatctggcccagatgaaatttacaggatcagacgatcggctgactttgagcttcgcttctcgcacccatacactcaagtctagcggacgcatttcagacgtttttctgtgtcgtcacgagaagatattccacccgaataaaggctatatctatgtcgtcaaagtgatgcgggaaaatactcatgaagccacgtacattcagcgcacattcgaagagttccaggaactgcataacaagttgcgcttgttatttccatcttctcacctaccgagcttcccgagccgcttcgtgatcggccgcagcagaggcgaagcagtggcagagcgtcgccgcgaggaactgaacggatacatctggcacctcattcatgcaccacctgaagttgccgaatgcgatttggtctacaccttcttccaccctctccctcgagacgaaaaggctatggggactagccccgcccccaagagttctgacgggacctgggccagaccagttgggaaggtggggggcgaggtgaaactgagcatctcctacaagaataacaagcttttcattatggttatgcacatccgtgggctgcagctgctccaagacgggaatgatcccgacccatacgtgaagatttatctcctgcctgacccacagaaaacaacgaagcggaaaacgaaggtcgcacggaaaacctgtaaccctacttataatgaaatgctggtctatgacggtatcccaaaaggtgacctacaacagcgcgaattacagttgagcgtcctttccgaacaggggttctgggaaaacgtgcttctcggcgaggtgaacatccggctgcgcgaactggatcttgcccaagagaagaccggttggttcgcccttggtagccgctcccacggtactctttag

SEQ ID NO: 128663 - DNA, 183 bp, Artificial Sequence
  Description of Artificial Sequence: Synthetic coding sequence
atgtcaagcacccagggcaatggagagcactggaaaagtctcgagtccgtgggcatctcacgcaaggagctggccatggctgaggccctacagatggaatacgacgccctgtcgcggctgaggcacgacaaggaagaaaacagagctaaacaaaacgccgaccccagcctgataagttggtag

SEQ ID NO: 128664 - DNA, 522 bp, Artificial Sequence
  Description of Artificial Sequence: Synthetic coding sequence
atgaggccatggagctcaccagcgcagctagtggccggcgcccaacccgcaggacggggagacccactgggacctcgacccatacctcccccccgcttcaggcgtgcttccagtcagcgagaacctccttacccacgacctgccgaaccagccctggagttggccggatcaaaatgtcaacccgacacccccgccgcctcactatgccctgccgatagcccgagtcagcatagagtgatgccacccgggcctgcgtcctgggccaacgtgggttcccgaccacatacagtggccaatggacacgagctgtttgaagtcagtgaagagcgggatgaagaagtagctgcattttgtcacatgttggatattctgcgcagtgggagcgacatccaggactactttctgacaggttacgtctggtccgcggtaacaccctctcctgagcatctgggagatgaggtcaatctgaaggtgaccgtgctctgcgaccggcttcaagaggcccttacgttcacatgctag

SEQ ID NO: 128665 - DNA, 4338 bp, Artificial Sequence
  Description of Artificial Sequence: Synthetic coding sequence
atggcttattcttggcagacagaccctaaccccaatgagagccacgaaaaacagtacgagcatcaagaatttcttttcgttaatcagccacactcttcatcacaggtctcactcgggtttgaccaaatcgtggacgaaataagcggtaaaattccccactacgagtccgaaattgatgagaatacctttttcgtgcctacggcacctaaatgggacagcaccggacatagtctgaacgaagcccaccagatcagtcttaatgaattcactagtaagagccgggagctctcttggcatcaagtctcaaaggcccctgctatcgggttctccccctctgtgctgcccaagccgcaaaatacaaataaggagtgcagctggggctctcccattggcaagcatcatggtgccgatgattctagatttagtatccttgcgccttcatttacatcactggataagatcaacctggagaaggagcttgagaacgagaatcacaactaccatataggctttgaatcctcgatccctccaacaaacagcagtttcagctccgactttatgcccaaggaggagaacaagcgatcaggccatgtaaacattgttgaaccttccttgatgctgctgaaaggctctctgcagcccgggatgtgggaatcaacctggcagaagaatattgaatctatcggttgttctatccagctggtcgaggtgccacagtcctccaacacttctctggccagcttctgcaataaggtcaagaagatcagggagagatatcacgccgcagacgtgaatttcaactctggaaagatctggtccaccactactgccttcccttatcagctcttttccaagactaagttcaatatacatatttttatcgacaattcgacccaacctctgcatttcatgccatgcgctaattaccttgtcaaagatttgattgcagagatcctccacttctgtaccaatgaccagctcctgcccaaagaccacatcctatcagtttgtgggagcgaagagttcttgcaaaacgaccattgtctgggttcccacaaaatgtttcaaaaagataagagcgtgattcaactacatttgcagaagtcccgggaggcccctggtaagctgagcagaaagcatgaggaggatcattctcagttctacttaaaccagttactggaatttatgcacatctggaaggttagcaggcagtgcctactgaccctgatacggaagtatgattttcacctgaagtacctcttaaaaacccaagaaaacgtttacaacattatcgaagaagttaagaaaatttgttcagttttggggtgtgtggagaccaaacaaattacggacgccgtgaatgaactgagtttgattttgcagagaaaaggcgagaatttctatcagtcctcagagactagtgccaaaggacttatcgagaaggtgacaactgagcttagtactagcatttaccagctcatcaacgtatattgcaacagcttttacgccgacttccagcctgtgaacgttccacggtgtacttcctatctgaaccccggccttccgtctcatctgtcgtttacggtttacgcagcacacaacatccctgaaacttgggtgcaccgaatcaactttccccttgaaatcaagtctctgcctcgggagagcatgcttaccgtgaagttatttggcatagcctgcgctacaaataacgccaatctgcttgcttggacttgccttccactctttcctaaggaaaagagcatcctgggaagtatgctcttttccatgacattgcaatctgaacctcccgttgaaatgatcacacccggcgtgtgggacgtgagccaacccagccctgtcacacttcagatcgattttccagccactggctgggagtatatgaaaccggatagcgaggagaatcggtcaaatctcgaggaacctctgaaggagtgtataaagcacattgcacgtttaagccagaaacagacaccgctcctgctctccgaagagaaaaagcgctacttgtggttttaccgcttttattgcaataatgaaaactgctcacttccactagtgctgggctccgcacctggctgggatgaaagaacagtcagcgaaatgcatacaatcctgcgccggtggacctttagtcaacctctcgaggcccttggtcttttgacgagctcctttcctgatcaggagatccgcaaggtcgccgtgcagcaactcgataacctgctgaacgatgaattacttgagtatttaccacagctggtgcaggccgtaaaattcgagtggaatttggagagccctctagtacaattgctgctccatagaagcctccagagcattcaggtggcccatagactatactggctgcttaagaatgctgagaacgaagcgtattttaagtcctggtaccagaaactgttggcagcccttcaattctgcgccgggaaggccttaaatgatgagttttccaaagaacagaaacttatcaagatcctgggtgacatcggagagcgcgtgaaatccgcctctgatcaccagcgccaggaagtattgaagaaggagatcggccgcttagaagagttttttcaggacgtcaatacctgtcatttgcctttgaatcccgcactctgcataaaaggaatagatcatgatgcctgctcttatttcacctcaaatgcactgccccttaaaatcacctttatcaacgctaatccgatgggcaagaacataagcattattttcaaagccggcgatgacctgcgtcaggacatgctggtccttcagttgatacaagttatggataatatctggttgcaggagggtctggatatgcaaatgatcatctataggtgcctaagtacaggaaaggaccaggggctcgttcagatggtgccagacgcggtcaccctggccaagatacaccgacactcgggactgataggcccattgaaagagaacactatcaagaaatggttttcccagcataaccacctcaaggcagattacgagaaggcgctccggaattttttctactcttgcgcaggatggtgcgtggtaacctttatccttggagtttgtgatcgtcataatgacaatatcatgcttactaaaagcgggcatatgtttcacatcgatttcgggaagtttctgggccatgctcaaacattcggagggatcaagcgtgatagggctcccttcatattcacctccgagatggaatacttcattactgaagggggcaaaaacccgcaacactttcaggatttcgtggaattgtgctgtcgggcctacaatattatccggaagcactcgcagctcctgcttaatctgctggagatgatgctctatgccggcctgccggagctctccgggatccaggacctgaagtatgtttataataatttacggcctcaggacaccgacctcgaagctactagtcattttaccaagaaaataaaggagtcactggagtgttttcctgtgaagctgaataatttgatacacacgttagctcagatgtccgcaatctcccccgcaaagtcaacatcacagacattcccgcaagagagctgtcttctcagtacaacacgcagcattgaacgcgccacaatcctgggatttagtaaaaagagctctaacctgtacttgatccaggtgacccacagcaacaatgagacatcccttactgaaaaatcctttgaacaattctccaagttacattcacagctacagaagcagtttgccagtcttactcttcctgaatttcctcattggtggcacctgccgttcaccaattccgatcacaggaggttcagagacctcaatcactacatggaacagatcctcaatgtatcccatgaagttacgaattctgattgtgttctgagtttcttcctgagtgaggctgtacagcagactgtggaagaatcaagcccagtatacctgggcgagaaattcccagataagaagccaaaagtccagctggtcatttcctacgaagacgtcaagcttacaattcttgtgaaacatatgaagaatatccacctccctgacgggtctgcgccaagcgcccacgtcgagttttaccttctcccatatccttccgaagtgagacggagaaagaccaagtctgtgcccaagtgcacagaccccacatataacgaaatcgttgtgtatgatgaggtcaccgaactgcaaggccacgtcttgatgttgatagtgaaatccaaaacagtttttgtcggagccataaatatccgcttgtgtagcgtcccgctagataaagagaaatggtatccgctggggaactctataatttag

SEQ ID NO: 128666 - DNA, 4338 bp, Artificial Sequence
  Description of Artificial Sequence: Synthetic coding sequence
atggcctacagctggcaaactgatccaaatcccaatgaaagccacgagaagcaatatgagcaccaagagttcctattcgtgaatcaaccgcattcatctagccaggtgtccctgggctttgaccagattgtggatgagatttccgggaagataccccactacgagtcagaaattgatgaaaatacattcttcgtgcctaccgcaccaaagtgggacagcacaggacactccctgaatgaagctcaccagattagcctcaacgagttcacctccaagagtagggagttgtcatggcaccaagtcagcaaagcacccgccatcggtttcagcccctcagtgttgcccaaaccacagaacacaaataaagaatgcagttgggggagtcccatcgggaaacaccacggggctgatgactccaggttcagtatcctcgccccctccttcaccagccttgataagatcaacctggaaaaagagcttgagaacgaaaaccataactatcacatcggcttcgagtccagtatccccccaacaaacagttcttttagctccgactttatgccaaaggaggagaataagagaagtggacacgtcaacatagtggagccaagcctcatgctgttaaaggggtcattacagccgggtatgtgggaatctacctggcagaagaacatcgagtctattggctgttccattcagctagtggaagtcccccaaagtagcaacacctcgctggcgtctttctgcaataaggtcaagaagattagggagaggtaccatgccgctgatgtaaactttaactccgggaagatctggagcactaccacagcatttccctatcagctgttctccaaaacaaagtttaacattcatatctttatcgataactctacacagccacttcattttatgccctgcgccaattatctcgttaaagaccttattgccgaaatattacacttttgcacaaacgaccagcttctgcctaaggatcatattctttccgtctgcggaagtgaagagttcctgcagaacgaccattgcctgggctcacataagatgtttcagaaagataaatcagtgatccagctgcatctgcaaaagtctcgtgaagccccaggaaaactgagtcgaaaacacgaggaggaccactctcagttttacctgaaccaacttctcgaatttatgcacatttggaaggtaagtaggcagtgtttgctgacactgatccgaaagtacgatttccatttaaaatatctgctaaagactcaggaaaacgtttacaatatcattgaggaagtgaaaaaaatttgctctgtactaggatgtgtggagacaaagcaaatcacagatgctgtgaatgagctgtccctcatcctccagcggaaaggtgagaatttttatcaatcttcagaaacttccgcgaaaggcctgatcgagaaagtgacaacggaactctcaacaagtatctaccaactcatcaacgtgtactgcaattctttttacgctgactttcagccagttaatgtgccccggtgcacttcctacctcaatcccggcttaccttctcacttgtcctttaccgtgtatgctgctcataacattcccgaaacgtgggtacaccgaatcaattttccactcgagatcaagtccctacctcgcgaatcaatgttgacagtcaaactttttggcattgcctgtgctaccaataatgctaatctgttagcctggacgtgcctgccactgtttcctaaggagaagtccatcctcggttcgatgctattcagcatgaccctgcagagcgaacctcccgtggagatgattacacctggagtctgggatgtatcccagccctccccggtcacccttcagatcgatttccctgccaccggatgggagtatatgaaaccagattccgaagagaatcgttctaacctcgaggagccactcaaggaatgcattaagcacatcgcacgcttgagccagaaacagacccccctcctgctgagcgaggaaaaaaagcgatacctgtggttctacagattttattgtaataatgaaaattgtagcctgcctctggttctgggttccgccccaggttgggatgagcggacagtttccgagatgcacacaatcctgagacggtggacattctcacagcccctcgaggccctgggcctgttaacttctagcttcccagaccaggagatcagaaaggtagcagtgcagcagcttgataatctattgaacgacgagctgctggaataccttccgcagctagtgcaggccgtgaagttcgaatggaacctggagtcgcccctggtgcagctgcttttgcaccgctccctgcagtcaattcaggttgcccaccggctgtattggttgctgaaaaacgcggagaacgaagcctattttaaatcatggtaccagaaattgcttgctgctctgcagttttgtgcaggaaaagcgctcaacgatgagtttagtaaggaacagaaacttatcaaaatcctgggcgatatcggtgaaagagtgaagtccgctagtgatcaccagaggcaggaggtgttgaagaaggagattggacgccttgaagagtttttccaggacgtcaacacctgtcacctccccttaaacccagccctatgcattaagggcatcgaccatgacgcttgctcttacttcaccagcaacgcactccctctaaagattacattcatcaacgccaatccgatggggaagaatatatctattatctttaaagccggcgatgacctccggcaggatatgctggtactgcagctgattcaagttatggacaatatttggctgcaggagggtctcgacatgcagatgataatctatcggtgcctgagcactggaaaggatcagggtctagtgcagatggtccccgacgccgtgactctcgcgaaaattcatcgccacagcggattgattggcccactgaaagaaaataccatcaaaaagtggttcagccagcacaatcacttgaaggccgattacgagaaagctctgaggaattttttctactcatgcgcagggtggtgcgttgtcacattcattctgggggtctgcgatagacacaatgataatataatgctgactaagtcagggcacatgttccatatcgattttgggaagttcctaggacacgctcagacctttgggggcatcaaacgggatagagcccctttcatatttacgtccgagatggagtatttcatcacggaaggagggaaaaatccccagcacttccaggacttcgtggaactctgttgccgagcatacaatatcatacgtaagcatagtcagttgttactaaacctactggagatgatgctgtatgctggcctgccagagttaagcggcattcaggatcttaagtacgtctataacaatctgaggcctcaggacactgatttagaagccacctcccatttcaccaaaaagataaaagaatcccttgaatgtttccccgttaagctgaataatctgatccacactctcgcgcagatgagcgccatctctccagccaagtctacatcccagacatttccgcaggaatcatgcctgctcagtacaactcgttccatcgagcgggcaacaatcctgggcttctcaaaaaagtctagcaatctttacctgatacaggtgacccattcaaacaatgagacgagtctgaccgagaagagcttcgaacagttctccaagcttcactcccagctgcagaagcaattcgcgtcactcacactaccggaatttcctcactggtggcatttaccgtttacgaactcagaccacagacgctttcgggacctgaaccattatatggaacagatccttaacgtgagccacgaagttaccaacagcgattgcgtgctgagttttttcctctcagaagctgttcagcagactgtggaggagtcttctcccgtatatctgggggagaagttccccgataagaaacccaaagtacagctggttatctcttacgaagatgtgaagctgactatcctcgtgaagcacatgaagaatatccatcttcccgatgggagcgccccttccgcccacgtcgaattttatctgttgccatacccgagtgaggtcagacgccggaaaaccaagagcgtgcctaagtgcactgaccctacctacaacgagatagtggtgtacgacgaagtgaccgaactgcagggtcacgtacttatgctgattgtgaagtcgaagaccgtgttcgttggggccatcaacatcaggctgtgtagtgttccactagataaggagaagtggtatccgctaggtaatagtatcatctag

SEQ ID NO: 128667 - DNA, 4461 bp, Artificial Sequence
  Description of Artificial Sequence: Synthetic coding sequence
atggcgtacagctggcagactgatcccaatccgaatgagagccacgagaaacagtacgagcaccaggagttcttgttcgtgaatcaaccccactcgtcttcccaagtgtccctggggttcgatcaaatcgtcgatgaaatatcgggaaaaatcccccactacgagtcggagatcgacgagaatacattcttcgtacctaccgcccccaagtgggacagcacagggcattccctgaatgaggcgcatcagatttcccttaatgagttcacatcaaagtccagggagcttagttggcatcaggtcagcaaagccccagcaattggcttcagtccatcggtgttgcctaaaccccagaataccaataaagaatgcagctggggctcaccaattggcaagcaccacggcgcagacgacagtcgcttctcgattctcgccccctcatttacatcactcgacaaaataaacctcgaaaaggaactggaaaacgaaaatcataactaccatatcggttttgaatcgtcaatccctccaacgaactcatcattttcctctgattttatgcctaaggaggaaaataagcgcagtggccatgtcaacattgtggaaccgtcacttatgctgttaaaagggagtcttcagccaggcatgtgggaatccacatggcagaaaaacattgaatcaattgggtgttctatccagctcgtggaggtgccccagtcctctaatacatccctggccagcttttgtaataaagtgaagaaaataagggagcggtatcacgccgctgacgtgaattttaatagcggtaagatttggtctaccaccactgcctttccttatcagctattctcgaagactaagtttaatattcatatctttattgataatagcacccagcccctgcacttcatgccctgtgctaattatctcgtgaaagatctaattgccgagattcttcatttttgcactaatgatcagttgctcccaaaggaccacatcttgagtgtgtgtggatctgaggaattcctgcaaaacgatcactgcctgggatctcataagatgtttcaaaaagacaaaagcgtcattcagctccatcttcagaaatctagagaggctcccggtaaattgtccagaaaacacgaggaagatcattcacagttctatctgaatcagcttctggagtttatgcacatctggaaagtgagcaggcagtgcctccttacgttgattcggaaatacgattttcatttgaaatacctcctgaagacgcaagagaacgtgtataacataatcgaagaggtcaaaaagatttgtagtgtacttggctgcgtggagaccaagcagatcacagacgctgtcaacgaactctcactgattctgcagcgcaagggggaaaacttctaccaatcatcggagacatcagctaagggtctaattgagaaggtgactacagaactgagcacgtctatataccagctcataaatgtttattgtaactccttttatgcagacttccagcctgtgaatgtgccaaggtgcacctcctatttgaatcctggtctgccgagtcacctctcctttacagtgtacgccgctcataatattcctgaaacttgggtccattcatacaaggccttcagttttacgtgttggctaacctacgcggggaagaagctatgtcaggtacgcaactatcgcaatattccggacaagaagctcttcttttttctggtgaattggaacgagacaataaacttcccactcgaaataaagtccctccccagggagtccatgctcactgtgaagctctttggtatcgcctgtgccaccaacaatgcgaacctgctggcctggacctgtttgcccctgttccccaaggagaaatctatcctgggatccatgttattctcaatgacactgcaatccgagccgcccgtggagatgatcaccccaggcgtttgggatgtgtcgcagccctcacctgttactttgcagattgactttcccgctacggggtgggagtacatgaaacctgattccgaagaaaataggtctaacctggaggaacctctaaaggagtgcatcaagcacatagcacgattgagccagaaacaaacacctttactcctttccgaggagaagaagagatacctctggttctaccggttttattgtaataacgagaattgttctcttcccctggtattgggttccgcccccggatgggacgaacgcaccgtgagtgagatgcatacaatcctgagacgctggactttcagccaacccctagaggccctcggtctgttgaccagctccttccctgaccaagagatccgcaaagttgccgtacagcagttggacaacttgttaaatgatgagctgcttgagtacttgccacagctagtgcaggcagttaagttcgagtggaatttggagtcacccttggtccagttactactccacagaagcctacaaagcatccaggttgcccacaggttgtattggcttctcaagaacgctgagaatgaagcatatttcaaaagctggtaccaaaagctgctcgctgctcttcagttctgcgcgggaaaggccctgaatgatgagttttccaaggagcagaagctgatcaagattctcggagacatcggagaaagagtaaaatccgcctccgatcaccaacggcaggaagtgcttaagaaggagatcggaaggctagaagaattcttccaggatgtgaacacatgccatctcccccttaacccagccctttgtatcaagggtatcgaccatgacgcctgctcatacttcacatcaaacgccttgccactcaagatcacatttatcaatgctaaccctatgggaaagaatatcagtatcattttcaaagccggggacgacctcaggcaggatatgctcgtgcttcagctgatacaagtgatggacaatatatggctccaggagggcctggacatgcaaatgatcatctacagatgcctctccaccggaaaggatcaaggactcgtacaaatggttcctgacgctgtgacattagccaaaatccataggcacagtgggttaataggacctttaaaggagaatacaataaaaaagtggttttcgcagcataatcatcttaaagccgattacgagaaggctttaaggaactttttttacagctgtgccggatggtgtgtggttactttcatcctgggcgtttgtgaccggcataacgacaatattatgctgacaaaatcagggcacatgtttcatattgacttcgggaaattcctggggcacgcccaaacatttggaggcattaaacgcgacagggcaccttttatctttacaagtgagatggagtatttcattactgaaggaggcaagaacccccagcatttccaagatttcgtggagctttgttgccgtgcctataatatcattagaaagcattctcagttactactgaatctgctggagatgatgctctacgctggactgccggagttatcaggaatccaggacctcaagtacgtctataataatttaaggccccaggacactgatttggaggctacatcgcacttcaccaagaagatcaaggagtctctagaatgcttccctgttaagctcaacaacttaattcacaccctggcccaaatgagtgcaattagccccgcgaagtccacatcacagacatttcctcaagaaagttgtcttctgtctacaacacggagcatcgagcgggccactatcctgggattcagtaaaaagtcatcaaacctttacctgatacaggtcacccacagcaataatgagacctccctgactgagaagtctttcgagcagttttcgaagctgcactcccagctgcagaaacagtttgcatcactgaccttgccagagttccctcactggtggcatctgcctttcaccaattccgatcaccgaagattcagggatcttaaccattacatggagcagatccttaatgtctctcacgaggttacgaacagcgattgtgtcttatcatttttcctgagcgaagcggtgcaacagaccgtggaggaatctagccccgtttacctcggcgaaaagtttccagataaaaaacctaaggtccagctggtgataagctacgaagatgtgaagttgacaatcctggttaagcatatgaaaaatatccatttgccagacggttccgcccctagcgcccacgtggagttctacctgcttccatacccttccgaggtcagaagaagaaaaacgaaatccgtgcctaaatgtacagacccaacatacaatgaaattgtggtgtatgatgaggttactgaactccagggtcacgttctgatgctcatagtcaaaagtaagactgttttcgttggggccatcaacatccgtttgtgctccgtgcccttggataaggaaaaatggtatccactggggaatagcatcatctag

SEQ ID NO: 128668 - DNA, 414 bp, Artificial Sequence
  Description of Artificial Sequence: Synthetic coding sequence
atgaccatggaaacgctgccgaaggtcctggaggtggatgaaaagagccctgaggctaaggatctgctgccaagtcagaccgcttcttccttatgtatctcctctcgttcagaatccgtctggaccaccactccgaggagtaactgggagatctataggaaaccgatcgttatcatgtccgtgggcggcgcaatcctgctttttggcgtcgtcattacctgccttgcttacaccttgaaactttccgacaagtccctatccatcttgaaaatggtgggccccgggtttctgtccttaggactgatgatgcttgtgtgcggcctggtgtgggtacccataataaagaagaagcagaaacacagacagaaatccaactttctgcgctcacttaagtcattctttctgactaggtag

SEQ ID NO: 128669 - DNA, 414 bp, Artificial Sequence
  Description of Artificial Sequence: Synthetic coding sequence
atgactatggaaacactcccaaaggtcctcgaggttgatgaaaagtccccagaagcgaaagaccttctgccaagtcagaccgctagcagcctgtgtatatcttccagatcggagtccgtgtggaccaccacaccccggtccaactgggagatatatagaaagcccatagtcattatgagtgtgggcggagctattttgctgtttggggtcgtgataacctgcctggcatacacccttaagctgtctgataaaagtctgagcatcctgaaaatggtggggccaggattcctctccctgggcctaatgatgctggtctgtggactggtctgggtgcctatcatcaaaaagaagcagaaacaccgccaaaagtctaactttctgagatctctaaaatctttctttctgacacgttag

SEQ ID NO: 128670 - DNA, 159 bp, Artificial Sequence
  Description of Artificial Sequence: Synthetic coding sequence
atggagaaggtacagtacctgactagatcagccatccgacgggcatcaacaatcgaaatgccccagcaagcgcgacaaaagctccagaatctgttcataaatttttgcctgattctgatttgtctgctcctaatatgtatcatcgtgatgcttctctag

SEQ ID NO: 128671 - DNA, 1371 bp, Artificial Sequence
  Description of Artificial Sequence: Synthetic coding sequence
atgccacccggtccctgggagtcctgcttttgggtgggtgggctaatcctgtggttgtccgtgggctcctctggagacgctccaccaacaccgcaacccaaatgtgcagactttcaatctgcaaatttattcgagggaacggatctcaaggtccagtttctgttattcgtgcccagtaaccctagctgcggtcagctggtcgagggaagctccgatctccagaatagcggattcaacgctacacttggtacaaaacttatcatccacggctttcgagttctggggactaaaccttcatggatcgacacttttatcagaacattgctgagagcaacaaatgctaatgtcattgcggtcgactggatttacggctccactggagtttacttcagcgccgtcaagaatgtgataaagctctctttagaaatatcgctctttctgaacaaattgttggtcctgggggtctctgagagcagcatccacatcattggcgtgtccttgggagcacatgtgggaggtatggtaggccagctatttggcggtcagctggggcagattactggcctggaccctgccggccccgaatacacacgggcctccgttgaggagagattagacgccggcgacgcattgttcgtggaagctatacataccgatacagataacctgggaatccggatccccgtcggccacgtggattactttgtgaatggcgggcaggaccagcctggttgccctacatttttctacgctggttattcttacttaatctgcgatcacatgagagccgttcatctctacattagcgccctggagaacagttgccctttgatggccttcccttgtgccagttacaaagccttcctcgcaggccgatgcctggactgcttcaacccttttctgttgtcttgtccgcggatcggtcttgtagaacagggaggagtaaaaatcgaacccctgcccaaggaggtgaaggtgtacctcctaactactagctctgctccttattgcatgcatcatagcttggtggaattccatctcaaggaactgcgcaacaaggatacgaacattgaggttacattcttgagctctaatattacctcctcgagcaaaatcactatcccaaagcagcagagatatggcaagggcattatcgcccatgctaccccacagtgtcagattaaccaggtgaagttcaagtttcagtcttccaatcgtgtttggaaaaaggatcgaacgacaattatcggaaagttctgcaccgccttactcccggtgaacgaccgcgaaaagatggtgtgcttacccgagcccgttaacctgcaagcgtccgtaacagtgagttgtgacctaaagatagcctgcgtctag

SEQ ID NO: 128672 - DNA, 1323 bp, Artificial Sequence
  Description of Artificial Sequence: Synthetic coding sequence
atgccaccgggaccttgggaatcttgtttttgggttggggggttgattctctggttgtccgtcggctcatctggcgatgccccccccacccctcaacccaagtgtgccgactttcaaagcgcaaacctcttcgaaggcaccgatctcaaggtgcagtttctccttttcgttccaagcaatccctcttgtgggcagctggtggagggaagttcagatctgcagaactcagggttcaacgccacactgggcaccaaactcatcatacacggctttcgggtgctcggaaccaagccctcatggattgacacatttatccgtacactcctgcgcgcaacaaacgccaacgtcattgcagtagactggatatacggttcaactggggtgtacttttcagctgtcaagaatgtcctgggtgtctccgagtcgtccatccatatcatcggcgtctccctaggtgcccatgttggaggaatggtcggccaactcttcggcggacaacttggccaaattacgggtctcgatccagctgggccagaatacacgcgtgcatctgtcgaagagaggctggacgcgggcgatgccttattcgtggaagctatccacacagatacagacaaccttggaattagaattcccgtaggtcatgtcgactactttgttaatggagggcaggaccagccagggtgcccaacctttttctacgccggctactcctatttaatatgcgaccacatgcgcgctgttcacctgtatatttctgccctcgagaactcatgtccgttaatggccttcccgtgcgcaagttataaggcctttttggcggggcggtgcctcgactgcttcaacccattcctgctgtcctgccctcggatcggcctggtggagcaagggggcgtgaagatagagccactgcccaaggaggtcaaagtatatttgcttaccacttcttccgctccctactgcatgcaccatagcctcgtggagtttcacttgaaggagttgcggaacaaggacaccaatattgaagtcacctttctgtcatccaatattacatccagctctaaaataactattcccaagcagcagcgatacggaaaaggcataattgcacatgcaaccccccagtgtcaaatcaaccaagtaaaatttaagtttcaatcatccaaccgagtatggaagaaagacagaaccactattataggtaagttctgtacggccctgctgccagtgaacgacagggagaagatggtatgcctccccgagcctgtgaatctgcaagcaagcgtgacggtaagttgtgacctgaagattgcctgtgtgtag

SEQ ID NO: 128673 - DNA, 852 bp, Artificial Sequence
  Description of Artificial Sequence: Synthetic coding sequence
atggttggccagctctttggcggacagctcgggcagattactgggttggacccagccggacctgaatacacgagagcctctgtggaggagagattggacgcaggggatgctcttttcgtggaggcgatccacaccgatacagacaacctgggcatccgtataccagtgggacatgtggattattttgtaaatggggggcaggaccaacctggctgtcccacattcttttacgccgggtactcttatttgatctgcgaccatatgcgggctgttcacttatacattagcgctttggagaactcctgtcctctcatggctttcccctgcgcatcctacaaagcgttcctggctggccgctgtttggactgttttaatccttttttgctctcctgtccgagaattggactggtggagcagggcggtgttaaaatcgagcctctccccaaagaagtaaaggtttatctgctaaccacctctagcgccccttactgtatgcaccatagtctggtggagtttcacctgaaagaactccgaaataaggacactaacatcgaagtgacgtttctgagtagtaacataactagtagttcgaagataacgatccccaagcaacagagatacggtaaaggcatcattgcacatgcaacccctcagtgtcagatcaaccaggtcaaattcaagtttcagagcagtaatagagtttggaagaaagaccggactactattattggaaagttctgtactgcactgctccctgtcaacgaccgtgaaaagatggtctgcctgcctgaacccgtaaacttacaggctagcgtcacggtgtcttgcgatcttaagatcgcctgcgtatag

SEQ ID NO: 128674 - DNA, 1656 bp, Artificial Sequence
  Description of Artificial Sequence: Synthetic coding sequence
atgcgtacgcggccaaggccaaggctgaggaggaccgaaaatttccttacagctgtgcaccacggcaagaaggaggaaaaggccgcagtcgagcgccgaagactgcatgtgctgaaggcactcaagaaactgaggatagaagctgacgaggctcctgtagtggcagtgctggggagcgggggcgggcttcgggcccacatcgcatgtcttggcgttctctccgagatgaaagaacaagggctgctggacgccgtcacctacctggccggcgtgtcagggagcacctgggcgatttctagcctgtacactaatgacggagacatggaggcacttgaagccgatcttaaacatcggttcacgaggcaagaatgggatctggcgaagtccctacagaagactatccaggccgcgcgttcggagaactatagcctcaccgacttttgggcctacatggtcatctctaagcagacacgggagctccccgagtctcatctgagcaatatgaaaaaaccagtggaagaaggcactctcccatatcccatcttcgcggccatcgacaatgatctgcagccttcgtggcaggaagccagagctccggaaacctggttcgagtttacaccacaccatgccggattttcggctctgggggccttcgtctctattacacattttggatccaaatttaaaaaaggaagactggttcggacccaccctgagcgggatttaacgttcttacggggcttgtggggatccgctttgggaaacacagaagtcattagagaatacatttttgaccagttaagaaacctcactttgaaagggctttggcgtcgtgctgtcgccaacgccaagtcaatcggtcacctcatttttgccagactgctgcgcctgcaggagtcttctcagggtgagcacccacctccagaggatgagggtggggaacctgagcacacttggctgactgaaatgctggagaactggaccagaacgtcattggaaaaacaggagcagccccatgaggaccccgaacgcaaagggtcgttgtcaaatctgatggacttcgtgaaaaagactgggatctgcgcctctaaatgggaatgggggaccactcacaattttctgtataagcacggagggattagggacaagattatgagttctcggaagcacttacatctcgttgacgcgggtcttgccatcaataccccttttccacttgtcctcccgcccacccgcgaggtccatctcatactgtccttcgacttctctgctggagatccttttgagacaatacgcgccactacagactattgtcggcgacacaagatacccttcccacaagttgaggaggccgagctagacctgtggagcaaggctcccgctagctgctacatcctcaaaggcgagaccgggcctgtggtaatgcattttcctctgtttaacattgatgcctgtggaggggacatcgaggcatggagcgacacgtacgatacctttaaattggcagatacttacaccctcgacgtcgtggttctcttactagccctagcgaaaaaaaatgtgagagagaacaaaaagaaaatactgagagagcttatgaacgttgctgggctttattaccctaaggacagcgcccgctcttgttgccttgcttag

SEQ ID NO: 128675 - DNA, 4392 bp, Artificial Sequence
  Description of Artificial Sequence: Synthetic coding sequence
atgctgctgtccccctctctgctcctcctgctgttactcggtgccccccgcggatgcgcagaaggagtagccgcagcactgacaccggagagacttcttgaatggcaggacaagggtatttttgtcatccagtccgagtcactgaaaaaatgtatccaagctggaaagtccgttctgaccttggaaaattgcaagcaggctaacaaacacatgctctggaaatgggtgagtaaccatggactttttaacataggcggctccggatgcttaggactgaatttttctgcacccgaacagcctctgagcctgtatgaatgtgacagcacactggtgagtctgcgctggcgctgcaaccgtaagatgatcaccggtccacttcagtactcggtacaggtagcccacgataacacagtggtggcgtccaggaagtacatacacaaatggatttcttacggctccggtggaggagatatctgcgagtatctccacaaggacctgcatacgataaagggaaatacccacggcatgccgtgcatgtttccatttcaatacaaccaccagtggcaccacgaatgcacccgtgaaggaagggaggacgacctactgtggtgtgcaaccacatcaaggtacgaaagggacgagaagtggggcttctgccctgatccgacttcagcggaggtcgggtgcgacacgatctgggaaaaagacttaaacagtcacatctgttatcagttcaatttgttatcctccctgagctggagcgaagctcacagcagttgccagatgcagggtggaacgctgcttagcataacagatgagaccgaagaaaactttatacgagaacatatgagttcaaaaactgtcgaagtatggatgggtctcaatcagctggacgaacacgctggatggcaatggtcagacggaacccccctcaactatttgaattggtctccagaagtgaacttcgaaccctttgtggaagatcattgtggtactttctcaagcttcatgccgtccgcctggcggtcgagggactgtgagagtaccttaccatacatctgcaagaagtacctgaaccacattgaccacgagattgtcgaaaaagatgcttggaaatattacgcaactcattgcgagcccggatggaacccctataatcgaaattgttacaaattgcagaaggaggagaagacctggcacgaagctctccgttcctgccaagccgacaacagcgcactcattgacatcaccagcctcgccgaggtggaatttctagtcacactgcttggggacgaaaatgcctctgagacatggattggcctgtctagcaacaaaattccagtgagctttgagtggagcaacgattcctcagttatcttcacgaattggcacactttggaaccccatatatttccaaatcggtcacagctgtgtgttagcgcagaacaaagcgaaggccattggaaggtgaagaattgcgaggagcgtctgttctatatctgcaaaaaggccggccacgtgctttctgatgctgaaagcgggtgtcaggaaggatgggagaggcacggcggattctgctacaagatcgatactgtgctgcgcagctttgatcaggctagtagtggttactattgccctccagctttagtgacgatcaccaacaggttcgagcaggcgttcattacctccctgatatcctctgtagttaagatgaaagactcctacttctggatagccctccaggaccagaatgacacgggcgagtacacatggaaacccgtcggccagaaacctgaacctgtgcagtatactcattggaacactcaccagccgaggtactctggcggctgtgtggcaatgagagggagacacccgttgggcagatgggaagtgaagcattgtagacactttaaagctatgagtctgtgcaagcagcccgtcgaaaatcaggagaaagccgaatacgaagagcggtggccgtttcatccttgctacctggattgggaatccgaacctggactggcatcctgcttcaaggtctttcattcagagaaagttctgatgaagcgaacctggagagaggcagaggccttctgtgaagagttcggagctcacctcgccagcttcgcccacatcgaggaggaaaatttcgtaaacgagctgttacattctaagttcaattggaccgaggagcgacaattttggattggtttcaacaagcggaatccccttaatgcaggcagttgggagtggagtgatcgaacccccgtggtatcctcatttttggacaacacatactttggggaggacgccaggaactgcgcagtgtacaaggccaacaaaaccttgttacccctgcactgcggaagcaaacgggaatggatttgtaagatcccacgggatgtgaaaccaaagatcccattctggtaccagtacgatgtgccctggctcttttaccaggacgcggaatacctgtttcacaccttcgctagcgaatggctcaatttcgagttcgtgtgtagttggttacatagcgacctgctgacgatacactccgcccatgaacaggagtttatccactctaagatcaaggctctcagtaagtatggagcgtcttggtggataggcctgcaggaagaacgagcgaacgatgaattcaggtggagagatggaactcccgtcatctaccaaaactgggatactgggagagagaggacagtgaacaatcagtctcagcgctgtggattcatctcgagtatcactgggctctggggcagtgaagaatgttctgtgtccatgcccagcatctgtaagcggaagaaggtctggctcatcgagaaaaaaaaagatactcccaagcagcatgggacgtgcccaaaaggctggctttacttcaattataagtgcttgctcctgaacattccaaaggacccttcaagttggaaaaactggacacacgcccagcatttctgcgccgaggagggcggcaccctcgtggctatcgagtccgaggtcgagcaggcgttcatcacgatgaacctctttggacaaacgacaagcgtctggattggcctgcagaacgatgattacgaaacttggctcaacgggaagccagtggtttactccaactggtccccgtttgacataataaatataccaagtcataacaccactgaggtgcagaaacacattcccctgtgcgctctgctttccagcaacccaaatttccactttactggtaagtggtattttgaggattgcgggaaagagggatatggatttgtctgtgagaagatgcaggataccagtggccacggcgtgaacacctctgacatgtaccccatgcccaacacgctggaatacggcaaccgtacttacaagattattaacgcgaatatgacttggtatgccgctatcaagacgtgcctgatgcataaagcgcagcttgtttcaattaccgaccaataccatcagagcttcctgaccgtggtgctcaataggctgggctacgcgcattggataggcctgtttaccacggataacggcttgaacttcgactggagtgacgggacaaagagcagcttcacattctggaaggatgaagagtcttccttgttaggcgattgcgtgtttgctgattccaacggaagatggcactcaacagcttgtgaatcattcctccagggtgccatttgtcacgtccctcctgaaacacggcaatcagagcatccagagctgtgctccgagacctccattccatggatcaaatttaagtccaattgttattctttttccacagttctagatagcatgtcttttgaggcggcccatgagttttgcaagaaggagggcagcaacctgctgacaattaaggacgaggctgaaaacgcttttttgctggaggagctgttcgccttcggctcatccgtgcagatggtgtggctgaatgcccagtttgatgggaataacgaaaccataaagtggttcgacggcactccaacggaccagagcaactggggcattcggaaacctgacacagactacttcaagccgcaccattgcgtagccttacgcatccctgagggactctggcagctgagcccctgccaagagaagaaggggtttatttgcaaaatggaggctgatatacacactgccgaagccctcccggaaaagggcccgagccattcgatcattcctttagcagtggtgctaacccttatcgtgattgttgcaatctgcactctatctttttgtatatacaagcacaacgggggtttttttaggaggttggcaggattccgcaacccctactatcccgccacaaatttcagtactgtctatttggaggagaacatccttatctccgacctggaaaagagcgaccagtag

SEQ ID NO: 128676 - DNA, 3975 bp, Artificial Sequence
  Description of Artificial Sequence: Synthetic coding sequence
atgctcctgtcgccaagcctgcttctgctgctactgctcggcgctcccaggggctgcgctgaaggggttgcagctgcccttacacccgagaggctgctggaatggcaagataaaggaatattcgttatacagtcggagagcctgaaaaaatgcatccaggcagggaaatctgtcctgacccttgagaactgtaaacaggcaaacaagcatatgttatggaaatgggtgtctaaccacgggcttttcaacatcggagggtccggctgtctgggcctgaatttcagcgctcccgagcagcctctgtcactatatgagtgtgatagtacactggtgtccctgaggtggagatgcaacaggaagatgattaccggtccgctacaatattccgttcaggtggctcacgacaacacggtggttgcttcccggaaatacattcacaagtggattagctatgggagtggggggggggatatctgcgagtacttgcacaaggacctgcatacaatcaagggcaatacccacggaatgccctgtatgtttccctttcagtataatcatcagtggcaccacgaatgcaccagagagggcagggaggacgacctgctatggtgtgcgaccacaagccggtacgagcgcgacgagaaatggggattctgccctgatccgacaagcgccgaggtgggctgcgatacgatctgggagaaggacctaaacagtcatatctgttaccagttcaatcttctgagcagcttgtcttggtccgaggctcattctagttgccagatgcagggggggaccttactgtccattactgatgaaaccgaagagaattttatcagggaacatatgtcctctaagaccgtcgaagtttggatgggactaaaccagttagatgaacatgcgggttggcagtggagcgacggaaccccactcaactacttaaactggagccctgaggtcaattttgaaccctttgtggaggaccattgcggcacattcagctcgttcatgccaagcgcatggcgcagcagagactgtgaaagtaccttgccctatatttgcaaaaagtatctgaatcatatcgaccacgagattgttgagaaggacgcatggaagtattacgctacccactgcgagcccggatggaacccttacaatcggaattgctacaagctgcagaaggaagaaaaaacatggcatgaggccctccgatcttgccaggctgacaatagcgcactcattgatattacgtctctggcggaagtggagtttctggtgaccctcttgggcgatgagaacgctagtgaaacttggatcggcctttccagtaataagatcccagtcagcttcgagtggtctaatgattcctctgtcatttttacgaactggcacacgctagagcctcacattttccccaatcgcagccagctttgcgtcagtgccgagcagtcggaggggcactggaaagtgaaaaactgtgaagagcgtctattctatatttgtaagaaagcggggcacgtcctttccgatgcagagagtggatgtcaagagggatgggaaagacatggaggattctgctataaaatagataccgttctgcgctctttcgaccaggcctctagcgggtactactgccccccagctctggtgactatcaccaaccgctttgaacaagcgttcatcaccagcctgatctctagcgtggtgaagatgaaggactcctatttctggatcgcactgcaggatcagaacgacaccggcgagtatacttggaagccagtgggccagaagcccgagccagtgcagtacacgcactggaacacgcaccagccacggtattcaggcggctgtgtggcaatgcgtggacggcatcccttggggcgctgggaggtgaaacactgccgtcacttcaaggcgatgtccctctgtaaacagccggttgagaaccaagaaaaagccgaatatgaggagaggtggcctttccatccctgctaccttgattgggaatcagaacctggtcttgctagttgttttaaagtatttcactccgagaaagtgctgatgaaaagaacttggcgggaggcagaagctttctgtgaggaatttggggcccacttggcatcgtttgcacacatcgaagaggagaattttgtgaatgagctgctgcattccaagtttaactggaccgaggaaagacaattttggataggttttaataaacgcaaccccctgaacgctggatcgtgggagtggagtgatcgcactcccgtcgtgtcatcttttctcgacaatacttatttcggcgaagacgcccgcaattgcgccgtctacaaggccaacaagaccctgttgccactccactgtggatctaagcgggagtggatatgcaaaattccgcgcgacgtgaagcctaaaatacccttttggtatcagtacgatgtaccttggttattctaccaggacgcagagtatctgttccatacttttgcaagtgagtggctgaacttcgagttcgtgtgttcctggcttcactccgacctgctaactatccattcagcacacgagcaagaatttatccactctaaaatcaaggctctgagcaaatacggggcaagttggtggatcggcctgcaggaggaacgcgccaacgacgagtttagatggcgtgacggaacacccgtaatctatcagaactgggacacgggacgggaaagaacggtcaataaccagtctcaacgctgtggattcatcagtagcatcacggggctgtggggcagtgaagagtgcagcgtttcaatgcctagcatatgcaagcgcaagaaagtgtggcttatcgagaaaaaaaaagatacacccaagcagcatggtacatgccccaagggatggttgtacttcaactacaagtgcttacttctgaacatacctaaagaccctagcagttggaagaattggacccatgctcagcacttctgtgcagaagagggaggcaccctggtcgctattgaatccgaagtcgagcaggctttcattaccatgaatctctttggacaaacaacgagtgtttggatcgggttgcagaatgatgactacgagacctggttaaatggtaaacctgtagtgtattccaactggtctcccttcgatatcataaacataccttcccataacaccacagaggtacaaaaacacattccgctgtgtgccttgctcagtagcaatcccaattttcatttcacaggcaagtggtatttcgaagactgtggcaaggaaggctatggattcgtgtgcgaaaaaatgcaggatacatccggccatggtgttaacaccagcgacatgtatccgatgcctaatacacttgagtacggcaatcgtacctacaagatcatcaacgccaacatgacctggtatgcggctatcaaaacctgcctgatgcacaaagctcagctagtgtcgattactgatcaatatcaccagtccttcctaacagtggtcttaaatcgacttggatacgctcattggattggcctgtttactaccgacaacgggcttaacttcgactggtcagacggaaccaagtcctccttcacgttttggaaagacgaggagagcagccttcttggtgattgcgtgtttgctgactccaacggacgttggcattcaaccgcttgcgagagctttctccagggcgccatatgccatgtgccaccggagacacgtcagtctgagcacccggagctgtgtagtgaaacatccattccatggatcaagttcaagagcaactgttactcgttctccaccgtgctggactccatgagctttgaggcagcgcatgagttttgcaaaaaagagggctctaatctcctcaccatcaaagatgaagccgagaatgctttcttacttgaagagctttttgctttcgggtcgtccgtgcagatggtttggcttaacgctcagtttgacggcaattctaaatag

SEQ ID NO: 128677 - DNA, 1584 bp, Artificial Sequence
  Description of Artificial Sequence: Synthetic coding sequence
atgggctcctcagaagtctcgataatcccaggattacagaaggaggaaaaagccgcggtcgaaagaaggcggctgcacgtgctaaaggccctcaaaaaactcagaatcgaggccgatgaagcacccgtggtggcagtgttaggatccggaggtggcttgagagcccacatcgcttgtctaggcgttctgtccgagatgaaagagcagggcctgctagatgccgtgacatacctggcaggagtttccggctctacgtgggccattagctcactgtacacaaatgatggggatatggaggctttagaagccgacctgaagcacagattcacgaggcaagagtgggatctggccaagtccctccagaaaacaatccaggccgcacgctccgagaattacagtctgactgacttttgggcctatatggtgatttctaagcagacccgagagttgcctgagagccatctctccaacatgaaaaaaccagtcgaggaaggaactttgccatatcctatcttcgcagccatcgacaatgatctgcagcccagctggcaggaagctcgagcgccggagacttggtttgagttcacaccacaccacgccggattctctgcactgggcgcctttgtcagcattacacacttcggaagcaaatttaagaagggtcgattagtgcggacacatccagaacgggatttgacgtttctgcggggtctctggggcagcgccctcggtaatactgaggtgataagggaatacatctttgatcagcttcgcaacctcactctgaagggcctgtggaggagagccgtggccaatgccaagtccatcggtcacttgattttcgccagactactgagactccaagagagctctcagggcgagcacccaccccctgaggacgagggtggcgaacctgaacatacctggttaactgagatgctggaaaattggacccggacttcattggaaaagcaagagcagccccatgaggatcccgaacgaaaaggctccttgtctaatcttatggactttgtcaaaaagactggcatctgtgcctcaaaatgggaatggggcacgactcacaacttcctttataagcacggaggtatccgcgacaagatcatgtcttccagaaagcatctgcatctggtggatgcgggccttgctattaataccccattccccctggtgttaccacctacgagagaggttcatctaatattgtcattcgacttctccgctggggatccgttcgagactatccgggcaacgaccgattattgtagacggcacaaaataccctttcctcaggtagaggaggctgaactcgacctctggtctaaagcaccagctagctgctatattttgaagggggagacgggtcccgtggtgatgcacttcccactgttcaatattgacgcatgcggtggagacattgaagcctggtccgacacctatgatacgttcaagctggccgacacctacacactggacgtcgtagtactcctgctggccctggccaaaaaaaatgttcgagagaataagaaaaagatactgcgggagctgatgaatgtggcgggttag

SEQ ID NO: 128678 - DNA, 1626 bp, Artificial Sequence
  Description of Artificial Sequence: Synthetic coding sequence
atgggctcttccgaagtttccatcatcccagggctgcagaaggaagaaaaggctgccgtggaacgccgccgtctccacgttttaaaagccctgaaaaagctgcgcatcgaagctgacgaggcccctgtggttgctgtacttgggagcggtggcggcctaagggcccacatcgcatgtttgggagtgttgagcgaaatgaaagagcagggactgctggatgcagtgacctatctcgctggcgtgagcggttcaacttgggcaatcagcagcttatacaccaatgatggcgacatggaagcccttgaggcggacctgaagcataggtttacaagacaagagtgggatctggcaaagtccttgcagaagaccattcaggcagcgcgatctgagaattattctctcaccgatttttgggcatacatggtgatttcaaagcagacccgtgagctcccagagagtcacctgtccaacatgaagaagcctgtagaagagggcactctgccctacccaatctttgcggctatagataatgatctgcagccatcctggcaggaagcccgggctccggagacttggttcgaattcacacctcatcacgctggattctctgcccttggggcctttgtatctatcactcattttgggagcaaatttaagaagggacgtctcgtccgcactcatcccgaaagggaccttacattcctaaggggcctgtgggggagcgccctcggtaatactgaggtaatcagggaatatatattcgatcagctcagaaatttgacgttgaagggcctgtggcgcagagccgttgccaacgctaagagcattggccatctaatcttcgccaggttgctgcggcttcaggagtccagccaaggcgaacaccccccacccgaggacgaggggggggagcctgagcacacgtggttgacggagatgctcgagaactggactaggacctctctggaaaagcaagagcagccacatgaagacccagaacggaagggatccctaagcaacttgatggactttgttaaaaaaaccggcatctgtgcctctaagtgggagtggggcacaacacacaattttttatacaagcatgggggtattcgtgataagataatgagcagtcggaagcatctacatctggtcgacgctgggctggccattaatacaccttttcctctggtgctgcctccaactcgcgaagtgcatctgattctgagcttcgatttcagcgctggggatccttttgagaccatacgagcaacgaccgattactgtagacgccataagataccttttcctcaggtggaggaggctgaacttgacctgtggtcaaaggcacccgccagttgttacatattgaaaggcgagaccgggccagtggtgatgcacttccccctatttaatattgatgcatgtgggggagacatagaagcctggtcagatacatacgataccttcaagttagccgacacttataccttagacgtggtggtgctgttgctggcccttgccaaaaagaatgtgcgagaaaataaaaaaaaaattttgagagagctgatgaatgtggctgggctctactatcccaaggactctgctcgctcctgttgcctcgcttag

SEQ ID NO: 128679 - DNA, 2457 bp, Artificial Sequence
  Description of Artificial Sequence: Synthetic coding sequence
atggagagtttgagtccaggaggccctccaggacacccataccaaggggaagcctcgacatgctggcagctgacggttcgcgtactggaagctcgcaacctgcgttgggcagacctgctgagtgaggccgatccgtacgtgatccttcagctgagcaccgcacccggcatgaagtttaaaactaaaacgctgacggacacttcacatccagtctggaatgaagccttccgctttctgatacagagccaagttaagaacgtgctggagctgagtatttacgatgaagacagcgtgaccgaagacgatatctgtttcaaagtcctatacgacatatccgaagtgctgcctgggaagctacttcgtaagaccttctcacagagtccacagggagaagaagaactggatgtggaattcctcatggaggagacaagcgacaggccagagaaccttattaccaataaggtgatagtggcccgcgaactctcatgtctggatgttcatcttgactccaccgggtcaaccgccgttgtggctgatcaggacaaactagagctcgaactggtgctgaaaggatcttacgaggatacccaaacatcatttctcgggactgccagtgctttcagatttcattacatggcagcccttgaaacggaactgtccggacgccttcggtcatcaaggtctaatggctggaatggcgataattccgccggctatcttacggtacctttaagaccgttaacaatcggtaaggaggtcacaatggacgtaccagctccgaatgcccccggggttcggctgcagctcaaagccgagggatgccccgaggagctagccgttcacctgggcttcaatttgtgcgccgaggagcaggcctttctgagtcgtcggaagcaagttgtggctaaggcgttgaaacaggctttacaacttgatagggatctgcaagaggatgaggtgccagtggtcggtatcatggctacaggtgggggcgctcgtgcaatgacctcgctatatggtcatctgctggctcttcaaaaactgggcctcctggactgcgttacttattttagcgggatctctggaagtacctggacaatggctcacctctacggtgaccctgagtggtcacagagggacttagaaggacccattcgatatgctagagaacaccttgcaaaaagcaaactggaagtgttttcacctgaacgactggcttcctatagaagagaactagagttacgggcagagcaggggcacccgactacgtttgtggacctgtgggccttagtactggagtcaatgcttcacgggcaggtgatggatcagaaactatcagggcagcgtgctgcgctggagcgcggtcagaatcctctgcccctttacctgagcttgaacgtgaaggagaacaacttagagaccctagattttaaagagtgggtggaattctctccatacgaagtgggattcctgaagtatggggcgtttgtgcccccagagttgttcgggtctgagtttttcatgggcagattgatgaggcgtatccctgagccgaggatctgctttcttgaggccatctggagtaatatctttagcctcaacctgctggatgcttggtacgacttgaccagctcaggtgagagctggaaacagcatatcaaagataagacaaggtctttggagaaggagcctttaaccacaagcggaaccagctctagactcgaagcgtcttggctgcaaccaggcaccgccctcgcacaggctttcaagggctttctcaccggaagaccactgcaccagagatctccaaactttttgcaagggctgcagctacaccaggactattgctcccacaaggatttctcgacctgggcagattaccagctggattcaatgccgtcccagcttacccctaaggagcctagattgtgtttggtggatgccgcatactttatcaatacctcctcaccatccatgtttcgccccggaaggcgcctggaccttatcctcagtttcgattactccttgtccgcacccttcgaagcgctgcagcagaccgaactttactgcagggcccggggactgcctttccctagggtggagcctagccctcaggatcagcaccagcctagagagtgtcatcttttcagtgatcctgcatgcccggaagcacctatcctgcttcattttccccttgtcaacgcttctttcaaggaccactcagcaccgggggtccagcgttcgccggcagagttgcagggagggcaggtggacttaaccggcgccacctgcccatacacgttaagtaatatgacttacaaagaagaagactttgagcgcttgctcaggttatcagattacaacgtgcagactagccagggcgcgatcctccaagcactgcgaaccgctctaaagcatagaactctggaggcccggcctcctcgagcacagacatag

SEQ ID NO: 128680 - DNA, 1326 bp, Artificial Sequence
  Description of Artificial Sequence: Synthetic coding sequence
atggtcccccccaaactacatgtcctgttttgcctgtgtgggtgtcttgctgtggtgtacccgtttgattggcaatatataaaccctgtagcgcacatgaagagcagtgcctgggtgaataaaattcaggtgttgatggctgcagcaagctttggccagaccaagatacccagaggaaatgggccctactctgttgggtgcacagacttaatgttcgatcataccaacaaaggcactttccttaggctctactatcccagccaagacaacgatagactcgacactctctggataccgaacaaagagtacttttggggactgtccaaatttctgggcacccattggctgatgggcaatatcctgagacttctgtttgggtcgatgacaacgcccgctaactggaattcccccctgcggccgggggagaaataccccctcgtcgtgttcagccatggcctcggtgcgttccgcactctctactcagctattggaatcgacttagcctcacacgggtttatcgtggcagcagttgagcatcgggacagaagtgcctctgctacctactattttaaggatcagagcgcagcggagataggtgacaaatcctggctttacctccgcacgcttaaacaggaagaagagactcacatacgtaatgaacaggttcgccaacgagccaaggagtgttcgcaagcgttgagcctaatccttgacatcgaccacgggaaaccagtgaagaatgctctcgatcttaagttcgacatggaacaactcaaagattctattgaccgggaaaaaatcgctgtgatcggacactcttttggcggagcgacggtgattcagactctttcagaagaccagagatttagatgcggcatcgcactcgacgcctggatgtttccactaggcgatgaggtatactctcgaatacctcagccattattcttcatcaacagtgaatatttccagtaccctgccaacattatcaagatgaaaaaatgctacagtcccgataaggaacgcaaaatgattactatccgcgggagtgtgcaccagaatttcgccgattttaccttcgccacagggaaaattataggacacatgctcaaacttaaaggagacatcgatagtaacgtggcaattgacctttcaaacaaggcttcactggcgtttctgcagaagcaccttggcctgcataaagactttgaccagtgggactgcctgatcgagggagacgatgaaaatctgattcccggcactaacattaataccacaaaccagcatattatgcttcaaaactctagcgggatcgagaaatacaattag

SEQ ID NO: 128681 - DNA, 1326 bp, Artificial Sequence
  Description of Artificial Sequence: Synthetic coding sequence
atggtgcctccgaagcttcacgtcctcttttgcttatgtggttgcctagccgtcgtatacccatttgactggcagtatatcaatcccgtcgcccacatgaaatccagcgcatgggttaataagatccaggttctgatggctgcagcgtcctttggccagactaaaatcccgcgtgggaatgggccatactcggtgggatgtactgacctgatgttcgatcacactaataagggcacattcctgcggctctactacccctcccaagacaatgatagattagacaccctctggattccaaacaaggaatatttttgggggctttccaaattcctggggacacactggctcatgggaaatattctgagacttctatttggttctatgaccactcctgccaactggaattctcctttgcggccgggcgagaaatacccgctagtggtgtttagtcacggactcggtgccttccgaacactctactcagccatcggcatcgacctggcgagtcatggtttcattgtggctgccgtggaacatcgagaccggagtgctagcgctacttactatttcaaggaccagagcgcagccgagatcggcgacaaaagctggctgtacctgagaaccttaaaacaggaggaggagacacacatcagaaacgaacaggtccgccaaagggctaaggaatgtagccaggccttgtccctgattctggatattgatcatgggaagcctgtcaagaatgctctggacctgaagtttgatatggaacagctgaaggactccatcgacagagagaagattgctgtcatcggccactctttcggaggcgctaccgttattcagactcttagcgaagatcagagatttcgttgtgggattgcacttgacgcctggatgttcccacttggcgacgaggtttattcacggataccccagcctctctttttcatcaatagtgaatatttccagtatcctgccaacatcataaaaatgaagaagtgctacagtcctgacaaagaaaggaagatgattactatcaggggcagcgtccatcagaattttgccgatttcacatttgcgacagggaagattattgggcatatgttgaagctgaagggtgatatcgatagcaacgttgccatcgatctctctaataaagcaagcttggcgttcctccagaaacacttgggtctgcacaaggatttcgatcagtgggactgcttgatagagggggatgacgaaaatctgataccgggtaccaatatcaacacaactaaccagcatattatgctgcagaatagcagcggtatcgaaaagtataactag

SEQ ID NO: 128682 - DNA, 660 bp, Artificial Sequence
  Description of Artificial Sequence: Synthetic coding sequence
atggctgccgccagctttggacagacgaagattccgcggggaaatggaccttactccgtggggtgtacagacctaatgtttgatcatactaacaagggcacatttttacggctttactatccttcccaggataacgataggctggacaccctgtggatccctaataaggagtacttctggggcctgagtaaattcctgggcacccattggctgatggggaatattctgcgactactctttggcagtatgacgacaccagctaattggaactccccactacgcccaggagaaaaataccccttggtggtgttttcccacggattgggagcctttcgcaccctgtattccgcgatcggaatagatctggcttcccacggcttcatagtggcagcggtggagcatagggaccgaagtgcctctgccacgtattattttaaggatcaatcagcagccgaaatcggcgataagtcatggctttacctacggacccttaagcaggaggaagaaacccacatcagaaatgagcaagttcggcagcgcgccaaggagtgtagccaggctctgagtctaatcctcgatatcgaccacggtaagcccgttaagaatgcattggatctcaaatttgatatggaacagcttaaggtatcttacaagaagtag

SEQ ID NO: 128683 - DNA, 414 bp, Artificial Sequence
  Description of Artificial Sequence: Synthetic coding sequence
atgactacccctgccaactggaactcccccttgaggcccggcgaaaaatatcctttagtcgtgtttagccacggacttggcgctttcaggactctttacagtgcgattggcatcgacctggcaagccacggattcatcgtcgctgccgtggaacaccgagaccgatctgctagtgcgacttactacttcaaagatcaaagcgctgctgaaatcggggacaagtcttggctttatctccgtactctcaagcaggaggaggagacacatattagaaatgaacaggtcaggcagagagccaaggaatgttcccaggctctgagtctgatcttagacatcgaccacggcaaaccagtcaaaaacgctctggacttgaaattcgacatggaacagcttaaggtgtcatacaagaaatag

SEQ ID NO: 128684 - DNA, 489 bp, Artificial Sequence
  Description of Artificial Sequence: Synthetic coding sequence
atgagagcccccattcccgaacctaagcctggggacctcatcgagattttccgtcccttctacaggcattgggccatctacgtgggtgatggctacgttgtgcatctggcaccaccatccgaagttgcgggagcaggagccgcatccgttatgagtgcattgacggataaagctatcgtaaaaaaggagttgctttacgatgtcgcaggctctgataaatatcaggtcaataataaacacgacgataagtacagccccctcccgtgttccaagattatccagcgtgcagaggaactcgtgggccaggaggttctgtataaactgacctctgagaactgcgagcattttgttaatgagttgcgatatggggtggcgcggtcggatcaggtaagggacgtgatcattgccgcttctgttgctggtatgggtctggcagctatgagcctgattggggtcatgttttctaggaacaagcgtcagaagcagtag

SEQ ID NO: 128685 - DNA, 489 bp, Artificial Sequence
  Description of Artificial Sequence: Synthetic coding sequence
atgcgggccccgatcccggagcccaagcccggggacctgatcgaaatctttcgccctttctaccgccattgggctatctatgtgggtgacggctacgtggtacacttggcccccccgagtgaagttgctggagccggggccgcctccgttatgtcagctcttacagataaggctattgttaagaaggagctgctctatgacgtagctggatcagacaagtaccaggtgaacaacaaacacgatgacaaatacagccccctgccctgttccaagattatccagagggctgaggaactcgtcgggcaggaagttctgtataaactgacatcagagaactgtgaacatttcgttaatgaactccgttatggtgtggcacgatctgaccaagtgagggacgtgatcatagctgcatctgtcgcaggcatggggctcgccgccatgtcactcataggagtgatgttctcccgaaataagcgtcaaaaacagtag

SEQ ID NO: 128686 - DNA, 4377 bp, Artificial Sequence
  Description of Artificial Sequence: Synthetic coding sequence
atgggtcttcgccctggcattttcctgctggaactcctattacttctggggcagggcacaccccagatacatacctctccgcggaagagtactctggagggacagctctggccagaaacccttaagaactctccctttccctgcaatccaaataaacttggggtgaatatgccaagtaagagcgtgcatagtctcaagccatccgatatcaaatttgttgccgccattggaaatctggaaatcccccctgatcctggaaccggtgacctggagaagcaggactggactgagagacctcagcaggtgtgcatgggtgtcatgaccgtcctgagcgacattatccgctatttctcaccatctgtgccaatgccagtgtgtcacacgggcaagcgagtcatcccacacgatggggctgaagatttgtggattcaggctcaagagttggtacggaatatgaaggagaacctccagctcgactttcagtttgactggaaactaataaacgtgtttttctctaatgctagccagtgctatctttgcccaagcgcacagcaaaacgggttagccgcagggggtgttgatgaattaatgggcgttctggactacctccaacaggaggtgccgagggctttcgtgaatcttgttgacttaagcgaagttgctgaggtcagtaggcagtaccacggaacatggctgagtcccgctcccgaaccctgcaattgttcagaagagacaacaagactcgcgaaggtcgtaatgcagtggtcctaccaggaagcatggaattccctcctggcatcttcgagatactcggaacaggagtcgtttaccgttgtttttcagcccttcttctatgagactactccatctctgcacagcgaagatccccgacttcaggatagcacaaccctggcctggcatttgtggaatcggatgatggaacccgctggggagaaggatgagccactctccgtgaagcacggaaggcccatgaaatgcccaagccaagagtccccttacctcttctcatacagaaattccaactatctgaccagactgcagaagccgcaggacaagctggaggtaagggagggagccgagattcggtgccctgataaggacccttccgatacagtgcccacatctgttcatcgtctgaagccagccgatattaacgtgataggcgcgttgggagacagcctgaccgccggaaacggtgcagggagtaccccaggaaatgtgcttgatgtgttaacacagtatcggggcctgagctggagcgtaggcggagatgagaacatcggaaccgtgacaaccctggcaaatatcctgagggaattcaatccctccctgaagggattctccgtggggacaggaaaagaaacatcaccgaatgccttcctaaatcaagcagtggctggagggagagccgaggatctccctgtgcaggctagaagactcgtcgacctgatgaagaatgatacacggatccatttccaagaggattggaagatcattactctgtttatagggggaaatgacctgtgtgacttctgtaacgaccttgtgcactatagtccccagaacttcacagataatatagggaaagcgctcgacattcttcacgccgaggtgccgcgggctttcgtcaacttggttaccgttctcgaaattgtcaaccttagagaactgtaccaggagaagaaggtctattgtccaagaatgatcctgcgcagcctgtgtccttgcgtgctgaaattcgatgacaactctactgaactggctacgttgatcgagttcaataagaaatttcaggagaaaacacaccagctcatcgaaagtggccggtatgacaccagagaggactttaccgtggtcgtgcagccgttttttgaaaatgtcgatatgcctaagacgagcgaaggactgcctgataattcttttttcgccccagattgttttcatttctcttccaagtcacactcccgggctgcttctgccctgtggaataacatgctggagccggtgggccagaaaactacacgccacaagttcgagaacaaaattaacataacctgccctaatcaggtgcaaccctttctgagaacgtataagaactccatgcaggggcacggaacatggctcccttgtagggacagggctcctagcgctctgcacccaacttccgtgcacgccctgcggccagccgatatccaagtcgttgctgctttgggtgactccctgacggctggaaacggtatcggaagcaagcccgacgacttacccgatgtaaccactcagtaccgcgggctttcctatagtgcagggggagatgggtccctcgagaacgtaactacactccccaacattcttcgggagttcaatcgtaaccttaccggttatgccgtggggaccggagatgcgaacgacaccaatgcatttctgaatcaggctgtgcccggtgctaaggctgaggacctcatgtctcaggtacagaccctgatgcagaaaatgaaggacgaccaccgagttaacttccatgaggattggaaggtaataaccgttctgattgggggttctgacctgtgcgattactgtacagactccaacttgtactcggccgctaattttgtacaccatctgcgcaatgccctggatgttctgcatagagaggtgccgcgtgtgttggtgaatctggtggacttcctgaaccctaccatcatgagacaggtctttctcgggaaccccgataagtgtcctgtgcaacaagcttccgtgctctgcaactgcgttcttactttgagggaaaatagccaggaactggcccgactcgaggccttttcccgagcctacaggagttccatgcgcgaactggttggttccggaagatacgatacccaagaggacttctctgtggtcctacaacctttctttcagaacatacagctcccagtgctggctgacggactgcctgacacttcatttttcgcgccagactgcatacacccaaaccagaagtttcattctcagctggctcgcgccctgtggaccaatatgctcgagcccttagggagtaagacggagacgcttgatctcagggctgagatgcccatcacctgcccaacccaaaatgagcctttcctgagaaccccacgtaacagcaactatacgtaccccattaagcccgcaatagagaactgggggtcggactttctatgtacagaatggaaagcatcaaactccgtccctaccagcgtgcatcagcttcggcctgccgatatcaaggtggtggcggcgctcggcgatagcctgaccaccgccgtcggcgcaaggcccaacaacagttccgacctcccgacgtcgtggcgtggcttgagctggagcattgggggagatggtaatttagaaactcacactactctgccaaacatactgaaaaagtttaacccctacttgctgggtttttccacatcgacttgggaaggcacagcggggttaaacgttgctgctgagggcgcaagagccagagatatgccagcccaggcgtgggatctggtggagaggatgaaaaacagtcctgacattaacctcgagaaagactggaagctggtgaccctgttcatcggagtcaacgacttatgtcactactgtgagaacccagaagcccatctggcaaccgagtatgtgcaacatatccaacaggcactggacatccttagtgaggagctgcccagagctttcgtaaatgtggttgaagtcatggaactagcttcattgtatcagggtcagggcggcaaatgtgccatgctggctgcccagaacaattgtacgtgtcttagacattcacaatcctcactcgagaagcaggaactgaagaaggtgaattggaacctgcagcacggaatctcctctttcagttactggcaccagtatacacagagggaggactttgccgtggtggtgcagccattcttccagaataccctaacgcctctgaacgaacggggagatactgacttgaccttttttagtgaggattgcttccacttctcggaccgcgggcatgccgaaatggcaattgccctgtggaataatatgctcgaaccagtcggacgcaaaaccactagcaataatttcacgcactcacgagccaaactgaagtgtccgtcacctgagtccccttacctctacaccctgcgaaatagtcgcctgctgccggaccaggccgaggaggccccggaagtcctgtactgggcagtgccagtcgcagccggagtggggttggttgtgggaatcattggtactgttgtgtggcgatgtcgccgtggcggtaggcgagaagatccgcctatgtcgctgagaaccgtggccctctag

SEQ ID NO: 128687 - DNA, 1467 bp, Artificial Sequence
  Description of Artificial Sequence: Synthetic coding sequence
atggagcccgccggtgaaaaggacgagccgttgtcggtcaaacacggtcggcccatgaaatgcccctcccaagaatccccgtatctgtttagctaccgaaactccaactacctgacccgactgcaaaagccgcaggacaagctggaagtccgcgagggggctgagatccgctgccctgacaaggatcctagcgataccgtgccgactagcgtccaccgactgaagcctgcagatataaacgtcataggcgccctcggagatagcctgaccgcaggtaacggagccggaagcacccctggcaatgtgctggacgtgctgacacagtaccggggactctcctggtcagtggggggcgacgagaatatcggcacagttactaccctggcgaatatcctaagggaatttaacccttcgctgaagggcttttcagtgggaaccggaaaggagacttcccctaacgcttttttgaatcaagccgtcgccggtggccgagcagaggatctcccagtgcaggctcgccggctggtagatctaatgaagaacgatactagaattcatttccaggaggattggaagattatcacccttttcatcgggggaaatgacttatgcgacttctgcaatgacctggttcattactccccccagaattttactgataacatcggcaaagcgctggatatcctgcacgccgaggtgccacgggccttcgttaacctggtgacggttctggagatcgtcaacttgcgtgaattgtatcaggagaagaaggtatattgcccaagaatgatcctgcgatctctgtgcccctgcgttcttaaatttgacgacaactcgacggaactggcgaccctcattgagttcaacaaaaagtttcaggaaaaaacacatcagctgatcgaatcaggtaggtacgacacaagggaagacttcaccgttgtggtgcagccctttttcgaaaatgtggacatgccaaaaactagtgaaggcctgcccgacaactccttcttcgcacccgactgcttccacttcagctcgaagtcccactcgagggccgccagtgccctttggaataacatgctggaacccgtcggtcagaaaaccacgcgccataagtttgagaacaaaattaacatcacctgcccaaatcaagtacaaccatttctccgaacatataaaaattctatgcagggccacggaacatggctgccttgccgagatagagcaccgagcgcccttcatccaaccagtgtgcatgcgttacggccagcagacatacaggtcgtggcagcgctgggagactcactgaccgctgggaacggtattggatctaagccggatgacctgcccgacgtgacgacacagtataggggcctgtcctaccgagagtctaagcccgggttcctgagcgatagttgggtgtccaaatctaatcgaaaatgtacgcgcaaagcaccgaacccgtag

SEQ ID NO: 128688 - DNA, 4344 bp, Artificial Sequence
  Description of Artificial Sequence: Synthetic coding sequence
atgggactacgacctggaatattcctgcttgagctgttgctccttttgggacagggcaccccgcagattcacacttccccaaggaagtccactctcgagggacagctttggcccgagactcttaaaaattctccttttccgtgcaatcctaataagctgggagtgaacatgccctccaaatcggtacactctctcaaacctagcgatatcaagtttgtggccgctatcggcaatctcgaaattccaccagaccctggaacaggcgacctggagaagcaggactggaccgaaaggccccagcaggtctgtatgggagtgatgactgtgttgtcagacattattcgctatttctcaccctcggtgcccatgcccgtttgccatactggcaaacgggtgattccacatgatggggccgaggatctgtggatacaggctcaggagctcgtgcgcaacatgaaagagaatcttcagctcgacttccagtttgactggaaacttattaatgtgttctttagcaacgcgagtcagtgttacctttgcccctctgcccagcaggccccatcactgtccactgtactgctgtcccagaacgggctggcagccggaggcgtggacgagcttatgggcgtcctggattatcttcagcaggaggttccccgggcttttgtaaacctggtggacctctccgaagttgcggaagtgagtcgtcagtaccacggaacctggctttcccctgcgccagagccgtgcaactgcagtgaggaaactactaggctcgcaaaggttgtgatgcagtggtcctatcaggaagcttggaacagtttgctggcttcctctcggtacagcgaacaagagtcatttacggtggtgttccaaccatttttttacgagaccacccctagtctccatagtgaggatccacggctccaggatagcaccacactcgcttggcacctgtggaatcgcatgatggagccagcaggcgagaaagatgaacctctttctgtcaaacatggaaggccaatgaagtgtccttctcaggagtctccttacctgttctcatatagaaattcaaactatctcaccaggctgcaaaaaccgcaggataaactggaggtccgcgaaggcgctgagatccgctgtccagacaaggacccatctgacaccgttcctacgtccgtccacagactcaaacctgccgacatcaatgtaataggtgccctcggcgattctttgacagctgggaatggagccggaagcacccctgggaacgtcctcgatgtgttgacgcagtatcgtggcttgtcctggtcagtcggtggtgatgagaatatcggcaccgtcaccaccttagccaatatcctgagggagttcaaccctagtctcaagggcttttccgtgggaactgggaaggagacgtccccaaacgccttcctaaatcaggccgtcgccgggggccgtgctgaagatctgccagtccaagccaggcgcctggtggatttgatgaagaatgatactcgcattcacttccaggaggattggaaaattatcacgctgtttataggaggcaacgatttgtgtgacttttgtaatgacttggtcccacgcgccttcgttaacctcgtcaccgtgctggaaattgtcaatctcagagagctgtaccaagaaaagaaggtgtactgtccccggatgatactgagaagtctctgcccatgcgtcctgaaattcgacgataattccacggaacttgcaactctaatcgagtttaataagaagtttcaggagaagactcatcagctgatcgaatccggccgctacgacacacgggaggacttcactgtggtagtgcagcccttttttgaaaacgtggatatgcctaagacttctgagggactccctgataattcgtttttcgcgcctgactgcttccacttttcttctaagtctcatagccgagcggcttccgccctgtggaataatatgctcgaaccggtcggacagaagacaacaaggcacaagtttgagaataagatcaacatcacctgccccaaccaggtgcagccctttctgcggacttacaagaattcaatgcagggccacgggacatggttgccctgccgagaccgcgcccccagtgctctgcaccctacgagtgttcatgcactccgaccagctgacatccaggttgtggctgcactgggcgattccctgacagctggtaacggtatcgggtcgaaaccagacgatctacctgacgtcacaacccagtacaggggcctgtcatacagtgctggaggggacgggagcctggaaaatgtaactacacttcctaacatcttaagggaattcaatagaaatctgaccggctacgccgtgggcaccggggatgctaatgacactaatgccttcttgaatcaggcagtacctggagcaaaggcagaggacctgatgtcccaggtgcagactctgatgcagaagatgaaggatgatcacagggttaactttcacgaggactggaaggttatcacggttctgattggcgggtccgatttatgcgattactgtacggatagtaatctctattctgccgccaactttgtccaccatctccgcaacgcgctggatgtcctgcaccgggaagtcccgcgggttctcgtgaaccttgtggactttctcaacccaacaattatgaggcaggtcttcttagggaatcccgacaagtgccctgtccagcaggcctctgtcctctgtaactgcgttctgacattaagggaaaattctcaggagctggcgcgacttgaggcattctccagggcctacagaagttccatgcgggagctcgtaggtagcggtagatacgacacacaggaagactttagcgtcgtcctgcagcccttcttccagaacatccaattaccggtgctcgccgatgggctacccgacacaagcttctttgcgccagactgcattcaccctaatcagaagtttcactctcagcttgcgagagccctctggacaaacatgttggaacccctggggagtaaaacagagaccttggatctgagagccgaaatgcctataacatgccccacacaaaacgagcctttcttgaggactccccgcaattcaaactacacctaccccattaagcctgccattgaaaactgggggagtgattttctttgtactgagtggaaggcctctaattcagtaccgacttccgtccatcaattgaggcccgccgatataaaggtagtggccgctctaggggactcactcactacagccgtaggcgcccggccaaacaactcctctgatctccctaccagttggaggggactgagctggtcaatcggaggcgatggcaacttggaaacccacaccacgctgccaaatatcttgaagaaattcaacccgtacctgctgggattcagcacaagcacatgggaagggactgctggtctgaatgtggcagcggagggagctagagcccgcgatatgccagcccaggcctgggatttagtggaaagaatgaaaaactctccagatataaacctcgagaaggactggaagcttgtcactctgttcatcggcgtgaatgatttatgccattattgcgagaatccagaggcgcacctggcaacagaatacgtccagcatatccaacaggcccttgacattctgtccgaggaacttcccagggcttttgtcaatgttgtggaggtgatggaattagcatcactgtatcaggggcagggggggaagtgtgctatgctggctgcgcaaaataattgtacctgtctgaggcattcccagtcttctctggagaagcaggagctaaaaaaagttaactggaatctacagcacggaatcagttcctttagctactggcaccagtatacacaacgggaggattttgccgtcgttgtgcagccatttttccaaaacaccctcacgccacttaacgagcggggcgatacagaccttacatttttttccgaggactgtttccacttctcagatcgaggacatgccgagatggcaatcgccctgtggaataatatgctggagcccgtgggtaggaaaaccacaagtaataacttcacacactctcgcgccaaactcaaatgcccatccccagagagcccgtatctgtatacactgcgcaatagtcgcctcttgcccgatcaggccgaagaagccccggaggtgttgtattgggccgtgccagtcgcggcaggcgtgggtctcgtggttggtataattggaactgtggtttggaggtgtaggagggggggccgacgcgaggacccaccgatgtccctccggacagtggccttatag

SEQ ID NO: 128689 - DNA, 1272 bp, Artificial Sequence
  Description of Artificial Sequence: Synthetic coding sequence
atgcccataacttgcccaacccagaacgaacccttcttgcgaactccccggaatagcaactatacatatcccatcaagcccgccatcgaaaactgggggtcagactttctctgcactgaatggaaggcttccaacagtgtcccaacttccgtgcaccagctcagacccgcagatattaaggtagtagcagccctgggcgactcattaactacagccgtgggcgccagacctaacaattccagcgacttaccaactagttggaggggactgagctggtcaattggcggtgatggaaaccttgaaacccatacaacactgcctaacattctcaaaaagttcaacccgtacttgctgggcttctctacgtccacgtgggaaggtacagccggtctgaatgtagctgccgaaggggcacgggcacgcgatatgcctgcccaggcttgggatttggttgaacggatgaagaacagtcccgacatcaacctggaaaaggattggaagctggtgaccctttttatcggcgtgaatgatctctgtcactattgcgagaaccccgaagcccacctggctactgagtacgtgcagcacatccagcaggcacttgacatccttagtgaagaattgccccgagcatttgttaacgtggtagaggtcatggaactcgcctcgttatatcaaggccagggcgggaagtgcgccatgttagcagcacaaaacaactgcacatgtctacgacacagccagagcagtctagagaagcaagagttgaagaaggtgaactggaacctgcagcatgggatctcaagcttctcctactggcaccaatacacccaacgggaggatttcgccgttgtggtgcagcctttttttcagaacacactcaccccccttaatgagaggggcgacaccgatttaactttcttctcagaggattgctttcacttttccgatcggggccacgctgagatggctatcgcactctggaacaatatgctggagccagtgggacggaagactacgagtaacaattttactcatagtcgggcaaaacttaagtgtcctagccccgaatcaccatacctttacacactcagaaattccaggcttctccccgatcaggcagaagaggccccagaggtcttgtactgggccgtgccggtggccgccggagtcggacttgtagtcggaattattggcaccgtcgtctggaggtgtaggcgcgggggccgaagagaagacccaccgatgagcctcagaacggtcgctttgtag

SEQ ID NO: 128690 - DNA, 3504 bp, Artificial Sequence
  Description of Artificial Sequence: Synthetic coding sequence
atggccggcgcccagcctggcgtgcacgccctccaactcgagccccctacggttgttgaaactcttaggcgcggtagtaaatttatcaaatgggacgaagagaaattaatgacagtggttagcggtcctgaccctgtaaacacagtctttctcaactttatggctgttcaggacgacactgcaaaggtctggtctgaggaactctttaagcttgccatgaatatcttagcacagaacgcatcaagaaatacttttctacgtaaggcttatacgaagctgaagctgcaggtgaaccaggacggtaggatccccgtgaaaaatatcttgaaaatgttttctgccgacaaaaaacgcgtagaaaccgctctcgaatcttgtggactgaaatttaacagaagtgagtccattaggcctgacgaattctctctggagattttcgaaagatttctcaacaaactgtgcttgcggcccgatatcgacaaaatactcctggaaatcggagccaaaggaaagccatatcttacattagagcagctgatggactttatcaaccagaaacagcgtgatccccgcttaaatgaggtcctgtacccacctttgaggccctcgcaggcaaggctccttatcgagaaatacgagcccaaccagcagttcctggagagagaccagatgtccatggagggattctccagatatctgggtggggaggagaacggcatcctgccattagaagccctcgatctgtccactgatatgactcagccactttccgcttacttcatcaattcgagccacaatacctacttaacagccggccaactggcgggcacctcttcggtggagatgtaccggcaggctctgctatggggctgccgctgcgttgaactcgacgtatggaaagggcgaccccctgaagaggaaccgtttattacccacgggtttaccatgacgaccgaggtacccttacgagacgtactcgaggctatcgcagaaaccgcctttaagaccagcccctaccctgtgatacttagtttcgaaaaccacgtcgactctgcgaaacaacaggctaagatggctgaatattgcagatccattttcggagacgccctcttgatcgaacccctagataagtatcctctggcccccggagtgccactgccgagtccgcaagacctgatgggtagaatccttgtgaagaacaagaagagacatagaccctccgctggcggtccagacagcgccggacgcaagaggcctcttgagcaatcgaactccgcactgtcagagtcatcagcagctacggagccctcctctccccagctcggcagcccatccagcgactcttgtccgggactatcgaatggtgaagaagtgggattggagaagcctagcttggaaccacagaaatctcttggagatgaagggcttaacagaggcccatatgttctgggacctgcagatcgggaggatgaagaagaggacgaggaggaggaggagcagacggaccctaaaaaacccacaacggatgaaggcactgctagtagtgaggtgaacgccaccgaagagatgagtaccctggtgaactacattgagcccgtgaaattcaaatccttcgaggcagcccgcaagaggaataagtgttttgaaatgtcttccttcgtggaaacaaaagcaatggagcaactgacaaagtctcccatggagtttgtggagtataacaagcaacaacttagtcggatttacccaaaaggcactagggtcgactcctcgaattacatgccacagctcttctggaatgtgggatgtcagttagtggctctaaacttccaaacactggatgtggctatgcagttgaacgccggcgtttttgagtataacggccgttctggatatttactgaagcctgagttcatgcggcggcccgataaaagtttcgaccctttcaccgaagtcatcgtcgacggaattgtcgccaatgccttgcgggtgaaagtgatatccggccagtttctgtcggaccgcaaagtggggatttatgtcgaggtggacatgtttggactgcccgtggacaccaggcggaagtatagaacccgcacctcacagggaaacagcttcaacccagtatgggatgaagagcccttcgactttccaaaggttgtacttccaacactggcgtcactccggatcgcggcctttgaggagggcggcaaatttgtcggtcaccgaatactcccagtaagtgctatcagatcaggttatcactatgtatgtctacgtaacgaggccaaccagccactttgcctccccgcacttctcatctacacagaggcctccgattacataccagacgatcaccaggactatgcggaggccctcatcaacccgattaaacacgtgtcgctaatggaccagagggccaggcaattggctgcgctgattggggagtccgaggcccaagcagggcaggagacgtgccaagatacccagagtcagcagctcgggtcccagccatcaagtaacccgacgcctagcccactagatgcctcccctagaagacccccaggacctaccaccagtccagcttctacttctctgtcctcaccagggcagagagacgacttgattgcgagcatcctgtcagaggtggcccccacaccactggacgaattgcgcggccataaagctctggtgaaactcaggtcacgccaggagcgggatctgcgcgaactgaggaagaagcaccagcgtaaagccgtgactctgaccaggcgtctcctggacggactcgcgcaggcgcaagcagaagggcgatgccggctaagaccaggcgccctgggaggcgcagccgatgtggaagacaccaaggaaggtgaggatgaagctaaacgctatcaagagtttcagaataggcaggtgcaatcccttcttgagttgcgtgaagctcaggtcgatgctgaggcccagcgaaggctggaacatttgagacaggcgttgcagagactgcgagaggttgtcctggacgcgaataccacccagttcaaacggttgaaagaaatgaacgagagagagaagaaggagctgcagaagatcttggatcgcaaacgccacaacagtataagtgaggcaaagatgagagataaacacaaaaaagaggccgaacttaccgagatcaatcggcgacacatcaccgaatccgtcaatagcatccgacgactagaggaagcccagaaacaaaggcatgatcgcctggtggctggccagcagcaggtcctgcagcaactggctgaagaagagccgaagctgttggcccaactcgcgcaggagtgtcaggagcagagagctcggttaccccaggaaatccgtcgttcattgctcggcgaaatgcctgaaggcctgggcgatggccctcttgtcgcctgcgcaagcaacgggcacgcccccggatctagtggtcacctatccggtgctgactccgaatctcaggaagagaacactcaactgtag

SEQ ID NO: 128691 - DNA, 3651 bp, Artificial Sequence
  Description of Artificial Sequence: Synthetic coding sequence
atggctggcgcacaacctggcgttcatgccctgcagctgaagcctgtgtgcgtgtccgatagtttgaaaaaagggacaaaattcgtgaaatgggacgatgactccacaattgtaacccccatcatcttaaggacagatccacagggcttcttcttctattggactgatcaaaataaagaaacagaactgctggacctatcactagtcaaggacgcccggtgcggcaggcacgccaaggccccaaaggatcccaagctacgagagttactggatgttggcaacattggccgactggagcagcgcatgatcaccgtcgtgtatgggcccgatctcgtaaatatatcacacctgaacttggttgccttccaagaagaggttgccaaggagtggaccaacgaggtcttttcactggctaccaacctcctggcccagaacatgagcagggatgctttcttggagaaagcctacactaaactgaagttgcaggtgactccagaaggcagaattcctctgaagaacatctaccgcctgtttagcgccgatcgcaagagggtggaaacagcacttgaagcatgcagtctcccaagctccaggaatgattccattcctcaggaggacttcaccccagaagtgtatcgggtcttccttaacaatctgtgtccccgccccgagattgataatattttctcggagttcggcgccaagagtaaaccctacctgaccgtcgatcagatgatggactttatcaacctgaaacagcgcgatccaagattgaacgagatcctctatcctccactgaagcaagagcaagtgcaggtgttgatcgaaaagtacgaacctaacaattctctggctagaaagggccagatctccgttgacggcttcatgaggtacctctccggcgaggagaacggcgttgtctctccagaaaaactggatctaaacgaggacatgtctcagccccttagccactacttcatcaactccagccataatacctatttgaccgccggtcagctggctggtaattcgagcgtggagatgtataggcaggtgttgctcagcggatgtcgatgtgtcgagctggattgttggaagggcagaacagctgaagaagaaccggtgataacccacggtttcaccatgaccacggagatcagtttcaaggaagtcattgaagcaattgctgaatgtgctttcaagacatccccatttcccatcctgctgagcttcgaaaaccacgtggactcccctaagcagcaagcaaagatggcagaatactgtcgtttgatcttcggtgatgctctcctgatggagcctctggagaagtaccccctcgaatctggggtgccgttgccttctcctatggatttaatgtataagattctggtgaagaacaagaagaagtcacataagtcttccgaaggctcaggtaagaaaaaactgagtgaacaagcttctaatacctattcagactcttcctctatgttcgaacccagttcaccaggcgccggggaagccgataccgagagtgatgatgatgatgacgacgatgactgtaagaagagcagcatggacgagggcacagctggaagcgaggccatggccactgaagaaatgagcaaccttgtcaactacatacaacccgtaaaattcgagtcctttgagatttctaaaaagcgtaacaagagttttgagatgagctcatttgtcgagacaaaaggcctggaacagcttaccaagagtcctgtcgaatttgtcgagtataacaaaatgcaactctctagaatatacccaaaaggcacacgagttgactcctcaaactatatgcctcagctgttctggaacgctgggtgccagatggtagccctgaatttccagaccatggacttggctatgcaaattaatatgggcatgtatgaatacaacggaaaatcaggttaccgcctcaaacccgagttcatgcggaggcctgataaacacttcgatccttttacggagggaattgtggacggaatcgtggctaatacactgtcagtgaagataataagcggacagttcttaagtgataagaaggtaggtacatacgtagaggtcgacatgttcggattgcctgtggacacgcgtcgtaaggccttcaaaacaaaaacgagtcagggcaacgcagtcaatccggtgtgggaagaggaacctatcgttttcaaaaaagtcgttctgcccaccctggcatgccttcgcatcgctgtgtacgaagagggtgggaagttcatcgggcatcgaattctgccagtgcaagccattagaccaggataccattacatctgcctgagaaacgagagaaaccagccactgacactccccgccgttttcgtctatatcgaggtaaaggactacgttccggacacatacgcagacgtgattgaagcattatccaatcccatacgctacgtaaatctgatggaacagagagccaaacaactggcagctcttaccctggaagatgaggaggaggttaaaaaggaggcagaccccggagagacaccatctgaagcacccagcgaggcgcggactacaccggccgaaaacggggtgaaccacacaacaactcttacgcccaagccaccgtcgcaggccctgcatagtcagccagcgccaggatctgtgaaggcccctgcgaagaccgaggatcttatccagagcgtccttacggaggtagaagcacagacgattgaagaattaaagcaacagaaaagcttcgtaaagttgcagaaaaagcattacaaggagatgaaggatcttgtgaagcgtcaccacaaaaagactacagatttgattaaagaacatactactaagtacaatgagatccaaaacgactacctgcgacgcagggctgctctggaaaaaagcgcaaagaaagattctaagaagaaatcagaaccctcctcaccagatcacggctcttccacaatcgaacaggaccttgccgctctggatgccgagatgacccagaagcttattgatttgaaagataagcagcagcagcaactcctgaatcttcggcaagagcaatactattctgaaaagtaccaaaaaagagaacacattaaactgctcatacagaagcttacagatgtggcagaggaatgccagaacaaccaattgaagaagctgaaagagatttgcgagaaggaaaaaaaagagctgaaaaaaaagatggacaagaagcgccaggaaaagatcaccgaagcgaagtccaaagacaaaagtcagatggaagaggaaaaaaccgagatgatccgcagttatattcaagaagttgtccagtatataaagagacttgaagaagcccagtcaaaacgacaggagaagctggtggagaaacacaaagaaatccggcagcagatattggacgaaaagccaaagctgcaggtggagcttgagcaggagtatcaagataagttcaaacgactccccctcgaaatcctggaattcgtgcaagaggccatgaaggggaaaatcagcgaggacagcaatcacggatctgctccactgagtctctcgtcggaccccggaaaagtgaaccataagacacctagctccgaagagctggggggcgacatccctggaaaggaattcgacaccccactgtag

SEQ ID NO: 128692 - DNA, 672 bp, Artificial Sequence
  Description of Artificial Sequence: Synthetic coding sequence
atgcgacgcccagataagcactttgacccttttacagagggaattgtagatggtatagtagcaaacacattatcagttaagataattagcggccagttcttgagcgacaaaaaagtggggacctatgtagaggttgatatgttcgggctccctgttgatacaaggcggaaggcattcaagacaaagacctctcagggcaatgctgttaaccctgtgtgggaagaggaacctattgtcttcaaaaaggtggtactgccaaccttggcatgcttgagaatcgctgtttacgaggaaggaggtaagtttattggacatagaatccttcctgtgcaggccataagaccaggataccattatatctgtcttagaaacgaacgcaaccagcccctgacattgcctgccgtgtttgtgtatatcgaagtgaaagactatgtccctgatacctacgccgacgtaatagaagccctctctaatcccattcggtacgtcaacctcatggaacagagagccaagcaactagcggccttaactttggaagatgaggaggaggtcaagaaggagggcggcttcctgcatgacgagattatgaggctaacacggaatactctggagaaacttatggctttgcccctcactcacgtcgtgccgatacagtcaaagatgctgtcatag

SEQ ID NO: 128693 - DNA, 3522 bp, Artificial Sequence
  Description of Artificial Sequence: Synthetic coding sequence
atggctggcgcacagcccggggtccacgcgttacagctcaagccagtgtgcgtgtccgacagtctaaagaagggcaccaaatttgtgaaatgggacgatgatagcacaatcgtgacccccatcatccttcgtaccgatccacaagggtttttcttttactggactgatcagaataaggagacagaactgctggatctctctctggtgaaggacgcccgctgcggaagacatgctaaggctcctaaggacccaaaattacgggaactactcgacgtgggaaatatcggccgtctggaacagaggatgattacagtggtctacggccccgatctagtaaatataagtcacctgaaccttgttgcctttcaagaggaagtggccaaggaatggacgaatgaggtgttcagcctggcgactaatctgctggcgcagaatatgtcgcgggatgcttttctggaaaaggcttacactaaactgaagctacaggttactcctgagggtaggattcctctgaaaaatatctatcgcctgttttcagctgaccgcaagcgagtggaaaccgcactggaggcttgctcactcccgtccagtcgaaacgatagcattccccaggaagatttcactccagaggtttaccgagtgttccttaataacctgtgcccccggccagaaattgataacatttttagcgaattcggcgctaagtccaagccatacttaactgtggaccaaatgatggacttcataaatcttaaacagcgcgaccccagattgaatgagatcctttatccacctcttaagcaggagcaggtgcaagtgctgattgagaaatacgagcccaataattctctggctcgtaaaggccaaatcagtgtcgatggatttatgaggtacctgagcggagaggagaatggagtggtttcaccggaaaagctggacctaaacgaggacatgagccagcctctttcacactactttattaactcttcgcacaacacctacctgaccgctggccaattggccggaaactcttctgtggaaatgtaccgacaggtactcctgtctgggtgcagatgcgtggaacttgattgttggaaagggcgaaccgccgaggaggagccggtgattactcatggctttactatgacaacagagattagtttcaaagaagtgattgaagccatcgccgaatgcgcctttaagacaagccctttcccaattctcttatcctttgagaaccacgttgattcaccaaaacagcaggcgaagatggctgagtattgtcggttaattttcggggacgccctgctaatggaacctctggaaaagtaccccctggagagtggggtccccctgcccagcccaatggacctcatgtacaagatactggttaaaaacaagaagaaatcccacaagagcagcgagggctcaggtaagaagaagctaagcgagcaagcctctaatacttatagcgactcgtcttctatgtttgaacccagctctcctggtgctggggaggctgacactgagtccgacgacgacgacgatgatgacgactgtaaaaaatcatcaatggacgagggcacagctggctctgaggccatggccactgaagagatgtccaacctggtgaactatattcagccagtgaaattcgagtcttttgaaatttcaaagaagcgcaataagagcttcgagatgtcatcatttgtggagaccaaaggattggagcaactgacaaagagcccagtggagttcgtcgagtacaacaagatgcagctgagtcgcatttacccgaagggtactcgagttgatagctccaattacatgcctcagttgttttggaatgcgggatgtcagatggtggccctgaactttcagactatggatctggcgatgcaaatcaacatgggtatgtacgagtacaacggcaaaagtggttataggctcaagcctgagttcatgaggcggcccgataaacattttgaccctttcacggaaggcatcgtggacggaatcgttgccaacaccctgtccgtgaaaattatatctggccagtttttgtctgacaagaaagtgggcacttatgttgaagtagacatgttcgggttgccagtggacaccagacggaaggcttttaaaacgaaaacctcccaggggaatgctgtgaaccccgtgtgggaggaggaacctattgttttcaagaaagtggttcttcccactctggcttgccttagaatcgccgtttacgaagagggtggcaagttcatcggtcaccgaatactgccggtgcaagccatcagacctggataccactacatttgcttgaggaatgagcggaaccagccacttaccctgccggcagtctttgtttacatcgaagtgaaagactatgttcccgacacatacgctgacgttattgaggcgttgtccaatccaatccggtatgtcaacctaatggaacagagggcaaaacaactcgcagccctgacccttgaagatgaggaagaggtcaaaaaggaagctgatcctggagaaacaccttctgaggccccgtctgaggcacggactacacccgccgagaatggcgttaaccatacgaccaccctgacaccaaagcccccgtcccaggcgcttcacagtcaaccggccccaggtagcgttaaggccccagcaaagacagaagaccttatccagtccgtcttgactgaggtcgaggcccagaccattgaagaactcaaacagcaaaagagtttcgtcaaacttcagaagaagcattataaggagatgaaggatttggtaaagcgccaccacaagaagacaaccgaccttatcaaggaacacacaacaaagtataacgagatacagaatgattacctcagaagacgggcagcactggaaaagagcgctaaaaaagatagcaagaagaagagcgaaccttcctctcccgatcatggctcctccactatagagcaggacttggccgcgctggacgccgaaatgactcagaagctgattgacctgaaagataagcagcagcagcagctactgaacctgcgccaagagcagtactactcagagaaatatcaaaagcgagaacacatcaagctcttgatccaaaaacttactgacgtcgccgaagaatgtcagaacaaccaactgaagaaactcaaagaaatctgcgaaaaggaaaaaaaggagctaaagaagaagatggataagaaaaggcaagagaagattaccgaagccaaaagtaaggacaagagccagatggaagaggagaagacagaaatgatccggtcatacattcaagaggtggttcagtacattaagcgactcgaagaagcccagtccaaacggcaagaaaaattagtcgagaaacacaaagagatacggcagcaaattctggacgagaaaccaaaaggtgagggatcttccagctttctgagtgagacctgccacgaagacccttcagtgagccccaacttcacaccaccgaatccacaggcattgaaatggtag

SEQ ID NO: 128694 - DNA, 3522 bp, Artificial Sequence
  Description of Artificial Sequence: Synthetic coding sequence
atggccggggcgcagccaggagtccatgccctccagctgaagcctgtgtgcgtatccgatagcttgaaaaaagggacgaagtttgttaagtgggacgatgactctaccatagtaacacctataattctccggacagacccccagggtttcttcttttattggactgaccagaacaaagagactgaacttctcgacctgtcactcgtgaaagacgcgcgttgtgggaggcacgctaaagcccctaaggacccaaagctgcgggagctgctggacgtgggcaacattgggagactggagcaaagaatgattactgtggtgtacggcccagacctagtcaacattagccacctcaatctcgtcgcgttccaggaagaggtcgccaaggagtggaccaacgaagtattctctctggccacgaatcttctggcccagaatatgagtagggatgccttcctggagaaggcctataccaaactcaagttacaggtgacaccggaggggcgcatccctctgaaaaacatatatcgccttttttcggccgaccgcaagagagtcgaaaccgcccttgaagcttgcagcctgcccagcagccgcaatgatagcattccccaggaagatttcactcccgaggtgtatagggtttttctgaacaatctttgcccccgcccagaaatagacaatatcttttccgaatttggagccaagagcaagccgtacctaaccgttgaccagatgatggactttattaatctcaagcagcgggatccccgcctgaacgagatcctctatccccccctgaaacaggagcaagttcaggtgttgatcgagaaatacgagccgaataactcccttgccagaaaaggccaaatatccgttgatgggttcatgaggtatctttcaggggaggaaaatggagtcgtctcccctgagaaacttgatctgaacgaggacatgagccaaccgctgtcccactattttattaacagctcacataacacatacctgactgccgggcagctggcaggcaacagctcagttgaaatgtaccggcaggtgctcctgtcggggtgtagatgcgtggagctcgattgttggaaagggcgtaccgccgaagaggagcctgttattacgcatggcttcacaatgacaactgaaatttcatttaaggaagtgattgaggccatcgcggagtgcgcctttaagaccagcccattcccaatacttctgtcattcgagaaccacgtggactcacccaagcagcaggccaaaatggcagagtattgtagactgattttcggcgacgcccttttaatggagccactggagaaatatcctctggagtctggcgtgccacttccctcccccatggatttaatgtataagatcctggttaagaacaagaagaagtcacataagtcatccgaaggcagtgggaagaagaaactatcagagcaggcttcaaacacttatagtgattcttctagtatgtttgaaccctctagccctggagccggagaggccgacacagagagcgatgatgacgacgacgacgatgactgtaaaaagagctctatggacgagggcaccgcaggatcagaagctatggctacagaagagatgagcaatctggtgaattacatccagcccgtaaagtttgagagcttcgagatcagtaaaaagagaaataaaagtttcgaaatgagtagctttgttgagacgaagggcctggagcagctgacgaaatcccctgtcgagttcgtcgagtacaataagatgcagctgtctcggatctatcctaaggggacccgagtcgactctagtaattatatgccacagctcttctggaacgcaggttgtcaaatggttgccctcaacttccagactatggatctggccatgcaaataaacatggggatgtatgaatacaacggcaagtccggatataggttgaagcctgagttcatgaggcgacctgataagcactttgatccttttacagagggaatagtggacggcatcgtcgccaacacgctttccgtgaagattatatctgggcagttcctatccgataaaaaagtgggcacttatgttgaggttgacatgtttgggttgccggtggacacgcggcgcaaagcctttaaaacaaaaacctcccaaggcaacgccgtgaatccagtatgggaggaagaaccgatcgtgtttaaaaaagtcgttttgccgactctggcttgtctgcgcatcgctgtgtatgaggagggcggtaaattcattgggcacagaatcctgcctgtgcaagccatccgccctggctaccattatatctgtctgcggaatgagcgcaaccagccgctgaccttgcccgccgttttcgtgtatattgaggtgaaagattatgttccggacacctatgctgatgtcattgaggccctgagcaaccccatccgctatgtgaatttgatggagcaacgagccaaacagcttgcagccctgacactggaggatgaagaggaagttaaaaaagaggcggaccctggcgaaacgcctagcgaggcacctagcgaggcccgcaccacccctgctgaaaacggggtgaatcataccacaacattgaccccaaagcctccctcacaagcgctgcatagccagcccgccccaggttccgtaaaagcaccagcaaagactgaggatctaatccagagcgtgctgactgaagtggaagcccagaccatagaggaattaaagcagcagaaatccttcgtgaaacttcaaaaaaaacactataaggaaatgaaggaccttgtgaaacgacaccataagaagacaacggacctgatcaaagagcacaccactaaatataacgagattcagaatgactatctcaggaggagggcagcacttgaaaagtccgcaaaaaaggactctaaaaagaagtctgagccttcctctcctgaccatggtagttctacgattgagcaggatctggcagctcttgacgctgaaatgacgcagaaactgatcgaccttaaggataagcaacagcagcaattgctgaatctccggcaggagcagtactacagtgagaaataccagaaacgggagcatatcaagctgctgattcagaagctcacagacgttgccgaagagtgccagaataaccagcttaagaagctgaaggaaatatgcgaaaaggagaaaaaagaactgaaaaaaaaaatggacaaaaaaaggcaggagaaaatcaccgaagctaagtctaaggataagagtcaaatggaagaagagaaaacagagatgatccggtcctacatacaggaggtggtgcagtacataaaacggctggaggaggctcaatccaagaggcaggagaagttggtggagaaacataaagagatcaggcaacagattctcgatgaaaagcctaagggagaaggatcctcgagctttctctcagagacctgccatgaagatccatcagtctctcctaacttcacccccccaaacccccaggcacttaagtggtag

SEQ ID NO: 128695 - DNA, 699 bp, Artificial Sequence
  Description of Artificial Sequence: Synthetic coding sequence
gccggagctcagccaggggtgcatgcactgcagctcaagcccgtgtgcgtgagtgattccctgaaaaaagggaccaaattcgtcaagtgggatgacgacagtaccattgtgacccccattatactccggaccgacccgcagggatttttcttttattggaccgatcaaaataaggagactgagctcctcgacctctccctagtcaaagacgctcggtgcggaagacatgccaaggcaccaaaggatccgaaactcagggaattgctggatgtgggcaacattggtcggttagagcaaaggatgatcacggtggtgtacgggccagacctcgtaaacatttcccacctgaatttggttgctttccaggaggaggtcgctaaagaatggactaatgaagtcttcagcctggccacgaacctcctggctcagaatatgtcccgagacgcttttttagagaaagcttacaccaagctcaaactgcaggtgacacccgagggacgcatcccgctgaaaaatatttatagactgttcagcgcagaccggaagagagtggagaccgctctggaagcttgtagccttccatcttctcgggtggagaaggcgaacgaggcagcaaagtcagaacagagttgcggtaaggccccccccaagcatttccacctgcacttcataaaacagaacaaaatgctcgaaccctag

SEQ ID NO: 128696 - DNA, 93 bp, Artificial Sequence
  Description of Artificial Sequence: Synthetic coding sequence
gaggaggcccagagtaagcggcaagaaaagctggttgagaagcacaaagagattcggcagcagatcctggatgaaaaacctaaggtaccttag

SEQ ID NO: 128697 - DNA, 591 bp, Artificial Sequence
  Description of Artificial Sequence: Synthetic coding sequence
ataattagtgggcagtttctctctgataagaaggtaggaacttacgtagaggttgatatgtttggcctccctgttgacactagaagaaaagcattcaaaactaagacatcccaggggaacgctgttaatccggtatgggaggaggagcctatagtgtttaaaaaagttgtcctacccaccctggcctgcctccgcatcgcagtgtacgaggaaggcggcaagtttattggacataggatccttcctgtgcaggccatacggccaggatatcattacatatgtttgcgcaacgaacgaaatcagcctctcaccctccctgcggtgttcgtctacattgaggtaaaggactatgtgcccgatacatatgccgacgttattgaggccctgagtaacccaataagatacgtgaatttaatggagcaaagagccaaacagctcgcagctcttaccctagaagatgaggaagaagtcaaaaaggagggtgggttcctgcacgatgagattatgcgccttacaaggaatacacttgaaaagttaatggcattgcccttaactcatgtcgtcccaatccagtctaagatgctatcttag

SEQ ID NO: 128698 - DNA, 3411 bp, Artificial Sequence
  Description of Artificial Sequence: Synthetic coding sequence
actcaggatccaaaactgagggagctcctcgacgtggggaacatcggtcgcctggagcagcggatgatcacggtcgtgtatggacctgatctggtcaacatcagtcatctgaatctggtggctttccaggaagaggtggctaaggagtggaccaatgaggtcttttccctggccaccaaccttcttgctcagaatatgtcccgagatgcattcctcgagaaagcctataccaagttaaaactccaggtgacacccgaggggagaattccgcttaaaaatatataccgcctgtttagtgctgataggaaacgggtggaaacagctctcgaagcttgctctctcccttccagcagaaacgactctatccctcaggaggacttcacaccagaggtgtatcgggtcttcttaaacaatctgtgtccgcggcccgagatcgacaatattttctccgagttcggggcaaagagtaagccatatctgacagtcgaccagatgatggactttatcaacctcaaacaacgcgaccctagactcaacgagatcctgtatccccctctaaagcaggaacaggtgcaggtgctgattgaaaaatatgagccaaacaactctcttgcaagaaagggccagatcagcgtggatggctttatgagatatctatctggagaggagaatggggtcgtgagtcccgagaagctggatctgaacgaagacatgagccaacctctgagccattacttcatcaacagctcccacaacacgtacctgaccgccggtcagctggccggaaactcttccgtcgagatgtaccgtcaggtgctcctctcagggtgtcggtgtgtggagctggattgttggaaaggaaggactgccgaagaagagcccgtcattacgcatgggttcactatgacgacggagatttcttttaaggaggttattgaagctatagctgagtgcgccttcaaaacatcaccttttccaatcttgctctccttcgaaaatcacgtggattctccaaagcagcaggcaaagatggccgagtactgccgtctgatttttggcgatgccctgttgatggagcctctggagaagtatcccctcgaatctggggtgccactgccttcacctatggaccttatgtataagatcttagtgaagaataaaaaaaaatcccataagtcatccgagggctctggtaaaaaaaaactgtctgaacaggcaagcaacacttattccgattcctcctccatgttcgaacccagcagtcctggagcaggcgaggccgataccgagtcagatgacgacgacgacgatgatgactgcaagaaatcctctatggatgaaggcactgccggttcggaggcgatggccacggaggagatgtccaacctcgtgaactacatccagccggtgaagtttgagtccttcgaaatctctaagaagagaaataagtcttttgaaatgagtagttttgtcgagaccaaagggctggagcagctcacgaagtctccggtcgagttcgtggagtataacaagatgcaactatctaggatctacccgaaaggcactcgcgtggacagctctaattacatgccgcagttattctggaacgctggttgtcagatggtggctcttaatttccagaccatggatctggccatgcagataaatatgggcatgtacgagtacaacggcaagtctgggtacaggctgaagccggaattcatgcgcaggccggataagcatttcgaccccttcactgagggcatcgtggacggaattgtagctaacacgctgtctgtgaaaattataagtgggcagtttctgtccgacaaaaaggttggcacatacgttgaagttgacatgttcggcctgcccgtcgataccaggaggaaggctttcaaaaccaagactagtcagggaaatgctgtgaatcctgtctgggaggaggagccaatcgtgtttaagaaagtggttctcccaacactcgcctgtctgcgtatcgccgtgtacgaggaaggtggcaagtttatcgggcaccgcatactgccagttcaggccattagaccgggataccactatatttgtctgcgtaacgaacggaaccagccattgacactccccgccgtgttcgtgtatatagaagtgaaagactacgtgcccgacacatatgctgatgtgatcgaggcactgtctaatcctattcggtatgtaaacctgatggaacagcgggccaagcagttggcagctctgactctcgaagatgaggaggaggtgaaaaaagaggccgatcctggagaaacccccagcgaggctccaagcgaggcccgcaccacccccgcggaaaacggcgtcaaccacacgacgacacttacacctaaacctccttcccaggcattacatagccagcctgcacccggaagcgtcaaggcccctgctaagactgaagacctgatacaatcggtactgactgaggtggaagcacaaaccatcgaagaattaaagcagcaaaagagtttcgttaagctccagaagaaacactataaggagatgaaggatctggtgaaaagacatcataagaaaacgactgacctgatcaaagagcacacaaccaaatataatgaaattcagaatgactatctgaggagacgagcggctttggagaagagcgcgaaaaaggactccaaaaagaaaagcgagccgtctagtcctgatcatggatcctctacgatcgagcaggatctcgcggcgttggatgccgaaatgacacagaaacttattgatctgaaggataaacagcaacaacagctgttgaacctccggcaagaacaatattattccgaaaagtatcagaagagagagcatatcaagctgttaattcagaaattaaccgacgtggcagaggaatgccagaacaatcagttgaagaagctgaaagaaatatgtgagaaagagaaaaaggagctgaaaaagaagatggataagaagaggcaggagaagattaccgaagccaaatcaaaggacaagtctcaaatggaagaagaaaagacagaaatgatacgctcctatatccaggaggttgtgcagtacattaaaagactggaggaggcacagtcaaagagacaggaaaagctggtcgagaaacacaaagagatccgccagcagatcctcgacgaaaagccaaagctgcaggtggaactggagcaagaataccaagacaaattcaaaaggttgcctctggagatacttgaattcgtccaggaggcaatgaaaggaaagatctctgaagacagtaatcatggcagcgcccctctcagtttatctagcgatcctggaaaggtgaaccacaaaacaccgagttccgaagaacttggtggtgatattcccggtaaggaattcgacacaccattatag

SEQ ID NO: 128699 - DNA, 3282 bp, Artificial Sequence
  Description of Artificial Sequence: Synthetic coding sequence
actcaagacccaaagctgcgggaactgttggatgtaggcaacattgggagactcgaacagcgtatgatcacagtggtatatggcccagacctagtgaacatttctcaccttaacctggtagcattccaggaggaagtcgccaaggagtggaccaacgaagtcttttcgctggctacgaacttactggcccagaatatgagtcgcgacgccttcttagaaaaagcttacaccaagctgaagctgcaggtaactccagaaggccgtatccctctgaaaaacatctacagattattctctgcagacaggaagagggtggagaccgccctggaagcatgctcactgccaagcagcagaaatgattctattccacaggaagatttcacgcctgaagtctacagagtctttctcaacaacctgtgccctaggcctgaaattgataacattttcagtgaattcggcgcaaagtctaagccttatctgactgtggatcagatgatggattttataaatctgaagcaaagggaccctcgactgaacgagatcctgtatccacccttaaaacaggagcaggtgcaggtgctgatcgagaagtatgagcccaataacagcctcgctaggaaggggcagatctccgtcgacgggtttatgcgctacctcagcggagaagagaacggcgtggtgtctccagaaaaattggatctgaacgaggatatgtctcaacctttatctcactactttataaattcgtctcacaatacttatttgactgccggacaactcgctggaaactctagtgtggaaatgtaccggcaggtgttgctcagcggatgtcggtgtgtggagcttgattgctggaaaggtcgaacagcggaggaggagcccgttattacccacggcttcaccatgacgacagagataagttttaaggaggtgatagaggcaatcgcagagtgcgcatttaaaacctcacccttcccaattctactctcattcgagaatcacgttgacagtccgaagcagcaggctaaaatggctgagtactgccgtctcatctttggggacgccctactcatggagccattggagaaatatcctctggaatccggcgtgcctctaccttctcctatggatctgatgtataagattttggtgaagaataaaaagaagagccataagtcaagcgagggctctggaaagaagaagctgtccgagcaggctagcaacacctattctgactcgtcctcgatgtttgagccttctagtcccggtgccggcgaagcagacaccgaatcagatgacgacgatgacgacgacgattgcaagaaatccagtatggacgagggtaccgcgggcagtgaagctatggcgaccgaggagatgagcaatctcgtgaactatattcagccggtcaagttcgagagcttcgagatctccaagaagagaaataagtcttttgagatgagctcctttgttgaaaccaaggggctcgaacaattgaccaaaagccctgtggagtttgtggaatataacaagatgcaactgagccggatctatccaaaggggacacgcgttgacagctctaactatatgccgcagctgttctggaatgcaggatgccagatggtggctctgaacttccagaccatggacctggcaatgcaaattaatatggggatgtatgagtacaatgggaaatctggatacaggctgaaacccgagttcatgaggcgacctgataaacactttgacccttttactgaggggatcgtcgatgggattgtagcaaacacgctgtccgtgaagattatttccggccagttcttatccgataagaaggtgggcacctacgtggaggtggatatgtttggtctgcccgtggatacaagacgcaaggcatttaaaactaaaacctcgcaaggtaacgcagtcaacccagtgtgggaggaggagccaattgtcttcaagaaggttgttctgcccactcttgcctgcctcaggatcgccgtttacgaagagggaggtaagtttatcggccatcgtatcctaccagtgcaggccatccgcccaggataccattatatctgcctcaggaacgaacgaaaccagccactcaccctgcctgctgttttcgtttatatagaggtgaaagattatgtgcctgatacttatgcggatgtgattgaggcgttgagcaaccctatcaggtacgttaacctgatggagcagcgcgcgaaacaattggccgccctgactctcgaggatgaggaggaagtgaaaaaggaggccgatcccggagagacaccttctgaagccccttctgaggctagaacgacccccgctgagaatggtgttaaccacaccaccacactgactccgaaacccccttctcaagccctacacagccagccggcacctggatccgtaaaagctccagcaaagaccgaggacctgatccagagtgtgctgaccgaggtagaggctcaaactattgaagagctgaaacaacagaaaagcttcgtaaagcttcaaaagaagcattacaaagagatgaaagatctggtgaaacggcatcataagaagaccaccgatctcatcaaggagcacacaacaaagtacaacgaaatccagaacgactacctgagaaggagagccgcgctggagaaatccgcaaaaaaggactccaaaaaaaaaagcgaacctagcagtccagaccacggttcaagcaccatcgagcaggacctggccgcgctggacgccgagatgacccagaagctgattgacctaaaggacaagcaacaacaacagttgctcaacctccgtcaggaacagtattacagcgaaaagtaccaaaagcgggaacatattaaattgctgatccaaaagctaacggatgtggcagaggaatgtcagaacaatcagctgaagaagctgaaagagatttgtgagaaagaaaagaaagagttaaaaaagaagatggataagaaaaggcaggagaagattacagaagctaaaagcaaggacaagtctcagatggaggaagagaagaccgaaatgataagatcttatatccaggaagtcgtgcagtatattaaacgccttgaggaagctcagtcaaagcgacaggaaaagctcgtagagaaacataaggagatcagacagcagatattagacgaaaaaccgaaaggtgagggctcaagctcattcctcagtgagacctgccatgaggatccaagcgtctctccaaattttacacccccaaacccacaggcgttgaagtggtag

SEQ ID NO: 128700 - DNA, 3558 bp, Artificial Sequence
  Description of Artificial Sequence: Synthetic coding sequence
atgtctctgctgaaccctgttctactgcctccaaaagttaaggcctacctttcccagggcgagaggtttatcaagtgggacgacgaaacaactgtggctagtccagtcatcctgcgggtcgatcccaaaggctactacctctattggacctaccagagtaaagaaatggaattcttggacattaccagcatccgggacacgcgctttggaaagttcgcgaaaatgccgaagtcccagaagctgagggatgtgtttaacatggactttcccgataactcttttctgttaaaaaccttgactgtggtaagcgggcctgacatggtggacctgaccttccacaacttcgtgtcctataaggagaacgtgggtaaggcctgggccgaagatgtgctggctttagtcaagcaccccttaacagcgaatgcctcacggtcaacatttctggataagatactggtcaaactgaagatgcagctgaacagtgagggaaaaatacctgtcaagaactttttccagatgttccccgccgaccgtaagcgcgtggaggcagcgctttcagcatgtcatcttcccaaaggcaagaatgatgctataaaccccgaggacttccctgagccagtctacaaaagtttccttatgtcactatgccccagacctgaaatcgatgaaatttttacatcttatcatgcaaaagccaaaccttatatgactaaggaacacctgaccaagtttattaaccagaagcagcgggactcaagattgaatagcctgttattcccacccgcacgacccgaccaggtgcaggggctcattgacaagtacgagccatcaggaatcaatgctcagagaggccagctctcgccggagggcatggtgtggttcctgtgcgggccagaaaattcagttctcgctcaggataagttattgctccaccacgacatgacgcagccattgaaccattactttataaattcatcacataatacctatttgacagcgggacagttcagcggactgtcaagcgctgaaatgtaccgccaggtcttgctctctggatgtcgctgtgtggagcttgattgttggaagggaaagccgcctgacgaggaacccataataacacacgggttcacaatgaccacggatatctttttcaaagaggctatcgaggcaatagccgagtctgctttcaagacttctccttatcccatcatcctgtcatttgagaaccatgtggattcgccacggcagcaggccaaaatggctgaatactgtcgaaccatcttcggcgatatgcttttgacagagcctctggagaaatttcctctgaagcctggcgtaccactgccttcacccgaggatctacgaggcaaaatactgattaaaaacaaaaagaaccagttcagcggacctacctcaagctcaaaagatacgggtggcgaggccgagggttccagcccccccagcgcccccgcgggggagggcacagtctgggctggtgaggagggtacggaactcgaagaggaagaagtcgaggaagaagaggaggaagaatcggggaacctggatgaagaagagataaagaagatgcagagtgacgagggcacggccggcctggaagtgacagcctatgaagagatgtccagcctggtcaactacatccagccgaccaaattcgtatcgtttgagtttagcgcccagaagaacaggtcttatgtgatcagctcctttaccgaattgaaggcatacgatctcttatctaaagcatccgtccagtttgtggactacaataaacgtcagatgtctcgaatctacccgaaagggacgagaatggacagcagcaactatatgccacaaatgttctggaatgcgggctgtcaaatggtggctctgaattttcagaccatggacctccccatgcagcagaacatggctgtttttgagttcaacggccagagtgggtatctcctgaagcacgaattcatgcgccggcctgacaagcagttcaatcccttcagtgtggatcgaatcgacgtggtcgtcgccacgaccctcagtatcacagtgatatcaggccagttcctgtcggagagatctgtgagaacctatgtggaggtggagctgttcggcctgcccggtgaccccaagcgccggtatagaaccaaactttcaccctcgacaaattccattaaccctgtatggaaggaagagccattcgtgtttgagaagatcctgatgcccgagctcgcctcactcagggttgccgtgatggaagagggaaacaagtttttagggcaccggataattcccatcaacgccctcaattcaggataccatcacctttgtctgcactcggagtccaacatgcccctcactatgccagcattgtttatattcctggagatgaaggactacatacccggcgcttgggcagaccttacggtggcactggccaaccccatcaagttctttagcgctcacgataccaagtccgtgaagttgaaggaggcgatgggaggtctccccgagaaacctttccctctcgccagccctgttgcaagtcaggttaacggagccctcgcgccaacatccaacgggagtcccgctgctagggcaggggcccgagaggaagcgatgaaagaggcagcagagccccggacagcctctctagaagagcttcgggaactgaaaggagtggttaagcttcagcgaagacacgagaaagagctgcgcgaattggaacggcgaggagcccgaagatgggaagaactgctgcagcgtggcgccgctcaactggccgagctcggccctcctggggtgggcggggtgggagcttgcaagctgggccccggtaaaggaagccgaaagaaacgcagtctgccaagggaagagtctgccggcgcagctccgggagagggccccgagggagttgacgggagagtgcgcgaattgaaggatcgcctggagttagaactccttcgacagggcgaggaacagtatgagtgtgttctcaaaagaaaagaacagcatgtggctgaacagatctctaagatgatggagctggctagagaaaaacaggctgccgagttaaaagcactgaaagagacatcagagaacgataccaaagaaatgaagaagaagctcgaaacaaaacgccttgaacggattcagggaatgaccaaggtcacaacagataagatggcacaagagaggctgaaaagagaaatcaacaattctcatatccaagaagtagtgcaggttataaagcaaatgaccgagaatctagaaagacatcaggagaaactggaagagaaacaggcagcttgcctcgagcaaatccgggaaatggagaaacagtttcagaaagaagctctcgcggagtatgaagccaggatgaagggcttggaagcggaagtgaaggagtctgtgcgggcctgtctgagaacttgcttcccgagcgaagccaaagacaaacctgaaagggcttgtgaatgtccccctgaattatgcgagcaagacccactgatcgcaaaagcagacgcgcaggaatcaagattgtag

SEQ ID NO: 128701 - DNA, 3546 bp, Artificial Sequence
  Description of Artificial Sequence: Synthetic coding sequence
atgagtctattaaatccggtcctgcttcctcctaaggtcaaggcttatctttcacagggagaacggtttattaagtgggacgacgagactactgtggccagtcccgtcatcctgagagtagaccccaaggggtactacctgtactggacttatcagtcaaaggagatggaattcctggatatcaccagcattcgagatacaagatttggcaagtttgctaagatgcccaaatcccagaagctgcgcgacgtgttcaacatggacttcccagacaattcatttctgctgaagacactgacggttgtgtccggccctgacatggtcgacctcacttttcataatttcgtttcctataaggagaatgttgggaaggcatgggccgaggatgttctggcacttgtgaaacaccctctcactgccaatgcctcaagaagtaccttcctggacaagatcctcgtgaaactcaaaatgcagctgaacagcgaaggcaagattcccgtaaaaaactttttccaaatgtttcctgccgaccgtaagagggtggaggcggctctgagcgcctgtcatctaccgaagggaaagaatgatgcaatcaacccagaagattttcctgaacctgtgtacaagagcttcctgatgtccctatgcccccgacccgagattgatgagatctttacctcatatcacgctaaggctaagccgtatatgaccaaggagcacctcactaaatttattaaccagaagcagcgagacagcaggttgaattctcttttgtttcctccagctcgacccgatcaagtccagggccttatagacaaatacgaaccaagcggaattaacgcacaacgcggccagttgtctccagaggggatggtctggttcttgtgcggaccagagaattctgtactagcacaggacaagctcctgctgcaccatgatatgacccagccgctcaaccactatttcatcaatagctctcacaatacttacctcaccgccggtcagttttccgggctctctagtgcagaaatgtataggcaggttttgttgtcgggctgcaggtgcgtagagctggattgttggaaaggcaagccaccggatgaggaacctattatcacccatggcttcaccatgacaaccgatattttcttcaaagaggctatcgaggcaattgcagagtcagcgtttaagacctccccctaccctattatactgagctttgagaatcacgtggacagtcctcgccagcaggccaagatggccgagtactgtcggactatatttggagatatgctgcttacagagccactcgaaaaattccccctgaagccaggcgtaccactgccaagtcccgaggacctaagggggaagattcttatcaagaataagaagaatcagttttctgggcccacaagttcctctaaggatacaggtggcgaggcagaggggtcttcaccacctagtgctcccgccgtctgggccggagaggaaggcactgaattggaagaggaggaggtagaagaggaggaggaggaggaatccggcaatctcgacgaggaagagatcaagaaaatgcagtccgatgaaggcacagcgggtttggaagtcaccgcctatgaggaaatgagctcactcgttaactatatccagcccaccaaatttgtgtctttcgaatttagcgctcaaaaaaataggtcttatgtcatatcttcattcacagaactgaaagcgtacgatctgctgtctaaggcaagcgtgcagttcgttgattacaacaagaggcagatgtctcggatatacccaaaggggacccgtatggattcaagcaactatatgcctcagatgttttggaacgcaggatgccagatggtggcgctcaattttcagactatggatctgcccatgcagcagaacatggcagtgttcgagtttaatggtcaaagcggctacctgctgaagcacgaatttatgaggcgaccggacaagcaattcaaccctttttctgtagaccgcattgatgtggtggtcgccacgaccctgagcattacagtgatcagcggacaattcctcagtgagagaagtgttagaacgtatgtcgaggtggaattgttcggcctccccggcgaccctaaacgccgctaccgcacaaagctttctccctcgacaaactccattaatccagtttggaaggaagagcctttcgtattcgaaaaaattctcatgcccgagttggcctctttgagggtagcagttatggaggaaggaaacaaatttctgggtcatcgaataattccaataaatgcccttaattcagggtaccatcatctttgccttcactccgaatccaacatgcccctcaccatgcctgcgctattcatcttcttggagatgaaagactatatacctggagcatgggcagatctgactgttgctcttgccaatccaattaagtttttctccgcccacgatactaaaagtgttaagctgaaggaagcaatggggggcctgccagagaaaccctttcccctagcttccccggtggcgtcccaggttaatggggcactggcgcccacatccaatggcagcccagcggctagagctggagctagagaagaagccatgaaagaggcagcagagccccggaccgcgagtttggaggagctacgggagcttaaaggagtggtgaaacttcagcggcggcacgaaaaagaactcagggaactcgagaggagaggcgcacgccgctgggaagagctgctgcagcggggggctgcccagctggctgagctggggccaccgggtgttggcggggtgggcgcttgcaagctggggcccggcaagggcagccggaaaaagaggtcacttccaagggaagagtcggccggtgccgcaccaggagaaggaccggagggagtagacggaagagttagagagctgaaggacaggcttgagcttgagctgctgagacagggcgaagagcagtacgaatgtgtcctgaagcgcaaagagcagcacgtagctgagcagatcagtaaaatgatggaactggcgagggagaaacaagctgccgagctcaaggcactcaaggagacttcagagaacgacacaaaggaaatgaaaaagaagttggagacaaaaaggttggagcgcattcagggaatgacaaaagtgacgactgacaaaatggcccaagagcggctgaagagggagattaacaacagccatattcaggaggtggtgcaggtgatcaaacagatgacggaaaatctcgagaggcatcaggaaaagcttgaagagaaacaggccgcctgcctggagcaaataagggaaatggagaagcagtttcagaaagaggcactggccgagtacgaagctcggatgaagggattggaggccgaggtgaaagagtcagtccgcgcttgtttgaggacatgcttcccatcagaagctaaggacaaacccgaacgcgcctgtgaatgccctcccgagctttgtgaacaggaccccctcatcgctaaggccgatgcgcaagagtcacgcctgtag

SEQ ID NO: 128702 - DNA, 3705 bp, Artificial Sequence
  Description of Artificial Sequence: Synthetic coding sequence
atggccggcgctcagccaggggtgcatgccctccagctagaacccccaacagtggttgagactctcaggcgagggtccaaatttatcaaatgggatgaagagaccagcagcagaaatctagtgacattaagagtagatcctaatgggtttttcctttattggaccggcccaaacatggaggtggacacccttgacattagctcaattcgcgacacccgcacagggcgatacgctcgactccctaaggacccgaaaattagggaagtgttgggttttgggggccctgatgctcggttagaggagaagcttatgacagtggtttctgggccagatcctgtaaacactgtctttctcaattttatggctgtgcaagatgacacggcgaaggtgtggagtgaagagcttttcaaactggccatgaacattctggctcagaatgctagtcggaatacgttccttcgtaaggcatacaccaagctgaaactgcaggttaatcaggacggcaggatcccagtgaagaacattcttaagatgttctcagccgacaaaaagagagttgaaacagcactggaatcttgtggactgaaattcaatcgctctgagtcaattcgacctgatgaattctctttagagatcttcgaacggtttctcaataaactgtgtctgcgacccgatattgataagatcttgctggagatcggtgccaaaggcaagccttatctgacactggagcagctcatggactttatcaatcagaaacagcgagacccacgacttaatgaggtgctgtaccccccacttaggccttctcaggcacgcttgttgatcgagaagtacgaacccaaccagcaatttctagagagggaccagatgtcgatggagggattttcccggtacctcggcggagaggagaatgggatcctgcctctcgaagccctcgatctgtccaccgatatgacccagccgctcagcgcctattttattaattctagccataacacctacctgaccgctgggcaattagccgggacaagctccgtggagatgtaccgccaggctcttctgtggggatgcagatgtgtcgaactcgatgtctggaagggtagacccccagaagaggaaccatttatcacccacggcttcaccatgacaaccgaagttccattaagagatgtgctggaggccattgctgaaaccgcatttaaaacttcgccctatcccgtaatactgtcctttgaaaatcatgtggatagcgccaagcagcaggccaagatggctgaatattgccgctcaatcttcggagacgctcttctgattgagccgctggataagtatccactggctcccggggttcctctgccaagtcctcaagacttgatgggccgcatcctcgtgaaaaacaaaaaaagacacaggccatccgccgggggtccagattcagcgggacgtaaaagaccgttagagcagagcaatagtgcattgtcagagagctcagcggctactgagcccagcagccctcaactggggtctcctagcagtgactcctgtcccgggctgagtaatggagaggaggttggactggaaaagccatcattggagcctcagaagtccctgggtgatgaaggactcaacagaggcccgtatgtgctgggccccgccgatcgagaagatgaggaagaagacgaggaagaagaggaacaaacagacccaaagaaaccaacgaccgatgaggggactgcttcctcagaggtcaatgctacggaggaaatgagtactctagtgaattacatcgagccagttaagtttaagagtttcgaggctgcccggaagcggaataaatgttttgagatgtccagttttgttgaaaccaaggcaatggagcaattgacgaagagtcctatggaatttgtggagtacaataagcaacaattgagcaggatctacccaaaagggacgagagtcgattcctctaattacatgccccaactattctggaatgtgggctgccagctggtcgcactaaatttccaaactttggatgtcgccatgcagctgaacgctggggtgttcgagtacaatggccgcagtgggtacttgctgaaaccggaatttatgcgtagacccgacaaatcctttgaccctttcactgaggtcattgtggatggaattgtagccaatgcactgagggtgaaagttattagcggccaattcctgtcagataggaaagtggggatttacgttgaggtggacatgtttggcttgcccgtggataccagacgtaaatacaggacacgtacaagccaaggtaacagcttcaaccctgtctgggacgaggagcccttcgacttcccaaaggtcgtcctacccactctggccagtctacgtatagcagcttttgaggaaggtggaaagtttgttgggcaccgcatattacctgtttctgccatcaggtcgggttaccactacgtgtgcctccgcaacgaggcgaatcaaccactgtgtctgcccgccctcttaatttatactgaagcgtcagattatatcccggatgaccatcaggactacgcagaggctctgatcaacccaattaagcacgttagcctgatggaccaacgcgcccgccagctcgcagctttgatcggtgagtctgaggcacaggccgggcaggagacgtgccaggacacacaatcacagcagctggggagtcagccatccagtaaccccactccatctcctctcgatgcgtcaccaagacgaccaccagggcccactacaagccctgctagcactagcctgtcgagccctggccagcgggacgatctgattgcctccattttatcagaagtagcaccaacaccgctggacgaactaagagggcacaaagccctggtgaaactgcgatcgcgccaggagagagacctgagagaactaagaaagaaacaccagagaaaggccgtcactctcactcgacggctcctggacggactggcccaagcacaggcggaggggaggtgcagattaagacctggagctttggggggcgcagccgatgtcgaagataccaaagaaggtgaggatgaagccaagcgctatcaggaatttcagaatagacaagtccaaagcctgctagaacttagagaagctcaggtagatgcagaggctcagcgaaggctggagcaccttcggcaggccctgcaaaggctgagagaagtcgtactggacgcaaataccacacagtttaaacgtttaaaagaaatgaacgaacgcgaaaagaaagagctccagaagatcctcgaccggaagcgtcataacagcatctccgaggccaagatgagggacaagcataaaaaggaggccgagctcactgagatcaatagaaggcacattactgagtccgtgaactctatacggaggctggaagaggctcagaagcagcgtcacgaccggctcgtggctggccagcaacaggtgctccagcaactcgccgaggaggagcctaaattgttggcccaactggcacaggagtgccaggagcagagagcccgcttgccccaggagatcagaagatccttgctgggagagatgccggaaggtctgggggacggtcccctggtcgcctgtgccagtaatggccacgcgcccggatctagtggccacctgagcggagctgacagcgaatcacaagaggaaaatacccaactgtag

SEQ ID NO: 128703 - DNA, 3705 bp, Artificial Sequence
  Description of Artificial Sequence: Synthetic coding sequence
atggcaggggcccagcctggtgtacatgcgctccagctcgaaccccctaccgtggtcgaaaccttaaggagggggtccaagttcattaaatgggacgaagagacaagcagcagaaacctggtgaccttgagagtggacccaaatggctttttcttgtactggaccgggccaaacatggaggttgatactcttgacatcagcagtatccgcgatacaaggaccggtcgatacgcaaggctccctaaggatcccaagatccgggaagtgctcggctttgggggtccagacgctcggctggaggaaaagctgatgacagtcgtaagtgggcccgaccctgtcaacactgtattcctgaactttatggcagtgcaggacgatactgccaaggtgtggagcgaggagctcttcaaacttgcaatgaatatcctcgcccaaaatgcgtcacgcaacacttttctcaggaaggcgtatacgaagttaaaactgcaggtaaaccaagatgggaggattcccgtaaaaaacatccttaagatgttttcagctgacaagaaacgcgtggagaccgcactggagagctgcggcctgaagtttaaccgatccgagagtatccggcctgatgaatttagcctcgaaatatttgaaaggtttctcaacaaattatgtctgcgtcccgatattgataaaatcctcctggagattggagcaaaagggaaaccctacttgactctggagcaattaatggactttataaatcagaaacagcgggaccctcgactgaacgaggttctgtaccctccactgcgaccatctcaggcacgcctgctgattgagaagtacgaacctaatcagcagttcttggagagggaccagatgtccatggaggggttcagcagatatcttggcggcgaggagaacggcatcctacctctagaggctttagacctttctaccgatatgactcaacccttgtctgcatatttcatcaattctagccacaatacttatctgaccgccggccagttggccggcacctcctccgtcgagatgtatcggcaagccctgctgtgggggtgtaggtgtgtggaactcgatgtatggaaggggcgaccaccagaggaggaacctttcatcactcatggcttcacaatgactactgaagtccccctgcgagatgtactggaggctatcgcagagaccgcgttcaagaccagcccgtatcccgtaattctcagtttcgagaaccacgtggatagcgcgaaacagcaggccaaaatggccgagtattgccgcagtatattcggagacgctctgctgattgaaccccttgacaaatatccactcgcgccaggtgttcccctgcccagccctcaagacctgatggggcgcatcctggtgaaaaataaaaagcggcatagacccagcgccgggggccctgactcggcggggcgcaagcgacccctggagcagtccaattcagccctgtccgaatcttccgctgcaaccgagccttcttccccacaactggggagcccgtcttccgatagctgtccggggctgtcgaacggcgaagaggtgggcctggaaaaacccagcctagaaccccaaaaaagcctaggtgatgaagggctgaatcgcggcccctacgtgctggggcctgccgaccgtgaagatgaagaggaagatgaagaagaagaagagcagactgacccaaaaaaaccgacaacagacgaggggaccgcaagcagcgaagtcaatgccaccgaggagatgagcacacttgtgaattatattgagcctgttaaattcaagtccttcgaagcagccagaaaacgtaacaaatgctttgagatgagctcattcgttgaaacaaaggcaatggaacagctaacaaaaagccctatggagttcgtggaatataacaagcagcagctgagccggatataccccaagggtactcgggtggactcaagtaattacatgcctcagctattttggaatgtaggatgtcagctggtcgcgcttaatttccaaacgctggacgtggcaatgcagcttaacgcaggcgtcttcgagtataacggaaggagtgggtatctcctgaagcctgagtttatgaggcgcccggataagagcttcgatccttttacagaggtaattgtagacggaatcgttgccaacgctctgcgagtaaaggtgatctcaggccagtttctctcagatagaaaggtgggaatttacgtcgaagttgacatgtttggtctgccagtggatacaagaaggaaatataggaccaggactagtcaggggaactcctttaatcccgtctgggacgaagagcccttcgactttccaaaagttgtgctgcctacactcgcgtctttacggatcgcagcatttgaggagggcggcaagtttgtcggacaccgcatcctccccgtcagcgctatccggtccgggtaccattacgtgtgtctcagaaatgaggccaatcagccgctgtgtctcccagcccttttaatatacacagaagccagcgactacattccagacgaccaccaggattatgccgaagcccttatcaatccaatcaagcatgtttctctgatggatcagcgggcacggcagctggcggctctcatcggggaatccgaggcccaggctggacaagagacctgccaggacactcagtcacagcagttggggagccagccgtctagcaatcctacaccctcgcctcttgacgcctcacctaggaggccacctggtcctactaccagtccggcaagtacctctttgtcctcccccggccaaagagacgacctgattgccagcattctgagtgaggtggctcccacacctctggacgagctgagaggccacaaagctctggtcaaactgcggtcccgccaagagcgggatctcagagagcttaggaaaaagcaccaaagaaaggcagtcaccctgacacgaaggctcctggatggactggctcaggctcaggctgaggggcgatgtagattgagacctggcgccctcggcggagccgccgacgtagaagacacgaaggaaggcgaggacgaggcaaagcgttaccaggaattccagaaccggcaggtgcagtctttgctggagctgagggaggcacaagttgatgccgaagctcaacggcgtctggaacatttacgccaagcattacagagactaagggaggtggtactggacgcaaataccacccagtttaagagactgaaggaaatgaacgagcgggaaaagaaggagctgcagaagattctagaccgcaaaaggcataattcgattagcgaagccaagatgcgcgataaacataaaaaggaagcagagctgacggaaattaatcgccggcatatcaccgaatctgtgaattctattcgacgtcttgaggaggcacaaaagcagcgtcatgatagattggtggccgggcagcagcaggttctccagcagcttgccgaggaggagccaaagctccttgcccagctggcccaggaatgccaagaacaaagagcgaggttgccccaggagatccgcagatcgctgctcggagagatgcccgagggtctaggggacgggcccctggtagcctgcgcctcgaacggacatgcacctggctcctctggacacctgagcggtgccgatagcgagagccaagaggaaaatactcagctgtag

SEQ ID NO: 128704 - DNA, 3528 bp, Artificial Sequence
  Description of Artificial Sequence: Synthetic coding sequence
atggccaagccctacgaattcaactggcaaaaggaggttcctagctttttacaagaaggcgccgtgttcgatagatatgaagaagagtccttcgtttttgagcctaactgtctgtttaaagtagatgagtttggattttttcttacctggcgttcagaagggaaagaagggcaggtcctagagtgctcacttattaactccatcaggtccggtgcgattcccaaggatccaaagattctcgctgctcttgaggcagttggcaagtctgaaaatgatctggagggccggatcgtttgcgtgtgttctggcaccgacctggtcaacatatcatttacctatatggttgcggagaatccagaggtgaccaagcagtgggttgaaggcctgcggagcatcattcataacttccgcgcaaacaatgtgtccccaatgacttgcctgaagaagcactggatgaaactggcctttatgactaacacaaacggcaagattcccgtcaggagtataaccagaacatttgcatctggcaagacggaaaaggtcatcttccaggctttgaaagagctgggactgccgtccggtaaaaacgacgaaatcgaacccactgctttctcctacgagaagttctatgagcttacacaaaagatatgcccacgcacggatatagaagacctgttcaaaaaaattaatggcgacaagacagactacttgactgttgaccagctggtgtcgttcctgaacgaacaccagcgggatccacgcctgaatgagatattgttccctttttatgacgctaagagggctatgcagatcattgagatgtatgaacctgatgaggatctgaagaagaaaggcctgatttccagtgatgggttttgtcgttacttgatgagcgacgagaatgcccccgtcttcctggaccggttagagctgtaccaggaaatggatcacccattggcccactacttcatttcatcatcacacaatacctacctcacgggccggcaattcggcggtaagtcctctgtggagatgtacaggcaggttctgttggctggttgccgctgcgtggagctcgactgctgggatgggaaaggtgaggatcaggagccaattatcacacacggaaaagctatgtgcacagatatcctgttcaaggacgtaattcaggccattaaggaaacagccttcgtcacctcagaataccctgtcattctgtcctttgagaaccactgctccaagtaccagcaatataaaatgtcaaagtactgcgaggacctgttcggggaccttttgcttaagcaagctctggaaagccatcctctggagccaggccgggcgctgcctagccctaacgatttgaagcgcaagattctgatcaaaaataaacgactgaagccagaggttgagaagaagcagctggaagccctgcggtctatgatggaggccggagaatccgctagccccgccaacattttggaggacgataacgaggaagagatcgagagtgccgatcaagaagaagaagcgcacccggaattcaaatttggaaatgaactctctgcggatgacctggggcacaaagaggcagtcgcaaacagcgtgaagaaagggctagtgacggtagaagatgaacaggcgtggatggcgagttacaagtatgtcggagccaccactaacatccacccctatttgtctactatgatcaattacgctcagccagtgaagttccagggttttcacgtcgccgaggaacgaaatatccactataatatgtcctctttcaacgagagcgtgggacttggctacctgaagacacatgcaatcgagttcgtgaactacaataaaaggcagatgtctcggatatacccaaagggcggcagggtggactcaagcaattacatgccacaaatattctggaatgcggggtgtcagatggttagtctcaattatcagacaccagacctggccatgcaactgaaccagggcaaatttgaatacaatggcagttgcggatacttgctgaaacctgactttatgagacgtccagatcggacctttgacccattttcggagacccctgtcgacggggttatcgccgctacctgctctgtgcaggtgatttctgggcagtttctaagcgacaagaagatcgggacgtacgtcgaggttgatatgtacgggctgcccactgacacaatcaggaaggagtttagaactagaatggtgatgaataatggattaaatccagtgtataacgaagaatccttcgtgtttcgtaaagtcatccttcctgacttagctgtactgaggattgctgtgtacgatgataacaacaaattgattggacagcgcatcctgccacttgatggtttacaggcaggataccgacatatttcattgcgtaatgaaggtaataagcccttaagtcttcctactatattttgcaatattgttcttaaaacatacgtgcccgatgggttcggggacatcgtggacgcgctgtcggatcccaagaaatttctgagcatcaccgagaaacgcgcagatcagatgcgggcaatgggaattgagacttccgacattgccgacgtgccctctgacacgagcaagaatgataagaaaggaaaagcaaatacagccaaggctaatgttactccgcagagtagcagcgaactgcgccccactaccaccgccgccctggctagtggagtcgaggctaaaaagggtatcgaattgatacctcaggtcagaatcgaggacctgaagcagatgaaagcctacctgaagcatctgaagaagcagcagaaagagctgaattctctgaaaaaaaaacatgccaaggagcattccactatgcagaaactgcattgtacccaggtggataaaatcgtagcccagtacgacaaagagaaatccactcacgagaagatcctggagaaggcaatgaagaagaagggaggaagcaactgtcttgagatgaaaaaggagactgaaataaaaatccagacattaacgtctgaccacaaaagtaaggtgaaagagatcgtcgcccagcacacgaaggaatggtctgagatgataaacacacatagcgccgaggagcaagagatccgcgacttgcacctgagccaacagtgcgagttacttaaaaaactcctgatcaacgcccacgaacagcaaactcaacagctgaaactcagccacgaccgcgagtctaaagagatgagggcccaccaggcgaaaatcagcatggagaattcaaaggccatcagtcaggacaaatccatcaaaaacaaagcagaacgggaacggcgggtgcgagaactgaatagttctaatacgaagaagttcttggaggaacggaaacgacttgctatgaagcaaagcaaagaaatggaccaactcaagaaggtccagttggaacacctggagtttctggagaaacaaaacgagcaggctaaggagatgcagcagatggtgaagctcgaagctgagatggacagaagacctgccacagtggtgtag

SEQ ID NO: 128705 - DNA, 3585 bp, Artificial Sequence
  Description of Artificial Sequence: Synthetic coding sequence
atggctaagccttacgagttcaactggcaaaaggaagtaccgtccttcctgcaggagggagccgtcttcgacagatacgaagaagaaagtttcgtgtttgagcctaactgcctcttcaaggtggacgagttcggctttttcctcacatggaggtctgagggaaaagaaggtcaagttctggagtgttcccttatcaattcgatcaggtccggggccatcccgaaggatcctaaaatactggccgccctggaggccgtgggcaagagtgagaacgacctggaaggccggatcgtctgcgtctgctccggaactgacctggtgaacatctcattcacttatatggttgctgagaatcccgaggtgacaaaacagtgggtggaggggctcaggtccatcatccataatttcagggcgaacaacgtatcgccaatgacctgcctcaaaaagcattggatgaaacttgctttcatgactaacacgaacggaaaaatccctgttcgcagcataactcgtacgttcgccagcggtaagacagagaaagtcatttttcaggcgctcaaggagctaggactcccgtcgggaaagaatgatgagatcgaacccacagctttctcctacgagaagttctacgagctgacccagaagatatgtcccaggacagacatcgaagacctgtttaaaaagatcaacggagacaaaaccgattatttgacagtggaccaacttgtcagctttctcaacgaacaccaaagagacccccgactcaacgaaattttgttccccttctatgacgccaagcgggcaatgcagataattgagatgtatgagccagacgaagacctgaaaaagaagggactgatatcgtccgacggcttctgtcgatacctgatgtcagatgagaacgcccctgtctttctggacagactggaactgtatcaggaaatggatcatcccctggcccattatttcatcagctcatcacacaatacgtacctcacaggcaggcagttcgggggaaagtcctccgtggagatgtatagacaggtgctgctagccgggtgtagatgtgtggagttggattgttgggatggtaaaggggaggaccaggaacctatcattacccacggcaaagccatgtgtaccgatatcctcttcaaggatgtgatccaggctattaaggagactgcgttcgttacttcggagtacccagtcattctatcctttgaaaaccactgttctaaataccagcaatataagatgagcaagtattgtgaagatctttttggggatctccttctcaaacaggcactggagtcccatcccttggagcccggacgagcattgccatcaccaaacgaccttaagagaaaaatcctgataaagaataaacgcctgaagcccgaggtagagaaaaagcagcttgaggccttgagatcaatgatggaagccggcgaaagcgcttctcctgcgaacattctggaagatgataatgaagaagaaatcgagtccgccgatcaggaggaggaagcccatcctgagtttaagtttggaaatgaactgtctgctgatgacctaggtcacaaagaagccgtggccaactccgtgaaaaagggccttgtcaccgtcgaggacgaacaagcatggatggcaagctacaaatatgttggcgccacgactaacattcatccgtatctttcgaccatgatcaattatgcccagccggttaagtttcagggctttcatgtagccgaagagagaaacatccattacaatatgtcctcatttaacgagagcgtgggcctggggtacttgaaaacacatgccatcgagttcgtgaattacaataaaaggcaaatgagccggatctatccaaaggggggtagagtggactcctctaattatatgccccaaatattttggaatgctggttgtcaaatggtgagcctgaattatcaaactcctgacctggcgatgcagctcaatcaaggcaaattcgagtataacggttcttgcggctacttactcaagcctgactttatgcggagacccgacaggacttttgaccccttctcagagacccctgtggacggagtcatagcagcgacttgttctgtgcaggttatcagtgggcagttcttgagtgacaagaagattggcacctacgtggaggttgacatgtacggcttgcctacagacacaattaggaaagaattccgcacgagaatggtcatgaacaatggtcttaatccagtctataacgaggagagcttcgtgttcaggaaggtgatactccccgaccttgccgttctgcgaatcgcagtgtacgatgataacaataaactcattggccagaggatcctgccgctggacgggctgcaggctgggtaccgacacattagcttacgcaacgaggggaataagccgctgagcctgcccacgattttttgcaatatcgttctcaagacgtatgtccccgacggcttcggcgacatcgtggacgcattatccgaccctaagaaattcctgtccatcacagaaaagcgggctgaccagatgagagcaatgggtatagaaacatccgatattgcggatgtgccaagcgacacttctaaaaatgacaaaaaaggcaaagcaaacactgccaaggctaacgtcaccccccagtcatcatctgaactgcgccctaccacaactgccgctctggcctccggagttgaagctaaaaaagggatcgaattgatcccacaagttaggattgaggacctaaagcagatgaaggcttatttgaagcacctcaaaaaacagcagaaggagcttaactcgctcaagaaaaagcacgccaaggagcatagcactatgcaaaagctccactgcacccaggtggacaaaatcgtcgcccagtatgataaggaaaaaagcacccacgagaagatcttggagaaggcaatgaaaaagaaaggggggagtaactgcctggagatgaagaaggagaccgaaatcaagatccagacccttacgagcgaccataagagcaaggttaaagagattgtggcacagcataccaaagagtggagtgaaatgattaatacccactcagccgaggagcaggaaattagggatctgcatctttcacagcaatgtgagcttctgaagaaactgctcataaacgcccacgagcaacaaacacaacaactgaagctgagccatgatcgggagtccaaagagatgcgggcccaccaagccaagattagcatggagaactccaaagccatatctcaggacaaaagcatcaagaacaaagctgagagagaaaggcgcgttcgtgagttaaattcctccaacacaaagaaattccttgaagagagaaaacgcctggccatgaagcagtctaaagagatggaccaactcaagaaggtacaactcgagcatttggagtttctggaaaaacagaacgagcagttgctgaagagctgccatgcagtatctcaaacccagggggaaggtgatgccgcagatggggagatcgggtcccgagacggacctcagacatctaacagttccatgaagctgcaaaatgctaactag

SEQ ID NO: 128706 - DNA, 3564 bp, Artificial Sequence
  Description of Artificial Sequence: Synthetic coding sequence
atggctaagccttacgagttcaactggcagaaagaggtgccctcttttttgcaggagggcgctgtcttcgatcgctacgaggaggagagtttcgtctttgaacccaattgtctgtttaaagtggacgagtttggcttctttctgacgtggagatccgaaggtaaggaagggcaagtgctcgagtgtagtctgattaacagcattcgctctggggctattcctaaggaccctaagatcctggcggctttggaagccgtggggaagtcagagaacgatctggagggcaggattgtatgcgtgtgcagcggcactgatcttgtgaacattagcttcacctacatggtggctgagaatcctgaggtgactaagcagtgggtggaaggcctccgttctattattcacaactttcgagccaacaatgtctctccaatgacgtgcctgaaaaagcactggatgaaacttgccttcatgactaacacaaacggaaagatacctgtccgtagtattactcgaaccttcgcctcagggaagaccgagaaagttatatttcaggcactgaaggaactgggtctgccctcaggaaagaacgacgaaatcgaacctacagccttctcctatgaaaaattctatgaactcactcagaaaatttgtcctcgcactgacatcgaggatctattcaagaagatcaatggcgataagacagactacttaactgtcgatcagctcgtgtccttcctgaacgagcatcaaagagatcccaggctcaatgaaatattattcccgttttatgatgcaaagagggctatgcagataatcgagatgtatgagccggatgaggatcttaaaaagaaggggctcatctcctctgacggattttgcagatacttaatgagcgacgaaaatgctcccgtgttcctggacaggctcgagctatatcaggagatggaccatccattggcacactatttcatctcaagctcccacaacacctatctcaccgggagacagtttggagggaaatctagtgtagagatgtaccgacaagtgcttctggctggatgtcgatgtgtggaactggattgctgggacggaaagggcgaagaccaggagcctatcattacccatgggaaggctatgtgcaccgatatcctattcaaggatgttattcaggcaattaaggaaacggcctttgttacttcagaataccccgttattctgtcctttgagaatcactgtagcaagtaccagcagtacaaaatgtctaagtactgcgaggacctgttcggggatctcctgctgaaacaggcactagaatcccaccccctcgaacccggaagagctctaccctcgcccaatgacctcaaaaggaaaatcttaattaagaataagcgcttgaagccagaagttgaaaaaaagcagcttgaggccttgcgctccatgatggaggcaggggaaagcgcttcaccggctaatattcttgaggacgacaatgaggaggaaatcgagagcgccgatcaggaagaagaggctcatccagagttcaagttcggcaatgagctcagcgccgatgacctaggacataaggaagctgtggccaacagcgtcaagaaagcctccgacgatctggagcatgagaacaataaaaaggggttggtgaccgtggaagacgaacaggcgtggatggccagttacaagtacgtgggggcaactaccaatatccacccttatctgtccacaatgatcaattacgcgcagcctgtgaaatttcagggatttcatgtcgctgaagaaaggaacatacactataatatgtcctcattcaacgaatctgtagggctggggtacctcaaaactcatgctattgagttcgttaattataacaaacgccaaatgtcccgaatctatcctaaaggtggaagggtagatagttccaactatatgccacaaattttttggaatgctggctgccaaatggtgtctttaaattaccaaacaccagacctcgccatgcagctgaatcaggggaagttcgagtacaatgggtcttgtggctatctgctgaagccggactttatgaggcggcctgatcggacgttcgacccattctcagagacacctgtggatggcgtgatcgccgcgacatgctcagtgcaggtgatttcaggacagttcctcagtgacaaaaaaattggtacttatgtggaagttgacatgtacggcttgccgacggacactatccggaaggaattccgaactagaatggtgatgaataatggactgaaccctgtgtacaatgaagaatcctttgtcttcagaaaagtaattctgcctgatttagccgttttgaggatcgctgtgtatgacgacaacaacaagttaattggtcagcgtatccttccactggacggactgcaggccggctaccgccacatctcattgaggaatgaggggaacaagccactcagccttcccacgattttttgcaatatcgtgttgaaaacatacgtcccagatgggttcggggacatcgtggatgccctgagcgaccccaaaaaatttctgtctattacagaaaagagggccgatcagatgcgggcaatgggaatcgagacaagtgacattgcagacgtccctagcgacacatccaagaacgataagaagggcaaggccaatactgctaaagccaacgtgacaccccaatcctcatctgaactcaggcccactaccaccgcagctttagcctccggagttgaagcaaaaaaagggatcgagctgataccccaggtgagaatcgaagacttgaagcaaatgaaagcctacctcaagcacctgaaaaaacagcagaaggagctgaatagtttgaagaaaaagcatgcgaaggagcatagtaccatgcaaaagcttcactgtactcaggttgacaagattgttgcccagtatgataaagagaagtcaacccatgaaaagatccttgagaaggccatgaagaagaaaggcgggagcaactgtctcgaaatgaaaaaggaaaccgaaatcaagattcagacgctcaccagcgaccataagagcaaagtcaaggagattgtggcgcagcatacaaaagaatggagcgagatgataaacactcactccgctgaggaacaggaaattcgcgacctccacctgagccagcagtgcgagctgctgaaaaagttgcttattaacgctcatgagcagcagacacaacagctaaagctgtctcacgaccgggaaagtaaagaaatgagggcccaccaggccaagataagcatggaaaactcgaaggccattagccaggataaaagcataaagaataaagctgagcgggaaaggagagtgcgggagcttaattcatccaacactaaaaagtttttagaggagcggaagaggctcgcaatgaaacaatctaaggagatggatcaactcaaaaaggtacagcttgagcacctggagttccttgaaaaacagaatgagcaggccaaggagatgcagcagatggttaaattggaagccgaaatggacaggcgacctgctactgttgtgtag

SEQ ID NO: 128707 - DNA, 3528 bp, Artificial Sequence
  Description of Artificial Sequence: Synthetic coding sequence
atggccaagccatacgaatttaattggcagaaagaggtcccatcattcctacaggagggcgccgtgtttgacaggtacgaagaggagtctttcgtttttgagccaaattgcctgttcaaagtagatgagttcgggttttttctaacctggagaagtgaaggaaaagaaggacaagtcttggaatgttctctgataaactccattagaagtggcgcaattccgaaagaccctaagatactggccgccctagaggccgtgggaaaatccgaaaacgatctggaaggcaggatcgtgtgcgtgtgcagtggcactgacttggtcaatattagcttcacctacatggtggccgagaatcccgaggttacaaaacaatgggttgagggactgcggtccatcattcataacttccgggctaacaacgtcagtcccatgacctgtttgaaaaagcattggatgaaactcgctttcatgacaaatacaaatgggaaaatccccgttcgatcgatcacgagaacgtttgcgtcaggcaagacagagaaggtaattttccaggcccttaaggaattgggcctcccaagtggtaaaaatgatgagattgagcccacagccttctcctatgagaagttttacgaactgacccagaagatatgtcccaggacagatattgaagatctattcaagaaaattaacggcgataagaccgattacctcactgttgaccagttggtatcgttcttgaacgagcaccagcgggacccccgcctgaatgagatcctttttcctttctacgatgccaagagagccatgcaaattatcgagatgtacgaacctgatgaagacctcaagaagaagggtctgatcagtagcgatgggttctgccggtacctgatgagcgatgagaacgcccccgtcttcttagatcggctggaactatatcaggagatggaccacccccttgctcactattttatctcgtcctctcacaatacctatcttactggtaggcagttcggggggaagtcatctgtggagatgtacagacaggtgttactggctgggtgccgctgtgttgaacttgactgttgggacggtaaaggggaggaccaagagcccatcatcactcacggtaaagccatgtgtaccgacatactgttcaaggacgttatccaggccatcaaggaaaccgcctttgtcacgagcgagtatcccgtgatcttgtccttcgagaaccattgcagcaagtaccaacagtacaagatgtctaagtattgtgaggacctctttggcgacctgctgctgaaacaggcacttgaatctcaccctctggagcccggacgggccctgccatctcccaacgacctgaagaggaagattctaatcaaaaacaaacggctgaagcctgaggtggagaagaagcagctagaagctcttcggagcatgatggaagccggggaatccgcaagtccggctaacattttagaagacgacaacgaagaggagattgagtccgctgatcaggaagaggaggcacaccccgagtttaagttcggtaacgaactgtccgccgacgatcttggtcacaaggaagctgtcgccaattctgtcaaaaagggcctagtgaccgtcgaggacgaacaggcttggatggcctcttacaaatacgtgggagctaccactaacatccatccgtatctatcgacaatgatcaattacgctcagcccgtgaaattccaggggtttcatgtcgccgaggagcggaatatccactataacatgagctcatttaacgaaagtgttggcctgggctacctcaagactcacgcaatagagttcgtaaactataacaagcggcagatgtcacgcatttatccaaagggtgggcgtgtcgactcgtccaattacatgcctcagatcttctggaatgcagggtgccaaatggtttcactcaattaccaaacgcctgatctagctatgcagctgaatcaggggaaatttgaatacaacgggtcatgtggctatcttctgaagccagatttcatgcgtcgtcccgatagaacatttgatcccttctctgagacgcccgtggatggagtgatcgcagctacatgctcagtgcaggtgatttccgggcaatttctgtccgataagaaaattggcacctatgtggaagtggacatgtacggactgccaacggataccataagaaaggaatttaggacaagaatggtgatgaataacggacttaacccggtgtacaatgaagaatcattcgtcttccggaaggtgattctgccagacctggcagtactgcgaatagccgtgtacgatgacaataataaactaattggacagcgtattttgcccttagacggcctgcaggccgggtatagacatatctccttgaggaacgagggcaacaagcccctgagtctgcccacgatcttttgtaacatagtgctcaagacttacgtcccagacggatttggggatattgttgacgctctttctgatcccaaaaagttcctcagcatcacagaaaaaagggctgaccagatgagggccatgggcattgagaccagtgacatagcagacgtgccttccgatacttctaaaaatgataaaaagggaaaggccaacaccgccaaggccaatgtaaccccccaatccagcagtgagctgcgcccgaccacaaccgccgccctggcctcaggcgtagaagctaagaagggtattgaattgataccacaggttcgaattgaggacctcaaacagatgaaggcgtacttgaagcatctcaaaaagcagcaaaaggagctaaacagtctcaaaaaaaaacacgcaaaagaacactcaaccatgcaaaagctccactgcacccaggtcgataaaatcgtggcacagtacgacaaagaaaagtcaacccacgagaagatcctggaaaaagcaatgaagaagaagggaggttccaactgccttgagatgaaaaaggagacggagattaagatccagacccttacctcagatcacaaaagcaaagtcaaggaaattgttgctcaacatacaaaggaatggagcgagatgatcaatacacattctgcggaagaacaggaaatcagagatttgcacctgagtcagcagtgtgagctgctcaagaaacttttgattaatgctcacgaacagcaaacacagcagctgaaactgtcacatgatcgagagtcaaaggaaatgagggcgcatcaggcaaagatcagtatggaaaattccaaagccattagccaagacaagagcattaagaacaaagccgagagggagagacgggtacgtgagttaaactcatctaacactaagaagttcttggaggagcgcaagaggctggcaatgaagcaatccaaagagatggaccagctgaaaaaagttcaactcgagcatttagagtttcttgagaaacagaatgaacaggcaaaagaaatgcaacagatggtcaagttggaagccgaaatggatcgccgccctgctaccgtggtttag

SEQ ID NO: 128708 - DNA, 3585 bp, Artificial Sequence
  Description of Artificial Sequence: Synthetic coding sequence
atggctaagccctacgaatttaactggcaaaaggaagtgccctctttcctacaggaaggcgcagtctttgaccgctatgaggaggagtcgtttgtgttcgagcctaactgtctatttaaagtggatgagtttggcttttttttaacatggaggtcagagggtaaagaaggccaagtactggaatgctctctgattaacagtattaggtccggggcgatccccaaggaccccaaaatcctcgccgcgctggaagccgtcggcaagtcagagaacgacctggagggacggattgtatgtgtctgttcagggacagacctagtaaatatctcttttacttatatggtcgccgagaaccctgaggtgacaaagcagtgggtggaggggctgcggtccattattcacaatttcagggctaataacgtctctcccatgacatgcctgaagaagcactggatgaagctggctttcatgactaacactaatggcaagattcccgtacgttccataacccggacattcgcgagcggaaaaactgaaaaagttatcttccaagctcttaaggaactggggctgccgtcagggaagaacgatgagatcgagcccaccgccttctcatacgaaaaattctatgagctgacacagaaaatctgcccccgcacagatattgaagatctttttaaaaaaatcaacggcgacaaaactgattatctgactgtggaccagcttgtgtcgttcttaaacgagcatcagcgggaccctagactgaatgaaattctgtttcccttttacgatgctaaacgcgcaatgcaaataatagaaatgtatgagcctgatgaagatctgaaaaaaaaaggactgatttctagcgatggcttctgccgttacctgatgagcgatgagaacgcccctgtcttccttgataggctggaactttatcaagaaatggatcaccctttggcccattactttatctctagctcccataacacttatctcaccgggcggcaattcggaggaaaatcttctgtcgagatgtatcgacaagtgctgttagctggatgtcggtgcgtcgagctggactgttgggatggcaaaggcgaagatcaagagccaatcatcacacacgggaaggcaatgtgtaccgacatcctgttcaaagatgtcattcaggcaattaaggaaaccgcctttgtgacgagcgaatatccggtgatactttcttttgaaaaccattgcagcaagtaccagcagtataagatgagcaagtactgtgaggacttatttggggaccttctgctcaagcaggcactagaaagtcacccattggagcctggacgggccctgccctctcccaatgatcttaaacgtaagatcttaattaaaaacaaacgcctgaagcctgaagtggaaaaaaaacagctcgaagctttgcgctccatgatggaggccggtgagtccgcctctcctgcgaatattctcgaggatgataacgaggaagagattgagagtgcagaccaagaagaagaagcccacccggagtttaagttcggaaacgagctgagcgcagacgaccttggtcataaagaagcagtcgccaatagcgtgaaaaaaggcctagtgaccgtggaggatgagcaggcttggatggcatcctacaagtacgtaggcgcaaccactaacattcacccctacctttctaccatgatcaattatgctcagccggtcaaattccaaggcttccacgtggcagaggaaaggaacatacactataacatgagctcgtttaatgagagcgtgggactgggttatttgaagacacacgcaattgaatttgtgaattataataaacgccagatgagcaggatataccccaaagggggccgggtggatagctccaattacatgccccagattttttggaatgccgggtgccagatggtcagcctgaactatcaaaccccagatctggcgatgcaactgaaccagggcaagtttgaatataatggatcctgtggctatctccttaagcccgacttcatgcgtcgccctgatcggacttttgaccccttcagcgagacacccgtggacggagtgatcgctgccacatgttcagttcaggttataagtggtcagttcctgtccgacaagaaaataggcacctacgtggaggttgacatgtatggcttgcccacagacacgatccgcaaggagtttaggacccggatggtgatgaacaacgggcttaatcccgtgtacaacgaggagagtttcgtgttccgcaaagtaatacttcctgacctggccgtactgagaattgcagtgtatgacgacaataataagttaattggacagaggatcctgccactcgacggactccaagcagggtacaggcacatttctcttagaaacgaaggaaataaacctctgtcactccccacaattttctgtaacattgtactcaagacgtacgtccctgacggtttcggtgacatcgtggacgctctgagcgatcctaaaaagttcctttcaataacagaaaaacgtgcagatcaaatgagagctatgggcatcgaaacatcagacatcgctgacgtgccctccgatactagcaagaacgataagaaggggaaagctaacacagccaaagcaaatgtcactccgcaatcaagctcagaattgcgcccaactaccactgcagccctggcaagtggcgtggaggccaaaaagggtatagagctgattccccaagtgcgtatcgaggacttaaaacaaatgaaagcctacctcaagcacctgaaaaaacagcagaaagagttgaattccctaaaaaaaaagcacgccaaggagcactccaccatgcagaagctgcactgtactcaggttgacaaaatcgttgcccagtatgataaagagaagtcaacccatgaaaagatcctcgagaaggcaatgaaaaagaagggaggatctaattgtcttgagatgaagaaagagacagagatcaagatccagaccctgacctctgatcacaagtcaaaggtcaaggagatcgtcgcgcagcatactaaggagtggtccgagatgattaacacccattcggccgaagagcaggagatccgcgatctccacctcagccagcagtgcgaacttttgaagaagcttctcatcaatgcccacgaacagcagacccagcagcttaaactgtctcatgatcgagaatcaaaggaaatgcgtgcacaccaggccaagatcagcatggaaaacagcaaggccatctcacaggataagtccatcaagaataaggcggagcgggaacgccgtgtgagggaactgaactcgtccaacaccaagaaattcctggaggagcgaaaacgactggcaatgaaacagtcaaaagaaatggaccaactgaagaaggtccaattagaacatctagaattcctggagaagcagaacgagcagctcttaaagagctgtcacgcagtgtcacagacacagggggagggtgacgccgcggacggcgagattggttctcgagacggaccacagactagcaattccagtatgaagctgcaaaacgctaattag

SEQ ID NO: 128709 - DNA, 342 bp, Artificial Sequence
  Description of Artificial Sequence: Synthetic coding sequence
atggcaaagccttacgagttcaattggcagaaagaagtgccctcgttcctccaggagggtgccgtctttgatcgctacgaggaagaatcctttgtattcgaacctaattgcttgttcaaggtggatgaattcggcttctttctgacctggaggtctgagggcaaggagggacaagttttagagtgcagcctcattaactctatcagaagcggcgccattccaaaagacccaaagatccttgccgccctcgaggctgttggaaaatctgagaacgacctagaagggcgtattgtgtgcgtctgctctggaacagacttggtcaacatttccttcacgtattag

SEQ ID NO: 128710 - DNA, 3072 bp, Artificial Sequence
  Description of Artificial Sequence: Synthetic coding sequence
ccggtgcgcagcatcaccaggaccttcgcttctgggaaaacagagaaagtgatatttcaggccctgaaagaactgggtttaccctccggcaaaaacgacgagatcgagccaaccgcattctcctacgagaaattctacgaacttacacagaaaatttgccctagaacagacattgaagacctgtttaaaaaaatcaacggcgataagactgactatctcacggtggatcagttggtgagcttcctgaatgaacaccagcgggacccacgcctgaacgagatcctatttccgttttacgacgcaaaaagagccatgcagattatcgagatgtatgagccagacgaggacttgaagaagaagggcctgattagttctgacggcttttgcagatatctgatgagcgatgagaacgccccagtgttcttggaccggcttgaactttaccaggaaatggatcatccgctggcccattactttatctcatccagtcacaatacatacctgacaggccggcagttcggaggaaagtcatccgtggaaatgtataggcaggtactgttagctgggtgtaggtgcgtagaattggactgctgggacggaaagggagaagaccaggagccaataataactcacggcaaggccatgtgtaccgacattctcttcaaggatgtaatccaagcaataaaagagaccgctttcgtgaccagtgaataccccgtcatcctgtcattcgaaaatcattgttccaaataccagcaatacaagatgtctaagtactgcgaggatttgttcggagatctgctcctcaaacaggctttggagagccacccgctggagccgggtcgggcactgccttcacccaacgacctaaagcgtaaaatcctgataaaaaacaaacgtctgaaacccgaggttgaaaagaagcaactggaggctctccggtctatgatggaggccggagagtccgcaagtcctgccaacatcctcgaggacgataacgaggaggagattgaatccgcggatcaggaggaagaggctcaccctgaattcaagtttggtaacgagctgtccgccgacgatctgggtcacaaggaggcggtggcgaattccgtcaaaaaggcctctgatgatctggaacatgaaaacaacaagaaaggcctcgtgaccgtcgaagacgagcaagcatggatggctagttataagtatgttggagctactactaatatacacccttatttaagcaccatgattaactacgcccagcctgtcaaatttcagggctttcacgtcgccgaggagaggaatatacactataatatgagttcctttaacgagagcgtaggtcttgggtacttaaaaacacacgccatagagttcgtcaattacaataaacgacaaatgagcagaatatatcctaaggggggacgcgtggactcttctaactacatgcctcagattttttggaacgctggttgccagatggtgtcactcaattatcagacgcccgacctggcaatgcagctgaaccagggcaaatttgaatacaatggcagctgcgggtacctgctgaaaccggattttatgaggcgccccgatcgcaccttcgacccattcagtgagacacccgtcgacggagttatcgccgccacatgctcggtgcaggtgataagtggtcaatttctcagtgacaaaaagattggcacctatgtggaagtagacatgtatggactccccaccgacacaatcagaaaggagtttagaacaagaatggtgatgaacaatgggctgaatcctgtatacaacgaagaaagctttgtgttccgaaaggtgattctgcccgacctggccgttttaaggatcgcagtgtacgacgataacaataagctcatcggccagcgtatcctgcctctggatggcctgcaggctggctaccgacatattagccttaggaatgagggcaataaacctcttagtttgccaactatcttctgtaacattgtgctgaagacatacgtccctgacggctttggcgacattgtggacgcactgagcgatccaaaaaaattcttgagcataaccgagaagcgcgcagatcaaatgagggctatgggaatcgagaccagcgacatcgccgacgtgccatcagacacaagtaagaacgataaaaaaggcaaagccaacacagccaaggctaacgtcactcctcaatcaagtagcgagctgagacccacaactaccgctgcactcgcttctggggtggaagccaagaagggcatagagttgatcccacaagtgcgaattgaggacttgaagcagatgaaagcctacctcaaacatctgaaaaagcagcagaaggagcttaatagcttgaagaagaaacacgccaaggaacattctaccatgcaaaagctacattgtactcaggtggataaaatagtcgctcagtatgacaaggagaaaagcacccacgagaagattctggaaaaggcaatgaaaaaaaagggcggtagcaattgcctggaaatgaagaaggagacagagataaaaatccagacattaaccagcgaccacaaaagcaaagtgaaagagatcgtggcgcaacataccaaagaatggtccgagatgattaatacacactctgctgaggagcaggaaatcagggacctgcatttatcacaacagtgcgagctgttgaagaaactgttgattaatgctcatgaacaacagacccagcagctgaagctgtcccacgatcgagagtctaaggagatgagggcacaccaggctaaaatttcgatggaaaactcgaaggctatcagccaggataagtccataaagaacaaggccgaacgggagaggagagtacgcgagctaaattctagtaatactaaaaagttcctcgaggagagaaaacggctcgctatgaagcaaagcaaggagatggatcagctgaaaaaagtccagctcgagcacctggagtttctggagaagcagaacgagcaggccaaagaaatgcagcagatggttaagctggaggcagagatggacaggagacccgctacagtggtgtag

SEQ ID NO: 128711 - DNA, 183 bp, Artificial Sequence
  Description of Artificial Sequence: Synthetic coding sequence
atggctaaaccttatgagttcaactggcagaaagaggtgccaagttttctgcaggaaggcgctgtgtttgataggtatgaggaggaaagctttgtcttcgagccaaactgtctgttcaaggtcgatgaatttggcttcttcctcacttggagaagcgaagggaaggagggtcaggtcctatag

SEQ ID NO: 128712 - DNA, 246 bp, Artificial Sequence
  Description of Artificial Sequence: Synthetic coding sequence
atggccaagccttacgaatttaattggcagaaggaggtgcctagcttcctgcaggagggagctgtgttcgatagatacgaggaggaaagctttgtcttcgaaccaaattgcctattcaaggtcgacgagtttggttttttcttaacctggagatcagaggggaaggagggccaggtgttagagtgtagcctgataaatagcatcaggtcaggcgccattccgaaagatcccaagattctcgcctag

SEQ ID NO: 128713 - DNA, 333 bp, Artificial Sequence
  Description of Artificial Sequence: Synthetic coding sequence
atggcgaaaccttacgagttcaattggcaaaaggaagtgccctcatttttacaggaaggtgcagtgtttgacaggtatgaggaagagtcttttgtgttcgagccaaattgtctgttcaaagtagatgagtttgggttcttcctcacctggcggtcggaagggaaggaaggtcaagtcctagagtgcagtcttataaacagtatacgcagcggggctatcccaaaagaccctaagatcctcgctgcactcgaggccgtggggaagtctgagaatgatctcgaaggaagaattgtgtgcgtgtgctctggaaccgaccttgtcaacatttcatag

SEQ ID NO: 128714 - DNA, 2271 bp, Artificial Sequence
  Description of Artificial Sequence: Synthetic coding sequence
atggactccgggagggactttctgactctgcacggactgcaagatgatgaggacctgcaggccttgctgaaaggcagtcaactgcttaaggtgaagtcttcgtcatggcgaagggaaaggttttataaactgcaggaggattgcaagactatctggcaggaatccaggaaggtgatgcggactcctgagtcccagctcttctccatcgaagatatccaagaggtccggatggggcatcgaactgaggggttggagaaattcgcccgagacgtgcctgaggacaggtgcttttcgattgtcttcaaggatcaacgaaatactctcgatctgatcgctccctcacctgcagatgcgcagcactgggtgttgggtctgcataagattatacaccactccgggtcgatggaccagagacagaagctccaacactggatccattcctgcttgcggaaagcagacaagaacaaagacaacaaaatgtctttcaaagagctgcaaaattttctaaaggagctaaatatccaggtggatgactcttatgctaggaagattttcagagagtgcgaccacagccagacagatagtttggaagacgaagaaattgaggccttctataaaatgctaactcagagagttgaaatcgacagaaccttcgctgaagcggccggaagcggggaaacactgtccgtcgaccagctggttacctttctgcagcaccaacagagagaggaagcggcaggacccgctctggccctctcgctcattgagaggtacgaacctagcgagacagctaaagcccagcgacaaatgacaaaagacgggtttctaatgtatcttttgagcgccgatggcagcgcctttagtctcgcccaccggcgagtgtatcaggacatgggccaaccgctttcccattacctcgtttcttcctcacataacacatatcttcttgaggaccagctggcaggtccctcatccacagaggcctacattcgggctctatgtaaagggtgccgctgtctggagttggattgttgggatggcccaaaccaagagccaattatctatcatggttatacatttacatctaaaattctgttctgcgatgttctcagagcaataagagattatgccttcaaagcctcaccttatccagtgatcttgagccttgaaaaccattgcactctggagcagcagagagtgatggcccggcatctgcacgccattctcggtccaatgctgctgaacaggcccttagatggagtcacgaactccctgccctcccccgaacagctgaagggcaaaattctcctgaaaggtaagaagctggggggcctcttaccgccgggaggtgaggggggtccagaagcgactgtggtgtccgatgaagacgaggcggcggagatggaagatgaggccgtgagatcacgcgttcagcataagcccaaggaggataaactcagacttgcccaggaattgtcagacatggtcatatactgtaaatcagtgcattttggcggcttttcgtcgccaggtacaccaggacaggccttttatgaaatggccagttttagcgagaacagagctctccgcttactccaagagagcgggaatggctttgtaaggcacaacgtcggccacctgtcaaggatctatcccgccggttggagaacggacagcagcaattattcgccagtagaaatgtggaatggaggttgtcagattgtggcattgaacttccagacacccgggcctgaaatggatgtctatcaaggacggtttcaggataatggggcatgcggctacgtgttaaaaccggcgttcttacgcgatcccaacggtaccttcaaccccagagctcttgcacaagggccgtggtgggcacgtaagagactgaacattcgagtgatttcaggacaacaattaccaaaggttaataagaacaagaacagtattgtagatccaaaggtgactgtggagatccacggtgtgtctcgcgacgtggcaagccggcagacagcagtgattaccaataacgggtttaacccctggtgggatacagagtttgccttcgaggtcgtcgttccagacctagcccttatccgttttctcgtggaagattatgatgccagctccaagaatgatttcatcgggcagtccaccattcctttaaattctctaaaacagggctaccggcacgtgcacctgatgtcaaagaatggcgaccagcatccgtcggccactctctttgttaaaatctctctgcaggattag

SEQ ID NO: 128715 - DNA, 2334 bp, Artificial Sequence
  Description of Artificial Sequence: Synthetic coding sequence
atgcaatgcttgggaattcgcagcaggtcaaggtccagggagctctatctccaggaaaggtcactcaaggtcgcggcactaaatggccggaggcttggactgcaagacgatgaggatctccaagccctactgaagggcagccagttgctgaaggtcaagagctcttcatggcggagagagaggttctataagctgcaggaggattgtaagaccatttggcaggaatcacggaaggtcatgcgaaccccagaatcacagctgttttccatagaagacatccaggaagtccgtatgggtcaccgcacagagggtctggaaaagttcgcgcgcgatgtgcctgaagatagatgcttttcaattgtgtttaaggaccagcgcaacacacttgatctgatcgctccaagtccagctgatgcccagcattgggttcttggccttcacaagattatccatcattctgggtcgatggatcagcgtcagaaattgcaacactggatccattcatgcttacgcaaggctgacaaaaataaagacaacaagatgtcttttaaggagctgcagaatttcttgaaagaactgaacattcaagttgatgatagctacgcccgcaaaatctttcgagagtgtgaccactcccaaacagacagtctggaggatgaagagatcgaagccttctacaaaatgctgacacagagggtggagatcgatagaacatttgcagaagcggccggaagtggcgaaacactgtcggtggaccaactcgttacatttctgcagcaccaacagagggaggaggcagcagggcctgccctggcactgtccctcatcgaacgttacgaaccaagcgaaacagctaaggcacagagacaaatgaccaaagatggctttctcatgtatttgctgtctgcagacgggtctgccttctctcttgcccatcggcgcgtataccaggatatgggccagccactgtcccattatctcgttagttcctcgcacaacacttatctgctagaggatcagctagccggccccagttccaccgaagcctatatcagggcactttgtaagggatgtaggtgcctggagttggattgctgggacggacccaaccaggagcccatcatctatcatggttacacgtttacgtctaaaatcctgttttgtgacgttcttcgcgctattcgcgattatgcctttaaggcctccccctaccctgtgattctttcactcgagaaccattgtacattggagcaacaacgagtcatggcgaggcaccttcacgcaatactcggcccaatgctcctgaatcgcccattagacggtgtaacaaactccctgcccagtccggaacagttgaagggtaagatactgctcaaggggaaaaagcttggcggcttgctcccacccggcggtgaaggtggaccagaagccaccgtggtgtctgatgaggatgaggctgcagagatggaagacgaagctgtacgatcccgtgtgcagcacaagccgaaggaggacaagctgcggctagcccaggagctgtccgatatggtaatctattgcaaatcagttcactttggcggattcagctctcccggaacacctggccaggcgttttatgaaatggcctccttctctgagaatagagccctccgtctcctccaggaatccgggaatggattcgtaaggcataacgttggacatctttcccgtatctatcccgccggctggcgcacggactcaagtaactattcacctgtagaaatgtggaatggtggatgtcagattgtggcactcaacttccaaactccaggcccagagatggatgtgtaccagggccggttccaggacaatggggcttgcggctatgtattaaaaccagcattcctccgcgaccccaacgggaccttcaatccaagagctctagcccaaggcccttggtgggcaaggaagcggctaaacattagggtgatttccgggcaacagctgcccaaagtgaacaaaaataaaaatagcattgtggaccccaaagtcacagtggagatacatggggttagtcgtgatgtggccagtagacagacagcggttatcacaaacaacgggttcaacccctggtgggacaccgagttcgcatttgaggtagtggtaccagaccttgccctgattagatttttagtggaagactatgacgcctcttccaaaaacgattttattgggcagtcaaccatacccctcaactctctgaagcagggttacagacacgtgcacctcatgagcaaaaatggcgatcagcatccctcggctacactgttcgtcaagatctcattgcaggactag

SEQ ID NO: 128716 - DNA, 6909 bp, Artificial Sequence
  Description of Artificial Sequence: Synthetic coding sequence
atgacctccgaagaaatgaccgcgtccgttttaatccccgtgacccaacgaaaagtggtcagtgctcaatccgctgcagatgagtcctccgaaaaagtaagcgacatcaatatctccaaagcacataccgtacgccgatctggtgaaacaagtcatactataagtcaactcaacaagttaaaggaagaaccaagcggaagtaatctgccaaaaatcctgtctatcgccagggagaaaatcgtctctgacgagaacagtaatgaaaaatgttgggagaaaattatgccggactcagcaaagaacctgaacatcaactgtaataacatcctccgcaatcaccagcatgggctgccacagcgtcagttttatgagatgtataatagcgtagccgaagaagacctttgtttagaaacgggaatcccaagcccgttggaacgtaaggtgtttccgggcattcagctggaattagaccgaccaagcatgggaatttcgccgttaggcaatcagagcgtaatcattgaaacggggcgagcacaccccgactcgcggagggccgttttccactttcactatgaggtcgacaggagaatgagcgacaccttctgcaccctctccgagaatttgatcttggacgactgtggtaactgcgtgccgcttcccggaggagaggagaagcagaagaaaaattatgtagcttacacctgtaagcttatggaattggctaagaactgtgataacaagaacgagcagttacaatgcgatcattgcgacacattaaacgataaatacttttgtttcgaaggtagttgcgagaaggtggacatggtatacagcggcgactccttttgccgaaaggacttcaccgattcacaggctgctaaaaccttcctgtcccactttgaagactttcccgacaactgcgacgacgtggaggaggacgcattcaagtcaaagaaagagaggagcactttgctcgttcgtcgattttgcaagaacgaccgcgaggtcaagaaatccgtttatacaggcacaagggccatagtacgcacactccctagcgggcacatcggcctcactgcttggtcttacatagaccagaagagaaatggtcccctcttgccgtgtgggagagtgatggagcctcccagcaccgtggaaattaggcaggatggtagtcaaagactctcggaagctcagtggtacccgatatataacgcagtcagaagagaagagaccgaaaataccgtcggctctttgttacacttcttgaccaaacttcctgctagcgagacagcacacgggcgtatttctgtgggaccatgtctcaaacagtgcgttcgggatactgtttgtgagtatagggccactttgcagcggactagtatttcccagtacattacagggtcactgctcgaagcaactaccagcctaggcgcacgatcagggctcctgtcaacctttgggggatcgacaggcaggatgatgttgaaagaacggcaacctgggccatctgttgctaacagtaatgccctcccatccagttctgccgggatcagcaaggagctgatcgatttgcagcctctcatccaattccctgaggaagtcgcttcaatcctgatggagcaggaacagactatctatcggcgggtgcttccagtggattatctttgtttcctgacccgtgatctgggcactcctgaatgccagtctagcttgccatgcttgaaggcctccattagtgcctccattctgactacccagaacggagaacacaacgccctggaggatctggtcatgaggttcaatgaagtgagttcctgggtaacctggctgattctgacagctgggtccatggaggagaaacgagaggtctttagttatcttgtccatgtggctaagtgttgctggaatatgggcaactacaacgccgttatggaattcttagccggcttaaggtcacggaaggtcctgaagatgtggcagttcatggatcaatccgacattgagacaatgaggagcctcaaggacgcaatggcgcagcatgaaagtagttgcgaataccggaaagttgtgacacgggccctgcatattccaggctgtaaggtagtgcctttttgcggagtcttcctgaaggaactgtgtgaagtactagacggggcctctgggcttatgaaattgtgcccacgatataactctcaggaagagacacttgaattcgtggccgattacagcggccaggataactttttgcagagagtcggacagaatggacttaaaaattctgaaaaagaatccaccgtgaactcaatatttcaagtaattaggtcatgtaatcgatctctcgagacagatgaggaagactctccatcagagggcaactccagcaggaaaagctcgctcaaggacaaaagccggtggcagttcattatcggagacttgctcgactccgataacgatatctttgaacagagcaaagaatacgacagccatggcagcgaggattcccagaaggcattcgatcacggcacagaactgatcccctggtacgtgctgagtatccaggcagatgtgcaccagtttttactccagggcgcaaccgtgattcactacgaccaggacactcacctgagtgctcgctgcttcttgcagcttcagccagataatagcacactcacatgggtaaagcccactacagcttctccagcatcaagcaaggcgaagctcggggttctgaacaacaccgctgaacctgggaaatttcctctgctgggtaacgccggattgtcttccctgacagagggtgtgctcgacttgttcgccgttaaggccgtttatatgggtcatcccgggatcgacattcacacggtctgcgttcagaacaaactgggtagcatgtttctctccgagacaggggtgactctgctctatggactgcagacgaccgataatagattgctgcattttgtcgcgcctaaacacactgctaaaatgctatttagtggccttctggagctgacacgcgccgtgcgcaagatgaggaagtttcctgatcagaggcagcagtggctccgaaaacagtacgtcagcttatatcaggaggacggccggtacgaaggtcccacacttgcccacgccgtggaattgttcggggggcggcggtggtcggccagaaacccaagtcctggaacaagcgctaaaaacgcggaaaaaccgaatatgcagcgaaacaataccctggggatctctaccaccaagaaaaaaaagaagatactgatgcgcggcgagagtggagaggtcacagatgacgagatggctaccagaaaagcaaaaatgcataaagagtgtcggtcgcgctcaggctccgacccacaggacattaacgaacaagaagaaagcgaggtcaacgcgatcgctaatcccccaaaccccctcccaagtcgccgagcccattctctcacaaccgcgggtagccccaacctcgccgcagggacctcttctcccatccgacctgtttctagccctgtgcttagcagctccaacaagagcccctcctctgcgtggagtagcagttcatggcacggtcggatcaaaggcgggatgaagggatttcagagcttcatggttagcgactccaacatgagcttcgttgagtttgtagagctgtttaaaagtttttctgtacgatctcgaaaagacctgaaggatctgttcgacgtgtacgccgtgccctgcaaccgctccggatcagaatcagccccactgtacactaatctgacaatcgacgagaatacctctgaccttcaacccgacctggatcttctcacccggaacgtcagcgacctgggcttgtttattaagtctaaacagcagctgagtgataaccagcgccaaatcagcgatgccatcgccgcagcctctattgttacaaatgggacaggtattgagtcaacgagtttagggatcttcggggttggtattctgcagcttaacgactttctggtgaactgtcagggtgagcattgcacatacgacgagattcttagcataatacagaaatttgaaccgagcatttccatgtgtcaccagggactgatgtcattcgaaggctttgcccggtttctcatggacaaggaaaactttgcctcaaagaacgatgagagccaagaaaatatcaaggagctgcaattacccctctcttattattatattgagagcagccataacacctacctcaccggccaccagctcaagggcgaatcgagcgttgaactgtactcccaagttttactgcaggggtgtcgctccgtggagctggactgctgggacggggacgacggaatgccgattatctaccacggtcataccctcaccacaaagattccttttaaagaggttgtggaggctattgacagaagcgctttcatcaacagtgatttgccaatcattattagcatcgaaaatcactgctcactgccccagcagcgtaagatggccgagatatttaagactgtgtttggcgagaaactggttactaaatttctgttcgagaccgatttcagcgacgacccaatgctgccttcaccggaccaactcaggaagaaggttctgttgaagaataaaaagctgaaggcgcaccagactcctgtcgatatccttaaacagaaagctcaccagttagcctctatgcaggtccaagcttacaatggtgggaacgccaatccccgacctgccaataacgaagaggaggaagacgaggaagacgaatatgactacgactacgaaagcctctcagacgataacatcttagaagaccgtccagaaaacaaatcctgcaacgacaaacttcagtttgagtacaatgaggagatccccaaacgcatcaagaaagcagataattctgcttgtaataaagggaaagtgtatgacatggagttgggagaagagttctatctcgatcagaacaagaaggagtccaggcaaattgcccccgaactctctgatcttgtaatatattgtcaggccgtcaaattccccggtctgtctacactgaacgccagcggcagctcccgtggaaaagaacgaaagagcaggaagtccatcttcggaaacaaccctggacggatgtcgccaggtgaaaccgcttccttcaacaagacatccgggaaaagttcatgcgagggcattcggcagacctgggaggagtccagtagcccactgaatcctaccacctctctcagtgcaattattcgcacccctaagtgctaccacataagttccctgaacgaaaacgctgcaaaacgcttgtgtcggcgatactctcagaaactaactcagcatacagcatgtcagttactgcggacctacccggcggcaacaaggatcgatagctccaaccccaaccccctgatgttctggctccacggtatccagttagtagcccttaactaccagactgacgacctgcctctacacctcaacgccgcaatgtttgaggctaacggcggttgcgggtacgtgctcaaacccccggtcttgtgggataaaaattgccccatgtaccagaagtttagcccactcgagagagacttagattccatggatccagccgtatattccctgactatcgtgagcggacagaatgtctgtccctctaattctatgggtagcccttgtatcgaggttgacgttctgggcatgcctctggatagctgtcatttcagaactaagcctatacatagaaataccttgaatcccatgtggaatgaacagttcctcttccacgttcattttgaggacctggtcttcttgaggttcgcagttgtcgagaataattcctccgccgtcacagctcagcgaatcattccactgaaggctttgaagaggggctatagacatctacaactgaggaacctgcacaacgaggtgcttgagatctcctccctttttatcaactctcgacgaatggaggaaaatagctccggaaataccatgtctgcgagtagtatgtttaacacggaggaacgcaaatgtctccagacccaccgcgtgacagttcacggagtccccggcccagagccatttacggtcttcactattaatggagggacaaaggctaagcagctgcttcagcagattcttactaatgagcaagacatcaaacccgtcacgacggattactttttaatggaggagaagtactttatatccaaagaaaagaacgaatgtaggaaacagccattccagcgcgccattggacctgaggaggagattatgcagatcctgagttcctggttccctgaagaaggttacatggggcgaatcgtcttgaaaacacagcaagaaaacctcgaagagaaaaatatcgtgcaagatgataaggaagttattctgagctcagaagaggagtcattctttgttcaggtccacgatgtatcacccgaacagcccaggactgtgattaaagcccctagggtgtccacagcacaggacgtcatccagcagaccctatgcaaggcaaagtattcttattcaatcctcagtaacccaaatcccagcgattacgtgttgctggaggaagtggttaaggacaccacaaataagaaaaccaccacaccaaaaagctctcagagggtgctactggaccaggagtgcgtcttccaggctcaatcaaagtggaaaggggccggtaagtttatcctgaagctgaaagaacaggtgcaggcatcccgcgaggataagaagaagggtatcagtttcgcttccgaactcaagaagctgacgaagagtaccaagcaacctcgtgggctgaccagcccgtctcagcttcttaccagtgaaagtattcagacaaaagaggagaagcctgtcggtggactgagctcctccgataccatggactacaggcagtag

SEQ ID NO: 128717 - DNA, 5985 bp, Artificial Sequence
  Description of Artificial Sequence: Synthetic coding sequence
atggttagtgaaggcagtgctgctggcagagattttgctggaatggaggaggtcagacaactgcacgttcgtttttgcaaggggattaagatctggcaccaagcttggtttctgtgcagcctgctggggcgagagccgcaggagcgagaggcaggatgccaattatggctttgtactctgtctgctgtgctgaaggtgggctggctgttccccctgtcagaggtccctaactttacactgcttaaggatggctgtgggtgttggcgtctgaaagaagatcagatttacaatgcggtcagaagggaagagactgagaacaccgtcgggagccttctgcatttcctcactaagttgccagcttctgaaacggcgcacgggcggatttctgtaggtccttgtctcaaacagtgcgtgcgcgataccgtttgcgagtatagagctaccttgcagcgaactagcatctctcagtacattacgggctctttgctggaagccacgacatcgctaggggcccgctcggggctcctctctacatttggcggaagcactggtcgcatgatgctgaaggaaaggcagcccggaccctccgtcgccaacagtaacgctctcccttcttccagtgcaggaattagtaaagagctcatcgacctgcagcccctgattcagtttcctgaagaggtcgcttcaatcctgatggaacaggagcaaaccatctatagacgggtgctgcccgtggattatctatgtttcctgacgcgtgacttgggaaccccagaatgtcaatcttctctgccatgtttaaaggcgagtatctctgcttccattctaacaactcaaaacggcgaacacaatgccctggaggaccttgtcatgagattcaacgaagtgtcatcttgggtgacatggttgatcttaactgctggaagcatggaggagaagcgcgaggttttttcgtacctggtacatgtggccaagtgttgttggaacatggggaattataacgccgtcatggagttccttgcgggcctgagaagtcgtaaagtgctgaagatgtggcaattcatggatcagagtgatatagagaccatgcgatcactgaaggatgcaatggctcaacatgaatccagctgcgaatacagaaaggtggtcacaagggcgctacacattccgggatgtaaggtcgtccccttctgcggcgtcttcctcaaggagctgtgtgaggtgctggacggcgcgagcggactgatgaaactgtgtccacgttacaattcccaggaggaaacactcgaattcgtggcagactattccggccaggacaatttcctgcaacgcgtcgggcagaatggcctcaagaatagtgaaaaggagtccacagtgaattcaatctttcaagtgataaggtcttgtaacaggagtttggagaccgatgaagaggattcccccagcgaaggcaatagctcccggaagagctcattgaaagacaaatcccggtggcagtttataatcggtgatctcctcgactctgataacgacatctttgagcagtctaaggagtacgattcccatggatcagaggactcacagaaagcttttgatcatggcaccgagctaattccctggtacgttctaagtatccaggccgatgttcaccagtttttactgcaaggggcgacagtcatccattacgatcaggatacgcacttaagcgctcgatgttttttacaattgcagcccgataattctacactgacctgggtgaaaccaacaacagccagcccagcgtcatcaaaagccaaactgggtgtcttaaataatacagcagaaccgggcaagttcccactgttgggcaatgccggtctgtctagtctcactgaaggagtgctagacctcttcgcggtgaaggctgtgtacatgggtcatcccggaattgacatacatactgtttgtgtgcaaaataagcttggtagcatgtttctgagcgaaacaggggtcacattgctgtatggtctacagacaactgacaatagactcctgcacttcgtagccccaaaacacacagccaaaatgctgtttagcggtctgcttgagctgaccagagccgtgcgaaaaatgcgcaaatttcctgaccaaagacaacagtggcttcgtaagcagtacgttagcctgtatcaggaggatgggcgttacgaaggccctactttagctcacgccgtggagcttttcggcggcaggagatggtccgctagaaatcccagtcccggtactagcgccaagaatgctgagaagcctaacatgcagagaaacaatactctgggcatcagtaccaccaagaaaaagaaaaagatacttatgaggggagagtctggggaagtcacagatgacgaaatggctacccggaaagcgaagatgcataaagagtgccgaagcagatccggctcagatcctcaggacatcaatgaacaggaggagtctgaagtcaatgcaattgcaaatccacccaaccctttaccttcacgtagagcccattctctgacgactgctgggtctcctaatctggctgcgggcacgtcctcccccataagacctgtgagcagtcctgttctgtcatccagtaataagagcccgagttctgcctggtcatcaagcagttggcacggccgaatcaagggtggtatgaaggggtttcaaagctttatggtctccgattccaacatgagttttgtcgaattcgtggaactcttcaagtcattctccgttagatccagaaaggacctcaaagacctgtttgacgtctacgccgttccttgcaatcgaagcggcagcgagtccgctcctctctatactaatttgactattgatgaaaatacgagcgaccttcagcccgaccttgaccttctgacaaggaacgtctctgacctgggcctctttattaagtctaaacagcaactgtctgataaccagcggcaaatatcggatgctattgccgccgcttctattgtcaccaacgggacgggaatcgagagtacgagtctgggcatcttcggagtcggtatactgcagttgaacgattttctggtgaattgccagggcgaacactgcacctatgacgaaatactaagcatcatccagaagtttgagccatccattagcatgtgtcatcaaggcctcatgagttttgagggcttcgctcggttcctcatggacaaggaaaattttgcgagtaagaatgacgagagtcaggagaacatcaaggagctgcaactgccgctttcctactactatatcgaatcttcacataatacatatctgactgggcaccagttgaagggcgagtctagtgttgaattgtacagtcaggtgctgctgcagggctgcagatcagtcgagctggactgctgggatggagacgacggcatgccaatcatctaccacggccacacccttaccactaagatccctttcaaggaggtcgtagaggccatcgacaggagcgccttcattaactccgatctgcctattataattagcatcgagaatcattgctcgcttccacaacagcgcaagatggccgaaatcttcaaaactgtgttcggagagaaacttgtcaccaagttcctctttgaaacagattttagtgacgacccaatgctgcctagtcctgaccagcttaggaagaaggttctgcttaaaaacaagaagctgaaagctcatcagaccccagtggacattctgaaacagaaagcccaccagctcgcaagtatgcaggttcaggcttataacggcgggaatgccaaccccaggcccgctaacaacgaggaagaagaggacgaggaagatgaatatgattatgactatgagtccttgagtgatgacaacattttagaagaccgccctgagaataagtcgtgcaacgacaaactgcagtttgaatataatgaagagataccgaaacggatcaaaaaggccgacaattccgcctgcaataagggaaaagtatatgacatggaactgggggaggagttctatttagatcaaaataaaaaggagtcaagacagattgctcctgagctaagcgatcttgtgatttattgccaggccgtgaagtttccaggtttaagcacgttgaatgcctctggcagctcacgtggtaaagagagaaagagcaggaagagcatctttgggaataatccaggcaggatgtctcccggggaaacggctagtttcaataagacgagcggtaaaagcagctgcgagggcattcgccagacttgggaagagtcaagctcccctttgaatcctaccacatcactcagcgccatcatcaggacaccaaagtgctatcatatctcatccctgaatgaaaacgcagccaaacggctgtgccggcggtactcacagaagctcacccagcatactgcctgccagcttctgcgaacctaccctgccgctactcgtatcgattcgtccaaccccaacccgctcatgttctggctgcatgggattcagctcgtggctctcaattatcagaccgatgatctaccgctacatctcaacgctgctatgtttgaagccaatggaggctgtgggtacgtgttgaagcccccggtgctgtgggacaagaactgtcccatgtaccaaaaatttagccccttagagcgtgacctggacagtatggacccagccgtgtacagtctgacaatagtctcaggccagaatgtctgcccctcaaacagcatgggctctccttgtattgaggtcgatgtgctgggaatgcccctcgactcatgccatttccgtactaaacccattcaccgcaataccttgaatcccatgtggaatgagcagtttctgttccatgtgcactttgaagatctggtctttctgcgctttgctgtggttgaaaacaatagttcagcggtgacagcccagagaatcattccattgaaagccctgaaacggggctatcgtcatctgcagctacggaacttgcataatgaagtgctggaaattagtagcctctttatcaatagtcgacgcatggaggagaatagcagtggaaacacaatgtcagccagctccatgttcaatactgaggagaggaaatgtctccagacacacagggttacggtccatggagtgccgggaccagagccattcacagttttcacgatcaacgggggaacgaaggccaagcagcttctgcaacaaatacttacaaatgagcaggatatcaagcccgtaactactgactactttctgatggaagaaaagtatttcatttctaaagaaaagaatgagtgtagaaagcaaccattccaaagagcaataggacccgaggaggaaatcatgcagattctgtcctcgtggttccccgaagagggatatatggggagaatcgtcctgaaaactcagcaggagaacctcgaagaaaagaacattgtacaagatgacaaggaggtgatcctttcctccgaagaggagagtttttttgtccaagtgcacgacgtctcacccgaacaacctagaacggttatcaaggcccccagagttagtaccgcgcaagatgtgatccagcaaaccctctgcaaggctaaatactcatactctattctgagcaatccaaatccgtcagactatgtattgctcgaagaggtagtgaaagatactactaataagaaaaccaccacaccgaagagtagccaacgcgttctgctggaccaggaatgtgtctttcaggctcagagtaagtggaaaggggctggaaaattcattctgaaactgaaggagcaggtgcaagcatcccgggaggataagaaaaagggcatttctttcgcttccgagcttaaaaaactcaccaagtcgaccaagcagccccggggcctgacctccccaagccagctgctgacttctgagtccattcagacaaaggaagagaagcccgtaggcggactaagcagctcggacacaatggactacagacaatag

SEQ ID NO: 128718 - DNA, 6939 bp, Artificial Sequence
  Description of Artificial Sequence: Synthetic coding sequence
atgacttcggaggagatgaccgctagtgttcttatacctgtcacccagcgtaaggtcgtgagtgcccagagcgccgcagacgagtcctctgagaaggtgagtgacattaatatttccaaagcccacaccgtgaggagatccggggaaacttcccacacaatttcacaactgaacaaactcaaggaagaaccatctggctccaacctgccgaagattctgagtatcgcgagggagaagatcgttagtgacgaaaattccaacgagaagtgttgggaaaagatcatgcctgactctgcaaaaaatctcaacataaactgcaataatatacttagaaaccatcaacatggactgccacagcgacagttttatgagatgtataattccgtcgcagaggaagatctgtgtttggaaactggcatccccagtccactggagcgaaaagtattcccagggattcagttagagctggaccgcccttccatgggaatcagtccccttggaaatcagagcgtgattatcgaaacaggtcgcgcgcatccagattctagacgggcagtgttccattttcactacgaagtcgataggcgcatgtcggacacattttgcacactgagcgaaaacctgattcttgacgattgtggtaactgcgttccactgccggggggggaggaaaagcagaaaaagaactacgtggcttacacctgtaaactcatggaactggcgaaaaactgtgacaataagaatgaacaactgcagtgtgaccattgcgacacactcaatgataagtacttttgctttgaagggagctgtgagaaggtcgatatggtgtacagcggagacagcttctgcaggaaggactttacggattcacaggctgccaagacattcctgagccattttgaggacttccctgacaactgtgatgatgtggaagaggatgccttcaagtctaaaaaggaaagatctactttactggtgcggagattttgtaaaaacgatagagaggtgaaaaagagtgtgtataccggtaccagggccattgtccgaacactgccgagcgggcatatcgggttaaccgcttggagttatattgatcaaaagaggaatggtcccctgctgccttgcgggagagtgatggaacctcccagcactgtggagattcggcaggacggcagccagcgtctgtcagaggcgcagtggtacccaatatataatgccgtgcgtcgcgaagaaaccgaaaacactgtcggctctctcctccattttctgaccaagctgccagcctccgagactgcccatggccgaattagcgtagggccttgcctgaagcagtgtgtgcgggacaccgtttgcgagtatcgagctaccctgcagcgcactagcatcagccagtacattaccggcagcctgctcgaagccacaacatctctgggagctagaagcgggctgctctctacattcggaggctctaccggtcgaatgatgctgaaggaacgacagccagggccctctgtcgctaactctaatgccctgccttctagttcagcaggcatatccaaggagctgatcgacctgcagcctcttatacagttcccagaggaagtcgcctcaatcctaatggagcaagagcagacaatttatcggcgtgtgttgcctgtggactatctctgctttctgacacgcgacctgggtacaccagagtgtcagtcatctcttccctgcttaaaagccagcatcagcgcttccattctcacaacccagaacggggaacataatgcactagaggacctcgtgatgcggtttaacgaagtgagtagttgggtgacttggttgatcttgaccgccggctctatggaggagaaaagggaagtttttagttatctggttcatgtggccaagtgctgttggaacatgggaaactataacgcagttatggaattccttgccgggctccgctcacgaaaagtgctgaaaatgtggcagttcatggatcagagcgatattgaaacgatgaggtcactgaaggacgctatggcgcagcacgaatcaagctgtgaatatcggaaggtggtgacacgcgctctgcacatcccagggtgtaaagttgtgcctttttgtggtgtttttctgaaagagctctgcgaggtcctggatggagcaagcgggttgatgaagctgtgtccgagatataattcacaggaagagacgctagaattcgtggctgactattcggggcaggacaacttcttgcagcgagtgggtcagaatggtctgaaaaactcagagaaggagtccaccgtcaactccatctttcaagtgataaggtcatgcaaccgatcacttgagaccgacgaggaggattcgccatccgaggggaactcttcccgaaagtcgagtctgaaagacaagagccggtggcagtttattattggagacttacttgatagtgacaacgatatttttgagcagtcaaaggagtacgactcccacggcagcgaggactctcagaaggcatttgaccacggaacagagctgattccctggtatgttttgagcatccaggcagacgtccatcaatttctccttcaaggcgcaaccgttattcactacgaccaggacacacatctgagcgcacggtgctttttacagttgcaacctgataacagcactctgacctgggtgaagccaacaacagccagtcccgcctcatcaaaggccaagctgggcgtcttgaacaacaccgcagaaccaggtaagttccctctgctggggaatgccggtctgtcttccctcacggaaggggtgctcgatttgttcgccgtcaaagcagtctacatgggacacccaggtatcgatatccataccgtctgcgtacagaataagctggggtcaatgtttctatcagagacaggcgttacactgctatacggcctgcaaaccaccgacaatagactgctgcacttcgtggccccaaaacacactgcgaagatgctgttcagcggactgttggagttgacacgggctgtgagaaagatgcgaaaattcccagatcagcggcagcagtggctcaggaagcaatatgtatcgctctaccaggaagacggacggtacgaaggacctacactggcacatgctgtggagctttttgggggccggaggtggtccgctaggaatccctcgccaggaacaagcgcaaagaatgctgagaaaccaaacatgcaaaggaataacacactgggaattagtactactaagaaaaaaaaaaagatactcatgcgcggcgaatctggagaagtgacagacgatgaaatggccacccggaaggccaagatgcataaagagtgcaggagcaggagcggcagtgacccccaagacatcaatgagcaggaagagtctgaggtgaatgcaattgcgaatcccccaaaccctctgccttccagacgggctcatagcctgaccaccgcaggaagccccaatcttgctgccggcacatcatcaccaatacgccctgtttccagcccagtgctgtcaagctccaacaagagtccgagcagtgcgtggagctcatcgtcctggcatggtcggattaaaggcggcatgaaagggtttcagtcatttatggtgtctgatagtaatatgagctttgtagaatttgtagaattattcaaaagcttctcagttcggtcaaggaaagatctcaaggacctgttcgatgtgtacgccgtaccttgtaataggtccgggtccgaatccgcccctctctatactaaccttacaatcgatgagaatacctcagatttacagccggacctcgacctgctcacgaggaacgtcagcgatctgggactgtttattaaatccaagcagcagctgtccgacaatcagaggcagatttcagatgcaattgccgcagccagtatcgttactaacggtaccgggatcgaaagcacctctttgggtatctttggggtcggcatcctccagctgaacgactttctggttaattgccagggcgagcactgcacttacgacgaaatcctgtctatcatccagaaattcgagcctagtatctcgatgtgtcatcaaggactgatgagtttcgagggcttcgctaggtttctgatggataaggaaaattttgcatcgaaaaatgacgaaagccaggagaacattaaggagttgcagctccctttatcctactattacattgaaagctcacataatacctacctgaccggccatcagctcaagggggaaagtagtgtagagttgtactcccaggtgctgctccagggttgcaggtccgttgagttggactgctgggatggggatgacgggatgccaatcatttaccacggccatacgttgactactaaaattcccttcaaggaggtggttgaagccatcgatcgctcagcttttataaacagcgacctgcccatcatcatctctatcgaaaatcattgcagccttccacaacagaggaaaatggccgaaatcttcaaaactgttttcggagagaagctggtcaccaagtttcttttcgagaccgattttagtgatgatcccatgctaccctcccccgatcagctgaggaagaaggttctgttgaagaataaaaagcttaaagcacaccaaacaccagtggacatccttaagcagaaagcccaccagctggccagcatgcaggtccaggcctataatggtggaaatgccaaccccagacccgcaaacaatgaagaagaagaagatgaggaggatgagtatgactatgactatgaaagcttgagtgatgacaacattctggaggataggcctgagaacaaaagctgtaatgacaaacttcagtttgagtataatgaggagataccaaaaagaattaagaaagctgacaacagtgcatgtaataaggggaaagtatatgacatggaactcggggaagagttctacctggaccaaaacaagaaagagtcccgccagatcgctccagaacttagtgacttagtgatatattgccaggctgtaaagtttcccggcttgtcaacattaaatgcctcaggttccagtaggggaaaggagcgcaagtctagaaagtctatcttcggcaacaatcccgggaggatgtcccctggcgagaccgcctccttcaataaaacctctgggaaatcatcgtgtgagggcattcggcagacgtgggaggaatcttcctctcccctgaaccccaccacttctctgtcagctatcatccgaactccaaaatgttaccatattagttccctgaatgaaaatgctgcgaaacgcttgtgtcggagatacagtcagaagttgacacaacataccgcatgtcagcttctgaggacctatcctgccgccacacggatcgattcatctaacccaaaccctcttatgttctggctccacggaattcagttagtggccctcaattatcagactgatgacctgccactccacctgaacgccgcaatgttcgaagccaacggagggtgcggatacgtcctgaagcccccggttctgtgggacaaaaactgtcccatgtatcaaaagttttctccgctagagcgcgatctcgatagtatggaccccgccgtctattctcttaccattgtgtctgggcagaatgtgtgcccttcgaatagcatgggatcaccatgcattgaagttgacgtgctgggcatgcctcttgacagttgccattttcggacgaaaccaatccaccggaatacactgaacccaatgtggaatgaacaatttctgttccatgtacacttcgaagatttagtgttccttagattcgccgtggtggaaaacaatagtagtgcagtcaccgctcagcggatcatcccactgaaggcattgaaacgcggatatcgacacctccagcttcgcaatctccacaatgaagtactcgagatttcttctctgtttatcaacagccgacggatggaggagaattcttctggaaatactatgtccgcctcatcaatgttcaacacagaagaacgaaagtgtttgcagactcatcgggttacagtgcacggtgtgccggggcctgaaccattcaccgtgttcaccataaatggaggcactaaggcaaaacagctgttgcagcagatactgaccaacgagcaggacattaagccagtgaccactgattacttcttgatggaagagaagtactttatctctaaggaaaagaacgagtgccggaaacagccattccagcgggctattggccccgaggaagaaataatgcaaattctgagttcttggttcccagaggagggctacatgggccgcattgtgctgaagactcagcaggagaacctggaggagaagaacatcgtgcaggatgataaggaggtgattctgtcctcagaggaggagagtttcttcgtccaagtccatgatgtgtccccagagcagcctcgtacagtcatcaaagctccaagagtgtcgaccgcccaggatgtgatccaacagaccttgtgtaaggctaagtacagctacagcatattgagcaaccccaacccaagtgactacgtgctgctggaggaagttgttaaggacactaccaacaaaaaaactactacaccaaagagctcacagcgcgtgctgctcgaccaggaatgtgttttccaggcccaatcgaaatggaagggggccggcaaatttatcctgaaactgaaggaacaggtccaggcaagcagagaggacaaaaagaaaggcatctcattcgcctctgagctgaaaaagctcacaaaatcgaccaagcagccacgcggattgacgtctcccagtcaactgttaacctctgagtctatccagactaaagaagagaaacccgtggggggacttagctctagtgacacgatggactatcgccaggtgaaaatctttaagcaggaagtgaaggaatag

SEQ ID NO: 128719 - DNA, 5985 bp, Artificial Sequence
  Description of Artificial Sequence: Synthetic coding sequence
atggtgagcgaaggctctgccgcaggccgggacttcgcgggcatggaagaagtgagacagctacatgtgaggttttgtaaggggatcaagatatggcaccaggcctggttcctgtgcagcctcctagggagggagccccaggagcgagaggcaggttgtcagctgtggctgtgcactctttctgccgtgctaaaggtgggctggcttttccccctgtctgaggtgccgaattttacgctcttgaaagatggatgcggttgctggaggctgaaggaggaccagatttataatgctgtccgtagggaggaaacggagaatacagtggggagcttgctgcacttcctgacaaagctgcccgccagtgagacggctcacgggagaatttccgtcggcccctgtctgaagcagtgtgttcgcgacactgtgtgcgaatacagagcaaccctacagcgaactagcatcagtcagtacatcactggaagtctgctcgaggcgaccacctctctaggtgccaggagcgggttgctcagcacatttggcggcagcacaggcaggatgatgttaaaagaacggcagcctggaccatcagtggccaatagtaatgctctcccgtcatcttctgccggcattagcaaggagcttattgacctgcaaccactgatacaattccctgaggaggtcgctagcatcctgatggagcaggaacagaccatctacagaagagttttgccagtagactatctctgctttcttaccagagaccttggcacacccgaatgtcagtcgtctctgccatgcttgaaagcctcaatatctgcctcaattctgacaacccaaaacggggagcataatgccctggaagacctcgtgatgagatttaatgaggtatcgtcttgggtgacctggctgattctcactgctggctctatggaggaaaagagggaagtgttctcctatttagtccacgtggcaaagtgctgttggaatatgggtaattataatgccgtgatggagtttttggccggattacgcagtcgaaaggtccttaaaatgtggcaattcatggaccagtcagatatcgaaaccatgagaagtctgaaggacgccatggcacaacacgaatccagttgcgaatacaggaaggtagtcaccagagccctgcatatcccaggttgtaaagttgtcccgttttgcggggttttcctcaaagaactctgtgaagttctggatggggctagcggcctgatgaaattatgtcccagatataacagtcaggaagagacccttgagtttgtggctgactactcaggccaagacaacttcctacagagggtgggacagaacggtctgaaaaattctgagaaagagagcactgtaaactcaatttttcaggttattagatcatgcaatagatccctagaaacggatgaagaggatagcccaagtgagggtaatagctcacgtaagagctctcttaaagataagagtaggtggcagttcattatcggcgatctgctcgattcagacaatgatatctttgaacaatccaaggagtatgactcccatgggagtgaagatagccaaaaggctttcgaccacggaacagagctgattccgtggtatgtgctgtctatccaagccgacgtccaccagtttctcttgcagggcgcgaccgtcattcactacgatcaggacacccatctctccgcccggtgttttttacaactgcagcctgacaacagcactctgacatgggtgaagcctaccacagcctccccagcctcatccaaagcaaagctcggagttctaaataacaccgccgagccgggcaaatttccactcttagggaatgccggactctccagtttgacagaaggtgtgctcgatctcttcgcagtcaaggctgtgtacatgggccacccaggcattgatatccacactgtgtgtgtccaaaacaaattgggctccatgttcctatcagagactggtgtgacactgctgtacggactccagacgacagacaatagactgctgcattttgtcgcacccaagcataccgcaaaaatgctcttttccggcttacttgagctgaccagagctgtgcgaaagatgcggaagtttccagaccagcgtcagcagtggctccggaagcaatacgtatcactatatcaggaagacgggcgctacgaggggccaacactggcgcacgcagttgaactgttcggcgggcgccgatggagcgcccgaaaccccagtcctggaacaagtgccaaaaatgccgagaaacccaacatgcaaagaaacaacacactagggatttcgaccactaaaaaaaaaaagaagatcctgatgcgaggcgagagcggagaggtgaccgacgatgaaatggctaccagaaaagccaagatgcataaggagtgtcggtcccgatccggctcagatccacaggatatcaacgagcaagaggaaagcgaagtgaatgctattgccaatccacctaatccgctcccgtctcggcgggcccactcactaaccaccgctggttctcccaatctggccgccggcaccagctctcccatcaggccagtgtcctcccctgttttgtcctcctctaataaatctccgagcagcgcctggagttcttcttcatggcacggtagaatcaaggggggaatgaagggcttccagtcttttatggtgtctgatagcaatatgtcattcgtggaatttgtggagttgtttaagagttttagtgtgcggtcccgcaaagatcttaaagatttattcgatgtatacgcagtgccatgcaaccgcagtgggagtgaatccgctccgttgtacaccaatttaactattgacgagaataccagcgacctccagccagatctggatctcttaacgcggaatgttagtgacctcggcctattcattaaatcgaaacagcaattgagtgacaatcaaagacagattagcgacgcgatagcagccgccagtatcgtgaccaatggcactggaatcgaatccacatcactgggaatcttcggggtcggtattctacagctgaacgactttctggtgaactgccagggtgaacattgtacctacgacgagatcctgagcattattcagaagtttgaaccctccatctctatgtgccaccagggactcatgagcttcgaaggcttcgcgagattcttaatggataaggagaactttgcatcaaagaatgatgagagccaggaaaatatcaaagagttgcagctccctctttcctactactatattgagagcagccacaacacctaccttactggtcatcaactgaaaggggaatcttcagtagagctatacagccaggttttgctgcagggttgccgcagcgtggagctggattgctgggacggtgatgatggtatgccgatcatctaccacggccataccctcaccacaaaaatcccattcaaagaagtcgtcgaggcgatagaccgaagcgccttcattaactccgatcttcctataattatttccattgaaaaccactgtagtctgccccagcagcggaagatggcggagatctttaaaacagtctttggcgagaaactagtcaccaagttcctgtttgagaccgattttagcgacgaccctatgcttccttctcctgaccagctccggaaaaaagtgctactgaagaacaagaagttgaaggcccaccagacacccgttgacattctaaagcagaaagcccaccagctggcatcaatgcaagttcaggcatacaatggcggcaatgccaatcccagacccgccaataacgaagaggaggaagacgaagaggatgagtacgactatgattatgaaagcttgtcggacgataatatcttggaggatagacccgagaacaagtcctgcaacgacaaattgcagtttgaatataatgaagagatcccgaagcgcatcaaaaaggcggataacagcgcctgtaacaagggcaaggtgtatgacatggaactgggagaggagttctacctagaccagaataagaaggagtctagacagattgcgcctgagctgtcggatcttgttatttattgtcaggccgtgaaatttcccgggttatccaccctgaacgcaagtggtagctcccgaggcaaagaacgaaaaagtcgtaaatctatcttcggcaacaatccaggtagaatgtcccctggagagacggcctcatttaataagacgagcggcaaaagctcttgcgaagggatacgacagacctgggaggagtcgtcttcacctttgaaccccacaacctctctgagtgcaattattaggaccccaaaatgttatcacatctcgagcctgaatgaaaacgctgcaaagaggttatgtaggcgatatagccagaaattaactcaacacacagcctgtcagttgctccgaacgtatcctgctgctacaaggattgattccagcaaccctaatccattgatgttttggcttcacggcattcagctcgtggctcttaactaccagactgatgaccttccactacatctaaacgccgccatgttcgaggcgaatgggggatgcggctatgtcctcaaaccgcccgtcttgtgggataagaactgtcctatgtaccagaagttttcccctcttgaacgggatttggactctatggacccggccgtgtattctttgacaattgtaagcggccagaacgtctgtcccagtaatagtatggggagcccttgcatcgaggtggatgtattagggatgccactggactcctgccattttcgaaccaagccgatccataggaatacactcaaccccatgtggaatgaacagtttctctttcacgtgcactttgaggatcttgtgtttctccgcttcgcggtcgttgagaacaacagttctgccgtcacagcccagcgcatcatccccctgaaagccctaaagcggggttaccgacacctacaacttcggaatctccataacgaggtacttgagatctcctcactgttcataaattctagaaggatggaagagaacagtagtggaaataccatgtcggccagctccatgtttaacacagaggagcgtaagtgtctgcagacccacagggtgacggtccatggtgtgccagggcccgagcctttcactgttttcacgataaatggcggcaccaaagcaaagcagctcctgcagcagattcttaccaatgagcaagatattaaacctgtgaccactgattactttctaatggaggagaagtacttcatctccaaggaaaaaaacgagtgtcggaagcagccttttcagagggcgattgggcctgaagaggagattatgcagatcctgtctagttggtttccagaggagggctatatgggccgcatcgtgcttaagactcagcaagagaacctcgaagagaaaaacatcgtgcaggatgataaagaggtgattctgtcctcagaggaagagtcattttttgtccaggttcatgacgtaagccctgagcagcctcgcaccgttatcaaagccccaagagtgagtacggcacaggatgttattcaacagactctgtgtaaagcgaagtatagctacagcattctatccaacccaaaccccagcgactatgtcctgctcgaggaagtggtgaaagatactaccaataagaaaactacaactccgaaaagctcccagcgcgtcctgctcgatcaggaatgtgtctttcaagcgcagtccaagtggaagggcgcaggcaaatttatcttgaaacttaaagagcaagtgcaagcctctcgtgaggacaaaaagaagggcatcagctttgcctcagagctgaaaaagctcaccaaatcaactaagcaaccaagaggtctgacctcccccagccagctgctcacctctgagagtatccaaactaaggaggagaaacctgtcggaggtctgtcatctagtgacacaatggactacaggcagtag

SEQ ID NO: 128720 - DNA, 4968 bp, Artificial Sequence
  Description of Artificial Sequence: Synthetic coding sequence
atgtccgtgatgcaatcaggtacacagatgatcaagttaaaacggggcaccaaaggtctggtgaggctgttctaccttgacgagcatcggacgcgcctgcggtggcgcccttcccgtaagagcgaaaaagctaagatcctcatagattccatttataaagtcaccgaaggtcgtcagtctgagatttttcacagacaagccgaaggaaacttcgaccctagctgttgtttcacaatataccatggcaaccacatggagtctttagacctgattacttccaaccccgaggaggcccgcacctggattacaggcctcaagtatcttatggccgggattagtgatgaggactctctcgcaaaacgtcagcgcacccatgatcagtgggtcaaacagaccttcgaggaggccgacaaaaatggcgacggcttgctgaatatcgaggagatccaccagttaatgcataaactgaatgtgaacctcccaagacgaaaggtgcgtcaaatgttccaagaagcggacacggatgagaaccaagggaccctgacttttgaagaattttgtgtgttctataaaatgatgtctctgaggagggatctctaccttctcctgctcagttactctgataagaaagatcatttgacggtggaagagcttgcccaatttcttaaggtggaacagaaaatgaataatgttaccacagattattgcctggacattatcaaaaaattcgaagtgtccgaagagaacaaagtgaaaaacgtgctgggcatcgagggattcacgaatttcatgagatcaccggcctgtgacatctttaaccctctgcaccacgaggtctaccaggacatggaccagcctttgtgtaactactacattgcgtccagccataatacgtacctgacaggagatcagctgctgagtcaatctaaggtcgacatgtatgcccgcgtgctccaggagggatgtaggtgtgtagaggtagactgctgggacggccccgatggcgaacccgtggtgcaccacggctacacactcaccagcaaaatactttttcgcgatgtcgtcgaaactatcaataaacatgctttcgtaaagaatgaatttcctgtgattctgtcgatcgagaatcattgcagcatccagcagcaaaggaaaattgcccagtatttgaaaggaatttttggagacaagctcgacctgagttctgtggataccggagaatgcaagcagctgccttcaccccaatctctgaagggtaagatacttgtgaagggcaagaagctcccatatcatcttggcgatgacgccgaggaaggggaggtcagcgacgaagatagcgccgatgagatcgaggacgagtgcaagtttaaactgcactactctaacgggaccacagaacatcaggtggaatcctttatcagaaaaaagttagagagtctgcttaaggagtcccaaattcgtgacaaagaagatcctgattcctttactgtgagagcgctgcttaaagctacccatgaaggcctaaatgctcatcttaaacaatcacccgacgtcaaagagtccggcaagaaatcacatggtaggtctctgatgactaactttggtaagcacaagaaaactaccaaatctcggagcaaaagttacagcaccgacgatgaagaggacactcaacagagcacagggaaggaaggcggacagctttaccgcctagggcggcgtagaaagaccatgaaactttgtagagaactgagtgatctggtggtatatacgaactcagttgccgcccaggatatagtggatgacggtactacaggcaatgtgctgagcttttccgagacccgcgcacaccaggtggtacaacagaagtcagaacagtttatgatttataaccaaaaacaactcacacgtatctacccttctgcctatagaattgacagtagcaattttaatcctctgccatattggaatgcggggtgccagctcgttgcccttaactaccagtcagaagggcgaatgatgcagctcaacagggctaagtttaaggcgaacgggaactgcgggtacgttctgaagccgcagcagatgtgcaaaggcacgtttaatccttttagcggggacccactgcccgcaaatcccaaaaagcagctgatcctcaaagtgatttccggccagcagctgcccaagccacctgattccatgttcggcgaccggggagaaattattgaccctttcgtggaagttgagattatcggcctgcctgtcgattgttgcaaggaccagactcgggtggtggatgataatggattcaatcctgtctgggaagagacattaactttcacggtgcatatgccagaaatcgcactggtcaggtttttagtctgggaccacgatcccattggcagagatttcgtgggtcagagaaccgttacattcagctcattagtacctggctaccgccatgtgtaccttgagggtctaacggaagcaagcattttcgtccacattacaataaacgagatttatggaaaaaaccggcagcttcaaggactgaaggggctgtttaataaaaaccctcgccattcaagctctgagaataacagtcattacgtgcgaaaaaggtcaatcggagataggatcctaaggaggactgcctcggccccagctaaaggaaggaaaaagtccaaaatgggctttcaagaaatggtggaaatcaaagattccgtatccgaagctaccagagaccaggacggcgtgctccgacgcactacgcgaagccttcaggctaggcccgtgagtatgcccgtagaccgcaacttgctaggagcattgtcccttcccgtctccgaaacagcaaaggatatagaggggaaggaaaattcgctcgccgaagacaaggatggccgtcggaaggggaaggctagtataaaagatccgcattttctgaatttcaataaaaagctgtcatcctcgagcagcgccctgctccacaaggacacttcccagggggacaccatagtttcaactgctcacatgagtgtgaccggcgaacagctaggcatgagcagcccgaggggtggaaggaccacgtctaacgccacttctaactgccaggagaatccctgtccaagtaagtcgctgtccccgaaacagcatctggccccagatcccgttgtaaatcctacacaggacctgcatggggtcaagatcaaggagaaaggaaatcctgaagattttgttgaaggtaaatctatcctatccggctcggtgctgtctcacagtaatttagaaattaagaatctcgagggcaatcggggaaagggtcgtgcagccacttctttctcgctgtccgatgtttctatgttatgttccgacattccggacctgcacagcaccgccatcttgcaggagagcgtgattagccaccttattgacaatgtgacgctgaccaacgagaacgaacccgggtcctcaatctctgctcttattggccagttcgacgaaactaacaaccaggccttgaccgttgtctcacatctccataacacgagcgtgatgtctgggcattgtcccctgccgagtctgggactgaaaatgcctattaagcacgggttttgtaaaggaaaatctaaatcttccttcctatgttcttcacccgagcttattgcactctccagctcagaaaccacaaagcatgccaccaacaccgtgtatgagacgacatgcaccccaattagcaaaaccaaaccagatgacgatctctctagcaaggccaaaaccgcagccctcgagagtaatcttccaggaagtccgaatacctcacgcggctggctgcctaagagcccaacaaagggagaggactgggagacgctgaaatcctgttcccccgcatcctctccagacctgacgcttgaagacgtgatcgctgacccaactctgtgttttaattcgggtgagtcttccctggttgaaattgatggcgaatccgaaaatctgtctctgacgacgtgcgaatacaggagggagggaacttcacagctggcatcgccattaaaacttaaatacaaccagggtgtcgtggagcattttcaacgaggacttagaaacggctactgtaaagaaacccttcggccttctgtgccagaaatcttcaacaatattcaggacgtgaaaacccagagtattagttacctagcatatcagggtgcaggttttgtccacaatcacttcagtgattctgatgccaagatgttccaaacttgcgtacctcagcagtctagtgcccaggatatgcacgtgccagtgccaaagcagctagcccatctgccgttgccagctttgaaactaccttctccttgtaagtccaagtctttgggagaccttacctccgaggatatcgcttgcaactttgaaagcaagtatcaatgcatcagcaaatcttttgtcaccacaggaatccgcgacaaaaaaggcgtcacagtcaagactaagtcacttgagccaattgatgctcttactgagcagcttcgaaagctagtctctttcgatcaagaagacaattgccaagttctctactcaaagcaggatgctaaccaactgcctcgtgcgctcgtccgcaaactctctagtaggtcccaaagcagagtgcggaatatagcctcaagggccaaagaaaaacaggaggctaataagcagaaggttcctaaccccagcaacggagcgggggtggtgctgcggaacaaacctagtgcaccaacccccgctgtgaacagacattccacaggctcttacattgctggataccttaagaatacgaagggtggcgggttggagggtagagggattcctgagggagcctgtaccgccctgcattacggccacgtagaccaattttgcagtgacaatagcgtgctgcagacagaaccttcatccgatgacaagcccgaaatctacttcttgctgaggttgtag

SEQ ID NO: 128721 - DNA, 5082 bp, Artificial Sequence
  Description of Artificial Sequence: Synthetic coding sequence
atggccgacctggaggtttataagaacctatccccagagaaggtagaaaggtgcatgtctgtgatgcaaagtggaacccagatgatcaagctgaaacgcggaacaaagggcttggtcaggctattctaccttgacgaacataggaccaggctgcgttggaggcctagcaggaaatctgagaaagcaaaaattttgatcgactccatctataaagtgacggaaggccgtcagagcgagatattccacaggcaggcagaggggaatttcgatccctcctgttgtttcaccatttatcatggaaatcacatggaaagcttggatttaatcacgtccaatccagaggaggcgaggacttggatcaccggactgaaatatctcatggctggcatttctgacgaggactccttggcaaaacggcagcgcactcacgaccaatgggttaagcagacatttgaagaagccgataagaacggagacggacttctgaacatcgaagagatccaccagctcatgcacaaacttaatgtcaacttaccccgcaggaaagtcagacagatgttccaagaagcagatactgatgagaatcagggtactcttacgttcgaggaattttgcgtgttttataagatgatgtctctgaggagagacttgtacctcctgctgctttcatactccgacaaaaaggaccatctgaccgtggaggagctggcccagttccttaaggtggaacagaagatgaacaacgtcaccactgactactgccttgatattattaagaaatttgaggtgtctgaggaaaacaaggttaaaaacgtgctagggattgagggatttacaaatttcatgcgctctcccgcgtgcgacatctttaatccactacaccacgaagtgtatcaggacatggaccagccactgtgtaattattacattgcttcctcccacaacacataccttaccggagatcagttgctcagtcagtcaaaagtcgacatgtatgcccgcgtactgcaggagggttgtagatgcgtcgaggttgactgctgggacgggcctgacggagagcctgttgtgcatcatgggtatactcttacctccaagatcctgttccgcgatgtcgtggaaaccattaacaagcacgccttcgtgaaaaatgaattccctgtgattttatcaatcgagaatcattgctccatccagcagcagagaaagatcgcacagtatttaaaggggatcttcggcgataaactggatctgagtagcgtcgatacaggagagtgtaagcagctgcccagtccacaatccctgaagggcaaaattcttgttaaagggaaaaaattaccctatcatttaggagacgatgctgaggagggtgaggtttccgatgaagacagcgccgatgagattgaggacgaatgtaaattcaagctccattactcaaacggcactacagaacaccaagtggagtctttcattcgaaaaaagctggagtccttattgaaggaaagccagattcgtgataaagaagatccagattcatttacagttcgggcattacttaaggccacacacgagggtctgaatgcccacttgaagcagtctcccgacgtgaaagaaagtgggaagaagagccacgggcgttcactgatgaccaatttcggaaagcacaagaagacaacgaagtcaagatccaaatcttactccactgatgacgaagaagacactcaacagagtactggcaaagagggtggacagctctatcggctcggacggcggcgcaaaaccatgaaactgtgcagagagcttagcgatctcgttgtttatacaaatagcgtagctgctcaagacattgttgacgatggaacaacaggcaatgtgctgagcttctctgaaaccagggcacaccaggtcgtgcagcagaagagtgaacagttcatgatatataatcagaaacaactgacacggatctatccgagcgcctatcgcatagatagctctaacttcaaccccctgccatactggaacgctggctgtcagttagtcgctcttaactaccagagcgagggtcgcatgatgcagctgaacagagccaagttcaaggctaacggcaactgcggttatgttctgaagccccagcaaatgtgtaaggggacgtttaaccctttcagcggagaccctcttccagctaacccaaagaaacagctgatcctgaaggtgatctcggggcaacaattgcctaagcctcctgactcgatgtttggtgaccgcggcgaaattatcgaccccttcgtggaggttgagatcatcgggttacctgtggattgctgtaaagaccaaacacgggtggtagatgacaatgggtttaatccagtttgggaggagactctcactttcactgtgcatatgccagagatcgcactagtgcgcttcctcgtgtgggaccatgatcccattggtcgagatttcgtgggacagcgtacagtgactttttcttctcttgtccccggttatagacatgtttacctggagggccttaccgaggccagcatattcgtccacataaccattaacgaaatctatggtaagtggtcacccctgattctgaatcccagttacactatcctccacttcctgggcgcgaccaaaaaccgccagctgcagggcttgaagggtcttttcaacaaaaaccccagacacagctcctccgagaataatagtcattatgtgagaaagaggtcgatcggcgataggatcctgcgccgcactgcctcggcaccagccaaggggcggaaaaaatcaaaaatggggtttcaggagatggttgaaattaaggacagcgtgtctgaggccacaagagaccaggatggagtgctgaggcggaccacaagaagcttgcaggcacgacctgtcagcatgcctgtggataggaacctcctcggcgcactcagcctgccagtctccgaaaccgctaaggacatcgagggcaaagagaactctctcgccgaggacaaggacggccggaggaagggaaaggctagcattaaggaccctcactttcttaactttaataagaaactgagctctagcagcagcgctctgttacacaaggatacatctcagggggacaccatcgtgagcaccgcccatatgagcgtgacgggggaacagctcggcatgagctcacctcgggggggtagaacaactagtaacgccacaagcaactgccaggaaaacccctgtccaagtaagagtctcagcccaaaacaacacctggcccccgacccggtggtgaatccgactcaagatctgcacggagtgaagatcaaggagaaaggaaatccagaggatttcgtggaagggaaatctattctgtctgggagcgtgctctcgcatagcaacctggagatcaaaaacctggagggcaaccgaggtaaggggcgggccgccactagcttttccctttccgatgtgtctatgctgtgttctgatatccccgatctgcacagcaccgccatactgcaagagtccgtaattagccaccttattgataacgtgacacttacaaacgagaacgaaccaggttcatctattagcgcgctgatcggccaattcgacgaaacaaataaccaggctctgactgttgtttcccacttgcacaacacatccgtgatgagcggacactgccccttgccctctctggggctgaagatgcccattaagcacgggttctgtaagggtaagagtaaaagctcttttctgtgtagcagtcctgaactcatcgctctgtcatcttctgagaccactaagcacgccacaaacacggtatatgagactacatgcacacctatctccaaaaccaagccagatgatgacctctcctccaaagcaaagaccgcggcgctcgaaagcaatttaccaggttcaccgaacaccagtcgagggtggctccccaaaagtccgacaaagggtgaagattgggaaactctcaaatcctgctctcccgcttccagccctgacctgacactcgaagacgttattgccgatccaactctgtgcttcaattcaggagaaagctcactggttgagattgatggggaaagtgagaatctcagcctgactacctgtgagtataggagagaggggacctcacaactcgctagtccccttaaattaaagtacaaccaaggtgttgtcgagcatttccagagggggctccggaacggctactgtaaggagacgctgagaccgagcgtgcccgagatatttaacaatattcaagatgtgaagacccagtctataagttacctggcctatcagggtgccggcttcgtccacaaccattttagcgactcagacgctaagatgtttcagacgtgtgttcctcagcagtctagcgcacaggacatgcacgtaccagtcccgaaacagctggcccatctcccgctcccggcgctgaagctgccatctccatgtaaaagcaaatcactgggcgacctgacgagtgaagatatagcctgcaattttgagtccaaataccagtgtatttccaagagttttgtgaccaccggcatacgagataaaaaaggggtaactgttaaaactaagtctctggagcccatcgacgcactgaccgagcagctgcgtaagttagtgtccttcgaccaggaagataactgccaagttctgtatagtaagcaggacgcaaaccaattgccccgggcccttgtgagaaagttatcctctagatctcagtccagagtccggaacattgccagtcgagctaaagagaagcaggaagcaaataaacaaaaagtgcccaatccaagcaatggcgctggcgtcgtgctaagaaataagccttccgctcccacacccgcagtaaaccggcattcaacggggtcctacattgctggttatctgaagaatactaaaggaggtggactggagggcagagggatccccgaaggcgcttgcaccgccctgcactatggccatgtggatcagttctgcagtgataattcggtgcttcagaccgaacccagtagcgacgataagccggaaatctattttctcctcaggctatag

SEQ ID NO: 128722 - DNA, 4968 bp, Artificial Sequence
  Description of Artificial Sequence: Synthetic coding sequence
atgagcgtgatgcagagcggaacacagatgattaagctgaagaggggcaccaagggcctggtgaggctcttctacctggacgaacaccgtactcgattgcggtggagacccagccgaaagagcgagaaggctaaaatcttaatcgacagcatctataaagtcaccgagggtcgccagtcagagatctttcacagacaggctgagggcaacttcgatccttcatgctgcttcaccatttaccatggaaaccacatggagagcctggatctgatcacgtccaatcccgaagaggctcgaacttggattacgggtttgaagtacttaatggccggtatttctgacgaggatagtttagcgaagcggcagcgaactcatgaccagtgggtcaagcagacattcgaggaggctgataaaaatggcgacggtctacttaatatagaagaaattcaccagttgatgcataaactgaatgtaaacctcccaagacgtaaggtcaggcagatgttccaggaggcggacaccgatgagaatcagggcactctgacctttgaggaattctgcgttttctacaaaatgatgtccttaaggagagacctgtacctgttgctcttgtcttattctgataagaaagaccatctgactgtggaagaactagctcaatttcttaaggtggaacagaagatgaataatgtgactacggattactgcctggacataataaaaaagtttgaagtcagtgaggaaaataaggtgaaaaatgtgctgggcattgaggggttcacgaattttatgaggtcccctgcatgtgatatcttcaatccactgcatcacgaggtgtaccaggacatggaccagccactatgcaattattatattgctagctctcataatacttacttgacaggcgaccagctgttatcccagtctaaggtcgatatgtatgcaagagtactacaggaaggctgtcggtgcgtggaagtagactgctgggatgggcctgatggtgagcccgtcgtccaccatggttacaccttaactagcaagatcctttttcgagatgtcgttgaaacaatcaacaagcacgcgtttgttaagaatgagtttcccgttatactatctatcgagaaccactgcagtattcagcagcagaggaagatagcccagtatctaaagggcattttcggggacaaactagatctcagttccgtcgatactggagaatgtaagcagctgccgagtccacagagtttgaaggggaagatactggttaaaggaaaaaagctgccatatcatctgggagacgatgcagaggaaggggaagtgtccgatgaagattcggcagatgaaatagaggacgagtgtaagtttaagttgcattactcaaacggaacaacagagcaccaggtcgagtcatttattcggaagaagctcgagtctctcctgaaagaatctcagattcgggataaggaagatcctgacagtttcacagtaagagctctgttgaaggcaacccacgagggactgaatgcacacctcaagcaatccccagacgttaaggagagtgggaaaaagagccatggcaggtcactaatgactaacttcggcaagcacaaaaaaacaaccaaatcaagatccaagagttactccaccgatgatgaggaggacacccaacaaagcaccggtaaagagggcggacagctctatagactgggtcgtaggcgaaaaacgatgaagttatgcagagaactgagtgatttagtcgtctataccaacagcgtggctgcacaagacatagtcgacgatggtactactgggaatgtgctttcattctccgagactagggcacatcaggtggtgcaacaaaaatctgaacagttcatgatctacaaccagaagcagcttactcgcatctatcctagtgcatacagaattgatagttcgaacttcaatcctctcccttactggaatgccggctgtcagctcgtagcattaaactatcagtctgaaggaagaatgatgcagttgaatcgtgctaagttcaaagccaacggcaactgcggatatgtcttgaagccccaacagatgtgcaaaggcacctttaacccattcagtggggacccccttcccgccaaccctaaaaagcagctgattctgaaagtgatttctggccaacagttgccgaaaccccctgactcaatgttcggcgatcggggcgagatcattgatcccttcgtggaggtcgaaattatcggcctgcctgtggactgttgcaaggatcaaactagagttgtcgacgacaatggattcaacccagtgtgggaagaaacacttaccttcactgtgcacatgcctgaaatagccctggttaggtttttggtatgggaccacgacccgatcggaagagactttgtgggccagcgcacagtgacctttagtagcctcgtccctggctaccggcacgtgtacctcgagggccttacagaagctagcatcttcgtccatatcaccatcaatgagatatacgggaaaaaccggcagctgcagggtctgaaagggttgttcaacaagaatcctagacacagctcttccgagaataattcacattatgtccgcaagcgtagtataggagaccggatactcaggaggaccgcctccgcccctgccaaaggacggaaaaaatcaaaaatgggcttccaggagatggtggaaataaaagacagcgtctccgaagctacacgggatcaagatggggtgttgcggagaacaacccggtccttgcaggcccgacccgtttcgatgccggtggatcgcaacctgcttggagccttgtcactgcccgtgtccgagactgcaaaggatatcgaggggaaggagaactctctggctgaagacaaagatggcaggcggaagggtaaggcttcgatcaaggacccgcactttttgaacttcaataagaagttgagctcctccagttccgcccttctgcacaaagacacgagccagggcgacaccatcgttagcacagctcatatgtcagttacaggtgagcagctcggcatgagctcaccccgaggagggcgcacgacctcaaacgctacctcaaactgtcaggagaacccttgccccagcaagagtctgtcacctaagcagcacctagcacctgatccagtggtaaatcctactcaggatctgcacggggtcaagatcaaagagaagggcaacccggaggatttcgtggaaggcaagtcaatcctatccggctccgtcttatcacactccaatctcgagattaaaaacctcgaaggcaaccggggcaaaggcagagcagcaacatccttctccctgtcggatgtgagcatgctttgctccgatatcccagatctccattctaccgcaatactccaggagtcagtcatttcccatttgatcgataacgtcacactgactaacgaaaacgagccggggagttcgattagtgctctgattggacagttcgatgaaacaaataaccaggctctgaccgtggtgagtcacctgcacaacaccagcgtgatgagcggccactgcccgctgcccagcctgggtctcaaaatgcccatcaaacatgggttttgtaagggtaagagcaagagttcattcctgtgttcttccccggagctcatcgccctctcctcctctgagaccactaagcatgcgactaataccgtgtatgagactacatgcacccccatcagcaaaacaaagcctgacgacgacctgtcaagcaaggcaaagactgccgccctggagagcaacctcccaggctctcccaatacctcccgcggttggctcccaaaaagcccaaccaagggagaggactgggagacgctcaaatcctgttcgcctgcttcctcaccagatctgaccctggaggatgtcattgcagaccctactctttgttttaactccggagagtcttcactagtggagattgacggcgagagtgaaaacctgtccctcaccacttgtgaataccgtagagaagggactagccagttggcctccccactgaagctgaaatataaccagggtgtggtcgagcattttcagcgcggtctgcgcaatggatattgtaaagaaaccctaaggccttcagtacccgagattttcaataacatccaggacgtgaaaacccaatccattagctatctcgcttaccagggcgcggggtttgtacacaatcacttcagtgattctgatgctaagatgtttcaaacatgtgtaccccaacagtcgtccgcgcaggacatgcacgttccagtgccaaaacagctagcccacctacctctccccgcactgaaactaccaagcccttgcaaatccaagagtctaggagacctaacctccgaggatatcgcatgcaactttgagagcaagtaccagtgtatcagcaagagcttcgtcaccacaggtattcgcgataagaaaggggtgaccgtgaagacaaagtccttggaaccaatcgacgctctgactgagcagctgcggaagctggtgtcctttgatcaggaagacaactgccaggtgctatatagcaaacaagacgccaaccaactgcccagagccctggtcagaaaactgtcctccagatctcaaagtcgcgttcgcaacatcgctagccgagcaaaagagaagcaagaagctaacaaacagaaagtgcctaatccttcaaatggcgctggagtcgtgctgcggaacaaaccttctgctcccacaccagctgtaaatcgacatagcactggtagttacattgcaggctacttgaagaacacaaagggcggcgggttggaaggacgaggcataccagaaggcgcctgtactgctctacattatggacatgtagaccaattctgtagcgataactctgtgctgcagacggagcccagcagtgatgacaaacctgagatctacttcctgctcagactgtag

SEQ ID NO: 128723 - DNA, 3009 bp, Artificial Sequence
  Description of Artificial Sequence: Synthetic coding sequence
atggccgatctggaggtctacaagaatctgtcccccgagaaagtcgaacggtgcatgtccgtgatgcaaagcggcacacaaatgattaaattgaagcgcggcacaaaaggattagtcagactcttctacctcgatgaacaccgcaccagactacgatggaggcccagcaggaagtctgagaaggccaaaatccttatcgatagcatatacaaggtgaccgagggtaggcagtcagagatattccataggcaggctgagggtaatttcgacccgtcatgctgttttacaatctaccacggaaatcatatggagagtctcgatcttattacatctaaccccgaggaagccaggacgtggataaccggccttaagtatctgatggcaggcatcagcgacgaagattccctcgctaagcgtcagcggacgcacgaccagtgggtaaagcaaacatttgaggaggctgacaaaaatggagatggcttgcttaacattgaggagatccatcaattaatgcacaagctgaacgtgaatctgcctcgccgcaaggtccggcagatgttccaggaagctgacaccgatgaaaatcaagggacactaacctttgaagaattctgtgtcttttacaagatgatgtctctcaggcgcgacctgtaccttttgctcctctcttacagcgataagaaagaccatctgaccgtagaagagcttgcccaatttctaaaggtcgagcagaaaatgaataatgttactaccgactattgccttgatattatcaagaagtttgaggttagcgaagagaacaaggtgaaaaatgttctcggcattgaggggtttacaaacttcatgcggagccctgcatgtgatatcttcaacccgctccaccacgaagtttatcaggacatggatcagccgctctgcaactattacattgccagctctcacaacacttatctgacaggggaccagctgctgagccagtcaaaggtcgacatgtacgctcgcgtcctgcaagagggctgtaggtgcgtcgaggttgactgctgggacggcccggacggcgaaccagtcgtccatcacgggtataccttaacctcaaaaatcttgttcagagatgtagtggagactatcaataagcacgcttttgtaaaaaacgagttccccgtgattctgagcatcgagaaccactgctccattcaacagcaaagaaaaatcgcgcagtacctgaagggtatctttggggacaaattagacctgtccagtgtggatacgggggaatgcaagcagctgcccagcccacagtcactaaaaggaaaaatccttgtgaaaggaaagaagctcccctaccacctaggggacgacgccgaagagggcgaggtgtctgatgaggattccgccgacgagatagaggacgagtgtaagttcaagctccactactctaacggtacaacggaacatcaggtcgagagttttatccgcaagaaactggaaagcctgttaaaagagagccaaatccgagataaagaggacccagactcatttacagtaagagccctgttgaaggccacacacgaaggcctgaatgcccatctgaagcaatcccctgatgtcaaggaatcaggcaagaagagccatggtcgatccctgatgacaaattttggcaagcacaagaaaactacgaagagccgctccaagagttactccactgacgacgaggaggatactcaacaaagtacaggcaaggaagggggccagctgtacagattgggcaggcgacgtaaaaccatgaaactatgccgagaactctcagatctggtggtgtataccaatagtgtagccgctcaggacatcgtggacgatggtacgaccggaaatgtcctgtctttcagtgagacacgggcgcaccaggtggtgcagcagaagtcagagcaatttatgatttacaaccagaaacaactgaccagaatataccctagtgcttatagaatcgactccagtaatttcaatccccttccctattggaatgctggatgccaactggtcgccctaaattaccagtctgagggaaggatgatgcagctgaatcgcgccaagtttaaagctaacggaaactgtggatacgtattaaagcctcagcagatgtgcaagggcactttcaatccgttctcaggcgatccactgcccgccaaccccaagaaacaattgatcttgaaagtcataagcggccaacagctgccaaaaccaccagactctatgttcggcgaccgcggggagatcatcgaccctttcgtggaagtagaaattataggtctcccggtggattgctgtaaggaccagactcgtgtcgtggacgacaatggcttcaatcccgtctgggaggaaactctaactttcaccgtgcacatgcctgagattgctctcgtcaggttcctagtgtgggaccatgaccctattggccgggattttgtgggtcaacggacagtgacgttctcttccttggtcccgggctaccggcacgtttacttggaagggctaaccgaagccagtatttttgtccatataaccatcaacgagatttacggcaaatggagtccacttatcctgaatccatcctacactatcttgcacttcctgggcgcgacgaaaaatcggcagttgcagggtctaaaaggactgttcaacaaaaacccgagacactcttcttccgagaataattctcattatgtgcggaagcgttcaatcggcgatcggattttgcgtcggacagccagtgcccccgccaagggccggaaaaaatcgaagatgggatttcaagagatggtcgaaatcaaggacagcgtctccgaggccacgcgagatcaggatggcgtgctgcgccgtacgactagaagtctgcaggcccgccccgtgtcgatgccagtcgatagaaacttgttaggagctctgtcactgccggtgagtgagaccgccaaggacatagaaggaaaagagaattctttggtccaaatctag

SEQ ID NO: 128724 - DNA, 4968 bp, Artificial Sequence
  Description of Artificial Sequence: Synthetic coding sequence
atgtcagttatgcagagcggaacccagatgattaagctgaagagaggaactaaaggccttgtgcggttattctatttggatgagcacaggactcgcttaaggtggcggccgtcccgtaagtcggaaaaggctaaaattctgattgacagcatctataaagtaactgaaggcagacagtccgaaatcttccatagacaagcggaaggaaacttcgatcccagctgctgcttcacgatctatcacggaaatcatatggagtctctcgatctgattacctctaatcctgaggaagcccgcacatggattacgggtttaaaatacttgatggcgggaatcagcgatgaggactctcttgctaaacggcagagaacccacgaccagtgggtgaaacagaccttcgaggaagccgacaaaaatggtgacggattgttaaacatcgaagaaattcaccagctcatgcacaagctgaatgtgaacctgccccggcgtaaagttcgacagatgttccaggaggctgacaccgatgagaatcagggcacactgacctttgaagagttctgtgtgttctacaaaatgatgtcgctgaggcgcgatttgtacctcctgctcctctcttactccgacaagaaggatcacttaacggtcgaagaactggcccagttcctcaaggtcgagcagaagatgaataacgtgaccactgattattgcctggatataatcaaaaaatttgaggtgagcgaagagaataaagttaagaatgtcttaggtattgagggattcacgaattttatgcggtcgccggcctgcgacatctttaatccgcttcatcacgaggtataccaggacatggaccagcctttgtgtaattattacatagccagctcccacaatacatacctcacaggcgatcagttgctcagccagagcaaagtcgacatgtatgctcgcgtgctgcaagaggggtgtcgctgcgtcgaagtcgactgctgggatgggccagacggcgaaccagttgtgcatcatggctacactctgacatctaaaatcctgttccgggacgtcgtagagacgattaataaacatgccttcgtcaagaacgagttcccagtcatactaagcatcgaaaatcattgctcgatccagcaacagagaaagattgcccagtacctgaagggcattttcggagacaagctggatctgagcagcgtcgatacaggcgaatgcaagcaactgccgagtcctcagtcacttaagggcaaaatccttgttaagggcaaaaagctaccttaccacttgggagatgacgccgaggagggtgaggtgtcggacgaggactccgccgacgaaattgaggacgaatgcaaattcaagttacactattcgaacggtaccactgagcatcaagttgaatctttcatcagaaaaaagcttgagtctttgctcaaggaaagccagattcgtgacaaggaggatcctgattcgttcacagtccgggctctactgaaagcgactcatgagggcctaaatgctcacctgaagcagtcccctgacgtgaaggaaagcggcaagaagtctcacggacgttcgctcatgacaaacttcgggaaacacaagaagacaactaagtccaggtccaagtcctactctaccgacgatgaagaggatactcagcagagcaccggaaaggaagggggacaactgtatcgcctaggccgaagaagaaagaccatgaaactttgtcgagaactgagcgacctagtggtttacaccaactccgtcgctgctcaagatatcgtagatgatgggacaactggaaacgtcctcagcttttccgagaccagggctcatcaggtcgttcagcagaagagtgaacagtttatgatctacaatcagaagcagctgacccgcatttacccttccgcctatagaatcgacagctcgaacttcaatcccctgccatactggaacgcaggttgtcagcttgtcgctctgaattaccagagcgaaggacgcatgatgcagctgaaccgcgccaaattcaaagctaacggaaattgtggctacgtgttaaagccacaacagatgtgcaaaggtaccttcaaccctttcagcggcgatcctctacctgcaaacccaaaaaaacagctgattctaaaggtcattagtgggcagcagttaccgaagccaccagatagcatgttcggcgaccgtggagaaatcatcgaccccttcgtagaagtcgaaatcatcggcctgcctgtggactgttgtaaagaccagactagggtcgtagatgacaacgggttcaacccagtttgggaggagaccctgacctttactgtccacatgccggagattgctctcgttaggttcctggtgtgggaccacgatcccattggcagagacttcgttggccagcgcactgtgacctttagttcgctggttccaggctatcggcacgtctacctcgaaggcctgaccgaggcatctatcttcgttcatattaccattaatgaaatctacgggaagaatcgacaactgcaaggattgaaaggcctgttcaacaagaatccgcgacattcctcttctgaaaacaattcccactatgtgaggaaacgctctatcggagaccgaatcttaaggagaacagccagcgctcccgctaaaggaagaaagaaatcaaaaatgggctttcaggaaatggtagagattaaggattcagtcagcgaggcaacccgtgatcaagatggggtcctgcggaggacgacacggtcgctgcaagcacggcccgttagcatgccagtggacaggaatttgttgggcgccttgagcctgcccgtgagcgagacagctaaagacatagaaggcaaggagaattccctggccgaagacaaggacgggcggaggaaaggaaaagcaagcattaaagacccccacttcctcaactttaacaagaagctgtcatcaagcagctccgccctgctgcacaaagacacaagtcagggtgacacgatcgtcagcacggctcacatgtccgtgacaggtgaacagcttggaatgagcagcccccggggtggcaggaccacaagcaacgccacctctaactgtcaggagaacccttgcccttcaaagagcctctcacctaaacagcatcttgcacccgatcccgttgtcaaccctacccaggacctacatggagtgaaaatcaaggagaagggcaatcccgaggattttgtcgagggaaagtctattctgtctggctccgtgctgagccactctaatctggagatcaaaaatctcgaggggaatagagggaagggtcgcgcagctacctctttttccctgtcagatgtgtccatgctgtgttcagacatccccgaccttcacagtaccgccatcctgcaggagtccgtgataagccacctgatcgataatgtgaccctgactaacgagaacgagcctggctcttcgatttccgctctgatcggacagtttgacgaaactaataatcaggcactgacagtcgttagtcatctacacaatacttctgtgatgtctggacactgtccattgccctcattaggtttgaaaatgcctatcaagcatgggttctgtaaggggaagtctaaatcatcgtttctctgtagcagccctgaactgattgctctgagctccagtgaaactacaaagcatgccacgaatacggtatatgagacaacatgcactccaatatcaaagactaaaccggacgatgatctcagttcaaaagcaaagaccgcggcactggagagtaacttaccaggtagcccgaatacatcacgtggttggctccccaagagcccgacgaagggcgaggactgggagacactgaagtcctgctctcccgcctcctcaccagacctgacactcgaagacgtgatcgccgaccctaccctgtgctttaacagcggagagtcctccctggtcgagattgatggtgagtctgaaaatttgagcctgaccacttgcgagtacaggcgcgagggcaccagccagttagcgtcccccctgaagctgaagtataatcaaggcgtggtcgaacattttcagcgcggtttgagaaatggatattgcaaggagacactcagaccctcagtgcccgagatcttcaacaacatccaggacgtgaagacgcaaagcatcagctacctggcatatcagggcgcagggttcgttcacaatcatttttccgattctgacgccaaaatgttccaaacttgtgttccacagcagtccagcgcccaggacatgcatgtccccgttcccaaacaactcgcacaccttcccctgcctgcgctaaagctgcctagcccctgcaagagcaagagtctcggcgacctgacatccgaagatattgcttgcaatttcgagtcgaagtaccagtgtatttccaagagcttcgtcacaactggcatacgagataaaaaaggcgtgacagtgaagaccaagtcactcgaaccaatcgatgcactcaccgaacagctgagaaaattagttagctttgaccaagaagacaactgtcaagtcctttattccaagcaagatgctaatcagctcccaagggcgttggtgaggaagctgtccagtcggagccagagtcgcgttcggaatattgcatcccgggcgaaagaaaaacaagaagccaacaaacagaaagtaccaaacccgtcaaatggcgccggtgtagtcctgcgcaacaagccatccgcccccacacccgcggttaatcggcattccacgggctcctatatcgccgggtatttgaaaaacactaagggcggcggactcgaagggcggggcattcctgagggagcctgtaccgccctgcactatgggcatgttgaccagttctgttcagacaattccgtgcttcaaacagagcccagctccgacgacaagcctgagatctacttcctgctacgtctctag

SEQ ID NO: 128725 - DNA, 3045 bp, Artificial Sequence
  Description of Artificial Sequence: Synthetic coding sequence
atggcagatctcgaagtgtataaaaatctcagcccggagaaagtagaacgctgcatgagcgtgatgcaaagtggaacccaaatgatcaagctcaaacgagggaccaaggggctggtccgcctcttctacttggacgaacatcgcacccgcctacgttggaggccctcaaggaaaagcgaaaaggccaagatacttattgatagtatctataaggtaactgaggggcggcagtctgaaatcttccatcgtcaagctgaaggaaacttcgatccatcttgctgttttacaatttatcatggtaatcacatggaaagtctggatctgataactagtaatcctgaggaggccaggacatggattacagggctgaaatatctaatggcgggcatctcggacgaggacagcctcgccaaacgccagcgaacacacgaccagtgggtcaaacagacattcgaggaggcagataagaacggggacggtctcctgaacattgaagagatacaccagctgatgcacaaactgaatgtgaacctgccgcgtcgtaaggttagacagatgttccaggaagctgacacggatgagaatcaggggacactgacatttgaggagttctgtgtgttttataagatgatgtcgttacggcgggacctgtacctgcttctgctgtcttattccgataaaaaggaccacctcacggtagaggagttggctcagttccttaaggttgaacagaagatgaacaatgtaacgaccgattactgcctcgatatcattaaaaagttcgaagtgagcgaagaaaataaggttaaaaacgtgcttggcatcgagggcttcaccaatttcatgagatccccagcctgtgatattttcaaccctctgcaccatgaagtctaccaagatatggaccagccactttgcaattattatatcgcaagctcccataatacctatttaacaggggatcagttgctgagccagtcaaaggtcgatatgtacgcgcgcgtcttgcaggagggctgccgctgcgttgaggttgactgctgggatggacctgatggcgagcccgtagtgcaccacggttatacgctgaccagtaaaatcctctttcgggacgttgtggagaccattaacaagcatgccttcgtgaagaacgagttccctgttatcttgtctatagaaaatcactgctcaatacagcagcagagaaagatcgcgcagtaccttaaagggatctttggagataagctggatctctcatcagtcgacacaggagagtgtaaacaattgcccagcccacagtctctaaagggaaagattctggttaaaggaaagaaattaccgtaccacctcggggacgacgcggaagagggtgaggtatcagatgaggattcagcagatgagatagaggacgaatgtaaatttaaactccactacagtaatggtaccaccgaacaccaggtcgagtcgtttatccggaagaagctggagagcctcctgaaggaaagccagatacgggataaagaggatccagacagctttactgtgagggcactgctcaaagcaacccatgaaggcctcaatgctcatctgaaacagtctccagatgtgaaagaatctggcaagaaatctcatggccgtagcctgatgacaaacttcggaaagcataagaaaactaccaaaagcagaagtaagtcctactccacagacgacgaggaggacacgcagcagagcaccgggaaggagggggggcagctatatcggttgggccgcagaagaaagacaatgaaactctgcagggagctctccgacctggtagtgtacacaaactctgtcgcggcacaggatatcgtggacgacgggacaaccggtaatgtcctctctttcagtgaaacaagggcgcatcaggttgtccaacagaagagcgagcagtttatgatttacaatcagaaacagttgacgcgtatttacccctccgcttataggatcgattcctcaaacttcaacccactgccctactggaacgccggctgccaactagttgccctgaattatcagagtgagggtcgtatgatgcaactcaatcgcgccaagttcaaggctaatggtaactgcggctatgtcctgaaaccccaacagatgtgcaaggggacctttaatccgttcagtggtgaccccctgcccgctaaccctaagaagcagctgatccttaaggtcattagcggacagcaactccctaaaccacctgattctatgtttggcgacaggggtgagatcattgatccttttgtggaagtcgagatcataggattgcctgtagactgctgcaaagaccaaactcgtgtggtggacgacaatggcttcaacccggtgtgggaggagactctcacgtttaccgtacacatgcccgaaatcgccttagtgcgctttttggtttgggaccatgacccaattggcagagatttcgtaggccaacggacagtcaccttctctagcctggttcctggctaccgtcatgtctatctggaaggtctgaccgaggcatccatctttgtccacatcacgattaatgaaatatatggtaaaaatcgacagttacagggactaaaaggattgtttaacaaaaatcctagacactctagttcagagaataacagtcattatgtcagaaaaaggtcaatcggggaccgtattttacgccggactgcctctgcccctgctaagggtagaaagaaaagcaaaatggggttccaggaaatggttgaaattaaggattcagtaagtgaggcaacacgggaccaggacggcgtgctgagacggacgacccgatcattacaggcacggcctgtgtcgatgccagttgatcgaaacttgctgggggcacttagcctgccagtgagcgagactgcaaaagacatcgaggggaaggaaaattcccttgatagtagcttttgccggccaacagagcaggccaaagcggaaatgtgtaaggtgccttttcctcggcaattagagtgcgtgatgaagatggaaatctccgagacatag

SEQ ID NO: 128726 - DNA, 3507 bp, Artificial Sequence
  Description of Artificial Sequence: Synthetic coding sequence
atgttccgcgaagccgacacggatgatcaccaagggaccctgggctttgaagaattctgcgccttctataagatgatgtctacacgccgagatctttacttactgatgctgacttactctaatcataaggaccatctggatgcggcttctctgcaaagattcctgcaggtagagcagaagatggccggcgtgacactggagtcgtgtcaagacatcatcgaacagtttgagccgtgtcccgagaataaatcaaagggcctgctgggaatcgatggttttactaactatactaggagccccgcaggtgatatctttaatccagagcaccatcatgttcaccaagatatgacccagccacttagccactattttatcacatcaagtcataatacatatttggttggagaccagctcatgagtcagagtcgagtagatatgtacgcgtgggtgttgcaagctggctgtagatgcgtggaagttgattgctgggatggtccagacggagagccgatcgtgcatcatgggtatacactgaccagcaaaattcttttcaaagacgtgatcgagactattaataaatacgctttcatcaagaacgaatacccggtgattttaagtattgagaaccactgctccgtcattcaacagaaaaagatggcccaataccttacggacattttaggagacaaactagacttatcatccgtgtcgtctgaggatgctacaactctaccctcacctcagatgttgaagggcaaaatcctcgtgaaagggaaaaaactacccgcgaacatcagtgaagatgcagaagaaggcgaagtgtctgacgaggactcagctgacgaaatcgatgatgattgcaagttactgaatggagatgcgtccaccaacaggaaacgagtagagaatacggctaaacgcaaacttgactccctgattaaggaatccaagatcagagattgcgaggacccgaataatttttctgtctcaaccctgagcccctcaggcaaattaggccgtaaatccaaggcagaagaagacgtggagtcaggcgaggacgccggtgcaagcaggagaaatggaagactcgtggtgggatctttcagtcgacggaagaagaaaggaagcaagcttaagaaagccgcaagcgtggaggaaggtgatgagggacaggattctccaggaggccagagccgcggcgccacaaggcaaaagaagactatgaagttatcacgcgccctgtccgacttagtgaaatatacaaagagtgtggcaacacacgatatcgagatggaggccgcttctagctggcaggtgtcttctttctcggagacaaaggcacaccagattctgcagcagaagcccgcccagtaccttcggttcaaccagcagcagctttcacggatctacccctcctcgtatcgagttgatagtagcaactataatccacagcctttctggaacgcaggatgccagatgggagtgttcaatcctaattctgaagaccccttgcccggacagctcaagaaacaacttgtgttacgcattatttccggccagcaactgcccaagcctcgtgactccatgctcggcgatcgtggtgaaattatcgatccgttcgttgaggtcgaaattatcgggcttcctgtcgattgttctcgggaacagacaagggtggttgatgacaacgggtttaaccctacttgggaagaaaccctcgtattcatggtccacatgccagaaatcgcacttgttcggtttctcgtctgggaccacgaccccatcgggcgggatttcatcggacagagaaccttggccttcagttcgatgatgcccggctatcgtcatgtttatctagaagggatggaggaggcctcaatctttgtgcatgtcgcagtgagcgatatttctggcaaagtcaagcaggccctgggtttgaagggcctcttcttgcgaggacccaaacccggcagccttgattcgcatgcggccggacgaccaccagcacgcccttctgtgagtcagagaatcttgaggcggactgccagtgcacccacaaaatctcagaagcctgggcgtcgtggctttccggagctggtgttggggactcgggatacaggctctaagggcgtcgctgatgatgttgtgcccccaggaccgggtccagctccagaggctcctgcccaggaaggccccggatctggttccccacgcgacactagaccattgtccacccagagaccgttaccgccactatgctccctcgagactatcgccgaagagcctgcccccggcccaggtccgcccccccccgctgcggtgcccacgtcatcttctcaggggcgccctccttaccctactggcccaggggcaaacgtggcgagcccgttggaagatacagaggaaccacgagactctcggcctagaccctgcaatggtgaaggagctggtggcgcttacgaacgcgcgcccggttctcagaccgacggcagaagccaacctcgaacacttgggcacttgcccgtgatccgcagggtgaagtcggaaggacaggtgccaacggaacctctggggggatggaggccgctggctgctcctttccccgctcccgccgtttacagcgatgctactggcagtgatccactctggcagaggctcgagccatgtggtcacagggattctgtgtcatctagttcctccatgagctctagtgacaccgtaatcgacctttcactgccatctctcggcttaggcagatcaagggaaaatctggccggagcccatatgggaagactgcccccccgacctcactcagcttcagccgctcgtcccgacctgccccctgtgactaaatctaaatctaatccaaacttgcgagcaacaggacagcggcctcctattccggatgagttacaacctaggtccttagcccctaggatggctgggctgccctttcgtcccccatggggttgtctctcactggtcggtgtgcaggactgcccagttgctgccaagagcaaatctctcggtgacctgaccgcagacgacttcgcgccctcgttcgaaggtggctcgaggagactgtctcactcccttgggttgcccggggggactagaagagtgtcaggtcctggagtgcgacgtgacacacttaccgagcagctacggtggttgaccgtgttccagcaggccggagacattacctctccgaccagccttggacctgcaggagagggggtcgcaggaggtccggggttcgtaaggcgaagctctagcaggtctcatagcagagttcgcgcaatcgcatcccgtgctcgccaggcccaggaaagacagcaacggctccagggactgggccgacaaggtccacctgaggaggagaggggcactcctgaaggagcttgttccgtgggccacgaaggctcagttgacgctcccgcaccctctaaaggagcactggggcccgcctcagctgccgccgagaacttagttttactgaggctgtag

SEQ ID NO: 128727 - DNA, 1500 bp, Artificial Sequence
  Description of Artificial Sequence: Synthetic coding sequence
atgggcgctatgcaggaaggtatgcaaatggtcaaactacggggcggcagtaagggcctcgtgcgcttttattacctggatgagcaccggtcctgtatacggtggcgacccagtcgcaagaatgagaaggctaagatatcaatagactcaattcaggaggtgtcagagggtcggcagagcgaggtctttcagcgctaccctgacggctcctttatcatcgatccctttgtagaggttgagattatcggtctgccagttgattgcagccgagagcaaacacgggtggtcgacgacaacggtttcaaccccacttgggaggagactctggtgttcatggtccatatgcctgagattgccctggtccgcttcctggtgtgggatcacgacccaatcgggcgcgatttcataggacagcgcacactggccttctcttcgatgatgcccgggtataggcacgtgtacctggagggaatggaagaagcctcgatctttgtccatgtggcagtcagcgacatttcaggcaaagtgaagcaggccctggggctcaagggacttttcttgcgcggaccgaaaccaggttcattggattctcatgccgcggggaggccaccggcacggccctccgtgagtcagagaatcctgcggcggacagcaagcgcacccaccaagagccagaagcctggccggcgtggtttcccggaattagttctaggaaccagagatactggctcgaaaggagttgcagatgacgtggttcctccgggaccaggtcctgctcccgaggctcccgcccaggaagggcccggctctggaagcccaagaggcaaggcaccggcagccgtcgcagaaaaaagccccgtgcgagttaggcccccccgggttctcgatgggcccggccccgcagggatggcagctacctgtatgaagtgcgtagtcggctcttgcgcgggggtgaacaccggtggtctccaacgagagaggccacccagtcccggcccagcctctagacaagccgcaatccgccagcagccgcgggcacgcgcagactctcttggagccccatgttgcgggctcgacccacatgccatacccggccgatctcgggaggcaccgaaggggccaggagcctggcgccaggggcctggaggatcaggctccatgtccagtgactcatcgtctcctgacagtcctggaatccctgaacgttcacctaggtggccagaaggcgcatgcaggcagccgggggctctccagggcgaaatgtcggcccttttcgcccagaagctggaagagatccgatctaagagccccatgtttagtgctgggaagcctctcctcccgtgtgtggtgttgccacacgcccccggaatggccggccctggtagtcctgcggctgcgtccgcctggaccgtgtccccacgggttttagttctggtcgccttatacccgtggcattgccttaggggaacactgctgccgtggctggcctgcggtccttag

SEQ ID NO: 128728 - DNA, 3177 bp, Artificial Sequence
  Description of Artificial Sequence: Synthetic coding sequence
atggccgggatctctgacgaggactcactcgcgagacgccagaggactcgggatcaatggctgaaacagactttcgacgaagccgataaaaacggtgacgggtctctatctattggggaagtgttgcagctcctgcacaagctgaacgtgaacctgcctcgccagagagtgaaacaaatgttccgggaagctgataccgacgatcatcagggcacactaggctttgaggagttctgcgccttctataaaatgatgtcgactagacgagatctctatctgctgatgctcacttactcaaatcacaaagaccacttagacgccgcatcccttcagcgatttttacaagtagaacagaaaatggccggtgttaccttggagagctgccaggacatcatcgaacagttcgagccctgtccggaaaacaagagcaaaggtctcttggggattgacggcttcaccaactacacccgcagtccagccggtgacatttttaaccccgagcaccatcatgtccaccaagatatgacccaaccgttgtcacactatttcataaccagttctcacaatacatacctggtgggcgatcagctgatgtcacagtctagagtcgacatgtacgcgtgggtgctccaggcagggtgtcggtgtgttgaagttgattgctgggacggccctgatggggaacccattgtacatcacgggtacaccctgacctctaagattctctttaaagacgtgatcgagactattaacaaatacgccttcatcaagaatgaatatcccgtgatcctctctatagagaatcactgctccgtcatccagcagaaaaagatggcccagtatctgaccgatatcttaggcgataagcttgatctcagctccgtgtcatctgaagacgccaccactcttccttctccacagatgcttaaagggaaaattttggttaaaggtaagaagctgcccgctaatatctccgaggacgccgaggagggagaggtatccgatgaggacagtgctgacgaaattgacgatgattgcaaactactgaacggtgacgcctcaaccaaccgcaagagggttgaaaacacagcaaaacggaaactggactccctgattaaggagagcaagatcagagactgcgaagaccctaataacttttctgtatctactttaagtcccagcggaaagctgggcagaaaaagcaaggcagaggaggatgtcgaaagtggcgaagatgccggtgcttcccgccgcaacggcaggctggtagtagggtccttctcgaggagaaagaaaaagggctctaaacttaagaaggccgctagtgtcgaagaaggagatgaaggccaggatagcccaggcggccagtccagaggagcaaccaggcaaaaaaagacgatgaagctctccagagcgctgagcgatctcgttaagtacacgaagagtgtggctacccacgatatagagatggaagccgcctcctcatggcaggtgagctccttctccgagaccaaagcgcaccaaattctccagcagaagccagcccagtatcttcggtttaatcagcagcagttgtctagaatttacccctccagttaccgcgtagatagctcaaactacaaccctcagcctttttggaatgctggctgccaaatggttgcactcaattatcagtcagaggggcgaatgctgcagctgaaccgggccaagttctcggccaatggaggatgtggatatgtgctgaaacctgggtgcatgtgccaaggtgtgttcaatcccaactccgaagacccactgccaggccagttgaaaaaacagctggtgctgaggatcatcagtgggcaacagctgcctaagccacgagactctatgcttggggaccgtggagaaatcatcgacccctttgtcgaagtggagattatcggcctgccggttgattgttctagagagcagactcgggtggtggatgacaacgggttcaaccctacatgggaggaaactttggtctttatggtgcacatgcctgagatcgcgttagtgagatttctcgtatgggatcacgaccccatagggcgcgattttatcggccagcgtaccctcgctttttccagtatgatgcccggctaccggcacgtttatctggagggcatggaggaggctagcatttttgtacatgtggctgtgtcggatatatccggcaaggtcaagcaggcactagggttgaaggggcttttcctcaggggcccaaaacccggttctttggacagtcacgccgcagggcgcccacccgctcggccgtccgtgtcccagaggatcctgcgaaggaccgccagcgctccaaccaagtcacaaaaacccggccgcagaggcttcccagaactggtgcttggtactagggacaccggctccaagggcgttgcggacgatgtcgtgcccccaggccctggacccgcacctgaagcacctgctcaggagggtcctggcagcggcagcccccgcgggaaagcacccgctgctgtcgccgagaagtctcccgtgagggtgcgccctccccgtgttctggatggacccggtccggcaggcatggccgcgacctgtatgaaatgtgtggtcgggagctgcgccggtgtgaatacgggaggactccaacgagagagacccccttcccctggaccagcaagccggcaagcagcaattcgtcagcaacctagggcccgagcagactcactgggcgcgccgtgctgtggactggatccccatgcaatccccggaaggtcaagagaagcgccaaaggggcctggggcgtggagacagggacccggcggcagcggatctatgagttcggactcctcctctcccgactccccaggtatcccagaacgcagccccagatggcccgaaggggcttgcaggcaacccggcgctttgcaaggcgaaatgtccgcactgtttgctcagaagttagaggaaattcggtctaagagccctatgttcagcgcaggaaagcccctgttgccctgtgtggtcctccctcacgcccctgggatggcagggcctggctcacccgcagcagcatcagcctggactgtgtcacctcgtgtcctggtgcttgtagcgctgtacccatggcattgcctccggggaaccttgctgccatggctggcctgtggcccatag

SEQ ID NO: 128729 - DNA, 1494 bp, Artificial Sequence
  Description of Artificial Sequence: Synthetic coding sequence
atgggcgctatgcaggaaggaatgcagatggtcaaactaagaggagggagcaaggggctggtccgattctactacctggacgagcatcggagctgcattcgatggaggccaagtcgcaaaaacgagaaggccaaaatatccattgactccatacaagaggttagcgaaggccggcaaagcgaggtttttcaacgttaccccgacggatcatttgacccgttcgtagaggtggagataatcggactgcccgtggactgttcccgcgagcagacgagagtggtcgatgataatggatttaatccaacctgggaggagaccctggtatttatggtgcacatgccggagatcgctttagttaggttcttagtctgggaccacgaccctattggccgagactttatcggacagcgtaccctggcattcagttccatgatgcccgggtacagacacgtttatctagaggggatggaggaggcttcaattttcgtgcatgtggcagtttccgatatcagcggaaaggtcaagcaagccttagggctgaagggccttttcctcaggggtccaaaaccagggagccttgatagtcacgctgcgggccggccccctgcaagaccttcggtgtcacagagaatcttgcggagaactgcgtctgctcctactaaaagtcaaaagcccggtcggcggggattccctgaacttgtgttgggcacgagagacaccggttctaagggcgtggcagatgatgttgttcctccaggtcctggtccggcccctgaggccccagcccaggagggtcccgggtcgggatccccccgcggaaaagcacccgccgcagttgcagagaaatcccccgtgcgtgtcaggccaccgcgggtgctggatggtcccggtcctgccggcatggccgccacttgtatgaagtgcgtggtgggaagctgtgccggtgtcaacaccggcggtctacaacgggagagaccacccagcccaggacccgcgtctaggcaggccgctattcggcagcagcctcgagccagagcggattcgctgggagcaccctgctgcggcctggatcctcatgccatacccggccggtctagagaggcccccaagggacctggggcctggagacaaggtcccggcgggtccggcagtatgagttcagactcctcctcccctgattcccctggcattccagaaaggagccccaggtggcccgaaggggcctgcaggcagccgggagccctgcagggcgaaatgtccgccttatttgctcagaaactagaagagatccgaagtaagtctcctatgttctctgccggtaagcctctgctcccatgcgtagtgctgcctcatgcccccggcatggcaggacctgggagcccagctgcagcttctgcgtggaccgtctccccccgggtcctggtgctggttgccctctatccctggcactgcctccgcggaacactcctcccctggctggcctgcggcccgtag

SEQ ID NO: 128730 - DNA, 4251 bp, Artificial Sequence
  Description of Artificial Sequence: Synthetic coding sequence
atgagtgggccttggccatctcctgacagcagaacaaagggcactgtagcatggctggcggaggtattactctgggtgggtggttctgtggtgctgtcttcagaatggcagttaggcccgcttgtcgagaggtgcatgggagctatgcaggaggggatgcaaatggtgaagctcaggggagggtccaaaggcctggtccgtttctattaccttgatgagcaccggagttgtattagatggagacctagccggaaaaatgagaaagcgaagatctctatcgacagtattcaagaggtttccgagggacggcagtcagaggtctttcaaagatacccagacggatcctttgacccgaattgctgctttagcatctaccatggctcccacagagaatccttggatctggtgagtacctcatctgaggtcgctcgaacgtgggtcacaggcctgcgatacctcatggcaggaatcagcgatgaggacagcctggctaggagacagagaactagggatcagtggttaaaacagacctttgatgaagctgataagaacggcgatggttctctctctattggggaagttttgcagttactccataagttgaatgtcaacctccctcgtcagcgcgtcaaacagatgttcagagaggccgatactgatgaccaccaaggcaccctgggctttgaggagttctgtgccttttataagatgatgagtacccgcagggacctgtacttgttgatgcttacatatagtaatcacaaagaccacctggatgctgcctcattgcaacgcttcctgcaggtggagcagaaaatggcgggagtgaccctcgagtcatgccaggacatcattgagcagttcgagccatgtcctgagaacaagagcaaaggactgcttggaattgacggtttcactaactacacccgatctccagctggcgacatcttcaatccagaacaccatcacgttcaccaagatatgactcaacctctgtcccattacttcattaccagttctcataacacttacctggtgggggatcagctcatgtcacagtcccgagtagacatgtacgcatgggtgctgcaggcaggatgtagatgcgtggaggtagattgctgggacgggcccgatggagagccgatagtccaccacgggtacaccctaactagcaagatcctgttcaaagatgtcattgagactatcaacaaatatgcgtttattaagaacgagtatcccgttatcctgtctatcgaaaatcactgttcagtgattcagcagaagaaaatggcccagtacctgactgacatcctcggtgataaactcgatctatcatccgtatccagcgaagatgccacaactttgcctagcccgcaaatgcttaaaggaaagatcttggtgaagggcaagaagctccctgctaacatctcagaggacgctgaggagggcgaggtcagcgatgaggactctgctgatgagattgacgacgactgtaagttacttaacggcgacgcatctacaaatcgcaaacgtgtcgaaaacacagccaaaaggaaattggattctctgattaaagaatcaaagatacgtgattgtgaagatcccaacaattttagtgtgagtactctctctccgtcagggaagttagggagaaagtcaaaagcagaggaggatgtcgagtccggagaggatgctggtgcaagcaggcgaaatggacgtcttgtcgtaggaagtttcagccggcggaagaagaaagggtccaagcttaaaaaagccgcatccgtggaggagggtgacgaaggccaggattctcccgggggacaaagccggggggcaactcggcaaaagaagacaatgaaattgtcaagggcactgtcagatctggtaaaatatactaaatccgtagcaacccatgatatcgagatggaggcggcttcttcttggcaagtcagctccttctccgaaactaaggcgcatcaaattctgcaacaaaagcctgcacagtatttaagattcaatcaacaacagctgtctcgaatctacccatcctcctatagggttgacagtagcaattataacccccagccattttggaacgcgggctgtcagatggttgctttaaattatcagtcagaagggagaatgttacagttgaatcgcgcaaagttctcagccaatggcgggtgcggttacgtcttaaagcctgggtgtatgtgtcagggtgtctttaacccgaattcggaagatccattaccaggccagctgaaaaaacagctggtgttacgtatcatttctggtcagcagctgccaaagcccagagatagcatgctaggggataggggcgagatcattgatccgttcgtggaggttgaaattattggtctaccagtggattgctctcgggaacagaccagagttgtcgacgataatggatttaatcccacatgggaagaaacgctggtgttcatggtacacatgccggagatagcactggtcagattcctggtatgggaccatgaccctattgggcgagactttatcggccagaggaccttggccttctcttccatgatgcctggctacagacacgtgtatttagagggcatggaagaggcaagtatatttgtccatgttgccgtgtcagacattagtggtaaagtgaaacaggctttggggcttaagggactctttcttagagggcccaagcccggtagcctcgattcacacgcagccggaagacccccagcccgcccatcggtgagccagcggatcctgcgacgcaccgctagcgctcccaccaagtcccagaaaccgggccggaggggcttcccagaactggtgctggggacacgtgatacaggctcaaagggtgtagcagatgacgtcgtgccgccaggaccggggccagcccctgaagcacctgcccaggaggggccaggctccggctcacccagggacacacgacctctgtctacccagagaccattgccgccactgtgcagcctcgagaccattgctgaggaaccagccccaggacctggtcccccccctcccgccgccgtccctacatcttctagtcagggaaggccgccatatccaacaggacccggcgccaacgttgcatcccccctggaagacactgaagagcctcgcgacagtaggccacggccatgcaacggcgagggcgctggcggtgcttacgagagagccccaggatctcagacagacggcagatcacagcctcgcactctcggtcatcttccagttatccggagggtcaagtcggagggtcaggtacccactgaacctcttggtgggtggcggcctcttgccgcgcctttccctgctcccgccgtgtactccgatgccaccgggtccgatccattgtggcaaaggctggaaccctgcggtcaccgggatagtgtttctagcagtagttccatgtcctcaagcgataccgtgatagacctctccctcccctccctcgggctcggccggtcgagggaaaacctggctggcgcgcatatggggcgactgcctccacggccacatagtgcgagtgccgcacggcccgatttacctcccgtcactaagtccaagtcaaaccctaacctacgggccacaggtcagaggccccctattccggatgagcttcagccaagatcgctggccccccgcatggctggcctgccttttaggcctccatgggggtgcctcagcctggtgggtgtgcaggactgcccagtggctgccaagtcaaaatcccttggggatctaaccgcggatgacttcgcgccaagctttgaaggtggaagcaggagactgtctcacagcttgggtctcccaggggggacccgccgcgttagtggtccaggggtgaggcgggacactctgactgaacagctcaggtggctcacagtgttccagcaggctggggacattaccagtcctacatctctcggacctgcaggtgaaggggtggcaggggggccaggcttcgttaggaggtccagttcgagatcccatagtcgggttagggccattgcttcccgagctcgccaggcacaggaacggcaacagagattacagggactcgggagacaaggtccccctgaggaagagagagggacccccgagggtgcttgtagcgtgggccacgagggctcggttgatgctccagctcctagtaagggagctctggggcccgcctccgcggccgctgaaaacttggtgctcctccgtctttag

SEQ ID NO: 128731 - DNA, 4143 bp, Artificial Sequence
  Description of Artificial Sequence: Synthetic coding sequence
atgagcgggccatggccttccccggatagccggacaaaaggaacagtcgcatggctagcagaggtgctgctctgggttggagggagtgttgtgctgtcgagtgagtggcaactggggccactcgtggaacgttgcatgggggcgatgcaggaggggatgcaaatggtgaaactgcgcggtggatctaaggggttagtgcgattctactacctcgatgaacatcggagttgcatcagatggcggccttctcgaaagaatgagaaagccaaaatatctatcgactctattcaagaagtgtccgaggggagacagagtgaggtgtttcagcggtaccctgatggtagcttcgacccaaactgttgcttttccatctaccatgggagccacagagaaagtctggacctggtctcaacttcttccgaggttgccaggacttgggtgactgggctccgctacttgatggctggcatcagcgacgaggactctttggcccgtcgacagagaacccgtgaccaatggcttaaacagactttcgacgaagcagacaaaaatggggacggatcgctctccatcggtgaagtcttacaattactccacaagttgaatgtcaatctgcccagacagcgcgtgaagcagatgttccgggaggccgatacagatgaccatcaggggaccctcggtttcgaagagttttgcgccttctacaaaatgatgtccacccgtcgcgatctgtacctgctgatgctcacatacagtaaccacaaggaccatctcgacgccgctagccttcagcgcttcctgcaggtcgagcagaaaatggctggggtcaccctggagtcctgccaagatattattgagcaattcgaaccatgtcctgagaataagagtaaaggcctgctcggaatagatggttttacgaattacactaggtcccccgccggcgatattttcaacccagaacatcatcacgtacaccaggatatgacacagcccttgagtcactactttataacttccagccacaacacatatttggtgggggatcagctcatgtcacagtcccgggtggatatgtatgcctgggttcttcaggccggatgccgctgtgtcgaagtagactgttgggacggcccggatggagaacccatcgtccaccacggttacaccctcacttcgaagattttatttaaagatgtcatcgagacaatcaacaaatacgcgtttataaaaaatgagtatcccgtgatcctttctattgagaatcattgctctgtcatccaacagaagaaaatggcccagtacctgaccgacattctgggggacaagctggatctgtctagcgtgagtagcgaggatgccactacgctcccttcaccgcagatgctgaagggcaaaattctggtaaagggcaagaaactccccgctaatatcagtgaagatgcagaagagggagaggtgtctgatgaggattccgcagatgagatcgatgatgattgcaagctgttgaacggtgatgcaagcaccaaccggaaacgcgtggaaaacactgccaagcgaaaattggacagtctgataaaggagtccaaaatcagggactgcgaggacccaaacaatttctcggtatcaaccttgtctccgagcggaaagcttggtcggaaaagtaaggcagaggaggacgttgaaagcggagaggacgccggcgcctctcggcgcaatggaaggctcgtggtcggaagtttctcgcggcggaagaaaaaaggatctaaactcaagaaagctgccagtgtcgaggagggtgatgagggacaagactcaccgggagggcagtcccggggtgccaccagacagaagaagacgatgaagctaagccgagctttgagtgatctggtgaaatatactaagagtgtggcaacccacgatatagagatggaagctgctagctcatggcaagttagctcgttctcagaaaccaaggcacaccaaattctgcaacagaagcccgctcagtacctacggttcaatcaacagcaactttcccgcatctacccttcatcctaccgtgtggactcctccaattacaaccctcagcccttttggaatgcaggttgccagatgggagtgttcaaccccaattcagaagatccgttacccggccagctgaagaaacagctggttctaaggatcatctcgggtcagcagcttccaaaaccccgggactcaatgctgggagacagaggggagattatcgatcctttcgtggaagtggagattatagggctacccgttgactgcagccgggaacagaccagagttgtagacgacaacggatttaacccaacttgggaagaaaccctcgtgtttatggtccacatgcccgagattgcactggtgaggtttctcgtttgggaccacgacccgattggcagggacttcatcggtcaacgcacattagccttttcaagtatgatgccaggctatcggcacgtgtatctagaaggcatggaagaagcgagcatattcgtccacgtggcagtgtccgacatctccggcaaagttaaacaggcccttggactgaaaggtcttttcctaagggggccgaagcctggttccttggattcccacgctgccgggaggccccctgcccgtccatcagtgtcacagcgtatcctgagaagaaccgcttcagcccctaccaaatcacagaagcctgggaggcggggttttccagagctcgttctcggtacacgcgatacaggaagcaagggggtggctgatgatgtagtaccccccggccctggaccggccccagaggcacctgcccaggagggcccagggagtggttcaccacgggacaccagacccctgagtacccagaggcccctgcctcctctatgttctttagagacaatagcggaagaacctgcaccggggccgggccctccaccaccagccgcggttcctaccagttcatcacaggggcgacccccatatcctaccggccctggcgccaacgtcgcttctccactggaggacaccgaggaacctcgggactcccgacctaggccctgtaatggtgaaggtgcagggggcgcttacgagagagcccccgggtcccaaactgatgggcggagtcaacctagaactcttgggcacctgcccgtaatacgacgtgtaaaatcggaagggcaggtacccaccgagccgttaggaggatggcggcccttggcagccccttttccagcacctgctgtttactctgacgcaacaggctctgacccactgtggcaaaggttggagccttgtgggcaccgggattccgttagttcctccagtagcatgagcagcagcgatacggtgatagatttgtcactgccttcactcggtcttggtcgaagccgggagaacctagcgggggcccacatgggtcggctaccccccagaccccattctgcatcggctgcacggcccgatctgcctcctgtgacgaaatctaaatccaatcccaacctgcgcgctactggacagcgaccccccatccctgacgaattacaacctaggagcttagcccccaggatggccggcctgccattccgccccccctggggttgcctatcactggttggagtgcaagattgccccgtggccgctaagtcgaagtccttaggtgatttgactgcagatgactttgctccatcctttgagggtggcagtagaaggctctcccatagcctcggtctccccggggggacgagacgggtgtcaggtccgggggtaaggagagataccttgacagagcaattacgctggctgacagtgtttcagcaagccggagatattacctcccccacttcattgggcccagccggtgaaggcgtggcgggggggccaggctttgtgcggcggtcctcatctcggtcacacagccgggtacgggccattgcttcccgcgcacgccaggctcaagaaaggcaacagaggctacaaggcctgggcagacaaggcccccctgaagaggagaggggaacaccggagggagcctgtagcgtgggccacgaaggttccgttgatgccccagcaccttccaagggcgcgctgggccccgcctccgccgctgccgaaaacctggtgctattacggctctag

SEQ ID NO: 128732 - DNA, 2136 bp, Artificial Sequence
  Description of Artificial Sequence: Synthetic coding sequence
tgagcattaaactaccagtctgagggaagaatgcttcagcttaatagggctaagttctcggctaacggtggctgcggttatgtcttgaaacctggctgcatgtgtcagggggtgtttaatccaaacagcgaagatcctctgcccggccagctgaagaaacagttagttctccgaatcatcagcggccaacagcttcccaaacctcgcgacagcatgctgggagatcgtggcgagattatcgatccatttgttgaggtggagattatcggcctaccagtggactgcagccgagagcagacacgtgtggtcgatgacaatggatttaacccaacctgggaggaaacactcgtgtttatggtgcacatgcctgaaattgcgcttgtcaggttcctggtgtgggaccatgaccctatcggccgagactttatcggccaaagaaccctggccttctcttcgatgatgcccgggtatcgtcatgtgtatctggaaggaatggaggaagccagcatcttcgtgcatgtggcagtaagcgacatcagcgggaaagttaagcaagctttgggcctgaagggcctgttcctcagagggcctaaaccgggctctcttgactcccacgcagcaggccgtccacctgcgaggccctcggtgagccaaaggattttgcgacgcaccgcctcggcccccactaaatcacagaagcccggcagacgtggcttccctgagttagtgctgggtacgcgcgacaccggctccaaaggggtggcggatgatgtggtgccaccaggtccagggcccgcgccggaagcccctgctcaagaggggcccggttcaggctctcccagagatactcgacctttgtccacacagcgcccactcccgccactgtgttccttggagacgattgcggaggagcccgccccgggcccaggtcctcccccccccgccgctgtaccaacttccagtagccaaggacgacctccttaccctactggcccaggagccaacgtggccagcccactggaagacactgaggaaccccgcgattctcgcccccggccatgtaacggcgaaggcgctggaggcgcttacgagcgagcccctggtagccaaacagatggacggtcccagcctcgcactctgggccacttacccgtaatcagaagagtgaagagcgaaggccaagtgcctactgagcccctgggaggttggaggcctctcgctgcaccctttccagcccccgcagtctattctgatgccaccggatctgaccccctgtggcaacgactcgaaccctgtggacaccgggatagcgtctcgagcagttcaagcatgtcaagtagcgacaccgtgatcgatctgagcctgccgtccctgggcctcgggagatcaagggagaatttggcaggggcccacatgggtcgcctgcctccccgcccacactccgcatccgctgctcgccccgatctgccgcccgtcacaaaaagtaaatcaaatcccaatctgcgggcaacgggccagaggcccccaatcccagacgagctgcagccgcgtagcctggcccctcgtatggcaggactgccctttcgtcccccgtggggatgtctaagcctggtcggcgtgcaggactgcccagtcgccgcaaagtctaaatctctgggagatctcaccgccgacgacttcgctccgtcgttcgaaggaggtagcagacgactttcccacagtttgggtctgcctggcggaacaaggagagtgtctggcccgggggtccggagggatacactgactgagcagttaaggtggctgacagtgtttcagcaggcaggcgacatcacgagcccaaccagcttgggaccagctggtgaaggggtggcaggcggccccggtttcgttcgccgctcgtccagtaggtcacacagccgagtccgcgcaattgccagtagagctcggcaggcccaggagaggcaacagcgtttacagggcctcggccgacagggtccgcccgaagaggagcggggcacccccgagggcgcgtgcagtgtggggcacgagggctctgtggatgctccagcgccgtccaaaggcgcccttgggcctgcatcagccgctgctgagaacctggttctcctgaggctgtag

SEQ ID NO: 128733 - DNA, 3390 bp, Artificial Sequence
  Description of Artificial Sequence: Synthetic coding sequence
atggaggagcctggccccccgggtggcctcagccaggatcaagttgagcgatgcatgggcgccatgcaagaaggaatgcaaatggtgaagctgagaggcggcagtaagggacttgtgcggttttactacctggatgaacataggtcgtgtatcaggtggcggccttcgcggaagaacgagaaggctaaaatctcgatcgatagcatccaagaggtgtcagaaggccgtcagagtgaagtcttccagcggtatccagacggatccttcgatcctaactgctgtttcagtatttatcatggatctcatagggaatctctggatctggttagtacgagcagcgaagtcgctaggacatgggtcactggcttgcggtacttgatggccggcatctctgatgaggattcactggctagacgccagcggactagggaccagtggctgaagcaaacatttgatgaagctgataaaaatggcgatggatcactaagtatcggcgaagttctacaactgctccacaagttaaatgtgaacttgcctagacaacgggtgaagcaaatgtttagggaggccgatacagacgaccaccagggaacgctggggttcgaagagttttgtgccttctataaaatgatgtccaccaggcgcgacctttacctgttgatgctgacctactcaaaccataaggaccacttggatgcagctagcttgcaaagattcctgcaggtggagcaaaaaatggccggtgtgactttggaatcttgccaagacataatcgagcagttcgagccgtgcccagagaataagtccaagggtctgttgggtatagatggcttcactaactacactagaagtccagcgggcgatatttttaatcccgaacatcaccacgtacaccaggatatgactcagccactatctcattacttcattacctctagccacaatacctatctcgtaggagaccagctgatgtcacaatcccgagttgatatgtacgcctgggtgctgcaggccggctgcaggtgcgttgaagtggattgttgggatggcccagacggtgaaccaatcgtgcatcacgggtatacacttacgagtaagatactgttcaaggacgtcatagagaccatcaataaatacgcgtttatcaagaacgagtacccagtcattctgagcatcgagaaccattgcagcgttattcagcagaaaaaaatggctcagtacctcaccgacatactgggcgataaactggacctgagttcggtttctagcgaggatgctacaacattaccatccccacaaatgctgaaaggtaaaatcctggtcaaagggaaaaaactcccagctaatatttccgaggacgcagaggaaggggaagtttcagacgaagattcagcggacgagatcgacgacgactgtaaactgctcaatggcgacgcatctactaaccggaaaagggtggagaatacagcaaagcggaaactcgatagtctgattaaagaatctaagatccgagattgtgaggatcccaataacttctccgtttcaaccctttccccaagcggcaaactggggcgcaagagcaaagctgaagaagatgtagaatccggggaggatgccggcgcgagtcgccggaatgggaggttggtagtcggcagtttttctaggcggaagaaaaagggctctaagctcaagaaggcagccagcgtggaggaaggcgacgaaggccaggattcacccggtggtcagtctcgcggtgcgactcggcagaaaaaaaccatgaagttaagccgtgctctgagcgaccttgtgaaatacacaaagtcagttgctacacacgacatcgaaatggaggcagcctcttcctggcaagtgagctccttctcagagaccaaagcgcaccaaattctgcagcagaagcccgcccagtacctgagattcaatcagcagcagctcagcagaatttacccctcaagctatcgcgtggattcatccaattataaccctcaacctttctggaacgccggttgtcagatggtagccctcaactatcagtctgaagggcgcatgcttcaactcaacagagccaaattctcagccaatggtggctgcggctacgtgctgaaaccagggtgtatgtgccagggggtttttaatcctaactctgaggatccattacccggccagttaaagaagcagctcgtcttgcggattatctcaggtcagcaactaccgaagcccagggatagtatgttaggtgatagaggagaaattatcgatccctttgtcgaagtcgagatcatcggactgccagtggactgttctcgtgagcagacacgggtcgtcgatgacaacgggtttaatccgacatgggaggagaccctcgtattcatggtccacatgcctgagatcgccctagtccgctttctggtgtgggaccacgaccccattggacgcgacttcatcggacagcgtactctggcgttctcctctatgatgcctggttatcgccacgtctaccttgaaggcatggaggaagccagcattttcgttcacgttgcagttagtgatataagtggtaaagtcaagcaagccctgggcctcaagggtcttttcttgcgaggaccgaaaccagggagtctagactctcatgcggccggtcggcctcctgctaggcccagtgtgtcccagcgaattctgagaagaacagccagtgcccctacgaaaagtcaaaaaccgggcaggcggggcttcccagaactggtgctgggcacaagagatactggctcaaagggagttgcagacgacgtggtgccccctggcccaggtccagcgccagaggctccggctcaagagggccccggctccggatcaccaaggggaaaagctccagccgccgtggcagagaaatccccagtaagagtgagaccccccagggtacttgacggacccgggcccgctgggatggccgccacatgtatgaaatgcgtcgtggggtcttgtgcgggagtgaatacaggcggactccagcgagagcgcccaccaagtcctggccctgcgagtcggcaggcagcgatccggcagcaaccaagagccagagccgattcactcggcgcgccgtgttgcggcctggacccccatgctatccccggcaggtccagagaagcacccaaggggcctggtgcctggcggcagggcccaggcgggtctggatcaatgtctagtgattcgtcgagtccagacagcccagggattccagagcggagccctagatggcctgagggcgcatgcagacaaccaggagcattgcaaggagagatgagcgcgctctttgcccagaaactcgaggaaattagatctaagtccccgatgttctcagccgtgagaaactag

SEQ ID NO: 128734 - DNA, 1827 bp, Artificial Sequence
  Description of Artificial Sequence: Synthetic coding sequence
atggaaatgaggtggttcctgagcaagattcaggatgacttcaggggcggaaaaattaatctggaaaaaacgcagagacttctagaaaagcttgatattagatgtagctacatccacgtgaaacagatttttaaggacaatgacagactgaagcagggtagaatcaccattgaggagtttcgggctatttacaggattataacccaccgggaggagatcatagagatctttaacacatatagcgaaaataggaaaatcctgctggcgtccaacctcgcccagtttttgacgcaggaacagtacgccgccgaaatgtcaaaagccatagcatttgaaataatacagaagtacgagcctattgaggaggtccgcaaggctcaccagatgtcactggaggggttcacacgatatatggacagccgcgagtgcctgctctttaagaacgagtgccggaaagtgtatcaggatatgacgcatccactgaacgattactttattagcagctctcacaacacttatctggtgtcggaccagctcttaggtcctagcgatctgtgggggtatgtcagtgcgttggtcaaggggtgcaggtgtctggaaatagactgttgggacggagcccaaaatgagcccgttgtctatcatggatatacgctgacatcaaaactgcttttcaaaaccgtgatccaggcgatccataagtatgcatttatgacttccgattaccccgttgtgttgagcctggagaaccactgttccaccgcccaacaagaggtaatggccgataacctgcaagctacattcggagagagccttctgtctgatatgctggatgattttcctgatacacttccaagcccagaggcattaaaattcaagatcctggtaaagaacaagaagatcgggacattaaaagagacccatgaacggaagggatccgacaaacggggcgataaccaggataaggaaaccggcgtgaaaaaactgcccggcgtaatgctttttaagaagaagaagactaggaagctgaaaatcgccttggccctctctgaccttgtgatctataccaaggccgagaaattcaagagttttcagcattctcggctctaccaacagttcaacgaaaacaattctattggtgagacccaggccagaaagttgtctaagctgcgggtgcatgagtttatttttcataccagaaagttcatcactcgcatttacccaaaggcgactagggccgatagctctaattttaacccacaggagttttggaatattggatgccagatggttgctttgaacttccagactcccggactgccaatggatctacagaatgggaagtttttagataacgggggttctgggtatattctgaagccacattttctccgcgagtctaaatcgtactttaaccctagtaacattaaggaaggtatgcctataaccctcacgattaggctgatatctgggatccaattacctcttacacattcttcgtccaacaagggtgactctctggtgatcatcgaagttttcggcgtgcctaatgaccaaatgaagcagcagactcgggtcatcaagaagaacgcgtttagcccaaggtggaatgaaacttttacttttatcattcatgtgccggagctggccctgattcgcttcgtggtggaaggacaggggttgattgccggtaatgagtttctgggccagtacacccttccacttctgtgcatgaataaaggatatcgacgaatcccccttttctcaaggatgggagagtccctggagcccgcctctctattcgtatacgtgtggtacgtgcgatag

SEQ ID NO: 128735 - DNA, 1242 bp, Artificial Sequence
  Description of Artificial Sequence: Synthetic coding sequence
atgcggtggtttttaagtaaaattcaggacgatttccgcggcggcaaaatcaacttggaaaaaacccagcgtctgctggagaagcttgacatacggtgcagttatattcacgtcaaacagatctttaagacaagcgactatcctgtcgtgctttctctcgaaaaccattgcagcacggctcagcaggaggttatggccgacaacctccaggccaccttcggagaatcactgctgtccgatatgctagacgattttcccgacacgcttcccagccccgaggctttaaaatttaagatattggtgaaaaacaaaaagatcggaaccctcaaagaaactcatgaacggaagggatctgacaaaagaggtgacaaccaggataaggaaactggagtgaagaaactgcctggggtgatgttgttcaaaaaaaagaagactaggaaactcaaaattgctcttgccctgagcgatctggtcatatatactaaagcagaaaagtttaaaagtttccaacattcacggctgtaccagcaattcaacgaaaataacagtattggtgaaactcaagcacgaaagctgagcaagttgagggttcatgagttcatcttccatacacggaagtttataacccggatttaccctaaggccacacgggctgacagttccaatttcaatccccaagagttctggaatatagggtgccagatggtcgcattaaacttccaaaccccaggcttacctatggacctgcaaaacggcaagttcttagataatggaggttcggggtatatcctcaagccccacttcctccgggagagtaagtcttacttcaacccaagcaatattaaggagggaatgcctattactctaacaatacgccttattagcggaatccagctcccactgacacacagttctagcaacaaaggtgatagccttgtgatcattgaagtcttcggggtgcccaacgatcagatgaagcaacaaacacgggtaattaagaaaaatgccttctcgccacgatggaatgaaacgtttacgtttattatccacgtgccagaactggcactcatcagattcgtcgttgagggacagggactcattgcaggtaacgagttcttaggccagtataccctgcccctgttatgtatgaacaagggctatcggcgtattcccctgtttagcagaatgggagagtcactcgaacctgcaagcctgtttgtttatgtttggtacgttcgatag

SEQ ID NO: 128736 - DNA, 1821 bp, Artificial Sequence
  Description of Artificial Sequence: Synthetic coding sequence
atgaggtggttccttagcaagatacaggatgattttcggggcgggaaaatcaacctggagaaaacccaacgcctcctggaaaagcttgatatcagatgcagctacattcacgtgaaacagatattcaaggacaacgataggctcaaacaaggaaggataaccattgaggaattcagagcaatttaccgaatcatcacacatcgggaggagattatagaaatatttaacacctatagcgagaacagaaagatacttcttgcgagcaatcttgcccagttcctgacccaggaacagtacgccgcagagatgtccaaagctattgcattcgagatcatccaaaagtacgaacccatcgaggaggtgaggaaagcacatcagatgtccctagagggctttacccggtatatggactccagagaatgtcttctgttcaaaaacgaatgcaggaaagtttatcaggacatgacccacccacttaatgactactttatttcatcgtcccacaacacctatcttgtttctgatcagctcctgggcccgtccgatttatggggctacgtgagcgcactggtgaaaggatgtcgatgtttggagatcgattgttgggatggagcccagaatgaaccagtcgtgtatcacggctacactcttacttctaaactgttgttcaagaccgtgattcaggccattcataaatatgccttcatgacctcagattaccctgtggtgctgtcattagaaaaccactgctcgactgcacagcaggaagtgatggccgacaacctgcaggcgacatttggagagtccctgcttagcgacatgctggacgacttcccagatactctgccctcccctgaggcactcaaattcaagatccttgtgaaaaataagaaaataggcacgcttaaagagactcacgagcggaaaggatccgacaagcgtggggataatcaagacaaagaaacaggtgtgaagaagttacccggtgtgatgctgtttaagaaaaaaaagacccgcaagctgaaaattgccttagccctctctgacttagtcatttacaccaaggccgaaaaatttaaaagcttccagcattctcgattgtaccagcaattcaatgaaaataacagcattggcgagactcaagcccggaaactgtccaagctcagagtgcacgaattcatctttcacactaggaagttcatcacaagaatttatcctaaggctacacgcgccgacagttccaacttcaacccccaggaattttggaatataggttgccagatggttgctctgaacttccagacccccgggttgccaatggatctccagaatggcaaattcctggataatggtggatccgggtacattttaaagccacactttttaagggagagcaaatcatactttaatcccagtaacataaaagagggaatgccgatcaccctgacgattcgcctgatctcaggaatacaattacctctcacacacagtagtagtaacaagggagactccctggtgatcatcgaggttttcggggtccctaatgaccagatgaaacaacagacacgcgtcatcaagaaaaacgcatttagccctagatggaacgagactttcacctttattatccacgtgccagaattagccttgatcagatttgtggtggaggggcaaggactgatcgctgggaacgaatttctgggtcagtatacactccccctgctgtgcatgaataagggctaccggcgtattcctttgttctcccgcatgggggagagcctggaaccggcctctctattcgtgtacgtttggtacgtccggtag

SEQ ID NO: 128737 - DNA, 1248 bp, Artificial Sequence
  Description of Artificial Sequence: Synthetic coding sequence
atggagatgcggtggttcttgtctaagattcaggacgatttccgcgggggaaagatcaacctcgaaaagacgcagcgactcctggagaaattagacatccggtgttcctacattcacgtcaaacaaatattcaagacttctgattatcccgtcgtcctcagcctggagaatcattgttccacagcccagcaagaagttatggccgataatcttcaagcgaccttcggggagagcctgctgtcggacatgctagatgattttcctgacactcttccaagccctgaggccctgaagttcaagattttggtcaaaaacaagaaaataggcacactcaaggagactcacgagcggaaaggctccgacaagcggggcgataaccaggataaggaaacaggcgtcaagaagctcccaggcgttatgctcttcaaaaagaagaagacacgaaagctaaagattgccctggccctctcagacctcgtaatctacacgaaggctgaaaagtttaaatccttccagcattcccgactttatcagcagtttaatgagaataacagcattggcgagactcaggcgcgtaaactgagcaaactgcgagtccatgagttcatctttcatactagaaagttcatcacccggatctacccgaaagccacacgggccgattcttctaacttcaatccacaagagttctggaatatcgggtgccagatggtggcacttaactttcagacccctggattaccaatggacttgcagaatggaaaattcttggacaacgggggaagcgggtatatcctgaaaccacacttcctacgcgaaagcaagtcatactttaacccaagtaacatcaaagaggggatgcctatcacactcactataagattgatttctggcatccagctgccactgactcacagcagttcaaataagggggactccctagtgatcatcgaggtgtttggcgtgcccaacgatcagatgaaacagcagaccagagttatcaagaagaacgcatttagccctagatggaacgaaactttcacctttattattcatgtgcccgaactcgctcttatccggtttgttgtcgaggggcaggggctcattgctggtaacgagtttctcggacagtatactctccctttactgtgtatgaacaagggctacagacgaattcctctcttctcccgaatgggggagtctttggaacccgcatcacttttcgtatacgtgtggtatgtccggtag

SEQ ID NO: 128738 - DNA, 1212 bp, Artificial Sequence
  Description of Artificial Sequence: Synthetic coding sequence
atggacagcagggaatgtctgttgtttaagaacgaatgcagaaaggtctatcaggacatgactcatccactgaacgactactttatcagcagtagtcacaacacatatctggtttccgaccaactgctgggcccctctgacctctgggggtacgtgagcgcacttgtcaaaggatgccgctgccttgagattgactgctgggatggggcacagaacgagccagtagtgtatcacggttacacgctaacctctaaattgctctttaaaaccgtgatccaggcgatccataagtatgcctttatgacaagcgactaccccgtcgtgttatctctggagaatcactgctccactgcgcagcaagaagtcatggccgacaatttgcaggccacgttcggcgagagtctgttgtccgatatgttggatgattttcctgacaccctgccaagccctgaggcccttaagttcaagatccttgtgaagaacaaaaagattggcaccctgaaagagacacacgagcggaagggatccgacaaaaggggcgataatcaagataaagagaccggtgttaagaagttacctggagtgatgttgttcaaaaagaagaagacgcgcaagctgaagattgcacttgcgctttcagacttggtgatctacacgaaggccgagaagttcaaaagttttcagcacagcaggctctatcagcagtttaatgagaataattccataggggagactcaggcccggaagttgagtaagctacgggttcatgagttcatctttcatactagaaaatttatcacacggatataccccaaggccacgcgggccgactctagcaatttcaatcctcaggagttctggaacatcggatgccagatggtggccttgaatttccagactccgggactgcccatggatttgcagaatggaaagtttctggacaacggtggctcaggatacattctcaagcctcatttcctccgggagagtaagtcatactttaacccatccaacattaaggaaggcatgcctatcacactcacaatcagactaatctctggaatccagctgccactcacacattcctccagcaacaagggtgattccttggtcatcatcgaggtgttcggcgtccccaatgaccagatgaaacagcagacgagagttatcaagaagaacggccagggaaacatggtgattatacccgcctag

SEQ ID NO: 128739 - DNA, 3387 bp, Artificial Sequence
  Description of Artificial Sequence: Synthetic coding sequence
atggcagactgcgtccgtggatgggccgccgtgggcggtgcattaccaacgtctcccggaccaagcctgggagctaagggagccctcaaagcgggcgtgggcgaggatggcgtgggaggaggaaggctggttcacggtagagcaagatatgattctggaggggttagcaatggggattgtagcctgggagtttcaggtgatgaagcaagggcttcccccacaaggggaccacgcggagttgcactcgcccctaccccttccgccgtcgtgtgtactctcccccgagagtccaaacccgggggtctgccaagacgtagttcaatcattaaagacggaacaaagcagaagcgtgaacgcaagaagacagttagtttctcctcaatgcctactgagaagaaaatttctagcgctagcgattgtatcaactctatggtggaagggtccgaactgaagaaggttcgatcaaacagcagaatctaccatcgctattttctgctggacgctgatatgcagagtttgaggtgggaacctagcaagaaagactctgagaaggcaaagatcgatattaaatcaatcaaggaggtgcgcacgggcaaaaatactgatattttccggtctaatggaatttccgatcagatttccgaggactgtgcattcagcgtgatctacggcgaaaactatgagtctctggacttagtggcaaacagcgcagacgtggccaacatctgggtaacaggtctcagatacctgatcagctatggcaagcatacactggatatgctggagtcgagtcaggataatatgcggacaagctgggtttctcagatgtttagtgagatcgatgtcgataatctggggcacatcacattatgtaatgcggttcaatgtattcgcaatctgaatcctgggctgaaaacttccaaaattgagcttaaattcaaagagttacacaagagcaaagacaaggccggaacagaagtcactaaagaagaattcatagaagtgttccatgagctgtgtacacgacccgagatctattttctgctggtgcagttcagcagtaataaggaatttttggataccaaagatctcatgatgttcctcgaggctgagcaaggggttgcgcacatcaatgaggagatctcgctcgaaattatacacaagtatgagccctctaaagaaggacaggagaaggggtggctatcaatcgatggctttacaaactacctgatgtctccagattgctatatctttgacccggagcacaagaaggtgtgccaggacatgaagcagccattgtcccactactttatcaactcatctcacaacacctacctcatcgaagatcaatttaggggaccaagtgacatcaccggttatatacgcgccctgaaaatggggtgcaggagcgttgaactagacgtctgggacggtccagataacgagcctgtgatctacaccggccacacgatgacttcccagatagtgttccgctcagtgattgacatcataaacaaatacgctttctttgcaagcgagtatcccctcattctctgcctcgagaatcattgctcaatcaaacagcagaaggttatggttcaacatatgaaaaagttattgggggacaaactgtataccacttctccaaacgtggaggagagttacctcccatcgccagatgtactcaaaggaaaaatcctgatcaaggcaaagaagctttctagcaattgtagtggggtcgagggagatgttactgatgaggatgaaggtgcagagatgagccagcgaatgggaaaagaaaacatggaacagcctaataacgtgccagttaagcgctttcagttgtgcaaagagctttctgagcttgtatcaatctgcaagtccgtacaattcaaggaatttcaggtttccttccaggtgcagaagtactgggaagtgtgcagttttaacgaggttctagcaagcaaatacgccaatgagaacccgggtgacttcgtgaattacaataaacgcttcttagcaagggtatttcctagccctatgagaattgatagctccaacatgaatccccaggatttttggaaatgtgggtgtcagatcgttgcaatgaattttcaaacccctggccttatgatggatttgaatattggatggtttaggcagaacggaaactgcggctatgtgctacgcccagctattatgcgcgaagaagtgtctttcttcagcgctaacactaaggactctgtgcctggcgttagcccccagctactgcatattaaaattattagtggccaaaatttccctaaacctaagggttcaggagccaaaggcgacgttgtggacccctatgtctatgtggagattcacggtattcccgccgattgtgccgaacagagaaccaagacggtgcaccaaaatggcgatgcccctatttttgatgaatcgtttgaattccaaatcaatctaccggagctggcgatggttcggtttgtcgtgctcgatgacgactatatcggcgatgagtttatcggccagtatacaattcccttcgagtgtctgcagacaggatacagacatgtgcccctacagtctctgacaggagaagtattggctcatgcttcactgttcgtgcatgtggcaatcaccaaccgtcgtggtggtggaaagcctcataagaggggtctgtctgtgaggaaaggcaaaaaaagccgagagtacgcgtccctacgcactctgtggattaagactgtggatgaggtgttcaaaaacgcccagcccccaatccgggacgcaaccgatctgcgtgaaaatatgcagaacgcagtggtgagtttcaaagagctatgcggacttagctccgtggccaatctgatgcagtgtatgctggctgtaagtccaaggtttctcggcccggacaatacgcctctcgtggttctcaacctgtctgagcagtaccccacaatggagctgcaggggattgtgccagaagtattgaagaagatagtgaccacgtatgacatgatgattcagagcttaaaggctttaatagaaaatgccgatgccgtgtacgaaaagattgtccattgccagaaagccgcaatggaatttcacgaacaccttcacagcatcggcaccaaagaggggcttaaggagagaaagcttcagaaggccgtagaatcgtttacttggaacatcactattctcaagggtcaggcggatctgctgaaatatgcaaagaatgaaacattggagaacttgaagcagattcattttgccgctgtgtcttgcggactaaataagcctgggacagaaaatgctgacgtccagaagccacgcaggagtctggaggtgattcctgagaaggccaatgacgagacaggagagtag

SEQ ID NO: 128740 - DNA, 2883 bp, Artificial Sequence
  Description of Artificial Sequence: Synthetic coding sequence
atgccaaccgaaaagaaaatatcgagcgcttctgactgcattaatagcatggtggagggatcagagctgaagaaagtgaggagcaacagcagaatctatcacaggtattttctgctcgatgcggatatgcaatccctccgatgggaaccctccaagaaggacagtgagaaggctaagatagacatcaagtccattaaggaagtgcgcactggcaaaaataccgacattttccgaagcaacggtattagcgatcaaatttccgaggactgtgccttttctgtcatttatggagagaactacgaaagcctggacttggtcgccaacagcgccgatgtggctaatatttgggtgactggcctgcggtatctaatctcttacggcaaacatactctggacatgctggaatccagccaggacaacatgcgaactagctgggtttcccagatgttcagcgaaatcgatgttgacaatctgggccatattacgctgtgcaatgcagtccagtgcattcggaatctgaaccccggtctgaagacctccaaaattgaactcaaattcaaggaactgcataagtcaaaggacaaggccggcactgaggtcacaaaggaggagttcatcgaggtttttcatgagctgtgtacacggcccgaaatttatttcttattagtgcaattttcctccaataaggagtttttggacacaaaagacctgatgatgtttctggaggcagagcaaggcgtggctcatattaacgaagagatttccctggagatcatccacaaatacgaaccctccaaggaagggcaggagaaaggatggcttagtatagatggatttacaaactaccttatgtcccccgattgttatatattcgaccccgaacacaagaaggtgtgtcaggacatgaagcagcccctgtcacattattttatcaacagtagccacaatacctatctgatcgaggatcagttccgcgggcctagcgacatcacaggatacatccgtgccctgaagatgggctgccgtagtgtggaactggacgtgtgggatggccctgacaacgagcccgtgatctataccggtcacacgatgacttctcagatcgtgtttaggagcgtgatagatatcattaacaagtatgccttctttgcctccgagtaccctctcattttgtgcctcgagaatcattgctctatcaaacagcagaaggttatggtccagcacatgaaaaagctactaggcgacaagctgtacaccacttccccaaatgtcgaggaatcatatctgccatcccccgatgtgctcaagggcaagatcctcattaaggccaaaaaactgtcatctaactgttctggcgtggagggcgacgtaacagatgaagatgagggggccgagatgagccagcgaatgggcaaggaaaacatggaacagcccaacaatgttcccgtgaagaggttccaactgtgcaaggaattatcagagttggtgagcatatgtaaatctgtgcagttcaaggagtttcaggtttccttccaggtacagaagtattgggaagtctgcagctttaatgaagttctggcgtctaaatatgccaatgaaaaccccggggattttgttaactacaataagagattccttgcaagggtattcccgagccccatgagaatcgattctagcaatatgaatccacaagatttttggaagtgtggctgtcagatagtcgccatgaatttccaaactcccggcctgatgatggatctgaatatcggctggttcagacaaaatggtaattgcgggtatgtgctgaggcccgcgatcatgcgggaagaagtttccttctttagcgctaacacaaaggattccgtgccaggagtcagcccccaactgctccacattaagatcatttccgggcaaaacttccctaagccaaagggcagcggggcaaagggggacgttgtagatccctatgtttatgtggaaatccacggcatcccagcagactgcgccgagcagcggaccaagacagtacaccaaaacggagatgcacccatttttgatgaatccttcgaatttcagattaacctccccgagctcgctatggtgcgcttcgtcgtcttggacgatgattacatcggagacgagttcatcggccagtatacaatcccgttcgagtgcctacaaactggatatcgccacgtgcccctgcagtctctgacaggcgaggtgttagctcacgcctctctctttgtccatgtagcaatcaccaaccgacgaggcggcggtaagccccataaaagaggcctgtcagtacgtaaaggcaaaaagtctcgggagtacgcgagcttgcggaccttgtggatcaaaactgtggatgaggtgttcaaaaatgcacaacccccaattcgagacgccacagacttaagagagaacatgcagaatgcggtggtatccttcaaagagttgtgcggtttgagctccgttgccaatttaatgcagtgtatgttagctgtgtcaccacggttcttgggacccgataatactccactggtggtgctgaatctgtccgagcagtatcctacaatggaactacaaggaattgtgcccgaggtgctgaagaagatagtcactacttacgatatgatgattcagagcctgaaagccctgattgagaacgccgatgccgtttacgaaaaaatcgtgcactgtcaaaaggctgcaatggagttccacgaacaccttcacagcattggaaccaaggaagggctgaaagagaggaaattgcagaaagctgtggagagctttacatggaatatcactatcctcaagatcaggaagacaggccggaggtcaatatttgttccccagacacctattatggtgtag

SEQ ID NO: 128741 - DNA, 3006 bp, Artificial Sequence
  Description of Artificial Sequence: Synthetic coding sequence
atgcccacagagaagaaaatttcatccgcaagcgactgtatcaactctatggtcgagggttccgagctcaagaaggtccgctcgaatagtcggatctaccataggtatttcttgctggatgcggacatgcagtccctccgctgggagccttctaagaaggatagcgaaaaggccaagatcgacataaaaagcatcaaggaggttcgtactggcaagaatactgatatttttcggtctaacgggataagcgaccagatttcagaggactgtgcatttagcgtgatctatggggagaattatgaatccctcgatctagtcgccaattcggctgatgtcgccaacatctgggttaccggactgcggtatctcataagttacggaaaacacacacttgacatgctggaatcttcacaggacaacatgcggacaagttgggtgtcacagatgttcagcgagatcgatgtggataacctgggccacatcacattgtgcaacgcagtccaatgcattcgcaacttaaaccccgggcttaaaacatctaagatcgagttaaagttcaaggagctgcacaaatccaaagataaagctggaacagaagttacaaaagaggagtttatcgaggtctttcatgagctctgcactcgaccagagatttactttctcttagtacaattctccagtaacaaggaatttttggacaccaaggatttgatgatgtttctggaggccgaacaaggggttgcccatataaacgaggagatcagtctggaaatcattcataagtatgagccatctaaggagggacaggaaaaagggtggttgtccattgatgggtttaccaactacttaatgagtccagactgttacatcttcgacccagagcataagaaagtctgccaggacatgaagcagcctttaagtcattatttcataaatagctctcataacacctacctgatcgaagatcaattccgcggcccatcggacattaccggctacatccgggctctcaagatggggtgtcggagtgtagaactcgacgtatgggacgggccggataatgagccagtgatttacactggtcacactatgacctctcagatcgttttcaggagcgtcatagacattattaacaaatacgccttcttcgcctccgagtatccccttatcctgtgcctggaaaatcactgtagcataaagcagcagaaggtgatggtgcagcatatgaaaaaactgcttggagacaaactctataccacttcccctaatgtggaagaaagctaccttccttctcccgacgttctgaagggcaagattctaattaaagccaagaagctcagtagtaattgttctggggtggagggagatgttacagatgaggacgagggagcagaaatgagtcagcggatgggtaaggaaaacatggaacaacctaacaatgtccctgtgaagagatttcagctttgtaaagaactgagtgagctggtttccatatgtaaatccgtacagtttaaagagttccaggtctccttccaagttcagaagtactgggaggtttgctcatttaatgaagtccttgcatccaagtacgccaacgagaaccctggcgattttgtaaattacaataagcgcttcttggctcgtgtgtttccttctcctatgcggatcgattcaagtaatatgaacccacaggatttctggaagtgcggctgccagatagtggcgatgaattttcagacccctggacttatgatggacctcaatattgggtggtttcggcaaaatggtaattgtggctacgtcttaaggccagcgattatgagagaggaggtaagcttcttttctgcaaataccaaagattccgtccccggggtctctccacagctcctgcacattaaaattatcagtgggcaaaactttcctaagccaaaggggtctggggccaaaggtgacgtggtggatccctacgtctatgtggagatacacggcatccccgccgattgtgccgagcagcgaacaaagaccgtgcatcagaatggcgacgcccctattttcgacgagagttttgagttccagatcaatcttcccgaacttgctatggtgcggttcgtggtcctcgacgatgactatatcggggacgagtttataggccagtatactatccctttcgagtgtctgcagaccgggtacaggcacgtacctttacagagccttacaggcgaggtcctcgcccatgcatcactctttgtgcacgtggcgatcaccaaccgtaggggcggggggaagcctcacaagagggggttgtcagtgcgcaaagggaaaaagtcccgcgagtacgccagcctgcggacgctatggatcaagaccgttgacgaagtgttcaagaacgcccaaccacctatcagagacgcaactgacctgcgggaaaatatgcagaatgccgtggtcagttttaaagaactgtgtggactgtcatccgtggcaaacctcatgcagtgtatgctggctgtcagcccgaggttcctcggtcccgataacaccccactagttgtattgaatctgagtgaacagtaccctactatggaactccagggcatcgtgcctgaagtgctgaaaaaaatcgtgactacttatgacatgatgatccagtcgctgaaggctcttattgagaacgccgacgctgtctacgaaaagatagtccactgtcaaaaagcagctatggaattccatgagcacctgcattccattggtacaaaagaaggactgaaggaaagaaagctgcagaaggcagtagagtcatttacatggaacatcactatcctgaagggacaggctgaccttctgaagtacgccaaaaacgagacccttgaaaatcttaaacagatccactttgctgccgtctcatgcggcctgaacaaacctggaacggagaacgccgacgttcagaaaccaaggcggagcctcgaggtcattcccgagaaagcaaacgatgaaactggagagtag

SEQ ID NO: 128742 - DNA, 3006 bp, Artificial Sequence
  Description of Artificial Sequence: Synthetic coding sequence
atgcccacagaaaagaaaatttcgtccgcatccgactgcataaacagcatggtagagggctcagagcttaagaaggtgcgatccaactctaggatttatcacagatacttcttgctggacgccgacatgcagagtctgaggtgggaaccgagcaaaaaggactcagaaaaggccaagatcgatatcaagagtattaaagaggtccggaccggcaagaatacagacattttcaggagcaatgggatctctgatcaaatttctgaggattgcgccttctctgtgatctacggagagaattacgagtccttggacctggtggcaaacagcgccgacgtggctaacatctgggtcaccggcctgcggtacctcatatcttacgggaagcatacactcgacatgctggaatctagccaagacaatatgaggacaagttgggtttcacagatgttctctgaaatcgatgtcgacaacctgggccacatcaccctctgtaatgccgttcagtgtattagaaacctgaaccctggactgaagactagtaagatcgagttgaaattcaaggagctacataaaagcaaggacaaagcaggcaccgaggtcacgaaagaggagttcatcgaagtcttccatgagttgtgtacaagaccggagatttacttcctgcttgtccagttctcatccaacaaggagtttctggataccaaggacctcatgatgttcttagaagcggagcaaggcgtcgctcacattaatgaggaaatctctcttgaaataatccacaaatacgagccaagtaaggagggtcaggaaaagggatggctgagtatcgacggattcacaaactatctaatgtcccccgattgctacatttttgacccagagcacaagaaagtgtgtcaggacatgaaacagccattatcgcactattttatcaattcttctcataacacctatcttattgaggatcaattcagaggaccttcggacattaccggttacattagagccctgaagatgggatgccgaagcgtcgaactggatgtgtgggacgggccagacaatgagccagtgatttatacaggccatacaatgacgagtcagatcgtcttccgctctgtcatcgacataatcaataaatacgcattctttgcttccgaatatcctttaatactgtgcctggagaaccactgctccattaagcaacagaaagtaatggtgcagcatatgaagaagttgcttggagataagctatatacaacttcacccaacgttgaagaatcttacttaccgtcacccgatgttctgaaaggaaagatcctgattaaagccaaaaagctgagcagcaactgctcaggggtcgaaggagacgtgacagatgaggacgaaggcgctgagatgtcacagagaatgggtaaagagaacatggagcagcccaataatgtccccgtaaagagattccagctgtgcaaggagctctccgaactcgtcagcatctgcaagtctgtgcaattcaaagaattccaggtcagttttcaagtccagaagtattgggaagtgtgctcgtttaatgaggtcttggcttccaaatatgccaacgagaacccaggagactttgtaaactataataagaggttcttagccagagtctttccttctcccatgcgcatcgacagttcaaacatgaacccccaagacttctggaagtgcgggtgtcagattgttgcaatgaatttccagaccccaggacttatgatggaccttaatataggctggtttcggcagaacggaaattgcggctacgtattgcgaccggcgatcatgcgggaagaggtgtcctttttctcagccaataccaaggactctgtgcctggagtgtcgcctcaattgctccacataaaaattattagtggacagaactttcccaagccgaaaggatccggcgccaaaggcgatgttgtggatccctacgtttacgtcgaaatccacggtatccctgccgactgcgctgagcagaggacgaagaccgtccaccagaatggagatgcaccaatattcgacgagtcatttgagttccagattaatctaccggagctggctatggtccggtttgtggtcctggatgatgactacatcggggatgaattcattgggcagtacaccattccattcgagtgcctgcagacaggctaccgccacgtgcccctgcaatctctaactggagaagttctagcacacgcaagcctctttgtgcacgtcgcaatcactaacagaagggggggcggcaaacctcacaagagaggactctccgtccgaaaaggaaaaaaaagtcgagaatacgcatccttacggaccctatggatcaagacagtggatgaagtgttcaagaacgcgcaaccaccgattcgtgatgcgactgatctcagagagaatatgcagaacgcggtggtgagcttcaaggagctctgcggactctccagtgtggccaatctaatgcagtgcatgctcgcagtcagccccaggttcttggggccggataacacgccgctcgtagtgctcaatctgagcgagcagtaccccacaatggagttgcaaggaattgtgccagaggttctgaaaaaaatcgtgactacatacgatatgatgattcagagtctcaaggcattaatcgaaaatgcggatgcagtgtacgagaaaatcgtacactgtcagaaagccgccatggaatttcacgaacacctacactccatcgggaccaaggaaggtctaaaggagaggaagttacagaaagccgttgaaagtttcacttggaacatcactatactaaaagggcaggctgatttgctgaaatacgccaaaaatgaaacactcgaaaatctgaagcagatccatttcgcagctgtatcctgcgggttgaacaaacccggtactgaaaacgccgatgtgcagaaacctcggcgaagtctggaagtcatcccagaaaaggccaatgacgaaacgggcgagtag

SEQ ID NO: 128743 - DNA, 2802 bp, Artificial Sequence
  Description of Artificial Sequence: Synthetic coding sequence
atgactgctactccagagagcctctttcctacgggcgatgagctggactcatctcaactgcagatggaaagtgacgaggtggacactctgaaggaaggcgaagatcccgctgataggatgcacccattcttggcaatctacgagttgcagtccctgaaagtgcaccctctggtgttcgcacctggcgtaccagtaactgcccaggtggttgggactgagcggtatacctcaggcagcaaggtgggtacttgtacgctgtattctgtacggctcactcatggcgatttcagttggactacaaaaaagaaataccgtcatttccaagaactccacagggatctgttgcgacataaggtgctgatgtctctcctgccacttgcccgcttcgccgtggcgtacagccctgcaagggatgcagggaacagagagatgccaagtctccctcgtgccggccccgaggggagcacccgacacgctgcatctaaacagaagtatttagaaaattatctgaatagattgttaacaatgagcttctaccgcaattatcacgccatgacagagtttctagaggtgagccagctgtcttttatccccgacctgggccgcaaggggctcgagggcatgatacgaaagagatctgggggtcatagagtccctggactgacctgttgtggccgtgaccaggtgtgctaccgttggagtaagagatggttggtcgttaaagacagttttctgctgtatatgtgcctggagaccggtgcaatctcattcgttcaattgttcgacccagggttcgaagtgcaggtgggaaaaaggagcaccgaggcacggcacggagtccggatcgacacatctcatagatctctgatccttaaatgcagcagctataggcaggctcgatggtgggcccaggagattaccgaacttgcacagggcccagggcgggacttcctgcagctgcaccgacacgattcttatgcaccacctcgcccaggaacactagccaggtggttcgtaaatggggctggctatttcgccgccgtcgccgacgcaattttgcgcgcacaggaggagatttttataacggactggtggctctcaccagaagtgtatctgaaacgcccagcgcacagcgatgattggcggctggatatcatgttaaaaaggaaggcggaggagggggtacgagtgagtattctgctgtttaaggaggtggaattagccttgggcattaacagcggctattctaaaagagctctgatgttgcttcatccaaatatcaaggtgatgcggcaccccgaccaggtgactctgtgggcacaccacgaaaagctgctcgttgtggatcaggttgtcgcattcttggggggtctagatcttgcctatgggcggtgggacgacctgcactacaggctgaccgacctcggggactcaagtgaaagcgctgcctcacagcctcctaccccgcgtccagactctccagccacaccagacctttcccataatcaatttttttggttagggaaagactatagcaatctcataacaaaagactgggtgcagctggaccggccatttgaggacttcattgacagagagacaaccccccgcatgccttggcgcgatgtgggtgtggttgtgcacgggcttccagcacgcgatcttgccaggcattttattcagcggtggaacttcaccaaaacgacaaaggcaaaatataagacgccaacttatccctacctgcttccaaaaagcacatccacggccaaccagttaccctttaccttacccggtgggcagtgtaccacagtccaggtgttacggtccgttgacagatggagtgccggcaccttggaaaactcaattctgaacgcgtacctgcacacaatcagagagagtcagcattttttgtatattgagaaccagttcttcatcagctgcagcgatggccgcaccgtgttgaacaaggttggggacgaaattgtggaccggattcttaaggcgcataagcaagggtggtgctacagagtatacgttctccttcccttactcccgggttttgaaggggacatctctacaggcggaggcaacagcatccaggctatacttcatttcacctacagaaccctctgtcgcggcgagtactcaatcttacacagattgaaggccgccatgggcactgcgtggcgcgactatatttctatctgcggcctgagaacacacggggagttaggtggccatcctgtgtcggaactgatttacatccatagcaaagtgcttatcgccgatgatcgcacggtgattatcgggtctgcaaacatcaacgaccgttccctcctgggcaagcgggactcagagttggccgttctcattgaggataccgagacggaaccttcccttatgaacggcgctgagtatcaagcaggcaggttcgccttgtccctgagaaaacactgcttcggggtgattcttggagcaaacacaagaccagatctggatttacgtgatccaatttgtgacgattttttccagttgtggcaggatatggccgagagcaatgcaaatatctatgagcagattttccgctgtctcccatctaacgcaacccgatcgctgcgaaccttgcgagagtatgtggcggtcgagccccttgccacagttagccctccactagcaagatccgagcttacacaagtgcaaggccatctggtacattttccactgaaatttttggaagacgagagcttacttccccccctgggttctaaagaggggatgatcccgctggaagtctggacctag

SEQ ID NO: 128744 - DNA, 2769 bp, Artificial Sequence
  Description of Artificial Sequence: Synthetic coding sequence
atgactgcaaccccagagtctttattcccaaccggtgacgagctggactctagtcaattgcagatggagagtgacgaggtcgataccctgaaggaaggagaagatccggccgatcgaatgcaccccttcctggcgatttatgaactgcagagcctcaaggtacaccctcttgtgtttgctcctggcgttcctgtgactgctcaggtggtgggaaccgaacggtacacatctgggtccaaagtgggaacctgcaccctttatagcgttcgactgacccacggggacttctcttggactaccaagaagaaataccgacacttccaggagctgcatcgcgacctattgaggcacaaggtgctgatgagcctcctgccacttgcgcgctttgccgtagcatactctccagcacgggacgcaggcaatcgcgagatgccttcgctgccacgagccggccctgagggctccaccagacatgccgccagcaagcagaagtacctggaaaattatttaaaccgcctgctgactatgtccttttatcgaaattatcatgctatgaccgagttcctggaagtgtctcagctgagtttcatacctgaccttggaaggaaggggctggagggaatgatcaggaaaagaagcgggggccaccgggtgccaggactgacctgttgcggcagggatcaggtgtgctatagatggtcgaagagatggctagtggtgaaggattccttccttctgtatatgtgtttggaaactggtgctatctctttcgtgcaactcttcgatccaggatttgaagtacaggtgggtaaaagatccaccgaggcgcgccacggtgtgcggattgacacgagtcataggtcactgattctcaagtgttctagctataggcaagcaagatggtgggctcaggaaatcaccgaactggcacagggccctggccgcgatttcttgcagctccacagacatgatagttatgccccccctcgtcctggaaccttggctaggtggtttgtcaatggcgccggatatttcgcagccgtggctgacgccattctacgggcccaggaagagattttcatcactgactggtggctgagccctgaggtctatcttaaacgcccagcccattcagacgactggcgcctggatattatgttaaaaaggaaggctgaagaaggtgtccgcgtctctatactcctgtttaaggaggttgagctcgccctagggataaactcaggttacagcaagagagccttaatgctcttgcatccaaacattaaagtcatgaggcaccccgaccaggttactctgtgggcccatcacgagaaattgctcgttgtggatcaggtcgtggcttttctcggagggcttgatttagcctacggccgctgggatgatctgcattacagactcactgatttgggagatagctctgaaagcgcagcgtctcagccacccaccccgcgtccggattcccctgccaccccagatctgtcccacaaccagtttttttggctcgggaaggattatagtaatttgataacaaaagattgggtgcagctagatagaccgttcgaggattttattgatcgggagactacgcctaggatgccatggagggacgttggggtagtggtccacggtcttccagcccgagaccttgcaaggcacttcatccaaaggtggaacttcaccaaaaccaccaaagctaagtacaaaacccccacctatccttacctcctgccaaagagcacatccaccgctaaccagttaccttttaccctccccggggggcagtgcaccactgtacaggttctgcggtctgtagaccgttggtcggcaggaactctcgagaactcaattctgaacgcctacctgcacaccatcagagagtcacagcatttcctttacattgagaaccaattttttattagctgctctgatggcagaacagtcctcaataaggtcggtgacgagatcgtggaccggatcctcaaagcccacaaacagggctggtgctaccgcgtttatgtactgctaccactactgcccggatttgagggtgatattagtacagggggaggaaattccatccaggctatcctgcactttacctaccgcactttgtgtaggggagagtactcgatcctgcataggcttaaggccgcaatgggaactgcttggcgggactacatttccatatgcggactccggacacacggcgagttgggcggacatcccgtttcggagctgatttacattcatagcaaagtactcatcgccgacgatagaacagtaattattggttcagccaatattaacgaccggagtttgctgggtaagcgggattccgagctcgctgtgttgatcgaggatactgaaactgagccaagtctgatgaatggggccgagtaccaggctgggagtgtaatactgggcgcaaatacccggcccgacttggatctgcgggatccaatttgcgatgatttctttcagctgtggcaggacatggccgaatccaacgctaacatctatgaacaaatctttcgctgtctgcccagcaatgctacgagatcgctgaggactctcagagaatatgtagccgttgagcctttggcgacagtgagcccgccgctggcccggtctgaactcactcaagtgcaaggccacctcgtccactttcccctgaaattcctcgaagatgagagcttgctccctcccctgggttccaaggagggcatgatcccgctggaggtttggacatag

SEQ ID NO: 128745 - DNA, 957 bp, Artificial Sequence
  Description of Artificial Sequence: Synthetic coding sequence
atggataagcaaaattctcagatgaacgccagtcatcccgagaccaatttgcccgtcggatatcctccacaataccctcccacagcctttcagggaccccctgggtactctggttacccaggacctcaggtctcctaccctccaccaccggccggacacagcggtcccgggccagccggcttccctgtgcctaatcaacctgtgtacaatcagccagtatataaccagccagtgggagccgcgggggtgccctggatgcctgctccgcagccgcctctgaactgtcccccaggactcgaataccttagtcagatagatcagattttaattcaccagcaaatagaactcctcgaggttttgactggcttcgagacgaacaacaagtatgagattaagaactcctttgggcagcgggtctatttcgccgcggaagacaccgactgctgtacccggaattgctgtggcccctccagaccctttactcttagaattattgacaatatgggccaggaggtgattaccctcgaacggcctctgcgctgttcgagctgttgctgtccctgctgcctccaggaaatcgaaatccaggctcctcccggggtcccaatcgggtacgtgattcagacttggcacccttgcctgcctaaatttactatacaaaatgagaaacgcgaagatgttctgaagatatctggcccctgcgttgtatgcagctgttgtggtgatgtggactttgagataaaatctctggacgagcaatgtgtcgtgggcaagataagcaagcattggaccggaatcctcagagaagcattcaccgacgccgacaatttcgggattcagttcccattagacctggacgtcaagatgaaggctgtcatgatcggagcgtgttttctgatcgatttcatgtttttcgagtcaacaggcagtcaggaacagaagagtggggtctggtag

SEQ ID NO: 128746 - DNA, 93 bp, Artificial Sequence
  Description of Artificial Sequence: Synthetic coding sequence
atgaaggccgtgatgattggcgcctgcttcctgatcgattttatgttctttgagtccaccggaagccaagagcagaagagcggcgtctggtag

SEQ ID NO: 128747 - DNA, 750 bp, Artificial Sequence
  Description of Artificial Sequence: Synthetic coding sequence
atggacaaacagaacagccagatgaacgcaagccaccctgagacaaacctccctgtcggctaccccccgcagtatccccccacggcttttcaagggcctccaggatacagcgggtatcccggtccccaggtttcctacccaccacctcccgcaggacactccggaccaggccccgccggctttccagtgcctaaccagccagtctacaaccagcctgtgtataatcagcctgtcggagctgcaggagtcccatggatgcctgctccgcagccacctctcaactgtcctcctggcttagaatacttaagccagatagaccagatcctgatccaccagcaaattgagttacttgaggtgctgacaggctttgagacaaataacaagtacgaaatcaagaacagctttgggcagcgcgtctatttcgccgctgaagatactgactgctgtacacggaattgctgtggaccatcacgcccttttacactcaggatcatcgacaatatgggacaagaggttattaccctcgaaaggcccctcagatgtagctcctgctgttgcccttgttgcctccaggaaattgagattcaggctccgcctggcgttccaattgggtacgtaattcagacatggcatccctgcttgcccaagtttacgattcagaacgaaaaaagagaagacgtgctcaagattagcgggccatgcgtcgtatgttcatgctgtggcgacgttgacttcgaaataaaatcatag

SEQ ID NO: 128748 - DNA, 675 bp, Artificial Sequence
  Description of Artificial Sequence: Synthetic coding sequence
atgccagctccccctccccctctgaactgtccccctggtctcgagtacctgtcacaaatagacatgatattgatacatcagcagattgaactgctggaggtgttattctcatttgagtctagtaacatgtacgagattaagaatagttttgggcagcggatctacttcgccgcagaggatacaaatttctgcatcagaaattgctgtggccgctcacgaccgtttacgttgagaatcaccgataatgttggcagagaagtaattacacttgagaggcctcttcggtgcaactgctgctgctgtccatgctgtctgcaggaaatagaaatccaggctccccctggtgtcccagtgggctatgttacccagacgtggcacccatgcctgaccaaattcactatcaagaatcagaaacgcgaggacgtgcttaagatctcaggcccttgtatcgtctgcagttgcattgccggggttgattttgagatcacatcactggatgagcaaatcgttgtaggacgaatctccaagcattggtctggttttctccgagaggcttttacagacgctgacaactttggcatccagttccccagggatctcgacgtgaaaatgaaggccgtgatgattggagcatgcttcctgatagattacatgttcttcgagaggacacggtag

SEQ ID NO: 128749 - DNA, 486 bp, Artificial Sequence
  Description of Artificial Sequence: Synthetic coding sequence
atgcccgcccctccccccccactgaactgcccccctgggctggagtacctgtctcagatagatatgatcctgatacaccagcagattgaactgctggaagtactattctcctttgaatccagcaacatgtatgaaattaaaaacagttttggccagagaatctacttcgccgcagaggacacaaacttctgcatccgcaattgctgtggtcgctcccggccattcacccttaggatcacagacaacgttggccgcgaagtgattacgctcgagcgcccactgaggtgtaactgctgttgttgcccatgttgcctacaggagatagagatacaggccccccctggagtgcccgtggggtacgttactcaaacgtggcacccctgtttaaccaagtttaccattaagaaccaaaaaagagaagatgtgctgaagatcagtggcccttgcatcgtgtgctcttgtattgccggcgtagacttcgaatag

SEQ ID NO: 128750 - DNA, 894 bp, Artificial Sequence
  Description of Artificial Sequence: Synthetic coding sequence
atgcgttcttggaattctttattttgcctcaactcctctcgccccccaggtcacattgtctatcctaagcaccaagcggggcacacagggaaacaggcggatcacctcggctcgcaagctttttatcccggcaggcagcatgactacctggtgccgccagccggtacagcaggcatccccgtgcagaaccaacctggcagacccgaaggagtgccttggatgcctgctccaccaccacccctgaattgccccccggggctggaatatctgagccaaattgatatgatattgattcaccagcagattgagctgctggaggtcctgtttagttttgagtccagtaatatgtatgaaattaaaaattcctttggacagcgcatctattttgctgctgaggacacaaatttctgcatcagaaattgctgcggacgatctcggccttttactctgagaatcacagacaatgttggtcgcgaagtgattactttggaacgaccgctgcggtgtaactgctgttgttgtccttgttgcctgcaagaaattgagatccaggctccgcctggagttccagtgggctacgtgacacagacttggcatccttgtttaacaaagtttacaatcaaaaaccagaagagggaggacgttttgaagatttctgggccctgcatcgtgtgctcatgcatagcaggcgtcgactttgagatcacctcgttagatgagcagattgtcgttggaaggataagcaaacattggtctgggtttttgcgggaggcttttacagatgcggacaactttggcattcagttcccccgtgatctggatgtgaagatgaaagcggttatgataggggcctgctttctgatcgactatatgttttttgagaggaccaggtag

SEQ ID NO: 128751 - DNA, 951 bp, Artificial Sequence
  Description of Artificial Sequence: Synthetic coding sequence
gtgtcagctcatctgcgcttttttctggccatcattctgagagattccggcctgtgggccgaatggcgcatgaagccgtttcagatccatctgcctggtccccccggacacatcgtttatcctaagcatcaggctggtcacaccggaaagcaagctgatcacctgggatctcaggccttctaccccgggaggcagcatgattaccttgtgcccccggctggtactgcggggatccccgtccaaaaccagcccggcaggccggagggtgttccctggatgccagctccgcccccgcccctgaactgtcctcctggcctagaatacctaagccaaattgacatgattctgattcaccagcaaattgagctgctcgaggtactgttctcgtttgagtccagcaatatgtacgaaatcaaaaacagctttggccagaggatctactttgcagcagaggacacaaacttctgcattcgcaattgctgtggtcgcagcagacccttcacactgcgcatcacggataacgtgggccgtgaggtcatcacactcgaaagacctcttcgctgcaattgctgttgttgtccctgctgcttgcaagagattgagattcaggcccctcccggcgtgcccgttggctatgtaactcagacctggcacccctgtctgaccaaattcacaatcaagaaccaaaagagggaagacgttctcaagatatcgggcccttgcattgtgtgcagctgtattgccggtgttgattttgagattacaagcttggacgaacagatcgtggtcggcaggatttccaagcactggtcaggctttttgcgagaagccttcacagacgccgataactttggtatccagttcccccgtgaccttgacgtgaagatgaaggcagtgatgattggggcttgcttcctcatagactacatgttcttcgaaagaacgcgttag

SEQ ID NO: 128752 - DNA, 888 bp, Artificial Sequence
  Description of Artificial Sequence: Synthetic coding sequence
atggccggatatctgcctccgaaagggtacgccccatccccgccccccccttatcctgtcacacccgggtaccccgagccagcattacaccctggtcccgggcaggcccccgtgcctgcacaggtccccgccccagctcccggattcgctctgtttccttcaccgggacccgtcgccctcggcagcgccgcaccatttttgcccctgcctggcgtcccgtctggtctcgagttcctggtacagatagaccagatccttattcaccagaaagctgaaagggttgaaaccttcctaggttgggagacatgcaatcggtatgaactgaggagcggggccggccagcctttaggccaggctgctgaggaatccaactgctgcgccagattgtgctgcggcgccagacgaccccttagggtgcgcctcgccgacccaggggatcgggaggtgctacggctcctgagaccgttgcactgcggttgtagttgctgtccttgcggcttacaggagatggaggtccaggccccacccggaactacgatcgggcatgtgctgcagacgtggcatccgtttctgcccaagtttagcatccaggacgccgacagacaaacagtgctaagggttgtcgggccctgttggacctgtgggtgcgggaccgataccaacttcgaggtgaagacacgcgatgaatcacgatctgtgggccgtatttcgaagcagtggggaggattggtccgcgaggcccttacggacgcagacgacttcggactccagttccccctggatctagatgtcagagttaaagctgttctgttaggtgcaacatttctaatcgattacatgttcttcgagaagcgtggcggcgccggaccatcagccgtgacatcctag

SEQ ID NO: 128753 - DNA, 672 bp, Artificial Sequence
  Description of Artificial Sequence: Synthetic coding sequence
atggcaggctacctcccacccaaaggatatgcaccttcgcccccgccgccttatccagtgacgccaggttaccccgaacctgccctgcaccccggacctggccaggccccagtgcccgcacaggtcccggctccagctcccggcttcgcgctgtttccttccccaggccctgtagctttgggcagcgcggccccattcttacccctccccggcgtcccttcaggattggaattccttgtacagatcgaccagattttaattcaccagaaggcagaacgggtcgagacatttctgggctggaggcctgtgattggaatgaactgcgctctaggcccgggatccccatgggtgagacgcccaaggcgggccaccgctgccccagtctgcgccgtcgctcccgcagggagatgcgtgagcgcctggcctacccccggaacagtgaggtgttgtgtttgttccgcccggtgcacggtggcagcagcagccgcacctgtggcctccaggagatggaagtacaggctgcaccaggctccgcctttggcgacatgctatcgacctggtatcccctcatctccaagttccccttcacgtatgccgatcgcccgccaatcgtgtgaatggtggggaccagctgggcctgtggcggttgcgcagacccctactctgcggtag

SEQ ID NO: 128754 - DNA, 888 bp, Artificial Sequence
  Description of Artificial Sequence: Synthetic coding sequence
atggctggttacctccccccgaagggatatgcacccagtccacctcctccgtaccccgtgacccccgggtatcctgaacccgccctacacccagggccaggccaggcaccagtgcctgctcaggtcccggctcctgctccaggatttgcgttattccccagccctgggccggtcgccctgggctcagccgcccccttcctgccactaccaggggtgccaagcggactggagttcctggttcaaattgaccagattttaatacaccaaaaggcagaacgcgtggaaacctttctcgggtgggagacttgcaacagatatgagctccgctccggagccggccagcccctggggcaggccgctgaagagagcaattgctgtgcccgcctttgctgcggtgccagacggcctttacgagtgcgcttggcggaccccggcgaccgggaggtcttgcgcttactacgcccactgcactgtgggtgtagttgctgtccctgcggtctgcaggagatggaggtccaggctcctcccggcacgaccattggacacgttttacagacgtggcatccctttctgccaaagttctccattcaggatgccgaccgccagacagtacttcgcgtggttggaccctgctggacttgcggatgcggtacagatactaattttgaagtgaaaaccagagacgaatcaaggagtgtgggaagaatttccaaacagtggggggggctggtgagagaggcgttgactgatgcggacgatttcggactccagtttccactggatcttgacgttcgggtcaaggcggtccttctgggagcaacatttctaatcgactatatgttctttgagaagaggggaggggccggcccaagcgccgtgacctcttag

SEQ ID NO: 128755 - DNA, 888 bp, Artificial Sequence
  Description of Artificial Sequence: Synthetic coding sequence
atggcagggtatctgccccctaaaggatatgccccatcacccccaccaccttatcccgtgacccccggttacccagaaccggcgttgcaccccggaccaggccaggccccagtacctgcccaggtgcctgcccccgcccctggatttgccctgtttccttctccaggaccagtggctctgggctccgccgcgcccttcctgcccctgccaggggtaccatctgggttggagttcctggtgcaaatcgatcaaatactgatccaccagaaagccgagagagttgagacttttctggggtgggagacttgtaataggtatgaactcagatccggggctggccaaccgctcggccaggcagctgaggagagcaactgttgcgctagactgtgctgtggcgcgcgtcggcctcttcgcgtgagactcgctgatcctggcgatagggaagtgctgagactgcttcgtccacttcactgtggatgttcatgctgcccctgtggcctccaggaaatggaggtccaggcccccccaggcactaccataggtcacgtgctgcagacctggcacccctttttgcctaagtttagcatccaggacgcagaccggcaaaccgtgctccgtgtggtgggcccatgctggacatgtggatgtgggacagatacaaactttgaggtgaaaactagagatgagtcacgctccgtgggaaggatttcaaagcagtggggggggttggtgcgagaggctctgacggacgccgacgatttcggcctgcagttccccctggacctggatgtgcgggttaaagctgttctgcttggagctaccttcctgatcgattatatgttttttgagaagagggggggcgccggaccgtctgcagtgactagttag

SEQ ID NO: 128756 - DNA, 990 bp, Artificial Sequence
  Description of Artificial Sequence: Synthetic coding sequence
atgtcgggggtggtgcctaccgcccccgaacagccagcaggcgaaatggaaaaccagactaagccacctgatccccgacctgatgccccgcccgagtacaatagccacttcctcccgggaccacctgggacagcagtgcctccgcctactggctacccaggtgggcttccaatgggctactactccccccagcagccctcgaccttcccactataccagcctgtcggggggatccatccggtaagataccaacctgggaaataccctatgccgaaccagtctgtgcctatcacctggatgcctggtcccacacctatggccaactgtccccccggactggagtaccttgtccagctcgataatatccatgtcctccaacattttgagcccttagagatgatgacatgtttcgagacaaacaataggtatgatatcaagaataattcggatcagatggtgtatattgtgactgaggacacggacgattttacccggaatgcttaccggacacttaggccttttgtactgcgagtcaccgactgtatgggccgcgagattatgactatgcaacgcccctttcgctgcacatgctgttgcttttgctgcccgagcgcacggcaggagctagaagtccaatgtcccccaggcgtgacaataggatttgtagctgaacactggaatctgtgtcgtgccgtgtactcaatacagaatgaaaagaaggagaatgtgatgagagtaagagggccctgctctacctatgggtgcgggtcagacagcgtgttcgaggtcaagtccttggacggcatttcaaatatcgggtccattatccgaaagtggaatggtctgctaagtgctatggccgacgcagaccactttgacatccacttccccctcgaccttgatgtgaagatgaaagcaatgatctttggggcttgcttcctgatagactttatgtatttcgaaaggagcccgccccagagaagtcgctag

SEQ ID NO: 128757 - DNA, 720 bp, Artificial Sequence
  Description of Artificial Sequence: Synthetic coding sequence
atgagcggagtcgtgccaactgcgcctgaacagcccgccggggagatggaaaaccaaaccaaaccacccgaccctagacccgacgctcccccagagtataatagccatttcctccccggccctcccgggacagcagtccctccccctaccgggtatcctggcggactcccaatgggctattatagtccacagcaaccttcaaccttccccttgtatcaacctgtgggtgggattcatccagttcgctaccagccaggcaaatacccgatgccaaaccaatcagtgccaattacctggatgccgggaccaacccctatggcaaactgcccacccgggctggaatatctggtgcagctcgaagtgcagtgcccccccggggtcacaatcggtttcgttgctgagcattggaatctctgccgggccgtgtacagtatccagaatgaaaagaaggagaacgtgatgagagtgcgcggaccgtgcagcacctatggttgtggtagtgattcagtatttgaggtgaagagcctggatggcatatctaatatcggctcaatcatcagaaaatggaacggactcctgagcgctatggctgacgccgaccattttgatattcattttcccctggacctcgacgttaagatgaaggcgatgatttttggcgcgtgctttttaatcgacttcatgtacttcgaacgctcccctccccagcgaagcagatag

SEQ ID NO: 128758 - DNA, 990 bp, Artificial Sequence
  Description of Artificial Sequence: Synthetic coding sequence
atgtcaggggtggtccccaccgccccagagcagcccgcgggtgaaatggaaaaccagacaaagcctcctgacccaaggccggatgcgccccccgagtataattcccatttcctgcccggcccgcctggaacagctgtgccgcctccaaccggctaccctggcggcctgcccatgggttactattcaccacagcagccaagcacctttcctctttatcagcccgtgggtgggatccaccccgttcgatatcagccgggcaaataccccatgccaaatcagtccgtgcccatcacctggatgcccggccctacacccatggcaaactgccccccgggactggaataccttgtgcaacttgacaatatacacgttttacagcatttcgaaccactggagatgatgacctgtttcgaaactaataaccgctatgacatcaagaataattctgatcagatggtctatattgttacggaagacacggacgacttcacccgcaacgcctataggactttgagacctttcgtattgcgagtgaccgattgcatgggtagagaaattatgacgatgcaacgcccctttaggtgcacctgctgttgcttctgttgcccctccgcccggcaagaactcgaggtccagtgtccaccaggagtaaccattggcttcgtggccgagcattggaacttatgcagggccgtgtattccatccagaatgaaaagaaagaaaatgttatgagagtgagaggtccatgcagtacgtatggctgtggttcagatagtgtctttgaagtgaagagcttggacgggatctcaaacattgggtcaattattcgcaagtggaacggattgctgtcggctatggccgatgccgaccactttgacattcattttcccttagacctggatgtgaagatgaaggctatgatttttggtgcctgcttccttatcgatttcatgtacttcgagcgctcccctccccagcggtcgaggtag

SEQ ID NO: 128759 - DNA, 789 bp, Artificial Sequence
  Description of Artificial Sequence: Synthetic coding sequence
atgtctggcgttgttcctacagcgcccgaacagccagccggggaaatggagaaccagacaaaaccaccagatcctaggcccgacgctcctcccgagtataattcacacttcctgcccggtcccccaggaaccgccgtcccaccacccacgggatatcctggcggcctgccaatgggctactactccccccagcagccatctacttttccactctaccagccggtgggcgggatccaccctgtgaggtatcagccgggcaagtaccccatgccaaatcagagcgtgccgattacatggatgcccgggcccaccccaatggccaattgtccacccggcctcgaatatttggtccaactggataatattcatgtcctacagcatttcgaacccctagagatgatgacatgtttcgagaccaataacaggtacgacattaaaaataactcagatcaaatggtttacattgtgaccgaagacaccgacgacttcactcgaaatgcttatagaacattaaggcccttcgtgctgcgtgtgaccgactgcatgggtagggagattatgactatgcagcggcctttccggtgcacatgttgctgcttttgctgcccctccgcccgtcaggagctggaggtgcagtgtcccccaggggtgactataggcttcgtcgctgaacactggaatctgtgtagggcagtgtattccattcagaatgaaaagaaagagaacgtcatgcgggtaagggggccctgttctacctacggctgtgggagcgactcagtatttgaatag

SEQ ID NO: 128760 - DNA, 627 bp, Artificial Sequence
  Description of Artificial Sequence: Synthetic coding sequence
atgagcggcgttgtcccaacagccccagaacaaccagccggggagatggagaatcagactaaaccccctgatcctaggccagatgctcctcctgagtacaacagccatttcctgccaggccccccaggcacggccgtgcctccccctacaggctaccctggaggacttcccatggggtattactcgccccagcagccctcaacctttcctttgtatcaacccgtggggggcattcatcccgtccgataccaacccggcaaataccccatgcccaatcagtcagtgcccatcacatggatgcccgggcccaccccaatggctaactgcccacctggcttagaatacctggtgcagctcgataacatccatgttctccagcacttcgaaccactcgagatgatgacatgttttgaaactaataatagatatgatatcaaaaacaatagtgatcaaatggtgtacattgtcacggaggataccgatgacttcacacggaatgcttatagaaccttgcgtcccttcgtactgcgggtgacagattgcatgggccgagagatcatgaccatgcaacgcccttttcggtgtacctgttgctgtttctgctgtccaagtgcgcggcaggagtag

SEQ ID NO: 128761 - DNA, 429 bp, Artificial Sequence
  Description of Artificial Sequence: Synthetic coding sequence
atgagtggggtagttcccacagcacccgagcagcccgctggggagatggaaaaccagacgaagcccccagaccccagacctgacgcgcctccagagtataatagccacttcctgcccgggccgcctggcacggccgtgccccctcctacagggtaccctggtggcctgcctatgggctattattccccacagcagccatctacattcccattataccaaccggtgggaggaatccaccctgtgcgttatcagcctggaaagtaccctatgcctaatcagagcgtccccatcacttggatgccgggaccaaccccaatggccaactgccctccaggactggagtacttagtgcagctagataatatccacgtgctccaacatttcgagccattggaaatgatgacttgcttcgaaactaataatagatag

SEQ ID NO: 128762 - DNA, 990 bp, Artificial Sequence
  Description of Artificial Sequence: Synthetic coding sequence
atgagcggcgtggtgcctactgctcccgaacagcccgctggagaaatggagaatcagacaaaaccccccgacccgcggcccgatgcgccacccgagtacaacagtcacttccttcccggccctccaggcaccgcagttcctccgcctacaggataccctgggggacttccaatgggctattatagccctcaacagccgagtacttttccgctgtaccaacccgtcggcggaattcatccggtcagataccaaccggggaaatacccaatgccaaaccagtccgtgcccataacatggatgccaggaccaacgcctatggctaattgcccccctggactagagtacctcgtacaactagataatattcacgtgctgcagcactttgagcccctcgagatgatgacgtgcttcgagaccaataatcgctatgacatcaagaacaattctgaccagatggtttatatcgtgaccgaggacacagacgactttacccgcaacgcttatagaaccttgagacccttcgttctcagagtcacagactgtatggggagggagataatgacaatgcagcgcccgtttaggtgtacatgttgctgcttctgctgtccttctgccagacaggaattggaggtgcagtgtccccccggcgtaactattgggttcgtcgccgagcactggaatctatgccgcgcagtctacagcatccaaaatgagaagaaagagaacgtaatgagagttagaggcccttgctccacctatggatgtgggagtgacagtgtatttgaagtgaaatctctcgatggcatctccaacatagggtccatcattcggaagtggaatggccttctaagtgccatggccgatgcagatcatttcgatatacacttccctctggacctggatgtaaaaatgaaagctatgattttcggtgcttgctttctgatcgactttatgtactttgagcgttcgcctccccagcgaagcagatag

SEQ ID NO: 128763 - DNA, 297 bp, Artificial Sequence
  Description of Artificial Sequence: Synthetic coding sequence
atgtcaggagtggtccccaccgcacctgaacagcctgccggagagatggagaaccagaccaaacctccagacccaagacccgacgctcctcctgagtataactcccactttctgccaggacctcccggcactgcagttcctccaccaactggatatccagggggccttccaatgggatactacagccctcaacaacccagcaccttccctctgtatcaaccagtgggtggaattcaccctgtgaggtatcagcccggaaagtacccgatgccgaaccagagtgtccctattacctag

SEQ ID NO: 128764 - DNA, 675 bp, Artificial Sequence
  Description of Artificial Sequence: Synthetic coding sequence
atggagaaccaaacgaaaccccccgatccgaggcccgacgcccctccagagtacaactcccacttcctcccaggccctccaggcacggccgtgccacctccaaccggataccctggggggctgccaatgggctattatagccctcaacaaccttccactttcccgctgtaccaaccagttggaggcatccatcccgtccgctatcagcccggtaaatatcccatgcccaaccagtcagtgcctattacatggatgccaggcccaacccccatggccaactgcccaccggggctggaatatctcgtccagctggaggtccagtgtcctcctggagtgactattgggttcgtggccgagcattggaacttgtgcagggccgtatacagcatccagaacgaaaagaaagagaatgtgatgagggtcaggggcccctgctctacctacgggtgcggaagcgactcagtcttcgaggtgaagtctctcgacggcatctccaacatcggtagcataatccgcaaatggaatggcctcctttctgccatggcggacgcggatcatttcgatattcatttccctctggatctcgacgttaagatgaaagccatgatctttggggcttgtttccttatcgactttatgtacttcgagagatctccgccacaacgtagccgatag

SEQ ID NO: 128765 - DNA, 1326 bp, Artificial Sequence
  Description of Artificial Sequence: Synthetic coding sequence
atggccctgtttggagcactgttcttagccctcttagccggagcacacgccgagttccctggatgcaagatcagggtaacttcgaaagccctggagctagtgaaacaggaaggattaagattcctggaacaagaactcgagactatcaccatccctgatctgcgagggaaggaaggtcacttctactacaatatctcagaagtcaaggtaacagagctccagctgacctcttctgaactcgacttccaaccacagcaggaacttatgttgcagattacaaacgcctctttggggctgagatttcgacggcaattgctttactggttcttaaaagtgtacgattttctgtccaccttcatcactagcgggatgagattcctcttgaaccagcaaatctgcccagtgttataccatgcaggaactgttttgttaaatagcctcttggacactgtgcccgtgcgtagtagcgtggatgaactggttggaatcgactacagtttaatgaaggatcccgtggcgtccacctcgaatctggacatggactttaggggggccttttttcctctaacagagagaaactggtctctcccaaaccgagccgtagagccgcagttgcaagaggaagaaaggatggtttacgtggcattctccgagttcttttttgacagtgcgatggagagctacttccgtgccggggctttacagctactgctggtaggggataaggtaccacacgacctggatatgctactccgagctacatatttcggcagcatcgtgctgttaagccccgcagtgatagactcccccctcaagctcgagctaagggtcctggcaccgccccgatgtacaatcaagccctctggcaccaccatctctgtgaccgcttcagttactatagccttagtgccccccgatcagcctgaggttcaactgtctagtatgacaatggatgctcgcctgtcagccaaaatggccctcaggggcaaagctctccgaacccaactggatctccggcggttccgaatctattcaaaccacagtgcccttgagtcactcgctctcatccctctccaggccccactgaagaccatgcttcaaattggcgtgatgcctatgctgaacgagcgtacgtggcgcggcgtgcagattccattgccggaaggaataaacttcgtgcatgaagtcgttactaatcacgcgggtttcctgacaattggcgcagaccttcatttcgccaagggcctgagggaggtcatcgagaagaaccgtccagccgacgtgcgcgcctccacggctcccaccccatccacagcagcagtgtag

SEQ ID NO: 128766 - DNA, 1482 bp, Artificial Sequence
  Description of Artificial Sequence: Synthetic coding sequence
atggctctgttcggcgccctttttctagccttactcgcaggggcccacgctgagttccctgggtgcaagattagagtgacgagcaaggctctggaactggtaaaacaggaaggcctccggtttctcgagcaggagctggagaccataacaatcccggacttgagagggaaggaaggtcacttctattacaatatcagcgaagtgaaggtcaccgaactgcagctcacttcctccgaactggacttccagccccagcaggagctgatgctccagataacaaatgcatccctgggccttcgattccgccgccaactactgtattggttcttctatgacggtggctacattaacgcaagtgctgagggtgtcagcatcagaactgggctggaactctcccgggatccggccggcagaatgaaagtgtcaaacgtgtcttgccaagcgagtgtgtcaagaatgcacgctgcgttcggggggacgtttaagaaagtttacgatttcctctctacatttatcacctccgggatgcgcttcctgctcaaccagcagatttgtccagttttataccacgctggcactgtgctcttgaacagccttctggataccgttcccgtgcgttcatcggtggacgaattagtcggtatcgactactccctgatgaaagatcccgtagcgagtacctctaatctggacatggacttcagaggcgcctttttccctttgaccgaacggaactggtccttaccgaaccgtgctgttgaaccccaattgcaggaggaggaacgaatggtatatgtcgcattcagcgagttcttcttcgattccgcaatggagtcatattttcgagcgggagcgctgcagctgctgttggtcggggacaaggtcccacatgatctggacatgttactgagagcaacatacttcgggagtatcgtccttctgagccccgccgttatcgacagccctctgaaactggagctccgggtgctggctccccctcgctgcacaatcaagccttcaggcacaactatctccgtcaccgctagcgtgaccatcgcacttgtgcctcctgatcagcctgaggtacagttgagctctatgacgatggatgcaagactgagcgcaaagatggccctgagggggaaggccctgagaactcaactggacctccgaaggttccggatctactccaatcattccgccctcgaatctctggcgctcatcccactgcaggctccactcaagacaatgctgcagattggagtgatgccaatgctcaacgagagaacctggcgcggtgtgcagatccccctacccgagggcattaattttgtccacgaagtcgtgaccaaccatgcaggctttttaaccattggggccgatctgcactttgcgaaaggtttgcgggaagtgatcgaaaaaaaccgccctgctgacgtcagggcctccaccgccccaacgccttctaccgcagctgtctag

SEQ ID NO: 128767 - DNA, 1482 bp, Artificial Sequence
  Description of Artificial Sequence: Synthetic coding sequence
atggcattgtttggcgcgctgttcctcgcattgctggcaggagctcacgcggaattcccagggtgcaagattcgcgtgaccagcaaggcacttgagcttgtcaagcaggaaggtctgaggttcctggagcaggaactggaaacaataactattcctgacctgagaggcaaagaagggcacttctactataatatttccgaagtgaaagtgacagaactgcaactgacctctagtgagcttgactttcagcctcagcaggaattgatgctccagattacaaatgcctctctaggactgcgcttccgaaggcagcttttatactggttcttttacgacggcggctatataaatgcaagcgccgaaggagtatcaatccggacggggttggagctgtcaagagatcccgcgggcaggatgaaagtgagtaatgtgtcttgtcaggcgagcgtttctcggatgcatgctgcctttggcggcactttcaagaaggtgtacgactttctcagtacatttattaccagtgggatgcgattcctgctcaaccagcagatttgtccggtgttgtatcatgctggcacagtgctacttaactccctcttggacaccgtgccggttagaagctctgtggatgagctggtagggatcgactactcgttgatgaaggatccagtggcctccaccagcaatctggacatggacttccgcggagcattcttcccgttgactgaacggaattggtccctgcctaacagagccgtggaaccacaacttcaagaggaagaaaggatggtgtacgttgctttctccgaatttttcttcgattctgccatggaatcctacttccgcgccggagcactacaactcctgctggtgggagacaaggtgccacacgatttagatatgctgttgcgggccacatattttggatctatcgtgttactgagtcctgccgtgattgattctcctttaaaattagagcttcgggttctggccccacccagatgtactattaagccctccggcactactatttccgtaactgcaagtgtcacaatcgccttagttccccctgatcagccagaggtacagctgagtagtatgactatggatgccaggctttccgctaaaatggccctacgcggtaaggccttgcggacacagctcgacctccgcagatttcggatatactctaaccattctgcactggaatccctggcattgatccccctgcaagcaccgctcaaaaccatgctgcagattggcgttatgccaatgctaaacgagcggacttggaggggagttcagatccccctgcccgagggtatcaatttcgtgcatgaagtggtgaccaatcacgccggcttcctgaccattggggcagatttacactttgcaaagggcctgagggaggttatcgagaaaaacagacccgcagacgttcgcgccagtactgcacctaccccgtccacagccgccgtgtag

SEQ ID NO: 128768 - DNA, 1542 bp, Artificial Sequence
  Description of Artificial Sequence: Synthetic coding sequence
atgggtctgagtggttctgacaatagctgtgatccgaccccacctcccggcccactggccatggctctgtttggtgccctctttctggctctacttgccggcgctcacgccgagtttcccgggtgcaagatccgcgtgacttccaaggccttggagctagtgaaacaggaaggccttaggtttctcgaacaggagctagaaacgatcacgatccctgatctccggggcaaagaggggcacttctattataatatcagtgaggttaaggtcaccgagctacaattaacgagctctgagcttgattttcaacctcagcaggaactgatgctgcagattaccaatgcaagtctgggcctaagatttcggagacagttactgtactggtttttttacgacggtggctacattaatgcttctgcagagggggtgtccatcaggactgggttggagcttagccgagatcctgccggccgaatgaaggtgagtaacgtcagctgtcaggcgtccgtaagtagaatgcacgccgctttcggaggaactttcaagaaggtttacgattttctctccactttcataacatcggggatgcgatttctgctgaatcagcagatctgtccagtgctctatcacgccgggacggtgctcctaaactccctgttggataccgtgccagttaggtcctcggtggatgagctggtcggcattgattactccttaatgaaggaccccgtggcatctacttccaacctggatatggacttccggggtgcatttttccccctgaccgagaggaattggtccttacccaaccgagccgtggaaccacagttgcaggaggaagagcgcatggtatacgtggctttctccgaattcttcttcgattctgcgatggagagctatttccgggccggagctctgcagctcctcctggttggagacaaagtgccacatgatctggacatgctcctgagggcaacatattttggttccattgtacttctttcccctgccgtgatagattctcccctgaaactcgagctgagggttttggctccgcccaggtgcacgatcaaaccgagcggcactactatctctgtgaccgcaagcgtgactattgctctggtcccacccgaccagcccgaggtccagcttagttcaatgacaatggatgccaggctcagcgccaagatggcactgcggggaaaagcgctgcggacccagctggacttgcgaaggtttcgcatatactccaaccactctgccctggagagcctggccctgatcccgttgcaggcgcccctgaaaaccatgctccagattggcgtaatgcccatgctcaatgagcgaacgtggcgaggagtacagatccccttgcccgaggggatcaactttgtacacgaagtcgtgaccaaccatgctggatttctcacaatcggggcggatctccacttcgccaagggtttgcgggaagttatcgaaaagaaccggccagctgatgtgagagcttctaccgcccctaccccgagtacggccgcagtgtag

SEQ ID NO: 128769 - DNA, 1218 bp, Artificial Sequence
  Description of Artificial Sequence: Synthetic coding sequence
atgctgcaaattaccaacgctagtctcggcttgcgctttcggagacagctattgtactggtttttctacgacggcggatacatcaacgccagcgcagagggagtttcaatacgcaccggcctcgaactgagtagagatccagccggacgtatgaaagttagcaatgtgtcatgccaggccagtgtgagtcgaatgcacgcggcttttggtgggacatttaaaaaagtttacgatttcttgagtacctttattacctctggcatgaggtttctacttaaccagcagatctgtccagtgctgtatcatgcagggactgtgctcctgaatagcctgcttgacacagttcccgtgaggagctcagtcgacgaattggtggggattgactattctctgatgaaagatccagttgcctctacaagcaacctcgatatggactttcgcggagcatttttccccctcaccgaacgcaattggagtctgcccaaccgggcagttgagcctcaactgcaggaggaggaaaggatggtgtatgttgctttcagtgaattctttttcgatagtgctatggagtcttactttcgcgccggtgcattgcagttgctgctggtaggggacaaagtaccacatgatctggatatgttacttcgcgctacatattttggctccatagtcttactgtctcctgctgtgatcgactctccacttaaactggaattacgggtgctggctccacctagatgtacgattaagccctccggaaccaccatctcagttaccgcctcggtgaccatcgcccttgtccccccagaccagcccgaggtgcagttgtcatctatgacaatggacgcacggctcagtgccaaaatggccctcagaggtaaagcccttcgaacccagcttgacctgcgtcgattcagaatctacagcaatcactccgccctcgaatctctcgcactgatacctctgcaggcccctctcaaaacgatgctgcagattggtgttatgccaatgcttaacgagaggacatggaggggagtgcagatccctcttcccgagggaattaacttcgtgcatgaggttgtgactaatcatgcaggctttcttactatcggcgctgacctgcacttcgctaagggattacgtgaggttatagagaaaaatcgacccgctgacgtaagggcatctactgccccaacacctagcacagccgctgtgtag

SEQ ID NO: 128770 - DNA, 1197 bp, Artificial Sequence
  Description of Artificial Sequence: Synthetic coding sequence
atggctctgttcggagccttgttcctggccctacttgccggagcccacgctgagttccccggatgtaagatccgcgtaacttcaaaagcgctggagcttgtaaagcaggagggactgaggtttctggagcaagagctggaaacaattacaatccctgatctaagaggcaaagagggacacttctactataatatatctgagaaggtctatgactttctgtctactttcatcaccagcggaatgagattcctcttgaaccagcaaatatgccctgtcctgtatcacgccgggacagtactcttgaattcacttctggatacagttcctgttagaagctcagtggacgagctcgtcggaatcgattacagtcttatgaaagatccggtggcatcaacgagcaatcttgatatggattttcgcggcgcattttttccactcacagaaaggaactggtcacttccaaatagagcagtggaacctcagctgcaggaggaggaacgcatggtgtacgtcgcattctctgagttcttttttgacagtgcgatggagtcttattttagagctggtgccctccagttactgctagtcggggacaaggtgcctcatgatttggatatgttgctgagagccacttactttggcagcattgtgctgttgtcacccgccgttatcgattctccacttaaactggaactacgagttctcgcaccgccacgatgtacgatcaagccctcgggcactacaatctccgtgacggcctctgttaccatcgctctggttccacctgatcagcccgaagtccagctctcctctatgacaatggacgcaaggctatccgccaagatggcactccggggcaaggccctgcggacgcagcttgacctgcgaaggttcagaatctactctaatcattcagccctggagtccttggccctgattcctctccaggcccccctcaagaccatgctgcaaattggggtgatgcccatgctgaacgagcgcacctggagaggcgttcagatccccctgcctgaaggcataaactttgtgcatgaagtggttaccaaccatgctggcttcctgacaatcggtgccgacctacactttgcaaaaggactccgcgaagttatcgaaaagaaccgtcccgctgatgtgcgggccagcaccgcacctacacctagcaccgctgcagtctag

SEQ ID NO: 128771 - DNA, 2343 bp, Artificial Sequence
  Description of Artificial Sequence: Synthetic coding sequence
atggcaccttactcattgttggtaacacggctgcagaaagccctgggggtgcgccagtaccacgtggcgtccgtgctttgtcagagagccaaggttgcaatgagccacttcgagccaaatgagtacatccattacgacctactggagaagaacatcaatattgtcagaaagcgtctaaacaggcccttgacactgtccgaaaaaatcgtctacggccacctggacgaccctgcaagccaggagatcgaacggggcaagagttacctgaggttgcgtccagacagggtcgcaatgcaagatgctacagcccagatggctatgctccagtttattagttctggcctgagcaaggtcgccgtgccctccacgatacactgtgatcatttaatcgaagctcaggtggggggagaaaaggacctgcgacgggcaaaggatatcaaccaagaagtctacaacttcttggctacagctggcgcgaagtacggggtgggattctggaagccagggtcaggaatcattcaccagatcatattagaaaactacgcttatccaggcgtactgcttataggcaccgactctcacaccccaaacggcgggggtctgggagggatctgcataggcgtcgggggggccgacgccgtggatgtgatggcaggtattccgtgggaacttaagtgtcccaaagtgatcggcgtgaaactaaccgggagcttgtctggctggtcatcccccaaagacgtgatcctgaaagtggcggggattctgactgtcaaaggcggcacaggtgctattgttgagtatcacggtcctggtgtggatagtatcagctgtacgggtatggctaccatctgtaatatgggggcggaaattggtgctacaacttctgtgttcccctacaaccacagaatgaagaaatacctgtctaaaaccggaagggaagatatcgccaacttagctgacgagttcaaggatcatctggtgcctgaccctggatgccactacgaccagctcatcgaaataaacctctcagagctcaagccacacataaatggaccatttacacccgatttggcccatccagtggccgaggtcgggaaagtggcagagaaggaagggtggccattggacatccgagtgggactgataggctcttgcacgaactcaagctatgaagacatgggccggagcgctgccgttgccaagcaggcactggcccatggccttaagtgcaagagccagtttacaattactcctggtagcgagcaaattcgggccaccatcgaaagggacggctacgctcagattctgcgtgacctgggaggcatcgtgctcgccaacgcatgcgggccttgcatcggtcagtgggatcgcaaagacatcaaaaaaggcgagaaaaacaccattgttacatcctataaccgtaacttcaccggtcggaacgatgcaaatcctgagactcatgcattcgtaacgtcaccagagatcgtgaccgcactcgccatcgccgggactcttaaattcaacccggagacagattatctaactggaacggacggaaagaagttcaggctcgaagcacccgacgcagacgaactcccaaagggtgaattcgacccagggcaggatacataccagcacccccccaaagatagctctgggcaacacgttgacgtgtctccaacttcgcagcgcctgcagctcctagagccgtttgacaagtgggacggaaaggatctagaagacctgcagatcctaatcaaggtcaagggcaaatgtacaacagaccacatttctgccgctgggccctggctgaagtttagaggacatctcgacaacatatcgaacaacctccttattggagcaattaacatcgaaaatgggaaggccaacagcgtaaggaatgctgtcacccaggaatttggacccgtccctgatacggcccgatattataaaaaacacggtattagatgggttgttataggggatgagaattatggagaaggatcgtcaagggagcatgcggccttggagcctcggcaccttgggggtcgagcaatcataactaagtccttcgcccggatacacgagaccaacctgaaaaagcaagggctcctgcccctgactttcgctgatcctgccgactacaataaaattcaccccgtggataaactcacgatccagggactaaaggactttacgcctgggaagccactcaaatgcattattaaacatccaaacggtacgcaggagaccatcctgctcaaccacaccttcaatgaaacccaaattgaatggtttcgcgctgggtccgctttaaataggatgaaagagctccaacagtag

SEQ ID NO: 128772 - DNA, 741 bp, Artificial Sequence
  Description of Artificial Sequence: Synthetic coding sequence
atggctgcccctggaccagccctatgtttgtttgacgttgatggtacactgaccgctcctcgccaaaaaatcaccaaagaaatggatgacttcctccagaaactccgacaaaaaatcaaaattggtgtcgttggcggctcagacttcgaaaaggtgcaggagcagctggggaatgacgtggtcgagaaatacgattatgtatttccagaaaatggcttggtagcttataaggacgggaagctgctgtgccggcagaacattcagtctcacttgggcgaggcccttattcaagatttgatcaattactgcctttcctacatcgcaaaaatcaaactccccaagaagagaggcacttttatagaattccggaatgggatgctgaacgtgtctccaattggacgttcctgtagccaggaggagcggatcgaattttatgaactggataagaaagagaatatccgacagaaatttgtcgccgacctgcggaaagagtttgccggtaaggggctgacattcagtatcggcggccagatttcttttgacgtgtttccagacggatgggataagagatattgcttacggcatgtggaaaatgatggctacaagacgatctattttttcggcgataagactatgcccggtggcaacgaccacgaaatttttaccgacccaaggacaatgggctatagcgtgactgcccctgaggacaccaggaggatctgcgaactgttgttcagctag

SEQ ID NO: 128773 - DNA, 366 bp, Artificial Sequence
  Description of Artificial Sequence: Synthetic coding sequence
atgctcaatgttagtcccatcggacggtcgtgctcccaggaagagagaatcgagttttacgagctggataagaaggaaaacattcgacaaaagtttgtggccgatctgagaaaggaattcgcgggtaaaggtctaacattttcaattggtggtcagattagctttgacgtgttccccgatggatgggacaaaaggtactgtcttcgccacgtagagaatgacggttataagaccatctatttcttcggggataagaccatgccaggcgggaatgaccatgaaatcttcacagacccaaggactatggggtattccgttacggcaccagaagatacccgcagaatctgcgagttactgttttcctag

SEQ ID NO: 128774 - DNA, 492 bp, Artificial Sequence
  Description of Artificial Sequence: Synthetic coding sequence
atgatgaatattcagtctcaccttggagaagcccttatccaggatctcattaattattgtctgagctacattgccaaaataaagcttccgaaaaagaggggcacatttatcgaatttagaaacgggatgcttaacgtgtctccgatcgggcggtcgtgctctcaagaggagcgaatcgaattctacgagctggataaaaaagagaatatcaggcagaaattcgtggccgatctgcgcaaggaattcgccggaaagggcctgacgtttagcattgggggtcaaatcagctttgatgtgtttccagacgggtgggacaagcgctactgtttacggcacgtcgaaaacgacgggtataaaactatctacttttttggtgacaagaccatgccaggggggaacgaccatgaaatatttacagatccaaggaccatgggatactctgtgacggcaccagaggacacccgtagaatctgtgaattgcttttcagctag

SEQ ID NO: 128775 - DNA, 579 bp, Artificial Sequence
  Description of Artificial Sequence: Synthetic coding sequence
atggctcctttggggggagccccacgcctcgtcctgctcttttctggaaagcggaaatcaggaaaagactttgtaactgaggctctgcagtcgcgactcggtgccgacgtttgcgccgtgctgcgtttgtcaggccccctcaaggagcagtacgctcaggagcatggcctcaatttccagcgcctcctagacacttcaacatacaaggaagcttttcgcaaagatatgatacgctggggagaggaaaagcggcaggctgacccaggatttttctgtaggaaaatcgtagagggcatttcccagccaatctggctggtgagcgacacaaggagggtcagcgacattcagtggttcagggaggcttacggagccgtcacccagaccgtcagggtggtagcgctggaacagagccggcaacagaggggttgggtgttcacccctggggtggacgatgccgaatctgaatgcggactggataatttcggggatttcgattgggtgatagagaatcacggcgtagaacagaggcttgaagaacagctagaaaatttaattgaatttattagatctagattgtag

SEQ ID NO: 128776 - DNA, 615 bp, Artificial Sequence
  Description of Artificial Sequence: Synthetic coding sequence
atggaacccaaagcctcctgcccagcggccgcccctttgatggaaagaaagtttcacgttttggtcggcgtcacaggatctgtggcagctctaaaactgcctttactcgtctcaaaactgcttgacatccctggtctcgaagtagccgtcgttacaaccgaacgagccaaacacttctactcaccccaggacatcccagtcacgttgtattctgatgcagatgaatgggagatctggaagagtcggagcgaccccgttttacacattgatcttagacggtgggctgatctcttgctggtggcccctttagacgctaacacgcttgggaaagtcgccagcggcatctgcgataacctactcacctgcgttatgcgcgcctgggacagatctaagccgcttctcttctgccccgccatgaacacagcaatgtgggaacatccaatcaccgctcaacaggtggaccagctgaaagcctttggatacgtggagatcccctgcgtggctaagaagctggtttgtggagacgaagggttaggtgcaatggccgaagtgggtaccatcgtggataaggtaaaagaggtcctgtttcagcattctggtttccaacagtcctag

SEQ ID NO: 128777 - DNA, 171 bp, Artificial Sequence
  Description of Artificial Sequence: Synthetic coding sequence
atggctgagatggaccccgtcgccgagtttcctcagcccccaggagctgcccggtgggctgaagctctgcttcgatgctttacctggttgcgtctgtgtcagatctcaatgtttttgtctctgaaatgcctcaatactcgtagttcccacttaggcgctcattgtcgctag

SEQ ID NO: 128778 - DNA, 642 bp, Artificial Sequence
  Description of Artificial Sequence: Synthetic coding sequence
atggctgaaatggaccctgtagcggaatttcctcaaccacctggagctgccaggtgggcagaggtgatggcaagatttgccgcgcggctcggagcacagggccgtagggtggttctagtcacctccggtggaacaaaggtgccactagaggccagaccagtgcgcttcctcgataacttctcatctggacgacgcggggctacgtccgccgaagccttcctggctgctgggtatggagtcctgttcctgtaccgagctaggagcgcctttccttacgcacaccggtttcctccacagacctggctgtccgccttgcgtccatcaggcccggctctctcaggactactgagcttggaggcagaagaaaacgccctgccaggattcgctgaggcactgagatcctaccaagaggccgccgctgctgggacatttcttgcggtggaattcacgacactcgctgactatctgcatctgctccaggccgccgcccaagccctcaacccactgggcccatctgccatgttttatctggccgctgccgttagcgacttctacgtgcctgtgtctgagatgcctgaacacaagatccagagcagtggcggacctttacaggtgatgggagcctctttacccgagatttag

SEQ ID NO: 128779 - DNA, 936 bp, Artificial Sequence
  Description of Artificial Sequence: Synthetic coding sequence
atggccgagatggacccggtggctgaatttccccagcccccaggcgctgctcgctgggctgaggtaatggctaggtttgcggcgcgcctgggcgcccaaggcagaagggtggtattagtgacttccggcggcacaaaggtccccctcgaggcaaggcccgtgcgatttcttgataatttttcctctggcaggcggggcgccacgagcgccgaagccttcctggcagccggctacggcgtgctattcttatacagagctaggagcgccttcccttatgcgcatagatttcctccacagacttggctgtcagctttgagaccttcaggccctgctcttagtgggttgttgagtttagaggccgaggagaatgcgttacccggctttgctgaggcactccgtagttaccaggaagcggccgccgccgggacctttctggccgtggagttcacaacactggccgactatcttcatctgttacaagccgccgctcaggcactgaaccccctgggaccctcggctatgttttacctagccgcggctgtgtctgacttttacgtgcccgtcagcgaaatgcctgagcacaagatacaaagtagcggaggacccctccaaatcacgatgaagatggtccccaaactgttgtcaccgttggtgaaagactgggcgccaaaagcgttcataatttctttcaagttggaaactgacccagctattgtcattaacagagctaggaaggctctggagatctatcaacaccaggtcgtggtcgctaacattctcgaaagccgacagtctttcgtcttcattgtaacaaaggactccgagactaagctgcttttgtccgaggaggaaatcgaaaagggcgtcgagatcgaagaaaagatcgtggacaatctacaatctcggcataccgcctttattggagaccgaaattag

SEQ ID NO: 128780 - DNA, 417 bp, Artificial Sequence
  Description of Artificial Sequence: Synthetic coding sequence
atgttttacttggccgcagcggtgtcggacttttacgtcccggtgtccgagatgcctgaacacaagatacagagtagcgggggaccactgcagataactatgaaaatggtcccgaagctgctgtccccgctcgtaaaggattgggcccctaaggccttcataatctcattcaaacttgaaacagacccagccattgtgattaacagagctaggaaggcccttgagatctaccaacatcaagtggttgtggcaaacatcctggaaagtcgccagtcttttgtttttatcgtcactaaggactctgagacaaagcttctgttatcagaggaagagattgaaaagggcgtggaaatcgaagaaaagattgtcgataacctgcagtcaaggcacacagcttttattggcgaccggaactag

SEQ ID NO: 128781 - DNA, 417 bp, Artificial Sequence
  Description of Artificial Sequence: Synthetic coding sequence
atgttctatcttgcagccgccgtatcagatttctacgttcctgtgagtgagatgcctgagcataaaatccagtcaagcgggggcccactgcagatcacaatgaagatggtcccaaaactgcttagcccactcgtcaaggattgggcgcccaaggccttcatcatttcattcaaactggagacagatcctgcaattgtcattaatcgtgcccgaaaggcgctggaaatctaccagcatcaggtggtcgtcgccaacatccttgaaagcaggcagtcatttgtgttcatcgtgacgaaggatagtgagaccaagctgctgctgagcgaggaggaaatagagaagggggtagaaatcgaggagaagatcgtggacaacctacagtcaagacatacagccttcataggagaccgaaattag

SEQ ID NO: 128782 - DNA, 393 bp, Artificial Sequence
  Description of Artificial Sequence: Synthetic coding sequence
atggccgagtatggcaccctgctgcaggacctgacaaataacattacgctcgaggatctcgaacagcttaagagcgcttgtaaagaggacattccatcagagaaaagtgaggaaatcacaaccggatccgcatggttttcttttctcgaaagccacaacaaactcgacaaagataatctgagctacattgagcacattttcgaaatttctcgtcgccctgatctgcttactatggtggtggattatcgaacccgtgtgctgaaaatatccgaggaagatgagcttgataccaaattgactcgcatcccatcagctaaaaaatataaagacatcataaggcagccttctgaggaagagatcatcaagctcgctcccccacctaaaaaagcctag

SEQ ID NO: 128783 - DNA, 456 bp, Artificial Sequence
  Description of Artificial Sequence: Synthetic coding sequence
atggaagatgagggcaacaaactttgccaagctcccccctggcccggacaaacgtctccagttatggctgagtacggtaccctgcttcaggatctcactaacaacatcactctcgaggacctggagcagttgaagtccgcttgtaaagaggacattcctagtgaaaaaagtgaagagatcaccacgggatcagcctggttcagtttccttgagtcacacaataagttggacaaggataacctgtcatatatcgaacacatctttgagatcagtcggcggcccgatctgctcaccatggtggtggactaccggaccagggttctaaaaattagcgaagaagatgagctcgacacaaagctcacacggatcccctccgccaagaagtacaaggatattattcgtcagcctagcgaagaggagattattaagctggccccaccacccaagaaggcttag

SEQ ID NO: 128784 - DNA, 327 bp, Artificial Sequence
  Description of Artificial Sequence: Synthetic coding sequence
atggcggagtacggtactctgttgcaagacctgactaataacatcacactggaggaccttgaacagctaaagagtgcatgcaaagaagacatcccatccgaaaagaataacttgtcatatatcgagcacatatttgaaatatcccgccggccagatcttttgactatggtggtggattataggacaagagtgctcaaaatctctgaggaggatgagctcgataccaagctgaccagaatccctagcgcaaaaaagtacaaagacattatcagacaacccagtgaggaggaaatcataaaattggcaccacctccaaagaaagcctag

SEQ ID NO: 128785 - DNA, 1554 bp, Artificial Sequence
  Description of Artificial Sequence: Synthetic coding sequence
atggagctggaggaactcggaataagagaggaatgtggcgtgtttgggtgtattgcgtctggcgagtggcctactcagctcgacgtccctcacgtgatcacattggggctggtgggcttacagcaccggggacaggagagcgccggcattgtaacaagtgacggaagttcagtccctaccttcaagtcccacaagggcatgggtctcgtgaaccacgtgtttaccgaagataatctgaaaaagctgtatgtaagtaatctagggattggtcacacacggtacgctaccactggcaaatgtgagctggaaaactgtcaaccatttgttgtcgaaaccctgcacggcaagattgctgtcgctcacaacggagagttggtgaatgcagctcgcctgagaaagaaactactgcgccacggaataggattgtcaaccagcagcgatagcgaaatgataactcagttactggcatacacaccacctcaggagcaagacgatacacctgactgggtggccaggattaagaacctaatgaaagaagctccaacagcttactccctgctaatcatgcatagagatgtgatatatgctgttcgggatccatacgggaatcggccactgtgtatcgggaggttgattcccgtttctgatatcaatgataaagaaaagaagacctctgagacagaaggatgggtagtgagttcagagtcctgctcgttcctgtctattggtgcacggtactatcgcgaagtactcccgggggagattgtggaaatctcgagacataacgtgcagaccctggatattatcagccgctcagagggcaatcccgttgctttttgtatttttgagtatgtctactttgctcggcctgactctatgttcgaggatcagatggtgtacacggtcaggtaccggtgtggacagcagcttgcgatagaggccccggtggacgctgatctggtgagcacagtcccagaatcagcgacacctgcagccctcgcttacgcaggtaagtgtggcttaccctacgtcgaagtcctatgcaagaaccggtatgtaggccgcacttttatacagcccaacatgaggttgagacagcttggcgtggcgaaaaagtttggtgtcctgtctgataacttcaaaggaaagcgaattgtcctggtggacgacagcattgtccgggggaacaccataagccctataattaagctcttgaaagaatctggtgcgaaagaagttcacatacgggtcgcaagccctcccattaagtatccctgttttatgggaatcaatattccaaccaaagaggagctgattgctaacaagccagaattcgatcatctggccgaatatttgggcgccaattcagtcgtctacctctcagtggagggactggtttcctccgtgcaagaagggataaaattcaaaaagcagaaggagaagaaacacgacattatgatccaggagaatgggaacggactggagtgtttcgaaaagtctggtcattgtaccgcttgcctgaccggtaagtatcctgtggagctggaatggtag

SEQ ID NO: 128786 - DNA, 657 bp, Artificial Sequence
  Description of Artificial Sequence: Synthetic coding sequence
atggaactgctgatcatgatcaatgcctgcaaaattgcctctgcatctagagtaaccgcagtgattccttgcttcccgtacgctcgacaggacaagaaagataaggggtttttcgatatacctgtggacaatctgtatgcggagcccgccgtcctcaagtggatccgcgagaatatttcagaatggcgcaattgcacaattgtgagccccgatgcgggcggagcaaaacgtgtcacttccatagctgaccgtctgaatgtcgatttcgcgttgatacataaagaacggaaaaaggctaacgaggtggataggatggtgctagtaggagatgtcaaggatagggtcgcgattctggttgatgacatggccgatacttgcggcaccatctgccatgcggccgacaaactactgagcgccggcgcaacacgagtttacgcaattttaacccacggcatatttagcggacccgccataagccgcattaacaacgcttgctttgaggcagtggtggtgacgaatacgatccctcaggaggacaaaatgaagcattgcagcaagatccaggtcattgatatctcaatgatattggccgaagccatccgcagaacacacaacggtgaaagcgtctcgtaccttttttctcacgtaccactttag

SEQ ID NO: 128787 - DNA, 507 bp, Artificial Sequence
  Description of Artificial Sequence: Synthetic coding sequence
atgccaaacattaagattttttctggttcctcacatcaggacctgtctcaaaagatcgccgaccgcctgggccttgaactgggaaaggtggtgactaaaaagttcagcaaccaggaaacatgtgttgagatcggcgaaagcgtacggggtgaggacgtgtacattgtacaatccggatgtggtgaaataaacgacaatctgatggagctcttgattatgatcaacgcttgcaagattgcgtctgcgtctcgcgtgaccgccgtgatcccttgttttccttacgccaggcaggacaaaaaggacaagagccgcgccccgatcagcgccaaactggtggcgaacatgttatccgtggctggcgctgaccacatcattacaatggacttgcacgcctcacagattcaggtgtctgtcgaggccaaatactggtgcttgaaagggggacgcaaggggctaatgatgctcaaaaccgccgagaagcccaaaattatgcccaagtacatctag

SEQ ID NO: 128788 - DNA, 756 bp, Artificial Sequence
  Description of Artificial Sequence: Synthetic coding sequence
atggagctactaatcatgataaatgcctgcaagattgcttccgccagcagggtgaccgccgtcatcccatgtttcccttatgctcggcaggacaagaaggataagagccgcgccccaatcagtgccaagcttgtggcaaatatgttatctgtggcaggtgcagatcacatcatcactatggatctgcacgcctctcaaattcagggattttttgacatccctgtggacaatctctacgccgagccagccgttttgaagtggatacgtgagaatatcagcgagtggcggaactgcacaattgtctcacccgacgccggaggcgcaaagagagtgacgtctatcgctgacaggctgaacgttgactttgccttaatccacaaagagaggaagaaggccaatgaagtagatcgtatggtactggtcggtgacgtgaaggatcgggttgctatcctcgtggacgacatggccgacacctgtgggaccatatgccatgctgccgataagttactttccgcaggagcaacccgggtgtatgccattctgacacacgggatcttttcagggcctgctatcagccggattaacaatgcatgtttcgaggctgtcgtggtcaccaacactatacctcaggaggacaagatgaagcattgttcgaaaattcaggtgatcgatatatccatgatcctggcagaggcaatacggaggacacacaatggggagtcagtgagttatttgttctctcatgtgccgctgtag

SEQ ID NO: 128789 - DNA, 957 bp, Artificial Sequence
  Description of Artificial Sequence: Synthetic coding sequence
atgcctaacatcaaaatctttagcggttcgtcccaccaggacctgtcccagaagattgcagatcgattaggcctcgagctcgggaaggttgtcacgaagaagttttcaaaccaagagacctgtgtcgagattggggagtccgtgcgcggagaagacgtctacattgttcagtcgggctgtggggagattaatgacaaccttatggagctgctgatcatgataaacgcctgcaagattgcaagtgcttcgagggtgacagctgtgattccctgtttcccatacgctcggcaagataagaaggataaatcaagagctcccatctctgccaagctggttgcaaatatgcttagcgtggccggcgccgatcacattattacgatggatctccatgcctctcagatccaggggttttttgacatccctgtggacaatctgtacgctgaaccagctgtcttgaaatggatccgagagaacatctcggagtggcggaattgtacgatcgtttcaccggatgccggcggagccaaaagggtgacttccattgccgacaggctgaatgtcgactttgctttgattcacaaagaacgcaaaaaagcaaatgaggtcgacaggatggtgctcgttggcgacgtgaaggaccgggtggcgatactcgttgacgatatggcagacacgtgtggcactatatgccatgctgcagacaaactactgagtgcgggggccacgagggtgtatgccatccttacgcatgggattttttcgggaccagctatttcccgcatcaacaacgcgtgtttcgaggccgtggtcgtgaccaatacaatcccccaggaggacaaaatgaaacattgcagtaagatacaggtcattgacatttccatgatattagctgaagccatccgacgaactcacaacggcgagagcgtgagctatctgtttagtcacgtacccctttag

SEQ ID NO: 128790 - DNA, 957 bp, Artificial Sequence
  Description of Artificial Sequence: Synthetic coding sequence
atgcccaatatcaagatattctcaggatccagtcaccaggacctgtcccaaaagattgcagaccggctgggtcttgaactgggcaaggtggtgacaaagaagtttagcaatcaagagacatgcgtggagatcggcgaaagcgtgagaggtgaggacgtctatatagtccagagtggctgcggtgagatcaacgataacttgatggaattactgattatgataaatgcgtgcaaaatcgcaagtgcctcaagggtgactgccgttatcccttgcttcccttatgctaggcaggataagaaggataagtctagagcgcccatcagcgctaagcttgttgccaatatgttaagtgttgcgggcgctgatcacatcattacaatggacttacatgcaagtcagatccaaggatttttcgatatccctgtcgataatctctacgcagagcccgccgtgcttaagtggattagagagaacatttcagaatggaggaattgcaccatcgtgtctcctgacgctggtggagccaaacgtgtgacgtcaatcgcggaccggcttaatgtagatttcgccttaatccacaaggaacggaaaaaggccaacgaagtggaccgaatggtgcttgtaggagacgttaaggaccgcgtcgccatccttgtagacgacatggccgacacttgtggtacgatatgccacgccgcagacaagttgcttagtgccggggctactagagtgtacgccatcctgacacacggtatcttctcaggcccagcgatctctcggattaacaatgcttgttttgaggctgtggtggtcaccaacacaatacctcaggaggataaaatgaagcactgtagtaaaatccaagtgattgacattagcatgatattagcagaagcaattcgaagaactcacaacggtgaatctgtgtcttacctcttttcgcacgtgcccctgtag

SEQ ID NO: 128791 - DNA, 957 bp, Artificial Sequence
  Description of Artificial Sequence: Synthetic coding sequence
acccctaatattaagatcttttctggatcctcccatcaagacctgtcccaaaaaatcgccgatcgactgggcttggagcttggtaaggtggtgactaagaagttttccaatcaagaaacatgcgtggaaatcgacgagagtgtcaggggcgaggatgtgtatatcgtgcaatccggctgcggagagataaatgatagcctgatggagctgctcattatgatcaacgcctgcaagatagcgagcgcctcccgagtgaccgccgtgatcccatgttttccctacgcccggcaagacaaaaaggacaagtctagatcaccaatcagtgctaaactggtagccaacatgctgagtattgccggcgcggatcatattatcaccatggacttgcacgcttcacagatacagggatttttcgatatccccgtcgataacctgtatgccgagccaactgtgcttaagtggatcagggaaaatatccctgaatggaagaattgcatcatcgtctcccctgacgccggaggcgccaaaagggtgacatccatcgcagaccagttgaacgtagactttgccctgatccataaagagcgaaaaaaggctaacgaggtagattgcatcgtgctggtgggggacgttaacgaccgggtcgctattttagtggatgacatggctgatacctgcgtgacaatctgcctcgccgccgacaaattgctcagtgccggggctaccagagtttacgccattctgactcatggcatcttttccggacctgccatcagcaggatcaacacagcttgtttcgaagctgtggtcgttacgaacacgatccctcaggacgagaaaatgaaacactgtagcaagatcagggtcattgacatctccatgattcttgcagaagccatacggcgaacccataacggcgagagcgtgagctacctgttttcccacgtgcctctctag

SEQ ID NO: 128792 - DNA, 957 bp, Artificial Sequence
  Description of Artificial Sequence: Synthetic coding sequence
atgcccaatatagttctgttctccgggtcctcgcaccaggatttgtcccaacgggtggctgacaggctgggtttagaactcgggaaggttgtcacaaagaagttttccaaccaagagacctcagtggaaatcggcgagtcagtccgcggcgaggacgtgtacatcattcagagtggctgtggcgagattaatgataacctgatggaactgctcatcatgattaatgcttgcaagatcgcgtcatcttctcgcgtgaccgctgtaattccatgcttcccctatgcaagacaggataaaaaggataagtcccgagcccctattagcgcaaagcttgtcgctaacatgctgtcagttgccggtgccgatcacattattacgatggatcttcatgcttcccagatccaggggttcttcgacatcccggtggataacctgtacgcggagcctgccgtcctgcaatggatccgcgagaacatagctgaatggaaaaactgtattatcgtcagtccagacgccgggggtgcaaagcgcgtcactagcattgctgacaggttaaacgtagaatttgccctgatccacaaagagaggaagaaagccaacgaagtcgatcgcatggtgctggtgggcgatgtcaaggacagggtagcaattctggtagacgatatggccgacacctgtggcacgatttgccacgccgcggataagctcttatcggctggggcaaccaaagtgtacgctatactgacgcacggcatcttcagtggtcctgctatatctaggatcaataacgcagcttttgaggccgtggtagtgacaaacactatcccacaggaagacaaaatgaagcactgtaccaagatccaggttatcgacatcagcatgatcctggcagaggccatccggagaacacataacggggaatcggtgtcgtatctgttctctcacgtgccgctgtag

SEQ ID NO: 128793 - DNA, 966 bp, Artificial Sequence
  Description of Artificial Sequence: Synthetic coding sequence
atgccaaatatagtgttattcagcggaagttctcatcaggatttgagccagagggtagcagataggttgggattggagttagggaaggtggtgacaaaaaagtttagcaaccaggagacgtctgtggaaataggcgaatctgtgcgcggagaagatgtgtacattattcaatccggctgtggggaaataaacgataacctgatggagctcctgataatgataaatgcctgcaagattgcctcatcatcgcgggttactgctgttattccctgttttccttacgccaggcaggacaaaaaagataaggtgggcgagtcccgggcgccaatcagcgccaaattggtggctaacatgctatctgtggctggggccgaccacattataactatggacctgcatgcctcacaaatccagggcttcttcgacattcctgtagacaatctctacgcagaacctgccgtccttcagtggattcgggagaacatcgccgagtggaaaaattgcatcatagtcagccccgatgccggcggcgccaaacgcgtgacctccattgctgaccgcctcaatgttgagtttgctttaatacacaaagaaagaaagaaggcaaatgaggtcgatcgtatggtgttagtcggtgacgtcaaagaccgagttgccatattagtcgacgatatggccgatacttgtggtactatttgtcacgcagccgataagctgcttagcgccggtgcaaccaaagtttacgctatcctgacccatggtatcttctcggggccagctataagtcgtattaataacgccgcattcgaggccgtcgtggtcactaataccatcccacaggaagacaagatgaaacactgcacgaagattcaagtcatcgacatcagcatgatcctcgccgaggctattagaagaacacataatggagagtccgtgagctacctgttctcccatgtacctctttag

SEQ ID NO: 128794 - DNA, 849 bp, Artificial Sequence
  Description of Artificial Sequence: Synthetic coding sequence
atggaactgctgattatggcatacgctttaaagacagcgtgtgctcgaaatataattggcgtgataccatacttcccatactccaagcagtcaaagatgagaaagcgagggagcatcgtgtgtaagcttctggcgagtatgctagccaaagccggcttaactcacatcatcaccatggatctgcaccagaaagaaattcagggattcttcagctttcccgtggataacctgcgtgcttccccatttctcctgcaatatatacaggaagagatccccaattaccgcaatgcagtcatagtagccaagtcccccgatgcagcaaaaagagctcaatcctacgcagagaggctccgccttggccttgcagtaattcacggggaagctcaatgcacggaactcgatatggacgacgggcgacactctcccccgatggtgaaaaatgccacggtgcatcctggactcgaattacctttaatgatggctaaggagaagcctcctatcactgtggtcggagatgtaggcgggcgaatcgccataatcgtcgatgacattatcgacgacgtggaatccttcgtggccgcggccgaaatcctgaaagagcggggagcctacaagatttacgtcatggcaactcacggtattctgtcagcggaagcaccaagactgatcgaggagtccagtgtcgacgaggtagtggtgaccaatactgtcccgcacgaagtgcagaagctgcagtgtcccaaaataaagaccgttgacatttcactgatcctgtcggaggccattcggaggatccacaatggcgagtcaatggcgtatttgttccgaaacatcacggtggacgactag

SEQ ID NO: 128795 - DNA, 1158 bp, Artificial Sequence
  Description of Artificial Sequence: Synthetic coding sequence
atgccaaaaaagctgctgctactgcctccaccgtcagcttcaagcgctttccgggtgccccgggctcggcccgtgcccccgccggctatgaatgctgcccggaccgggtatagagttttcagcgcaaacagcactgcagcttgcacagaactcgcaaagcgcatcactgagcggctgggcgccgagctgggcaagtccgtggtctatcaggaaactaatggcgagactagggtggaaattaaggaatctgtgaggggacaggacattttcatcattcaaaccatcccccgagacgtcaatacagcagtgatggaactcctcatcatggcttatgcccttaaaacagcttgcgcaagaaacatcatcggggtcataccgtactttccttacagcaaacaaagcaaaatgaggaagcggggctcaatcgtgtgtaagctccttgccagcatgctggcgaaggcaggcctcactcacatcatcacaatggacctccatcaaaaagagatacaaggtttctttagcttccccgtggacaacctcagagcgtcccctttcctgctgcaatacattcaagaggagatccctaattacaggaacgcagtgatcgtagcaaaatctcctgatgccgccaaacgcgcacagtcttacgcagaacgcctgcgcttgggcctggccgtgattcatggtgaggcccagtgcacggagcttgacatggatgacgggaggcacagtccccctatggtgaaaaacgctaccgtgcatccaggcttggaattgcccctgatgatggccaaagaaaaacctccaatcaccgtggtgggtgatgttggggggcgaattgccatcatcgtggacgacattattgacgatgtcgagagttttgttgcagccgctgagatcttgaaagagagaggcgcatataaaatttatgtgatggcaactcacgggatcctgagcgcagaggcccccaggctgatcgaggagtctagtgtggatgaggtggtggtgaccaacaccgttcctcatgaggtgcagaagcttcaatgcccaaaaatcaaaactgttgatatctcactcatccttagcgaggccattcggagaatccacaacggggaatctatggcttacctgttccgcaacataactgtggacgactag

SEQ ID NO: 128796 - DNA, 1110 bp, Artificial Sequence
  Description of Artificial Sequence: Synthetic coding sequence
atgttttgcgtcaccccaccagagctcgagaccaagatgaacatcacaaaaggaggcctggtcctgttttcagcgaacagcaacagtagttgcatggagctttcgaagaagatagctgaaaggctgggtgtggagatgggaaaagtgcaagtataccaggagcccaatcgggagacccgcgtgcagatacaggaatcagtgagaggaaaagatgtgtttattatacagaccgttagcaaagatgtgaataccaccatcatggaactgttgatcatggtgtatgcctgcaaaacatcttgcgccaagagcattatcggggtcatcccctactttccttacagcaaacagtgcaaaatgaggaaacggggttccatagtttctaagctgttagcttccatgatgtgcaaagcaggcttaacacacctgattacaatggacctgcaccaaaaagagattcaggggtttttcaacatccccgtcgataatctgagggcaagccccttcctgctgcagtacatccaagaagagattcctgactaccggaacgccgttatcgtcgctaagtccccagcatcagccaagcgagctcagtcttttgccgagcggttaaggctggggattgccgttattcacggagaagcccaagacgcagagagcgatctggtcgatgggagacactcccctccaatggtcaggtctgtggcagcaattcaccctagcctcgagatcccaatgctgataccaaaagaaaaacccccaattacagttgttggtgacgtgggcggaaggatcgctattatagttgatgatataatcgacgacgtggacagctttctcgccgccgcagaaactctgaaggaaagaggcgcatacaaaatctttgtgatggccactcacggccttctatcttcagacgcgccgcgacgaattgaggagagcgctatcgatgaagtggtagtgaccaacacaatcccgcacgaagtgcagaagcttcaatgcccaaagattaaaacggtagatatttctatgattctgtccgaggccattcggcgcattcacaatggtgagtcaatgtcctatctcttccggaatatagggctggacgactag

SEQ ID NO: 128797 - DNA, 1110 bp, Artificial Sequence
  Description of Artificial Sequence: Synthetic coding sequence
atgttttgtgtgactccgcctgagctcgagaccaagatgaacatcaccaaaggcggactggtgcttttcagcgccaattccaactcttcttgcatggagcttagcaagaagatcgctgagagactgggcgttgagatgggcaaggttcaggtgtatcaagaacctaatcgggaaacgcgggtgcagatacaggagtctgtgcgcggaaaggatgtgttcattattcagactgtatccaaggatgtaaacacaacaatcatggaactgctgatcatggtctatgcctgtaaaacgtcgtgtgccaaaagcattatcggagtgattccttacttcccctattctaagcagtgcaaaatgcgcaagcgtggatccatagtcagcaagctgctcgcttccatgatgtgcaaggccgggttgacccatctgattactatggaccttcatcagaaagaaatccagggtttctttaatattcccgttgacaacctaagggcttctccttttctgctgcagtacatacaggaggagattcctgattatcggaatgctgtgattgtggctaagagccccgcctccgctaagcgagcacagtcattcgctgaacgcctgaggttgggtattgctgttatccacggcgaggcccaggatgccgagtccgatctggtggacggtcgccacagtccccctatggtgcggagcgtcgctgcgattcatccttcactggaaattcccatgctgatccccaaggagaaaccgcctataactgtcgtgggggacgtaggcggtaggattgccattatcgttgatgatattatcgacgatgtcgacagcttcctagcagccgcagagacattaaaagagagaggggcctacaaaatttttgttatggcaactcacggcctcctaagtagtgacgcaccacggcgaatagaagagagcgcgatagacgaggttgtcgtcacaaataccatcccccacgaggttcagaaactccagtgccccaagatcaaaaccgtggatatttcaatgattctctcagaggccattagacgaatccacaacggcgagagcatgagctacttgttccgaaacatcggccttgacgactag

SEQ ID NO: 128798 - DNA, 807 bp, Artificial Sequence
  Description of Artificial Sequence: Synthetic coding sequence
atgttttgcgtgactccccccgagctggaaaccaagatgaacatcacaaagggcggccttgtgttattctctgcaaatagcaatagtagttgtatggaactgtcaaagaagatcgccgagcgtctcggcgttgaaatgggtaaggtgcaggtctaccaggaaccaaatagagaaacaagggttcagatccaggaaagcgttagagggaaggatgtgttcatcatccagacggttagcaaggacgtcaacactaccatcatggaacttcttattatggtgtacgcatgcaaaacctcttgtgcgaagtcaataataggagttatcccatacttcccctactctaagcagtgcaagatgcgaaagcgcgggagcatcgtctctaagctcctggctagcatgatgtgcaaggctggccttacacacctgataacaatggacctgcaccagaaggagattcaaggcttcttcaatattccagtggataatctgagagcttccccttttctccttcaatacatacaggaggagattcctgattaccgaaatgcagtgatcgtggcgaagagccccgcctcggccaaacgtgcccagtcgtttgccgaacgcctgagattggggatcgctgtaattcacggggaagctcaggatgcagaatcggacctcgtggatggaagacatagcccgccaatggtcaggtcagtggcagccatccacccttctctggaaatccctatgttgatcccgaaagaaaaaccccccataacagtggtaggcgacgttgggggtaggatcgctatcattgtctag

SEQ ID NO: 128799 - DNA, 585 bp, Artificial Sequence
  Description of Artificial Sequence: Synthetic coding sequence
atgttctgcgttacaccccccgaactggaaacaaagatgaacattactaagggcggactggtgctgttttcagccaatagcaacagttcatgtatggagttgagtaaaaagatcgcagagcgattgggcgtggaaatgggaaaggtacaggtgtatcaggagccaaaccgcgagacccgggtgcaaattcaggaaagtgttcgcgggaaagacgtcttcattatccagaccgtttctaaggacgtcaataccaccatcatggagttgctgattatggtgtacgcctgtaaaacctcttgcgccaagtcaattatcggagtcattccatactttccttacagcaaacagtgcaaaatgcggaaaagagggtcaattgtctcgaaactactcgcttcgatgatgtgtaaagccgggctcacgcacctgatcaccatggatctccatcaaaaggaaatccagggcttctttaacattcccgtggataatctccgtgccagcccatttctgttgcaatacatccaggaggaaatcccagactatcgcaacgcggtgatcgtcgccaaaagccctgccagcgcaaaatag

SEQ ID NO: 128800 - DNA, 990 bp, Artificial Sequence
  Description of Artificial Sequence: Synthetic coding sequence
atgttttgtgtgactcctccagaactcgagactaaaatgaatatcacgaaaggtggactggtgctctttagcgctaactctaatagcagctgcatggaactttctaagaaaatcgccgaagacgttaacacaaccatcatggagctgttaattatggtgtatgcctgcaaaactagttgcgcaaagagtatcataggggtcataccctattttccctacagcaaacaatgtaaaatgagaaagcgggggtctatcgttagcaagttgctcgcgagtatgatgtgtaaagctggcctcactcacttgattaccatggacctgcaccagaaggaaattcaggggttctttaatatccccgtcgataacctgcgcgccagcccatttctgctccagtatatacaggaagagattcccgactaccgaaacgcggtcatcgtggcgaagagtccggccagcgctaagcgagctcaatcatttgcagagcggctacgcctgggcatagcggtcatccatggcgaggcgcaggacgcggaatccgatctggtggacggaagacactctcctcctatggttaggtctgttgctgcgattcatcccagcctcgaaatccctatgctgatccctaaggagaaacctcctatcactgtcgtcggtgacgtcggaggtagaattgctataattgtcgatgacatcatagatgatgtcgatagctttttggccgctgcagaaactctgaaggagcgcggagcctacaagatctttgtgatggctacccacggattgttgtctagcgatgccccacgccgaattgaggagagcgccattgacgaggtagttgtgacaaacacaatcccccacgaagtacagaagctgcagtgcccaaaaattaaaactgttgatattagtatgatactgtctgaagctattagaaggatccataatggtgaatcaatgtcctatctgtttaggaacatcggcctggatgattag

SEQ ID NO: 128801 - DNA, 531 bp, Artificial Sequence
  Description of Artificial Sequence: Synthetic coding sequence
atgttttgcgtcaccccacccgaactagaaactaagatgaatatcaccaagggcggactcgtgctgttttctgctaacagtaactccagctgtatggagttatccaagaaaatagccgaacggctgggagtggagatgggcaaagtgcaggtctaccaggagccaaaccgagaaactcgggtgcaaatccaggagagcgttaggggcaaagatgtgttcataattcaaactgtgtctaaggacgtgaatactactatcatggaactgctaataatggtgtatgcctgtaaaacaagctgcgccaaaagtatcattggagtcatcccatacttcccttactctaaacagtgcaaaatgcggaagcgagggtcaattgtatcaaagctgcttgcatccatgatgtgtaaggcaggtcttacacatctaatcacgatggatctccaccaaaaggagatccaggggtttttcaatattcctgttgataatttgcgcgccagtccattcctccttcagtacatccaggaggagtag

SEQ ID NO: 128802 - DNA, 735 bp, Artificial Sequence
  Description of Artificial Sequence: Synthetic coding sequence
atgttttgcgtgaccccccccgagctggaaacaaaaatgaatattactaagggaggtcttgttctgttctctgccaattcgaactcctcatgtatggagcttagtaagaaaattgccgaacggctgggcgtggagatgggtaaagtgcaggtataccaagagcctaatcgtgagacgcgcgtccagatccaggagtcagtacgcggcaaagacgtgtttatcatccagacggtgtcaaaagatgtgaataccacgattatggaactgctcataatggtctacgcctgcaagactagctgtgccaaatctatcatcggcgtgatcccatacttcccctatagcaaacaatgtaagatgcggaaacgggggtccatcgtttccaagcttctggcttctatgatgtgcaaagcagggctcactcacttgatcaccatggaccttcatcagaaagaaattcaaggatttttcaatatacccgttgacaacctgcgggcatcaccctttctcctgcagtacatccaagaggaaattcccgactatagaaacgccgttatcgtcgccaagtctccggcgagcgcaaaaagggcccagagtttcgccgagaggctgcgactcgggatcgcagttattcacggcgaggcacaggatgccgagtctgatttggtggatggtagacattccccccccatggtgcgaagcgtcgctgccatccatcctagcctggagatcccctag

SEQ ID NO: 128803 - DNA, 135 bp, Artificial Sequence
  Description of Artificial Sequence: Synthetic coding sequence
atgttttgtgtgactcccccagaactcgaaaccaaaatgaatatcacaaaaggtggcctggtgctgttcagtgccaactctaacagcagctgtatggaactgtctaaaaagattgcagagaggctgggcgtttag

SEQ ID NO: 128804 - DNA, 807 bp, Artificial Sequence
  Description of Artificial Sequence: Synthetic coding sequence
atgttttgtgtgacaccccccgagttggagacaaaaatgaatatcactaaaggtggtttggtgctattttctgccaattcaaactcctcctgcatggagctttctaaaaagattgcagagcggctcggggttgagatgggaaaagtgcaggtgtaccaggaacccaatcgcgagaccagggttcaaatccaagaatcggtgcggggtaaggatgtgtttatcattcagactgtgtcaaaggacgtgaacaccactatcatggagctgctgatcatggtgtacgcatgcaagacatcatgcgcaaaaagcatcattggagtgataccttacttcccctattcgaagcagtgcaagatgagaaagcgggggagcattgtttctaagctgttagcctccatgatgtgtaaagctggtctgacacatctcatcacaatggacttacatcagaaggagatccagggcttctttaacattcccgtggataacctacgggcaagtcctttcctgctgcagtatatccaggaggagatccccgattacaggaacgcagttattgtggccaaaagccccgcttccgctaaaagggcccagtccttcgctgagcgtctacgcctcgggattgctgtaatccacggtgaggcccaagacgcagaaagcgacctcgtagacggtcgtcactctcccccaatggttaggtctgtggcagctattcacccatctctggaaattcctatgctgattcctaaagaaaagcccccgatcacagtggtgggtgatgttggaggaagaattgcgataatcgtttag

SEQ ID NO: 128805 - DNA, 423 bp, Artificial Sequence
  Description of Artificial Sequence: Synthetic coding sequence
atgttctgcgtgactcctccagaactggagaccaagatgaacatcactaaggggggtttggtactgttctccgccaattctaatagctcatgtatggagctgagtaagaagattgccgaacggcttggcgtggagatgggcaaggtccaggtctaccaggagcccaatagagagactagagtccagatccaggagagcgtgaggggcaaggacgtatttatcatccaaacagtcagtaaagacgtcaataccaccataatggagctccttattatggtctacgcgtgcaagacttcatgtgctaaatccatcatcggtgtcataccatactttccttatagcaagcagtgcaagatgaggaagcggggctcaattgtgtccaagttgctggccagcatgatgtgtaaagccgggctaacctag

SEQ ID NO: 128806 - DNA, 807 bp, Artificial Sequence
  Description of Artificial Sequence: Synthetic coding sequence
atgttttgcgtgacaccacccgaactcgaaacaaagatgaatattaccaaaggcgggttagttttattctccgccaactcaaattcatcttgtatggagctgtcgaagaagattgccgagagattaggtgttgaaatgggaaaggtgcaggtttatcaggagcctaatcgggagactcgggtacagatacaggaaagcgttagagggaaggatgtgtttattatacagaccgtgagtaaagacgtgaatacgaccatcatggagttacttataatggtgtacgcctgcaagacatcgtgcgccaagtctattatcggagttattccctactttccctactcaaaacagtgtaaaatgaggaagcggggctccatagtttccaagctcctggctagcatgatgtgcaaggccggactgacacatctgatcactatggacctgcatcagaaggaaatccagggcttcttcaatattcccgtagataatctgcgagcgtctccattcctgctccagtacatacaggaagaaattcccgactacagaaatgcagtgatcgtggccaagagcccagccagcgcgaagagggcccagtcatttgctgaacgtctgcggctggggatcgccgtcattcacggcgaagcccaggatgccgagtctgaccttgtcgatggcagacactcccccccgatggtgcggtccgtggctgccattcacccctctctggagattcccatgctcattcccaaggagaagccgcctattacagtggtgggcgacgtgggaggtagaattgccatcatcgtttag

SEQ ID NO: 128807 - DNA, 852 bp, Artificial Sequence
  Description of Artificial Sequence: Synthetic coding sequence
atggagctgcttatcatggtttatgcttgcaagacctcctgcgcgaagtctatcatcggggttatcccttattttccgtatagtaaacagtgtaagatgcgaaagaggggcagcatcgtatctaagttactggccagcatgatgtgtaaggctggtttgacccacctaataacaatggatctgcatcaaaaggagatccaaggcttctttaatattccggtggacaatctgcgggcaagcccatttctgctccagtacattcaggaggagatccctgattaccgcaatgcagtaatagtggccaaaagccctgcaagcgccaaacgcgcacaaagctttgcagaaagactgcggcttgggattgccgttatccacggagaagcacaggacgccgagtcggacttagtcgacggacgacactccccgccaatggtccgttcagttgctgcgatccacccttctctggagatacccatgctgataccaaaagaaaaaccaccgattactgtcgtgggagatgtgggcggccgtatcgcaattattgtggatgatattattgacgatgtggatagttttttggctgctgctgagacactaaaggagcggggggcatataagatattcgtgatggctacacacggactactctcctctgatgcccccagacggattgaagagagcgcaattgacgaggttgtcgttactaacacaatcccccacgaagtacagaagctccagtgccctaaaatcaaaacagtcgatattagtatgatcttgagtgaggctatcaggcggatacacaacggcgagagtatgtcatatctcttcagaaatattggcctcgacgactag

SEQ ID NO: 128808 - DNA, 963 bp, Artificial Sequence
  Description of Artificial Sequence: Synthetic coding sequence
atgttttgtgtgaccccacccgaactggaaaccaagatgaacatcactaagggcggtctggtgctgttctccgcgaattccaactcatcgtgcatggagttgtctaagaaaattgccgagagactcggggtagagatgggcaaagtgcaggtttatcaggaacctaaccgggagacacgcgttcaaatccaggagagcgtgcgcggcaaagacgtgttcatcatccagaccgtctctaaagacgtgaataccaccattatggaactacttatcatggtctacgcatgcaagacatcatgcgcgaaatctattataggagtcattccctactttccctatagtaaacagtgtaagatgcgcaaaaggggaagcatagtttccaaattactggctagtatgatgtgtaaggccggcctaacacaccttatcaccatggacctccaccagaaagagattcagggattcttcaatatccccgtagataacctcagggcgagtccttttctgctgcaatacatacaagaagagattccagactatagaaatgccgtcattgtggccaagagccctgcaagtgccaagagggcccaatcatttgccgagaggttacggctgggcatcgccgtgatccacggcgaagcccaggatgctgagtctgatctggttgacgggagacattcccctcccatggtgcgaagcgtggccgcaattcacccaagcctggaaattccgatgcttatcccaaaagagaagccaccaatcactgtcgtcggcgacgtaggagggcgtatagcaataattgttgtagtggttaccaataccatcccccacgaagttcagaagcttcagtgccccaaaatcaagaccgtggacatcagcatgattctgagtgaggctatccggcgtatccataacggagagtcaatgtcttacctctttcgcaacattggcctggacgattag

SEQ ID NO: 128809 - DNA, 237 bp, Artificial Sequence
  Description of Artificial Sequence: Synthetic coding sequence
atgttctgcgtcacccccccagagctcgagacaaagatgaacataacaaagggggggttagtgctcttctcggccaattcgaactccagttgcatggagctgagcaagaaaatcgcggagaacaagtctaccaacagtagagtgtgtgaagggaagcgctgcttccatcaccccaattgtttcgagggccgggaacaccatcaccatggggcgccagatcatggcgtatgtatgtag

SEQ ID NO: 128810 - DNA, 678 bp, Artificial Sequence
  Description of Artificial Sequence: Synthetic coding sequence
atggcgggatcttcggaggaggccccagattacgggagaggcgtggtgatcatggatgactggcctggctacgacctaaacctgttcacctatccacagcactactatggggacctagagtatgttctgatcccacacggaattattgtggataggatagagagactggcaaaagatatcatgaaggatataggatactctgatatcatggtgttgtgcgtgctaaagggaggttacaaattttgcgccgacctggtagagcaccttaagaacatctcgaggaacagtgaccgcttcgtgtccatgaaggtggactttatcaggctcaaatcctacagaaacgaccagagtatgggagagatgcagattattggcggcgacgatctgagcacactggcgggtaagaatgtactcatcgtcgaggatgttgttggtacaggacgcacaatgaaggcactcctcagcaacattgagaagtataagccgaacatgataaaagtcgcatctttacttgtgaaaaggacttcacggagtgacgggtttcggcccgattacgccggctttgaaattccgaaccttttcgttgtcgggtatgcactcgattataacgagtacttccgggatctcaaccacatatgtgtcatcaacgagcacggtaaggaaaaataccgggtttag

SEQ ID NO: 128811 - DNA, 573 bp, Artificial Sequence
  Description of Artificial Sequence: Synthetic coding sequence
atggccggatccagtgaagaggcccctgattatggcaggggtgtagtgattatggatgactggcctggctacgacctaaacctctttacctatccgcaacattactacggggatcttgaatacgtactgataccacacgggataattgtcgacagaattgaacgtcttgccaaggacataatgaaagacattggctattcagacatcatggttctttgtgtcctcaaagggggctataaattctgcgctgacctggtcgaacatctaaaaaatatctccaggaacagcgaccgcttcgtgagtatgaaagtggacttcatccgactcaagtcctatcgaaacgatcagagcatgggggagatgcagataattggcggagatgatctgagcactctggcaggaaagtctgtgctgtttgccaaagacgtggtaggtaccgggcgcactatgaaggctctgcttagcaatatcgaaaaatataagcccaacatgataaaagtagccagccttctggtgaaacgaacaagccggtctgacggcttcaggccagatagtcatatgaggcaccagtag

SEQ ID NO: 128812 - DNA, 522 bp, Artificial Sequence
  Description of Artificial Sequence: Synthetic coding sequence
atggccggctcgagcgaagaggccccagactatggacggggggtagtcattatggacgattggccggggtatgacctgaatttgttcacatacccccagcactattacggtgacctggaatacgtgctgattcctcacgggattatcgtggacaggattgagagattggccaaagatattatgaaggacattggatattctgacataatggtactgtgcgtgctgaagggaggatacaaattctgcgcagacctggtggaacatctgaaaaacattagccgcaatagtgataggtttgtcagcatgaaggttgacttcatcagacttaagagctaccggctcagagcacggctcaaacgcacaacaatatgcgatcgcggggggctcgctttcagccaaggatacatgtcctcatgcgcccccctgcaggagagtccaaacaccctgtggcgcggttacctccaggtgctcattccttgtttccacatcaggttccagctaccacgtagtgagcagaactag

SEQ ID NO: 128813 - DNA, 573 bp, Artificial Sequence
  Description of Artificial Sequence: Synthetic coding sequence
atggcaggttcctctgaggaggcccccgactacggccggggggtggttatcatggacgactggccaggttacgacttgaatctgttcacgtatccgcaacactactacggcgatctggaatatgtactcatcccccacggaatcatagtggatcggattgaaagactagcaaaggatatcatgaaggacatcgggtatagcgacatcatggtcttgtgtgtgcttaagggaggatacaaattttgcgccgatctggtggagcatctgaaaaatatctccagaaactcagaccgctttgtctccatgaaggtggattttatcagacttaaaagctatcgaaatgaccagagcatgggagagatgcagatcattggaggcgacgatctgtctacactggctgggaaaaacgttctcattgttgaggacgtggtgggaacgggaagaacaatgaaagccttactgtccaacattgaaaagtataaacccaacatgattaaagttgcctccttgttagtgaaacgcactagccggtctgatggcttccggcccgactcacacatgaggcatcagtag

SEQ ID NO: 128814 - DNA, 1299 bp, Artificial Sequence
  Description of Artificial Sequence: Synthetic coding sequence
atggccactgccgaagtacttaatatcggcaagaagttatacgaggggaagacaaaggaagtatacgaactccttgactcccctggaaaagtgctgctacaatccaaggatcaaatcactgctgggaatgctgccaggaaaaatcatctcgagggaaaggcagccatctccaacaaaatcacatcatgtattttccagcttctgcaggaggctgtgacaagctataaaagcaataggattaaaacagcctttaccagaaaatgcggtgaaacagcttttattgctcctcaatgcgaaatgatccccatcgaatgggtctgcaggcggatcgctaccggctccttcctgaaaaggaacccaggagtaaaagagggatacaaattttatcctcccaaagtcgagttgttttttaaggacgacgccaacaatgacccccagtggagtgaggagcaactgatcgcagccaagttttgcttcgctggcctgcttatcggccagacagaagtagacattatgtcccatgccactcaggccattttcgaaatcctggaaaaatcgtggctcccgcagaactgtacactggttgatatgaaaattgagtttggcgttgacgtgacaaccaaagagattgtgctggctgatgtaattgacaatgattcttggcgcctttggcctagcggggaccggtcacagcagaaggataagcagtcatacagggacctgaaagaagttacacccgagggcctgcaaatggtcaaaaagaatttcgaatgggtggccgagagggttgaactcctgttaaagagcgagagccagtgccgggtggtcgtcctcatgggctcaacaagtgatctaggacattgcgagaagattaagaaagcatgtggaaacttcggcataccatgcgagctgcgcgtgactagcgcccacaagggccccgacgagactctccggatcaaggccgagtacgagggtgacggaatccccaccgtgtttgtggccgtggctgggcggagcaacgggctgggtcctgtgatgtccggaaacacagcatacccagtgataagttgcccacccctgacacccgactggggcgtccaggatgtgtggtcttccctaaggttgccttcaggcctcgggtgctccacagtgctgagccccgagggctccgctcagtttgctgcacaaatcttcggcttatctaaccatctcgtctggtccaaactccgggcaagcatattgaatacctggatctctcttaagcaggcagacaagaaaataagagagtgcaatctatag

SEQ ID NO: 128815 - DNA, 1278 bp, Artificial Sequence
  Description of Artificial Sequence: Synthetic coding sequence
atggctaccgctgaggtacttaatatcggaaagaagctctacgaggggaagaccaaagaggtgtacgaactgctagattctcctgggaaagtgctcctgcaatctaaagatcagatcactgccggaaatgccgcaaggaagaatcacttagagggcaaggccgcgatatcaaataagataacaagctgtatattccaacttcttcaagaagctgggataaagacagcttttacaaggaaatgtggggaaactgcctttatagctccacagtgtgaaatgattcctatcgagtgggtttgcagaaggattgccacaggctccttcctcaaaaggaaccccggagtgaaggaaggctacaagttttatccaccaaaggttgaactgttctttaaggatgacgccaataatgatccccagtggagtgaagaacagctgatagccgccaaattctgctttgccggactactcattggccagactgaggtggatatcatgagtcacgcaacccaggcaatttttgaaatcctggaaaaatcatggttaccacagaattgtaccctcgttgacatgaagatcgagttcggggtggatgtgacgactaaagaaattgttttagccgatgtgatcgacaatgactcatggaggctgtggcccagcggcgataggtcacagcagaaggataagcagtcctacagagacctcaaagaagttacacccgaggggctgcagatggtcaagaaaaacttcgagtgggtggccgagcgtgtcgaactgcttctgaaatcggagagtcaatgcagggtggttgtgctcatgggtagtacctcagacttgggccactgtgagaaaatcaaaaaggcatgcggcaatttcgggattccctgtgaactgcgagtgacaagcgctcataagggaccagatgaaactctcagaatcaaagccgaatatgaaggcgatggaataccaaccgtgtttgtcgcagtggcaggtcggtcaaatggactgggacctgtcatgtctggtaacacagcctatccagttatttcatgcccccccctcacgcctgattggggtgtacaggacgtctggtcctctctcaggctaccctccggcctgggctgcagcactgttctgtccccagaaggatccgctcaattcgcagctcagatctttgggctttcgaatcacctcgtgtggtctaagctgcgcgcctccatcctgaacacatggatcagcttgaaacaagcagacaagaagatcagagaatgcaatctatag

SEQ ID NO: 128816 - DNA, 1278 bp, Artificial Sequence
  Description of Artificial Sequence: Synthetic coding sequence
atggctaccgctgaagttctcaacatcggcaaaaagctttacgaaggcaagacaaaagaggtgtacgagcttctggatagcccgggcaaggtgctgcttcagagcaaagatcaaataacagctggcaacgccgcccgaaaaaatcacttagagggtaaggcggcaatttccaataaaatcacatcttgtatatttcagctgctacaggaggcaggcatcaaaaccgcgttcacaaggaaatgcggtgagacagctttcatcgcaccgcaatgtgaaatgatcccaattgaatgggtttgccggagaatcgctaccggttcttttttgaagagaaaccccggcgtgaaggaaggatacaaattctacccccccaaagtcgagctattctttaaagacgacgcgaacaacgatccccaatggtccgaagagcaactgattgccgcaaaattctgtttcgctgggctcctgattgggcagactgaggtggatatcatgtcccatgcgactcaagcgatctttgagattctcgaaaagagctggctgccacagaattgtacactcgtagatatgaaaattgagtttggcgtggatgtgaccacaaaagaaattgtgctcgccgatgtgatcgataacgacagctggcgcctatggccgagcggtgatagatcccagcagaaagacaagcagtcttacagagacctgaaagaggtcacccccgagggtctccaaatggttaagaaaaacttcgaatgggtggcagagagggtggagctcctcttgaagtccgagtctcagtgccgagtagtggtcttgatgggatccacaagcgacctggggcattgtgagaagattaagaaagcttgcggcaatttcggcattccatgtgagctgcgtgtgacatccgcgcacaagggtccagatgagacgttgaggataaaagccgaatatgagggtgatgggataccaacagtgtttgtggctgttgctggacgcagtaatggtctgggtccagtcatgtcaggaaatactgcgtacccagttataagttgcccacctctaaccccagattggggagtacaggatgtgtggtcatctctgagattgccatccgggttaggctgctcaacggtactgagtcccgaaggatctgcgcagtttgccgcccagatctttgggctttctaatcatctggtgtggtctaagctgagagccagcatcctgaacacctggatctccctgaaacaggcagacaagaaaattagagagtgcaacctgtag

SEQ ID NO: 128817 - DNA, 4017 bp, Artificial Sequence
  Description of Artificial Sequence: Synthetic coding sequence
atgtcccctgtgctccatttttacgtgcggccctccggccacgagggcgcggcacctggccatactcgccggaagctgcagggcaaattacccgagttgcaaggggtggagactgaactgtgttacaacgtcaactggacagccgaggctctcccatccgcagaggagactaagaaactgatgtggctgttcggatgcccactgctgttagacgacgtagcccgtgagtcttggctgttgccgggctccaacgacctcctgttagaggtgggccccaggctgaatttcagtaccccaacaagcacaaacatcgtgtccgtttgtcgggccactgggctcggtccagtagatagagtggaaacaacccgtcggtaccggctctcatttgcgcacccaccatctgccgaagttgaggcgatcgcactggctaccctgcacgaccgtatgactgagcaacactttcctcatcccatacagagtttttccccagaatccatgcctgagccactcaacggcccgattaatatcctgggtgagggccgtctcgctctggagaaggcaaatcaggagctgggcctagcccttgattcttgggatctggacttttatacgaagcgattccaggaattgcaaagaaacccttcaactgtggaggcattcgacctggcccagtcaaatagtgagcactctagacactggttcttcaaagggcagcttcatgtggatgggcagaagctcgtccactctctcttcgaatcaatcatgagtacccaggagtcaagcaaccctaataacgtactgaagttttgtgacaatagctccgccatccaggggaaggaggtgagattcttacgcccggaggacccaacgcggcccagtaggttccagcagcagcaggggctgagacacgttgttttcacggcagaaactcacaacttcccgacgggtgtttgcccgttttccggagcaacaaccggcacaggaggccgaatcagggacgtgcagtgcacagggcgcggggcgcacgttgttgccgggacagctggctactgtttcggcaatttacacatcccgggatacaatttgccctgggaagacccctcatttcagtaccctgggaacttcgcacgcccattggaggttgcaatcgaggctagcaacggggcctcagattatggtaacaagtttggcgagccagtcctagctggctttgcaaggtctctgggcttgcaattgcctgatggccaaaggcgcgaatggataaaacccatcatgttttcaggtgggatcggttcgatggaagccgaccacattagcaaggaggcgccagagcccggaatggaggtcgtgaaagtggggggcccagtgtaccgcatcggggtcggaggcggagccgctagctccgtacaggtacaaggcgataacacctccgacctggattttggcgccgtccagagaggagatcccgaaatggagcagaaaatgaacagggttatccgagcctgtgtggaagctcccaagggcaatcctatatgttccttgcacgatcagggagcaggcggaaatgggaacgtgctaaaagaactgtctgacccggcaggcgcaattatctacacaagccgtttccaacttggtgatcctacattgaacgcactggagatttggggagccgagtatcaagagagtaacgcactgcttctccgcagtccaaaccgcgacttcctcacccatgtcagcgctagagaacgatgccctgcatgcttcgtcggcactatcacgggcgacaggcgaattgtgcttgttgatgaccgagaatgcccggtaaggagaaatggccaaggcgacgcacccccaacccctctccctactccagttgatctggaactggaatgggtcctgggcaagatgccccgcaaggagttttttttacagaggaaaccccccatgttgcaacccctggccttaccccccggactctcagtccatcaggccctcgaaagagtgcttaggctcccggccgtagctagcaaaaggtacttgaccaacaaggttgaccgctcggttggcgggctggtggcccaacaacagtgcgtgggtcctttgcaaacaccccttgctgatgttgctgtcgtggccctgtcccacgaagagctgattggtgctgcaaccgccctgggagaacagccagtgaaaagcctgctggatcccaaggtggcagcccgacttgcggtggccgaggccctaaccaatttggtgttcgctctggttacagacctgagagacgtgaagtgctccggaaattggatgtgggccgcaaagctgccaggagaaggcgcagctctcgctgatgcttgtgaagccatggtagctgtcatggcggcccttggcgtggccgtggatggcggaaaggactcactctctatggctgcccgggtgggcacagagaccgttcgagctcctgggagcctggtcatcagtgcatacgcggtgtgtcccgatatcacagccacagtgactccggatctcaaacatcccgaggggaggggacacttgctatatgttgctttatcgccgggccagcatcggctgggcgggaccgcactagcccaatgttttagccagctaggggagcatccaccagatctggacctgccggaaaacctcgtgcgcgccttcagcataacacagggactgctgaaagacagactgttatgctctggccatgacgtttccgatggggggctggtcacttgcctgcttgaaatggcattcgccggaaactgcggcctccaggttgacgtgccagtgcccagagtggacgttttgagcgtgctgtttgcggaggaacccgggctggttcttgaagtccaggagccggaccttgcccaggtgcttaaacggtatagggatgccggtctgcactgcctggaactcgggcatacaggcgaggccggtccacatgctatggtccgggtgtctgtgaacggagccgttgtcttggaagagcccgtgggcgaactccgagctctttgggaggaaacaagctttcagctcgacagactacaggctgagccacgttgtgtggccgaggaggagcggggattgcgcgaacggatggggccatcctactgtctaccgccaacattcccaaaggcctcggttcccagagagcctggcggcccttcacctcgcgtggcaattctacgggaggaggggtctaacggtgacagagaaatggccgacgcattccatctggcaggttttgaggtgtgggacgtgactatgcaagacctctgttccggcgccattggactagatacttttcgcggggtagcgtttgtgggtgggttctcctacgccgatgtactgggcagcgcaaaggggtgggccgccgcagtcacgtttcacccacgcgctggggctgagctgaggcgttttcgcaagagacccgacaccttttcgctgggggtgtgcaacggttgccagttgttggcattgctgggatgggtcggcggagatccaaacgaggacgccgccgaaatgggccctgattcacagccagccaggcctggactactactgcgacataaccttagcggaaggtacgagtcccgctgggcgtccgtgcgcgtcggccccggccccgccctgatgctcagggggatggaaggtgctgtgttacctgtgtggagtgcccatggcgagggatacgtcgctttcagcagccctgaacttcaggcacagattgaggcccgtggcctcgcgccattacactgggccgacgacgacgggaaccccactgaacaatatcctctgaatccaaatgggagtccagggggggttgccggtatatgttcatgtgacggccgacatctggcagtgatgccccacccagaaagagcagtcagaccttggcagtgggcctggagacctccgccttttgacacgttgactacaagtccttggctccagctgtttattaacgcccgcaattggacactagagggttcttgctag

SEQ ID NO: 128818 - DNA, 2745 bp, Artificial Sequence
  Description of Artificial Sequence: Synthetic coding sequence
atgttcagcggtggaatcggatctatggaggccgaccatattagtaaagaggccccagagcctggtatggaagtagttaaggtgggtggcccagtttacaggattggcgtgggtggtggcgctgccagctcagttcaggttcaaggcgacaacacttcagatctggacttcggtgccgtccagcgtggcgatcccgaaatggagcagaaaatgaacagagtcattagggcatgcgtcgaagcccctaagggtaatccaatctgttcattacacgatcagggtgctggtggcaatggaaatgtgttgaaggagctgtctgaccccgccggtgccattatatatacatcccggttccagctgggcgaccctactttgaatgctctggagatctggggcgcagagtaccaggaaagtaacgccttgctgctgagatcccctaacagagatttcctcactcacgtcagtgccagagagcgctgtcccgcctgcttcgtgggcaccatcactggcgacagaaggatcgtcctcgtcgacgaccgcgagtgtcccgttcggcggaacggacaaggggacgcccctcctactcctctccccacccccgtcgatcttgaactagagtgggtcttgggcaagatgccccggaaagaatttttcctacagcgcaagccgcccatgctgcaacctctggcccttcctcccggactgtctgtgcatcaggctctcgagagagtgcttagactgcccgccgtagccagtaagagatacttgaccaacaaagttgacagaagtgtggggggcctagtggcccagcagcagtgcgtgggacctcttcagactcctctagccgacgtggccgttgtcgctcttagccacgaagagttgataggggccgccactgctctcggagagcagccagtgaagtctcttcttgaccctaaagttgcagcacgcctcgccgtagcagaggcactgaccaatttagtcttcgcgctggtaactgacttacgcgatgtcaagtgttcaggtaattggatgtgggcagccaagttacccggcgagggcgccgccctggccgacgcctgcgaggccatggtagcagtcatggccgctctgggggtggccgtcgatggaggtaaggattcccttagtatggcagcccgagtggggaccgagactgttagggctcccggctctttagtgatttctgcatacgctgtgtgtccagacattacagccaccgtcacaccagacctcaaacacccggagggtaggggacaccttctatacgtcgcgctgtcaccaggccagcatcggttaggcggcacagctctggcccagtgttttagccagttaggggagcacccgcctgacctcgacctccccgagaatctggtcagggctttttcaatcactcagggactgttgaaagatagactattgtgttctgggcatgacgtgagcgatgggggactggtaacatgtctgttggagatggcattcgcaggcaactgcggactccaagtggatgtacctgttccacgagtggacgtcctgtcagtcttattcgccgaagaaccaggactcgtgctcgaggttcaggaaccagatcttgcccaggttctgaagcgttacagggatgctggcctccattgtctcgagctcgggcacacgggggaagctggaccgcacgcaatggtgagggtttccgtgaatggagccgtcgtcctggaggaacctgttggcgagctccgagcactctgggaggagacttcatttcaactcgatcggttacaagctgaacctcggtgcgtcgccgaagaggaacgcggtctcagggaacgtatgggcccttcatactgtctgccgccaacatttcctaaagcatccgtacccagggaaccaggtggaccaagcccacgagtggcgatcctccgcgaggagggcagcaacggagatcgggaaatggccgacgcatttcaccttgcaggatttgaggtgtgggacgtcacgatgcaggatctgtgtagcggggctatagggctggacaccttcagaggggtcgcgtttgtgggcgggttcagctatgctgacgtcctagggtcagctaagggttgggcagctgcagtgacttttcaccctcgggccggcgccgagcttaggaggtttagaaagcgccctgacactttttctctaggtgtgtgcaacggttgccaactgctcgccctgctaggctgggtcggaggtgatcccaacgaagatgccgccgaaatgggaccagactctcaaccggcaagaccaggtctgctgcttcggcataacctctccggccggtatgaaagccgttgggcatcagtgagagtcggtcctgggcctgccctcatgctccgggggatggagggagcggtgttgcccgtgtggagcgctcatggggaaggctacgtggcatttagtagtcctgaactgcaggcccaaattgaggcccgcgggctcgcccctctccattgggctgatgacgatggcaatccaactgagcagtacccattgaacccgaacggctctcccggcggagtggccgggatctgttcatgtgatggtcgtcacctggcagttatgcctcaccccgagcgggcagtccggccatggcagtgggcttggcggcccccaccatttgatactctcaccacctctccatggctccaactgttcatcaacgcgcgtaattggacactggagggcagctgctag

SEQ ID NO: 128819 - DNA, 2244 bp, Artificial Sequence
  Description of Artificial Sequence: Synthetic coding sequence
gtgaaaggcgagagacgcatagttcttgtcgatgacagagaatgtcctgttcgccggaatggccagggggatgcccctcccacgccgctcccaactcccgttgaccttgaactcgagtgggtgctggggaagatgccccggaaggagttttttctgcagcgcaaaccccccatgttgcagcctttggcgctgcctccaggattgtcagtgcaccaggcactcgaacgcgttttgaggttgcctgccgtagcttctaagagatatctgaccaacaaggtcgatcggtctgttggtggcctggtggcacaacagcagtgtgtcggccccctgcagacacccctggcagatgttgccgtggtggcactttcacacgaagaactcatcggtgcagccacggccctcggggaacagccagttaaaagtctcctggatcccaaggttgccgcccgcctagccgtcgccgaggccctgacaaaccttgtgttcgctttggtcactgacctccgggacgtcaagtgctccggaaattggatgtgggcagcaaaactgccaggggagggagcagccctggccgatgcttgcgaggccatggttgcggtgatggcagcactcggggttgcagtggatggagggaaagactcgttatcaatggccgccagggttggcacagagactgtgcgtgctcccggcagcctggtgatatccgcttacgcagtatgccccgacatcacggcgacggtgacccccgacctaaagcatcccgagggccggggacatctactatacgtcgcactttcaccaggacagcaccgattagggggtacagcccttgctcagtgcttctctcagctgggagaacacccccctgacctggacctgcctgaaaatctggtgcgggccttttcgataacgcaaggcctgttgaaggaccgtctgttgtgctcaggacatgatgtgtcagacggcggcctggtcacatgtttattagagatggcttttgctgggaactgtggtcttcaagtcgacgtgccagtgccccgcgttgatgtcctcagcgtcctgtttgccgaagaacctggattggtgctcgaagtgcaggaacccgatctggctcaagtcctcaagcggtacagggatgccgggctgcactgtctggagctcggccatacaggagaggctggccctcacgcaatggtgcgggtgtccgtcaatggtgccgtagtcctagaagaaccagtcggagagctgagagctctctgggaagaaacctctttccagctcgatcggcttcaggcagaaccccggtgcgtggcagaagaggagaggggactcagggaaaggatgggaccttcgtactgcttgccccccacctttcccaaagcctccgtgcctcgtgaacccggcggtccaagtcctcgggtggctattctgcgggaagaaggaagtaacggggaccgtgagatggccgacgcatttcacctggccggctttgaggtgtgggacgtgacaatgcaggacctttgcagcggggctatcggattagatacttttcgcggggtggcattcgtgggtggtttctcatatgccgatgtgttgggcagcgccaagggctgggccgccgcagtcacttttcaccccagggccggagccgagttacgccgattccggaagcggcctgacactttctctctgggcgtctgtaatggctgtcagctcttagccctcctcgggtgggttggaggagatccgaacgaggatgcagccgaaatgggacctgattctcagcccgccaggccaggactgcttctcaggcataatctgtccggtcggtatgagagtcggtgggcctcggtccgggttggtcctggacctgctctgatgctccgcggaatggagggcgctgttctacccgtttggagtgcgcacggtgagggctacgtggcattctctagccctgaattgcaagcgcaaattgaggcacgcggccttgcgccactccattgggcggatgatgacggtaaccccaccgagcagtacccgcttaaccccaatgggtcaccaggcggggtggcagggatctgctcctgcgacggcaggcacttggcagtcatgccccatcctgagcgtgctgttcggccatggcaatgggcgtggaggccccccccatttgataccctcacaacgagcccttggctgcaattgttcattaatgcgagaaattggacccttgaaggcagttgttag

SEQ ID NO: 128820 - DNA, 1302 bp, Artificial Sequence
  Description of Artificial Sequence: Synthetic coding sequence
atggccgcccgagtgctgatcattggaagtggcgggagggagcataccctggcctggaagcttgcccagtcacaccacgtcaagcaagtactcgtggccccaggcaacgccggaacagcatgcagtgaaaagatcagcaacactgccatatcaatttccgatcacacagcactggcacaattctgcaaagagaagaagatcgaatttgtcgtcgtcgggccagaagcgccgctggcagccggtattgtgggcaatcttaggagcgcaggagtacagtgctttggaccaaccgccgaggctgcccagctggaatcaagcaagaggttcgcaaaagaatttatggatcgtcacggaattccaaccgcgcagtggaaagcatttaccaagcctgaagaagcctgcagctttatattgtctgcagacttcccggccctggtggtaaaggcgtctggtttggctgccgggaagggagtcattgtagctaaaagcaaggaggaggcctgcaaggcggttcaggagataatgcaggagaaggctttcggcgccgcaggagagacgattgtgattgaagaattgttggatggagaagaggtttcatgcctgtgtttcaccgatggcaaaaccgtggctcctatgcctcctgcgcaggaccataagaggctgctcgaaggagatgggggccctaataccggtggcatgggcgcctattgccccgctccccaggtcagcaacgacctgctgctcaaaattaaagacacagtgcttcagcgcacagtggacggcatgcaacaagaaggtaccccttacacagggattttatacgccggtatcatgcttacaaagaatggccccaaagtgctggagtttaattgccggttcggagaccccgagtgtcaggtgattctcccattattgaagagcgacttatacgaagttatccaaagcaccctcgatgggctgctgtgtacctccctcccggtctggttagagaaccacaccgcattaaccgtagtgatggcttcgaagggctatccaggggactacacaaagggggttgagatcactggttttcccgaagcgcaggccctgggcctagaggtttttcatgccgggaccgcactgaagaatgggaaagtggttacacacggaggcagagtcctggcagtgaccgccatccgggagaacttgattagtgcattggaggaggccaagaagggcctcgcagctatcaaatttgaaggagcaatttaccgcaaggacgtgggcttcagagccatcgcctttctgcagcaacccaggtag

SEQ ID NO: 128821 - DNA, 3033 bp, Artificial Sequence
  Description of Artificial Sequence: Synthetic coding sequence
atggccgctagggtgttaatcatcgggagtggtggcagagagcacacattagcatggaaactggctcagagtcaccacgtaaagcaggtgctggtcgctcccgggaatgcggggacagcttgcagcgagaagattagtaacactgcaatcagtatctctgatcacactgctcttgcccaattctgcaaagaaaaaaagatcgagtttgtggtcgtggggccagaagcccctttagcagccggcattgtgggaaatctgcgatctgccggcgtgcaatgtttcggccctacagctgaggccgcacaacttgagtcctccaaacggttcgctaaagaatttatggaccggcatggcattcccaccgctcagtggaaagcatttacaaaaccagaggaggcatgcagtttcatcctaagtgctgatttcccggcccttgtcgtgaaagcctcggggctcgccgccgggaaaggcgttattgtggccaagtccaaggaggaagcctgtaaggcggtgcaggagattatgcaggagaaagctttcggcgctgccggcgagaccatcgtaatcgaggagctgctagacggcgaagaggtgtcttgcctgtgttttacagacggaaaaaccgtcgcccccatgcccccagctcaagatcacaagaggctgctggaaggggatggcggccctaatacgggtgggatgggtgcttattgcccagctccgcaggtgtccaatgatctgctgctcaaaatcaaggacactgtcctgcagcggacggtggacgggatgcagcaggagggcaccccatacacaggcattctgtacgcagggatcatgctgacaaaaaatggaccaaaagtcctcgagtttaattgtaggtttggagacccagagtgccaggtgattctgcccctgctcaagagcgacttgtatgaagtgattcagagcacccttgatggcctgctttgcactagcctgccagtgtggctcgaaaatcacactgcattgactgtagtgatggccagtaaaggctaccccggcgattacaccaagggcgtcgagatcaccgggttccccgaggcccaggccttggggttagaggtttttcacgctggcactgcactcaagaatggtaaggtggtgacccacggggggagagtgctcgcagtaactgctattagagagaatctaatttctgccctggaggaggcgaaaaaagggctggccgcaatcaagtttgagggggcaatctacagaaaagatgtggggtttcgcgccatcgcctttttacagcagcccaggagcctgacctacaaagaaagcggcgtcgatatcgccgctggcaatatgttggtgaaaaaaattcagcccctggccaaggctacttcacgatctggttgcaaagtggatctcggcggattcgccgggctgtttgatctgaaggccgccggctttaaggacccgctcctggcatccgggaccgatggcgttggtactaaattaaagatcgcacaactgtgcaataagcatgatacaatcgggcaagacctggtggccatgtgtgtgaacgacattctcgctcagggcgcggagcctttattttttctggactatttctcatgtggcaaactcgacctgagcgtcaccgaggcggtcgtggccggcatcgcgaaggcttgtggaaaggccggctgtgccctgttaggcggcgagacagcagagatgcccgacatgtaccctcccggtgagtacgacctggctgggtttgcagtcggggcgatggaaagggatcagaaacttccccatctggagaggatcactgagggagacgtagttgtgggcatcgcgagctctggcttacattcaaacgggttcagcctggtacggaaaatcgtagctaaatcctccttgcagtactcatcgccagcacccgacggctgtggggatcagacacttggggatctcctcctgacacccacccgcatctatagccacagtctgctcccagtgctgcggagcggccacgttaaggccttcgctcatatcacgggcggaggcttactggagaatatccctcgtgtgctgccagaaaaactcggagttgatctagacgcgcaaacatggagaatcccacgggtgttctcttggctgcaacaagagggccacttaagcgaagaggagatggctagaacatttaattgtggagtgggggctgtgcttgtcgtgtcaaaggagcagaccgagcagatccttagagacatccagcaacacaaagaagaggcttgggtcatcggctccgttgtagcacgcgccgaaggatccccacgtgtgaaagtgaagaatctaattgagtcaatgcagatcaatggatctgtgctcaaaaatggttccttgaccaaccacttttccttcgagaagaagaaggcccgcgtcgctgtgctgatctccgggactggttctaacttgcaggccctgatcgactctactcgggagcccaatagtagcgcccaaattgacatagtcatcagtaacaaggccgctgtggcgggattagacaaggccgaaagagccgggatacccaccagagtcataaatcacaagctctacaaaaaccgggtggagttcgactccgccatcgacctggtgctggaggaatttagtatcgatatcgtgtgccttgcaggtttcatgcggatcctgagcggccctttcgtgcagaaatggaacggcaagatgttgaatatacatcctagcctgctacccagttttaaaggctctaacgcacatgagcaagccctagaaaccggcgtcaccgttaccggttgtaccgtgcactttgttgccgaggacgtagatgctggacagattatcctacaggaggcagtgccagtgaaaaggggcgatacggtggctacattgagcgaaagggttaagcttgccgagcacaagatttttcctgcagcacttcagttggttgccagtgggacagtacagttgggggagaatggcaagatatgttgggttaaggaggagtag

SEQ ID NO: 128822 - DNA, 3033 bp, Artificial Sequence
  Description of Artificial Sequence: Synthetic coding sequence
atggctgctcgtgtgctgatcatcggtagtggcgggagggaacatacgctcgcgtggaagctggctcagtcacatcatgtgaaacaggtgttggtcgccccgggcaatgcaggcactgcgtgctctgagaagatctccaacactgcaatttcgattagtgaccataccgctctcgcccaattttgtaaggaaaaaaagatcgaattcgtggtggtgggacctgaggcccctctggccgccgggatcgtgggaaatttacgttcagcgggggtccagtgctttggccctacagccgaagctgcacagctggaaagttccaagcgattcgcgaaggagtttatggatagacacggcatacccaccgcacaatggaaggcttttacgaagccagaggaggcctgttcttttatcctgagtgctgattttccagcacttgtggtcaaggcttcaggcctggccgcggggaagggcgtaattgtagcaaagagcaaagaggaggcctgtaaagccgtacaggagattatgcaggagaaggcctttggggctgcaggcgaaaccatcgtcatcgaggagctcttggatggtgaggaggtcagctgcctgtgtttcactgacggtaagactgtggcccccatgccgcccgcccaggatcacaagcgcctactggagggtgatggcggccccaataccggcggtatgggcgcctactgcccggccccacaggtcagcaacgacctgcttctgaaaatcaaagacaccgtgttgcagcgtactgttgacggcatgcagcaggagggtaccccctacaccggtatcttatacgcaggaataatgctcacgaagaacgggccgaaggtacttgaatttaactgtagatttggggatcccgaatgtcaggtgattctccctttgcttaaatcagacctatacgaggtaattcaatcaactcttgatgggctcctatgtacaagtctgcccgtctggctcgaaaatcataccgctttgaccgtagtgatggccagtaagggttaccctggagattatactaagggcgtggagatcaccggcttccctgaagcccaggcactcggtctggaggtgtttcatgccggcacagctctcaagaatgggaaagtcgttacgcatggcgggcgggtgctcgcagttactgcgataagggaaaacctgatcagtgccttggaggaagccaagaaagggcttgccgcgataaagtttgagggtgcgatctataggaaggacgtggggttccgggccatcgcatttcttcaacagcctaggagcctgacatataaggaatcaggggttgatattgcggctggaaatatgcttgtcaagaaaattcagccactggccaaggctacaagtcgctcaggctgcaaagtggatcttggcggcttcgccggactttttgacttaaaagcagctggattcaaagaccccctgctcgcttctggaaccgacggggtaggaacaaagctgaaaattgcccaactgtgtaacaagcatgatactatcggacaggatcttgtggccatgtgcgtcaacgacatactggctcagggcgcggaacccctgttttttctagactattttagctgcgggaagctggatctgtccgtgaccgaggcggttgtcgccggtatagcgaaggcctgtgggaaggccggctgtgccctcttgggaggcgagaccgccgagatgccggacatgtatcctcctggcgaatacgacttggccgggtttgccgtgggggcaatggagagggatcagaagctgccacatctggagcggattaccgaaggcgacgttgtcgtcggaatcgcaagcagtggcttacattccaatgggttttcccttgtgcgcaagatcgtggccaagagttcgctgcagtatagcagtcctgctccggatgggtgcggcgaccagacactgggggatctgttactcacccccacacgcatttattcacattccctgctccctgttcttcgatcaggtcacgtgaaagcctttgctcatatcacgggaggaggtttattggaaaacatcccacgagtgttgccagaaaagctgggggtggacctggatgcgcagacctggcgtatcccgcgagtgttcagttggttacagcaggagggacatttgtcagaagaggaaatggccaggacctttaattgcggggtgggagccgtgctggtagtgagtaaggaacagaccgagcagatcctacgggatatccagcagcacaaggaagaggcctgggtgattggatcagtagtggcccgcgccgaaggttcaccccgtgtgaaagtgaaaaacctcatcgagtcaatgcaaattaatgggagtgtcctaaaaaacggttcactgacgaaccacttctccttcgaaaagaaaaaggctagggttgctgtgctgatcagtgggacaggttcgaacctgcaggctcttatcgatagtacccgagagcccaattcctctgctcaaatcgacatagtcataagcaacaaagcggctgtggccggactcgacaaggctgagcgggccgggatacctactcgggtcatcaaccataagctttataagaatagggtggagttcgactctgccatagatcttgtcctagaagaattcagcattgatatcgtgtgcctcgccggctttatgcggatcctctctggaccttttgtgcagaaatggaacgggaaaatgctgaatatacacccaagcctcctaccttcctttaaaggtagtaacgcccacgaacaggcgctcgagaccggcgtgacagtgactggttgtaccgtccattttgtcgccgaggacgttgacgcagggcagattatcctgcaggaagcggtaccagtaaagcggggcgatacagtggccacgctttcagagagggtgaagcttgctgaacataagattttcccagcggcacttcagctcgtggcctctggtacagttcaactcggagagaacggtaaaatttgctgggtcaaagaggagtag

SEQ ID NO: 128823 - DNA, 3033 bp, Artificial Sequence
  Description of Artificial Sequence: Synthetic coding sequence
atggctgcgagggtgctgattattgggtcaggaggccgggagcacaccctagcctggaagctggcccagagccatcacgtcaaacaggtactggtcgctcctgggaacgctggtaccgcgtgcagcgagaagattagcaacactgctatcagcattagtgatcatacagctcttgcacaattttgtaaggagaagaagatcgaattcgtggtcgtggggccagaggcaccgctggccgctggcatcgtggggaatttgcgctcagccggcgtccaatgctttggaccaacagcagaggcagcacagttagagagcagcaagcggttcgcgaaggagtttatggaccgccacggaatcccgaccgcgcagtggaaggcattcaccaaaccagaggaagcctgcagttttatactctccgccgacttcccggccctggtagttaaggcctcaggcctagcagccggtaaaggcgttattgtggccaaatcgaaagaagaggcctgcaaagccgtccaggagattatgcaagagaaagccttcggagctgctggcgagactattgtgatcgaagaactgctggacggcgaggaagtctcttgtctgtgcttcacagatggaaaaactgttgccccgatgccgcctgcacaggatcacaaacggctgctggagggagacggaggaccgaataccggcggcatgggcgcctactgcccagcccctcaggtgtcgaacgatctgcttctaaaaattaaggacactgtcctgcagagaactgtagacgggatgcagcaggaaggcaccccgtatacgggaatcctctacgccggcatcatgcttaccaagaacgggcccaaggttcttgagttcaactgccggttcggggatcctgaatgtcaagtgatattgcctttactgaaatccgacctatacgaggtgatccaatcaactcttgatgggctgctatgtactagcctaccggtctggctcgagaaccacactgctttgactgtggtgatggcatccaagggctatccaggagattacaccaagggcgtcgaaattaccggtttcccagaagcccaggctctggggctggaggtgttccacgccgggaccgctctcaaaaacgggaaagtcgtgacacacggaggacgggtactcgccgttacagcaatacgagaaaatctgatctccgcactggaggaagccaagaaaggcttggccgctatcaagtttgagggcgccatttaccggaaggatgtggggttccgggccatcgccttcctgcaacaacctagaagtttgacatacaaagagtctggggtagatatcgcggccggcaatatgttggttaaaaaaattcagccactggccaaggcaactagtagaagcgggtgcaaggtagacctgggaggctttgccgggttgttcgatcttaaggccgctggctttaaggatcccttgctggccagcggcactgacggcgtgggcacgaaactgaaaatagcccaattatgcaacaagcacgacaccattggtcaggacctggtcgcgatgtgtgtcaatgacatcctggcccagggggcggaacccctcttcttcctggattattttagttgcggcaagctggacttgagtgtaactgaagcagtcgttgctgggattgccaaggcatgtggcaaggccggctgcgccctactgggaggagaaaccgcagaaatgcccgacatgtatccaccaggcgagtacgacctggcaggatttgccgtcggggcaatggaaagagaccagaagttgccacatctcgagcggatcaccgagggagatgtggtggtggggatagcctcttcaggcttgcactcaaatgggttctcactggtgcgcaaaattgtggcgaaaagttctcttcagtactccagccccgcacccgatgggtgcggagatcagacactgggcgacctacttctgactccaaccaggatctacagccactctctcttgcccgtgttaagaagcggacacgtgaaggcgtttgcgcacattaccggagggggactgctcgagaatattcccagggtgctgcctgaaaagctgggcgtcgatctagatgcccagacgtggcgcatacccagggtcttctcctggcttcagcaggaaggccatctgtccgaggaggagatggccagaacattcaactgtggagtgggggccgtccttgtggtgagcaaggagcaaacagaacagattctaagggatatccaacagcataaagaggaggcttgggtcatcggtagtgttgtcgccagagcagagggttccccacgggtgaaggttaagaatctgattgaatccatgcagatcaatggctcagtcctgaaaaatggtagcttaacaaaccatttcagcttcgagaagaaaaaggctcgggtagccgtgttaatctctggaacaggttctaacttgcaggcactaatcgactcgacccgagagcccaacagctcagcacagattgacatcgtgatcagtaacaaggccgctgttgcaggccttgataaagctgagcgggccgggatccctacgcgcgtgatcaaccataagctgtataaaaaccgtgtggagttcgatagcgcgatcgatctggtgctcgaagaattctctattgatatcgtctgtttggccgggttcatgagaatactgagcggccccttcgtgcaaaaatggaatgggaaaatgctgaatattcatccatccttgctgccatcctttaaggggtccaatgcccacgagcaagcgcttgagacaggcgtcaccgttacaggctgcacggtacatttcgttgcagaagatgtcgatgcaggccagattatcctgcaagaagcagtccctgtaaagcggggcgatacagtagccactctgtcagaaagggtgaagcttgctgaacataaaatctttcccgccgccctacagcttgttgcctccggcacagtgcagctgggggagaacggaaagatctgttgggtgaaagaagaatag

SEQ ID NO: 128824 - DNA, 699 bp, Artificial Sequence
  Description of Artificial Sequence: Synthetic coding sequence
atggccgccagagtcttgataatcggatccggtggccgcgaacacaccctggcctggaaattggcacaatcacaccatgtcaaacaggtgctggtcgccccaggaaacgccggcactgcctgttccgaaaaaatctcaaatacagcaatctccatttcggatcacactgcactagcacagttttgcaaggagaaaaagatagagttcgtggtggttggccccgaggcccccctcgccgcagggattgtcgggaacctgcggtcagccggcgtgcagtgttttggacccacggctgaggccgcccagttggaatctagcaagcggttcgcgaaagagtttatggaccggcatggaatccccacagcccagtggaaggcctttaccaagccagaagaggcctgcagctttattctgtctgccgatttccctgccctagttgtgaaagcctccggactggcggccggtaaaggcgtgatcgtggctaagagcaaagaagaagcttgcaaagcagtgcaagaaatcatgcaggaaaaagccttcggagccgctggtgaaacaatcgtgattgaggagctgttagatggagaagaggtgagctgtctttgtttcaccgatgggaaaactgttgctccaatgcccccggcccaagaccacaagagactgcttgagggggatggcgggcctaacaccggaggatag

SEQ ID NO: 128825 - DNA, 726 bp, Artificial Sequence
  Description of Artificial Sequence: Synthetic coding sequence
atggcggcgcgggttcttatcatcggaagcggtggcagagaacacacactggcctggaaacttgctcagtcacaccatgtgaaacaggtgcttgtggctccaggaaatgcaggcaccgcttgtagcgagaagattagcaataccgcaatctccattagtgaccacacagctctcgcccaattctgtaaggagaagaagatcgaatttgtcgtggtggggcccgaagcgcccttggccgctggcatcgttgggaatctcagatctgcaggagtccagtgctttggaccgacagctgaggcggcccagttggagtcctccaaacgtttcgccaaggaattcatggaccgccacggaatacccactgcccaatggaaagcgttcactaaaccggaggaggcttgttcctttatcctgtccgccgactttccagccctcgtagtgaaagctagcggactggccgctgggaagggtgtaatcgtggcaaagagcaaggaggaagcttgcaaagcggttcaggagattatgcaggagaaggcctttggtgccgccggagagacgatcgtgatcgaggaacttctggacggcgaggaggttagttgcctctgctttacagacggcaaaactgtagctcctatgccccctgcccaggatcacaagcgtctgttagagggcgacggtgggcccaatactggcggcatgggcgcctactgccctgcaccacagtag

SEQ ID NO: 128826 - DNA, 417 bp, Artificial Sequence
  Description of Artificial Sequence: Synthetic coding sequence
atggcagccagagtgctcattattggttccggtggacgcgaacataccttagcatggaaactggcgcagtcgcaccatgtcaagcaggtactggtggcacctgggaacgcaggcacagcctgctccgagaagatctctaataccgcgataagcatttccgaccacaccgcattggctcagttttgcaaagagaagaaaattgaattcgtggtcgtgggacccgaagcgcctttggccgcgggcatcgttggtaatctgcggtcagcgggagtgcaatgtttcggaccaacagcggaagcagcgcagttagaatcatctaagaggtttgcaaaagaattcatggacaggcacggcatccctaccgcacagtggaaagcctttaccaaaccagaagaagcatgctcctttattttatag

SEQ ID NO: 128827 - DNA, 411 bp, Artificial Sequence
  Description of Artificial Sequence: Synthetic coding sequence
atggctgccagggtgcttatcatcggaagcggcggccgggaacacacactggcatggaaactcgcacagtctcatcacgtgaaacaagtgcttgtcgcaccgggtaatgccggaaccgcctgttccgagaagatctctaacaccgccatctcaatctcagatcataccgcactggcccaattttgcaaagaaaagaaaatcgagttcgttgtggtgggaccggaagcaccattagcagcgggtattgtgggtaacctaaggagcgccggcgtgcaatgcttcggacctaccgcggaggcagcccagctggagtccagcaagagatttgctaaggagtttatggataggcacgggattccgactgcccagtggaaggcctttacaaagcccgaggaggcatgtagtttctag

SEQ ID NO: 128828 - DNA, 1689 bp, Artificial Sequence
  Description of Artificial Sequence: Synthetic coding sequence
atgctggtgaagaagatccaaccacttgccaaagcaacgtcaaggtcaggctgtaaagtcgacctgggtggcttcgctggtcttttcgaccttaaagcggcaggtttcaaggaccctctcctagcctctggtactgatggtgtggggactaaattgaagatagctcagctctgtaataaacatgatactattgggcaggatcttgtggcaatgtgtgtgaacgacatcctggcgcagggagccgagcccctttttttcctcgattacttttcatgcggcaaactcgatctgagcgtcaccgaggcagtcgtggccggcatcgccaaagcctgcggaaaggcaggatgtgcactcctgggcggcgagaccgcagaaatgcccgacatgtaccccccaggtgagtatgatctggcgggcttcgcagttggtgccatggagagagaccagaagttacctcatctggaacgcattactgaaggggacgtcgtggtaggaatcgcctcttcggggctgcactccaatggcttcagcctcgtgagaaaaatcgtggctaaaagtagtcttcagtactcttcccctgccccggacgggtgcggagaccagactttaggggacctgctgctaacacctactagaatctacagccattccctgctgcccgtgcttaggtccggccacgttaaggcttttgcgcacattactgggggaggcctactcgaaaatattcctagggttttgcctgagaaactgggggtggatctcgatgcccagacttggcgcattccaagagtgttcagttggctgcagcaggaggggcatctgagcgaggaggagatggcgcgaacctttaactgtggagtcggtgcagtcttggtggtgtcgaaagagcagacggagcagatcctgcgcgacatccagcaacataaagaggaggcctgggtcattggctctgtggttgccagagcggagggatcccctagggtgaaagtaaagaatctgatcgaaagcatgcagattaacggcagcgtgctcaagaatggaagcctcacaaaccattttagctttgagaagaaaaaggcccgggtggctgtgctcatctctggtacaggctcaaatctgcaggccctcattgactctactcgggagcccaattcctcagctcagattgacattgtgatatctaataaagcggccgtggctgggttggacaaagcagagagagccggcattcctacccgtgtgattaatcataaactgtacaagaaccgggtggaattcgattcggctatagatttggtcctagaagagtttagtattgatatagtgtgtttggcaggctttatgcggattctgtcagggcctttcgttcagaagtggaacggaaaaatgttgaacatccatccatcacttctgcctagttttaaaggaagcaatgcacacgaacaggccctggaaacgggcgtgactgttaccgggtgtactgtgcattttgttgcggaagacgtggacgcaggacaaataatcctgcaggaggccgttcctgttaagcgcggcgataccgtcgccaccttaagcgaacgagtgaaacttgctgagcacaagatatttcccgctgcactccagctggtggcctcaggaaccgtccagctgggtgagaacggcaaaatctgttgggtcaaagaggaatag

SEQ ID NO: 128829 - DNA, 2265 bp, Artificial Sequence
  Description of Artificial Sequence: Synthetic coding sequence
atgtcaaggcctttaagcgatcaggagaagcgtaagcagattagcgtacgggggctggctggggtggagaacgtgactgaattgaaaaaaaacttcaatagacacctccactttacactggtcaaagaccgcaatgtggctactcctcgggactactattttgcacttgcccacacggttcgcgatcacctggtcgggaggtggatccggacccagcaacattactatgagaaagatcccaagaaaatatccggcggttggcaaatggaggaggcagacgattggttgagatacgggaacccttgggagaaggctagaccggagttcacccttccggtacacttctacggccatgtagaacataccagccagggagccaaatgggtcgacactcaagttgtgctggcgatgccttacgacacaccagtgcccgggtaccgcaataacgtggtcaatacaatgagactctggtccgctaaagccccaaatgacttcaatctgaaggattttaatgtgggaggctatatacaagctgtgctggataggaaccttgccgagaacattagtagagtgctgtaccccaacgataatttctttgaaggtaaagagctccgcctgaagcaagaatatttcgttgttgccgccacgttgcaagatattatcaggaggtttaagtcaagtaagttcgggtgtcgtgatccagtgcggactaatttcgacgcattccctgataaagttgctattcagctcaatgatacacatccttcactagcaatccctgagctgatgcgaatcttagttgatttggagagaatggattgggataaggcctgggacgtcacagtcaggacctgtgcatacaccaaccatactgttctccccgaagccttggagaggtggcccgttcatctgctcgaaaccctactgccccgccacctacagattatttacgaaatcaatcagcgctttcttaatcgggtggccgcagccttcccgggcgacgtggaccgccttcgaaggatgtcactggtggaagagggggcggtcaagagaatcaatatggctcatttgtgcatagctggctctcatgctgttaacggggtagcgcgaatacattcggagattttgaaaaaaaccatctttaaagatttttatgaactggaaccccacaaattccagaacaaaacgaacggtattactccaagacggtggttagtgctgtgtaatccaggcctggccgaggtgatcgcggagcgaattggcgaggattttattagtgatttagaccagttgagaaaattactcagcttcgtcgatgacgaggcattcattcgagatgtggcgaaagtgaagcaggagaacaagttgaagttcgccgcttatcttgagagggaatacaaggtccacatcaatccaaactctttattcgatatccaggtcaagcgcatccacgaatacaaacggcagctgctgaactgtttgcatgtgatcactctctacaacaggattaaacgtgaaccgaacaagttcttcgtgccccgcactgtaatgataggaggcaaggctgcgccaggataccatatggcaaaaatgatcatccgcttggtcaccgccataggcgacgttgtgaatcatgaccctgcagtgggtgaccggctccgcgtgattttcctggagaattaccgcgtgagtctggctgaaaaggtcataccggccgctgatctgtccgaacaaatcagtacagccggaaccgaggcctcagggaccggcaacatgaaatttatgctgaacggcgctctgaccatagggactatggacggggccaacgtggaaatggccgaggaggccggggaagaaaactttttcatctttgggatgagagtagaagacgtggataaactggatcagcgcggttacaatgcccaagagtactacgatcgaatcccagagttgcgccaggtcatcgagcagctgagttccggatttttcagtcccaaacagccggatctttttaaggacatagtcaacatgctcatgcatcatgaccgattcaaagtgttcgccgattacgaggattatataaaatgtcaggagaaggtctcagcactgtacaagaatcccagggagtggacccgtatggtgattagaaatatagccacgtctggaaaattttcaagcgaccgtacaattgcacaatacgcccgcgaaatctggggtgtagagccttcacgacagcgtttgcccgcacctgacgaggcaatttag

SEQ ID NO: 128830 - DNA, 3633 bp, Artificial Sequence
  Description of Artificial Sequence: Synthetic coding sequence
atgaggagtcgctctaattccggtgtcagacttgatggctacgctagattagtgcagcaaacaatcctgtgtcaccaaaatcccgtgacaggcctactgcccgccagttatgaccagaaggatgcatgggtgcgagataatgtatattctattctcgcagtatggggactcggattggcgtatagaaaaaatgcagaccgcgacgaggataaagccaaggcatacgaattggaacagtcagtggtgaaactgatgagaggactgcttcattgcatgatcagacaagtcgacaaagtcgagtcattcaaatacagccagtcgacgaaggacagtctgcatgccaagtacaacacaaaaacctgcgctacagtcgtcggggatgaccagtggggtcatctccagttagacgccacctcagtatacttactattcctcgcgcaaatgacagcaagtggactgcatatcattcactcactcgatgaagtgaattttatccagaatctagtcttttatattgaggccgcttacaagaccgccgactttgggatctgggagcgcggcgacaagacaaatcaggggatctccgagctgaatgcctcctccgtgggcatggcgaaggcggctttggaggcactggatgagctggatctttttggtgtaaaaggcggaccccagagtgtgatccacgtgctcgccgacgaagtccagcattgtcagagtattctgaactcactgttgccccgtgcttcaactagcaaagaagttgatgccagtctgctgtccgttgtgagttttcccgcctttgccgtggaggacagccagctggttgaattaacaaagcaagaaatcatcacaaagctacaggggagatatggctgttgtagattccttcgtgatggctataagactccaaaggaagatcccaacaggctttactatgagccagccgaattaaaattgtttgagaatatagaatgtgagtggcctctgttttggacctatttcattttggatggggtgttcagtggaaacgctgaacaggtccaggagtacaaggaggccctggaagctgtgttgatcaagggaaaaaacggggtgcccctgttgcccgagctatattccgtcccccctgaccgggtggatgaagaatatcagaacccacacacagtagacagagtacccatgggaaagcttccccatatgtggggccagtctctgtatatccttgggagcttaatggccgagggttttctcgcccctggggaaatagaccctctgaataggcggttttctacagttcctaagccggatgtggtggtccaggtgagcattctggctgaaactgaggaaattaagactatcctgaaggacaaagggatatacgtggaaacgattgcagaggtgtatccaatcagagtgcagccagctcgcattctttcacacatttactccagcctgggttgcaacaacaggatgaaactctccgggcgaccttaccgccatatgggggttctcggtactagcaagctttacgatattaggaaaacaatcttcacgtttaccccccaattcatcgaccagcagcaattttatcttgctctcgataataagatgatcgtggaaatgttgagaactgacctcagctacctgtgttctcggtggcggatgacaggccagccaacaatcaccttccccatcagccattcaatgctagatgaagacggaacgagcctcaactcctcaatcctagctgccctgaggaagatgcaggacggttatttcggcggtgcacgggtgcagacagggaagctgtctgagtttttgaccacctcctgctgcacgcacctgagcttcatggatccaggaccagaaggtaagctgtactcagaagattacgatgacaactacgactatttagaatcaggaaactggatgaatgactacgacagtacctctcatgcaaggtgtggagatgaagtggctcggtatctggatcacctcttggcccacaccgcaccccatcccaaactggctcctacctcacagaagggcggcctcgatagatttcaagcagcagtccagacgacttgtgacttgatgtctctggtgactaaggccaaggaacttcacgtccagaacgtgcatatgtacctgcccaccaagttatttcaagcctcccggccatcatttaacttgctcgatagtccccaccctcggcaagaaaaccaagtgcctagtgtgagagtggaaatccacctgccgagagaccagtctggtgaggtcgactttaaggcgctggtcctccagctgaaggagacaagttccctacaagagcaggctgatattctgtacatgctgtacacaatgaagggaccggactggaacactgagctctataatgaacgaagtgctaccgtgagagagttactgacagagctttatggcaaagtgggtgagataagacattgggggttgattcgatacataagcggaatcctgcggaagaaggtcgaggccctcgacgaggcctgcactgacctgctgtcacaccaaaagcacctcacagtgggccttccacccgaacctcgggaaaaaaccatcagcgcacctcttccgtatgaggcgctcacccaactaatagacgaggcctccgagggcgatatgtccataagcatcctgacacaggaaatcatggtttacttagcgatgtatatgcggacacagccaggactcttcgctgaaatgttccggcttcgcatcgggctgataatacaggtaatggccacagagctggcccactctcttcggtgctcggcggaggaggctacagaaggattgatgaacctgagcccatccgctatgaagaatcttttacatcatatactgagcggcaaagagtttggcgtggagaggtctgtgaggccaacagattcaaacgtgtcccctgcaatctctatccatgagatcggagcggttggcgcaacaaaaaccgaacgcactggtattatgcagttgaaaagcgaaatcaagcagagccctgggacatcaatgaccccttcgtctggctcttttccctcggcctatgaccaacaatcgtctaaagatagtcggcagggacaatggcagcgtaggaggcgacttgatggggcattgaaccgcgtgccggttggtttctatcaaaaggtttggaaagttctgcaaaaatgccacggactgagcgtggaaggatttgttctgccttcttcaaccacacgggagatgactcctggtgagattaagtttagcgtccacgtggaaagcgtcttgaatagagtgcctcagccagaataccggcaactcctcgttgaagctatcctagttctaactatgctggcagatattgaaattcattctattggtagcataatcgccgtcgagaagattgttcatattgccaatgaccttttcctgcaagaacagaagacgctcggcgccgatgatactatgctggcgaaagatcccgccagcggcatctgtactttgttatacgattccgcaccctccggtcggttcggaactatgacttacctctccaaggccgctgcgacctatgtgcaggaatttcttccccattcaatctgtgctatgcagtag

SEQ ID NO: 128831 - DNA, 3723 bp, Artificial Sequence
  Description of Artificial Sequence: Synthetic coding sequence
atgcggagtcgttctaactccggcgtccgcctggatggttacgcacgcttggtacagcaaacaatcctatgtcaccagaatcctgtcactggactcctgccagcctcctatgaccagaaggacgcctgggtcagggataacgtgtatagcatcctggccgtgtggggactcgggctagcatataggaagaacgcggatcgagacgaggataaggcaaaagcctatgagctcgagcagtccgtagtaaaactcatgagggggcttttgcactgcatgatcaggcaagtggataaagtggagtcgttcaagtatagccaatcaacaaaggatagtctgcacgctaagtacaataccaagacctgtgctacagtggtgggggatgaccagtgggggcacctacagcttgatgcaacctcagtttacctcctgttcctcgctcagatgacagcaagtgggctccacatcatccatagcttggacgaagtcaactttatccagaaccttgtgttttatatcgaggccgcttacaagaccgccgatttcggaatatgggaaagaggcgacaagaccaatcagggtattagcgagctgaatgcttcttcagtggggatggcaaaggccgctttagaagctctcgatgagcttgacttgttcggcgtaaagggtggcccacagtcagtgattcatgtgcttgccgacgaggttcagcactgccagtcaatccttaattccctgttgccacgagccagtacctcaaaagaagtcgatgcctctttgctgtcagtggtctcttttccagcttttgcagtagaagatagtcagcttgtagagctgacgaaacaggaaattatcaccaagctgcagggaagatacgggtgttgtcggtttctgcgagatggctacaaaaccccaaaagaggatcctaatagattatactacgagcccgcagaactgaagctattcgaaaacatcgaatgcgagtggcctttattttggacatatttcatattggacggtgtcttcagtgggaacgccgaacaggtgcaagagtacaaggaagccctggaggccgtgctcattaaggggaagaatggagtccccctgcttccagagctgtattcagtacccccggaccgggtagatgaagagtatcagaacccccatacagtagaccgtgtccctatggggaaactgcctcatatgtgggggcagtctttatacatcttaggtagtttgatggccgagggcttcctagccccaggcgaaatcgaccccctcaacaggaggttcagtacagtcccaaaaccagacgtggtggtacaggttagcatcctcgctgaaactgaagagattaaaacaatccttaaggacaaggggatctacgttgaaacaatcgctgaggtatatccaatccgggtgcaaccagctagaattctttcccatatctatagttccctagggtgtaataatcggatgaaactgagtggcaggccctacaggcacatgggtgtgctggggaccagcaagctttacgacatccgcaaaactatatttacctttacaccccagttcatcgatcagcagcaattttatctcgccctggacaacaagatgatcgtagaaatgcttaggactgatttgtcttacctctgcagcaggtggaggatgacaggccagcccaccattacattccctatcagtcacagtatgctagatgaggacggcacaagtctcaattcttctattctggcggctcttcgtaagatgcaggacggatacttcggcggtgctagggttcagacaggtaagctgtctgaattcttgacaacatcttgctgcacacacctgagctttatggatcctggccctgaagggaagctgtattctgaggactacgacgacaattatgactatctggaatctggaaattggatgaacgactacgattcgacaagtcacgcccggtgtggcgacgaagtggccagatatctagatcacctactggcacacacagctccccatccgaaattggcccctaccagccaaaagggcggtctggatcgcttccaggccgctgtgcaaaccacatgtgacctgatgagtctcgtaaccaaagccaaagagctacacgtacagaatgtccacatgtacctccccacaaagttattccaggcctctcggccaagctttaacctgttggactctccgcacccgcgccaagagaatcaggtcccctctgttcgggttgaaatccatctgcccagagatcagagcggagaggtggactttaaggccctggtgttgcaactgaaagaaacatccagtctgcaggagcaggctgacatcctgtacatgctatatactatgaagggaccagattggaacacagaattgtataatgagcggtcagcaacagtaagagaattgctaacggagttgtatggtaaggtaggcgagatccggcattggggcctcattcggtatatcagcggtattctgcgtaagaaggtagaggccttggatgaagcatgtacagacctcctaagccatcagaagcacctgacagtcggactgcccccagaaccaagggagaaaacaatctccgcaccattgccctacgaagccttgactcagcttatcgacgaggcctccgaaggtgacatgagtatcagcattctgacacaggaaattatggtctatctcgccatgtatatgaggacccagcccggcctctttgcagaaatgttccgcttgcgaatcgggcttattatccaagtcatggccaccgagctggctcacagccttagatgttccgcagaggaggccactgaaggccttatgaatctgtctccgtcggctatgaagaacttactgcatcatattctgagcgggaaagagttcggtgtagaaagatcagtccgaccgactgatagtaacgtctccccagccattagtatccatgagattggtgcagtcggggccaccaagactgagcgaacgggaattatgcagttgaaatctgagatcaaacaagtggagttcaggaggctatccatttctgcagagagccagtctaacggcggtcacccactaggcatcgacttaatgagtccttctttcatgtcaccgggtactagcatgacgcccagcagcggcagtttcccttccgcctacgatcagcaatcaagcaaggattccagacagggccagtggcagcgaagaagaaggctcgacggggccttgaatcgagtccccgtgggattctaccagaaggtctggaaggtcctacagaaatgccacggactctccgttgagggattcgtgctcccctcttcgaccactcgagaaatgacgcctggggagatcaagttttccgtccacgtcgagtcagtcttgaacagggtgccccagcccgaatataggcagctgcttgtcgaggcgattttggtgctcactatgctggcagacatagagatacactcaatcggcagcatcattgccgtggagaagatcgtgcacatcgctaacgacctgtttctgcaagaacagaagaccctcggcgctgatgacactatgctcgctaaagatccagcctccggaatatgtacactactttatgattctgctccttccggcagattcgggaccatgacatacttatcgaaagccgcggccacctacgtccaggagttcctaccccattccatctgcgccatgcagtag

SEQ ID NO: 128832 - DNA, 3672 bp, Artificial Sequence
  Description of Artificial Sequence: Synthetic coding sequence
atgcgttcccgcagtaactcaggagttcgcctggacgggtacgccagacttgttcagcagaccattctttgtcaccaaaaccccgtaaccggacttcttcccgcctcttatgaccaaaaggacgcctgggtgagggataatgtctactccattttagctgtgtgggggttagggctggcttaccgcaagaatgctgaccgcgatgaggataaggctaaagcctacgaactggagcaatcagtggtaaaactcatgaggggcctacttcattgtatgattcggcaggttgacaaggtcgagagttttaagtactcccagagcacaaaagatagtctgcatgctaagtacaacaccaagacatgtgcgacggtggtgggggacgatcagtggggccacctccagttagatgcgacttccgtgtatctgctgtttctcgcacagatgaccgcgtcaggtctgcacattattcactccctggacgaggtgaacttcattcaaaacctcgtgttctacatcgaggctgcctacaagacagcagattttggcatctgggagcgtggagataagaccaaccaggggatctcagagctgaacgccagctcagtgggaatggcaaaggccgctctggaggccctcgatgagctcgacctgtttggagtgaaggggggccctcagtctgtgatacatgtgcttgccgacgaagttcagcactgccagtccatcctgaacagtctccttcccagagcttctacgtccaaggaagtcgacgcctctctgctctcagtcgttagctttcccgctttcgctgtcgaagactctcagctggttgagctcacaaagcaggagatcatcaccaagctccagggacggtatgggtgttgccggttcctccgtgatggctacaagaccccaaaagaagatccaaatagactatactatgagcccgctgagctgaagctgttcgaaaacatcgagtgcgagtggcccttgttctggacatatttcatcctggatggagtgttttccggtaacgctgagcaggtacaggaatacaaggaagctttggaggcagtgctcattaaaggaaagaatggagtgcccttgctaccggagctttactccgtgcctccggaccgagtggacgaggaataccagaatcctcatacagtggaccgagtgcctatggggaaattgcctcatatgtggggtcaaagcctctacatactgggatcgctgatggccgaaggatttctggctcctggagagattgacccactgaatcgcaggttttcgacggtgcccaagcccgatgtcgtagtgcaagttagcatactggcggagacagaagagatcaaaacaatcctcaaagataaggggatctacgtggaaacaattgctgaggtgtatcccatcagggtacagcccgctagaatcttgagccatatttactcttctctggggtgtaacaacagaatgaaactgtctgggcgtccttaccggcacatgggggtactcgggacttcaaagctttacgacatcaggaaaactattttcactttcacccctcagttcatcgaccaacagcagttctatctggcactggacaataaaatgatcgtcgaaatgcttcgtactgatctctcctacctgtgtagtaggtggaggatgacggggcagccaacgatcacatttcccatcagccactccatgctggatgaggatggcacttccctgaactcctccatcctggctgcattgcgcaagatgcaggacggttatttcggcggagccagagtgcagaccggaaaactgagtgaattcctgactacatcatgttgtactcacctcagttttatggatcccgggcctgagggcaagctatatagcgaggattatgatgacaactatgactatctagagagcggcaattggatgaatgactatgattctacgtcccatgcccggtgtggagatgaagtcgcccgatatcttgatcacctgctggcccacacagctccccatcccaagctggcgcctacttctcagaaaggcggactggacagattccaggctgcagtgcaaaccacctgcgacctcatgtcactggtaaccaaagccaaagaactacacgtgcaaaatgtccacatgtacctacctaccaagctgttccaagcctctcggccgtctttcaaccttctggattcacctcatccaagacaggagaaccaggttccaagcgtgcgtgtcgaaatccatctcccacgggaccagagcggagaggtggatttcaaggccctcgttcttcaattgaaagagacgtcaagcctgcaggaacaagccgacatactgtatatgctgtacaccatgaagggccctgattggaacacggaactttacaacgaacgctcggccacggtgcgcgaactcttgacagagctgtatggaaaggtgggtgagatacgtcattggggcctgattcgatatatttctggtattctcagaaagaaagtggaggccctggatgaggcttgcaccgacctcctgtcccaccagaaacacctgacagtcgggctcccgccagagccaagggaaaagactatctcggcacctctgccttacgaggctctgacccagctgattgatgaggcttcggagggtgacatgtctatctcaattttgactcaggaaatcatggtctatctcgccatgtacatgaggacacagcccgggctgttcgccgagatgttccggctgcgcatcgggctaataatccaggtaatggctaccgaactggctcacagcctgcgctgtagtgccgaggaagcaaccgagggtttaatgaacttaagccctagcgcgatgaagaatcttttacatcatatcctgagcggaaaagaattcggcgtcgaacggtctgtccgcccaaccgactcaaacgtttcccctgctattagcatccacgagatcggggccgtgggagctacaaagacggagaggactggaattatgcagcttaagtctgagataaaacaggtggaattcaggagactctctatcagcgccgagtcccagagcccgggcacctcaatgaccccatccagcggttcctttccatccgcttatgaccagcagagttcaaaggactctagacagggccagtggcagcgtaggcggcgcctcgacggagcactgaatagagttcccgtgggtttctaccagaaggtgtggaaagtgctgcagaagtgccatggactctcagtggagggattcgttttgccaagctcaaccacacgcgaaatgacacccggcgagattaaatttagcgtccacgtggagagtgtgctgaatagagtgccgcagccagaatacagacaactcctggtcgaagccattcttgtcctgacaatgttggctgatattgagattcactctatcggatcaatcatagccgttgagaagattgtccacatcgccaatgatttgttccttcaggaacagaaaactcttggcgccgatgacaccatgctggccaaggatcccgctagcgggatttgcacgctcctctacgacagtgcgcctagcggtaggttcggcaccatgacttaccttagtaaggctgccgccacctatgtgcaagagtttctccctcactccatctgtgctatgcaatag

SEQ ID NO: 128833 - DNA, 3546 bp, Artificial Sequence
  Description of Artificial Sequence: Synthetic coding sequence
atgaggtcaagatctaactcaggagtccgcctcgacggctacgcgcggctggtgcagcagacaattctctgtcaccaaaatccagttactggtctactccctgccagctatgaccaaaaagacgcatgggtacgagacaatgtgtactcgattctcgctgtgtgggggctcgggttagcgtatagaaagaacgcagacagagatgaagacaaagccaaggcgtacgagcttgaacagagtgtggtgaagttgatgaggggcctccttcactgtatgattcgacaagtggacaaggtggagtcgtttaaatactcacaatccacaaaagatagcttgcatgccaagtacaacacgaagacttgcgctaccgtggtgggtgatgatcagtggggccatctgcagctggacgccaccagcgtttacctgctgtttttggctcagatgactgcatctgggctgcacatcattcactccctggacgaagtcaattttatacagaatcttgtcttctatattgaggcggcctataagactgctgactttggcatttgggagcggggggacaaaacgaatcaaggaatttctgaattgaacgcctcctccgtcgggatggccaaagctgccctcgaggccttggatgagctggacctgtttggtgtgaaagggggtccacaaagtgtcattcacgtgcttgccgatgaagtgcagcactgccagtcaattctcaactctttattaccgagagcatctaccagtaaggaggtcgacgccagccttttgagtgtggtgagctttcccgcatttgctgtggaggactctcagctcgtagagcttaccaaacaggagatcatcaccaaattacagggtaggtatggttgctgcaggttcctcagagacggctataaaacccccaaggaagatcccaatcgtctgtactatgaaccagccgagctgaagctgtttgagaatatagagtgcgagtggcctcttttttggacctattttatcctggatggcgtgttctctggaaatgcggaacaggttcaggaatacaaagaggctctcgaggccgtgctgattaaagggaaaaacggggtgcccctgttgcctgagttatacagcgtaccaccagatagggttgatgaagaatatcagaatcctcataccgtggaccgcgtcccgatgggtaaacttccccacatgtggggccaatccctgtatatcctgggcagtctgatggcggagggcttcctggctccgggcgaaattgatccgctaaaccggagattctcgacggtaccaaagccggacgtggtagtgcaagtcagcatcttagctgagaccgaagagattaagactatcctaaaagataagggtatttatgtcgagaccatagccgaggtctatcccatacgggttcagccagctaggatcctcagtcatatatacagtagtctgggctgtaacaataggatgaagctttccggtcggccatatcgccatatgggcgtattaggaactagtaaactctacgacattcgcaagacgatttttacttttacaccacaattcatcgatcaacaacagttttatttggccttagataataagatgatagtggagatgctgcgcaccgatctgtcatatctgtgctccaggtggagaatgaccgggcagcctacgatcacatttccaatcagccattcaatgctggatgaagatggaacaagcctcaattcttctatccttgcagccctcaggaaaatgcaagacgggtacttcggcggtgccagagtgcagaccggcaagctgtccgagttcttaacgacctcatgttgcactcacctaagcttcatggatcccgggcccgaaggaaagctttatagcgaggattacgacgataactacgattacctcgagagtggcaattggatgaatgattatgactcgacgagtcacgatgtacacatgtatctccccacaaagctgtttcaggcttcacgaccaagctttaacttactcgactctccacacccacggcaggaaaatcaggttccctctgtccgcgtcgaaatccacctaccgcgggatcagagcggggaagttgactttaaagcattggtcttgcagttgaaggagacatcctctttgcaggaacaagcggacatcctttatatgctttataccatgaaagggccagattggaacacagagctgtataatgaaagatctgcaactgtacgggaacttctgaccgagctctatgggaaggttggagaaatccggcactggggattgatccggtatattagcggaattctgcgtaagaaggtagaggcattggatgaagcctgcaccgacttgcttagtcaccagaagcatctgactgttggattgccgcccgagccacgcgaaaaaaccatctccgctcctctgccttatgaggccctgacacagctgattgatgaggcctccgagggtgacatgtccatatctatactcacacaggaaatcatggtgtatctagcgatgtacatgaggactcaacccgggttattcgcagagatgtttcgtctccgcatcgggttgatcatccaggtaatggccaccgaactcgcgcactcactccggtgcagcgctgaagaggctacagaaggattgatgaatctatctccttcagcaatgaaaaatctactccaccacatcctaagcggtaaggaattcggagtcgagaggtctgtgagacccactgactccaacgttagccctgccatttctatccacgagattggcgcagtgggggctactaagacagagcgaacgggcataatgcaactgaagagtgagatcaaacaggttgaatttcgaagactgtctattagtgcagagagccagtcaaacgggggccatcctttgggaattgatctgatgtcacctagctttatgagccccggtacaagtatgacacctagtagcgggagcttcccttctgcctacgaccagcagtcttcaaaggacagccggcagggccagtggcagaggagaaggcggctggacggagccttgaatagggtgcccgtgggcttctaccagaaagtttggaaggtgctgcaaaagtgccacgggctgagcgtcgaaggttttgtccttcctagttctacgacacgggaaatgaccccaggtgagatcaaattcagcgttcatgtggagagtgtgcttaatagggtccctcagcccgaatatcgccagcttctcgtggaagccattctcgtgctcacaatgctggcagacattgaaatccactccatcggaagcatcatcgccgtcgagaagatcgttcatatagcgaatgatctctttctacaggaacagaaaactctgggcgcggatgacaccatgctggccaaagaccctgcctcagggatctgtacgctgctgtatgactcagccccttctggccgttttgggaccatgacatacctgtctaaggctgccgctacatacgtacaggagtttctgcctcatagcatttgcgcaatgcagtag

SEQ ID NO: 128834 - DNA, 3456 bp, Artificial Sequence
  Description of Artificial Sequence: Synthetic coding sequence
atgcgctcccgatctaactctggtgtgcgcctggatggctatgcaagacttgtgcagcagacaattctttgccaccaaaatcccgtcaccggtctgctccccgcttcctatgatcaaaaagacgcctgggtgcgagataatgtctacagcatactggccgtctggggtctgggactcgcgtatcggaagaacgcagacagggacgaggacaaggccaaagcctatgaactcgaacagtccgtagtcaagctgatgcggggactgcttcactgtatgattaggcaggtagataaagttgagtcttttaaatacagccagagcacgaaagattccttgcacgccaaatacaacaccaagacctgcgctaccgtcgtgggagatgatcaatggggccatctgcaattagacgcaacctctgtctacctcctgttccttgcccagatgaccgcttcgggcttgcatatcatccactctctggatgaggtgaattttatccagaatctggtgttctacattgaggctgcctataaaactgcggatttcggcatatgggagagaggcgacaaaacaaatcagggtataagcgagcttaatgccagctctgttggaatggccaaggcggcgctggaggccctcgacgagctggacttgtttggggtcaagggcggccctcagagtgttatacacgtgctcgctgatgaggtgcagcattgccaaagcattctcaacagtctgctgcccagagcgagtacctctaaagaggtcgacgccagccttttaagcgtggtatcatttcctgcattcgcggtggaggatagtcagctggtagaacttaccaagcaggagatcataactaagttgcagggaagatacggatgctgccgcttcctcagggatggatataagacccctaaggaagatccaaacagactatactacgagcctgctgagctgaagttattcgagaacatcgagtgcgaatggccactcttctggacctatttcatcctggacggcgtgttcagtggtaacgcagaacaggtacaggaatataaggaggccttggaagcagtgctcatcaaggggaagaacggggtgcccttgctacccgagttgtacagcgtgcccccagatcgagttgacgaggaataccagaatccccacaccgtcgaccgcgttccgatggggaagctccctcacatgtggggccaatctctgtacatcttggggtcgctgatggccgagggtttcttagccccaggcgaaattgatccattgaaccggcggttctctacagtgcccaaaccagacgtcgtggttcaggttagcattctggccgaaacggaagagatcaagaccattttgaaggataagggcatctatgtggagactattgcggaggtctaccctattcgggtgcaaccagctcgaattttgtcgcacatctattctagcctaggctgtaacaacaggatgaaactgagcggtcgcccttatcgccatatgggagttctgggtacttctaaattatacgacatacggaaaacaatatttacattcacgccccagttcattgatcagcagcagttttatctcgcactcgataacaaaatgatcgttgagatgctgagaaccgaccttagctatctatgcagtcgctggcggatgacgggacagcctaccattactttccccattagccacagcatgctggatgaagatggtacatcactgaattcctcgattctcgccgcccttaggaagatgcaggatggttatttcggaggtgctcgcgttcagactgggaagttgtccgagtttctcacaacatcatgctgcactcatctctcctttatggatcccggacctgagggcaaactctacagtgaagattacgacgataactatgattatctagaatcgggaaactggatgaatgattacgactcgacttctcacgacgtccacatgtacctccctacaaagctgttccaagcgtcccggccatccttcaacctgctggattcaccccatccacgacaggaaaaccaggtgcctagtgtgcgcgtggagattcacctccccagggatcagagcggagaagtcgatttcaaagctctggttttgcagctgaaggagacttctagccttcaggaacaggctgatatcctgtacatgctgtacactatgaagggtcctgactggaataccgagctgtataacgagcgaagcgccacggtgcgcgagctgcttaccgagctatacgggaaggtgggagaaatccgacactggggcctgatccgatacattagcggcatcttgcggaaaaaagtggaagccctggacgaagcatgtacagacttgctgtcccatcagaagcacctcactgtaggactgccaccagagcccagggaaaagaccattagcgccccactgccttacgaagccttgacccagctcattgatgaagcttctgagggagatatgagcatctccattctcacacaggagattatggtttatctggccatgtacatgcgcacccagcccggattgtttgctgaaatgtttcggctgcgcataggattgatcatacaggtcatggcgaccgagctcgcccattcattacgttgcagcgcggaggaagcgacagagggccttatgaatctctctccatcagctatgaaaaatctgttgcaccatatactttccggcaaagagttcggagtagagcggagtgtcaggcctaccgattccaatgtgtcacctgccattagtattcatgagattggagcggttggggccacaaaaacagaaaggacagggatcatgcagttgaagtcagagataaagcaaagtcctggcaccagcatgacaccatcctctggctccttccctagcgcttacgaccaacagagctccaaagattctagacagggtcagtggcagcggcggcgcaggttggacggagcacttaacagagtgcctgtcggcttttaccaaaaggtgtggaaggttctgcagaagtgccacgggctctcagtagaaggatttgttctcccatcatcaaccacacgcgaaatgacccccggcgagataaaattcagcgtgcacgtggagagcgtgctgaaccgagtaccccagccagagtatcggcagctgcttgtcgaagccatcctcgttctgactatgttggcagacattgaaatacactccataggttccatcattgctgtggaaaagattgtccatattgcgaatgacttgtttttgcaggaacaaaagaccctgggtgctgatgataccatgttagccaaagatcctgcctccggcatctgtacgctcctttacgattctgcacccagcggccggttcgggacaatgacctacctgtcaaaggccgccgcaacttacgtccaagagtttttgccacactcgatctgtgcaatgcagtag

SEQ ID NO: 128835 - DNA, 1164 bp, Artificial Sequence
  Description of Artificial Sequence: Synthetic coding sequence
atgacacgggatgaggcccttcccgactctcattctgcacaggatttctatgagaattacgaacccaaagagatcttggggagaggggtgtccagtgtcgtgcgacgttgtattcataaaccaacttcccaggagtacgcagtcaaggtcatagatgtaaccggcgggggatcattcagccccgaagaggtgagggagttaagagaggccaccctcaaggaggttgatatactacggaaggtctccggacaccccaacattatccagctaaaggatacctatgagacaaacaccttcttcttcttggtgttcgatctgatgaaaagaggggaactgttcgattatctgacagaaaaggtgacgctatccgagaaagaaactaggaaaattatgcgcgccctcctcgaggtgatctgtactctgcacaagctcaatattgtgcatcgggacttgaagcctgagaatatcttgctcgacgacaacatgaacatcaagctgaccgacttcggattttcttgccagctggagcctggggagagactgcgtgaggtgtgcggaaccccctcatatctggctcctgagattatcgaatgctcaatgaacgaggatcatcccgggtacggaaaggaggtcgatatgtggtccacaggcgtcattatgtacacactcctcgccgggtctccacccttctggcaccgcaagcagatgctgatgttacgcatgatcatgagtggcaactatcaatttgggtctcctgagtgggacgactacagcgacactgttaaggatcttgtgtcacggttccttgtcgtccagccgcagaaccggtacacggctgaagaagccctcgcacatcccttttttcaacagtatctggttgaggaagtgcggcacttttctcctcgcggtaagtttaaggtgattgcactgacggtgctggcttcagttcggatctactatcagtatcgtagggtgaaaccagtgaccagagagatcgttatcagagatccgtacgccctgagaccactcagacgcttaattgacgcttacgcatttcgcatttacgggcactgggtcaaaaagggccagcaacaaaatagggccgcgttattcgagaatacgcccaaggcagtgctgctttccctggctgaggaagattattag

SEQ ID NO: 128836 - DNA, 1260 bp, Artificial Sequence
  Description of Artificial Sequence: Synthetic coding sequence
atgactcgtgacgaggccctaccagattctcactccgctcaagatttttatgagaactatgaacccaaagagatcctgggccggggtgtctcttccgtcgttcgtaggtgcatccacaaaccaacttcacaagaatacgccgtgaaggtcatagatgttaccggaggaggaagtttctcaccagaggaggttagagaattaagggaggctactttgaaggaggtggatatactacgaaaagtgtctggacaccccaatatcattcaactcaaggacacgtatgagaccaacacgttttttttcttagtctttgacttgtgggaggataccgataccatggagatggaacagaaatggtgtcttggatgggattctccaaagtcaacaaacttcagagcccaggggcgcgctcgaatgaagagaggggaactgttcgattatctgacagaaaaagttaccctctctgagaaggaaacaagaaaaatcatgagagcactgctggaagtcatttgcaccctgcacaagttgaatattgtgcatagagaccttaagccggaaaacatccttttggatgacaatatgaatataaaactgacggatttcggcttctcctgccagctggagccaggggaaaggctgcgggaagtatgtggaacaccttcttatctagctccagagatcattgaatgttccatgaatgaggatcatccagggtatggaaaggaagtagatatgtggtctacaggcgtgatcatgtatactctgttggctgggtccccccctttttggcatcgcaaacagatgttgatgttaagaatgatcatgtctgggaactaccaattcggatctccggaatgggacgactacagtgacaccgttaaagacctggttagtcgtttcctagtggtccagccccagaatcggtatacggcagaggaagccctggctcatccattctttcaacagtatttggtagaagaggtacgccacttcagcccaagaggaaaatttaaggtgattgctcttacagtgttggcctccgtacgtatctactatcagtaccgccgagttaaacccgtgaccagggaaatcgtgatccgcgacccttatgctctgaggcctctgcgccgcctcattgatgcttacgctttcaggatctacggtcactgggtaaaaaagggccagcagcagaaccgggccgcgctatttgagaacacacccaaagcggtcctgctgtccctggccgaggaggactattag

SEQ ID NO: 128837 - DNA, 1002 bp, Artificial Sequence
  Description of Artificial Sequence: Synthetic coding sequence
atgcatccacaggcacacgagccgggggtgcgacgggaagggcatcggcgtcatagatggcggcagttgcagcctggtggaggagctggcgctgctcgtagccacgctgagggcggcggacaccctgcccagggcctgcgcgcccctcagcatcagatgaaacgtggtgaactgttcgactatcttacagaaaaggtaaccctgagtgaaaaagaaacccggaagatcatgcgggctctgctggaagttatctgtacactccataaactcaacattgtgcaccgggacctgaagcctgagaacatactcttggatgataacatgaacattaagctaaccgactttggattttcctgccagcttgaaccgggggagagattacgggaagtctgcggcacgccatcgtacctagctccagagataattgaatgttcaatgaatgaagaccaccctggatacggcaaggaggtggatatgtggagcactggggttatcatgtacaccctgttggccggcagcccaccattctggcaccgcaaacagatgctgatgctccgcatgattatgtcaggcaactaccagtttggctctcctgaatgggacgactattccgataccgtcaaggacctcgtttcccggttcctagtggtgcagcctcaaaatcgctacaccgcggaagaggcgcttgcccatccattttttcaacagtatctcgtggaggaagttagacacttctcccctagaggcaagtttaaggtcatagctttaaccgtgttggcgtccgtgagaatttactaccagtatcggagggtcaaacccgtgaccagggagattgtcattagagatccatacgcactgcgccccctgagaaggcttattgacgcgtacgccttccggatttatggccactgggttaaaaaaggccagcagcagaatcgggcggcgctttttgagaacacacctaaggcagtgctgttgtcactggcggaggaagattattag

SEQ ID NO: 128838 - DNA, 2529 bp, Artificial Sequence
  Description of Artificial Sequence: Synthetic coding sequence
atgagccgcccactgagtgaccaagagaagcgtaagcaaatcagcgtacgaggtctggcaggcgttgaaaatgtaacggagctgaaaaagaactttaatcgacaccttcacttcaccctggtcaaggacaggaacgtcgccacaccccgagactactacttcgccctagcacacactgtgagagaccaccttgttggccgctggatccggacacagcaacattactacgagaaagaccctaagaggatatactacctgagcctggagttttatatgggccgcacattacagaacaccatggtgaacctcgctctggagaacgcctgtgacgaggccacttaccaactgggcctggacatggaggagttggaggagatcgaggaggatgctggcctgggaaacgggggcctgggacgactcgctgcttgcttcctggactctatggctactctagggctcgccgcctatggctacgggatcagatatgaatttggaattttcaatcagaagatctccggggggtggcaaatggaggaggctgacgactggctcaggtatgggaatccttgggagaaggccaggcctgaattcactctgcccgtgcatttctatgggcatgtcgaacacacgtcacagggagccaaatgggtcgatacccaagtggtgttagccatgccatatgatacacccgtccccgggtatcggaacaacgtagtgaatacaatgcggctgtggtcagcaaaagcgcccaacgattttaacctgaaggacttcaacgtcgggggctacatacaggccgtgctcgacagaaatctggccgagaatatatctcgggttctctatccaaatgacaacttcttcgaaggcaaagaattacgcctgaaacaggagtactttgtggtagccgcaactttgcaggacatcattcggcgattcaaatcctccaagtttgggtgtcgagatcccgttcgtacaaactttgacgcctttcccgataaagtggcaattcagttgaacgacactcatccctccctcgccatccccgaactcatgaggatattagtggatctggaaagaatggattgggacaaggcgtgggatgtgaccgtccggacttgcgcctacaccaaccacacagtgctgcctgaagctttagagcgctggcctgtgcatctgctggaaaccctgctgccccgccacctccagatcatttatgaaatcaatcagcgctttctgaatagagtggccgcagcatttccaggtgatgtcgatcggttacgacggatgagcctggtcgaggagggcgcagtgaaaaggatcaacatggcccacctatgcatcgcaggctctcacgcggtgaatggggtggcaaggatccattcggaaattttgaaaaaaaccatcttcaaagacttctatgagctggaaccgcacaagttccagaataagaccaatggcattacgccaagacggtggctggtgctgtgtaatcccggtctggcagaggtgatcgccgagcggatcggggaggatttcatcagtgatctcgaccagctcaggaaactcttgagctttgtagacgacgaagcctttatccgagatgtcgctaaggtgaaacaggagaataagctcaagttcgcggcatatcttgaaagggagtacaaggtgcacatcaatcccaactcgttgtttgatatacaagtgaagaggatccacgaatataaaaggcagctgctgaactgccttcacgtgattacactgtacaataggatcaaacgagaacctaacaagttctttgtcccccgcacagtgatgattggcggaaaggcagcccctggctatcacatggcaaagatgataataaggctcgtgacagcaatcggtgacgtggtgaaccatgatcctgccgtcggagatcggctgcgcgtcatctttctagagaattatcgggtctccctggccgaaaaagtcattcctgccgccgacctaagcgagcagatatccactgcggggactgaggccagtggcaccgggaacatgaaattcatgctcaacggagcactgacaatcgggaccatggatggtgcgaatgttgagatggccgaagaggcgggggaagaaaatttttttatctttggaatgcgggtagaggatgtagacaaactggatcaaagaggttacaacgcacaggagtactatgaccggattcctgaactcaggcaggtcattgagcagctttcatccggcttcttctcacctaagcagcctgacctgtttaaagacatagtaaatatgcttatgcaccatgacaggtttaaggtgtttgccgactacgaggactacattaaatgccaggagaaagtgtccgccttgtataagaaccccagagaatggactcgtatggtgatcagaaacatcgctacttccggcaaatttagtagcgaccgcacaattgcccagtatgctcgggagatctggggagtggagccctctcgtcagaggctacctgcgcctgacgaagccatctag

SEQ ID NO: 128839 - DNA, 2499 bp, Artificial Sequence
  Description of Artificial Sequence: Synthetic coding sequence
atgtctcggccactctcggatcaggagaagagaaaacagatttctgtccgggggctggcgggggtcgaaaacgtcaccgagcttaaaaagaacttcaacagacacctgcatttcacacttgtgaaggatagaaatgtggctactccaagagactactacttcgcgctggctcacaccgtaagggaccacctggtgggacgatggataagaactcagcagcattattatgaaaaagatccaaaaagaatttactaccttagcctcgagttttatatgggacggactttgcaaaatacaatggtaaacctggctctggaaaacgcctgtgacgaggccacctaccaggttgggttaggcagattagctgcctgtttcctggactctatggctactctcggcttagccgcctatgggtatgggatccggtacgaattcggcatcttcaaccaaaaaataagtggagggtggcagatggaggaggccgacgattggctccgatacggcaacccctgggaaaaggccagacccgaattcacactgcctgtacatttttatggacatgtggaacacacgtcacagggggcaaagtgggtggacacacaggtcgtcctcgcaatgccatatgacactcctgtgcccggctacaggaacaacgtggtgaataccatgagactgtggtcagcaaaggcccctaatgacttcaacttgaaagacttcaacgttggcggttacatccaggctgtcctcgaccgtaatttagctgagaacatatctcgtgtgctctacccaaacgacaacttttttgaaggcaaggaactcaggcttaaacaggagtactttgtggttgccgccacccttcaagacataatcagaaggttcaagagtagcaagtttggttgtagagacccagtgagaaccaatttcgatgcattcccagataaagtggcgattcaactgaatgacactcacccttctctcgcaatacccgaattaatgcgtattttggtggatctcgaacgcatggactgggataaagcttgggacgtgacagtaaggacatgcgcctacacaaatcacactgttttaccagaagctttggagcgctggcccgtgcacctgctggaaactctgctacccagacaccttcagatcatttatgaaattaaccagcgattcctgaatagagtagccgccgctttccccggggacgttgatcgtttaaggaggatgtccttagtggaggaaggggctgtgaaacgaattaacatggcccatctctgcattgcagggtcccacgcagtcaatggagtggccaggatccattccgagatcttaaagaagaccatatttaaagacttctatgagctggaaccccataagtttcaaaataagacgaatggcataacaccgcggcgttggctcgtcctctgcaatccaggtctcgccgaggtgatcgccgaacgtatcggcgaagattttataagcgacctcgatcagctcaggaagctgctgagctttgtcgacgatgaagctttcattcgagacgtggcgaaggtgaaacaggaaaataaactgaaatttgccgcctacctggagcgagaatacaaggtccacatcaatccaaacagtttgtttgacattcaggtgaagcggatacacgaatacaaacgtcagttgctgaactgtctgcatgttataacactgtacaatagaattaaaagggagccaaataaattctttgtgcccaggacggttatgattggagggaaggccgcacccgggtatcacatggccaaaatgataattcgactggtgactgctattggtgatgtggttaaccatgatccagcagttggcgatagactgcgggtgatattcctggaaaactacagagtgtcgctcgcagagaaggtgatccccgcagccgacctctcagagcagatctccaccgccggaaccgaagccagtggcaccgggaacatgaagttcatgctcaatggcgctctcactatcggcactatggacggggcaaacgtggagatggcagaagaagcaggcgaagagaattttttcatcttcggaatgcgggttgaggacgtggacaaactggaccagagagggtataacgcccaggaatactacgaccggattcctgagctgcggcaagtgatagaacaactaagtagtggtttcttctcccccaagcagccagatctcttcaaggatatagtgaatatgctgatgcaccacgaccgctttaaggtcttcgctgactatgaggattacatcaaatgccaagaaaaggtctcagcgctttataagaatcctcgggagtggacaaggatggtgattagaaatatcgcaacctcagggaagttttcctccgaccgaaccatcgctcagtacgccagggaaatttggggagttgagccatcccggcagcgattacccgcccccgctccccacgcagagggcggagtgttagagctcgacctttag

SEQ ID NO: 128840 - DNA, 1425 bp, Artificial Sequence
  Description of Artificial Sequence: Synthetic coding sequence
atggctaccaactggggaagtttactgcaggataagcaacaactcgaggaactcgctagacaggcagtggatagagccctggccgagggagtgctgctccggacgtcccaagagccaacttcatcagaggtcgtgtcttacgctccgttcacgctgtttccttccctggtcccctcggccttgctggaacaagcttacgcggtgcagatggactttaacctccttgtggatgccgtgtctcaaaatgctgctttcctggagcaaactttgagtagcacaattaaacaggacgatttcaccgctagactttttgatatccataagcaggtgctaaaagagggaatcgcccagactgtattcctgggcttaaatcgaagcgattatatgttccagaggtccgctgacgggagtcccgctcttaagcagatagaaatcaacaccatcagcgctagttttgggggtctggcatcgagaacccccgctgtacacagacacgtgctctctgtgctcagcaagacaaaagaagccggtaagattttgagtaacaatccttctaagggtctcgctctggggatcgcgaaggcttgggagctttacggatcccccaacgccctggtcctcttgatcgctcaggagaaggagcgcaatattttcgatcagcgagcgatcgagaacgagctgctagcccgcaacattcacgtcattaggcgcacattcgaagacatctccgagaagggatccctggatcaggacaggcgcctctttgttgatggccaggagatcgccgtcgtctacttcagagacggttatatgcctcgccagtacagcttacagaactgggaggcccgcttactccttgagaggagtcatgcagcgaaatgcccggacatcgcaacgcaacttgctggaacgaagaaggttcagcaggaactgagtagaccgggtatgttggagatgctcctcccaggccagcctgaggctgtggccagactcagggctaccttcgctggcctgtacagtttggatgtgggcgaggagggcgatcaggcaatcgctgaagcattggccgccccatccagatttgtgttgaaacctcagagagaaggagggggtaacaatctatatggggaggagatggtgcaggcacttaaacagctgaaggactccgaagagagagctagctatatactgatggaaaaaatcgaacctgaaccttttgaaaactgcctgctacggcccggatcgcccgctcgcgttgtgcaatgtatctcggaactgggcatcttcggcgtttatgtaagacaggagaagactttggtcatgaataaacatgtggggcacttactgcggaccaaagctatcgaacatgcagatggaggcgtagcagccggcgtcgccgttttggataacccctacccagtctag

SEQ ID NO: 128841 - DNA, 738 bp, Artificial Sequence
  Description of Artificial Sequence: Synthetic coding sequence
taaaagcaccaccatacagtgccccccagcgtcactcctaaagctctcgatcgcagcccaccctgtccggagatgttcactcgcgccgctcctggttaccacatggctaaactgatcattaaactcgtgaccagcattggggatgtcgttaaccatgatccagttgtcggggacaggctgaaagtcattttcctggaaaattatagggtgtccttagctgaaaaagtcataccggcggccgatctgtcccagcagatttcaacagccgggaccgaggcgtctggaacaggaaatatgaaatttatgcttaatggcgccctgacaattggaaccatggacggcgcaaatgttgaaatggctgaagaagccggagctgagaatctctttatttttggattgcgcgtggaagacgtggaggcgttagatcggaaggggtataatgcacgtgagtactatgaccatcttcccgagctgaagcaggctgtagatcagatctcatccggatttttctccccgaaggagcccgattgtttcaaagatattgtcaatatgctgatgcaccatgaccgttttaaggtctttgccgattacgaggcatacatgcagtgccaggcacaagtggaccaactctacaggaaccccaaggagtggacaaaaaaggtgatccgcaacatcgcctgttccggaaagttttctagtgaccgcaccatcacagagtatgcacgcgaaatttggtag

SEQ ID NO: 128842 - DNA, 975 bp, Artificial Sequence
  Description of Artificial Sequence: Synthetic coding sequence
atggatgctcctcggcaggtggtcaactttggcccaggccctgccaagcttcctcattctgtcctgctggagatccagaaagagctcctggattacaaaggcgtcggcatttccgtcctggagatgagtcacaggtcctccgatttcgctaagattataaataacaccgagaatttagtgagagagttactggccgtgcccgacaactataaggtcatttttctccaggggggggggtgcgggcaattttccgccgtgccgcttaacctgattgggctgaaggccgggcggtgtgccgattatgtggtgaccggtgcttggagtgcgaaggcagctgaagaagccaaaaagttcggaactattaatatcgtccacccaaaattgggaagctacacaaaaatccccgatccttcgacttggaatcttaatcccgacgcctcctacgtttactactgcgccaatgagacagtgcatggagttgaatttgactttattcctgacgtgaaaggggctgtcctcgtctgcgatatgagcagcaacttcctgtccaaacctgtggatgtgtctaaatttggtgttatctttgctggggctcagaaaaatgtggggtccgctggcgtaaccgtggtgattgtgcgggacgacttgctcggcttcgcgctgcgcgaatgtccctcagtgctcgagtacaaagtccaggcaggtaattccagtctgtataacacccccccctgcttcagtatttatgtgatgggacttgtgctggaatggatcaagaacaacggcggagcggccgccatggagaagctgtcgagcatcaagagccaaactatttatgagatcatcgacaatagtcaggggttctacgtgtcggtaggcggcattcgggcctctttgtacaacgcagtcaccatagaagatgtacagaaactcgccgcattcatgaaaaagttcctagagatgcaccagttatag

SEQ ID NO: 128843 - DNA, 1113 bp, Artificial Sequence
  Description of Artificial Sequence: Synthetic coding sequence
atggatgctccaagacaggttgttaattttggccccgggcctgccaagctgcctcacagcgtcctgcttgagatacagaaagaactgttggattataaaggagtcggaattagcgtgcttgaaatgagccatcgctcttcagactttgccaaaatcatcaataataccgagaatttagtcagagagctgttggctgttcctgataattacaaggttatcttcctgcagggcggaggatgcggccagttctctgcagtccccctcaacctgattggactcaaggccggacggtgtgccgattacgtcgtgacgggggcttggtccgcgaaagccgccgaggaagctaagaagtttgggaccatcaacatcgtgcaccctaagctggggagctacactaaaattccagaccctagcacctggaatctcaatcctgacgcatcttacgtttattactgcgccaacgagaccgtgcatggcgtggaattcgattttataccggatgtgaagggagctgtgctggtctgtgatatgtcctctaacttcctctctaaaccagtggacgtatctaagttcggggtcattttcgccggtgcccagaagaacgtggggagtgcaggggtgaccgtggtgattgtgcgggatgacctgttggggttcgccctgagagaatgtccttccgttttagagtacaaggtgcaggccggaaactcatctctctataataccccgccctgcttttcaatctatgtcatgggacttgtactggaatggattaaaaacaacggaggggccgcagccatggaaaagttgtcaagcattaaatctcagaccatctacgaaattatcgacaatagtcagggattttatgtatgtcctgtggaaccacaaaatagaagcaaaatgaatatacccttccggattgggaatgcaaagggcgacgatgctctggagaagaggttcctggacaaggcccttgagctcaatatgttatccctgaaaggccatcggagcgtcggcggaatccgagccagcctatataacgcagtcactatcgaggacgttcaaaagcttgctgcttttatgaagaaatttttagaaatgcaccaactgtag

SEQ ID NO: 128844 - DNA, 585 bp, Artificial Sequence
  Description of Artificial Sequence: Synthetic coding sequence
atgtcctcaaacttccttagtaagccagtggacgtttctaagttcggggttatctttgcaggcgcacagaagaacgtgggctcagccggggtaaccgtggtgatagttagggatgatctgctgggatttgcacttagggagtgtcctagcgtcttggagtacaaggtccaggcaggcaatagtagtctatataatacacctccatgcttctcaatttacgtgatgggactggtcctcgaatggatcaagaataacggtggcgcggctgctatggagaagctctcctcaatcaagtcacagacaatctatgagatcattgacaactcacagggcttctatgtctgcccagtggagccccaaaaccgcagtaaaatgaacatccccttccgaatcgggaatgctaagggagacgacgctctggaaaagaggttccttgataaggctctggagctcaatatgctgtcactaaagggacatcgttcggtaggagggatccgtgcgtccctgtacaacgctgtgactatcgaggacgtgcagaaattggctgccttcatgaagaagttcctcgaaatgcatcagctttag

SEQ ID NO: 128845 - DNA, 1050 bp, Artificial Sequence
  Description of Artificial Sequence: Synthetic coding sequence
atgtcttctctttctggcaaagtccaaacagtcctgggattggtggaaccttccaagctaggtagaacacttacccacgagcacttagcgatgactttcgattgctgctattgtccccctcccccctgtcaggaggcaatcagtaaggagcctatcgtgatgaagaatttgtattggattcagaagaacgcatatagtcataaggaaaatctgcaactgaaccaagagactgaggcaattaaggaggagctgttgtattttaaagcaaacggaggcggcgcgctagtcgaaaacacaactactggcattagcagggacacccaaaccctgaaaagactggcagaggagactggagtgcatataatcagcggggccgggttttatgtggatgccacccatagtagcgagaccagggcaatgtctgtggagcagttgaccgatgtgctgatgaacgaaatattgcacggagcagacggcacatcaatcaaatgtggaattattggtgaaatcggatgttcatggcccctgactgaatctgagcgaaaggttcttcaggccacagcccacgcgcaagcgcagctggggtgtccggtcataatacatcccggtaggagctcccgtgcccccttccagatcattcgaattctgcaggaggccggcgcagacatctccaaaactgtgatgtcccaccttgatagaactatcctggacaagaaggaattactcgagtttgcacagctcggatgttatctggagtacgaccttttcgggacggagctgctgcactatcagctcggaccagacatcgacatgccagacgacaacaagaggatcaggagggtcagactgctggttgaggaggggtgtgaggatcgtatcttagtggctcacgatatccacacaaagactcgactgatgaaatatggtggacacggttattcgcacatcctaactaatgtcgtccccaaaatgctccttcggggcatcacagagaacgtcctggataagatactgatcgaaaatcctaagcagtggctcacgttcaagtag

SEQ ID NO: 128846 - DNA, 1050 bp, Artificial Sequence
  Description of Artificial Sequence: Synthetic coding sequence
atgtccagcctgtccgggaaagtccagactgtcctgggacttgtggaacccagcaagctagggcgaactctcacacatgagcacctggccatgactttcgactgttgttattgtcccccacctccgtgccaggaggccatctccaaggaaccaatcgtgatgaagaacctgtactggattcaaaaaaacgcttattcacataaggagaaccttcagctgaatcaagagacggaggcgatcaaggaagagcttctatacttcaaagccaacggcggtggcgcactggttgagaataccactaccggaatcagcagagacacacagaccctcaagcgtcttgctgaggaaaccggcgttcacatcatctccggcgccggtttttatgtggacgcaacacatagctcagagacaagggcaatgtcagtagagcagctgacggacgtccttatgaacgaaattctgcacggcgccgacggaacttctattaagtgtggtataatcggagagattgggtgcagctggcccttaaccgagtccgaacgtaaagtcctccaggctactgcccatgcccaggcccagctggggtgccccgtgatcatacacccaggacggtcatcccgagcccctttccagattatcagaatcttacaggaggccggcgccgacatctcaaagaccgtcatgagtcacctagaccggacaatcctagataagaaagaactccttgaatttgcgcagctaggatgctatcttgagtatgatctgtttgggaccgagttactgcattaccagctgggcccagatattgacatgcctgacgataataagagaataaggagggtgcgtcttctcgtcgaggaaggttgtgaggataggattttggtggcacatgatatccataccaaaacgaggctgatgaaatatgggggacacggctactctcatattttaactaatgtggtccctaagatgctcttgagaggtattacagagaatgtgttggacaaaatactgattgaaaacccaaaacagtggctgaccttcaagtag

SEQ ID NO: 128847 - DNA, 1050 bp, Artificial Sequence
  Description of Artificial Sequence: Synthetic coding sequence
atgagttccctttcagggaaagttcagacagtgctcgggttagtggagccgtctaagctcgggcgcacgctgactcacgagcacctggccatgactttcgactgctgttactgtccaccccccccctgccaagaagccatcagcaaggaacctatagtgatgaaaaatctttattggatccaaaagaatgcttattcacataaggagaacttgcagctcaaccaggagaccgaagccatcaaagaagagttactgtatttcaaagccaacggtgggggggcacttgtggagaataccacgacaggcatctcacgagatacccagacattgaagaggttggccgaggaaacaggcgttcacataatctccggcgccggcttctacgttgatgccactcattcttctgagacacgggcgatgtcagttgaacagctcaccgatgtgcttatgaacgagattttgcatggcgccgacggtacttccattaagtgcgggattatcggagaaatcggctgcagttggcctctaacagagtccgagcgtaaggtcctgcaggctactgcacatgcacaggctcagcttggctgcccagtcattatccaccctggccggagctcacgagccccctttcaaattattcgaattctgcaggaggcaggagcagatatcagcaagacagtaatgtctcatttggacagaaccatactggataagaaagaattgctagaattcgcccagctggggtgctaccttgagtacgacctgttcgggacagagttactccattaccagctgggtccagacatcgacatgcccgatgacaataaacggattaggagagtgcgactactggttgaggaggggtgtgaagatagaattctggtggcccacgatatccataccaaaacaagactaatgaaatatggaggtcacgggtactctcatatcctgacaaatgtagtccctaaaatgctgctgaggggtattacagaaaacgtcctggacaagatcctgatcgagaatcctaagcagtggctcacattcaaatag

SEQ ID NO: 128848 - DNA, 909 bp, Artificial Sequence
  Description of Artificial Sequence: Synthetic coding sequence
atgagctccctgtccggtaaggtgcagaccgttctaggactggttgaaccttctaagctgggccgaactctcacccacgagcatctcgcgatgacattcgactgctgttattgtcctccaccaccatgtcaggaagccatctccaaagagcccatcgtgatgaaaaatttgtactggattcagaaaaacgcctattcgcacaaagagaatttacagctgaaccaggagaccgaggcaattaaggaggagcttctgtatttcaaggccaatggcgggggcgcgcttgtggagaacactactaccggaatatcaagagacacccagactctcaagaggctggctgaggaaactggagtccatattatttctggtgcagggttttacgtagacgctacccattctagtgagaccagggccatgagcgtcgagcagttaacagatgtcctgatgaatgaaattctgcacggcgcggatggcacgtccatcaagtgcgggattatcggagaaattggatgctcctggcccctgacagagtctgaacggaaagtgctccaggcaacagcccatgcacaggctcaacttgggtgcccagtgatcatccatccaggtagaagctctagggcccccttccagattatccgcatcttgcaggaggccggcgccgacatctccaagactgtcatgtcacatcttgacagagtgcgcttgcttgtagaagagggctgtgaggaccggatactcgtggcccacgacatacacactaaaacccgactaatgaaatacgggggccacgggtacagccatattttgaccaacgttgtgccaaaaatgctgttgaggggtatcaccgaaaacgtgctggacaagatactaattgagaatccaaagcagtggctaactttcaagtag

SEQ ID NO: 128849 - DNA, 1050 bp, Artificial Sequence
  Description of Artificial Sequence: Synthetic coding sequence
atgtcctctctgagcggaaaggttcagaccgtcctgggattggtggagccttccaagttgggccggaccctgactcacgagcacctggcgatgaccttcgattgttgctattgtcctccccccccctgccaggaagctatttcaaaggagcccattgtgatgaagaatctgtactggatccagaaaaatgcctattctcacaaggagaacctgcaattaaaccaagaaaccgaagcgataaaggaagagcttctgtactttaaagcaaacgggggtggagctctagtagagaacactaccacaggaatttctcgcgatactcagacgctcaagaggttggccgaagaaacaggagttcacatcattagcggtgctggcttctatgtggacgcaactcattcctctgagacccgggctatgtctgtagagcaactcacagacgtgctcatgaatgagatacttcatggggcagacggcacatccattaagtgcggcatcattggcgaaatcggctgtagttggcccctgacagaatcggagcgcaaggtactgcaggcaacagcacatgcccaggcgcaacttgggtgccccgttatcatccatcccggtaggagctcccgcgcaccgttccaaattatcaggatattgcaggaggctggtgccgatatctcaaagactgtaatgtcacaccttgatcggactatcctggacaagaaggaactgttggaattcgctcagttggggtgttacctcgaatacgaccttttcgggacggagctgcttcattatcagctgggcccagacatcgacatgcccgacgataacaaacgcataaggcgtgttaggctgctggtggaggaagggtgtgaagatcggatcctcgtggcccatgacattcacactaagacaaggcttatgaagtacggcggacacggatattcacacatcctaacaaacgtcgtcccaaaaatgttactccgcggaataaccgagaatgtcctggataagatcttgattgagaatcccaagcagtggttaaccttcaagtag

SEQ ID NO: 128850 - DNA, 753 bp, Artificial Sequence
  Description of Artificial Sequence: Synthetic coding sequence
atgttctcactcccattgtctctccccctatgcgaggacaccgcattcttgccgagtaagtgttgcagctcccacaaaaccatcaaacaagcccgcacactcatcatgatctttctcgcttctggtacacacttccagacaatgctgaagtctaagctcaatgtgcttacgctgaaaaaggaaccattgccagcagtgatattccacgaacctgaggcgatcgaactctgcacaaccacccctctcatgaaaaccagaacccactccgggtgcaaagtgacatatcttggcaaagtttctaccactggcatgcaattcttgtctggttgcactgaaaaacctgtgatcgaactctggaaaaaacacaccctggccagagaggatgtcttccccgccaatgcccttctggaaattagacctttccaagtgtggctccaccacctggaccacaaaggtgaagctaccgtgcatatggacacatttcaagtggcgaggatcgcatattgcaccgcagaccataacgtatcccccaacatcttcgcctgggtgtatcgagagatcaacgacgatctgtcttaccagatggattgccatgccgtcgagtgtgaaagcaagcttgaggccaagaaactggcacatgccatgatggaagcgtttaggaagacctttcacagtatgaaatcggacggaagaattcattctaactcaagctctgaggaagtgtcccaggaattggaatcagacgacggctag

SEQ ID NO: 128851 - DNA, 747 bp, Artificial Sequence
  Description of Artificial Sequence: Synthetic coding sequence
atgccaagaatagcaggtaaccacctcatgctagaagaaagccgaacatgttcctcacccgagctccttgatggtgtttggccttgtcagcccctacattttggactccccgcgtccgagatgcactttcaaactatgctcaagagcaagttaaacgtgttaaccctgaagaaagaacccctaccggccgtcatctttcacgaaccagaggctatcgagctgtgcaccactacccctctgatgaaaactagaacacactctggctgtaaggttacttacctgggtaaagtgtcgaccacagggatgcagtttctgtcaggatgcaccgaaaagccagtgattgagctatggaagaaacacacgttagctagagaggatgtgtttccggcgaatgccctgcttgaaattcggccctttcaagtatggctgcaccatctggatcataagggcgaagctaccgtccacatggacactttccaagtggcccgcatcgcatactgcaccgctgatcacaatgtgtcccctaacatctttgcctgggtgtaccgcgaaataaacgatgacctgagctaccagatggattgccacgccgtggagtgtgaatctaagttggaagccaaaaagctggctcatgctatgatggaggcctttcgcaagactttccattcaatgaaatctgacgggcgcatacatagcaactcctctagcgaggaggtgagtcaggagcttgagtctgatgacggctag

SEQ ID NO: 128852 - DNA, 654 bp, Artificial Sequence
  Description of Artificial Sequence: Synthetic coding sequence
atgtggcagcctgcaaccgagagattgcagcacttccagacaatgttaaagtctaagttgaacgtgctcaccctcaaaaaggaacccctgcccgctgtaatctttcacgagccagaggcaattgagctgtgcacgacgacaccactgatgaaaacgcgtacccactccggctgtaaggtgacttatctagggaaggtgtccaccaccgggatgcagttcttaagcggatgcacagaaaaacccgtgatagagctgtggaaaaaacacactctggctagagaagacgtgtttccagcgaacgccctgctggaaatccgcccattccaggtatggctgcaccacttagatcataagggagaggcaacagtgcacatggacacattccaggtggcacgtattgcctactgcacggctgaccacaatgtgagtcccaatatcttcgcctgggtctatagagagatcaatgacgatctttcgtatcagatggattgtcatgctgtcgaatgtgaatcgaagttagaagccaagaagcttgcccatgcgatgatggaggcttttcgcaaaacttttcattcgatgaaatccgacgggcgaatccactcaaactccagttctgaggaggtgagtcaggaattggaaagcgatgacggttag

SEQ ID NO: 128853 - DNA, 507 bp, Artificial Sequence
  Description of Artificial Sequence: Synthetic coding sequence
atgtggcagccagcgacagagcgcttgcaggtgacttacctcgggaaagtgagcacaaccgggatgcagttcctgtccggttgcactgaaaagcccgtcattgagctgtggaaaaagcacactttggcccgcgaggatgtctttcctgctaacgcccttcttgagattagaccgtttcaggtctggctgcatcatcttgaccacaagggagaagccaccgtgcatatggatacgttccaggtcgctagaatagcgtattgtactgccgaccataacgtcagccctaatatcttcgcctgggtctaccgcgaaattaatgacgacttaagttaccaaatggattgccatgcagtggaatgtgaatccaaactggaagccaagaaactcgcccacgctatgatggaggccttcaggaaaaccttccactcaatgaagtcagatgggaggatccacagcaattcctcctccgaagaggtttctcaagagctagaaagcgacgatggctag

SEQ ID NO: 128854 - DNA, 753 bp, Artificial Sequence
  Description of Artificial Sequence: Synthetic coding sequence
atgttctcactaccactgagcttgccgttgtgcgaagacactgcattcctgcccagtaagtgttgttcgagtcacaagacgatcaagcaggcccggaccctcatcatgattttcctcgcttccggcacacacttccagactatgcttaaaagtaagcttaacgtattgacactgaaaaaggagccactgcccgcggtcatcttccacgaacccgaggccatagaactgtgcaccacaacacctcttatgaagaccaggacacattccgggtgcaaggtcacttacttaggcaaggtgtcaaccacagggatgcagtttctgtcaggttgcaccgagaagcccgttatcgagttgtggaaaaagcatacgttggcacgagaggatgtgttccccgcaaatgcactccttgagatacgtccctttcaggtctggctccaccatttggaccacaagggcgaagccacggtccacatggatacctttcaggtcgccaggatcgcctattgtactgccgaccacaacgtgagcccaaacatcttcgcgtgggtgtacagagaaattaacgacgaccttagttaccagatggattgccatgctgtggagtgtgagtccaagctcgaagcaaaaaaactggcacatgcaatgatggaggccttccggaaaacctttcatagtatgaagtccgatgggcgaatacactcaaactctagtagtgaagaggtttctcaggagctcgagagcgacgacggctag

SEQ ID NO: 128855 - DNA, 1017 bp, Artificial Sequence
  Description of Artificial Sequence: Synthetic coding sequence
atggagcagcttagagccgcagcgcgcctccaaattgtgctgggccatctgggcagaccatccgccggcgcggtggttgcgcacccaacaagtggtaccatttcatctgccagctttcacccccagcagttccaatacaccctggataataatgtcctcacactggagcagaggaagttctacgaagagaacgggttcctagtgattaagaatctggtgccggacgctgacattcaacgcttccgtaacgagttcgaaaagatttgccgtaaggaggtcaaacccttgggactgaccgtgatgagagacgtaactatttcaaaatcagaatatgcgccaagtgaaaaaatgattaccaaggtgcaggattttcaagaggataaggaactgtttaggtattgcacgctgccggagattctgaaatatgtagagtgcttcacagggccgaacatcatggcgatgcatactatgctcataaataagcctcctgacagcgggaaaaaaacctcccgccaccccctgcaccaggatcttcattattttccattcaggcccagcgacctgatcgtttgcgcctggaccgccatggagcacatttcccggaataatggatgtctggttgtcctgcccgggacgcacaaggggtcactaaaaccccatgattatcccaagtgggaaggtggagtgaacaaaatgtttcatggcatccaggattatgaagagaataaggcaagagtgcatctggtgatggagaaaggagatactgtgttttttcatcctctgctaatacacgggtcaggccaaaataagacacaggggttccgaaaggcaatctcctgccacttcgcaagcgccgactgccactatattgacgttaaaggcacttcccaagaaaatatcgaaaaggaagttgtcggtatagcccacaaatttttcggcgccgaaaactccgtcaatctgaaggatatttggatgttcagggcacggcttgttaagggagagcgaactaatctgtag

SEQ ID NO: 128856 - DNA, 717 bp, Artificial Sequence
  Description of Artificial Sequence: Synthetic coding sequence
atgcgggatgtcaccatatcaaagtccgaatatgctccctccgagaagatgattactaaagtgcaggacttccaagaagacaaagagctgtttcgatattgtaccctgcccgaaatcctgaagtatgtggagtgcttcacgggacctaacatcatggccatgcacaccatgctgataaataagcctccagacagcggtaaaaaaacttcccgccatcctttacaccaggatctgcactactttccctttaggcccagcgacctcattgtgtgtgcctggaccgctatggaacacatttctaggaataatggctgcctggtagttcttcctggcacgcacaaaggcagtctgaagccacacgactaccctaagtgggagggcggggtgaataagatgttccacggcattcaggactatgaggagaacaaagctcgggtgcatcttgtgatggaaaagggcgacaccgtgttttttcatccactgctcattcatggaagcgggcagaacaagacccagggcttccgcaaggctatttcctgtcactttgcctcggctgattgtcattacattgatgttaagggtacaagccaggaaaacatagagaaggaggtggtggggatcgcccacaagttctttggagcggagaactccgttaatttgaaagacatttggatgttccgggcacgcttggtcaaaggagaacgcaccaatctgtag

SEQ ID NO: 128857 - DNA, 15429 bp, Artificial Sequence
  Description of Artificial Sequence: Synthetic coding sequence
atggggaatgaagctagcctggaaggggagggcctgccagaaggactagctgcagcagctgctgctggcgggggggcctccggagcaggttccccatcccacacggcaatcccagcaggcatggaggcagatctttcccaattgtctgaagaagagagaaggcagatcgcagccgtgatgagtcgcgctcaaggtctgcctaaaggatcggttccacctgcggccgccgagtctccgtcaatgcacagaaagcaggaactcgactcatctcacccaccaaagcagtcgggccggccacccgatcccggccggccagctcagcctgggctgtccaaaagtaggacaacagataccttccggtccgagcagaagctccccggtcggagcccttctaccattagcctgaaagagtcaaagtcaagaactgatctcaaggaggagcacaagtctagtatgatgccaggcttcctctcagaggtaaatgctctaagtgcagtaagctctgtcgtgaacaaatttaatccatttgatctgatctctgacagtgaagcgagccaggaagaaactactaaaaaacagaaggtagttcagaaggagcagggcaaaccggagggcataattaaaccccccttacagcagcaacccccaaagcccattcctaagcagcagggtcctggcagggacccgctgcagcaagacggcacacctaagtcaatcagttctcagcaaccagagaagattaaatctcaaccgcctggcaccggcaagccaatccaggggccaacacagacccctcagacagaccatgctaagctgcccctgcagagggatgcctcacgtccccaaacaaagcaagccgatattgttcgcggggagagtgttaagcctagcctgccatctccaagcaagccgcccatacagcaacctacccccggtaaaccccctgcgcagcagccgggccatgaaaaatcccagcctggcccggccaagccaccagcacaacccagtggcttaactaaacctctcgcgcaacagccaggaacggtgaagccccccgttcagccacctggcactacaaagccacccgcccagcctctgggaccagctaaacccccagcacagcagaccgggtccgagaagcccagctccgaacagcccggacctaaggctttggcacaacccccaggcgtcggcaagactcccgcccagcagccaggacccgctaagccccccacccagcaagtcggcacacccaagcccctagcccagcagcctggactgcagagtcccgccaaggcccccggcccaaccaagacacccgtgcagcaacccgggcctggcaaaattccagcccagcaagctggcccaggcaaaacatcagctcagcagactgggcctactaagcctccgtcccagcttccaggccctgccaagccgcccccacagcagcctgggcccgcaaagcccccaccccaacagcctgggagtgcaaaaccaccctcccagcagccaggatcaacaaagcctccgccccagcagcccgggccagccaagccctccccccaacaaccaggttcgacaaagccgccaagtcagcaacctggttctgcaaagccaagtgcccaacagccttctccagcaaagccgagtgcgcagcagagcacaaagcctgtgtcccagaccggaagtggcaagccattacaaccccctacagtgtctccatctgcaaaacagcccccttcccagggattgcctaagactatctgcccactatgcaataccacggagttattgcttcacgttcccgagaaggcaaacttcaatacctgcactgagtgtcagaccaccgtctgctcactgtgcggattcaaccctaatccccacctgaccgaggtgaaagaatggctctgtttaaattgtcaaatgaagagagcgctcgggggggacctggcacccgtgccgtccagcccgcagccaaagttgaagacggctcccgtgaccactacctctgccgtcagtaagagctccccccagccccagcagacttcccccaaaaaagacgcggcaccgaagcaggacctgtccaaggcgccagagcccaagaaaccgcccccccttgtcaagcaacccacactccacggttcacctagcgcgaaggccaagcagcctcctgaggccgacagcctatctaagcctgcaccccccaaggagccaagcgtcccttctgagcaagacaaggccccggtggccgatgataagcctaaacagccaaagatggtgaagcctacaacagatttggtgagctcctcttcagctacaactaaacccgacatcccctccagcaaggtccagtcacaagccgaagaaaaaacaacgccccctctaaagaccgacagcgccaaacccagtcaatcgttcccaccaacgggggagaaggtcagcccatttgacagtaaagctatccccagacccgcctccgactccaaaatcatttctcaccctggaccgtcctccgaaagcaaagggcagaagcaggtggatcccgtacaaaaaaaagaggagcctaaaaaagctcaaaccaagatgtctccaaaaccagatgccaaacccatgccaaagggatcccctactccccccgggcctagacccacagcaggccagacggtgcccactcctcaacaatccccaaaaccacaggagcagagcagacggttctctcttaatctcggctcaatcactgatgccccgaaaagccagccgaccacgcctcaggaaacagtgactggcaaactctttggttttggtgctagtatctttagtcaggcgtctaatctgatcagcacggcaggacagcccggaccgcacagccagtcaggtccaggagctccaatgaagcaagcacctgcccccagtcagccacccacgtctcaagggcccccaaaatcaaccgggcaagcaccccctgctccagctaaaagtattcccgtaaagaaagagaccaaggcgcctgctgctgagaaactcgaaccgaaagctgaacaggcccccaccgtaaagagaacagagacagagaagaaaccaccccccattaaggactccaaatccttaaccgctgagccccaaaaggccgtcctgcccacgaaattagaaaagtcccccaaacctgagagcacctgtcctctgtgcaagacagaactcaatatcgggtcaaaagacccccctaattttaatacctgtacggaatgtaaaaaccaggtgtgtaacctttgcggctttaatcccaccccacacctgacagagattcaagagtggctgtgcctgaattgccaaacgcagcgcgcgatctctggtcagcttggggacatacgtaaaatgcccccggctccctccggccccaaagccagccctatgccagtccctacagaatcaagctcacagaagacagcggtccctcctcaggtgaaactggtgaaaaaacaggaacaggaggtcaagactgaagcagaaaaggtgatcttagaaaaggttaaggaaaccctttcaatggagaagattccaccaatggtgactaccgaccagaaacaggaggagagcaaactcgagaaagacaaggcgagtgcccttcaggaaaaaaagccactcccagaggaaaagaaactcatcccagaggaggagaagatacgcagcgaggagaaaaaaccactactggaggagaagaaaccaacacccgaagacaaaaagcttcttcccgaggcgaaaactagcgctcccgaggagcagaaacacgacctcctcaagtcccaggtgcaaatcgcagaagagaagcttgagggtagggttgctccaaagaccgttcaagagggcaagcagccccagaccaagatggagggtttgccttcaggcacccctcaatcgttgccaaaggaagacgacaaaactaccaagactattaaggagcaacctcagcccccttgtacagctaagcctgaccaagtcgaaccggggaaagaaaaaacagagaaagaagatgataaatcagatacatcctctagtcaacagcccaagtctccacaggggctgtccgacacaggatactcgtcagacgggatctcttcgagtctgggcgaaatcccatctctcattcccactgatgaaaaggatattctgaaaggtctgaagaaagattctttttcacaagaaagttccccctccagccccagcgacctagcaaaactcgaaagcacagtgctgagtatactcgaagcacaagcctcgacactggccgacgagaaaagcgaaaagaaaacccagcctcatgaggtgagtccagaacaacctaaagatcaggagaagacccagagtctgagcgagacgctagaaatcacgatatccgaggaggagattaaagaatcacaggaggaaaggaaggacaccttcaagaaagacagccagcaggacatcccgtcgagtaaggatcataaggagaagtcagagttcgtggacgatattactactagacgtgagccttacgattcggtcgaggagtcgagcgaaagtgagaactctcccgtccctcagaggaaacggcggacctcagttggctccagcagctcagacgagtacaagcaggaggactctcagggttctggggaggaggaagacttcatccgaaaacagatcatcgagatgagtgccgacgaagatgcttccgggagcgaggacgatgaattcatccgaaaccaattaaaagaaatttcctccagtactgaaagtcaaaaaaaagaggaaaccaagggcaagggcaaaataacggcaggaaaacaccgtcgcctaacgcgcaagagttccaccagcatcgatgaagatgcaggtcgtaggcactcctggcacgatgaagatgacgaggccttcgacgagagcccagagctaaaatatcgcgagacgaagagtcaggagtctgaagagctcgtggtcacgggcggaggagggttacgcaggttcaaaactattgagttaaatagcactatcgccgataaatatagtgcagaatcatctcagaagaagactagtctgtacttcgatgaggagccggaactagaaatggagagcttgacagattcgccggaggatcgaagccgtggagaaggaagctcttccctgcatgcttcttcctttacacccggaacttcacccacttctgtgagttctctggatgaagattcagactcttcaccgtcccacaagaaaggtgagagtaagcaacagaggaaggcccgccaccgcccccacggacctttgttgcctacgatcgaggatagttctgaggaggaggaactgcgggaagaggaagagctgttgaaggaacaggagaaacaacgagaaatcgagcagcaacaaaggaagtccagctccaaaaagtccaagaaagacaaggacgagctgcgggcgcaacggagacgcgaacgacctaagacgccacccagcaacctctccccaatcgaggacgccagtccgactgaagaactgcgccaggcagccgaaatggaagaacttcatcggagttcatgcagcgagtacagtccttccattgagagcgaccccgagggctttgaaattagtcccgaaaagattatagaagtccagaaggtgtataaattgccaacagctgtgtctctgtattctcccacagacgagcagtcaattatgcagaaagaaggcagtcagaaggccctcaagtcggccgaagaaatgtacgaagagatgatgcataagacgcataagtacaaggccttccctgctgcaaacgagcgtgacgaagtatttgagaaggaaccactgtacggcgggatgctgatcgaggattatatatacgaatcacttgtcgaagatacctacaatgggagtgttgacgggagcttactgactagacaagaggaggagaacggattcatgcagcagaagggccgcgagcaaaagattcgacttagtgagcagatctacgaggacccgatgcaaaagattactgatttacaaaaggagttctatgagctcgagtcactgcactcagtagtgccacaggaagatatcgtgagctcatctttcataatcccagagtcccacgagatcgtagatcttggtactatggtgacttctacggaggaagagcgcaagctgttagatgccgatgcagcatacgaggagctcatgaagcggcagcagatgcagctgacccctggatctagccctacacaggctcctatcggtgaggacatgacagaatctactatggacttcgacaggatgccagatgcaagcttaacctcaagcgttctcagcggcgcttctctgactgatagcactagctccgcaacactatcaatcccagatgtgaaaattacacagcatttcagtacagaggagattgaggacgagtacgtgacagactatacacgcgagatccaagagatcatagctcacgagagcctgattctgacctacagcgagccaagcgagagtgccacatccgtgccgccttcggacactccatcactcacttcctccgtcagtagcgtgtgcacaacagattccagctctccgatcactaccctggactctatcacaacagtgtacaccgagcccgtcgacatgatcaccaaatttgaagacagcgaggagatcagctcctctacatattttccaggaagcatcatcgactatcccgaagaaatatctgtgagcctcgacaggactgccccgcctgacggaagagcttccgctgaccatatcgtcatcagcttatccgatatggcgtcctctatcattgagagcgtggttcccaaacccgaaggaccggtggctgataccgtctctaccgatctgctcatctctgaaaaggatcccgttaaaaaagcaaagaaagaaactgggaacgggattattctcgaagtgctggaggcttatagggataagaaagagttggaggctgagcggacaaaatcatcactttccgaaaccgtttttgaccaccctccgtctagcgtcattgccttgccaatgaaggagcagctgagcaccacctacttcacatcaggcgagacgttcggccaagagaaaccagcgtcacagctgccaagcggttcaccgtctgtcagcagtctcccagcaaagccgagaccgttctttagaagttcctcactggatatctctgcccaacctccgcccccacccccgcctcctccgccccctccccctccaccaccacctcctcccccacctccccttccaccccctacctccccaaagcccaccattctgcctaagaaaaaactaacggtggccagtccagtgaccacagcgactcctctgtttgatgccgtgactacactggaaaccactgctgttttgagatcaaacgggctcccagtaacaaggatttgcacgacagcaccaccacctgtgccccctaaaccatcatccattccctcgggtctagtatttacccaccgccccgaaccctctaaacccccaatcgcccccaagccggtgattccacagctcccaactaccacacaaaaacctacggacatccatcctaagcccactggtctcagtttaacgagcagcatgacccttaacctcgtgactagcgcagattacaagctgccctcaccaacaagtccgctctcaccccacagcaataagtcgagtcctcgctttagcaagtcgctgacggaaacatatgtggtgattaccctcccctctgaacccggcacgcccacggattcatctgcctctcaggcaataacaagctggcctctggggtccccttccaaggatctggtgtcagtagagcccgtcttctctgtggtcccacccgtcaccgcagtagagatacctatatccagcgaacaaacgttttacatctcaggagctctgcagaccttttcagctacacccgttacagcaccaagctcgtttcaggctgcgcccacctctgtcactcagttccttacaactgaggtgagtaagacagaggtcagcgctactaggagcacggcccccagcgtcggcctgtccagtatttcaattaccatccccccagagccccttgctctggacaatattcatctcgaaaagccccagtataaggaggatgggaaactgcagttggtgggcgatgtaatagatctgagaactgttcctaaggtggaagtaaagactaccgacaaatgtatagacctcagtgccagtaccatggatgtaaagcggcaaattactgcaaatgaggtgtacgggaaacagatttcagccgtgcagccatccatcataaacttgtccgtgacatcgtctatagttacaccagtgtctctggctacggagaccgtcacttttgtaacctgcaccgcctctgcttcttacacaacaggtactgagagcctcgtcggggctgaacatgccatgacgacccccctccagttgactacaagtaagcatgcggaacctccctatagaatccccagcgaccaagtatttccaattgcccgtgaagaggctccgatcaatctgtctctagggacccctgctcacgccgtaacccttgccataaccaagcctgtaaccgtgccccccgttggtgttacaaatgggtggaccgactctactgtttcccagggcattaccgatggtgaagtggtggacttatctacaaccaagtctcatcggacagtcgtcaccatggacgagagtaccagctccgtgatgacgaaaattattgaagatgaaaaacccgtggacctgaccgcggggaggcgcgcagtttgttgcgacgttgtatataaattgcccttcggacgcagttgcactgcacagcaacctgccactactctgcccgaagataggttcggatatagggatgatcactatcaatacgatcgctccgggccctatggataccgaggaattggggggatgaagccaagtatgtctgacactaacctggccgaggccggtcatttcttttataagagtaagaacgcattcgactacagtgaaggcacggataccgcagtggatctgacgtctggacgggttacaacgggagaggtgatggattatagctccaagaccacggggccatatccagagacccgccaggtcatcagcggtgcaggaatctcaacaccacaatactcaaccgctcgcatgacacctccgcctggcccccaatactgtgtagggtccgtgctgcggagtagcaacggtgtggtatacagctccgtggctacacccaccccatccacattcgcaatcactacacagcccggcagcatcttctcaaccacagtcagggatctgtccgggattcacaccgccgacgccgtgacaagtctccccgctatgcaccactctcagcctatgccacgatcgtactttatcaccaccggggcaagcgagactgacatcgccgtgactggcatcgatatcagcgcgagccttcagacaatcaccatggagagtcttactgccgagactatcgattcagttcctacactgacgacagcttctgaggtcttccctgaggtcgtcggtgatgagtctgcactcctcattgtgcccgaggaagacaagcagcaacagcaactcgacctagagagagagttacttgagttagaaaagataaaacagcagcgattcgctgaagagctagagtgggaacggcaggaaatccagagatttagagagcaggaaaaaatcatggtccagaagaagctggaggagctccaatccatgaaacagcatttgctgttccagcaagaggaagagagacaggcacagtttatgatgcgccaagagactttggcgcagcagcagctccaactcgagcaaatccaacagctgcagcagcaattacaccagcagctagaggaacagaaaattcgtcagatctatcagtacaactatgacccaagcgggaccgcaagcccacagacaaccactgagcaggcaatcctggaagggcagtatgcggctttggagggaagccaattctgggcaaccgaggatgctactacaaccgccagcgccgtggtagctattgagatcccacaatctcagggatggtacacagttcagtctgacggcgtcacacagtatatagcacccccaggtatcttgtccaccgtttcggaaatcccactcaccgacgtcgttgtgaaagaggaaaagcagcctaaaaagcgcagctcaggcgcaaaggtgagagggcagtacgatgatatgggcgagaacatgacggacgatccccgatccttcaaaaaaatagttgacagtggagtgcagaccgacgacgaggacgccaccgataggagttacgtcagtcgcaggcgacggacaaagaaaagcgtggatactagcgtccagaccgacgacgaagaccaggatgagtgggacatgcctacgcggtcgaggcgaaaagcccgcgtgggcaaatacggggattccatgaccgaagctgataaaacaaagcccctcagcaaggtgtctagcatcgcagttcaaaccgtagctgaaatctctgttcagactgagcccgtgggaaccattcgtacaccttctattcgcgctagagtggatgcgaaagtggaaatcattaagcacattagtgcacctgaaaaaacttacaagggaggaagcctgggatgccaaactgaagccgattcagacactcaaagtccgcagtacctgtctgcaacttccccaccaaaggataagaaacgccctacccccctcgagatcggatactcttcacacctgcgagctgatagcactgtccagctggctccatccccaccaaagagtcctaaagtcctttatagcccgattagccccctgtctcctggaaaagcccttgagtccgcctttgtgccttacgagaagccactccccgacgatatcagcccgcaaaaggtgctgcatcctgatatggcaaaagttcctcccgcctcgccgaaaactgcaaaaatgatgcagcgatcaatgtccgatccgaaaccgctctctccaacggcggacgaatcatccagggcgccgttccagtacaccgaagggtatactactaagggttctcagactatgacttcatcaggagcacagaagaaagtgaagaggacactcccgaatccacctcctgaggagatctctactggaactcagagcacattttccacgatgggcactgtgtcacggagaagaatctgccggacaaacaccatggcgagagctaaaatcctccaggacatcgatcgggaactagacctcgtggaaagagagagcgcgaaactgcgaaaaaagcaggccgaactcgatgaagaagagaaagagatcgatgcaaagctgcgatatttggaaatgggaataaatagacgcaaagaggccctgctgaaagaaagagagaagcgggaacgggcatacctccaaggtgtggctgaagatagggactacatgagcgattcggaggtgtcctccactagacctactcgaattgagtcgcaacacggtatcgagagaccaaggacagctccacaaaccgaattctctcagtttataccacctcaaacacagacggaatctcaactggtgccccctacctccccatatacccagtaccaatacagctctcccgccctgcctacacaggccccaacctcatatactcaacagagccacttcgagcaacagacgctgtatcatcagcaggtgtccccataccagacacagcctacttttcaggcggttgcaacgatgagctttacaccacaagtgcaaccaactcctacgccacagccaagttaccagctgccctcacagatgatggtcatccaacagaagcctcgtcagacaacactgtaccttgagccaaaaattacatctaattacgaagtcataaggaatcagccgctcatgatcgcacctgtgtctacagataatacctttgccgtatcacacctcggatctaagtataacagcctcgatctaagaattggactggaagaacgctcttcgatggccagcagtccgattagtagtatcagcgcagactctttttacgccgacattgaccatcatacgcccaggaactatgttctcatagatgacattggagaaataacaaagggcactgctgccctttctacggctttttctcttcacgaaaaggatctgtctaagaccgaccgactgttgcgcacgactgaaacaaggaggtcccaggaggtgaccgattttctggcccctctacagtcctcttcaaggctgcactcgtatgtaaaggccgaggaggaccccatggaggatccatacgagctaaagttacttaaacaccaaattaagcaggagtttcggagggggacagagtccctcgaccacctagctggcctgtctcactactaccacgccgataccagttaccgacatttcccaaaaagcgagaagtacagcatttcgagactgaccctcgagaagcaggcagctaagcagctgccggctgcgattctgtatcagaagcaatcaaaacacaaaaagtctctgatcgatccaaagatgagcaaatttagcccaatccaggaaagccgggacctggaacccgactactcgtcctacatgacttctagtacatcaagtataggtggcatctcttcccgcgcaagactgttgcaggacgacattacctttggactcagaaaaaacattaccgatcagcagaagttcatgggctctagccttgggaccggcctgggcactctgggtaacaccattcggtcagccctgcaagacgaggccgacaagccctattcatctggatctcgcagtcgcccttcgagtcgcccaagctccgtctacggacttgacctgtctatcaaaagggactcttctagtagtagcctgcggctgaaggcccaggaagctgaagccctggacgtctctttcagccacgcctcgtcatcagccaggacaaagccaacaagcctgccgatcagccaaagtcggggccggatccctattgtagcccagaattccgaagaagagtcccccctgtccccagtcggacagcctatgggcatggccagggccgcagctggacccctcccccctatttcggccgacacgagagatcagttcggtagttcccactctctacccgaggtgcagcaacatatgagggaggagtctcgcactaggggttatgaccgagatatcgcttttatcatggatgatttccagcatgccatgtctgactctgaggcttatcatctgcggcgggaagaaacggattggtttgacaagccgcgggaaagccgcttagaaaatgggcatgggctggatcgcaaactgcccgaaagactcgtccactcccggccactttcacagcatcaggaacagattattcaaatgaacggcaaaactatgcactatatcttccctcatgctaggatcaagatcacgcgcgatagtaaagaccatacagtaagtggcaatggcctggggattagaattgtaggcggcaaggagatccctgggcatagcggtgagatcggcgcttacatcgccaagattctgcctggaggaagcgcagagcagaccgggaagctgatggaaggtatgcaggtccttgaatggaacggaattccactgaccagtaagacatacgaggaggtacagagcattatttcccagcaatcgggcgaagctgaaatatgcgttagactggatctgaatatgcttagtgacagtgagaatagtcaacacctagagctgcacgagccacccaaagccgtggacaaggctaagagtccaggcgtagatccgaagcagctagcagctgaactgcaaaaggtgagccttcagcagagtccactggtgctctcgtctgtggtggagaagggttcccatgtccattctggaccaacttcagctgggagctcctcagtgccctccccgggccaacccggcagccccagcgtgagtaaaaagaagcatggtagctccaagccaacggacgggaccaaagtggttagtcatcctattacgggagaaatacagctacagataaattatgacctgggtaacctgatcatccacattctgcaggcccggaacctggtgccgcgcgacaacaatgggtattcagaccccttcgtaaaggtttatttattgccaggtaggggccaggtgatggtggtgcagaatgcaagtgccgagtacaaaaggcgcacaaagcacgtccaaaagagccttaaccctgagtggaatcaaacagttatatataagagcatctcaatggagcagttgaaaaagaagactttagaggtgactgtctgggactacgatagattctcttccaacgactttttaggagaagtcttgatagacctgagctcgacgtctcatctcgataacacaccgagatggtaccccctgaaagaacagacagaatccattgatcatggtaaatctcactctagtcagtctagccagcagagccctaaaccatccgtcattaagtcccgatcccacggtatttttccagaccccagcaaggatatgcaggttcccactatcgagaaaagccacagctcacccggatcctccaagtccagttctgaagggcatctgcgcagccatggcccaagtcgcagtcagtcaaaaacaagtgttacccaaacacacttagaagatgctggagctgccattgccgccgctgaggctgcagttcagcaactgcggattcaacccacaaagccacctaatcaccgacccgctgaaagcagcgtgtccacgggaagctctggcagtagctttggcagtggctactcggttgactctgagggctcctcctctacagcgggagagactaacctctttcccattcctcgaataggcaaaatgggacagaacggccaggagcctgttaagcagcccggtgtgggcgtcggccttgcggatactgaagctaaaacccaagtgatgggagagataaaaatcgcactgaaaaaggaaatgaagactgacggcgaacagctcatagtggagattttgcagtgtcggaatattacgtacaagtttaaatcccctgatcacctccccgatttatatgtcaaaatctatgtgatgaacatttctacacagaagaaggtgattaagaaaaagacgcgagtatgtaggcacgaccgggaaccaagtttcaatgagacattccggttcagcttgtctcctgccggccattccctccaaatcctcctgtttagcaatgggggtaagtttatgaaaaagactctcattggcgaagcttgcatctggctggacaaggtggatctgcgaaaacgcatcgtgaattggcataaactgctcgtgtcaccgacacagacacactag

SEQ ID NO: 128858 - DNA, 1269 bp, Artificial Sequence
  Description of Artificial Sequence: Synthetic coding sequence
actaaggtttggaactctaacggattgggaatccggattgtgggagggaaagaaattcctgggcactctggtgagatcggagcctatatcgcaaagatccttcccggcgggtctgccgagcagaccggtaaactcatggagggaatgcaggtgctggaatggaacggaatccctctcaccagtaaaacctacgaggaggtgcagtccattatcagccagcagtccggggaggcggagatctgcgtgcgcctggacctgaacatgctgagcgacagcgaaaattcccagcacctggaactccatgagcctccaaaggcagtggacaaggctaaatccccaggtgtagaccccaaacagcttgcggctgagcttcagaaagtcagccttcagcagtctcccctggtcttaagctccgtggtagagaaaggaagtcatgtgcacagcggtcctacatcggccggttcctcaagcgtgccaagccctggacagccagggagcccctccgtatcaaagaagaagcatggaagctcaaagccaactgatgggactaaggttgtgtcacatcccattacaggcgaaatacaactgcagatcaattatgatttaggtaacctcattatccacatcttgcaagcgagaaacctcgtgcccagagacaataatggatactctgacccattcgtcaaggtctatctgctgccaggacgcggcgctgaatataaaagacggaccaagcacgttcaaaagagtttaaatccagagtggaaccagacagtcatctataaaagtatctcaatggaacaactcaagaagaagaccctcgaagttactgtctgggactacgatagattcagttcaaacgattttctgggcgaggtccttattgatctgagttcaaccagccacctggacaacaccccccggtggtatcctctgaaggaacagacagaaagcatcgaccatggcaagagtcattccagccagtcgagtcagcaatccccaaaaccctccgtgatcaagagtagaagtcatgggatttttcctgatccctctaaggatatgcaggtccctaccatcgagaaatcccattcttcacccggctcaagcaagtccagttcggagggtcacctgaggtcacacggcccttccagatcacagagtaagacttcagtcactcagacccacctggaggatgctggggcagctatcgccgcagctgaggccgctgtgcagcagctacgcattcaaccaagcaaacgcagaaagtag

SEQ ID NO: 128859 - DNA, 14808 bp, Artificial Sequence
  Description of Artificial Sequence: Synthetic coding sequence
atggggaacgaagccagtctcgagggcgaaggcctcccggagggactggccgccgcagcagcagcagggggcggcgcatccggggctggcagccccagccacactgcgattccggccggtatggaggccgatctctcacagctgtccgaagaagaacgccggcagattgcggctgtcatgtccagggcccaaggactacccaaggggagtgtgcctccagccgctgctgagtccccttctatgcatcggaagcaggagcttgattcgtcccacccacctaaacaatcaggcagaccccccgaccccggcagaccggctcaaccgggactgtctaaatctagaactaccgataccttccgatctgaacaaaaactgccgggacgttcaccgagtacaatctctttaaaggaaagcaagagtaggaccgacctgaaggaggagcacaagtcgtctatgatgcccggcttcctatccgaggtcaatgctttgagcgctgtgtcatccgttgtgaataaattcaatccattcgacttgatcagcgattctgaggcatcacaggaagaaactacgaagaaacagaaagttgtacagaaggaacagggaaaacccgagggcataattaaaccacccttacaacaacagccacccaagccaatccccaagcaacagggccccgggagggaccctttacaacaggatggtacacctaagagcatttcgtctcagcagccagaaaaaatcaagtcccagcctcctggaacaggtaagcccattcaaggtcccacccagacgccacagaccgaccatgccaaattgccactgcagcgagatgcctcgagaccacagaccaagcaggccgatatagtgcggggtgagtctgtgaagccttcactcccaagccctagtaaaccccctattcaacagccgacccccggaaagcctccggcgcaacagcccggccacgagaaatctcaaccggggccagccaaaccacccgcccagccaagcgggttaacaaagcctctggctcagcagcccggcacggtgaagccccccgttcagcccccaggaacgactaaaccccctgcacaacccctcggccctgcaaagccacctgcccaacagacgggttctgagaaacctagtagcgagcagccggggcccaaagcgctggcccagccaccgggggtgggtaaaacacctgcccaacagcctggaccagctaaacctcccacacaacaggtggggactcccaaaccgcttgctcaacagcccgggctgcagtcacctgccaaagcacctggaccaaccaaaacacctgtacagcaaccggggcccggtaagatccccgcccagcaagccgggcctgggaaaacgagtgcccagcagactggaccaacaaagcctccaagccaactccccggcccagcgaaacctcctccgcaacaaccagggcctgccaaaccccctccccaacagccaggttcggcaaagccgccaagtcaacagccaggaagcaccaaacctcctccccaacagccaggtcctgctaagccaagtccccagcaacccggaagtacaaaacctcctagccagcagcccggatcagccaagcccagtgcccagcaacctagtcccgcaaagcctagcgcccaacagtccacaaaacctgtgtctcagacgggtagcgggaagccgctacagccgccgactgtctctccatccgccaaacagcctccatctcaggggctgcctaaaaccatttgccctctgtgtaataccactgagctgcttttgcatgtccctgagaaggcgaatttcaacacatgtactgaatgccagacaacggtttgctccctttgtggcttcaatcccaacccccatttaaccgaagtcaaggagtggctctgtctgaattgccagatgaagcgcgcactgggaggggatctcgccccagtgccgagttctccacagccaaaactcaagacagccccagtgacaacaactagtgccgtgtctaagtcttcaccgcaaccccagcagacctcaccaaagaaagatgccgctcccaaacaagacctctccaaggcccctgagccaaaaaagccccctccattagtcaaacagccaacattgcacggttcacctagtgcaaaagctaagcagccacccgaggcggatagcctcagcaaacccgcacctcccaaggagccatcggtaccctcagagcaggataaggctcccgtggcagatgataagccgaaacagcctaaaatggtgaagccgactactgacctggtttcttcgtctagtgccactaccaagccagacattcccagttctaaagtccagagccaggccgaggaaaagaccaccccgcccctgaaaacggactccgccaagccctcccagagctttcccccaaccggggaaaaggtttcaccctttgatagcaaggcaatcccgcgtcccgccagcgattcgaagataatcagccacccaggtccttcttccgagagcaaagggcagaaacaggtggatcccgtgcagaagaaagaggaaccaaaaaaggcgcaaactaaaatgagccctaagccagatgccaagcctatgccgaagggatcccctacacctcctggacctcgcccaaccgccggccagacggtgccaactccacaacagagcccaaagcctcaggagcagagcaggaggttctctctcaatttaggaagtatcacagacgcccctaaaagtcagccaaccacaccacaggagacggtaaccggcaagctcttcggatttggtgcctctatttttagccaggcttcaaatctaatctccaccgctggacaacccggaccacactctcagtcaggacctggggccccaatgaagcaggccccagctccttctcagccacccactagccaagggcccccaaagagcactggccaggccccacccgccccagccaagagtattcccgtcaagaaggagaccaaggcccccgcggctgagaagctcgaacctaaagctgaacaggctcctaccgttaaacgtaccgaaaccgaaaagaagcccccaccaattaaagacagcaagtcactcacagccgagcctcaaaaagctgtcctccccactaaacttgaaaagagccctaagccggagagcacttgccctttatgcaaaactgaactcaacatcggatccaaagatccgcctaatttcaatacatgcactgagtgcaaaaatcaagtctgcaatctctgtggctttaatcctacaccccatctcactgagattcaggaatggctctgcctgaattgtcagacgcagagggccatatcggggcagctgggcgacatccgaaagatgccccctgctccaagcgggcccaaagccagccccatgccagtacctactgagagctcctctcagaagacggcagtgccaccacaggtgaaactcgtgaaaaagcaggagcaggaggttaagacagaggctgaaaaggtcatactggagaaagtgaaggagaccctgtcaatggagaagatccctcctatggttacgaccgatcaaaaacaggaggagtccaaacttgaaaaagacaaagcctcagcgttgcaagaaaagaagccactcccagaagagaagaagctaatccctgaggaggagaagattagatctgaggaaaaaaagccccttctcgaggagaaaaagcccacccctgaagataaaaaactgctacctgaggctaagacttcagcccccgaagaacaaaaacatgacttacttaagtcacaggtgcagatcgccgaagagaaacttgaagggagagtggcccctaaaacagtgcaggaaggcaaacagccacagacaaaaatggaggggctgcccagtgggacccctcagagtctccccaaagaagacgataaaacgacaaagactatcaaagaacagccacaacccccatgcaccgccaaacccgaccaggtggagccagggaaagagaaaaccgagaaggaggatgataagtctgacacatcaagcagtcaacagcctaagagtcctcagggcttgagcgacacgggatattccagtgatggaatttcctcatcgttgggggagatccctagcctcatcccaactgacgaaaaggatatcctcaaagggctgaaaaaggattcgttctcccaggaatctagcccgtcttctccatctgaccttgccaaactcgaatcaacagtactgtccatcctggaggcccaagcttctactctagctgatgagaagtctgagaagaagacccagcctcacgaggtcagtcctgaacaaccaaaggatcaggaaaagacccaatctttgagcgagaccttggagattacaatttccgaggaggagatcaaagagtctcaggaagaaaggaaggatacgtttaaaaaagattcccaacaggatattccttccagcaaggatcacaaggaaaaatctgaattcgtggacgacatcactactagacgggagccctacgacagcgtcgaagagtcttccgaatccgaaaactcccctgttcctcagcgcaagcgccgcactagcgtcggtagttcaagcagcgatgagtacaagcaagaggactctcagggatccggggaggaggaggatttcatccggaaacagatcatcgagatgtcagcagatgaggacgccagcggttccgaggacgatgaattcatccgaaaccaactgaaggaaatatcgagctccacagagtcacagaagaaagaagagacaaagggtaagggcaagatcactgcaggtaagcatcgccggcttactagaaaaagtagcacctccattgacgaggacgccggtcgtcgccattcttggcatgatgaggacgatgaagcctttgacgagagcccagaacttaagtacagagagacaaagagccaggagagcgaggaactggttgtgacaggaggggggggactgcgtaggtttaaaaccatcgaacttaattcgactattgccgataaatatagcgctgagtctagccagaagaagacatcactgtacttcgatgaggaacctgagcttgagatggagagtctaacagattcgcccgaggaccgctccaggggagaaggatcctccagcctccatgctagtagctttacccccggcacatctcctaccagcgtttccagcctcgatgaggattctgatagctcccccagccataagaaaggggagagcaagcaacagcgcaaggccaggcacagaccccacgggccactgctccccaccatagaagattcctcagaagaagaggagctcagagaagaagaagagctgctgaaagagcaggaaaagcaacgcgagatcgaacagcagcagcggaagtcctctagtaagaaatccaaaaaggacaaagacgaactacgcgcgcaaaggaggcgcgaacgcccaaaaaccccaccctcgaatttaagccctatcgaggatgccagccccaccgaagagctgcgccaagcagccgaaatggaagaactgcatagatcctcctgctctgagtactcgccttccattgaaagtgatccagaaggctttgaaatctcgcccgagaaaattatagaggtccaaaaagtctacaagttacctactgctgtaagcctctacagccccaccgatgaacagagtattatgcaaaaagagggttctcagaaggctctcaaatccgccgaagaaatgtacgaggagatgatgcacaagacccataaatataaggcatttccagccgctaacgaacgcgatgaagtgttcgaaaaagaaccactctatggcggaatgttgattgaggactatatctacgaaagtctcgtggaggatacgtacaacggaagcgtggatggcagtctccttaccaggcaggaagaggagaatggtttcatgcagcagaaggggcgggaacagaagataagacttagcgaacagatctatgaggaccctatgcaaaaaatcactgacctgcagaaggagttttacgagctggagtccctgcactccgtcgtgccccaggaggatatcgtttctagtagttttatcattccagaatcccatgagatcgtggatctcggcaccatggtcacatccacggaggaggaaagaaaattactcgatgcagacgctgcatacgaagagctgatgaaacggcagcaaatgcaattgacacctggttcaagtcccacccaggcccccatcggagaggacatgacagaaagtactatggattttgatagaatgcctgatgcctccctcacctcatcagtcctgtcaggagcctccttgaccgattcaacttcctctgccaccctgagtatccccgatgtgaagatcacacagcacttcagcaccgaagagatcgaggacgaatatgttacagattacacccgggaaattcaagagataatcgcccatgagtctctgattctgacatactccgagcctagtgagtcagctacttcagttccacctagcgacactccatccctgacctcatccgtgagcagcgtgtgcacgaccgattcttcatcccctataaccacattagattctatcacaaccgtgtataccgaacccgtggatatgataacaaagttcgaggattcagaggagatttcatccagcacatactttcctgggtcaattatcgattatcctgaagaaatttccgtgtccttggacaggacggcacctccagacgggcgcgcctcagccgatcacatcgtgatatcgctgagcgacatggcctcaagtatcatagagtccgtcgtgcctaagccagagggtcctgtggccgataccgtctccactgatttactcatcagtgaaaaagatcccgtcaagaaggccaagaaggaaacaggaaacggaatcatcctggaagtactagaagcctatcgcgacaaaaaagaactggaggccgagcgcaccaaatctagtttgagcgaaaccgtcttcgaccatccaccaagtagcgttatcgcgttgcccatgaaagaacagctgagcaccacatactttacctcgggggagacatttggtcaggaaaaacccgccagtcagctgccaagcggttccccaagtgtgagcagtttaccggcgaagcctcgccctttctttaggtctagttccctggatatctcagcacagcctcctcctccccctccacctccgccccctcccccacctcccccaccgcccccacccccgcccccattgccccctcctacgtcaccaaagccaaccattctgcccaagaagaaactcactgtggccagtcctgtgactacagccacacccctttttgatgcagtgacaaccctcgagaccacagccgtacttaggagtaatggactcccagttacacgaatttgcacaactgcaccaccccccgtccctccgaagccctcaagcatcccatcaggcctcgttttcacacatcgaccggaaccatctaaaccaccaattgcccccaaacccgttatccctcaactgcctactacaactcagaagccgaccgacattcaccccaagccaactgggctgtccttgacgtcgtcaatgactctgaacctggttacaagcgctgactataaactccccagtccaacctctccattatccccccactctaataagtcctccccaagattctcaaagtcgctgaccgagacttacgttgttataacgctcccgagcgagcctggtacccccaccgatagctccgcatctcaggcgattacatcgtggcctctgggttccccatctaaggacttagtgagtgtcgagccagtgttcagtgtggtgcctcctgtgactgcagtggagattcctatttctagcgagcagaccttctacatcagcggggcccttcagacattcagcgccacacccgtgacggctcctagtagtttccaggctgctcccacatcagtcactcagttcctcacgactgaggtgagcaagactgaggtatcagctactcgcagtaccgccccctctgtcggcctcagctcaatctccatcacaattcccccagagccgttagccctcgacaacattcacctcgaaaagccccagtacaaggaagatggcaagctgcaactggttggcgatgttatcgatctgcgcaccgtccccaaggtcgaggtgaaaaccacagacaaatgcatagatctgtcagcgtctactatggatgtcaagagacagatcactgcaaatgaggtctatggcaaacagattagcgctgtccaaccgagtattattaacctttccgtcaccagctctattgtgacccctgttagtctcgctacggaaaccgtgacgtttgtgacctgcacagcctctgctagctacaccaccggaactgaatcactcgtgggagctgagcatgctatgacaactccactccagttgaccacctccaagcacgctgagcctccttatagaatccccagcgatcaggtgttcccaatcgcccgggaagaggctccaattaacttgtcgcttggcacgcctgcacacgctgtaaccctggcaattacgaagccagtgaccgtgcctcccgtgggcgttaccaacgggtggactgattcaaccgtctctcaggggattactgatggtgaagtggtagatcttagcactaccaagagccataggaccgtggtgacaatggacgagtccaccagtagtgtcatgactaagatcatcgaggacgagaaacccgtcgatctaacagcaggcaggcgcgcagtttgctgcgacgtcgtttacaaactccccttcggccgcagttgtaccgctcagcagcccgctaccaccttacccgaggatagatttggctaccgcgacgatcactaccaatacgatagaagtggcccttatggctatcgcggtatcggtgggatgaaaccgagtatgtccgacaccaacctggctgaagcaggccacttcttctataaaagtaaaaatgcttttgactacagcgagggcacggatacagccgtcgatctcaccagcggtcgtgtcacaaccggcgaagtgatggactactcatctaaaactacgggtccatacccagagacccggcaagttatttccggtgctggcatttccactccacagtacagcactgcacggatgactccacctcccggacctcagtactgtgtaggttctgtgttacggtcctcaaatggggtcgtctactccagcgtggcaacaccaaccccaagcacatttgccattacgacacagccggggtctatattcagtactacagttagggacctcagtgggatccataccgccgacgctgtcacctctctgcccgccatgcatcattcccagcctatgcctcggagctatttcattacaacaggcgcgtcagagaccgatattgcggtgacggggatagacatctccgccagcttgcagaccatcacaatggagtcactgacagcagaaaccattgattctgtgcccaccttgacaactgcgtctgaggtattcccagaggttgtgggggatgagtctgcactgctgatagtcccagaagaggataaacaacagcagcagctggatctggagagggagctgttggagttagagaaaattaagcaacaaagatttgcagaagagctggagtgggagaggcaagagatccaacgttttagagaacaagaaaagattatggtgcagaagaagttggaagagctgcagtccatgaagcagcatctcctgttccagcaagaggaggagagacaggcacagtttatgatgaggcaggagaccctggcccagcaacaactgcagcttgagcagatacagcagctgcagcagcaactgcatcagcagctggaggaacagaagataagacaaatttaccagtataattacgatccctcaggcaccgcttctccccaaacgactactgagcaggccatattagagggccagtacgcagccctggagggctcccagttctgggcgaccgaagacgcgacgaccaccgcttctgcagtggtggcaatagaaatcccccagtctcagggctggtacacggtgcagtcggatggtgtgacccaatacatcgccccccccggaatcctaagtacggtgagcgaaattccccttacagacgtggtagtcaaggaagagaagcaaccaaagaaacggtcatcaggagccaaggtgcggggccagtatgatgatatgggggagaatatgaccgacgatccacggagctttaagaaaatcgtggatagcggggtccagactgacgacgaagacgccaccgatagaagttacgtatctaggcgacgaaggaccaagaagtccgtcgatacctcagtccagaccgacgatgaagaccaggacgaatgggacatgcctacacggtcacgaaggaaggccagagtcggcaagtatggcgatagcatgacggaggccgataagaccaaaccgctctcaaaagtgtctagtattgcagtgcagaccgtcgcagagatctctgttcagaccgagcccgtgggcaccatccggacccctagcatccgtgccagggtggacgcaaaagtagagattattaagcacatatctgcaccggaaaagacctataaaggagggagcctcgggtgccagacagaggctgactctgatacgcagtcacctcaatacttatcagcgaccagtccaccgaaagacaagaagcggccaacacctttggagatcggatacagtagtcaccttcgagctgactccaccgtgcagctggctccgagcccccccaagagcccaaaggtcctctattcccccattagccccttgagtccgggtaaagcactggagtctgcattcgtgccttatgagaaaccactgcccgatgacataagcccccagaaggtcctgcaccctgacatggccaaggtcccccccgccagtcctaaaacagctaagatgatgcagcgcagcatgtccgaccccaagccattatcccctaccgctgacgaaagcagccgagccccttttcagtacaccgagggctatactactaagggcagtcaaaccatgacatcctctggggcacagaagaaagtgaagcggacgcttcccaatccccccccagaagaaatcagcactggcacccaaagtacattcagcacaatggggaccgtgtcacgcagacgaatatgcaggaccaacactatggctagggccaaaatcttacaggatatcgaccgggagctggatctagtggagcgcgagtccgccaagctgaggaagaaacaggcagagctggacgaggaggagaaagagatcgacgctaaacttcgctaccttgaaatgggaatcaaccggaggaaggaggccctccttaaggaacgagaaaaaagggagcgagcctaccttcagggcgtcgctgaggatagggactatatgtctgattctgaggtttcaagcaccagacccacaagaattgagagtcagcatggcatcgagaggcctcgaacagctccacaaactgagttttctcaattcattcctccccagacgcagaccgagagccaacttgtcccacccacaagcccctatacacaatatcagtactccagccccgctctccctacacaggcgcctacaagctacacgcagcagagccatttcgagcaacagactctttatcatcagcaggttagcccgtaccaaactcaacccacctttcaggcagttgccacaatgagcttcacgccccaggtgcagcccacaccaactccacagcccagctaccagcttcccagtcagatgatggtgatacaacaaaagccccgccagacaacactgtatctggagcctaaaattacatcaaactacgaggtcatccgaaatcagccactaatgattgcccctgtaagtacagacaatacatttgcggtgtctcacctgggctccaaatacaacagtcttgatttgagaatcggactggaggagcggtcgtctatggcatcatctcccatctccagtatatctgcagattcattttatgcggatattgaccatcacaccccaagaaattatgtgctcatcgacgatattggtgaaatcacaaaagggactgctgcgctgtcaaccgccttttctcttcatgagaaagacttatctaagaccgaccggttgctaaggacaacggaaaccaggaggagccaggaagttactgatttccttgccccccttcaatcatcttctcgactgcacagttacgtaaaggccgaagaggatcccatggaggatccctacgagctcaagctgctgaagcaccagatcaagcaggaattcagaaggggcaccgaaagcctggaccatctcgctggcctcagtcactattatcatgccgatacgtcttatagacattttccaaaaagcgaaaagtactccatctctaggttgacgctggagaagcaggcagccaagcaattgccggctgccatactgtaccagaaacagagcaagcataagaaatcgctcatcgacccgaagatgagtaagttcagcccgatacaagaaagtagagacctcgagccagactacagttcatatatgacctcctcgacatcctcgataggtgggatttctagccgggcccgccttctccaggacgatattacgttcggacttcggaagaatatcaccgaccaacagaaattcatggggagcagtttaggaaccggcctcggtaccctcgggaatacaattaggtcagctttacaagatgaagccgataagccctacagcagtggtagtcgctccagacctagctccagaccgtcttccgtgtatgggctcgacctgtctattaagcgtgattcaagttcatccagtctccggttgaaggctcaggaagccgaggcacttgacgtcagcttttcccacgcaagttcatctgccaggaccaagccaacatccttgcccatcagccagtcccgtggccgcattccaattgtagcccagaatagcgaggaagaatctcccctgtccccagttggccagccaatggggatggcccgcgccgccgccggcccactgcctccaatctccgccgacacaagagaccagttcggatcatctcattcgttgcctgaagtacagcagcatatgcgtgaggaaagtcgaactcgagggtacgatagagacattgcctttattatggatgatttccagcatgctatgtccgactccgaagcttaccacctgcgacgcgaagagacggactggttcgataagcctcgcgagtcacgtttggaaaacggacatggtctagaccgcaagttgcccgagcggcttgttcactcaagacctctgagccagcatcaggagcagatcatacaaatgaatggcaaaaccatgcattacatcttcccgcacgctaggatcaagattacccgagatagcaaagaccacactgtgtcggggaacggtctcgggatccgtattgtcggaggcaaagaaattcctggccactctggtgagatcggggcttacatcgccaaaattctacccggcggcagcgccgagcagactggcaaactcatggagggaatgcaggtccttgaatggaacgggatacctctcacgagtaaaacgtacgaagaggtccagagcatcattagccaacagtccggtgaggccgaaatctgtgtgaggctcgatctgaatatgctctccgattccgaaaattcacagcacttagaactccatgaaccccctaaggctgtcgataaggcaaagagtccgggagtagaccccaagcaacttgcggccgagttacagaaggtatctttgcagcagtcccctctggtgctcagcagcgttgtggagaaagggtcgcacgtccatagcggccccacttcagccggcagctcttctgtgcctagtcctggccagcccggctcaccgtccgtgagcaaaaagaagcatggaagctccaaaccgaccgatgggactaaggtggtgtctcacccaatcacaggagagattcaattacagatcaactatgatctgggcaaccttattatccatatcctccaggcccggaacctcgttcccagggataacaatgggtattctgatccatttgtgaaagtgtacctactgcctgggaggggccaggtgatggtagtgcagaacgccagcgccgaatataagcgcagaactaaacacgtgcagaagagtctgaatccagagtggaaccagacagtcatttacaagagcatttccatggagcagctgaaaaaaaagactctggaggtaaccgtgtgggactatgaccgctttagcagcaatgactttctgggtgaggtcctgattgacctctcaagcaccagtcatttagacaatactccacgatggtatccactgaaggagcagacagagtccatcgaccatgggaaatcacactccagccaatctagtcaacagtcacccaaacccagcgtgatcaagtctcgctcccacgggatatttcctgaccctagtaaagatatgcaggtgcccacaatcgagaagagtcatagctctccaggcagcagcaaaagtagttccgaagggcacctgaggagccacgggccgtcccgctctcagtccaagaccagcgtgacccagacacaccttgaagacgccggcgccgcaattgcggctgcagaagcggcagttcagcagctaaggatccagccaagtaagcggcgaaaatag

SEQ ID NO: 128860 - DNA, 10908 bp, Artificial Sequence
  Description of Artificial Sequence: Synthetic coding sequence
atggggaatgaagcctcccttgagggggaaggcctcccagaggggctggccgccgccgccgccgctggcggcggggcctcaggagccggctctccctcgcatacagccatcccagctggcatggaagctgatctttctcagctcagcgaggaggagagacgtcagatagctgctgttatgagccgcgcccagggattacctaaggggtcagtaccccctgcggctgccgagtctcccagcatgcataggaaacaggagctggattcctcccacccacccaaacaaagcggtaggccaccggaccccggacggcccgctcagcctggtcttagtaagtctcgcacaacggatacatttcggtccgaacagaaactgcccggtcggtctccttcaactatttctcttaaggagagtaaatcaagaactgatctcaaggaggagcacaagagctccatgatgccaggcttcttgtctgaggtaaacgctcttagcgccgtgagctcagtggtcaacaaatttaatccattcgacttaatctccgactccgaagctagtcaggaggaaacgacaaaaaaacagaaggtcgtccagaaagagcagggcaaaccggaaggtatcataaaaccacccctgcaacagcaaccacccaagcccattcctaaacagcagggtccaggaagggatcccctccagcaggacggaaccccaaaatccatttcgagtcagcagcccgagaaaatcaagtctcagcccccagggactggaaaaccaatccaggggcccacgcagacccctcagaccgaccacgcaaaattaccactgcagcgagatgcctcacggccacagaccaaacaggccgacattgtgaggggggagtccgtgaagccatctctgccatccccatctaagccgcctattcagcagcccactcccgggaagccccccgcccaacagccaggccacgaaaagtctcagcctggccccgccaagccgccggcccaaccctcagggctgaccaaacctctcgctcagcagccaggaacagtcaaacccccggtccagcccccaggcaccacgaagcctcctgcccaaccactcgggcctgccaagcctccagctcagcagacgggtagcgaaaagcctagcagtgagcagcccgggcctaaggcactggcgcaaccacctggcgttggaaaaaccccggcgcagcagcctggccccgccaagccccctactcagcaagtagggacgccaaaaccactcgcacagcagccagggctgcaaagtcctgcaaaggctccggggcccactaaaaccccagtgcagccaaaacctccttctcagcagccgggtagcacaaaacccccaccacaacagcccggaccggctaagccttccccacagcagcccggctccacgaaacccccatctcagcaaccgggaagcgctaagcctagcgcacaacagccctcacccgccaagccaagcgcacagcaatccactaagcccgtgtcacaaactggatccggtaagcccctgcagccccccacggtcagcccgagcgccaaacagcctccaagccagggactccccaaaaccatctgtccgttatgtaacacaactgaactacttcttcacgtgcctgaaaaggctaacttcaatacttgtaccgagtgccagactaccgtgtgttccctgtgcggatttaaccccaatccacacctcaccgaggtcaaggaatggctatgcctcaattgtcagatgaaaagagctctcggcggggacctggcaccagtgcctagtagcccgcagcccaaactgaaaacagcgccagttacaacgacatcggccgtgtcaaaaagcagcccgcagccacaacagacgagccctaagaaggacgcagccccaaagcaggatctatcaaaggctcccgagcccaaaaagccaccgcctctcgtgaaacagcctacactccatgggtctccctctgccaaagccaagcaacccccagaggccgattccctgagcaagccagccccccctaaggagccctcagtcccttctgagcaggacaaggccccagttgcagatgataaaccaaagcagccgaagatggttaaacccacaaccgatcttgtctctagttcttcagccacaacaaaacctgacatcccctcttctaaggtacagtctcaggcagaggagaagacgacaccccccctgaagaccgatagcgctaagcccagtcagtcgtttccccctacaggggagaaagtaagcccattcgactccaaggctatccctaggccagccagtgacagtaagattatcagccaccccggcccatcttcagagtctaaaggccagaaacaggtggacccagtacagaaaaaggaagaacctaagaaggcacagacaaaaatgagccctaagcccgatgccaaacccatgccaaagggcagccccactcccccaggtccgcgccctacagccggtcagaccgtacctactccacagcagagccctaagccacaagagcagtctaggaggtttagcctaaacctcgggagcatcacagacgccccaaagtcacagccaacgactccacaagagactgttactggcaagctttttggatttggggcttctatcttttcccaggcaagcaatctgatttcaaccgccgggcagcccgggccccactcacagagtggacctggcgcccccatgaaacaagctcctgctcctagccaacctcccaccagccaggggcctccaaagagtacaggtcaggccccccctgcgcctgctaagagcataccagtaaagaaagagactaaggcccccgctgctgaaaagctcgaacctaaagctgaacaagccccaacagtgaaacggactgaaaccgagaagaaaccccctcccattaaagactctaaaagtctgaccgccgaaccacagaaagctgtgctgcccacaaaactggagaagtctccaaagccagagtccacctgcccgctatgcaaaacagaattgaatattggatccaaagaccctcctaactttaacacctgcactgagtgtaagaatcaggtctgtaacctgtgtggatttaaccccacccctcatctaacagaaaactgtcagacccagagagcgatcagcggtcagctgggggacatcaggaagatgcctccggctcccagtgggcctaaagcgtccccaatgcccgtgccaaccgagtcaagctcacagaagaccgcggttccaccccaggtgaagctcgtgaagaaacaagagcaggaagtcaaaaccgaggctgaaaaggttattcttgaaaaggtgaaggagacgcttagtatggaaaagattcctccaatggttacgaccgatcagaagcaggaagagtcaaagctggaaaaggacaaagcatcagcactgcaggagaaaaaaccactccccgaggaaaaaaagctcatccccgaggaggaaaaaatccgctctgaagaaaaaaaaccactgctggaggagaagaagcctacaccagaagataagaaactactaccagaggcaaagacctcagccccggaggagcaaaaacatgaccttcttaaatctcaggtgcagatcgcagaggaaaagctcgagggaagggtcgcccccaagacagtgcaagagggtaagcagcctcagacaaagatggagggacttccgtccgggacacctcagtctctgcctaaggaggacgataaaaccacgaaaacgatcaaggaacagccccagcctccatgcacagccaaaccagatcaggagaaggaagatgataaaagcgataccagcagttcccaacagcctaagtctccacaggggctcagtgacacaggatacagcagcgatggaatctcctccagccttggcgagattccttcgctgatacccacagacgagaaggatatcctcaagggcctcaaaaaagacagctttagccaggaatctagcccatcttcacctagcgacctggcaaagcttgagagtacagtgctgagcattctggaggcccaggctagcactctagcggacgagaaatcagagaagaagacacagccgcatgaggtttcacccgaacaaccgaaggaccaagagaaaactcagtcattgtctgaaactctagaaattacaatcagtgaagaggagattaaggagtctcaagaagaacgaaaggacacattcaagaaagactctcagcaggacatcccttcatcaaaggaccataaggagaaatccgaattcgtggatgacatcacgacccggcgcgaaccatatgatagcgtggaagagagtagtgagagcgaaaatagtcctgttccacaaaggaagcggcgtacatcagttggatcttcctctagcgatgagtacaagcaggaggactcacaagggtcgggcgaggaggaagacttcatccgcaaacaaatcatcgaaatgtctgccgacgaggatgcaagcgggtccgaggatgacgagttcatcaggaaccagctaaaggagatcagctcgtctactgagtcgcagaagaaagaagaaaccaaaggcaaaggtaagatcaccgccggtaaacaccgccgcctgactcgcaagtcctcgacaagcatagatgaggatgccggacgccgacattcttggcacgacgaagacgacgaagcttttgacgagtccccggaattgaaataccgggagactaaaagccaagagtctgaagagctcgtagtgactggcggtgggggccttcgcagatttaagactattgagctgaactctaccatagctgacaagtacagtgcggagtcatcccaaaagaagacgagcctgtactttgatgaggagcctgagttggagatggagagtttgaccgacagccccgaggaccgaagtagaggggagggaagtagctcgctccacgcttcttctttcaccccggggacctcccctacatcggtgagtagtctggacgaggattcagattctagccccagtcataaaaaaggcgaaagtaagcagcaaaggaaagctcggcatcgccctcatgggcctttattacctactatagaggactcttcagaagaagaagaattacgggaggaagaggagttgttgaaagagcaggaaaaacagagagagatcgagcaacaacagagaaaatcctccagcaagaagtccaagaaagacaaagatgaactgcgtgcacagagacgcagagaaagacctaagaccccaccctcaaacctgagtccaatagaagacgcttccccaaccgaggagctgcgacaagcagctgagatggaagaactgcatcgttcttcatgtagtgaatatagcccttctatagagagtgacccagaggggttcgaaatatcaccagaaaagataatcgaggtgcagaaagtttacaagctccctaccgcagtgtcattatacagcccaactgacgagcaatcaattatgcagaaagaaggttcccagaaggcgctcaagagcgcagaggaaatgtacgaagagatgatgcataagacacacaagtataaggcattccctgcagccaatgagagagatgaagtgtttgagaaagaaccactctacgggggtatgctcatcgaagactacatttacgaatcactggtggaagacacctataatgggagcgtggacggatcactgctgacgcgtcaggaagaggagaacgggtttatgcagcagaagggacgcgaacagaagatacgcctctccgaacaaatctacgaggatccaatgcagaagatcacagatctgcagaaggaattctatgagttagagagtctccattccgtggtgccccaggaggacattgtatcttcttcttttatcattccagagtcacatgagattgttgacctcgggaccatggtgaccagcactgaggaggaacgcaagctattggatgcagatgccgcatatgaagagctcatgaagcggcagcagatgcagctgacccccggatcatcccccacccaggcccctataggagaggacatgactgagtccacgatggactttgaccggatgcccgatgccagtctcacatcatcagttctgagcggcgcgtctttaacagactcaacgtcatctgccacgctgtcaatacctgacgtcaaaattacacagcacttctccaccgaggaaattgaggacgaatacgtgactgattatacccgcgaaatccaggagatcatagcacatgagtccctcatactgacgtattcggaaccctctgaatcagcaacgtccgtgccccctagtgacacccccagcctgaccagctccgtctctagcgtgtgcactactgattcgtctagcccaattactaccttagacagcatcacaactgtgtacaccgagcctgtggatatgatcaccaagttcgaggacagtgaagagatcagctcctccacttatttcccagggtcaattatagactatcccgaagagatctctgtgtctctcgatagaactgcccccccggatggtagagccagtgctgaccatatagttatcagtctaagtgacatggccagtagtattattgagtctgtcgtacccaagcccgaaggtccagtggccgacactgtctcaaccgatctgcttatatctgagaaggaccctgtcaagaaggcaaagaaggaaacaggtaacggaatcatactagaggtgctggaggcttatagggataagaaggagttggaggccgaaaggacaaagtcaagcctctccgagacggtgttcgaccatcctcccagctcggtcattgcccttcccatgaaggagcaactctctacaacatatttcacttcaggcgagacatttggtcaggaaaaaccagcctcccaattaccctctgggtctccctccgtcagcagcctaccggccaaaccacgtcctttttttagaagttcttctttggatatatcggcacagccccctcccccaccgcctccccctccccctccccctccacccccccctccacctccaccacctcccctgcctccccccacatctcccaaacccacaatcctaccaaagaaaaagctgacagtggcaagccccgtcaccacagcgacccccctgttcgacgcggtgacaacccttgagacaactgctgttctgcggtcaaacggactcccagtgacacgaatctgtacaacggcccccccgcctgtgcccccaaaacctagtagcatcccctcgggtctcgttttcactcatagacccgagccttctaaaccacctattgctcctaaacccgtaatcccccagcttcccactacaacacaaaagcctacagacattcacccaaagcccaccgggcttagtctgacaagctctatgaccttgaacctggtgacatctgcagattataagttgccttctccaacgagcccgctcagcccccactcaaataaaagcagtccacgcttttctaagagcctgaccgagacttatgtggtcattaccttgccgtccgaacccggcacacctacagactcaagcgcgagccaggctattacctcatggcccttgggcagtcctagcaaggacttggtctcagtcgagcccgtgttttctgtggtgcccccggttacagccgtggagatccccataagctcagagcagacattttatattagtggtgctctccagactttttccgcaacgcctgtcacggctccatccagctttcaggctgctcctaccagtgttacacagttcttaacaacagaggtcagcaagactgaggtatccgcaacacgatcgaccgcaccctcagtgggcctcagctcaatctcaatcaccatccctcccgaaccactcgcactagacaatattcacttggagaaaccgcagtataaagaggacgggaaactacagctagtgggagatgtgattgatctgcgtactgtgccaaaagtggaggtgaagacaaccgacaagtgtatcgatctttctgccagcaccatggatgtgaaacggcagattaccgcgaacgaagtctacggaaagcagatcagtgcggtgcagccctccattatcaacctatccgtgacttcaagcatcgtcactccagtttcactcgcaacagagacagtcaccttcgtgacctgtacggctagtgcttcatatacgacgggtaccgagagcctggtcggcgcagaacacgccatgacaacccccctgcaactgaccaccagcaaacatgcagaacctccgtaccggatcccctcagaccaggtgttcccgattgcacgcgaagaggcacccatcaacttatccttgggcaccccagcccacgccgtcactcttgcgatcacgaaacctgtgaccgtgcctccggttggagtgacgaacggatggacggacagtaccgtttcacaggggatcactgacggggaggttgtggacctgtctaccaccaaaagccatagaactgtcgtcacaatggacgagagtaccagctcggtcatgactaaaatcatcgaagacgaaaagcctgttgacctcactgcgggcagacgtgccgtgtgttgtgacgtggtgtataaactgccttttggccggtcctgtaccgctcaacagccagccaccactctgcctgaggatcggtttggatatcgtgatgaccattaccagtatgaccggagtggtccgtatggatatcgggggataggtggaatgaaaccgtccatgagtgatacgaatctcgccgaggcaggccatttcttttacaagagcaagaatgcttttgactattccgaagggactgacaccgcggtcgacctgacatcaggtcgggtgactaccggggaggtaatggactactcttctaagacgactggaccgtatcccgaaacccggcaggtcatttccggtgcgggcattagtactcctcaatacagtaccgcccgcatgacaccacctcctggtccccagtactgtgtgggatctgtcctgagatctagcaatggagtggtatactcttccgttgcaacccccactcccagtacatttgcaatcacaacccagcctggctcaattttctccaccactgtaagggatctgtcagggatccatacagctgatgcagtgacttctctccccgccatgcaccactctcaacctatgcctagatcatactttattactactggggcatcggagacggatatcgctgttaccgggatcgacatttcagcctcactccagactattacaatggagtccctgacggccgaaactatcgattcagtgccaaccctgaccacagcttctgaggtcttcccagaggtggttggtgacgaatccgcattgttaatcgtacccgaagaagataagcagcaacagcagctggatctggagagggaactgcttgagttagaaaaaattaaacagcaacgctttgccgaggaactggagtgggagaggcaggagatccaacgatttcgtgagcaagagaaaattatggtgcagaagaaacttgaagaactgcaatcaatgaagcagcatctgctgtttcagcaagaggaggagcgccaggcccagtttatgatgagacaggagacccttgctcagcagcagcttcagctcgagcagattcaacagctacagcagcaattgcatcagcaactggaagaacagaaaatcagacagatttaccagtacaattatgatccttcaggaaccgcatctccacagacaaccacagaacaggcaatcctagagggacaatacgccgctctggaagggtctcagttctgggccactgaggacgccactacgacagcatctgccgttgtggcgatagaaatacctcagagccagggatggtacactgtgcagtctgacggggtaactcagtacatcgcgccccccggcatcttatccacggtctctgagatcccacttacagacgtcgtggtgaaggaagaaaagcaacctaagaagaggagctcaggggcaaaggtacggggacagtatgatgatatgggagagaacatgaccgacgaccccagaagtttcaagaaaatcgtggacagtggagtccagaccgacgacgaagacgcgactgaccgtagctacgtaagcaggcgaagacggactaagaagtccgtagatacttcagtgcagactgatgatgaagatcaggatgagtgggacatgcctaccaggtcaaggcgaaaggctcgggtcggcaaatacggtgattcaatgactgaagcggacaaaacgaagcccctgtccaaggtgtcttctattgccgttcagaccgtcgctgagatcagtgtgcagaccgagcccgtgggcaccatacgcaccccctctatcagagcgagagtggatgccaaggtcgaaattattaagcacatttctgcccccgaaaagacttacaagggcggaagtttagggtgccagacagaagctgattccgatacgcaaagcccgcagtacctgagtgcgacatctccacccaaggataagaagaggcccaccccccttgaaataggttatagcagtcacctgagggcagacagcacagtccagctggccccctcccctcctaagagtcctaaggtgctttattcccccatatcccctctgagtcctggcaaggctctggagtctgctttcgtaccctacgaaaaaccattacctgacgacattagtccgcaaaaagtgttgcaccctgacatggctaaagtcccccccgcctctcccaaaactgcgaagatgatgcagcggtccatgtctgatccaaagcccctgagccccacagccgatgagtcttccagggctccttttcaatacactgaaggctatacatag

SEQ ID NO: 128861 - DNA, 1635 bp, Artificial Sequence
  Description of Artificial Sequence: Synthetic coding sequence
atggagaagctgcaggagcatttaattaaggccaaggctttcactattaaaaagaccctcgaaatctacgtgcctatcaagcagtttttctacaacctgatacacccggagtacagcgctgttacagacgtgtatgtgctgatgttcctagccgatacagtcgatttcatcatcattgtcttcggcttctgggcgttcggaaaacattcagccgccgccgacataacttcttcactatccgaggatcaggtcccgggcccgtttctggtgatggtgttaatacagtttggtaccatggtggttgacagggccctctacctgcgaaagacagtgctcggcaaggtgatctttcaggtaatcctggttttcggtatccacttttggatgttctttatcctccctggcgtgacggaacggaagttctctcagaacctcgtcgcacaattgtggtatttcgtgaaatgcgtctattttggcctctctgcttaccagatcaggtgcggataccctaccagagtccttgggaattttctcaccaaatcatacaactatgtgaatcttttcctcttccaaggattcagactggtccctttcctcacggagttacgcgcagtcatggactgggtctggacagatactaccctctcactctcctcctggatatgcgtggaggatatctacgcacatatctttattctgaaatgctggagggaatcggagaagcccatcttcaccatgtccgcgcagcaatctcagctgaaagtcatggatcagcagagctttaacaaattcatacaggccttcagccgcgatactggcgccatgcagtttctagagaattatgaaaaggaggacatcacagtcgctgaactggagggaaacagtaattcactctggacaatatctcccccttccaaacaaaagatgatccacgaactgctcgaccctaactcctcattttccgtggtattctcatggtcaattcagcgtaatctttcattaggcgctaagtccgagatcgccaccgataagttaagctttccgctcaaaaacatcacccgaaaaaacatcgccaaaatgattgccggtaattctacagagagcagcaaaacaccagtgacaatcgaaaagatctacccctattatgttaaggccccctcggatagcaacagtaagccaatcaagcagttactgagtgaaaacaactttatggatatcacaattatcctgagtcgagacaataccactaaatacaatagcgagtggtgggttttgaaccttactgggaaccggatctacaatcccaattctcaagctttggagttggttgtctttaacgacaaggtcagccccccaagcttgggattcctcgcagggtatggcataatgggcctttacgccagcgtggtgctggttattggaaagttcgtgagggagttctttagcggcattagccattcaatcatgttcgaggagctgcctaatgtggatcgaattctgaaactctgtacagacatcttcctggtccgcgagactggcgaactcgagcttgaggaagatctctacgccaaactcatcttcctgtaccgtagccctgagacgatgatcaaatggactagggaaaagacaaactag

SEQ ID NO: 128862 - DNA, 8259 bp, Artificial Sequence
  Description of Artificial Sequence: Synthetic coding sequence
atggcttccgaggtcgtgtgcggcttaatctttaggctgctccttcctatctgcttagcagtggcctgcgcttttagatataatggcctgagctttgtttacctcatctacctcttattgattccactgttttctgagccaaccaagaccacaatgcaaggccataccggtcggctgcttaaaagtctgtgctttatctctctgtcctttctcctgctgcacatcatcttccacatcacgctagtttccctggaagcacagcaccggatcgcccctgggtacaactgttctacctgggaaaaaactttccggcagatcggctttgaatccctgaagggggccgatgcgggaaacgggattagggttttcgtgcctgatatcggcatgtttattgcctccctaaccatctggttattgtgtcgtaatattgtgcagaaaccagtaacggacgaggctgcccagtctaatcctgagtttgagaacgaagagctggccgagggggaaaaaatcgactccgaggaggcccttatttatgaggaagattttaatggaggggacggcgtagagggcgagctcgaagagtcgactaaacttaaaatgttcagaaggctggccagcgtggcttccaagctaaaggagtttatcggtaacatgatcactacagccggcaaagttgtcgtaacgatcctgctaggaagctctggaatgatgctgcccagcctgacctctagcgtgtatttcttcgtgttcctggggctgtgtacctggtggtcttggtgtcgaacattcgaccctctgttatttagctgtctttgtgttttgttagctattttcaccgccggacacctcattggactgtatctgtaccagttccagttcttccaggaagctgtaccaccaaatgattattacgctcgcctttttggcattaaatctgttatacagacagattgcagtagcacttggaagatcattgtcaatccggacctgagttggtatcatcatgccaacccgattctgctcttggtaatgtactacacactggctacactgattcgcatatggttgcaggagcccctcgtacaagacgaaggtacaaaggaagaggacaaggccttggcctgttctccaattcagattacagctgggcgtcgtcggagtctgtggtacgccactcattaccctaccgacgaacggaagctgctcagcatgactcaggatgactacaaaccatctgacgggctgttggtgaccgtcaacgggaaccccgtggactatcacacaattcatccatccctgccaatggaaaacgggccaggcaaagcggatttgtatagcactccacagtatcggtgggagccgagcgacgagagttccgagaaacgcgaggaggaagaggaagagaaggaagagttcgaggaggaacgcagccgagaggaaaagaggtctatcaaggtccacgctatggtcagcgtgttccagttcataatgaaacagtcttacatctgtgcgttaatcgccatgatggcctggagcataacctaccattcttggctgacctttgtgctgctcatctggagttgcaccctctggatgatccggaatagacgcaaatacgccatgatctcttcacctttcatggtggtttatggtaacttactactgatcctgcaatacatatggagcttcgagttgccagagattaagaaggtccctggttttctagagaagaaggaaccaggagaacttgcttcaaagattctgttcacaataaccttttggctccttctccggcagcacctcaccgaacagaaggcgctgcaagagaaggaggcactgctgtcagaggttaagatcggctcccaggagaatgaagaaaaggacgaggaactccaggatatacaggtcgaaggggagcctaaggaagaggaagaagaggaagccaaggaagagaagcaggaaagaaagaaggttgagcaggaggaggctgaggaggaagacgaacaggatatcatgaaagttctgggtaatctggtggtggcaatgttcataaagtattggatatacgtgtgtggcggcatgttcttctttgtgtcattcgaggggaagattgtgatgtataagattatttatatggtcttattcttattttgtgttgctctctaccaggtacactatgagtggtggaggaagatcctcaagtatttttggatgagcgtggtcatatacaccatgctggtattgatattcatttatacctaccagttcgaaaactttcccggcctctggcagaatatgaccgggctcaagaaggaaaaactcgaagacttggggctcaaacaattcaccgtggctgagttgttcacaagaatatttatcccaacctctttccttctcgtctgcatccttcatttacattatttccacgaccgctttttagaacttactgatctgaagtcaattccgtccaaagaagacaataccatatacagactagcgcaccccgagggtagcctgcccgaccttactatgatgcaccttaccgcgtcacttgagaaacccgaggtccgaaagttagctgaacccggagaggaaaaacttgaggggtactctgaaaaagcccagaagggcgatctcggaaaagattctgaagagtctgaggaggatggtgaggaggaggaggagtccgaggaagaagaagagacctctgacctccgcaacaaatggcacctggtcattgacagactcacagtcctgttcctaaaattcctcgagtactttcataagctacaggtgtttatgtggtggatactggagttacacatcatcaagattgttagctcctatatcatctgggtgtccgtcaaggaggtatctctgtttaattacgtgttcctgatttcttgggctttcgccctgccttatgcaaaactacgaagattagcctcctctgtttgtaccgtatggacatgtgtgatcattgtgtgtaagatgctgtaccagctgcaaacaatcaagccagaaaatttctctgtgaactgtagccttcctaatgagaatcagaccaacattcctttcaatgaactgaacaaatctcttttgtactctgcgcccatcgacccaacagagtgggttggactccggaagtcatctcctttactagtctatctccgtaacaacctcctgatgctggctattttagcttttgaggttaccatctataggcatcaggagtattataggggacgaaacaatctgactgccccggtgtcaagaaccatcttccatgatattactaggctgcatctggatgatggtctgataaattgcgccaagtactttattaattacttcttctacaagttcggcctggaaacatgttttttgatgtcggtaaacgtgatcggccaacgcatggatttttatgcaatgatccatgcctgttggctgatcgctgtcctttacaggagacgccgcaaagccattgctgagatctggcccaaatactgttgctttctggcttgcattattactttccagtattttatttgtatagggattccgcccgctccctgccgagactacccctggagattcaagggagcctcgtttaacgacaatatcattaagtggctgtatttccccgactttattgtaaggcccaacccagtcttcttggtgtacgatttcatgctgctattatgcgcatctttgcaacgacagatctttgaggacgagaataaggcggctgtgcgaattatggccggtgataacgtggaaatatgcatgaacctcgatgcggcctcctttagtcagcataaccctgtacccgactttatacactgccggtcgtatcttgatatgtctaaggtgataatcttctcctacctgttctggtttgtgctgactattatttttatcacaggcacaacacgcatctctatcttctgcatgggttacctagtggcctgtttttactttttgctatttggaggggacctgctgctcaaaccaattaaaagtatacttcgctactgggattggctgatcgcttataatgtcttcgtgatcaccatgaagaacatcctgtctattggggcatgcggctatatcggcaccttagtccacaactcatgctggctgatacaggctttttccctagcatgtacggtgaaaggctaccagatgcccgctgcaaattcaccctgtacattaccatccggcgaagccggcatcatttgggacagtatctgctttgcctttctgctcctgcagagacgggtatttatgtcctactatttcttacacgtggtggcagacataaaagcctcccaaattctggcctcccggggggctgagctgttccaagccactattgttaaagcggtgaaggcacgaattgaggaggaaaagaagagcatggatcagctgaagcgccagatggacagaattaaggcacgccagcagaagtacaagaaagggaaggaacggatgctcagcctgactcaagagcccggggaggggcaagacatgcaaaagctatccgaagaggatgacgaacgggaagctgacaagcagaaagccaaagggaaaaagaagcagtggtggaggccttgggttgaccatgcctctatggtaaggtccggggactattacctcttcgaaactgattcagaggaagaggaggaagaggagctcaagaaggaagatgaagagccaccccgccggtcagcctttcagttcgtgtatcaagcttggataacggacccgaaaaccgccctgcggcagcggcacaaggagaaaaaaagaagcgcccgcgaagaacgaaagcggaggcgcaagggcagtaaagaaggccccgtggagtgggaggatcgggaagatgaaccgatcaagaaaaagtcggacgggccagataacattatcaaacgcatcttcaacatcctcaagtttacatgggtactgtttttagctacagtggattcttttacaacctggttgaatagcattagccgagaacacatagacattagcacagtgttgagaatagaacgctgtatgctaacacgagaaattaagaagggtaatgtgcctacccgggagtcaatccatatgtattatcagaatcatattatgaatctgtcaagggagagcgggttggacactatcgacgagcacccaggagcagctagcggagctcaaacagcgcaccgtatggacagtttagattctcatgattccatctccagcgagcctacacaatgtacaatgctatactccagacaggggaccactgagacaatcgaagaggtggaagctgagcaggaagaggaggccggaagtaccgctccagagcctcgagaagcaaaggaatacgaagccacgggctatgatgtcggcgcaatgggtgccgaggaggcatcattgacccctgaggaagagttaacacagtttagcaccctggacggggacgttgaggcacctccttcatacagtaaggctgtctcattcgagcatttgtcattcgggagccaagacgattccgccggaaagaaccgcatggccgtctccccagatgactcccggaccgacaagctggggtcctcaattctgccacccctgacacatgagttgaccgccagcgagctgctgttaaagaaaatgtttcacgacgatgagctggaggagtccgaaaagttctacgtggggcaaccccggttcctgcttttgttctacgccatgtacaatacgctcgtggctagaagtgagatggtgtgttactttgtgattattcttaatcatatggtgagtgcatccatgatcaccttgctgctccccatccttatctttctctgggctatgctaagtgtccctcggcccagtcgacggttctggatgatggcgatcgtgtacactgaggtagccatcgtggtgaagtacttctttcagtttggcttctttccatggaataagaatgtcgaggtgaataaggacaagccgtaccaccctccaaacatcatcggtgtggagaagaaagagggctatgtgctatatgacctaatccagcttctggcgctgttttttcaccgctcaatcctaaagtgccatggtctttgggatgaggacgacatgacagaaagcggaatggcacgtgaggaatcggacgacgagctgtctctgggccacgggagacgcgactcctccgattcactgaagtctataaatctcgcagcttctgtggagagcgttcacgtcacattcccagagcagcaaacggcggtgcgccggaagaggagcggttccagttcagaaccctcgcagcggagtagtttctctagtaacaggtcacagagagggagtacatccacacggaattctagtcagaaggggagttctgtcttaagcattaaacagaaagggaagcgagagctctacatggaaaagctgcaagaacatctaattaaggcaaaagcatttaccatcaagaagactttggaaatttatgtgccaattaaacagttcttctacaatctaatccaccccgagtattctgcagtgaccgacgtctacgtgctgatgtttcttgccgacactgtagactttataatcatagtgtttggcttctgggcgtttgggaagcactccgctgcagccgatatcactagctcactcagcgaggaccaggtgcccggcccattcctcgtgatggtgctcatccagtttggcaccatggtggtcgatagagccctgtatctccgtaagaccgtgctggggaaagtcatctttcaggttatccttgtatttgggattcatttctggatgttttttattctgccgggagtaactgagcgaaagttctcccagaacctcgtcgcacagttgtggtatttcgtgaagtgtgtctatttcggtctatctgcctaccagatccgctgtgggtatccaactcgcgtcctaggcaatttccttaccaagtcctacaactacgtgaacttgtttcttttccaggggttcaggctagtccctttcctaacggagctccgcgccgtgatggactgggtgtggaccgatacaactctatcactcagcagttggatctgtgtggaagacatctacgcacacattttcattcttaaatgttggagagagagcgagaaacgctaccctcaacctagagggcagaagaagaaaaaggtcgtgaagtatggaatgggcggtatgatcattgtcctcctcatttgcattgtctggtttcctctgctgttcatgagcttgattaaaagcgtggcaggcgtgataaatcagcccctggacgtttccgtgaccatcaccctcggagggtaccagcctatctttactatgagcgcacaacaatctcaattaaaagtgatggaccagcagtcttttaacaagtttatccaagccttcagcagagacaccggcgccatgcagttcttggaaaactacgaaaaggaagatattaccgttgccgagttagaaggcaatagcaatagtttgtggacaatctctcctccaagtaagcaaaagatgattcacgaactcttagacccaaattcatcatttagcgtcgtcttttcctggagtattcagcgaaatctgtctctcggcgctaaaagtgaaatcgccacagacaaattatcctttcccctgaaaaacataacgcgcaaaaatattgctaagatgatcgctggcaacagcaccgaaagctctaaaacgcctgtgacgattgaaaagatatatccatactatgttaaggctccctccgattccaattcgaaacctataaagcagctcctctcggagaataactttatggatatcactatcatcctctctagagataacaccactaagtacaactccgagtggtgggtcctgaacctgacgggcaaccggatttataaccctaattctcaagccttggaactggtggtgtttaatgataaggtctccccaccttcccttggttttctcgccgggtacggcatcatgggcctttacgcttccgtggtattagttatcggcaaattcgttcgtgagtttttttcaggcattagtcattctatcatgttcgaggagctgccaaacgtcgatcgtatcctgaagctctgcacagacatctttctcgttcgggaaacaggtgaactagaattagaagaggacctgtacgcgaaacttatatttttgtataggtcccctgaaacgatgatcaagtggactcgtgaaaagacaaactag

SEQ ID NO: 128863 - DNA, 1692 bp, Artificial Sequence
  Description of Artificial Sequence: Synthetic coding sequence
atgtccgtggtgatctatactatgctagtgttaatctttatttacacttaccagttcgaaaattttcccggcctatggcagaacatgaccggtctcaagaaggaaaaactcgaagatttgggcttgaaacagttcacagtcgcagaactcttcaccagaattttcataccaactagcttcctattagtctgtatcctgcatcttcactacttccacgatagatttctggagctcactgatctgaagtccatccctagtaaagaggataacaccatttattcccacgcaaaggtaaacggtagggtgtatctgattattaactctataaagaagaagctgcctatccatcaaaacgagcttgcgcatcctgaggggtctctccccgatttaaccatgatgcatttgaccgctagtttggaaaagccagaggtgcgcaaactagccgaacccggggaagagaaattggagggatacagcgagaaagcccaaaagggcgacctgggaaaagactcagaagaatcagaggaagacggggaagaagaagaggaatctgaggaagaggaagagactagcgacctccgcaacaagtggcatctggtgatcgaccggttgacagtgctttttctcaaattcctggaatacttccacaagcttcaagtgttcatgtggtggatactggagttacatattatcaagattgtctccagttatatcatatgggtcagcgtgaaagaggtgtccctgtttaattatgtgttccttattagctgggccttcgcccttccttacgcaaagttgcggagactggccagtagtgtgtgtaccgtgtggacgtgcgtgatcatcgtgtgcaagatgctgtatcagttacaaacgattaaacctgaaaacttcagcgtgaattgctcattgccgaatgagaaccagacgaacatccccttcaatgagctcaacaagtctctcctgtattccgcccctattgatccaacggagtgggtgggacttcgaaaatcctcgcccctgctggtgtatctgcggaacaacttgttaatgcttgctattctggcgtttgaggtcaccatttatcgccaccaggagtattatcgcggcagaaataacctgaccgcccctgtttctcggactatttttcacgacatcacacggctgcatctggacgacggattgatcaattgtgctaagtacttcattaattacttcttctacaagttcggcctggaaacatgctttttgatgtctgtgaacgtgatcgggcagcgcatggatttttatgccatgatacacgcctgctggttaattgcagtcctttataggagaaggaggaaggcgatcgctgagatttggcctaaatactgctgctttctggcgtgcattatcacattccagtacttcatttgcatcggcataccgcccgccccatgcagggactacccctggcggttcaaaggggcctccttcaatgacaacatcattaaatggttgtattttccagattttatcgttaggcccaaccctgtttttctggtttacgatttcatgcttttgctgtgcgcgtccctgcagcgacagattttcgaggacgagaataaggcagccgttagaattatggcgggtgacaacgtcgagatttgcatgaacctcgatgccgccagcttcagtcagcacaatccgtag

SEQ ID NO: 128864 - DNA, 1941 bp, Artificial Sequence
  Description of Artificial Sequence: Synthetic coding sequence
atgaccgaaagcggcatggcccgggaggaaagcgatgatgagttgtctctcggccatggtcgcagggattcttccgactcactcaagtcgattaacctggctgctagcgtagagtccgttcacgtgaccttccccgagcagcagacggcagtgcgacgcaaacggagtgggagctcaagtgagccatcacagcgaagctctttcagcagtaacaggagtcagcgaggtagcacatcgactcggaatagctcacaaaagggcagttcagtgttatccataaagcaaaaaggaaaaagagagctctatatggagaagctccaggaacatctgataaaagcgaaagcattcaccatcaaaaagacgctcgagatctatgtccccattaagcagttcttctataatctcatccaccccgaatacagcgccgtgactgacgtgtatgtccttatgttcctggcagacacggtggattttatcatcattgtcttcggattttgggcattcggcaagcactcggcggctgcggacataacaagcagtcttagtgaagaccaggtaccaggcccattcctcgtcatggtgcttatccagtttggcacaatggtggtggaccgggccctgtacctccgtaagaccgtgctgggcaaagtgatattccaagttatattggtattcggtatacacttctggatgtttttcatcctgccaggggtgactgaacggaagttctcacagaacttggtcgcccagctgtggtacttcgtcaaatgtgtctatttcggactgagcgcttatcaaattaggtgcggatatcccaccagagtcctcggaaacttcctgacaaagtcttataactacgtcaacttatttctcttccaagggtttaggttggtgcccttccttacagaactccgcgcagttatggactgggtgtggaccgataccactctctcgctgtcttcttggatctgcgtagaggatatctatgcccacatctttattctgaaatgttggcgggaatccgagaaacctatcttcaccatgtcagcccagcagagccaactgaaagtcatggatcagcagtcttttaataaattcatacaagccttctcacgagacacaggcgctatgcagtttctggaaaattacgagaaggaggatatcacggtagcagaacttgaagggaactctaactccctgtggactatttccccccctagcaagcagaagatgatccacgagttgctggatcctaactcctccttctctgttgtgttttcttggagtatccagcgaaatctgagcttgggtgcaaagagcgagatagccaccgataaactgtccttccctttgaagaacataaccaggaaaaatatcgctaagatgatcgccgggaatagtactgagtcctctaagacacccgtgactattgagaaaatttatccatattacgtgaaagctccatccgattcaaattcaaagccaattaaacaactactatctgagaacaactttatggatattaccatcatcctaagtcgggataatactaccaaatataatagcgagtggtgggtacttaacctaaccggcaataggatatacaatccaaacagccaggctttggaactcgttgtcttcaacgacaaagtatctccaccttcactagggttcctggccgggtacggcatcatgggcttatatgcctccgtggtgctggtcatcggtaagttcgttagggaattcttttccgggattagccacagtatcatgtttgaagaactgccaaacgtcgaccgcatcctgaagttatgcaccgatatctttctggttcgtgagactggcgagctcgagttggaagaagatctgtatgccaagctaattttcctgtatcgtagtcccgagaccatgattaaatggactagggagaagacaaactag

SEQ ID NO: 128865 - DNA, 2130 bp, Artificial Sequence
  Description of Artificial Sequence: Synthetic coding sequence
atgaccgagtctgggatggctagagaagagagtgacgacgaacttagcctcggccacggcaggagagatagttccgacagcctcaaatcaatcaacctggccgcctctgttgaatcagtccatgtgaccttccccgagcaacagacggccgtgcggcgcaagcgaagtgggagctcttctgagccaagccaacgaagcagctttagctctaaccgcagccaacggggcagtacctcaacacgtaatagctcacagaaagggagctccgtcttgagtataaagcaaaagggtaaacgggagctgtacatggaaaaactgcaggagcacttgatcaaagcaaaagccttcaccatcaagaaaaccttggagatctacgttcccattaaacagttcttttacaatctcatccatcctgagtatagcgccgtcactgacgtctacgtcctgatgtttcttgccgacaccgtggatttcataatcattgtgttcggcttttgggccttcggaaagcattcagccgccgctgatatcacatcatcactgtctgaagaccaagtgccgggacccttcttggtgatggtgttgatccaatttgggacaatggttgtggatagggccttatacttgcgaaagactgtgctgggcaaggtgattttccaggtgatcctcgtcttcggcattcacttctggatgttctttatcctgcccggcgtgaccgagagaaaattctctcagaacctcgtggctcagctttggtatttcgtcaagtgcgtctacttcggcctatcagcctaccagatcaggtgtgggtaccccaccagggtcctgggaaatttcctgactaagagttacaattatgtcaacttgttcctgttccagggcttcaggttagttccctttcttactgagcttcgagctgtgatggattgggtctggacagacacaacgctgtccctcagctcttggatctgtgttgaggacatttatgcccatatttttatcctcaaatgttggagagaatccgaaaagcggtacccacagcctaggggccaaaaaaagaagaaggtggtgaaatatgggatggggggcatgataatcgtgcttctgatttgcatcgtctggttcccgctgctttttatgtctctgattaaaagcgtggccggggtcatcaaccagcccttagacgtgagcgtcacaatcacgctcggcgggtatcagccaatattcaccatgagtgcccagcagagccagttaaaggtgatggaccaacaaagctttaacaagtttattcaggcattctctcgagacacgggagccatgcagttcctggaaaattatgagaaggaagacatcacagtcgctgagctcgaggggaactccaattcactgtggacaataagcccaccttccaagcaaaagatgatacacgagctcttagatcctaactccagtttctctgttgtgttctcctggtccattcagcgcaatctcagcctgggcgctaaaagcgaaatagctacagacaaactcagctttccccttaaaaatatcacacgtaagaacatcgcaaagatgattgccggaaattccactgagagttccaagacacctgtcactatcgagaagatctacccctattatgtgaaggcaccgtcagactccaattccaaaccaattaagcagttgctgtccgagaacaatttcatggacattactatcatcctgagtcgcgacaacaccactaagtacaattcagagtggtgggtccttaatctgacagggaaccggatctataatcccaacagccaggcacttgagttggtagtttttaatgataaggtaagcccaccttctctggggttccttgccggctatgggattatgggactttacgcatccgtggtccttgttattggcaagttcgttcgggaattcttttctggtattagccactctatcatgttcgaggaactgcccaatgtggaccggatccttaaactgtgtaccgacatcttcctggtgagagaaacgggcgagctcgagttagaggaggatctgtatgccaagttgatatttttatacaggtccccagaaacaatgattaaatggaccagggaaaagaccaattag

SEQ ID NO: 128866 - DNA, 2565 bp, Artificial Sequence
  Description of Artificial Sequence: Synthetic coding sequence
atggcattgaggctcgttgcagactttgatctcgggaaggatgtccttccctggctgcgggctcagcgggctgtatcggaagccagtggggcaggaagcggaggcgctgatgtcttggaaaacgactacgaatctttacatgtgctgaatgtggaaaggaatggaaatattatatatacatacaaagatgataagggtaatgtggtctttggtctgtacgactgtcagaccaggcagaatgagctgttgtatacctttgaaaaggatttgcaggtattctcctgcagcgtcaactccgaacgaactctgctggcggccagcctcgttcagtcaacaaaagaggggaagaggaatgagttgcagccaggatccaaatgtcttaccctcttggtggaaattcaccccgtgaataatgtaaaggtgcttaaagcagtcgactcttacatctgggtgcaatttctgtatcctcatatcgaaagccaccccctaccggagaaccatctattactcatttctgaagagaagtatattgagcagttccgcattcacgtggcccaagaagatggcaatcgcgttgtcattaagaacagtggacaccttccacgagataggatagcagaggactttgtgtgggcgcagtgggatatgtcagagcagcggctgtattacatagacctgaagaaatcacgatcgatcttgaagtgtattcagttctatgcagacgagtcctacaatctcatgtttgaagtgccactggacatttcgctgagcaattctggattcaagctggtcaatttcggttgcgactatcaccaatacagggacaaattcagtaagcatctgactctgtgcgtttttaccaatcacactggttcactttgcgtgtgttattcccccaaatgcgccagctgggggcaaattacctattctgtcttttacatccataagggtcactctaaaaccttcaccacatcccttgagaatgttggaagtcacatgaccaagggcatcaccttcttgaatctggattattacgttgccgtgtatcttcctggacatttcttccatcttctgaatgtgcagcacccggacttaatatgccataacctctttttgacaggaaataacgagatgattgatatgttgccacattgccctctacagtcgctttctggctcccttgttttagattgttgttcagggaagctctatagagccctcctcagccagtctagtttactgcagctgctgcagaatacctgtctagattgtgagaaaatggctgccctccactgcgccttgtattgcggccaaggagctcagtttctggaagcccaaatcattcagtggatctccgaaaacgtgagcgcctgccatagcttcgaccttatacaagaattcatcatcgcctcatcttactggagcgtttacagtgagacatccaacatggataagctcctgccccacagttcagtgttgacatggaataccgagatccccggcattacactagttacagaagatatagccttgcctctgatgaaagtgctgagcttcaaaggttattgggagaaactcaacagtaatcttgagtatgttaaatacgctaagccccattttcactacaacaatagcgtcgttaggcgtgagtggcacaatttaatctcagaagagaaaaccggaaaacggaggtcagctgcttacgtaaggaatatcctggacaacgccgtcaaagtgatttcgaatctggaggccagaaatttggggccccgattgactccactcctgcaggaggaggattcgcatcaaagactgctgatgggtctgatggtctccgaactcaaagatcactttttgcgccatctgcaaggagtcgaaaagaaaaagatagagcagatggtgctggactatatctccaagcttctcgaccttatttgccacatcgtggagaccaattggcgaaagcataacctgcacagttgggtgttgcacttcaattcgaggggctccgccgcagaatttgcggtcttccatattatgacgagaatcctggaggccacaaattccctgttcctccctctccctccaggctttcatactttgcacaccattctgggcgttcagtgcctccctctgcacaatttactgcactgtatcgactcaggcgtgctgctgcttacagagacggctgtgatccgtttaatgaaagacttagacaacaccgaaaagaatgagaaattgaaattcagtattattgtccgtcttcctccgctgatcgggcagaaaatttgccggctgtgggatcacccgatgtcctctaatattataagtcggaaccacgtcacccgattattgcaaaattacaaaaagcaaccccgaaattcaatgataaacaagagttcgtttagcgtcgagtttttgcccctgaactatttcatcgagatcttaactgatatcgagtcttcaaaccaggccctctaccccttcgaaggccatgataacgtggatgcagaatttgtggaggaggctgctctcaagcacacggcaatgttgctggggctatag

SEQ ID NO: 128867 - DNA, 528 bp, Artificial Sequence
  Description of Artificial Sequence: Synthetic coding sequence
atgacacggatcctggaggctacaaatagcctattcctcccactgccgccaggctttcacaccctccacaccatattgggagtgcagtgcttgcccctgcacaatctcctgcattgcatcgacagcggggtgcttctgctaaccgaaaccgctgtaattaggctgatgaaagatctcgataatacggagaagaatgagaagttgaagttctctatcattgtaagactaccacccctcatcggacagaagatctgccgactttgggatcatccgatgtcttccaacataatttcgcgaaatcacgtgactagactcctgcagaactacaagaaacagcctaggaactctatgatcaacaaatcgagctttagcgtggagtttctgcctctgaactacttcatagagatactgacagatattgagagctcaaaccaggccctgtacccatttgagggacacgacaacgtggatgcagaattcgtcgaggaggctgccctaaaacatacggccatgttgctcgggttgtag

SEQ ID NO: 128868 - DNA, 873 bp, Artificial Sequence
  Description of Artificial Sequence: Synthetic coding sequence
atggctaacccaaagctactgggcatggggctgtcagaagccgaggctattggggcggattctgctcgctttgaggagcttctccttcaggccagtaaggagttacagcaggcccagaccacacggcccgaatctacgcaaattcagccccagcctggcttttgcataaagaccaactccagcgaagggaaggtgtttattaacatctgccacagtcccagcatccctccacctgccgatgtgacggaggaggagctgctgcagatgctggaagaggatcaggccggtttcaggattcctatgtctttgggcgagccccatgcagagctggacgctaagggacaaggatgcaccgcatacgatgtggccgtgaactcagatttttataggagaatgcaaaactctgattttttacgggaactggttatcactattgcccgggaaggtcttgaagacaagtataatctgcagctgaaccctgagtggcgaatgatgaaaaatcgtccttttatgggcagcatcagccagcagaacatccggtctgagcagaggcccagaatccaagagttaggcgatttgtacaccccagctccagggcgcgccgagagtgggcccgaaaagccacaccttaatctctggctggaagccccggatctcctgctggccgaggttgacttgcctaaactggatggcgccctgggcttgtccctggagataggcgagaacagactcgtgatggggggacctcagcagctctaccacctggatgcttatatcccccttcagattaacagtcatgagagtaaggccgctttccaccggaagagaaagcagttgatggtggcgatgccactgctgcccgttccctcttag

SEQ ID NO: 128869 - DNA, 942 bp, Artificial Sequence
  Description of Artificial Sequence: Synthetic coding sequence
atgctactcagcaagatcaactcccttgcccaccttcgagcggcaccctgtaatgacttacacgccacaaaactggcacccggcaaggagaaggagcccctggagtcacagtatcaggtcgggcctttgctggggtctggcggattcggatcggtttactccggtattagggtgtcagacaacctgccagtggctatcaaacatgtcgaaaaggacaggatctctgattggggcgagctccccaatggaacgcgcgtgcctatggaggttgttctactaaagaaggtgagctcagggtttagcggggtgatcaggctcttagactggttcgaacgaccagattcgttcgtgctgatactggagaggcccgaacccgtgcaggatttgtttgatttcattacagagcggggagctttacaggaagagctggcacggagcttcttctggcaagtgttagaggctgtgcgacactgtcataattgtggggtactgcatcgagatattaaagatgaaaatatactgatagatctgaatagaggagagttgaagcttatcgactttggctcaggcgctttgctcaaggataccgtgtacaccgattttgatgggacccgcgtatactcacctcccgaatggattcggtatcatagataccatggcaggagtgcagctgtatggtctttggggatcctgctctatgacatggtgtgcggcgatatcccctttgaacatgacgaagagataatccgggggcaggtgttcttcagacagcgtgtttcgagtgagtgtcagcatctgattcgctggtgcctcgcccttaggccctccgaccgtccaactttcgaagaaattcagaatcacccttggatgcaagatgtcctgcttccacaggagacagccgagatccacctacattccctgtcccctggcccctctaagtag

SEQ ID NO: 128870 - DNA, 936 bp, Artificial Sequence
  Description of Artificial Sequence: Synthetic coding sequence
atgctgacaaagcctttgcagggcccccctgcccctccagggactccaactccaccccctggcggaaaggacagagaagccttcgaggcagaatataggttgggccccttgcttggcaagggcggattcggcaccgtgttcgctgggcatcgcctcaccgaccggctgcaagttgctataaaggtgatcccccggaatcgggtcctgggttggagcccattaagtgacagcgttacttgtccgctggaggtggccctcctttggaaggtgggcgctgggggaggtcatcctggggtgattcgcctcttagattggttcgaaacccaggaaggctttatgctggtattggaacgccccttgcccgcccaagacctatttgactacattacagagaaaggccctttgggggaggggccctcccggtgtttctttggccaggtggtcgcagccatacagcactgccacagcaggggagtcgtgcatcgggacatcaaagacgaaaacatcctgatcgatctgagacgtggttgcgctaaacttatcgacttcggatccggtgcattgttacatgacgaaccttacacagacttcgacggaactcgagtgtactctcctcctgaatggatttcgaggcatcaatatcatgctctgcctgccacagtttggagtctgggaatcctcttatatgacatggtgtgtggggatatacctttcgaacgcgaccaggagattctcgaagcggagttacatttcccagcccatgtctcacctgattgctgcgccttgatccgccggtgcctggctccgaaaccgagtagcagaccctcactggaggagattttgcttgacccctggatgcaaacgcccgcagaggacgtacccctgaacccgagtaaaggcgggccggctcccctcgcctggagcctccttccttag

SEQ ID NO: 128871 - DNA, 438 bp, Artificial Sequence
  Description of Artificial Sequence: Synthetic coding sequence
atgttggtcttagagcgccctctccccgcccaggacctgttcgactacatcacggaaaaaggaccccttggggagggccccagcagatgcttcttcggacaggtggtagctgctattcaacactgccacagccggggagtcgtccacagagatattaaggacgaaaacatcctgatcgatctccgtagaggttgcgccaaactgattgactttgggtccggggctttgcttcatgatgagccgtatacagatttcgacggtacacgagtctatagcccaccggaatggatcagtcgccaccaatatcacgccctccccgctacagtttggagccttgggattttactgtacgatatggtatgtggcgatatcccctttgaaagggaccaggagatccttgaggcagaactgcactttcctgcccacgtgtccccatag

SEQ ID NO: 128872 - DNA, 2925 bp, Artificial Sequence
  Description of Artificial Sequence: Synthetic coding sequence
atggcaaaagcaggacgggccggcgggcccccacctggtggtggcgcaccgtggcatttgagaaacgttttgtctgacagtgtagagagctctgacgatgagttcttcgacgcccgcgaggagatggccgaagggaagaacgcgattcttatcggtatgagccagtggaattccaacgacctggtggagcagatcgagacgatgggaaagctggacgagcaccagggggaaggtacggccccatgtacctcctctatcctgcaggagaaacagcgggaattatacagagtctctcttaggaggcagcgcttcccggcccagggaagtattgagatccacgaggacagtgaagaaggatgtccccagcgttcttgcaaaacccatgtgctcctgctggttctccatggtgggaatattctcgacacgggggcaggcgatcccagctgcaaagcagctgacattcacacattttcgtccgtccttgagaaagttacacgcgctcacttcccagccgccttaggacatattttaattaaattcgtgccctgcccagccatatgcagcgaggctttctcacttgtctctcacctgaacccttactcccatgacgagggctgcctgagctcgtcccaagaccacgtgcccctggctgctcttcctttgctcgccattagcagcccacagtaccaggatgccgtggcaaccgtgatcgagagagctaaccaggtctatagagagtttctcaaatcctccgacgggatcggcttttccggacaagtatgcttgatcggagattgcgtgggcggtctgctagctttcgatgcgatctgttactcggccgggccatcaggcgattctcctgccagcagcagccgcaaggggagcatatcaagtacacaggatacgcccgttgccgtcgaagaagactgcagtctggcgagttccaagcgactcagtaaaagcaatatagacatatcctccggccttgaagatgaggaacccaagcggcctcttcctcggaagcagtcagacagttcgacatacgactgcgaagccattacacaacatcatgcgttcttaagcagtatccactccagcgtcttgaaggacgaaagtgagacccctgccgcaggcggcccacagctcccagaggtgagcctggggcgtttcgacttcgatgttagtgacttctttctcttcggttctcctctaggactagtgttagctatgcgccgcaccgtactaccgggcctcgatggattccaagtgcgtcctgcgtgttctcaagtgtactccttctttcactgcgccgatccttcagcctctcggctcgagcccctgctggaaccaaaattccacttagtacccccagtctcagtgcctaggtaccagcgcttccctttaggagacggtcagtccctgctactggcagacgcactacacacccacagcccactattcctggaaggctcctctcgtgactctccccccttactggacgctcctgcttccccgccacaggcaagtcggttccagcgtccaggcaggaggatgagtgaaggttcaagccatagtgaaagctcggaatccagtgattctatggccccagtgggcgcttcccgaattacagcgaagtggtggggcagtaaacgcattgactacgccctgtactgtccggatgtcctgacagcattcccaacagtggctttgccccacctgttccacgcatcatactgggaatctaccgatgtggtcgccttcatactgcgtcaggtgatgcgctacgaaagcgttaacatcaaggaaagtgcccgactggatcccgctgcactaagtccggctaatccgcgagagaagtggcttcgcaaacgcacccaggttaaactgagaaatgtcactgccaatcacagagccaatgatgtgatcgctgcagaagacggtccacaggtgctggtcggccggtttatgtacggccctttagatatggttgcgttgaccggcgagaaagtagacatcctggtgatggccgagccttcaagcggacggtgggtgcacttggataccgagattacaaatagttcaggcaggatcacgtataacgtccccagaccgcgccgcttgggtgtgggtgtgtaccctgtcaaaatggttgtgagaggtgatcaaacttgtgccatgtcctatctgaccgtcttgccacgcgggatggaatgtgtggtgttctctattgatggctcgttcgccgcatccgtctcaatcatgggcagtgatccaaaagtgaggcccggagctgtagatgtggttcggcactggcaggacctcgggtacatgatcctctatattaccggacggccagatatgcagaagcagcgagttgtgagctggctaagccagcacaatttccctcagggtatgatattcttctcagacggcctggtccacgacccgttgaggcagaaggccatctttctacgcaatctgatgcaagagtgctttatcaagataagtgccgcatacggcagcactaaggacatcagcgtatactcggtgctgggtctgcccgctagccagatcttcatcgttggtcgcccaacaaaaaaataccagactcagtgtcagttcctttctgagggctacgcagctcacctggccgccctggaggcgagccaccgctctcgccccaagaaaaataacagcagaatgattctacgtaaaggaagttttggactgcatgcgcaacccgaattccttcgaaaacgcaatcatctccggaggaccatgtctgtgcagcaacctgacccgccagctgctaatccgaaacccgagcgcgcgcagagccagcctgagagcgataaggatcacgagcgacccctgcccgccctttcgtgggcacggggtccaccaaagttcgagtccgtgccttag

SEQ ID NO: 128873 - DNA, 2817 bp, Artificial Sequence
  Description of Artificial Sequence: Synthetic coding sequence
atggcgaaggccggacgcgccggaggccccccaccaggagggggtgctccatggcatctccgcaatgtgctgtctgacagtgtggagagctccgatgacgagtttttcgacgcacgcggcgagggaactgccccgtgtacctcttcaatactacaggaaaagcagagagagctataccgggtctccttgaggcgccagaggtttcccgcacagggctctatcgagattcacgaggatagtgaggagggatgtcctcagcgcagctgtaagacccacgtgctactgttggtattgcatgggggaaacattctcgacacgggggcaggggatcctagctgtaaagccgccgacattcacactttcagttccgtgcttgaaaaagttaccagggcacattttcccgccgcactgggtcacatactgataaaatttgtaccatgtcctgcaatatgttctgaggcgttttcccttgtatctcatctgaacccgtactctcacgacgagggctgtttatccagtagccaagatcacgtgcctctggcggccctgccactgctggctatttctagtccccagtatcaggacgcggttgccaccgtgattgaacgggcgaatcaagtttaccgggaattccttaaatcttcagatgggatcgggttttccggccaggtgtgtctgataggcgattgcgtcgggggattactggcgttcgacgccatatgttatagtgccggtccttccggagattcaccagcttcctctagccgcaagggctctatcagctccacacaggatacccccgtcgccgtcgaagaggattgcagcttggcttcctctaaaaggctaagcaaatccaacatcgatatctccagtggtctggaggatgaggagccaaagcgtccactgcctcggaaacagtctgactcctccacctacgattgcgaggcaattacacagcatcatgcatttctgagtagtatccacagcagtgttcttaaggacgaatctgaaacacccgcagccgggggtccccaactcccagaagttagcctaggtcggtttgattttgacgtttccgactttttcctgttcggcagtccactgggtcttgtcctggctatgcggaggactgtgctgccaggcctggacggcttccaagtgaggcccgcctgttctcaggtgtacagttttttccactgcgccgatccctctgcttcacggctagagcccctgcttgagcctaagttccatctggtcccgcccgtgtcagtccctcgctatcaaagatttccattaggagatgggcagagtctgctgctggcagacgctttacatacacactcaccattgttcctcgagggcagtagtagagattctcccccactcctggacgcaccggctagtcccccacaagcttcacgcttccaaagacccggcaggcgtatgagtgagggctcctcccattcagaaagttcagaatcttctgattcaatggctcctgtgggagcaagcaggatcactgcaaaatggtggggaagtaagcggattgactatgcgttgtactgtcccgatgtcctgactgcctttccaactgttgctttacctcacctcttccacgcgtcatactgggaaagtacagatgtggtagccttcatactgagacaggtgatgcgctatgaatctgtcaatatcaaagagtctgcacgtttggacccagccgctctgagtccagccaaccccagagagaagtggctgagaaaacgtacacaggtaaaactgaggaatgtgactgccaaccatcgcgcaaatgacgtgatcgcggccgaggatgggccacaggtgttagtgggccggttcatgtacgggcccctggatatggtcgcactgaccggcgagaaagtggacattctcgttatggcagagccttcctctggtcggtgggtccaccttgatacagaaattaccaattcctccggtagaatcacttacaacgtgcctcgaccaagaagactaggcgttggcgtgtaccctgtcaaaatggtagtgcgcggcgatcaaacctgtgctatgagttatcttacagtgcttcccagggggatggaatgtgtcgttttcagcatcgacggtagtttcgcagcgtcagtgtcgatcatgggaagtgaccctaaggtccgacccggcgcggtggatgtggtccgccattggcaggatctggggtacatgattctctacatcactggacggcctgacatgcagaagcaacgcgtggtttcatggctgtcccagcacaatttcccccaagggatgatcttctttagcgacggcctagtgcatgatcccctgcgccaaaaggcgatttttttgcgtaacctaatgcaggagtgctttatcaagataagtgctgcatatggcagcacaaaggatatctcagtgtatagcgtgttaggactgcccgcctcccagatttttatagtgggacgacccaccaaaaagtaccagacacagtgccagtttctgtccgagggttatgccgcccacctggcagcactcgaggccagccatcggagcagacccaagaagaacaatagcaggatgatattgcgcaaagggagctttggcctgcacgcccaacctgagttcttgaggaaaagaaatcatttaaggagaacaatgagcgtacagcagccagatcccccagcagccaatccaaaacctgagcgggcgcagtcgcagcctgagtccgataaggaccacgaaaggcccctgcccgccctgtcttgggcacggggaccacctaagttcgagtctgtgccctag

SEQ ID NO: 128874 - DNA, 609 bp, Artificial Sequence
  Description of Artificial Sequence: Synthetic coding sequence
atggcaaccctcatttatgtggataaggaaaatggagaacccggtacccgagttgtggcaaaagacggattgaagctggggtctgggccctccattaaggcgctggacggccgttctcaggtgtctacgccccgattcggaaaaaccttcgatgctccaccagcccttccgaaagccactagaaaggctttggggaccgtgaatagagcaacagagaagtccgtgaagactaaggggcctctgaagcagaagcagccctcgttctcagccaaaaaaatgaccgagaagacagtcaaggctaagtcgtcagtcccagcatctgacgacgcctacccagaaatagagaaattctttccattcaaccccctggacttcgaaagctttgacctcccggaggagcaccaaatcgcgcacctgccactttccggcgtgcccctcatgatcctggacgaagagagagaattggaaaaactgtttcaacttggcccaccttcccctgtcaagatgccatcccctccatgggagagcaacctcctgcagagcccaagctcaattctgagtacgctcgatgtcgaacttccgccggtctgctgcgacatcgatatttag

SEQ ID NO: 128875 - DNA, 609 bp, Artificial Sequence
  Description of Artificial Sequence: Synthetic coding sequence
atggctactctcatttacgtggataaggagaatggagagccgggaacgcgggtcgtggctaaagacgggcttaagttgggcagtggtcccagtatcaaagctctcgacgggcgttcacaagtaagcactcccaggtttggcaagacattcgacgcacctccagccttgcctaaagcaacaaggaaggccttgggaacagtgaatcgggccactgaaaaatcagtcaagacaaagggacccctcaagcaaaaacagcccagtttcagtgctaaaaagatgacagaaaaaacggtcaaagccaagtcaagcgtgccagccagcgacgacgcatatccagaaattgagaagttctttccgttcaatcctctcgacttcgagagttttgatctcccagaggagcaccagatcgctcacttacctctttctggggtgcccctgatgattctggacgaggaaagggaactggagaagctctttcagctgggccctccaagccccgtgaagatgccatcacctccatgggaaagtaacctactccaaagtccatcttctattctgtctacccttgacgtggaattacctcccgtctgctgtgacatagatatatag

SEQ ID NO: 128876 - DNA, 609 bp, Artificial Sequence
  Description of Artificial Sequence: Synthetic coding sequence
atggcaaccctgatatacgtcgacaaggaaaatggcgagcctgggactcgtgtagttgccaaggacggcctgaaactggggtcgggcccttccataaaggccctggacggccgaagccaggtttccaccccccgattcggtaaaacttttgatgcaccaccggctctgcccaaggccacacgcaaggccctgggaactgtcaatcgagctacagaaaagagcgtgaagaccaagggccctctcaagcagaaacaaccatctttcagcgcaaagaagatgactgaaaagactgtaaaggcaaaatcctccgtgcctgccagtgatgacgcgtatcctgaaatcgaaaagttcttcccattcaatcccctggacttcgagagctttgacctgccggaggagcaccagatcgctcacctgcccctgagcggcgtccctctgatgatattggatgaggagcgggaactggagaaactttttcagctcggccctccctcaccagtcaaaatgccatcacctccttgggagtctaatctgttgcaaagtccaagctcaatcttatctacattggatgtcgaattgcctcctgtgtgttgtgacatcgatatttag

SEQ ID NO: 128877 - DNA, 543 bp, Artificial Sequence
  Description of Artificial Sequence: Synthetic coding sequence
atggcccctggcgtagcccggggacctaccccatactggaggctcagacttggaggcgccgccctcctgctgctgctgatcccagtcgcagcagctcaagagccgcctggagccgcttgtagccagaatactaataagacttgcgaagagtgcctgaaaaacgtctcctgcctttggtgcaacacaaacaaggcttgcctggattaccccgtgacctcagtgctccccccggcctctctgtgtaaacttagctctgctcgttggggcgtctgttgggtcaattttgaggccctgatcattacgatgtccgttgttggtggcacactgctgcttgggatagcgatctgttgctgctgctgctgccgaaggaaacgatccaggaagcccgacaggagtgaagaaaaggccatgagagagagagaggagagacgtattcgtcaggaggagaggcgggccgagatgaagacacggcatgacgagatacggaagaagtacggacttttcaaagaggagaacccctatgcacggttcgaaaacaactag

SEQ ID NO: 128878 - DNA, 429 bp, Artificial Sequence
  Description of Artificial Sequence: Synthetic coding sequence
atggccccaggggtcgcccgcggccccacaccctactggcggctacggctgggcggcgccgccctcctgctgctcctgatcccggtggccgccgctcaggaaccgcccggagctgcctgctctcagaataccaacaagacgtgcgaagaatgtttgaaaaatgtttctgcctgccttaagaaaaaaacccggatgctggacttgaagactactaaggcccttcaacacatctctcccgatgctagttgcgaagtgcacgcgccacaacccagtcccgccgggcggcctcgggggcattgtggactgctgacactggcatccgagcccgcatcactgcctgggcaggcggcaggggaacttccgttgaaggactcacccctggtcttgcagaccggcgacctactctttcctgtacacctctgcttttag

SEQ ID NO: 128879 - DNA, 576 bp, Artificial Sequence
  Description of Artificial Sequence: Synthetic coding sequence
atggcaacactgatctatgtggacaaggaaatcggggaacctggcacacgggtggcagccaaggatgtgctcaaactcgagtctaggcccagcatcaaggcattggatggaatctcgcaggtgcttactcggcgtttcggaaagacctatgacgcacctagcgccctgcctaaagcaacccgaaaggccctgggcaccgtgaatcgagcaactgagaaatcagtgaagactaatgggcctcgcaaacagaaacaacccagtttttccgctaagaaaatgacagaaaagactgtcaaaactaaaagctccgtgccagcttctgacgatgcgtatcccgagatagaaaagttttttccattcaatctgttggacttcgagtcttttgatctgcccgaagagcggcagatcgcgcatctgccccttagcggcgtccctctcatgatcctcgatgaggagggtgagctggaaaagcttttccagctagggccgccatcccctgtcaaaatgccttctccaccttgggagtgcaatctgtttgccgtcagtttcaaacatagtgtcgatccaggttgctag

SEQ ID NO: 128880 - DNA, 2586 bp, Artificial Sequence
  Description of Artificial Sequence: Synthetic coding sequence
atgactggccgagccagagcccgtgcacgaggccgggcaagagggcaggagaccgcgcagctggtcgggtccacagcctctcagcagccaggctacatccaacctcgaccacagcctccccctgcagagggcgagttatttggaagaggtcggcagagggggactgccgggggcacagccaagagtcagggcctgcagatttcggctggttttcaggagctgtcactggccgagcgcggaggcaggagacgggatttccacgacctaggggtgaacacacgacaaaacctcgatcatgttaaggagagtaaaactgggtcctctggtattatcgtgcggctctccacgaaccacttccgactgacatcccgtccgcagtgggctctatatcagtatcacatcgactacaaccccctgatggaggcccggcggctgcggtcggccctgctgtttcagcatgaggacctgattgggaaatgccatgcgtttgatggcaccattctcttcctccctaaaagactgcaacagaaggtgactgaggtgttcagcaaaacccgaaacggtgaggacgtcagaatcacaatcaccctaactaacgagcttccccccactagcccaacatgcctgcagttttataatataatctttcgcaggctgctcaaaatcatgaatttgcagcagattgggcggaattactacaacccgaacgatcctatcgacatccctagtcatcggctcgtgatctggccaggattcactacttccatattacaatatgagaatagtatcatgctgtgtactgatgtctctcataaagtcttgaggtccgagactgtccttgacttcatgttcaatttctaccaccagacagaggagcacaaatttcaggagcaggtctcaaaagagctgatcggcctggttgtgctgaccaagtataacaacaaaacttatcgagtggacgatattgattgggatcagaatcccaagagcacctttaaaaaggccgacggctccgaagtttcctttctggaatattatcgtaaacagtataaccaagagattacggacttgaagcagcctgtcttggtgtctcagccaaaaagacgcagggggcccggcggaacattacctggaccggctatgcttattcctgaactctgttaccttaccggccttaccgataaaatgaggaatgactttaatgtcatgaaagatcttgccgtgcatacaagactcactcctgagcaaaggcagagggaagtgggccgtctgatcgactatattcataaaaacgacaacgtgcagcgggagctgcgagactggggccttagtttcgacagcaacctgctttctttctctggcaggattttgcagaccgaaaagattcaccaaggcggcaaaacctttgattacaacccacagttcgccgactggtcaaaggagacacgcggggcgcctctgattagcgtaaagcctctggataattggttgcttatttatacccgccggaactacgaagctgccaactccttgatccagaatttgttcaaggttacgcctgctatgggaatgcaaatgcgcaaggcgatcatgatcgaggtggacgaccggacagaggcttatctgcgggtccttcagcaaaaggtgaccgccgatacccagattgtcgtgtgcttgctttccagcaatcgcaaagacaagtacgatgcgattaaaaaatacctttgcactgactgtcccactccgagtcagtgcgtagttgctcgtaccctgggaaagcagcagacggttatggcaattgcaacaaagatcgctctgcagatgaattgcaaaatgggaggcgagctatggagagtggacatacccttgaagctggtgatgattgtggggatcgattgctaccacgacatgacagctggcaggcgttccattgcagggtttgtggctagcattaacgagggaatgactcggtggttcagtaggtgtatcttccaggacaggggccaggaattagtcgacggtctgaaagtctgcctgcaggctgctctgcgagcttggaactcctgtaacgagtacatgccttccagaattattgtttatcgggacggtgttggagatgggcagctgaagacgctcgtaaattacgaggtgcctcagtttctggattgccttaagtccatcggtcgagggtataatccaaggcttacggtgatcgtagtgaagaaacgggtgaatacaagatttttcgctcagtcaggaggccgactgcagaaccctctgcctggaacagtcattgatgtcgaggtgactagaccagaatggtacgactttttcatcgtctcacaggctgtgagaagtgggtcggtaagccccacacactacaatgtgatctacgacaactcggggctgaagcccgaccacatacagcgcttaacctacaaattgtgtcatatttactataactggcccggagtcatcagagtgcctgccccgtgccagtacgctcacaagttggcatttctcgtaggacagtccatccatagagagccaaacttgtccctgagtaatcggctgtactatctgtag

SEQ ID NO: 128881 - DNA, 369 bp, Artificial Sequence
  Description of Artificial Sequence: Synthetic coding sequence
atgaccggccgtgcaagggctcgcgctagaggaagagcaagagggcaagagaccgcgcagctggtgggcagcacagccagccagcagcctggctatattcaaccgcgtccccaacctcctcccgctgaaggtgaactgttcggcagaggacggcagaggggcactgctgggggcaccgccaagtcccagggcttgcagatttcggctggcttccaggaattatcgctggcagaacgggggggcagacggcgggattttcacgacttgggggtgaatactcgccagaatctggatcacgtgaaagagtctaaaacaggaagtagcggcatcattgtgaggctttcgactaaccattttcggctcacttag

SEQ ID NO: 128882 - DNA, 453 bp, Artificial Sequence
  Description of Artificial Sequence: Synthetic coding sequence
atgacagggagggctcgggccagagcgagaggccgggcacggggccaggagactgctcaactggtgggttcgacagctagccagcaacccggatacattcaaccaaggccacagcctccccccgccgaaggcgagctgtttgggagagggcgccagagaggtaccgctggtggaacagccaagtcacagggattgcagatcagcgccggatttcaggaactgtctctggcagagcgggggggtcggcgccgtgattttcacgatctgggcgtcaacaccaggcagaacctggatcatgtgaaagagtccaaaactgggagttccgggattatcgttcggttgagcacaaatcactttcgattgacttctaggccccagtgggctctttatcagtaccatatcgattacaacccactcatggaggcgcgtagacttaggtctgccctgctttag

SEQ ID NO: 128883 - DNA, 519 bp, Artificial Sequence
  Description of Artificial Sequence: Synthetic coding sequence
atgacaggtcgcgctcgggccagagcgcgcggaagagccagagggcaagaaacagctcagctggtgggtagcaccgcttcgcaacagcctggctacattcaacccaggccccagccgcctccagcagaaggtgagttgtttgggaggggccgacagaggggcactgccggcggcactgctaagagccaagggctgcagatctcagccggctttcaggagttgagtttggcagaacgtggcggccggcgcagagattttcacgatctcggtgtcaatactcgccagaatttagatcatgtgaaggaaagcaaaactggttcatcgggtattatcgttcgactgtctactaaccacttcagactgactagtagaccccagtgggctttataccagtaccatatcgattacaacccactaatggaggcgagaaggctgagatctgccctcctgttccagcatgaagatcttataggtaaatgtcacgccttcgatggcaccattctcttcctgcctaaatag

SEQ ID NO: 128884 - DNA, 498 bp, Artificial Sequence
  Description of Artificial Sequence: Synthetic coding sequence
atgactgggagagctcgagctcgagctcgagggcgcgcacggggccaagagaccgcccagctagtcggcagcactgccagccaacagccaggatatattcaaccaagaccccaacctcctcccgccgagggggaactgtttggaagaggcagacaacgcgggacggcaggggggactgcaaaatcccagggccttcagatttcagccggcttccaggagctaagcctggccgaacgcggaggacgcaggcgggacttccacgacctgggcgtgaacaccaggcaaaacttggatcacgtgaaggagagcaagacagggtcttcaggaattatcgtgcgcctgtcaacgaatcattttaggctgacaagcaggccacagtgggctttgtaccagtatcatatcgattataatcccctgatggaggcccgaagacttcgctccgccttgctctttcaacacgaggatctcatcggaaagtgccacgcatttgacggatag

SEQ ID NO: 128885 - DNA, 2922 bp, Artificial Sequence
  Description of Artificial Sequence: Synthetic coding sequence
atggacccattccgacctagttttcgaggccagtctcccatccacccgagccaatgtcaggctgtgaggatgccagggtgctggccgcaggccagcaagccactggatcctgcgctggggcgcggcgcccccgctggccgcgggcatgtcttcgggaaaccagaagaaccaagtacccagcggggtccagcacaaagagaatccgtcggattggtgtccatgttcaggggattagggatcgagactgtgtccaaaacccctttaaaaagagaaatgcttccaagtgggagaggtatactgggccgcgggctaagcgccaatctcgtgagaaaagatagggaagagctcagcccaactttctgggaccctaaagttttagcagcaggtgactctaaaatggccgaaacttccgtggggtggtcgaggactctgggtaggggaagctctgatgcatctttgctgcctctgggccgggcggccggaggaatttcccgcgaggtcgacaagcctccatgcaccttttctaccccctctcgtggcccacctcaactaagctcaccacctgcgttgccacagtcaccactgcatagcccagaccgccccctcgtccttacggtggagcacaaggaaaaagaattaattgtgaagcaggggagcaagggaaccccccagagcctgggcttgaacttagtcaagatacagtgccacaatgaagcggtctaccagtatcacgtcaccttttctccgaacgttgaatgcaagagtatgcggtttgggatgttgaaagatcatcaggccgtaacaggtaacgtgactgctttcgatggctctatcctgtacctgccggttaaactacagcaggtcctggaactaaagtcccagcgaaagacagactccgctgaaatctccatcaaaattcaaatgacgaaaatcctggaaccctgcagcgacctctgcataccattctacaatgtggtgtttagaagagtgatgaagctcctcgatatgaaactggtgggacgcaacttctatgatccgactagtgccatggtgcttcagcagcacagacttcagatctggccaggttacgcggcctcgatccgcagaactgatggaggtctgttcctgctggcagatgtcagtcacaaggtgattcgcaatgactgtgtactggatgtgatgcatgccatctaccagcaaaataaggagcattttcaggatgagtgtactaaactcctcgtcggaaacatcgtgattaccagatacaataaccgaacctataggattgatgatgtggattggaacaaaacccccaaagactcttttacaatgtccgacgggaaagaaatcacattcctggaatactactcaaaaaattacggaatcaccgttaaggaagaggaccagccgctgttgatacatagaccctccgagcgacaagacaaccacggcatgctgctgaaaggggagattcttttgctgccggagctctcattcatgaccggcatcccagaaaaaatgaagaaggattttagagcaatgaaagacctcgcacaacagataaacctgtccccaaagcagcatcatagcgcccttgagtgcctcctgcaaaggatagcgaagaacgaagctgccacaaacgagctgatgcggtggggtctcagactgcagaaggatgttcataagatcgagggacgtgttctgcccatggagcggattaacctaaagaatacctctttcattacgagccaagaacttaattgggtgaaggaggtgacacgcgacccatctatactgactattccgatgcatttttgggctctgttctaccctaagagagctatggatcaggctcgcgagctggtgaacatgctggaaaagatagctggaccgatcggtatgcggatgtctccacctgcatgggttgaattaaaggacgaccggatcgagacatacgtccgcacgattcaatcaactcttggcgcagagggcaaaattcagatggtagtctgcatcataatgggccctagagatgatctgtacggagccatcaaaaaactgtgttgtgtacagagccctgtgccaagccaggttgtgaatgttcggacaatagggcagccaaccagactccggtctgtcgcccagaagatactcctccagatcaattgcaaactgggtggcgaactctggggggttgacattcctctgaaacaactgatggttattggaatggacgtgtaccatgacccttctagaggtatgcgctcagtcgtggggttcgtggcttctataaatttaacactaacgaagtggtattctagagtcgtctttcagatgccacatcaggagattgtggatagtctgaagctttgcctcgtggggagtctgaagaagttctacgaggtgaatcactgtctcccggagaaaattgtggtgtatagggacggcgtgagcgacgggcaactgaagacagtggccaattacgagattccacagctgcagaaatgtttcgaggccttcgagaactatcagccaaagatggtggtgttcgttgtgcagaagaagatatcaaccaatctgtacttagccgctccccagaactttgtcaccccgaccccagggaccgtggtggaccacaccatcacctcttgtgaatgggtggatttttacctcctggcccaccatgtgaggcagggatgtgggatccctacacactatgtgtgcgttctgaacacagccaatctgtcccccgatcatatgcagcgcctgacgtttaagctgtgtcatatgtattggaactggcccgggacaattcgcgtgccggccccatgtaaatacgctcacaagttagcctttctgagcggccacattttgcaccacgaacccgccattcaactgtgcgaaaacctgttctttttatag

SEQ ID NO: 128886 - DNA, 2922 bp, Artificial Sequence
  Description of Artificial Sequence: Synthetic coding sequence
atggatccttttcggccatcctttagggggcagagccctattcaccccagccagtgtcaggccgtgcgaatgcccggctgctggccccaggcttcaaagcccttagacccagcacttggcagaggagctccagccggcaggggccatgtctttgggaagcctgaggaacctagcacacagcggggcccagctcagcgggaatctgtgggcctcgtgagcatgttcagaggccttggcattgaaacagtgtccaagacccctttgaaaagagagatgctcccatccggtagaggcattctagggcgaggcttaagtgcgaatctggtgcggaaggacagagaggagctttcaccaactttttgggatcctaaagtgctagcggcgggcgatagcaagatggccgagacgagtgttggttggagccgcacactcggtagaggaagctctgacgcaagcctcctccccctgggtcgggccgctgggggcatcagtcgtgaggtcgataaacccccctgcactttttctaccccgtctcggggccctccgcagctctcctcccccccagctctgccccagtctcctcttcactctcctgatcgtccactggtgctgaccgtggaacacaaggaaaaggagctgattgttaaacaaggctccaaagggacccctcagagtctcgggcttaacctcgtgaaaattcaatgtcataatgaggcggtctatcagtaccacgtcacattctctcctaacgtggagtgcaagtcgatgaggtttggcatgttgaaagaccaccaagcagtgacaggcaatgtcactgcttttgacggctccatcctgtatctgcctgtcaaacttcagcaggttctggagcttaagtctcaacgcaaaaccgatagcgctgagatcagtataaaaattcagatgacaaaaattttagagccatgcagtgacctgtgcatcccattttacaacgtggtgtttagaagagtgatgaaacttcttgacatgaagctggtggggcgtaacttttatgatcctacgagtgcaatggtattacaacaacataggctgcagatttggcctggctacgctgcaagtatcaggcggacagacggggggctctttctgcttgccgatgtgtcccataaggtgatcaggaacgattgtgtgctggatgtcatgcacgccatttatcaacagaataaagaacacttccaggacgaatgcaccaagctgctagtgggaaatatagtgataacccgatacaacaatcggacctatcgtatcgacgacgttgactggaataaaacgcctaaggatagctttaccatgtcagacgggaaagaaataaccttcctggaatattattcaaagaactacgggattactgtgaaagaggaagatcaaccactattgatccaccgcccctccgagagacaggacaatcacggcatgctcctaaagggagagatcttattgctccctgagctgtccttcatgaccggaatcccagagaaaatgaagaaagactttagagccatgaaagacctggcacagcaaatcaacttgtctcccaaacagcaccacagcgccctcgagtgcctgctgcagcggattgcaaaaaatgaggccgcgaccaatgagttaatgcgctggggcctgcgcttgcagaaggacgttcataaaattgagggaagagttctccccatggaaaggataaatctgaaaaataccagctttattacatctcaggagctaaactgggtcaaagaggtcacccgggacccgagcatcctcaccattccaatgcacttttgggcactgttttacccaaagagagctatggaccaggctagagagctcgttaacatgctagagaaaatcgcgggccctatcggcatgcggatgagtccccctgcctgggtggagttaaaggatgatagaatcgagacttatgtacggacaatccagtctaccctgggagccgaaggcaaaattcagatggtggtttgtattataatgggcccccgagatgatctatacggcgccataaagaagctttgttgtgtccagtcaccagtcccctctcaggtggttaacgtgcggactataggccagccaacacgacttagaagtgttgcacaaaaaatcttgctccagatcaattgcaagctagggggggagctgtggggagtagatatccccctgaaacagctgatggtgattggcatggatgtgtatcatgatccctccagaggaatgagaagtgtggtgggctttgtcgcctcaatcaatctgaccctgacaaagtggtactcaagagtggtgttccaaatgccacaccaggaaatagtggactcccttaagctgtgcctcgtggggtctttgaagaaattctatgaagtaaaccactgcttgcctgaaaaaatcgttgtttatagggatggggtgagcgatgggcagcttaagactgttgccaattatgaaattcctcaactccagaaatgctttgaggcattcgagaactaccagccaaaaatggtggtgtttgtggttcaaaaaaagatctcaacaaacctgtatttggcagccccgcaaaacttcgtgacccctacccccggaaccgtggttgatcacaccatcacctcttgcgaatgggtggacttctacctgttagctcaccatgtgagacagggatgcgggatcccgacgcactatgtctgtgttttgaatacagctaaccttagtccagaccatatgcaaagactcacatttaaattgtgtcatatgtactggaactggccgggcacaatcagagtgcctgccccctgcaagtatgcacataaactggccttcctgtctgggcatattctgcatcacgaaccagccatccagttgtgtgaaaacctattcttcctctag

SEQ ID NO: 128887 - DNA, 639 bp, Artificial Sequence
  Description of Artificial Sequence: Synthetic coding sequence
atgaaggtgttcaagttcatcggcctcatgattctgcttacgagtgctttctctgcgggctccggacagtcaccaatgaccgtactgtgctctatcgactggttcatggtgacagtccacccctttatgctcaataatgatgtatgcgtccattttcatgaactccacctgggactgggctgcccgccaaaccatgtccagccacacgcgtaccagttcacctatcgggtcactgagtgcggtattcgggcaaaagccgtgagccaggacatggtgatctactcaactgaaattcactactccagcaaggggacacctagcaagttcgttattccagtgtcttgtgctgcccctcagaagagcccgtggctcaccaaaccctgctccatgcgcgtcgctagcaagtccagagctacagctcaaaaggatgaaaagtgttacgaggtcttcagcttaagccaatcctctcagagacccaattgcgattgtccaccctgcgttttctctgaagaggagcacacacaggtgccttgtcatcaggcaggggcccaggaggcccagcccctgcaaccctctcactttctggacatatccgaggactggtccctgcatacggacgatatgataggctccatgtag

SEQ ID NO: 128888 - DNA, 294 bp, Artificial Sequence
  Description of Artificial Sequence: Synthetic coding sequence
atgcgccctctcttatgtgcactgaccgggcttgcccttctacgagcagccggaagtctggccgccgccgagcctttcagccctccgaggggggatagtgcacaatctaccgcttgcgatcgccacatggccgtacagcgccgcctggacgtgatggaggagatggtggaaaagaccgtggatcatcttgggacagaagtcaagggtttgttaggcttgctggaggagctagcttggaacctcccacccggtcctttcagtcccgcgccggatctgctcggcgacggtttttag

SEQ ID NO: 128889 - DNA, 264 bp, Artificial Sequence
  Description of Artificial Sequence: Synthetic coding sequence
atgcgcccactgctgtgcgcacttaccggactcgccttgctgcgggcggcagggagtctggcagctgcagagccattttccccgccgcgcggagatagcgcccagagtacagcctgtgatcgtcatatggctgtgcagcggaggttagatgtcatggaagagatggccagcgagccatggtcctggtcccccgctgtcggcggcggagctcctgccaggcaaaggccccagaaccagccgtgccctctggactttcttccatag

SEQ ID NO: 128890 - DNA, 168 bp, Artificial Sequence
  Description of Artificial Sequence: Synthetic coding sequence
atggctgtgcagcgccgcttggacgtgatggaggagatggtggagaagacagttgatcatttgggaacagaggtcaagggcctgctggggctgctcgaagaacttgcttggaatctgccccctggccctttcagtcctgcacccgatctcttgggtgatggattctag

SEQ ID NO: 128891 - DNA, 2244 bp, Artificial Sequence
  Description of Artificial Sequence: Synthetic coding sequence
atgaaccattctccgctgaaaaccgccctggcttatgaatgcttccaggatcaggataacagcacacttgcattaccttccgatcagaagatgaaaactggaacatccgggagacagagggtgcaggagcaggttatgatgactgtgaagcgacagaagtccaagtcctctcagagcagtactctgagtcattcaaatcgaggctccatgtatgacgggctggcagataattacaactacgggaccaccagcaggtcatcttactattctaagttccaggctggtaacggcagctggggttacccaatctacaacggaactctcaaacgagagccggataacagacggttttcgtcatatagccagatggagaattggtctcgccattatccacggggctcatgcaacacaacgggcgcaggcagcgatatctgcttcatgcagaagattaaagcgagccgctcagagcctgatctgtattgcgaccccagggggaccctgcgcaaaggaacactgggttcaaaaggccaaaaaacaacgcagaaccgctattctttctacagcacgtgcagcggccaaaaggcgatcaagaaatgcccagtcaggcccccctcctgtgccagcaaacaggacccagtgtatataccacccatcagctgcaacaaggacctctcctttgggcactcccgagcatcaagcaagatctgtagcgaggatatcgaatgtagtgggttaactattcctaaagctgtacagtatttgtcatctcaggacgaaaagtatcaggccatcggggcttactacatccagcatacctgcttccaggatgagtcagccaaacaacaggtgtaccaactgggcggaatttgtaaattggtagacctgctgagatcgcctaaccagaatgtgcagcaggcagcggcaggagcgctgagaaatctggtcttcaggtccacaaccaataaactcgaaactcggaggcaaaatgggatccgcgaagccgtgtctctgttgcgccgaaccggtaatgctgagatacagaagcagcttactggactcctgtggaacttgtcttccactgacgagctgaaggaggagctgattgccgatgccttaccagtcctcgccgaccgcgtaataatccctttcagtggttggtgtgatggtaacagcaatatgtcgcgcgaagtggtggacccagaggttttcttcaatgcgaccggatgccttcgaaagcgcctcggtatgcgggaactcctggccctggtgcctcagagagccacaagctcccgcgtgaacctctcctcagccgacgctggacgtcagacaatgcggaactattccggattgattgattctctcatggcctatgtgcaaaattgcgtggctgcctctaggtgtgacgacaaaagcgtggaaaattgtatgtgcgtccttcacaacttgtcatataggctcgatgccgaagtgcccacacgataccgccaactggaatataatgctcgcaatgcgtatactgaaaaatcttccactggctgcttctcaaacaagtccgataagatgatgaataacaactacgactgtcctctcccagaagaggagactaatcccaagggctcgggctggctctaccattcagacgccatacggacctacctaaacctcatgggtaagagtaaaaaggacgctaccttggaggcctgtgctggcgccctccaaaatttgaccgcgtcaaaagggctgatgagttctggaatgagccagctgattgggttaaaagagaagggattgcctcagatcgcacgtctcctccagagcggcaacagtgatgtggtccggtccggtgcttcactcctgtcgaatatgtcacggcacccgcttctgcaccgcgtgatgggcaatcaggtcttcccggaagtaactaggctactaacctcccataccggtaatacatcaaatagtgaggacatcctctctagtgcctgttatacagttcggaacctaatggcctcccagccacaattggccaagcagtacttcagcagttcaatgctaaataatatcatcaacctgtgtcgttcatccgcctcacccaaagccgctgaggcagcccgtctgttattgtcagacatgtggagcagcaaagaattgcagggtgtcctgcgacagcagggattcgatcggaatatgctgggcaccctggccggtgccaactcactgagaaactttacaagtcggttctag

SEQ ID NO: 128892 - DNA, 2244 bp, Artificial Sequence
  Description of Artificial Sequence: Synthetic coding sequence
atgaaccatagtcccctgaagaccgcactagcgtacgagtgtttccaggatcaggacaattccacactcgcactgccgagcgatcaaaagatgaagacaggcacgtctggtcgccaacgagttcaagagcaggtaatgatgactgtgaaaagacagaaatctaaatcatcccaatcctctacactctcacatagcaatcgcgggtccatgtacgacggactcgccgacaattacaactacgggaccacatcccgatcctcgtactactccaagtttcaagccggcaacggttcatggggttacccaatttataacggtactctgaaacgggagccagataatcggagattctcctcctacagccagatggaaaactggagtcgacactatccacgcggatcgtgcaatactaccggcgctggcagtgatatctgcttcatgcagaaaataaaggcatctaggtctgaacctgacctctactgtgaccctcgaggcacactcaggaagggaacactgggtagtaagggccagaagaccacccagaatagatactctttctatagtacatgttcaggacagaaggcgattaaaaaatgtccagtcagaccaccgtcctgtgcatcgaagcaggacccagtctatataccaccgatcagctgtaacaaggacctgagctttggtcacagcagggctagcagtaagatatgcagtgaggacatcgagtgctccggattaaccatcccgaaggccgtccaatatctctcttctcaggatgagaagtaccaggcaattggtgcatattatatccagcatacgtgtttccaggacgagtccgctaagcagcaagtgtatcagctggggggcatttgcaagttggtagacctgttaaggtcccctaaccagaacgtgcaacaggcagctgctggtgccctcaggaacctggtgttccgttccacaaccaacaaactggagacacgacgacagaacggaatacgcgaggcagtcagtctcctgagaagaactgggaatgcggagattcaaaagcagttaacaggcctgctatggaatctgagttctaccgacgagcttaaggaggagctcattgcagatgcactgcccgttctcgcagaccgcgtgatcatcccctttagcggctggtgtgatgggaatagcaacatgagccgggaggtagtagaccctgaggtgttcttcaatgctactggatgcctaaggaaacgccttgggatgagagagctactggccctggttccccagcgagctacttcatcccgcgtgaacctatctagcgcagatgccggaaggcagaccatgcgtaactatagtggactgatcgattcactcatggcttacgtgcagaattgcgtcgctgcatccagatgtgacgacaaatcagtcgaaaattgtatgtgcgtgctgcataacctgtcttaccggcttgacgctgaagttcccactcgatatcgccagctggagtataacgcacggaatgcctacacagaaaagtcttctacaggatgtttctcaaacaagagcgataaaatgatgaataataactatgattgtcctttgcccgaagaagaaacaaaccccaagggatcaggatggttgtaccactccgatgccatcagaacttatctgaatctcatggggaaatccaaaaaagacgctacactggaggcctgcgcgggtgccttacagaatttgaccgccagcaagggattgatgtcctctggcatgtcccagctgattggtctcaaagagaaaggcctgccacaaatagcccgcctcctccagagtggaaatagcgatgtggtgaggagtggagcatctctcctcagcaatatgagtaggcatcctctattgcacagggtgatgggcaatcaggtgtttccagaagttacaagactgctgacttcccatacagggaacactagtaactccgaagacatactcagttctgcgtgctacaccgtccgcaacctgatggcgtcccagccacagctcgctaaacaatacttcagttcttcaatgctcaataatatcatcaatctctgtcgcagttctgcatcacctaaggcggccgaggcagcacgtttgctgctctccgacatgtggtcaagcaaggaactccaaggcgttctgcgacagcagggattcgaccggaacatgctgggaacactagccggcgctaactccttgagaaattttaccagccgtttctag

SEQ ID NO: 128893 - DNA, 2181 bp, Artificial Sequence
  Description of Artificial Sequence: Synthetic coding sequence
atgaaccactcaccactgaagacggcactcgcttatgagtgcttccaagaccaggacaactcgaccctcgcccttcccagtgaccagaaaatgaagactgggacttctggacgccagagagtgcaggagcaggtgatgatgaccgtgaaacgccagaaaagcaagagctcccagtcctcaacgctgtcacactctaaccgcgggagtatgtacgatgggctggctgacaattacaattacggaactacgagccgatcctcctactactctaagtttcaggccggcaacggcagctggggctaccctatttacaatggcacactgaagcgagagcccgataacaggcgattttcgtcttactcccaaatggaaaattggagccgacattaccccaggggcagctgcaacaccactggggctggatctgatatctgtttcatgcaaaagattaaagccagcaggtctgaaccggatctgtactgcgacccaagaggcacattacggaaagggactttaggctctaagggacagaaaaccacacagaacaggtacagcttctactccacctgctctgggcaaaaggctattaaaaagtgcccagtgcgcccgcctagctgcgcctctaaacaggatcccgtgtacatccctccgatctcctgtaacaaggacctgtctttcgggcatagcagagcctcctcaaaaatctgttctgaagatattgagtgctccggcttgacaatcccaaaagccgtccagtacctgagcagtcaggacgagaaatatcaggccatcggggcctactacatacagcatacatgttttcaagacgaaagtgcaaaacaacaggtctaccaactcggcggaatctgcaaattagttgatttgctaaggtcccccaaccagaatgtccagcaggctgccgccggcgccctccgaaatttggtctttaggtcaaccaccaataaattggagacacgcaggcaaaacgggatacgtgaagccgtgagccttctccggcggactgggaatgccgaaattcaaaaacagttaactgggctcctgtggaatctctctagcaccgatgaactgaaagaggaactgattgcggacgcactccctgtcctcgcagaccgagtcataattccatttagcggttggtgtgatggcaacagtaacatgtccagggaggtagtggatccagaggtattctttaatgctaccggctgcctgcggaacttgtcctctgctgacgcaggcaggcagaccatgcggaactatagcggactgattgattctttgatggcttatgttcaaaattgcgttgccgccagccgatgtgacgacaagtctgtggagaactgcatgtgcgtgctgcacaacttatcatatcgcctggatgctgaggtgcctactcgctaccgccaacttgagtataacgctcgcaatgcgtacaccgaaaagagtagcaccggatgtttttcaaacaaaagcgacaagatgatgaacaataactacgattgtcccctgcctgaagaggagaccaatccaaagggtagcggctggctctaccattcagacgcaattaggacctacctaaacctgatgggtaagagtaagaaagatgcaactctcgaggcctgcgcaggagctctgcagaacttgaccgcctctaagggactcatgtcctcgggcatgtcacagctcattggcttgaaagaaaaggggctgccccaaatcgctagattgctccagtccggcaatagtgatgttgtacgtagtggagcctcactgctctcaaatatgagtcgccatcctcttctgcacagggtcatgggcaatcaagtgtttcctgaggtgacccggctgctaacatctcatacgggtaacacctcaaacagtgaagacatcctgagtagcgcttgctacaccgtgcgtaacctgatggcttcacaaccccagctggctaaacagtatttttcttcttcgatgttgaacaacatcatcaacctttgtagatctagcgcatcaccaaaagcagctgaggccgcgcgcttgttactgagcgacatgtggagctccaaggagctccagggggtgttgaggcagcagggattcgacaggaatatgctggggaccctggctggtgccaacagtttgagaaatttcacatcacggttttag

SEQ ID NO: 128894 - DNA, 2646 bp, Artificial Sequence
  Description of Artificial Sequence: Synthetic coding sequence
atggccgctcctggcgcccccgctgagtacgggtacatcaggacagttctgggacagcagattctaggtcaattggatagctcatcactggccctgcctagcgaagcgaaactgaaactcgccggctcatccggcaggggggggcaaacagtgaagtccctgcgcattcaggagcaggttcagcagacactcgcccggaagggaagaagctccgtcggaaatggtaatctgcatcgcacttcaagtgtcccagagtacgtttataatctgcacctggtagaaaacgatttcgtgggggggcggtctccagtcccaaagacctatgatatgctgaaggcagggaccactgccacatatgagggacgttggggcagagggacagcacagtatagcagccaaaagtccgtggaggaaaggtccctgcgtcaccctctgaggcggcttgagatctcccctgattcatcacccgagagagcgcactacacccactcagattatcaatactcacaaagaagccaggccggccacacacttcaccatcaagagtcacgccgggctgcactacttgtcccaccccgatacgcgagatccgaaatcgtcggtgtctctcgcgctggcacaaccagcagacagagacattttgatacttaccaccgtcagtaccaacatggatcggtgtccgatacagttttcgactccatccccgccaatcctgcgctgctaacataccccaggcccggcacatcacgctctatgggtaatctactggagaaagagaactacctgaccgccggactcaccgtgggccaagttcgaccccttgttcctctccagcctgtcactcagaaccgggctagccgttcttcttggcaccagtctagctttcacagcaccaggaccctgcgcgaggcgggcccatccgttgccgtggactcatccggccggcgtgctcacctgaccgtggggcaggctgccgccggaggctcgggaaatctcctgactgagcggtccactttcaccgacagccaattaggcaacgctgacatggagatgaccctggaacgcgcagtgtccatgcttgaagccgaccacatgctcccttcgagaataagcgcagcagcaaccttcatccagcatgagtgcttccaaaagtccgaagcgcgcaagagggtgaatcaactgcgggggatactgaagctcctgcagctcctgaaggtgcaaaatgaggatgtgcagcgggctgtttgcggagcactgcgaaatctcgtgttcgaagacaatgataacaaacttgaagtggctgagctcaacggcgtccccaggctgctgcaggtgcttaaacaaacacgcgatctggaaactaaaaaacaaatcactgaccataccgttaatttacggtctaggaacggctggcccggtgctgttgcacacgcgtgcaacccttcaacccttggaggacagggtggaaggattacccgctctggcgttcgagaccagcctgaccaacacggtctgctctggaatctgtcttctaacgataagctgaagaacctgatgattaccgaagctttgcttactttaaccgaaaatatcattatccccttttctggttggcccgaaggcgattaccctaaggcgaatgggctgctcgatttcgatatattttacaatgtaaccggctgtctgagaaacatgtcttctgcaggggccgatggtaggaaggcaatgagaaggtgtgatgggctgattgattcactggtgcactatgtgcgtgggaccattgccgactaccagcctgacgacaaagctactgagaactgtgtttgtatccttcataatctgtcctaccagttggaggccgaacttcctgaaaaatacagtcagaatatttacattcagaatcgaaacatccagaccgataataacaaaagcattggctgcttcggctcacggagccgtaaggtgaaagagcagtaccaggacgtgccgatgcctgaagagaaatctaacccaaagggagttgagtggctgtggcattcgattgtgatacgaatgtacttgagcctaattgctaagagtgtgcgtaactatacacaggaggccagcctaggcgcattgcaaaacctgaccgccggctctggaccaatgcccacctccgtggcacagaccgtggtgcaaaaggaaagcggactgcagcacacacggaaaatgctgcacgtaggggacccttctgtaaagaagacagctatctcgctactccgcaacctttctcgtaatctgtctctgcagaatgagatcgcaaaagagacacttcccgatctggtgagtattatccccgatactgtcccctcaaccgacttgctgatcgagactacagccagcgcctgctacacccttaacaacataatccagaacagttaccagaacgcacgcgacctgcttaatacaggtggaatccagaagattatggccatctccgccggagacgcatacgcatcaaacaaagcgtcgaaggccgcatcagttctgctgtactcgctctgggctcatacggagctgcaccacgcctacaagaaggcccagttcaagaagactgacttcgtgaatagtcgaacagcaaaggcatatcactctttgaaggattag

SEQ ID NO: 128895 - DNA, 2514 bp, Artificial Sequence
  Description of Artificial Sequence: Synthetic coding sequence
atggcagccccaggcgccccagccgaatatggctatattagaacagtcctgggccagcagattctaggacagctggattcctcatccttagccctcccttcagaggctaaactgaagctcgcgggtagctccggacggggaggccagaccgtgaagtctctgcgtatccaggagcaggtgcaacaaactcttgccaggaaggggcgttcttcagtcggtaatgggaatctccatagaacatcctctgtgcctgaatacgtctataatttacacctggtggaaaatgacttcgtgggaggccgatcacctgtcccgaagacctacgacatgcttaaagcaggcacaaccgctacatacgagggtcgatggggacgaggcacggcccagtactcttcccaaaaaagtgtggaagagcgatctctccgccatccactgcgccgtctggaaattagccctgattcttcccccgagcgagcacattacacacacagcgattatcagtacagccagaggagtcaagcaggccacaccctccaccaccaagagtctaggcgcgcagccctgttagtacccccaaggtacgctcggtccgaaattgtaggagtttcgcgggccggaaccacgagtaggcagaggcattttgatacataccacagacagtaccagcatgggagcgtgagcgacactgtctttgacagcatccccgcaaacccagctctcctgacatacccgcgccccgggactagcaggtctatgggcaatctcttggagaaggaaaattatctgactgctggactcaccgtggggcaagtgaggcccctggtacccctgcagccagtcacacagaacagagccagtcgtagctcctggcatcagtcaagtttccattcaacccgaactctgcgagaagccggaccctccgtcgctgttgacagcagtggacgcagagcacatctgaccgtcgggcaggcagccgccggagggtccgggaatctcctgaccgagaggtcaacgtttacagacagccaattgggaaacgccgatatggagatgacattagaacgtgcggtttctatgctggaagccgaccatatgctgccttctaggatttccgccgccgcaacctttatccagcacgagtgttttcagaagtccgaggctaggaagcgggtgaaccaactccgaggtattttgaagctcctccagctgcttaaggtacaaaatgaggacgtgcagcgcgctgtatgtggcgcactgcgaaatctggtttttgaggacaatgataacaaactggaggtggccgagttgaatggcgtaccccggttactgcaggtgttaaagcagacacgcgacctggaaacgaagaagcagatcaccggcctcctgtggaacctgtcttctaacgacaaactaaaaaatctcatgataacggaagcattgctgacactaacggaaaacatcatcatccccttcagcggttggccagagggtgactacccaaaggctaacggattactagactttgatatcttttataacgtgacaggctgcctgaggaacatgtcctcagccggtgcagatggccggaaggctatgagaagatgcgacgggttgatcgactctctggttcattacgtgcgaggcactatagccgattaccaaccggacgacaaagccaccgagaactgcgtgtgcatcctgcataatcttagctaccagctagaagcagaactcccggaaaaatattcgcagaacatctacattcagaatcggaatatccagactgacaacaacaaatccattggctgctttgggtcacgaagccgcaaagtgaaggagcagtatcaagatgttccgatgcctgaagaaaaaagcaaccccaagggggtggagtggctttggcattccatcgtcatacgcatgtacctgtcattaattgcaaagtccgtgcggaactatacccaagaggcctctctaggcgcccttcagaacttaactgctgggtccggtcctatgcctacttccgtggctcagactgtcgttcaaaaggaaagtgggctccagcatactagaaaaatgcttcatgtcggagacccaagtgtgaaaaagaccgcaatatctctgctccgcaatctgtctcgtaatctgtcactccaaaacgagattgcaaaagaaacccttcctgacctcgtttcaatcattcctgataccgttccatctacagacctgctgatagagactaccgccagtgcttgctatacattgaataacatcatccagaattcctatcagaacgctagggacctcctgaacacgggaggcatccagaagatcatggccatctccgcgggggatgcctatgcgtctaataaggcctctaaggccgctagcgttctgctgtatagtctgtgggcccacaccgagctgcatcacgcttataaaaaagcccagtttaagaagaccgacttcgtcaattcaaggactgcgaaagcttaccatagcttgaaagactag

SEQ ID NO: 128896 - DNA, 2475 bp, Artificial Sequence
  Description of Artificial Sequence: Synthetic coding sequence
atggccgcgcctggggcacccgcagagtatggctacatacggacagttcttggtcaacagatattggggcagctggattccagctcactggctctgccatctgaggcaaagctgaaacttgctgggtccagtgggaggggaggtcagaccgtgaagagtttaaggatacaagagcaggtgcagcagactctcgccagaaaaggcagatcctccgtgggaaacggtaatttacaccgcactagctccgttccagagtacgtgtacaatctgcacttagtcgagaacgactttgtgggaggcaggtcgccggtgccaaagacctatgacatgctgaaggccggtactacagcgacgtacgaagggcggtggggtcgagggaccgcgcagtattcaagccagaagtccgtcgaagagagatctctgcgccaccctctgaggcgactagagattagtccagacagttctccggagcgggcccattatacgcactctgattaccagtacagtcagcgcagccaagccggtcacacactccaccatcaagaatctcggagagcagcactactggtgcctcccaggtatgctcgcagcgaaattgttggagtaagtcgcgccggtactacctctagacagcgccatttcgacacataccatcgccaataccaacacgggtcagttagcgacaccgtttttgatagcattcctgccaatcccgcgcttttaacttacccgaggcctggcacctccagatctatggggaacctactagagaaagagaactatctcacagcaggactgaccgtgggacaggttcggcccctagtacctctccagcctgtaacacagaatcgcgcatctcgcagttcctggcaccagtcttcatttcactctactagaaccctgcgggaagccggcccaagtgttgctgtagactcttccgggaggagagcccacctgacagtggggcaggcggctgccggaggctctggtaacctgctgactgagagatcgacattcacggactctcagctcgggaatgctgacatggagatgaccctcgagagagcagtgagtatgctcgaagccgatcatatgcttcccagtagaatctctgccgcggccacatttattcagcacgaatgctttcagaagagcgaagccaggaagagggtaaatcagcttcgcggcatcctgaagctgctccagcttctaaaggtgcagaacgaggacgttcagcgcgcagtgtgtggtgccctcagaaatctggtgttcgaggacaacgacaacaagctggaagttgctgaacttaacggggtgccccgcctgctgcaggttctgaagcaaactagggacttggagaccaagaaacagatcaccgaccatactgtgaatctgcgctctcggaacggctggcccggggccgtcgcccacgcttgtaaccctagtaccctggggggccagggtggtaggatcacacgaagtggtgtgagggaccagcctgatcagcacgggctgctttggaacctcagtagtaacgataagctgaagaatctgatgataactgaagctcttctgactttgacagagaacatcatcataccattttctggatggccagaaggcgattacccaaaagcaaatgggctcctagatttcgatatcttctataatgttactggctgtctccgaaacatgtctagcgctggtgcggacggcaggaaagcgatgcgccgttgcgatggcctgatagatagtctggtacactatgtccgggggacaatcgctgactaccagcccgacgacaaggccacggagaactgcgtatgcattctccacaatctgtcctaccagcttgaggcagagctgccggaaaagtattcgcagaatatctatatccagaatcggaacatccaaaccgacaacaataagtcaataggatgttttgggagccggagccggaaagtaaaagagcagtatcaagatgtccccatgccggaggagaaatcaaaccccaaaggggtggaatggctgtggcactcaattgtgatccggatgtatctgagcctgatcgccaaaagcgtccgaaactacactcaagaggccagcttgggggcactgcagaacctcactgccgggagtgggcctatgccgacctcagtggcccagaccgtggtgcagaaggagtccggcttgcagcatactcgcaaaatgctccatgtgggtgacccttctgtgaagaaaaccgccatctcactgctgagaaatctgagcagaaacctgtctttgcaaaatgagattgccaaggagacactgcccgacctggtcagtattatacctgatactgtgccgtccacagatctgttgatcgaaactacagctagcgcttgctacaccctgaacaatatcatacagaattcgtatcaaaatgcccgtgaccttctcaatcgtggccaccctgagaactacgggcactag

SEQ ID NO: 128897 - DNA, 2394 bp, Artificial Sequence
  Description of Artificial Sequence: Synthetic coding sequence
atgcaagacggcaacttcttgctatcagctctccaacctgaggcgggtgtgtgttccctggccctgccaagtgacctgcagctcgaccggcgaggcgctgaaggacctgaggcggagcggctgagggccgcgcgcgtccaggagcaggtgcgtgctcgcttacttcagctcgggcagcagcccagacataatggggctgccgaacctgagcccgaagccgagacagccaggggcacctctaggggacaataccataccctacaagctggattctcctccaggtcgcagggtctttctggagataagactagtggattccgcccaattgcaaagcccgcttattcaccggcatcctggtctagcagatcagctgtggacctcagctgcagtagaagactgtcatctgcccataacggcggttccgcctttggcgcagccggctacggaggtgcgcaacctaccccgccaatgcctaccagaccagtatcattccatgaaagaggaggcgtgggcagcagagccgattacgatactctatccttgaggtctctcagacttggtcctggcggactcgacgaccgctatagtctcgtgtccgaacagctcgagcccgctgccacatcaacctacagagcgtttgcttacgaacggcaggcatcatcaagctcatctcgggcaggcgggctggactggcctgaagccactgaggttagccccagccgaacaattcgggccccagctgttcgcaccctacagagatttcaatcctcccatagatctcggggtgtcggcggcgcagtgccaggcgccgtgctggaacccgtggctagggcaccgagtgtgcggtccctgagcttgtctctcgcagattcaggacatctgccagacgtgcatgggtttaatagctacgggtcccacaggacactgcaaagactaagctctggctttgacgatattgacctgccttcagcggtgaagtacctgatggcgagcgaccctaacctgcaggtactgggagccgcatatattcaacataaatgctactccgacgccgcggcgaaaaagcaagcaaggtctttgcaagccgtaccccgcctggtgaagctatttaatcacgctaaccaagaggtgcagcgacacgcaacaggagctatgcgaaatttaatatatgacaatgcagacaataaactggctctggtcgaggagaatggcatcttcgagcttctacggacgctgcgtgagcaggatgacgagttaagaaaaaacgttaccgggatcctgtggaatctgagtagttcggatcatttgaaggatcgcctagctagagatacactcgagcagcttaccgacctcgtgctctcccccctgagtggagctggaggaccgcctctgatccaacagaacgcaagtgaagctgaaattttctacaatgcaaccggtttcttaagaaatctgtcctcagcctcccaggctacaagacagaagatgcgcgagtgtcacggactggtcgacgccctcgtgacatccattaaccatgcactcgatgctggcaaatgtgaagataaatccgtcgagaatgctgtatgtgttctgcggaacttgagctacagactttacgacgagatgcctcccagcgccctgcagaggttagagggccggggccggagggatctggcgggggcaccacctggggaggtggtgggttgcttcacgccccaatcaaggagactccgcgagttacccttggccgcagatgccctaacttttgccgaggttagcaaggatcctaaaggtcttgagtggctgtggtccccacagatcgtggggctgtataacagactgctacagcgatgcgagctgaaccggcacaccacagaggccgcagctggcgctctccaaaacataaccgccggcgacaggagatgggccggcgtgctttctaggctagcccttgagcaggaacggatccttaatccgctcctggatagggtcaggaccgctgaccaccaccagctgaggagcctgactggactgattagaaacttatctcggaacgcacggaacaaagacgaaatgtcgactaaagtcgttagccacttgattgaaaagctgcccggttcggttggagaaaagagtccgccagccgaggtgttggtaaacatcatagcggttctgaacaacttagtagtggctagccccatcgccgcgagggacctgttgtatttcgatggcctgcggaaactcatctttatcaaaaaaaaacgcgactcgcctgatagcgaaaagtcctctagagccgccagctccctgctagccaatttatggcagtacaataagctgcaccgtgactttcgggccaaaggctataggaaggaggactttcttggaccttag

SEQ ID NO: 128898 - DNA, 276 bp, Artificial Sequence
  Description of Artificial Sequence: Synthetic coding sequence
acagccttcaggaggacccccggagaggagttcgcgtggcgggaccctgagctgcctgaagtcatacacatgctgcaacaccagtttccctcagttcaggcaaacgctgccgcatacctacagcatctctgcttcggtgacaacaaagttaaaatggaagtgtgtagactcggaggcattaagcacttagtcgatttgctggatcatagggtcgggtcttcagaggagtgcctctggtgcccgtcaaagcctagattttggcaggtgtacagatag

SEQ ID NO: 128899 - DNA, 3450 bp, Artificial Sequence
  Description of Artificial Sequence: Synthetic coding sequence
atgccggcaccagagcaggcatccctcgtcgaggaaggccagccacagactcgccaggaggccgcctccaccggaccgggcatggaaccagaaacgacggccacaacgatcttagccagtgtgaaggaacaggagctgcagtttcagcggctgacaagagagcttgaggttgagaggcagatcgtggcttcacagctggaaagatgtcgcttaggagccgagagtccatccatcgcaagtacaagctcaacagagaagtccttcccctggcgcagcaccgatgtacctaacactggggtcagcaagcctagagtgagtgacgcggtccaaccaaataactaccttatcaggaccgagccagaacaaggaactctgtactctccggaacaaacatccctgcacgagtccgagggcagtctcggaaattcgaggtctagcacccagatgaacagctacagtgattctggataccaggaagccggctcattccataactctcagaatgtcagcaaagctgacaatcgccagcagcactcttttataggcagtaccaacaatcacgtggtacgcaatagcagggctgagggacaaaccctggtccagccctcagtggcaaaccgtgcaatgaggcgggtaagcagcgtgccaagtcgggctcagtccccctcttacgtgatttcaacaggagtgtctccttcaaggggaagcctgagaacttcattaggcagcggtttcgggagtccttctgttacagacccccgaccgctgaacccttccgcatatagctccacaacacttccggcggccagggcggccagtccctatagccagcgtccggcttccccgacggctatccgtcggattggaagcgtgacctctaggcagacaagtaaccctaatggcccaaccccccaataccagaccaccgctcgtgtcgggtctcccctcactctgacagacgcccaaacccgtgtcgcgtctccaagtcaggggcaggttggaagctccagtccaaaaaggagcgggatgaccgcagtgccacagcatctgggtccgtctctccaaagaacagtacatgatatggagcagtttggacagcagcagtatgatatctatgagcgcatggtccctccacgccctgacagtttgacgggactcagatcaagttatgcttcgcagcactctcagcttgggcaggatctgcgcagcgccgtgtcacccgatctgcacatcacgccaatttacgaagggcgtacttactacagtcctgtttaccgcagcccaaaccatggcacggttgagcttcaaggctcccaaacagccctctatcggactgggtccgttggtatagggaatctgcagcgcacaagttctcagagatcaaccttaacataccagcgtaacaattatgcactgaacacaacagcaacttacgccgagccctaccgaccaatccaataccgtgttcaggagtgtaattacaataggctgcaacacgcggtaccagccgacgatggcaccaccagaagcccttccatcgacagcatccagaaagacccgagggagtttgcctggagagaccccgagctgcccgaggtgatccatatgctccagcatcagttcccgtcagtacaggctaatgccgccgcctacctgcagcacctttgctttggagacaataaagtgaaaatggaagtctgccggctgggagggattaagcatctggttgatctgttggatcaccgcgtgttggaggtgcagaagaacgcctgcggagccctaaggaacctggtttttggcaaaagcactgatgaaaataaaattgccatgaaaaacgtcgggggcatcccagcactcctccggctgcttagaaaatcgattgacgctgaagtccgcgagctggtgacaggcgtgctttggaacctcagctcctgtgatgctgtgaagatgacgataatcagggatgctctgtctactctcactaacactgtgatagtgcctcattccggctggaataattcttcctttgacgacgatcataagattaaatttcagacctccctggtgctgcgcaacacaaccgggtgtctccggaacctttctagcgcaggcgaggaggccagaaaacagatgcggagttgcgaaggactggttgatagtttactctatgtgatccacacatgcgtgaatactagcgattacgatagtaaaaccgtggagaactgcgtgtgtactcttagaaacctcagttacagactggagctggaagtacctcaagcaagacttctgggcttgaacgagcttgatgaccttctgggcaaggagtctccatccaaagattcggaaccatcttgctgggggaaaaaaaagaagaaaaaaaaaagaactccacaggaggaccagtgggatggagtaggccctatccccggccttagcaaaagtccaaaaggcgtcgaaatgctctggcatccgagtgttgtgaagccttatctcactttgttagcagagtccagcaatccggccaccctggagggatcagcggggagtcttcagaatctgtcagctggcaactggaaattcgctgcctacattcgtgccgctgtcaggaaggaaaaaggcctacctattttagtcgaacttctcaggatggataatgatcgggtggtttcttccgtggccaccgcgttaagaaacatggcactggatgtgcgcaacaaagagttgatcggtaagtatgctatgagagatctggtgaacagactgccaggtgggaacgggccttccgtgctgtcagatgaaaccatggcagcgatttgttgtgccttacacgaagtgacctcaaaaaacatggaaaatgctaaagctctcgccgatagtggcggaatcgagaagctggttaacataaccaaaggccggggcgatcggtcttccctcaaggtggtgaaggcggccgcacaggtgctgaatactctgtggcagtacagagacttgcggtctatatataaaaaggacggctggaatcagaatcacttcattacccccgtgtccactcttgagcgggatagattcaaaagtcatccctccttgagcaccaccaatcaacaaatgtcccccatcatacagagcggaagctctaaaccttcacccatctacatttctagttactcctcccccgccagagaacaaaaccgccggttacagcaccagcaattgtactatagtcaggatgacagcaacagaaaaaatttcgacgcgtaccgtctctacctccagtctccccacagctatgaggatccttattttgatgatcgcgtgcactttcccgctagtaccgactactcgactcaatatgggctgaaatccactacgaattacgtggatttttacagcactaagcggccaagctacagggctgaacaatacccagggagccccgattcctgggtatag

SEQ ID NO: 128900 - DNA, 3579 bp, Artificial Sequence
  Description of Artificial Sequence: Synthetic coding sequence
atgcccgcccctgaacaggctagtttagtggaggagggccagccccagactcggcaggaagccgcctccacaggcccaggcatggagcctgaaactacagccacgaccattctggcatccgtcaaagaacaggagctacaattccagagattaacaagggagctggaagtggaaagacagatcgtggcgtcacaactggagcgctgtaggctgggagctgaatccccgtctatcgcttccacatccagcacagaaaaatcctttccttggcgatccacggatgtgccaaacaccggagtgtccaagcctcgcgtgtccgatgcagtgcaacctaacaattacctaatccgcaccgagcctgagcaggggacactttactcacctgagcaaaccagcttgcacgaatctgagggttcgcttgggaatagccgctcatctacccagatgaatagctacagcgactcaggatatcaggaggccggcagtttccataacagccagaatgtctcaaaagcagataatcggcagcaacatagttttatcggctctaccaacaaccatgtcgtgcgcaacagcagagccgagggccagaccttagttcagcccagtgtggctaatcgtgcgatgaggagggtctcctcagtgccttcaagagcccaatcacctagctatgtgatctctaccggagtttcaccttcaaggggcagtttgaggacatctctcggcagtggcttcggttctcccagtgtgactgaccctaggcccctgaacccgtcggcctactcctctacaacgctgccagcagcgcgcgcagcttccccctacagccagaggccagctagcccaacagccatcagacgcatcggttctgtgaccagccgacaaacctcaaatcccaatggccccacaccccagtaccagaccacagctcgggtcgggagccccctgaccttaactgacgcccagacgcgggtggcatctccttcccagggccaagtggggagcagtagcccaaaacgctcagggatgaccgctgtgccacagcacttgggaccatcgctacagcgcacagtacacgatatggaacagtttgggcaacagcagtacgacatttatgagcggatggtccccccccgccccgactccttgaccggcctcagatcaagctatgcatcccagcattcccagctgggccaggaccttcgctccgccgtcagtcctgacctgcacataaccccaatatatgaagggcggacttattattctccagtgtataggtcgcctaatcacggaaccgttgaacttcagggcagccagacagcactctatcgaaccggctcagtcggcatcggaaatcttcagaggacttcctcgcagcggtccacactcacgtatcagagaaacaattacgccctaaatacaaccgccacatatgcagagccatatcgtcctatacagtatcgcgtccaggaatgcaactacaatcgcctgcagcatgcggtccccgcagacgacggcactacaagatcacccagtattgacagcatacagaaggaccctagggaatttgcctggcgcgaccctgaactccctgaagtgattcacatgttacaacaccagttcccgagtgtccaggccaatgccgctgcctatctccagcacttatgcttcggggataacaaggtgaagatggaggtgtgtaggctagggggcatcaagcatttggtggacctccttgaccacagggtgctggaagtacagaagaatgcatgcggagcccttagaaacctggtgtttgggaaaagcacagatgagaataagatagctatgaagaacgttggcgggattccagctctgctgcgccttttgaggaagagcatcgatgctgaggtgcgggaactcgtgactggcgtgctgtggaacctgtcttcatgtgatgcagttaagatgactataatccgtgacgctctgtctacactgacaaacaccgtgatagtgcctcacagtggttggaacaattcttctttcgatgacgatcataaaatcaagtttcagaccagtcttgtgttgaggaacactaccgggtgcctgcgaaatctctctagcgctggggaagaggcgcggaaacagatgagatcctgtgagggcctcgtagactccttgctgtatgtaattcatacctgtgtaaacaccagcgactatgacagtaagacggttgagaactgcgtgtgcaccttgcgcaacctgtcctataggctggaactggaagtgccacaggcccgcctgctcggattgaatgagctggatgacctcctgggcaaagaaagcccatctaaagactccgaaccaagctgttggggcaaaaaaaagaaaaagaagaagcgcaccccccaggaagatcagtgggatggggtgggccccatacctggcctgtcgaagtcccccaaaggcgtggaaatgctgtggcacccctctgtagtgaagccctatctcaccctgctcgctgaaagctctaatccggcaacactggagggatccgctggctcactgcagaatctgtctgcaggcaactggaaattcgctgcttacatcagagccgccgtgcgcaaagaaaaaggactgcctattctggtcgagctcctgaggatggacaatgacagagtggtgagtagcgtggcaactgcactgcgcaacatggccttggacgtgagaaacaaggagctgatcggaaagtacgccatgagggacttggtgaaccgcctgccaggcggtaatggaccctcagtgctgtctgatgagaccatggctgcaatctgttgcgctcttcacgaggtcaccagcaaaaacatggaaaacgctaaggcgcttgccgattctggtggcatcgaaaagctcgtgaatatcactaaaggacgtggggataggagcagtttaaaagtggtcaaggcggctgcccaagtcctcaatactctctggcagtatcgggacctcagaagcatctataaaaaggacggctggaaccagaaccatttcatcactccggtgtccaccttagaacgagataggttcaaaagtcatccttctttgagcacgactaaccagcagatgtcgccgatcattcaatccgtgggcagcacctccagcagcccagccctcctgggtatccgcgacccgcggagcgaatacgacaggacgcaacctcctatgcagtactacaattcccagggagacgctactcacaagggtctctatcccggctcctccaagcccagcccgatctacatctcttcctatagctctcccgccagagagcaaaatcgacggttgcagcaccaacagctgtattatagccaggatgacagtaaccgcaaaaacttcgatgcatatcggttgtacctgcagtcacctcacagttatgaggacccttattttgatgaccgggtccacttccccgcctccacggactattctacccagtatggtcttaaatctacaactaattacgtggatttttacagtaccaagcgtccgagctacagagctgagcagtacccaggcagcccggattcgtgggtgtag

SEQ ID NO: 128901 - DNA, 1845 bp, Artificial Sequence
  Description of Artificial Sequence: Synthetic coding sequence
atgaactcatattccgacagtggctaccaggaggccggctcttttcacaatagccaaaatgtgagtaaagctgacaacaggcagcagcacagctttatagggtctaccaataaccacgtggtgcggaatagccgggccgagggacagaccctggtgcaaccatctgtcgccaatcgcgctatgcgcagagtgtcatcagtccccagcagagcacagtcaccttcttacgtgatctccacaggagtatctccatctagaggatctctaagaactagtctgggatctggattcggcagcccatcggtgacagaccccaggccactgaatccctctgcctattcttccaccacactcccagccgcccgagcagcctcgccttactcacagagacctgcatcccccaccgccatccgacggatcggttcagtgacttctaggcagacatctaatcccaatggtcccactcctcagtatcagacaacggcccgggtcggaagcccacttactcttaccgacgcacaaactcgcgtggctagcccatcacagggacaggttggcagcagctctccaaagcgctcaggcatgactgctgttccgcagcacctggggccaagccttcaacgcacggtgcacgacatggagcagttcggccaacaacagtacgacatctacgaaaggatggtgccccccagaccagattcgctcactgcctacggggtgcccatgttggtgtcaattgtgtctctgggaaagacatttgtgctaccatgcccggatcttcacataacgcccatctacgagggcaggacatactatagccctgtttaccggtcccccaatcacggaacagtcgagctccagggctcacagaccgctctgtataggacaggttcagtgggcattggaaatctgcagcgcaccagttcccagagaagcacgctcacttaccagagaaataattacgcacttaacacgacggctacgtacgcagagccttataggcctatccaatatcgcgttcaagaatgtaactacaaccggctgcagcatgccgtccctgccgatgatggaaccacacggtcaccttccatcgactctatccagaaggatcctcgggagtttgcttggcgagatccagagctgcctgaagtgattcacatgctacaacaccagtttcccagcgttcaggcgaatgcagccgcgtacctccagcatctgtgttttggcgacaacaaggtgaagatggaagtttgcaggctaggggggattaaacacctcgttgatcttctggaccacagagtactggaagtgcagaagaacgcatgtggagctcttcggaaccttgtatttggtaagtccacagacgagaataaaattgccatgaaaaatgtgggtggtattccagctttgctcagattgttgagaaagagtatcgacgcagaggtccgagagctcgtcaccggagtactctggaaccttagcagctgcgacgccgtcaagatgaccataatcagagatgccctgtccaccctgactaacacagtcatcgtcccgcattctggatggaataactcttccttcgacgacgaccataaaattaagttccaaacatcacttgtgctccgtaataccaccggctgcctgcgcaacctcagctccgctggagaagaggcgcgcaagcagatgaggtcttgcgaggggttggtggattccctgctttacgtaattcatacatgtgtgaatacaagcgattatgactccaagaccgtggaaaattgtgtatgcaccctgcgcaaccttataggttggtcgtggcgctgtcctcgcccaggttactgggactag

SEQ ID NO: 128902 - DNA, 1329 bp, Artificial Sequence
  Description of Artificial Sequence: Synthetic coding sequence
atgggactcgctatggaacacggtggatcgtacgcaagggctggcggttcaagcagaggctgctggtattacttgaggtatttcttcttattcgtctcactgattcagttccttatcatccttgggctggtgctctttatggtatacggaaacgtccacgtgtctaccgagtctaacctacaggcgaccgagaggagggcggagggactgtattcgcagctgctgggcctgaccgcatcccagagtaacctgaccaaagaactgaattttactacacgcgccaaggacgccataatgcagatgtggcttaatgcccgaagagatctggaccggatcaacgcaagcttccgacagtgccagggagaccgcgtaatctacaccaacaatcaacgttacatggcagcaattatactgagcgagaagcagtgccgcgatcagtttaaggatatgaataaaagctgtgacgctctcctgtttatgctgaaccaaaaagtaaagaccctggaggtcgagatagctaaggaaaaaactatttgcacaaaagacaaggagtcggtactgctgaacaaaagggtcgcagaggaacaacttgtggagtgtgtgaaaacgagagaattgcaacaccaggagagacagttagcaaaagagcagctgcagaaggtgcaggcattatgtctcccacttgacaaggacaagtttgaaatggatctgcgcaacctgtggcgtgattcgatcatcccaaggagtctggacaatctgggttataacctgtatcaccctctgggatccgagctcgccagtattcggcgggcctgcgatcacatgccgtcacttatgagcagcaaagtggaggaacttgccaggtccttacgcgccgacatcgagcgggtggccagagaaaattcagacctgcagcggcagaaactggaggcgcagcaggggctcagggcctcccaggaggccaaacagaaggtggaaaaggaggctcaggctagagaagccaagcttcaagccgagtgtagccgacagacacaactggcactcgaggaaaaggccgtgcttcggaaggagcgggataacctggctaaggagctggaggagaaaaaacgagaggctgaacagctgaggatggagctggccatccggaatagcgccttagatacgtgtatcaaaacgaaaagtcaacccatgatgccggtatcacggcccatgggccccgtgcccaacccccaacccatcgatcccgcatcattagaagaatttaaacgtaagatcctcgaatcccaacgcccccccgccgggattccggtcgccccttccagcgggtag

SEQ ID NO: 128903 - DNA, 291 bp, Artificial Sequence
  Description of Artificial Sequence: Synthetic coding sequence
atggagcacaaggaggtggtgttactactgctcctgttcctgaagagcggtcaaggagagcccctggatgactacgttaacacccagggccctagcttgttctctgtgaccaaaaagcaattgggcgcgggctctcgcgaagaatgcgcggccaaatgcgaggaagacaaggaattcacatgtagagccttccagtaccatagcaaggagcaacaatgtgtgattatggccgagaatagaaagagctcaattatcattcgcatgagggatgccgtattgtttgagaagtag

SEQ ID NO: 128904 - DNA, 291 bp, Artificial Sequence
  Description of Artificial Sequence: Synthetic coding sequence
atggaacataaggaagtggtgttgttgcttcttctatttctgaagtctggtcaaggggagcccttggatgactatgtaaacactcaggggcccagcctgttcagcgtcactaaaaagcagctcggcgcagggtcacgggaggaatgcgccgccaaatgtgaggaagataaggaattcacatgccgggccttccagtatcatagcaaagagcagcaatgtgtcataatggcggagaatcggaagagctccatcatcatacgcatgcgcgacgctgttctgttcgagaagtag

SEQ ID NO: 128905 - DNA, 291 bp, Artificial Sequence
  Description of Artificial Sequence: Synthetic coding sequence
atggaacataaggaagtggtgctgctgttgcttttgtttctaaagtccggacagggagaacctctcgacgactacgttaatacacagggacccagtctgttctctgttaccaagaaacagctgggagccggctcccgtgaggaatgtgcagccaaatgtgaggaagacaaggaattcacatgccgggcctttcagtaccactcaaaagaacagcagtgcgttataatggctgaaaaccgcaagtcatccatcataatccgaatgcgagacgctgtgctgtttgaaaagtag

SEQ ID NO: 128906 - DNA, 492 bp, Artificial Sequence
  Description of Artificial Sequence: Synthetic coding sequence
atggatgcactggagggagagagttttgctctttctttttcctcagcgagcgacgctgaatttgacgccgtggtgggatatctagaggatatcataatggatgatgaatttcagctactgcaacgaaattttatggacaaatattacctcgagtttgaagatactgaagagaacaagctgatctatacccccatcttcaacgagtatatttccctggttgagaagtatatcgaagaacagctgttgcagcggatcccagagttcaatatggccgcttttacgacaacgctacagcaccataaggacgaagttgcaggagacattttcgacatgcttctgacgtttacagactttctggcttttaaagagatgttcttggattatcgagcagagaaagagggcaggggactagatctgtccagcggactggtggtaacatccctgtgtaagagctcctcgctgccagcatctcagaacaatttacggcactag

SEQ ID NO: 128907 - DNA, 1890 bp, Artificial Sequence
  Description of Artificial Sequence: Synthetic coding sequence
atggaaaatagcacgaccactatatcacgagaggaactggaagaactgcaagaggccttcaacaaaatcgacatcgacaactcagggtacgtaagcgattatgaattacaagatctgttcaaagaagcctccctcccgctgcctggctacaaagtccgggaaattgttgagaaaattctgtccgtggctgatagcaacaaggatggaaagatttcctttgaggagtttgtgagtctgatgcaagaattgaaaagcaaggacataagcaaaacttttaggaaaataataaacaagcgggaaggcattactgctatcggagggacttctacaatcagctcagaaggaacgcaacattcgtacagcgaggaggaaaaggtggcctttgtgaattggatcaataaagctctcgagaacgaccccgactgtaaacatctcataccaatgaatccaaatgatgatagccttttcaaatccctggccgacggtatcttgctgtgcaagatgatcaacctcagcgagcccgacacaatcgatgagagggcgatcaataaaaagaagcttactcccttcactatatcagagaacctcaatttggctctgaattccgctagcgccattggctgcaccgtagtcaacataggcgcctcagatctgaaggagggtaaacctcaccttgtcctggggctgttatggcaaattatcaaggtgggcttattcgctgacatcgagattagcagaaacgaggctctcatagcattgctgaacgaaggcgaagaactggaagagctcatgaagctgagtcctgaagaactattgctccgctgggtgaattatcacctgactaacgccggctggcacaccatctcgaatttttctcaagatataaaagactccagggcctactttcatctcctcaatcaaatcgcaccgaagggtggagaggacggaccagccattgccatcgatctaagcggaattaacgaaacaaatgatcttaaaagagctggattgatgctgcaagaggccgataaactggggtgcaaacagtttgtcacaccagctgacgtcgtgagcgggaatcccaagctgaacctggcttttgtcgccaacctgtttaatacctatccatgtcttcataagcctaataataacgacattgacatgaaccttttggaaggagaaagcaaggaagaacgcacttttaggaactggatgaattcactcggtgtgaacccctacatcaaccacctgtactccgatctggccgacgcactggtaatcttccagctgtatgagatgatcagggtccctgtgaactggtctcatgtgaacaaacctccatacccagcactaggggggaatatgaagaaaattgaaaattgcaattacgctgtagaactgggtaaaaataaggccaagttttcactggtagggattgcaggacaggacctgaacgagggtaattcgacactgacattagccttggtctggcaattgatgcgaagatatacgctgaacgttttgagcgacttaggggagggagaaaaggttaatgatgagattattatcaagtgggtgaaccagacactgaagtccgcaaacaagaagacctcaatctcaagttttaaagacaaaagtattagcactagcctaccagtcctggacttgatcgacgcaatcgcccctaacgccgtgcgacaggaaatgataaggcgagagaacttgtctgacgaggataaactcaacaatgcgaagtacgcaatttccgtcgcccggaagattggagcaaggatctatgcactgcctgatgaccttgtggaggtaaagcctaaaatggtcatgacagttttcgcctgcctgatgggaaagggcctgaatagaattaagtag

SEQ ID NO: 128908 - DNA, 1890 bp, Artificial Sequence
  Description of Artificial Sequence: Synthetic coding sequence
atggaaaactccaccaccacaatctcgcgcgaggagctcgaggagctgcaggaggcattcaataagatagacatcgacaacagtggctatgtatccgattacgagttgcaagacctgttcaaggaggcttccctgccgctgccaggatataaagtgcgcgagatcgtggagaagatcctgagcgtggccgatagtaacaaggacggcaagattagttttgaggagttcgttagcctgatgcaagagctgaagtcaaaagacatctccaagacctttagaaagattatcaataagcgcgaaggtataactgcaatcggcggaaccagcacgatttcctcagaggggactcaacattcttattctgaagaagagaaggtggctttcgtgaattggatcaacaaagcccttgagaatgaccccgattgtaagcacctgatcccgatgaatcccaacgatgacagcctcttcaagagcctcgctgacggcatcttgctgtgcaagatgatcaatctctccgagcctgacacaattgatgagagagccataaataaaaagaaactgactcctttcacaataagcgagaatctgaacctggcgctcaattctgcgtctgcaattggctgtactgtggttaacatcggcgcctctgacctgaaggaaggtaagcctcacctggtgcttggcctgctttggcagattatcaaagtcgggttgttcgccgatattgagatatctcgtaatgaagccctaatcgcactgttgaatgaaggggaagagcttgaggagcttatgaaattgagtcccgaggaactgctccttcgctgggtcaattaccacctcacaaacgctggctggcacaccatctccaacttttcccaggacattaaagacagtcgcgcctacttccatcttctgaaccagattgcaccgaagggcggcgaagatggacccgctatcgcgatagatttaagcggcatcaatgagaccaacgacctgaaacgtgctgggctgatgttgcaggaggctgataaattaggttgcaagcagtttgtgactcccgcagatgtggtaagcggcaatccaaaactgaacctggccttcgtggcgaacctatttaacacttacccttgcttgcataaaccgaacaacaacgacatcgatatgaatttattagagggcgagagcaaagaggagagaacatttcggaattggatgaatagcttgggggttaacccttacatcaaccacctctacagcgatctggcagatgccctcgtaatctttcagctatatgagatgattagggttccagtaaattggtcacacgtgaacaagcccccatatcctgcgctgggcgggaatatgaaaaagattgaaaactgcaattatgctgtggagctgggcaaaaataaggcgaagttttccttagtcggcattgccgggcaagatcttaacgaagggaatagcactcttacactggccctggtctggcagttaatgaggcggtacacccttaatgtgctgtccgacctcggagagggcgaaaaagttaatgatgaaatcataataaagtgggtcaaccagaccctgaagagtgctaacaagaagacctcaatatcctcctttaaagataagagcatctccacttccctgcctgtgcttgaccttattgatgctattgcccctaacgctgttcgacaagagatgatccgtcgtgagaacttatcagatgaggataagctaaataatgccaagtatgcgatcagtgttgccaggaaaatcggtgcgaggatatacgccctccctgatgatctggtcgaagtgaagcccaagatggtgatgactgtcttcgcctgcctgatgggaaagggactgaatcggatcaagtag

SEQ ID NO: 128909 - DNA, 165 bp, Artificial Sequence
  Description of Artificial Sequence: Synthetic coding sequence
atggaaaactccactactacgatctcccgcgaggaactagaggagctgcaggaggcatttaataagattgacattgataacagcggctatgtatccgattacgagctgcaggacctgtttaaagaagcctcactgcctttgcctgggtataaagtgcgcgagtag

SEQ ID NO: 128910 - DNA, 363 bp, Artificial Sequence
  Description of Artificial Sequence: Synthetic coding sequence
atggagaatagtacgaccactatttctagagaggaacttgaggagctccaggaagccttcaacaagatcgacattgacaatagcggttatgtgtccgactacgaattacaggatctgtttaaagaggcctctttgccacttcctgggtataaagttcgtgaaattgtcgagaagatcctgtcagtcgccgattccaacaaggatgggaagatcagtttcgaggagtttgtctcactcatgcaggaactgaagagcaaagacatcagcaagacctttcggaaaatcattaacaaacgcgaaggaataactgccattggtgggaccagcaccatctcgtctgagggaacccagcacagctactag

SEQ ID NO: 128911 - DNA, 360 bp, Artificial Sequence
  Description of Artificial Sequence: Synthetic coding sequence
atggagaattcaacaacaactatctcaagggaggagctagaggagcttcaggaggctttcaataagattgatatagacaattcaggctatgtatcggattacgaactgcaggatctgtttaaagaggcatctttgcccttaccagggtataaagtacgggagatagtagaaaagattcttagtgtggctgattcgaacaaagacggtaagatcagcttcgaagagttcgtgagtctgatgcaggagcttaagagcaaagatatctctaaaacatttcgtaaaattatcaataaacgggaggggattacagcaataggcgggacttccaccatctcaagcgaaggaacccagcattcttag

SEQ ID NO: 128912 - DNA, 102 bp, Artificial Sequence
  Description of Artificial Sequence: Synthetic coding sequence
atggaaaattcaactactactattagccgtgaggagctggaagaactccaggaagcctttaacaaaattgacattgacaatagcggatatgtgagcgactag

SEQ ID NO: 128913 - DNA, 177 bp, Artificial Sequence
  Description of Artificial Sequence: Synthetic coding sequence
atggagaacagcaccactacaatcagccgtgaggaattggaggaactacaagaagcctttaataaaatcgacatcgataacagtggctacgtctccgattacgagttgcaggacctgttcaaggaggcgagccttccactacccgggtacaaggttagagaaattgtggagaaatag

SEQ ID NO: 128914 - DNA, 1890 bp, Artificial Sequence
  Description of Artificial Sequence: Synthetic coding sequence
atggagaactctactactacaatttcacgagaagagttggaagagttacaggaagctttcaacaaaatcgacatcgacaatagcggatatgtcagtgactatgaactccaagatctgtttaaggaagcctcccttccactgccaggctacaaagtgcgggagattgtggaaaagatcttgagcgtagccgactccaacaaagatggaaagatcagttttgaggagtttgtgtctctgatgcaagagttgaagagtaaagacatctcaaagacttttaggaagattataaataagcgggaggggatcaccgcgattggcggaacctctaccatttcgtccgagggcactcaacatagctactccgaggaagaaaaagtcgcattcgtgaactggattaataaggccctggagaacgacccagactgtaaacatttgattcccatgaatcctaacgatgatagtctttttaagtcactggcagacggaatcctgttgtgcaaaatgatcaatctctctgaacccgacacaattgacgaacgggctattaataagaagaaactgaccccttttactatatccgagaatctcaatctggccctgaacagcgcttccgccatcgggtgcactgtggtaaacataggggcatccgatttgaaggagggtaagccccatctagtgctgggtttactctggcagatcattaaggtgggcctgtttgctgacattgaaatctcaagaaacgaggccctgattgccctgttaaacgaaggagaggagctggaggagttaatgaaactcagtccagaggaactcttactccggtgggtgaattatcatctgaccaatgccggatggcacacaatctctaacttttcccaggacattaaggacagccgggcctacttccatctgttgaatcaaatcgccccaaaaggaggcgaggacgggccagccattgctatcgatctgtcaggtattaacgaaactaacgatttaaaacgagctggcctgatgttgcaggaagccgataaattaggatgtaaacaattcgtgacaccggctgacgttgtgtctggcaatcctaaactgaacctcgctttcgtggccaatctgttcaatacatacccatgcctccataaacctaataacaatgacatcgacatgaacttactggaaggcgagtctaaagaggagagaacctttagaaactggatgaattcattaggagtgaacccctatatcaatcatttgtatagcgatcttgcagatgccctggtgatattccagttatacgagatgattcgcgtgccagtgaattggagtcacgtgaataagcccccctatcccgcattggggggcaacatgaaaaagattgaaaactgtaactacgccgtggaacttgggaaaaataaggccaaattttcccttgtcggaattgcagggcaggacctcaacgaaggaaattctactctaacactagccttagtctggcaactgatgaggcgctataccctgaatgtgctcagtgacctgggagagggggaaaaggtgaatgatgaaattatcatcaaatgggtcaatcagactctgaaaagtgcaaacaaaaagaccagcatttctagttttaaagataaatctatctcaaccagtcttcccgtcttggacctgattgacgccattgcccctaacgccgttcgacaggaaatgattaggcgcgagaacctgtccgatgaggataagttaaacaatgctaaatatgcaatcagtgtcgcgcggaagattggcgcaagaatctacgcacttcccgatgacctggtcgaggtcaagcctaagatggtgatgaccgtatttgcctgtctgatgggcaagggcctcaaccggattaaatag

SEQ ID NO: 128915 - DNA, 162 bp, Artificial Sequence
  Description of Artificial Sequence: Synthetic coding sequence
atggagaacagtactacgaccatctcccgcgaagaactcgaagagttgcaggaggccttcaacaagatcgatattgacaactccggatacgttagcgattacgaactgcaggatctctttaaggaagccagtctgcctttgcccggttacaaagttcgttag

SEQ ID NO: 128916 - DNA, 1785 bp, Artificial Sequence
  Description of Artificial Sequence: Synthetic coding sequence
atgccgctgcctggatacaaggttagagaaataattcagaaactcatgctggatggcgatcgcaataaggacggcaaaatttccttcgatgaattcgtctatatttttcaagaagtgaaatcaagcgatatcgccaagaccttccggaaggcaataaaccgcaaggaggggatctgtgctctgggcggcacttcagagctcagcagtgaaggtacccagcattcgtatagtgaagaagaaaaatacgcctttgtaaactggataaataaggcgctcgagaatgaccctgattgtcggcacgtgatccctatgaacccgaataccgacgacctgtttaaggcggtgggagatggcatcgtgctctgtaagatgattaacctgtctgtaccagatactatcgatgaacgcgctattaataagaaaaagttgacccctttcatcatccaggaaaatctaaacctagcactgaacagcgcatctgccatagggtgtcatgtggtcaatataggggccgaggacctcagagccggaaaacctcatctagtgttgggcctgctgtggcagattattaaaatcggacttttcgccgatattgaactgtcacgaaacgaagcactggcagctttgcttagagacggggagactttggaagaattgatgaagctatcaccagaggaattgcttctgaggtgggcaaattttcatctggagaattccgggtggcagaagattaacaacttttcggcggacatcaaactcatcgacttcagcaatagtgtcaaagactcaaaggcctattttcacttgcttaatcagattgctcctaaaggacagaaagaaggtgaacctcgaatcgatattaacatgtctgggtttaatgagaccgacgaccttaagcgcgccgaaagtatgctgcagcaggcagacaagctcgggtgcaggcagttcgttacgcccgctgatgttgtgtccgggaacccaaaactgaacctcgctttcgtcgccaacctcttcaataaatatcctgcactaacaaagcctgaaaaccaggacattgactggacactacttgagggagagactagagaggagcggacattccgaaactggatgaatagcctaggcgtgaatccacacgtaaatcacctgtacgctgacttgcaggacgcacttgtgatattgcagctctatgagaggattaaggtacccgtggactggagtaaggtaaacaaacctccctatcctaaactgggagccaatatgaaaaagctcgagaattgcaactatgccgtggagctcgggaagcaccccgctaagttctccttagtgggcatcggcggtcaggacttaaatgacggtaaccaaacgctgactctcgcccttgtgtggcagctcatgagaagatacacgttaaacgtgctggaggatctgggagacggccagaaggctaatgacgacatcatcgtcaattgggttaatcggacgttgagtgaggccgggaaaagcacgtctatccagtcattcaaagacaaaactatatcctcctctttggcagtggttgatttaatagatgcaatccaaccaggatgtattaattatgaccttgtgaaaagcgggaatttaactgaggacgacaaacataacaacgcaaaatacgcggtgagcatggcacgtcgcattggggccagagtgtatgcccttccagaggatctggtggaagtgaagccaaagatggtcatgactgtttttgcgtgcctgatgggacgtgggatgaagagggtctag

SEQ ID NO: 128917 - DNA, 1893 bp, Artificial Sequence
  Description of Artificial Sequence: Synthetic coding sequence
atggatgaaatggccactactcagatttctaaagacgaactggacgagctcaaagaagcattcgccaaggtggatctgaattcgaatggttttatctgcgattacgaacttcatgagctgttcaaagaagccaatatgcctctgccaggctacaaggtccgggagatcatccagaaactaatgctggatggcgaccggaataaggatggcaagatcagttttgacgagtttgtttatatttttcaagaagtcaagagttcggatatagcaaagaccttcaggaaagctatcaaccgtaaggaaggcatttgtgctctcggtgggacatccgaactgtcttctgaagggacccaacacagctattccgaagaagagaagtatgcctttgtgaactggatcaacaaggcactagaaaatgaccctgattgcagacacgttataccgatgaaccccaacaccgacgatttgttcaaggctgtgggagatgggatcgttctctgcaagatgataaaccttagtgtccctgacacgatcgacgagcgggctattaataaaaagaaattgacaccattcatcattcaggagaacctcaacctagcgctgaattctgcctctgcaatcggatgtcatgtggttaatatcggagccgaggatctccgagccggtaagcctcaccttgttctgggccttttatggcagattattaagattgggctcttcgccgatatcgaattgagtcgtaacgaggcattggcagccttactgagagacggggagacgctagaggagctgatgaagctctcacctgaagagctgctcctgagatgggccaactttcatctcgaaaacagcgggtggcagaaaatcaacaactttagtgctgacataaaggattcaaaggcgtattttcatttgctgaaccagatcgctccaaagggccagaaagagggagagcctcgcatcgacattaacatgtctggttttaacgagaccgacgatctgaagagagcagaatcgatgctccaacaggccgacaaactgggctgtagacagttcgtcacccccgcagatgttgtcagtgggaacccaaagctcaacctggccttcgtggcaaatctgtttaataagtatcctgccctgacgaaacctgagaaccaggatattgactggactttactggaaggcgagacacgggaggagcggacatttagaaactggatgaacagtctgggagtgaatccacacgtcaaccatttgtatgcagatctgcaagatgccttagttatcttacagttatacgagagaatcaaggtccccgtggactggtccaaagtaaataagccaccatacccgaagctgggagctaacatgaagaagctggaaaattgcaactacgcggtcgagctgggcaaacatccagcaaagtttagcctggtcggcataggtggccaagacctgaatgatgggaaccagacgcttacactcgcgttagtttggcagttgatgcggagatataccctgaatgttcttgaggacctcggagacggacagaaggcaaacgatgacataatagtcaattgggtgaatcgcaccctcagtgaagcaggtaaatccaccagcatccagtctttcaaggataagacgatatcaagctcattggcagtggttgacctcattgacgctatccagccaggctgtatcaattatgacctcgtcaagtccggtaatttgactgaggatgacaagcacaacaacgctaaatatgcagtaagtatggcaagacgcatcggggctcgtgtttacgcactacctgaagatctggttgaggttaagcctaaaatggtgatgaccgtgttcgcctgtctcatgggacgcggaatgaagcgagtatag

SEQ ID NO: 128918 - DNA, 1893 bp, Artificial Sequence
  Description of Artificial Sequence: Synthetic coding sequence
atggatgagatggctacaacacagatcagtaaggatgagctggatgaactgaaggaagcatttgcgaaagttgatctgaattcgaacggcttcatatgcgactatgagctgcatgagttgttcaaggaggctaatatgcccctccccggctacaaagtccgagaaatcatccagaagctgatgttggatggagacagaaataaagacggaaagatctcgttcgatgagttcgtgtatatctttcaagaggtaaagtcaagcgatattgccaaaacctttcgtaaagccattaatagaaaggagggtatttgtgcccttggtggcacgtcagaactgagctcagagggcacccagcacagctactcagaggaagagaagtacgctttcgttaactggattaataaagcactggagaatgatccggattgccgacacgtgattccaatgaaccccaacacagatgatttattcaaggcggtcggtgacgggatcgtactgtgtaaaatgattaatctgagtgtgcctgacacaatcgatgagagagctattaataagaaaaagctcacacccttcatcattcaggagaatctaaacctagcactgaatagcgcttctgcaataggctgccatgtcgtcaacattggcgccgaggatctgagggccggcaagccacatctggttctgggccttctgtggcagattatcaaaataggattgttcgctgatatcgagctgtcgaggaatgaggctctggctgccctgctgagggatggtgaaactctggaggaattgatgaagttgagccctgaggagcttctgctgagatgggctaactttcacctcgagaactccggctggcagaagatcaataatttctctgctgatatcaaagactccaaagcctactttcacttactgaaccagattgcccctaagggccagaaggagggagagccacgcattgatatcaatatgtccggtttcaacgagactgatgatttgaaacgggcggagagcatgctccagcaagccgataaattagggtgcagacagtttgtgacaccagctgacgtcgtatcggggaacccaaagctaaacctggcattcgttgctaatctcttcaataagtacccggccctgactaagcccgagaatcaggacattgattggaccctgctggaaggcgagacaagagaagaaagaaccttcagaaattggatgaatagtcttggcgtaaacccacacgtgaaccatctatatgcagacctgcaggacgcactggtgatcctccaactatacgagcgaatcaaagttcccgtggactggtcaaaggtgaataaaccgccttacccaaaactgggggccaatatgaagaaactggaaaactgtaactacgctgtggaactgggaaaacaccctgcaaaattttcacttgttggtatcggtggacaggatctgaacgacgggaaccaaacactcaccctggcactcgtatggcagctaatgagaagatataccctaaacgttttagaagatctcggagacggtcagaaggccaacgatgatattatagttaactgggtgaatcggacgcttagtgaagcaggcaaatccacctccatccagtcctttaaggacaagactatctccagcagcctggccgtcgtggatctgatcgacgcaatccagcccgggtgtataaattacgacttggtgaaaagcgggaatcttaccgaggatgacaagcacaataatgccaaatacgcagttagcatggcgcggagaatcggtgcaagagtttatgcattgcccgaagacctcgtcgaggtaaagcctaaaatggtgatgacagtgtttgcttgcttaatgggccggggtatgaaaagggtttag

SEQ ID NO: 128919 - DNA, 1854 bp, Artificial Sequence
  Description of Artificial Sequence: Synthetic coding sequence
atggaagacctgaattcaaatggttttatctgtgactacgaactgcacgagctgtttaaggaagctaacatgcctctacctgggtataaggtcagagagattatacagaagctgatgctggacggggaccgaaacaaggacggcaaaatatccttcgacgaatttgtctatatctttcaggaggtgaagtcaagcgatatcgccaagacctttagaaaggccatcaacaggaaggagggaatatgtgcactcggcggcaccagcgaattgtccagcgagggcactcagcactcctacagtgaggaggaaaagtacgcctttgtgaattggatcaataaggccctggagaatgacccagactgtcgacatgtcatacccatgaaccccaacactgacgatcttttcaaagccgtgggcgatggtattgtgctgtgcaagatgataaacttgtccgtgccagacacgatcgacgaacgcgctattaacaaaaaaaagttaactccgtttatcatccaggaaaacctgaacctcgcattgaattcagcatcagcaatagggtgtcatgtcgtgaacatcggcgctgaggatcttcgcgctggaaaacctcatctggtactgggcctcctttggcagattatcaaaatcgggctgttcgcggacatagaactctcccgcaatgaagcccttgccgccttgctcagggatggagagacccttgaggaactgatgaaattgtcaccagaagagctgttgctccggtgggcaaattttcatctagagaattccggttggcagaaaattaataacttctcagccgacataaagttaatcgatttctctaattcagtgaaagattcaaaggcttactttcaccttttaaaccagatcgcccccaagggtcagaaagagggtgagccaaggattgacattaatatgtccggttttaacgagacagacgacctgaagcgggcagaaagcatgcttcaacaggcggacaagttgggctgtcggcagttcgtcacacccgctgatgtcgtgagcgggaaccctaagcttaacctggctttcgtcgcaaatcttttcaataaatatcccgcactgacaaaaccggaaaaccaggatatcgactggaccctcttagaaggggagaccagagaggaaaggacatttaggaattggatgaattctctcggagtcaatcctcacgtcaaccatctgtacgccgacctgcaggatgcccttgtcatcttacagctttacgagaggatcaaggtcccagtggactggagcaaagtcaacaagccaccatatcctaagctgggcgcgaacatgaagaagctggaaaactgcaactacgcggtagaacttgggaaacaccctgcaaagttctccctggtgggcatcggaggacaggatctgaacgatggcaaccagactttaactctggccctcgtttggcagttaatgagaagatacacgctgaacgtgctcgaagatctgggcgatggccagaaagccaacgacgacattatcgtcaattgggtgaatagaaccctgtctgaggccgggaaatcgacgtcaatccagtcattcaaggacaaaaccatatcctcttctctggccgttgtggatcttatagacgcaatccagccggggtgtataaattatgatctggttaaaagcggtaatctaacagaagatgataagcacaacaacgctaaatacgccgtctcgatggctcggcgcataggggctagagtttacgccctcccagaagatctggtggaggtgaaaccgaagatggtgatgacggttttcgcatgtttaatgggcagaggcatgaaaagggtttag

SEQ ID NO: 128920 - DNA, 1758 bp, Artificial Sequence
  Description of Artificial Sequence: Synthetic coding sequence
atgccactgccaggctataaggtgagagaaattatccagaagctgatgctggacggtgatagaaacaaagatggcaaaatctcttttgacgaattcgtctacattttccaggaggtcaagtcaagcgacattgccaagaccttcaggaaggctatcaaccgaaaagaaggcatctgcgctctagggggcacctctgagctgtcctctgagggcactcaacacagctattctgaggaggagaagtacgcgttcgttaattggattaacaaagccctggaaaatgacccggactgccggcacgttattcctatgaatccgaacacggatgatttgttcaaggccgtgggtgatgggatcgttttgtgtaagatgatcaatctttctgtgccggacacaatcgacgagagagctattaacaagaagaaactaaccccatttatcattcaggagaacctgaacctggctcttaactctgcatccgctattgggtgccacgttgtgaacataggagcagaggatctgagggccgggaaaccacatctggttctgggcctgctatggcagatcattaaaattggccttttcgccgatatcgaactgtcacgtaatgaggccctggcagcactgttgagagatggggaaactctcgaagaactcatgaagctgtcccccgaggagctgctgctgagatgggccaattttcacctggaaaactctgggtggcagaagattaacaacttcagtgcagacattaaagactctaaggcctactttcacctgctgaaccagattgctcccaagggacagaaagagggagagcctagaatcgatatcaacatgtcgggattcaacgagactgatgatctcaagagggctgagtctatgttgcagcaggccgataaactcggctgtagacagtttgtcactccagcagacgttgtatcaggaaacccaaagttgaacctggcttttgtcgcgaatctctttaacaagtacccggcccttacaaagccagagaatcaggacatcgactggaccctgctggagggcgaaactagagaggagcgcacttttcgcaattggatgaacagtttaggtgtgaatcctcatgtgaatcatctctatgccgacctgcaggatgccctggtgatcttacagttatatgaacgaatcaaagttccggtggactggtcaaaggtaaacaaacccccatacccaaaactaggggctaacatgaagaagctcgaaaactgtaactacgctgtggaactggggaaacatcctgctaagttcagcctagtggggatcggtggccaagacttgaatgacgggaaccagacacttacgctggccttagtgtggcagctgatgagaaggtacacactgaacgtgctggaggacctgggtgacggtcagaaagccaatgatgatattatcgtgaactgggtaaatcgcaccttaagtgaagccggaaagagcacctccatccagtcttttaaagataaaacaatctctagttcccttgccgtggtcgatctgatagacgccatccagccggggtgcatcaattatgacctggtgaaatctggcaatctcaccgaagacgacaagcataacaatgcaaagtacgctgtctctatggccaggagaataggtgcaagggtgtacgccttgcccgaggatctggtggaggtcaagcctaaaatggtgatgacggtctttgcctgccttatggggagaggtatgaaacgcgtctag

SEQ ID NO: 128921 - DNA, 675 bp, Artificial Sequence
  Description of Artificial Sequence: Synthetic coding sequence
atgaattccctaggggttaatcctcacgtcaaccacctgtacgcggatctgcaagatgccttggtgatcctccagctgtacgaacgcatcaaagtgcctgtggactggtccaaggttaacaagcccccataccccaagttaggcgccaatatgaaaaagttggaaaactgcaactatgcggtcgagttaggcaaacatccagctaaattcagcctggtggggatcggtggacaggatttgaacgatgggaaccagacacttacactcgccctggtgtggcaactaatgcgaaggtacaccctcaacgtcctcgaggacctgggagacggacagaaggccaacgatgacattatagtgaactgggtgaaccgcactctttctgaagctgggaaatctacttctatccagtcatttaaggacaaaaccatcagcagctccctagcggtggtcgatctaatcgacgcaattcagccgggatgtataaactacgacctggtgaagagtggtaatctgactgaggacgataagcacaacaatgccaaatatgcagtgtcaatggctagacgcattggcgccagggtttacgccttgcctgaagacctcgtggaagttaaacctaagatggtgatgacagtgtttgcctgtcttatggggagaggaatgaaacgggtctag

SEQ ID NO: 128922 - DNA, 306 bp, Artificial Sequence
  Description of Artificial Sequence: Synthetic coding sequence
atgagctctgccgcagggttctgtgcttcccgcccaggcctcctttttctgggcttacttctgctgcctttagtggtcgcctttgcttccgctgaggccgaagaagatggtgacttgcaatgcttgtgcgtcaaaactacatcccaggtgcggccaaggcatatcacgtctctcgaggttattaaagctgggccacactgtcctacagcacagcttatcgctacgctaaaaaacggtcgcaaaatttgcctggacctgcaggctcccctgtacaaaaagattataaaaaaacttctagagtcttag

SEQ ID NO: 128923 - DNA, 405 bp, Artificial Sequence
  Description of Artificial Sequence: Synthetic coding sequence
atgaagtccctgacatggattctgggattgtgggcactggccgcctgtttcacacctggtgagtcccagcgcggcccccgagggccctaccctcctgggcctttagcccccccacccccaccgtgctttccattcggaaccggcttcgtgccaccccctcaccccccgccatatggtcctggacgcttccctccacccctctcaccaccctacggccccgggagaatccctccctcaccccctccaccttacgggcctgggagaatccaaagccactcgctccctcctccttacgggccggggtaccctcagcctccatctcagcctcgcccgtaccccccggggccccctttttttcccgtgaattctccaacggatcctgcactccccactcccgctccttag

SEQ ID NO: 128924 - DNA, 399 bp, Artificial Sequence
  Description of Artificial Sequence: Synthetic coding sequence
atgagccagggagacagcaaccccgccgcaatcccccatgccgctgaggatatccagggtgacgacaggtggatgtctcagcataaccgattcgtgctggactgtaaagacaaggaacccgacgtgttgtttgtgggggatagcatggtccagctgatgcaacagtacgagatctggcgagaattgttttcaccgctccacgctctaaatttcgggataggcggcgatacaacccggcatgttctgtggagactgaaaaatggtgagttggaaaatatcaagcctaaagtgatcgtagtgtgggtgggaactaacaaccatgaaaacactgctgaagaggtggctggcggcatagaagcaatcgtccagctgattaacacccgacagccgcaggcgtag

SEQ ID NO: 128925 - DNA, 690 bp, Artificial Sequence
  Description of Artificial Sequence: Synthetic coding sequence
atgtcacaaggagacagcaatcctgccgccatcccccacgctgccgaggacattcagggcgatgacagatggatgtctcagcataatagatttgtactggattgtaaggataaagagccagatgtactgtttgtgggggatagtatggtgcaattgatgcagcaatatgaaatctggcgagagctgttctcccctcttcacgccctgaattttggtataggaggcgacaccactaggcacgttctttggaggctgaagaatggcgagctggaaaatattaagcctaaagtaattgtggtttgggtggggacaaataatcacgagaataccgccgaggaggttgccggcggcattgaggctatcgtgcagctgattaatacaagacaacctcaagcaaagatcatcgtccttgggctgcttccccgcggcgaaaagccaaaccccctgagacagaaaaacgccaaggttaaccagctgctgaaggtcagtctccctaagttggcaaacgtgcagctgttggataccgatggcggctttgtccactcagatggcgccatctcgtgtcatgatatgttcgactttcttcatcttacaggcggagggtacgctaagatttgcaagcctctgcatgagctgataatgcaacttctggaagagacgcccgaggaaaagcagaccacgatcgcctag

SEQ ID NO: 128926 - DNA, 468 bp, Artificial Sequence
  Description of Artificial Sequence: Synthetic coding sequence
atgtcacaaggtgatagcaaccctgccgctattccacatgcggccgaagacattcaaggagacgatcggtggatgagtcagcacaatagatttgtcctagactgcaaggataaagagcctgatgtcctcttcgttggcgactctatggtgcaacttatgcagcagtacgagatatggcgtgagctcttcagccccctccatgccctgaacttcggtatcggaggcgacaccacccgccacgtactttggcggctgaagaatggggaactggaaaatatcaaacctaaggttattgttgtgtgggtcggtactaacaaccacgagaatacagccgaagaggtggcgggtggcattgaggccattgttcaactgataaacacacgccagccacaggctaaaatcatcgtcctgattatctactggcaggacgagcaggactaccacgagcgcaaagtgcaaatggattag

SEQ ID NO: 128927 - DNA, 609 bp, Artificial Sequence
  Description of Artificial Sequence: Synthetic coding sequence
atgtcacagggtgactcaaaccctgccgccattcctcacgccgcagaagacatacaaggagatgaccggtggatgagtcagcacaacagattcgtcctggattgtaaagacaaagagccagatgtcttattcgtaggggactccatggtgcagctgatgcaacagtacgagatctggcgcgagttattctcacctcttcacgctctgaattttggcatcggtggggacacgacgcggcacgttctgtggaggcttaaaaatggagagttggaaaacatcaagcctaaagtaatcgtggtttgggttggcaccaacaaccatgagaatacggccgaagaagtggctgggggcattgaggcaatagtgcagttaatcaacacaaggcagcctcaggcaaaaataatcgtgctcggcaaggccgcagccagtaagtattccatttccgaaatcgtgagactcgaacaaggctccgtgaactggagcatcggcacttacccagatgatacccccgcaactacccggcccgccatcctgcagctgtttactggcaagatgtcccgcataacaatgaaagaaaaaagcaggtggactgaggagattcttcactag

SEQ ID NO: 128928 - DNA, 696 bp, Artificial Sequence
  Description of Artificial Sequence: Synthetic coding sequence
atgagtggtgaagagaaccctgccagcaagccaacgccagtccaggacgtgcagggcgacggacgctggatgtccttacatcaccgctttgtggccgatagcaaggataaagagcccgaggtagttttcatcggagactcactggttcagctcatgcatcagtgcgagatctggagggagttgttttccccccttcatgctctgaactttggaattggaggcgacggaacgcagcacgtcctctggcgactggagaatggcgagctggaacatattaggccgaagattgtggtggtgtgggttggaactaacaaccacggccacacggcagagcaagtgaccggcggaattaaagctattgtccagttggtgaatgagaggcagcctcaggctcgggtcgtcgtgctggggctattaccccgtggtcagcaccctaacccactgagggaaaaaaacaggcaggtcaatgaactggtacgggccgcgctggccgggcatcccagagcgcatttcctcgatgccgatccggggtttgtacactccgacgggaccataagccaccacgatatgtatgattatctccacctctctagactgggctacacccctgtgtgtcgcgcactgcactctctccttttgcgcttgctcgcccaggaccaaggacaaggcgcccctctcttggaacccgctccttag

SEQ ID NO: 128929 - DNA, 696 bp, Artificial Sequence
  Description of Artificial Sequence: Synthetic coding sequence
atgtctggcgaggaaaaccccgcgagtaagccaacacccgtgcaggacgttcagggcgatggccgatggatgtcactgcaccatcggtttgtggcagattcaaaagacaaggagccagaggttgtgtttatcggagacagcctagtccaactaatgcatcagtgcgagatttggcgggagttattctcaccacttcacgccctcaattttggtataggcggagacggcactcagcatgtgttgtggagacttgagaacggtgaactcgagcacattaggccgaagatagttgtggtgtgggtgggaactaataaccacgggcacactgcggaacaggtgacaggaggaatcaaggcaattgtgcagctggtcaatgaaaggcagccacaggcgcgcgtggtggtcttaggactcctgccccggggacagcatcccaaccctcttcgtgagaaaaaccgacaggtgaatgagttagtgcgcgctgctttggcaggacatcctcgggctcacttcttggacgccgaccctggctttgtgcactctgatgggactatcagccaccacgacatgtacgattacctgcatctctccagactggggtacacacctgtgtgtcgggccttgcactccctgttacttcgcctgctcgcccaggaccaggggcagggtgccccacttcttgaaccagctccatag

SEQ ID NO: 128930 - DNA, 720 bp, Artificial Sequence
  Description of Artificial Sequence: Synthetic coding sequence
atgaccattaaactgtgggactttcagggcttcgaatgcatccggacgatgcatggccatgaccacaatgttagcagcgtggccattatgccgaatggagatcatatagtcagcgcctcacgggataagacaataaagatgtgggaagttcaaaccggttattgcgtgaagacgttcacagggcatcgcgaatgggtgagaatggtaaggccgaaccaagacgggaccctcatagcctcttgcagtaatgatcagacggtccgcgtgtgggtggtcgcaaccaaagaatgtaaggccgaacttcgcgaacatgaacacgtggttgagtgtatctcttgggctcccgagtcctcctattcgtctattagtgaagccacggggtcagagacaaagaagagcggcaagcctggacctttcctcttgtcagggtcacgggacaaaaccataaagatgtgggacgtcagcaccggcatgtgtctcatgaccctggtgggtcacgacaactgggtccgtggtgttcttttccactccgggggtaagtttatcctgtcatgcgccgacgataagaccttgcgcgtttgggattacaagaataagcgatgcatgaagaccctgaacgcacatgaacacttcgtcactagcctggattttcacaagactgccccttatgtcgtcacgggtagtgtggatcagaccgtcaaggtttgggagtgtagatag

SEQ ID NO: 128931 - DNA, 1233 bp, Artificial Sequence
  Description of Artificial Sequence: Synthetic coding sequence
atggtgttgagtcagcggcaacgcgatgagctcaacagggccattgccgactatctccggtctaacggttatgaggaggcatactcagtgtttaagaaggaggctgaactggatgtgaacgaagaacttgacaaaaagtatgctggtctgttggaaaagaaatggacttccgtcatccggcttcagaagaaggtcatggaactcgaatcaaaactcaacgaagctaaggaggagttcaccagcggcgggcccttgggtcagaaacgagatcccaaggaatggataccccgcccccctgagaaatatgccttaagtggccatcgctcacccgtgacccgggtgatttttcatccagttttttccgtgatggtgagtgccagtgaagacgcaacaatcaaagtgtgggactatgagacaggagatttcgaaaggacactgaaagggcacacagatagcgtgcaggatatttccttcgatcacagcggtaaactgctggcatcctgttctgccgacatgacgattaaattgtgggattttcagggcttcgagtgcatacgaactatgcacggccatgaccacaatgtctcctcagtggccataatgcctaatggcgaccatattgtatcggcatctagggacaagaccatcaaaatgtgggaggttcagaccggctattgcgtcaagacatttacggggcaccgtgaatgggtgcgcatggtgcgcccaaaccaggacggaacactgattgcgtcctgttcgaatgaccagaccgtccgggtatgggtcgtagccacaaaagagtgtaaagcagagctgagagagcatgaacacgttgtcgagtgtatttcctgggcccctgagagttcctatagcagtatcagcgaagccaccgggagcgagactaagaagtcgggcaagccaggcccattcttgctgagcggtagccgggataagacaattaagatgtgggatgtgagcaccggaatgtgtctgatgaccctggtgggacatgacaactgggtccgcggggtgttgtttcattccggaggcaaattcatcttatcttgcgctgacgacaagaccttgcgggtctgggattataaaaacaagcgttgtatgaaaactcttaacgcccacgaacactttgtaacaagcctggatttccataaaacggcgccttacgttgtcaccgggagcgtggaccaaactgttaaagtgtgggaatgtaggtag

SEQ ID NO: 128932 - DNA, 618 bp, Artificial Sequence
  Description of Artificial Sequence: Synthetic coding sequence
atgaccataaagctatgggattttcagggattcgagtgtattagaaccatgcacggccacgatcacaacgtcagcagcgttgccattatgccaaacggggaccacatcgttagcgcgtcacgcgataagactatcaagatgtgggaagttcagacaggatactgcgttaaaactttcactggacaccgagagtgggtgcgcatggtgcggcctaatcaggatggcacgttaatcgcatcatgtagcaatgaccagacagtgcgggtttgggttgtggcaactaaagaatgcaaggctgagctgagagagcacgagcacgtagtggagtgtattagctgggcgcccgagagttcctacagctccatctcggaggctactggctctgaggtgggtcacgacaactgggtccgcggggtcctttttcacagcggaggaaaattcatactgtcatgtgcagacgacaaaaccctccgcgtgtgggactataagaacaagcggtgcatgaaaaccttgaacgcccacgagcactttgtcacatcattggatttccacaagactgccccgtacgttgtgacaggctccgttgatcagactgttaaagtttgggagtgtcgatag

SEQ ID NO: 128933 - DNA, 1029 bp, Artificial Sequence
  Description of Artificial Sequence: Synthetic coding sequence
atggagccccacgacagctcccacatggactccgagttcagatatactctgtttccaatcgtttactctattatttttgtccttggcgtcatcgccaatgggtacgtgctttgggtttttgctaggctctatccctgtaagaagttcaacgagatcaagatattcatggtgaatctgaccatggccgatatgctctttctgataacgttaccactgtggatcgtgtattaccaaaatcagggcaattggatactgcctaagtttctttgcaacgtggcaggttgtctcttctttatcaacacgtactgtagtgtggcctttctgggggtcataacttataaccggttccaagctgtaactaggccaataaagactgctcaagctaacactcgtaaacggggaatctcattgagcctcgttatatgggtcgcaattgtcggtgctgcgtcatatttcctgatcttggatagcaccaataccgtgccagactcagctgggagtgggaatgtgacaagatgtttcgaacattacgagaaaggttctgtcccagtgctgatcatccacattttcatcgtgttcagcttctttcttgtattcctcatcatcttattctgcaacctggttatcatccggacactcctcatgcagccagtgcaacaacagaggaacgccgaggtcaagcgtagggctctgtggatggtgtgtaccgttctggctgtgttcataatatgttttgttccacatcatgtggtccagctgccctggactttagccgagctgggctttcaggactcgaaatttcaccaggccatcaatgacgctcaccaggtgaccctttgcctgctgagcacaaactgtgtgctcgatcccgtgatctattgcttcctgaccaagaagttccggaaacacctgaccgaaaagttctatagcatgcgctcctcacggaaatgctcccgggccacaactgacacagtgactgaagtggtcgtacccttcaatcagattccaggcaactctctcaagaactag

SEQ ID NO: 128934 - DNA, 1029 bp, Artificial Sequence
  Description of Artificial Sequence: Synthetic coding sequence
atggaaccccatgatagcagccatatggattcagagtttcgctataccctattcccaatcgtctactctatcattttcgttctcggtgtaatcgcaaatgggtatgtgctgtgggtatttgcgcgcctgtatccatgcaaaaaattcaatgagattaaaatatttatggttaacttgaccatggccgacatgttatttcttatcaccctccccctttggatagtgtattatcagaatcaggggaattggattcttcctaaatttttgtgtaacgtggccgggtgcctgtttttcatcaatacttattgctccgttgccttcctcggagtgataacctataataggttccaggcggtgacaagacccattaagacagcccaagctaatacccggaagcgagggattagcctgagtctcgtaatctgggtcgcaattgtcggggcggcttcttactttctgattctggattccacgaacactgttccagatagtgctggatctggtaacgtgacacggtgcttcgagcattatgagaagggatcggtgcctgtgttgatcatccacattttcatcgtgttttcttttttcttagtgttcttaattatcctgttctgtaatctggtcatcataagaacccttctcatgcaacccgtgcagcagcagcgaaatgccgaggtgaagagacgtgctctttggatggtgtgcactgtcctggcagtgtttatcatatgttttgtcccccatcacgtggtccaattaccctggacgcttgccgaacttggttttcaggactccaagttccaccaggctattaacgacgcacaccaggtgacgttatgcctcctgagcactaattgcgtgctcgacccagtgatctactgcttccttactaaaaaattcaggaagcatctgaccgagaagttctattcaatgcggagctccagaaagtgttctcgggccaccacagacactgtcaccgaggtcgtagttcctttcaaccagattcccggaaatagcctgaagaattag

SEQ ID NO: 128935 - DNA, 1029 bp, Artificial Sequence
  Description of Artificial Sequence: Synthetic coding sequence
atggagccccatgatagttctcatatggacagcgagttcaggtatacgctgttccctattgtatattccatcatttttgtcctcggcgtgattgccaacgggtacgtgctgtgggtgtttgcacggttatatccctgcaagaaattcaacgagatcaagatcttcatggtcaacctgaccatggctgacatgctgtttctgatcacccttcccttatggattgtgtattatcagaatcagggaaattggatcctccctaaatttctgtgtaatgttgctggatgtttattttttatcaatacctattgcagcgttgcgtttctgggcgtgatcacctataatcgattccaggcagtgactcgccctataaaaaccgctcaggctaatacgaggaagagaggcatctcactatctctggtaatttgggttgctattgttggagctgcaagctatttcttaatcctggattcaactaatactgtccccgacagcgccggttccggtaacgtcaccagatgctttgagcattacgagaagggctccgttccagtactcatcattcacatttttatagtattcagtttctttctggtgtttttgatcatccttttctgtaatctcgtcatcatccggacactactaatgcagcccgtacaacagcagcgcaacgctgaggttaaacgtagggctctctggatggtgtgcaccgtcttagccgtcttcatcatctgtttcgtgccacaccatgtggttcagctcccctggaccctcgccgagctggggtttcaggacagcaagtttcatcaagcgatcaatgacgcacaccaggtgaccttgtgtctcctttccacgaactgcgttcttgaccccgttatttattgtttcctgacaaaaaagttcaggaagcatttaacagagaaattttatagcatgagatcttcacgcaagtgcagcagagcaactactgacaccgttaccgaggtcgtagtaccttttaatcagatccccggcaattcactgaaaaactag

SEQ ID NO: 128936 - DNA, 1128 bp, Artificial Sequence
  Description of Artificial Sequence: Synthetic coding sequence
atgaaagtttggttgctgctgggactactgctggtacatgaggcgctggaagatgttacaggtcaacatttaccaaaaaataaacgacctaaagagccgggagaaaaccggataaagcctaccaacaagaaggttaagccaaaaatccccaagatgaaagacagggactctgcgaactctgctccgaaaacgcagtccattatgatgcaggttctcgataaaggacggttccaaaagcccgcggctaccctctccctcctggccggccaaaccgtggaattaagatgtaaaggcagccgcataggctggagctatccagcttatctggacacattcaaggatagcaggctcagcgtgaagcagaacgagcgatacggacaactgaccctggtgaacagcacatccgctgataccggagagttctcctgttgggtacagctctgttccggttacatttgtagaaaggacgaagctaaaacaggctcaacctacatttttttcactgaaaaaggtgagttattcgtaccgtctcctagttatttcgacgtggtgtatctcaaccccgaccgacaggccgtggtaccttgccgagtcacagtcctgtctgcgaaggtaacattgcatcgggagtttccagcgaaggagatacctgctaacggcaccgacatagtttacgacatgaagagaggtttcgtctatctgcagcctcattccgagcaccaaggggttgtgtattgtcgtgcagaagccggcggaagatcccagatctccgtcaaataccagctcttatacgtggcagtgcctagcggcccacctagcacgaccattctcgcgtcttctaataaggttaaatccggagacgatatttcagtcctgtgcacagtgctcggcgagccggatgtcgaagtggagtttacttggattttccctggtcaaaaagatgagagacctgtgaccattcaagacacctggaggctgatccacaggggactgggtcataccacccggatcagccagagcgtgataaccgtagaggatttcgaaacaattgacgcaggttattacatctgcactgctcagaacttgcagggacagacaaccgtggccacaactgtggaattcagctag

SEQ ID NO: 128937 - DNA, 1128 bp, Artificial Sequence
  Description of Artificial Sequence: Synthetic coding sequence
atgaaggtgtggcttttgcttggattattgctggtccacgaggcgctggaggacgtgaccggacagcatctacccaagaataaacggcccaaggagcccggcgagaaccgaatcaaacctaccaacaaaaaggtaaagcccaagatcccaaagatgaaggatcgggactccgccaactccgctcctaagacacagagcattatgatgcaagtcctggacaagggacgatttcagaagcctgcagccacactttcactgcttgccggccagactgtagaactacggtgcaaaggaagtaggatcgggtggtcttaccccgcctatctcgatacatttaaagattctcggctatccgtgaaacaaaacgagagatatggccagttgacgttggtgaattctacctccgccgacactggcgaattcagctgttgggtccaattatgttcagggtacatttgtcggaaggacgaggcgaaaacgggatctacttacatattcttcactgaaaagggggagctctttgtgcccagccctagttatttcgatgttgtgtacttgaatcccgacaggcaggctgtagtcccttgccgggtgactgtactgagtgccaaggtgaccctgcatagagaattcccagcaaaagaaattccagcaaacgggacggacattgtgtacgacatgaaacgagggttcgtctatctgcagcctcacagcgagcaccagggtgtggtatactgtcgagcagaagcgggtggcaggtcgcagatctcagttaaatatcagcttctttacgtggccgtgccctcagggcccccctccaccacgattcttgcctcttctaacaaggttaagagtggagatgatataagcgtgctgtgcacagttctgggagagccggacgtggaggtcgaattcacatggatcttccctggccagaaggatgagagaccagttacaatccaggatacctggaggctaattcaccggggtctgggacatactactcgcatctcccagagcgtcatcacggtcgaagatttcgaaacaatcgacgccgggtattacatttgcacagcccaaaatctacaggggcagacaactgtagcaaccactgtggaattctcttag

SEQ ID NO: 128938 - DNA, 1128 bp, Artificial Sequence
  Description of Artificial Sequence: Synthetic coding sequence
atgaaagtgtggctccttctgggtctgcttctcgtccacgaggccctcgaggacgtgaccggacagcatcttcctaaaaataagcgccctaaggaaccaggtgaaaaccgcattaagcccaccaataaaaaagtgaaaccgaaaatcccaaagatgaaggaccgagattccgcaaattcagcacctaagacgcaatccattatgatgcaggtgctggacaagggtcggttccagaaaccagctgccactctcagtctcttggctggtcagaccgtggaactacgctgcaaagggagtcggattggttggtcttatccggcctatctggacactttcaaggattctcggttatcagtgaaacaaaatgagagatatggtcagcttacgctggtgaattcaacgtctgccgacacaggtgaattttcatgctgggtgcagctttgtagcggctacatatgtcgtaaggacgaggcaaaaacaggctccacctacattttcttcactgagaaaggagagctttttgtgccgagcccttcctactttgatgttgtgtacctcaaccctgaccggcaagctgtggtaccgtgccgggtaactgttctgtctgccaaggtaacactgcacagggagttccctgccaaagaaatccccgccaatggcaccgatatagtgtacgacatgaaacgcggatttgtgtacctgcaaccacattccgagcaccagggggtcgtatactgtcgcgcggaggccggcgggaggtcccaaatctcagtcaagtatcagctgctgtatgttgccgtgccttcagggcccccatccacaaccatactggcgagctccaataaagtgaaatccggagacgacatatctgtcctctgcacggtgctcggcgagccagatgtggaggtcgagttcacttggatcttccccggccagaaagacgaacgccctgtgactattcaagatacctggagattgatacatagaggacttggccatacgacccggatatcccagtcagttattaccgtcgaggacttcgagaccattgatgccggatattacatctgtacagcacaaaatctccagggtcagacaactgtggcaactaccgtggagtttagttag

SEQ ID NO: 128939 - DNA, 3075 bp, Artificial Sequence
  Description of Artificial Sequence: Synthetic coding sequence
atggcacaaggagccatgagattttgctctgagggtgattgtgcgatctccccaccaagatgcccacgcagatggctgcctgaggggccagtgccacaatcacccccagccagcatgtacgggtccacgggctcccttttgaggagagtggcagggccagggccccgcggccgggaactagggagggtgacagcaccatgcacgccccttaggggaccgccttccccccgcgtggccccttctccgtgggccccatcgtcacccaccggccaacctccccctggggcacagagctcagtggtgatcttccgcttcgtcgagaaagctagcgtgcgccctctgaatgggctccctgctcctgggggcctgtcaagatcttgggatcttggcggggtctcccctcctagaccaactccggccttagggcccggttcaaacagaaagctacgcctcgaagccagcacgagtgacccactgcccgcccggggaggctcagcactccctgggtcgcgcaatctcgttcacggccctcctgcaccgcctcaggtcggggccgacggcctgtattcttctctcccgaatgggctggggggtccccctgagagactcgctactctcttcggtggccctgcagacactggcttcctcaatcagggcgatacttggtctagcccaagagaagtttcttcccacgctcagaggattgccagagcaaagtgggaatttttctatgggtcactggaccccccgagcagcggcgcaaagccccccgaacaggcgcctcctagcccccccggggtgggatcccggcagggaagcggggtggccgtgggacgcgccgccaaatacagtgagaccgacctcgacactgtacctttaaggtgttatagagaaaccgacatagacgaagttctcgccgagagggaagaggctgacagtgcaatagagagccagccatcttctgaagggccacccggcacggcctaccctccagctccacgcccggggcccctgcccggtccgcatccaagtcttggctcgggcaatgaagatgaggatgatgatgaggctggaggtgaggaggatgtcgatgacgaagtgttcgaagcctcagaaggcgccagaccggggtcacgcatgccccttaagtctcccgtccctttcctgccaggtacatcaccttccgctgatggtccagactccttttcttgtgtctttgaggctatcctggagtcacaccgcgccaaagggacctcttacaccagcctagctagccttgaggctctggccagccctggtccaacacaaagcccattcttcaccttcgaacttcctccccagccaccagccccaagaccagacccgccagctcccgcccccttagccccgctagaaccagactccggtacctcgtctgccgccgatgggccctggacccagcgcggcgaagaagaagaggcagaagctagagcgaagctcgcacctggcagggagcctccttccccctgtcacagtgaagactcgttaggtttgggagctgcacctctcggctctgagcccccactgagccagttagtgtccgacagcgacagcgaactggattccacggaaagactggccttagggagtactgacacattatccaacgggcagaaggccgatctggaggctgcgcaacggctggcgaaacgcctctatcggctagatggttttcgaaaggcggatgtggcccgccatctcggcaagaataatgactttagcaaactcgtggccggtgaatacctcaaattttttgtttttacaggtatgaccctggaccaagccctgcgcgtgttcctgaaggagcttgctttaatgggggagacgcaggaacgggaacgcgtgctagcccatttcagtcagcggtacttccaatgcaatcccgaagctctgtcctcagaagatggcgcccacacgttaacgtgcgctctaatgcttttgaatactgatttgcacggacacaacatcggtaagcggatgacttgtggagacttcatcggaaacttagaaggactgaacgatggcggggacttcccaagggagctgctcaaggcgctgtattcttctatcaagaacgagaagctccaatgggctattgacgaagaagaactgaggcgatcactgtctgagctggccgaccccaatccaaaagtgatcaagagaatttccgggggctcaggatccggatcaagtccttttttggacctgactcctgaaccaggcgccgctgtatataaacatggcgctctcgttcgcaaagtgcatgccgatcccgattgccgaaagactccacgggggaaaaggggatggaaaagcttccatggaatcctaaagggaatgattctgtacttgcagaaagaggaatacaaacctgggaaggctctgtcggagacagaattgaagaacgcaataagcatccatcatgccctggccacccgggccagtgactattccaaacggccccatgtcttttacctgcgaacagcagactggcgggtctttctgtttcaggcccctagcctggagcaaatgcagtcttggattactcggattaatgtagtggctgcaatgttcagtgcccccccctttcccgccgctgtgtctagccagaaaaaattttctcgacctttactcccgtcagccgccaccagactttcacaagaggaacaggttcggacacacgaagccaagctcaaggccatggccagtgaactgcgtgaacacagagcagctcagctgggcaaaaagggcagaggaaaggaggcagaagaacagaggcagaaggaagcatatctggagtttgagaaatcccggtattcaacttacgcagctctgcttagggttaagctgaaggcgggtagtgaggagctggatgccgttgaggctgcactggcgcaggcgggttctaccgaggatggtttaccaccatcacacagttccccctcgttacagccaaagccctctagtcagcctcgcgctcagagacactcaagcgagcccagaccaggggccggatccgggcgacggaaaccgtag

SEQ ID NO: 128940 - DNA, 3075 bp, Artificial Sequence
  Description of Artificial Sequence: Synthetic coding sequence
atggcccagggggccatgcgattctgcagcgagggagactgcgccatcagtccaccacggtgccctcggagatggcttcctgaaggacctgttccacagtccccgccagcctctatgtatggctcgaccggaagcctgctcaggagggtggccgggccagggccacgtggcagggagctggggcgggtgactgctccttgcacccctctgcggggtcctccttctccccgggtggcacctagcccatgggcgcctagttctccaactggccagccccctcccggagctcagagcagcgttgtgattttccgctttgtcgaaaaggcctcagtacggcctctgaatgggcttcctgcccccggcgggctcagccgctcatgggatctcgggggcgtcagtcctcctcgccccacgcctgctctgggacctggcagcaatagaaagttgcggctcgaggcctccacatccgatccactgcctgcacggggaggaagcgcccttcccggatctaggaacctcgttcatggccccccagcgcccccacaggtgggggccgatggcttatacagttccctacccaatggattgggaggcccacccgaacgcctggccacccttttcggaggcccggcggatacaggctttcttaatcagggagatacttggtcttctccccgcgaggtaagttcccatgcacagagaatcgcacgcgcaaagtgggagtttttctatggttccctggacccccctagctctggagcgaaaccccctgaacaggctccccccagtcctcctggagttggcagccgccaaggatccggggtggcggtgggtcgcgcagcgaagtacagtgagactgacctggacaccgtccccctaagatgttaccgtgaaacagatatcgacgaggtgcttgctgagcgcgaagaggccgactccgctatcgaatctcagccctcttcggagggccctcctgggaccgcctatcctcctgctcctagacccgggcctttaccaggcccacatccgtctctgggctctggaaatgaggatgaagacgacgacgaagcggggggcgaagaagacgtggacgacgaggtgttcgaggcatctgagggtgctcgaccaggtagccggatgccgttgaaatctcccgtgccttttctgcccgggacctccccatcggccgacggccctgactcttttagttgtgtgtttgaggccatcctcgagtctcatagagctaagggaacgagctacacgagtcttgcgagccttgaagccctcgcttcgcctggtccaacacagtctcctttttttacattcgaactccctccccagccccccgcacctagacccgaccctcctgcacctgcccctctggccccgctggaacctgactccggcacttcctccgccgctgatggcccgtggactcagcgaggggaagaggaagaggccgaagcaagagctaaactggccccaggcagagagccacccagcccctgccatagcgaagactccctgggccttggtgcagctccccttgggtctgaacccccgctcagccaactcgtttctgactcagactctgaactagacagtacggaacgactggcactgggctccactgacacactatctaatggccaaaaagccgacctcgaggccgcacagcggttagccaagaggctgtatcggctggatgggtttagaaaggccgatgtcgcaagacaccttggaaaaaacaatgactttagtaaactggtcgcaggggagtatctgaagtttttcgtgtttaccgggatgaccctggaccaggccctaagagtcttcctgaaggagctggcactgatgggtgagacacaagaaagagagagggtactggcccatttctctcaacgatatttccagtgtaaccctgaagcactctcctctgaggacggcgcacacaccctcacctgtgcgcttatgctacttaatactgacctgcatggacataatatcgggaaaaggatgacatgcggggactttataggaaacttggagggacttaatgacggaggcgacttccccagggaactactcaaggctctttattcttctatcaagaacgagaagttgcagtgggctattgacgaagaagagttgagaagaagtctgtccgaattggctgaccccaacccgaaggtgatcaagcggatatcaggcgggtccgggagcggttccagcccattcctggatctcactcctgagcctggagccgccgtctataagcacggggccctggtccgaaaagtacacgcagatcccgactgcaggaagaccccgcgcggcaaacgcggctggaagtcctttcatggcatcctgaaggggatgatcctgtacctgcagaaagaggagtacaagccggggaaggccctgtccgagaccgagctgaaaaacgcaatttctattcaccacgccctcgctaccagagccagtgattattctaagcgacctcacgtgttctacctccgaaccgctgactggcgtgtctttttattccaggctccctcccttgagcagatgcagagctggatcacacgcataaatgtagtcgcagcgatgtttagtgcaccaccattccctgcagcagtctcgtctcaaaagaaatttagccgtcctctcctaccaagcgcggccacaaggttgagccaggaggaacaggttcgtacacatgaggccaagcttaaagctatggcgagtgagctgcgcgaacatagggctgcccagcttggcaaaaaaggccggggaaaggaggccgaggaacaacgacagaaagaagcttacttagaattcgaaaagagccgttactctacctacgccgccctactaagagtcaagctgaaggctgggagtgaggagctggatgcagtggaggccgcattggctcaagccgggagcacagaagatggcctcccaccaagccactcatccccttccctacaacccaagccttctagtcagccaagagctcagcggcacagttcagagcccagaccaggagccggctcaggcagacgcaaaccttag

SEQ ID NO: 128941 - DNA, 2784 bp, Artificial Sequence
  Description of Artificial Sequence: Synthetic coding sequence
caaatctggcgctgtcctctacagcatcacgcagagagcgcaccacctctacctgcacttagttgggctcagcccctgctgtgccttagctcagtcagtgccctgggagaacagagacccacaccagccctcgggccaggtagtaatcggaagttgcggctcgaggcctccacatcagaccccctgcctgcacgggggggcagcgcgttacctggctcccggaaccttgtgcatggccccccagctcccccacaagtaggcgctgatggcctttatagcagtctgccgaatgggttaggtggacctccagaaagactagcaacgttgtttggtggccccgccgacacggggttcttaaatcagggagatacttggtcctccccccgggaggtttcatcccatgctcagcgcatcgctagagctaagtgggagtttttttatgggtctctggaccccccatcctcaggcgcgaaaccccctgaacaagcccccccatcaccacccggagtcggttctaggcagggcagtggcgtggcagtgggaagagccgcaaaatatagcgaaactgatctggacacagtccctctgcgatgctatcgagaaacggatatagatgaggtgctggccgagagagaagaagctgattcagccattgaatcccagccttccagtgaaggaccacctggcacagcctatccgcccgcgccaaggcccgggccactgccagggccccatccatctctgggatccggcaatgaggacgaggatgatgatgaggctggaggcgaggaagacgtcgacgatgaagtgttcgaagcttctgaaggcgcacgccccggctccaggatgcccttaaaatccccggtaccttttctcccagggacttccccctcagctgatggccccgactccttttcctgcgttttcgaggccatcctcgagagtcatcgcgctaagggtactagctacacctctctggcttccttagaggcacttgccagtcctgggccaacacaatcacccttttttacctttgagctcccccctcaacctccagccccacgcccagatccacccgcacctgcacccctagcaccactggaacctgattccggtacatcctccgcggccgacgggccttggacccaaagaggagaagaggaggaggcagaggccagggctaagctggctcccgggcgggaacctccctctccctgtcacagtgaagactccttagggttaggggctgcacccctaggctctgaaccccccttgagccaactggtctctgatagcgacagtgaattggacagtacagaacgactggctttagggtcgaccgatactctgtctaatggccagaaagcagacttagaagcggcacagcgtctagccaagaggttgtacaggttggacggtttccgcaaagccgacgtcgctcgccaccttgggaagaacaacgacttctccaagctggtcgccggagagtacctgaagttctttgtatttactggaatgacactcgaccaggccctcagggtgttcttaaaagagctcgctctcatgggcgaaacacaggagcgcgagcgagttttggctcactttagccaaaggtactttcagtgcaatcccgaggccctgtccagtgaagatggtgctcataccctcacgtgtgccttgatgctattgaacacggaccttcacgggcacaatattgggaagcgaatgacgtgcggagacttcatagggaacctcgaaggcctcaatgatggcggtgattttccccgggagcttctgaaggccctgtacagttctattaaaaatgaaaaattacaatgggccattgatgaggaagagctccgacgtagcctgtctgagctcgccgatcccaatcctaaggtcataaagcgcatatccggcggatctggatcggggtcttccccattcctagacctgacaccagagccgggcgccgctgtctataaacacggtgccctggtgcgaaaggtgcatgcagacccagattgtcgtaagaccccacgcggaaagaggggctggaaaagtttccacggaattcttaaaggcatgatcctgtacctgcagaaggaggaatacaaacccggaaaagcactatcagagacagaactgaaaaacgccatttcaatccaccatgcactggccactcgggcatctgattactcaaaaagacctcatgtcttctacctccggaccgctgactggagggtgttcttatttcaggctccctcgctcgaacaaatgcaatcctggatcactaggatcaatgtggtcgctgctatgttcagcgcccctccatttcctgctgctgtgtcttcacaaaaaaagttttcgcggcctcttctgccctccgcagctacacgactgtcacaggaggagcaggtgcgaacccacgaagctaaactcaaggctatggcaagtgagctgcgagaacacagagcagcacagctgggaaagaagggccgcggaaaagaagccgaggagcagagacagaaggaagcatacctggagttcgagaagagcaggtattcaacttatgccgccctcctaagggtgaagctgaaggcaggttccgaggaactcgacgctgtcgaggccgctctcgctcaggccggctctactgaggacgggctccccccttctcacagttccccttctcttcaacccaagccttcttcccagcctagggcacagcgacattcatccgaacccagacctggtgccggctcgggaaggaggaagccttag

SEQ ID NO: 128942 - DNA, 1542 bp, Artificial Sequence
  Description of Artificial Sequence: Synthetic coding sequence
atggggtcttcatggtgcttgtacggttgctgtaacgccggggtgaaaacgacgcgactggaggctcactccgaaatgggaagtactgaaatcttggagaaggaaactcctgaaaacctgtccaacggaacctcttcaaacgtcgaagccgcgaaaagactggccaagcggctgtatcagctggaccggttcaagcgtagtgacgtggcaaaacatttggggaagaacaatgagttttccaaactggtagcggaggagtatctgaaattcttcgactttactggcatgacgttggatcagagccttagatacttcttcaaggctttctcactcgtgggcgaaacccaggaaagggagcgcgtgctcatccacttctcaaacagatatttctattgcaaccccgataccatcgcttcacaggatggagtacactgtcttacctgtgctatcatgctattgaacactgacctacacgggcataacattgggaagaagatgacttgccaagagtttatcgccaatcttcaaggtgtgaacgagggtgtcgacttttctaaagaccttttaaaggcgctatacaattccatcaaaaatgaaaaactcgagtgggccgtggacgatgaagaaaagaaaaagagccccagcgagtctacagaggagaaagctaatggcacacaccctaagaccatctcccgtatcgggtccacaaccaaccctttcttggacatcccacacgatcccaatgcagccgtctacaagtccggcttcctggcccggaagatccacgctgacatggacgggaaaaagacaccacgcggcaagagaggttggaaaaccttctacgcagtgctgaaagggaccgtcctgtatctacagaaagatgagtataaacctgagaaggccctgagcgaggaagatctcaagaatgccgtgtctgtccatcacgcgttggccagcaaggccactgactacgagaaaaagccgaatgtgtttaagctcaaaacagcagactggagggtgttgctgttccaaactcaaagccccgaagaaatgcagggctggataaataaaatcaattgtgtggcagctgtgtttagcgctcccccttttccagctgcaataggctcccagaagaagttcagccgccccctcctgccggccactacgaccaagctcagtcaggaggaacagctaaaaagccacgagtctaagctgaaacagatcactaccgaactggcggagcacagatcgtacccccctgacaaaaaagtcaaagcgaaggacgtagacgaatacaaattgaaagaccattacctggagtttgagaagacaagatacgagatgtacgtatcaatcctgaaagagggcggcaaagagctactgtctaatgatgagtccgaggctgccggcttgaagaaaagtcacagctctcccagcctgaacccagacaccagtccaattaccgctaaggtcaaacgaaacgtttctgagagaaaagaccatcgaccggaaactcctagcatcaagcagaaggttacttag

SEQ ID NO: 128943 - DNA, 3144 bp, Artificial Sequence
  Description of Artificial Sequence: Synthetic coding sequence
atggaggggaggagcgccgccgccgagactttcgtgtgggtcaataatgctagcgcccactcacaatctgtcgcgaaggccaagtacgagttcctgttcggaagaagtgagggtaaagctcctgatacatctgatcacggggggtccacgcttctgcctccaaacgtcaccaacgagttccctgagtatgggaccatggaggaagggggcgagggcttgagagcctccctagagtttgacggcgaggccctgccctgtcatcctcaagaacaacagggagttcaacctctgacagggtgtcatagtggactggattctgtgaccgaaggtccaaaagacgtaagagaggcgcccagtcagagccatctgaaagagcagtcattacagccgattgattctctgatatccgcattaaaagccaccgaggcgcggataatttccggaaccttgcaggccacgaaagtcctagaccaggacgccgttagttctttctccgttcagcaggttgaaaaggagttggacaccgcatctagaaaaactcaacgcgtgaataaaaccttgccagccggccagaaaaatctgcctgagatacctttatcagccgaagtgaccaccgaagaatctttctacttgagtattcagaaagacctgaccgccctgctcactggcgatacccaggctgagatctcccagatcatgaataatggaaggaagggtgccgtctgtgttcaggaaccatcctgtccactggcttcactgggtagcagtgccgtgacatgtcattcagctggctctgtgggtttcctgaaggaacagaggtccgctctgggtcgggaacatcccggagggtgtgaccgctcatcctcaatggggcgtccgggtcgggtcaagcatgtcgagttccaaggtgtggaaattctctggaccggaggcgacaaaagggagacgcagcacccgatcgactttgagacatcgctccagagaaccgcttccccagacagcaaggagtcttctaaagtcccgagacatctgatttcatcagccgggctgtgtaattcgagttcattaaccgaaaacgtgtgggatgagtcctggaaagcaccatccgagcgacctggcacctcctcggggaccttcagccccgtacgcctggacgagagcggggaagacgaggttttcctgcaagagaataaacagcacctggagaagacccctaagcctgagcgggaccgggaaaggatttctgaacaggaagagcacgtgaaaggagaagacgaagatatccttggccctggatacacagaagacagcaccgacgtgtattcaagccagttcgagacaatcctggacaatacatctctctattattccgctgaatcattggagaccctatattcagagcctgattcgtatttcagtttcgaaatgcctctgacaccgatgattcagcagaggatcaaggaaggcggacagtttttagagcggactagcggggggggacaccaagacattctgtccgtttctgctgacggaggaatcgtcatgggatacagctcaggcgtgactaatgggctcaacgatgcctctgactctatttacacgaagggaacacctgaaattgccttctggggatcaaacgcgggggtcaagaccacccgcctggaggctcatagcgagatggggagcacggaaatcctcgaaaaagagacacctgaaaatttgtccaacggaacttcatcaaacgtggaagctgcaaaacgtttagctaagcgcctctaccagctggaccgattcaagaggtccgacgttgctaagcacctagggaaaaataatgagttttctaaactagttgctgaagagtacttgaaattttttgatttcactggcatgaccctcgatcagagcttgcgatatttttttaaagccttttcgttggtcggcgaaacacaggaaagggaaagggtactcatacacttcagcaacaggtacttttattgcaacccagatacaatcgcttctcaggacggtgtgcattgtctcacatgtgcaatcatgcttctgaataccgacctccacgggcataacatcgggaaaaaaatgacctgtcaggaattcatagccaacctgcagggagtgaacgaaggtgttgatttcagcaaggatttactcaaagcattgtacaattctattaagaacgaaaaattggaatgggctgttgacgatgaggagaagaaaaagagccccagtgagtctaccgaagagaaagcaaatggtacccaccccaaaacgatttcccgcatcggatccaccaccaacccatttctggacatcccacatgatccgaacgctgccgtttacaaaagcgggttcttagctcggaagattcacgcggacatggatgggaagaagactcctcggggtaagaggggatggaagaccttttacgccgtgcttaagggcacagtgctctatctgcaaaaggatgagtataagcccgagaaagcactgtctgaggaagatttgaagaatgcagtttccgtccatcacgcactggcctctaaggcaaccgattacgagaagaagcctaacgtctttaagctgaaaaccgctgattggagggtcctgttatttcagacacagtcccctgaggagatgcagggctggatcaacaagataaattgcgtggcagcagtgttctcagctccacctttccctgccgcgatcggctctcaaaaaaaattttctcgccctttactgcctgctacaactactaaattatcgcaggaagagcagttgaaatcccacgaatcgaagctcaagcagatcactacagaacttgccgaacacaggtcatatccacctgataagaaggtgaaggccaaggacgtggacgagtacaagctaaaagaccactacctagagttcgaaaaaacccgctatgaaatgtatgtgtctattttgaaggaaggaggtaaggaattgctctcgaatgacgaatccgaagcggccgggctgaagaaatcacattcatccccatccctcaaccccgatacatccccgatcacggctaaagtcaagagaaacgttagcgagcggaaggaccatcgcccagaaacaccctcgataaagcagaaagttacttag

SEQ ID NO: 128944 - DNA, 810 bp, Artificial Sequence
  Description of Artificial Sequence: Synthetic coding sequence
atgattggggtcaactctgtgcagtccgcatctaaggttcgggttcgcacatccggaagtgtgaaatactcccgcgaggattcaataaggaggcagtctcacaggtcaaaatctatgaagatttctaatagcagcgagttcagtgcaaaggagaataaagccctgtacaacagcatcaaaaatgaaaaactcgagtgggccgtggatgatgaggagaagaaaaaatctcctagcgagtctacggaagaaaaagcaaatgggacacatcccaagacaatttccaggattgggtccacaacgaacccattcctcgacattcctcacgatcctaatgcggctgtatataagtctgggttccttgcacgaaagatccacgcggacatggatggaaaaaagacgcctagggggaagcgcggatggaagactttctatgccgtgctcaagggcactgtgctgtatctgcagaagcacgaatctaagctaaagcaaatcaccaccgaactggctgagcatcgatcctacccccctgataagaaagtgaaggccaaagatgtagatgagtataaactcaaagatcactaccttgaattcgagaagacaagatacgagatgtacgtgtcaattctgaaggaagggggaaaagagctgttgagcaacgacgagtccgaagctgctggcttgaaaaagtcacactcaagtccgtccttgaacccggataccagccctattaccgctaaggttaagcgcaatgtgtccgagaggaaagaccaccgcccagagacgccatcaataaagcagaaagtgacctag

SEQ ID NO: 128945 - DNA, 3150 bp, Artificial Sequence
  Description of Artificial Sequence: Synthetic coding sequence
atggaagggaggtccgcagctgcagaaacttttgtgtgggtgaataatgccagcgctcattcccagtcagtcgcgaaggctaaatatgagttcctttttgggaggtctgaggggaaagcccccgacacaagtgaccacggcgggagtactctactgcctcccaacgtgaccaatgaattccccgagtatggaaccatggaagaggggggcgagggactccgggcatccctggagttcgacggggaagctctaccctgccacccacaagaacaacaaggcgttcagccgcttacaggatgtcatagcggcctcgacagcgttaccgaaggtccaaaggatgtgcgcgaggcaccttctcaaagtcatctcaaagaacagtcattgcaaccaatcgattcactgatttctgcattgaaagctactgaggcccggattatatccgggaccctgcaggccacaaaggtgctcgaccaggacgccgtgtccagtttttctgtgcagcaggtggagaaggaattagacacagcctccagaaagacgcagcgagtgaataaaactcttcctgctggccaaaagaacctgccagagatcccactgagcgcagaagtgacaacagaagaatcattctatctgtctatccagaaggacttaactgctctgctgacaggcgatacgcaggccgagattagccagatcatgaataacgggcgcaaaggagcggtctgtgtgcaggagccatcatgtccactcgctagcctggggtcctcagccgtaacctgtcacagcgccggttccgtgggattcttaaaagagcagcggtctgcactgggacgggaacatcccggggggtgtgatagaagctcatcaatgggaagaccaggtcgggtgaaacacgtggaatttcaaggcgtggaaatcctctggacgggcggcgataagagggaaacccagcacccaattgactttgagacatcactacagcgtacagcttcacctgattctaaggagtcctcgaaagtgcctagacatctgatatcgtccgccggcttatgcaacagctcctctctcactgaaaacgtgtgggatgagtcatggaaggccccctctgagagacccgggacatccagcggaacatttagcccggtgcgcctggatgaaagcggagaagatgaggtgtttctgcaggagaacaaacagcacctggaaaagaccccaaaaccggagagagatagggaaagaatcagcgagcaagaggagcacgtgaaaggtgaagacgaagacatcttgggtcctggttatacagaagattccaccgacgtgtattcaagccagtttgagactattctcgacaacacgtctctctactattctgcagaatcactggagacactttattcagagcccgactcctactttagtttcgagatgcccttaaccccgatgatccaacagcggataaaggaaggcggacagttcctagagcgaactagtggcggaggccaccaggatatcctgagtgtttcggcagacggcggcatcgtgatgggatactccagcggggtcacgaatggcctaaatgatgcaagcgattcaatttacaccaagggcacacccgaaattgcgttctggggcagcaatgcaggcgtaaaaacgacccggttggaggctcacagcgaaatgggatctactgaaatccttgagaaggagacccccgaaaacttgtccaatgggacctcttctaatgtcgaggccgccaaaaggctcgccaaacgtctctatcagctggaccggttcaagcgttccgacgtggccaagcacctgggaaaaaataatgagttctcaaaactggtggctgaggagtatctcaaattttttgacttcacgggtatgacactcgatcagtctcttagatacttttttaaagctttttctctcgtgggcgagacccaagagagggaacgagtgctgattcacttttctaaccgatacttctactgcaaccctgacacaatcgcctctcaggatggggtgcactgcttgacatgcgcgatcatgctgttaaatactgatctccatggccacgtgtccaacatagggaagaaaatgacatgccaagaattcattgccaatctgcagggtgtgaacgaaggagtagatttctctaaagatctactgaaagccctatacaactccattaagaacgagaaactggaatgggcagtcgacgacgaggaaaaaaagaaaagtccaagcgagagtaccgaggagaaggcgaacggcacacaccccaagactatttctcgtatcggctccactaccaatccattcttggatattccccatgatcctaacgctgctgtttataaatcaggtttccttgcgagaaagatccatgcggacatggatggcaaaaagacaccccggggcaagaggggttggaaaaccttctacgctgttctgaagggtacagtgctttacctgcagaaagacgagtataaaccagagaaagccctctctgaggaggatctgaaaaacgccgtttcagttcaccacgccctagcttcaaaagccaccgattatgagaagaaacctaatgtcttcaagttaaagacagcagactggagggtgctcctgtttcagacccaaagtccagaagagatgcaggggtggatcaataagattaactgcgtggcggccgtcttttctgcaccgccctttccagcggccattggcagccagaaaaagttctccagaccgttgttgccagcaacaacaacgaagctttcccaggaggagcaactgaagtcacacgagagcaaactgaagcaaataacgactgaactggcagaacaccgcagctatcctccagacaagaaggtgaaagccaaagacgttgacgagtacaaacttaaggatcactacttggagttcgagaagactaggtatgaaatgtacgttagtatactgaaggaaggaggcaaggaactcctgagtaacgacgagtcggaggccgccggtctgaaaaaatcacactctagtcccagcctgaaccctgacacctctcccattacagccaaagttaagaggaatgtgagcgagcgcaaagaccacagaccagagacacccagtatcaagcagaaggttacttag

SEQ ID NO: 128946 - DNA, 3171 bp, Artificial Sequence
  Description of Artificial Sequence: Synthetic coding sequence
atgatgggcgactaccgcctacccgatcatccacagcctatggagatcctcaatctctaccttggagattctctggagccacacccaggtgaatgtccccgagagacctgttctcacgaagatccacccgaaccctttgaggagcagacctgggccaccgaccctccagaaccaactcggcagaacgttcccccatggggatccggtgtggaattgacgcatctgggctcctgggtgcaccaggacggactggagccttgtcaggaacagacaagggcaacggacccgcccgaaagcactcgtcaggatgcccccccctggggcagtggagtagaactgacccacctaggtagcccatctgcacagagggaacatcggcagaacaccgcaagcccaggcagtcccgttaattcccacctgccaggatcccccaagcaaaataggagtacgagtacgcaggtggtgttctgggctgggatcctgcaagcacagatgtgtgtgctcgacctggaggaggaactagagaaaactgagggccttaaggccggactcaaatgttgtcttcccactcctcccgtggacctaccaggggacaccggcttgcactcctcacctccggaaaatgaggactctggggaagactcatcggaacccgagggcgagggccaggcctggctcagggagggaacacctgactcgtccccgcagtggggggcagaggaagagtcaatgtttttctccaatccactgttcttggccagtccttgcagtgaaaactccgcaagcggcgagtgcttctcttggggagcttccgatagccacgccggtgtcagaacaggccctgagagccccgccacactggagccccccctccctgaggacaccgtgctgtgggaactggaatccgaaccagacctgggggacggtgcggcaatctcaggccactgcacaccaccttttcctgtacctatctacaaacctcacagcatctgttgggcctcagtcgctgctgccgaaggggctcccgctgccccaccaggccatggcgagtctgaaggggaccgcctaggcccagccccatccgccgcgccctgtgttgatgaggccttgacctgggaatcagggtgcgtcggtagcgatctgggaccagcggcgcacccagtgcagccctgggcaagcctttcccccgaaggttggcaacgaggaggccccttctggccacaagtcacactgaacagccaggatcgtgatgagagggaaggcggtcatccacaggaaagcctgccatgtacgctggctccatgcccctggcggtcacctgcgtcatctccagagccaagcagccccgaatctgagtcgagagggccagggccccgcccatctcctgcatcttcgcaggagggaagcccccagctccaacaccactcgagcggtatcttaccaaaatggaccctggacgccagccaatcatccctccttgagacagacggggaacagccctcatcactgaagaagaaagaggcaggagaggctccaaaaccaggcgaagaggtcaagtcagaagggaccgcccgaccggctgaaacgggagacgtgcagccagatatacacttgacgagtgcggagcacgagaacctgaggaccccaatgaacagttcatggctgcccggcagcccaatgccccaagctcagagccctgaagagggacagcggccccctgcaggagataagctcgcaaatggagtcagaaacaacaaagtcgcttggaacttagccagtcggctctatagattagagggcttcagaaaatctgaagtggccgcctatctgcagaaaaacaacgatttttcacgcgccgtggccgaggaatatctgtccttttttcagtttggcggacagagtctggacagggccctgcgtagctttttgcaggcactggttctctccggtgagacacaggaacgggaaagaatcctgtaccagtttagccggcggttccatcattgtaacccaggaatctttccttccgtcgactcggtgcatacactgacatgtgcgatcatgctgctgaatacggacttgcatggtcagaatatcgggaagtcaatgagctgtcaggaatttatcacaaatttaaacgggctaagggacggcggaaatttccccaaagaattgctgaaggccttgtattggtcgatcaggagcgaaaagctggagtgggctgtggatgaagaggatacagctaggcccgagaaggctcagcctagtctcccagccggaaaaatgagcaaaccctttctgcaactcgcccaagatccaaccgtaccaacatacaaacagggcatccttgctcgcaaaatgcaccaggatgctgacggcaaaaagacaccctggggaaagcgggggtggaaaatgtttcacaccctgctgagaggaatggtcctctatttcttgaaacagggcgaagatcattgtttagaaggggaaagcctggtgggacagatggtcgacgagccagtgggggtgcaccatagcctggccactcccgccacacattataccaaaaagccccacgtgttccagttgaggacggctgactggcgcctctacttatttcaggcccccacagcaaaggagatgtcctcctggattgctagaattaacctggccgcagccacacacagcgctccaccctttccagcggctgtcggctcccagcggaggttcgtgagaccgatcctgcctgtgggtcccgctcagtctagtctggaggaacaacataggagccatgagaactgtctcgacgccgctgcagacgatctcctggatttacagcgcaacttaccagagagaagaggacgcggcagggagctcgaggaacaccgtctcagaaaggaatacctggagtatgaaaagacaaggtacgagacctacgtacagttgctagttgccagactgcactgtccatccgacgccctggatttgtgggaagagcaattgggacgggaagctggagggacaagggagcccaagctttctctaaagaaatcacacagtagccctagtttgcatcaagacgaggcacctactactgccaaagtgaagcggaacatttccgaaagacggacgtatagaaaaattatcccgaaacgcaatcgcaatcagctatag

SEQ ID NO: 128947 - DNA, 1152 bp, Artificial Sequence
  Description of Artificial Sequence: Synthetic coding sequence
atgccatatgtcgacaggcagaataggatttgcggctttttggatatcgaggagaatgaaaactctggaaaattcctgaggcgatacttcatcctggacacaagggaggatagttttgtgtggtacatggacaacccccagaatttacccagcggctcgtccagagtgggcgcaattaaactgacttacattagcaaggtgtccgatgcgacaaaactgcgcccgaaggccgaattctgtttcgtgatgaatgctgggatgaggaaatacttcctgcaggcaaatgatcagcaggatctggtggagtgggtaaatgtcctgaataaagccatcaagatcacagtgcccaagcaaagcgattctcaaccaaatagcgacaacctcagccgccacggcgaatgcggcaagaaacaggtgagctatcgtaccgatatcgtggggggcgtcccgataataaccccgacacagaaagaggaagttaacgagtgtggtgaatccatcgaccgtaacaacctgaaaagatcgcagagccacttaccctattttactcccaagcccccgcaggatagcgccgtgatcaaggcaggctactgtgtgaagcagggcgcggtgatgaaaaattggaagagaagatattttcagctagatgagaataccataggctattttaaaagcgagctggaaaaggaacctctgcgtgttattcctctgaaggaggtccacaaggtacaagagtgcaaacagagcgatatcatgatgagggataatttattcgaaattgtgactacgtccaggaccttctacgtccaggccgattcacctgaagagatgcatagctggattaaagccgttagcggggcgatcgtcgcccagaggggacctgggagatctgcttcttccatgcgtcaggcccggcggctgtcaaacccgtgcattcagcggagcattccgccagtcctgcagaatcctaacactctgtctgtgttacctacgcaaccgcccccaccccacattccccagcctttggctgcaacgctgtggtcccagccactgccatggaggagcgaggattttacaagccttctgcccagatctagccagggcacttcgagaagccgtctcagtttacaggagaatcagctgccaaagtag

SEQ ID NO: 128948 - DNA, 1152 bp, Artificial Sequence
  Description of Artificial Sequence: Synthetic coding sequence
atgccatacgtcgaccgacagaatagaatttgtggattcctcgatatcgaggaaaatgagaattccggaaaattcctacgcaggtattttattctcgatacgcgggaggactctttcgtctggtacatggataatccacagaacctgccgagcggcagctcacgcgtcggcgctatcaagctcacctatataagcaaggtgagcgatgctactaaactgagaccaaaagctgaattttgctttgtcatgaacgcaggtatgcggaagtacttcctccaggccaacgaccagcaagatcttgtggaatgggtgaacgtgctgaacaaggcaatcaagatcaccgtgcctaaacaatctgactcccagccaaattctgataatctgtcccggcacggtgagtgcgggaaaaagcaggtgagctatcggacagacatcgtggggggtgttcctattatcacaccaacacaaaaagaggaagtgaacgagtgtggggaatccattgaccgaaataacctcaagaggagccaatcccatttgccctattttactccaaagcctccacaagactcagctgtcatcaaagcgggctattgtgttaagcagggtgcggtcatgaagaactggaagcgccgctactttcagttagacgagaacacaatcggttattttaaatccgagctagagaaagagccacttagagtgatacccctgaaggaagtgcataaggttcaggagtgtaagcagtcagacatcatgatgagggataatctcttcgaaattgtgactacatcaaggacgttttatgtgcaagcagattcacccgaggagatgcattcctggattaaggcagtgagtggcgccatcgtagcccagaggggccccggacgcagtgccagtagcatgcgccaagcacggcgactgtccaacccatgcattcaacgctcaattccgcctgtactgcagaatcctaatacactgagcgtcctccccacccaaccacccccccctcacatcccccaacccctggctgcaacattatggagccaacctctaccttggaggagtgaggacttcacctctcttttgccccgcagctcacagggcacctcccggagccgactctcgctccaagagaatcagctacctaaatag

SEQ ID NO: 128949 - DNA, 1215 bp, Artificial Sequence
  Description of Artificial Sequence: Synthetic coding sequence
atgccatacgttgatcgccagaatagaatttgtgggtttctggatattgaggaaaacgagaactctgggaagttcctccgtagatacttcatcctcgacacacgagaagatagcttcgtatggtacatggataatcctcagaacctgccatctggctcttcccgtgtgggggcaatcaagctgacatatatttctaaggtcagtgatgccactaaacttcgccccaaggctgagttttgcttcgtaatgaatgcaggaatgcgcaaatatttccttcaggctaatgaccagcaggacctggtggagtgggtcaatgtgctgaacaaggccataaagataactgtgccaaagcaaagcgacagccagcccaattccgacaacttatctaggcatggcgaatgtggtaagaaacaagtttcttatagaacagacatcgtggggggcgtgcctataattacaccaacacagaaggaggaggtgaatgagtgtggcgagtctattgataggaataacctgaagagaagtcagtcacatctcccctactttacccctaagccaccccaagactcagctgtgattaaggcggggtattgtgtcaagcaaggagccgtcatgaaaaattggaaacggcgttattttcaactagatgaaaacactatcgggtactttaagtccgagctggaaaaggagcccttgcgggtgatcccacttaaagaggtccacaaagttcaggagtgcaaacagtcagacatcatgatgcgcgacaacctgttcgaaatcgtcactaccagcagaactttctacgtacaggccgacagccctgaagagatgcactcctggatcaaagccgtatccggcgccatagtcgctcagcgcggacctggccggtctgctagttctgagcatccccccggcccttccgagtctaaacacgcctttcgcccgaccaacgcggccacagctacttcgcattctacagctagcaggagcaactccttagtgagcaccttcactatggagaaaaggggattctacgaaagtctcgcaaaagtaaagcctggaaattttaaagtccagaccgttagccctagggaacccgcatccaaggttaccgagcaagccctcctgcggccgcagtctaagaatggccctcaggagaaagactgcgatctcgtggaccttgatgatgcttcactccccgtgtcggacgtctag

SEQ ID NO: 128950 - DNA, 345 bp, Artificial Sequence
  Description of Artificial Sequence: Synthetic coding sequence
atgccctatgtagatcggcaaaaccgaatttgcggatttctggatattgaggaaaacgagaatagcggtaaattcctaaggagatattttattctggacactagagaggacagcttcgtgtggtatatggataacccccagaatcttccatctgggagcagccgagttggtgcaatcaagctaacatatataagtaaggtgtcagacgcaacaaaactccgccccaaagcagagttctgtttcgtgatgaatgccggtatgaggaaatatttcttgcaagcaaatgaccagcaagacttggtggaatgggtcaacgtacttaacaaggctatcaaaattacctag

SEQ ID NO: 128951 - DNA, 1215 bp, Artificial Sequence
  Description of Artificial Sequence: Synthetic coding sequence
atgccgtacgtggatcgacagaatagaatctgtggttttctggatattgaagaaaacgagaacagcggaaagtttttaaggagatattttatcctggacacacgagaagactcattcgtttggtacatggacaaccctcagaatctgccctcgggaagcagtcgcgtcggtgcaattaagctgacctacatatcgaaagtgtctgacgctaccaaacttagacctaaggcagaattctgcttcgtcatgaacgccgggatgcgaaaatacttcctgcaagctaacgatcagcaggacctggtagagtgggtgaacgtgctgaataaggcaataaagattaccgtcccaaagcagtctgacagccagcctaatagtgataacctgtccagacacggcgagtgtggaaaaaaacaagtgagctataggacagatatcgtgggcggtgtgcccattataacgcccacgcagaaagaagaagtgaacgaatgtggcgagagcatcgacaggaataatctgaaaaggtctcagagtcatctgccgtacttcactcctaaaccaccccaggactctgctgtgattaaggctggatactgtgttaaacaaggcgccgttatgaagaactggaagcgaaggtacttccaactcgacgagaataccatcggatatttcaagagcgaattggagaaggagccactgcgggtaatacctttgaaggaggttcataaggtgcaggagtgcaagcagagcgatatcatgatgagggacaacctgtttgagattgtaactacaagccgcacgttctatgtccaagctgatagccccgaggagatgcactcctggatcaaggctgtgagtggggccatcgtcgcgcagcgtggcccgggacgtagtgctagcagtgagcaccccccaggccctagtgagagtaagcacgcattcaggccaactaatgccgcgactgccacctcccatagcaccgcttcacgctccaatagtttagtgtcgacatttactatggaaaagagaggtttttatgagtcactggctaaagtgaagccgggcaacttcaaagtgcagacggtgagtccaagggagccagcatctaaggttactgagcaggcactgcttagaccacaatcaaaaaacgggccacaggagaaggactgtgatttggtagatctggacgatgcctctctgccagtgtcagacgtgtag

SEQ ID NO: 128952 - DNA, 1215 bp, Artificial Sequence
  Description of Artificial Sequence: Synthetic coding sequence
atgccttatgtcgatcgccagaacagaatttgcgggttcttagacatagaagagaatgagaacagcgggaaatttctgcgccggtatttcattttggatacacgggaggactcattcgtgtggtacatggataatccacagaatttacctagtgggagctctcgcgtaggcgccattaagcttacctacatatccaaggtctctgatgccaccaaactgcgccctaaagcagaattttgtttcgttatgaacgctggtatgcgaaaatatttcctgcaagccaacgaccaacaggatttagtggagtgggtaaatgtcctcaacaaagccatcaagattaccgtccctaagcagtcagactctcaacccaattcagacaacctgtctcgccatggcgaatgtgggaaaaaacaagtgagctacaggacagacatcgtgggcggggtaccaatcatcacacctacgcagaaggaagaagttaacgaatgcggtgaatcaattgataggaacaacttaaaaagatcccaatcacatctcccctacttcacccccaaaccgccgcaggattccgcagtgattaaggcaggatattgcgtgaaacaaggagcagtgatgaagaactggaaaagaaggtactttcagctggatgagaacactattgggtacttcaaaagcgaattggaaaaggagcccctgagggtgatcccgctaaaagaagttcacaaggtgcaggagtgtaaacagagcgacatcatgatgcgggacaacctatttgaaatcgttaccaccagccggaccttttacgtgcaagccgatagccctgaggagatgcatagctggatcaaggcggtgtcaggcgctatcgtagcacagagagggcctggccggagcgcttcaagcgagcatccgcctggaccaagtgaatctaaacatgcattcaggccaacaaacgctgcaaccgctaccagccactctaccgcgtcccgctcgaatagtctggtcagtaccttcacaatggagaaaagaggcttttacgagtccctggctaaggtgaagcccgggaattttaaggtacagaccgtctccccacgagaacccgccagcaaggttactgaacaggccctactgaggccgcagagcaagaatggccctcaagagaaggactgtgacctcgtggacctagacgacgcatccctccccgtgagcgacgtatag

SEQ ID NO: 128953 - DNA, 1005 bp, Artificial Sequence
  Description of Artificial Sequence: Synthetic coding sequence
atgccctatgtagacaggcagaataggatatgtggatttctcgatattgaggagaatgagaactctggaaaatttctgcgacggtattttatcttggatacccgcgaagactccttcgtctggtacatggacaacccgcagaaccttccctccggcagctctcgagttggtgccattaagctgacatacataagcaaggtgtctgatgccaccaagctacgcccaaaggcagagttttgttttgtaatgaatgccggaatgcgcaagtatttcctccaggctaacgatcaacaggacctggtggagtgggtcaatgtgctcaataaggccattaaaattactgtacccaagcagagcgattcccagccaaacagtgacaatttatctcggcatggcgagtgcgggaaaaaacaagtgtcttaccggaccgatatcgtgggcggcgtgccaatcattacaccaacacaaaaggaggaggtgaatgaatgcggagagtctatagatagaaacaatctcaagcgctcccagagccatttaccatatttcactcccaaacccccccaggatagcgctgtgatcaaggccggctactgtgtgaaacagggggccgtcatgaagaattggaaacgccggtacttccagctggatgagaatactattggctacttcaaatcggaattagaaaaagagcccttaagagtgattccactcaaagaggttcataaagtccaggagtgcaagcaatcagatattatgatgcgcgataatctatttgaaattgtgaccactagtcgcacgttttacgtgcaggcagacagccctgaagagatgcacagctggattaaggcagtttcgggtgctatcgttgcccagcgtggtcccggtagatctgcctcaagtatgcgacaggcacgtcgcctgtccaacccatgcatccaacgctatacgtcacgagcaggggagtgttccacctatgtggggtctcatgctaatgtgccaagttag

SEQ ID NO: 128954 - DNA, 1278 bp, Artificial Sequence
  Description of Artificial Sequence: Synthetic coding sequence
atgccctatgtcgatagacagaacaggatctgtggctttcttgacatagaagaacacgaaaattctggtaagtttctcaggcgctacttcatcttggatacacaggccaattgcttactgtggtatatggacaatccacagaatctggcgatgggggcgggggcggtgggagccctccagctgacatacatctccaaggtgtcgatcgccacacccaaacagaaacctaagacaccattctgcttcgttataaacgctctctcacaacggtactttttacaggccaacgaccagaaggatatgaaagactgggtggaggccctgaaccaggcgtctaaaatcaccgttccaaaaggcggggggcttcccatgaccacagaggtgctaaagagcctggccgcccccccagccctggaaaagaagccacaggttgcctacaaaaccgagattattggaggagtagtagttcatacaccaatttcccaaaacggtggggatggacaggaaggcagtgagccgggtagccatactatattacggaggtcgcaaagctacataccaacctccgggtgcagggcctctactggcccccccttgatcaaaagtggttactgtgtgaagcaagggaatgtgaggaagagttggaagaggaggtttttcgcactggatgatttcacgatctgctacttcaagtgcgaacaagacagggagcccttgcgtacaatctttttgaaagatgtactgaagacgcatgagtgcctcgtgaagtcaggggacttattaatgagagacaacctgtttgagatcattaccagttctcgtacattctacgtacaagccgacagtcccgaggacatgcactcttggattaaggaaataggggccgccgtacaggcgcttaagtgccatcccagggaaacatctttctcgaggtccatttcactcacccggccaggcagctcctcactttcatcaggccccaattccatcctgtgtagagggaggccaccacttgaagagaagaaggccctgtgtaaagcgccgtccgtggctagcagttggcagccttggacacctgtaccacaagcaggtgagaagctgctaccacccggggacacctctgaggactcacttttcactccaaggccaggcgagggatctgcgcctggcgtcctaccatcatctaggattcggcacaggtccgagccccagcaccctaaggagaagccctttatgtttaatttggatgacgaaaacatccgaacctccgatgtatag

SEQ ID NO: 128955 - DNA, 348 bp, Artificial Sequence
  Description of Artificial Sequence: Synthetic coding sequence
atgccctatgtggacaggcagaatcgcatttgtggctttttagacatagaagagcacgaaaactccggaaagtttctacgccggtacttcattttggatacccaagccaattgtctgctctggtatatggataacccccagaacttggccatgggcgcaggagccgtcggtgccctgcaactgacctacatctccaaggtgagcatagcaaccccaaagcagaagcctaagaccccattttgttttgttatcaacgctctgagccaacgctatttcctgcaggctaacgatcagaaggatatgaaagactgggttgaagccctgaaccaggcctcaaagatcacctag

SEQ ID NO: 128956 - DNA, 1128 bp, Artificial Sequence
  Description of Artificial Sequence: Synthetic coding sequence
atgggggccggcgctgtgggcgctctccagctgacatacatttctaaggtctctatcgccacccccaagcagaagccgaagaccccgttttgtttcgtcattaatgctttgtcccaacggtacttcctgcaggctaatgaccagaaagatatgaaggattgggtggaagctctgaaccaagctagcaagataacggtgccaaaggggggaggcttacccatgaccactgaggtcttgaagtccctcgcagcaccacccgccctggagaaaaaaccccaggtggcctacaaaaccgagattatcggcggcgtcgtagttcatacgcccatttcccagaatggcggagatggccaagaggggtccgaacctggttcccacacaatcctgcggagatcacagtcttatatccctacaagcggttgtagagcaagtaccgggcccccacttataaagtctgggtattgtgtaaagcagggtaacgtgaggaagagttggaagcgccgtttttttgcattggatgatttcaccatctgctactttaagtgcgaacaagacagggagcccctacgcaccatttttttgaaggacgtgttgaaaacacatgagtgcttagtaaaaagcggggacctgctgatgcgggataatctcttcgagatcattacaagctctcggactttctacgtgcaggcagacagccctgaagatatgcacagctggatcaaggaaatcggggccgccgtgcaggccctcaagtgccacccgcgggagaccagcttctcacggagtatttccctgacaagacctggtagcagcagccttagcagtggtccaaattccattctgtgcaggggcagaccgcccctggaagagaaaaaggcactctgtaaggctccaagcgtggccagttcctggcagccatggacccccgtccctcaggctggcgagaagctgctgccccctggagatacttccgaggattctctatttaccccacggcctggggaggggtccgccccgggcgtactcccatcttcccgaatcagacacaggtccgaaccccagcatcctaaagagaagccttttatgttcaatctggatgatgagaacattcgcacctcagacgtttag

SEQ ID NO: 128957 - DNA, 4083 bp, Artificial Sequence
  Description of Artificial Sequence: Synthetic coding sequence
atgagcagacagagtacactctattccttttttcccaagagccccgctctgagtgatgctaataaagcctccgctcgcgcaagtcgtgagggaggccgtgcagccgccgccccgggagccagcccatctcctgggggcgacgctgcgtggtccgaagccggaccaggcccgagaccccttgcgcggtcagcatcgcctcccaaggcgaagaacctgaacggtgggctgcgtcggagcgttgctcctgcagcaccaacgagctgtgacttttcacccggtgatctggtttgggccaaaatggagggttacccttggtggccctgccttgtctataaccatccctttgacgggacatttattagggaaaagggcaagagcgtgagagtacatgtccagtttttcgacgatagtcctacaagggggtgggtttcgaaacgactcctcaagccctacaccggatcgaaatcaaaagaagctcagaaggggggacacttctacagcgccaagcccgaaatccttcgggcaatgcagagagctgatgaggctttgaacaaggacaaaatcaagcgacttgaactggccgtctgtgacgaaccgtcggagcctgaagaagaggaagagatggaagtcggaactacatacgtaaccgacaagtctgaagaggacaacgagatagaatccgaggaagaagtgcaaccgaaaacgcagggatcacgaagatcatccaggcaaatcaaaaagaggcgagtgattagcgactctgaaagtgatatcgggggatccgacgtggagttcaagcccgacaccaaggaagaggggtcttctgatgagatttcctccggcgtgggggatagtgaatccgaggggttaaattctcccgtgaaggtcgccagaaagcgtaaacgaatggttacagggaacggctccctgaagaggaagtcatcgaggaaggagacaccctccgcaactaaacaagcaacaagcatctcttccgagaccaaaaatactttaagggctttttccgcgccccagaattccgaatcgcaggcccacgtgtccggtggcggagatgactcctctcgcccgactgtgtggtaccacgagacactggagtggttaaaggaggaaaagagacgcgatgaacacaggagacgcccggatcatcccgattttgatgcgagcaccctgtacgttccagaagattttcttaacagctgcactcccggcatgaggaagtggtggcagatcaaaagccaaaattttgatttggttatatgttacaaggtagggaaattttatgaattgtatcacatggatgccctgataggggtgtccgagctcggtctcgtcttcatgaagggcaactgggctcattccgggttcccagagatcgcgttcggtagatacagcgactccctcgttcagaagggatacaaggtggcccgagtcgagcaaacggaaacaccagagatgatggaggctcggtgccggaaaatggcccatatatccaaatacgaccgtgttgtgagacgcgaaatatgccggatcattaccaagggtacacagacttactctgtgctcgaaggcgacccctccgagaattactctaagtatctgctcagtcttaaggagaaggaggaagattccagtggacacacacgcgcctatggcgtttgttttgtggatacgagcttaggaaagtttttcatcggccagttctccgacgaccgacactgttctcgtttccgcactctggtcgcccattaccccccggtccaggtcttgttcgaaaagggtaatctcagcaaggaaaccaagactatccttaaatcttctctgagctgcagcctccaagaagggctgatcccaggctctcaattctgggacgcctctaaaacgctgcgtactctactggaggaggaatacttccgcgagaaactttccgacggaatcggcgttatgcttccacaggtcctgaagggcatgaccagcgaatccgattccataggcctcacccccggcgagaagtcggagctggccctttctgcactaggcgggtgtgtgttttatctgaaaaaatgcctcattgaccaggagctcttatccatggccaatttcgaggagtacatccctttggatagcgacaccgtgtcgacaacgagatccggggccatcttcaccaaagcctaccagaggatggtcctggacgcggtaactctgaacaacctggagatttttttaaacggcaccaatggcagcactgaggggacactcctggaaagagtagacacatgtcacacacccttcggaaaaaggctcctcaaacagtggctgtgcgctccactgtgcaaccactacgcaatcaacgatcgattggacgccatcgaagatctcatggtggtaccagataagatcagcgaggtcgtggagctgttaaaaaagctcccagacctggaaagactcttgagcaaaatccacaatgtggggtccccattgaaaagccagaatcaccccgacagccgggccatcatgtatgaagagaccacatattctaaaaagaaaatcatcgactttctgagcgctttggagggttttaaggtcatgtgtaaaattatcggcatcatggaggaagtggcagatggtttcaagtcgaagatactgaagcaagtgattagtctgcagactaagaaccccgaggggagattccccgatttgacggtcgagcttaaccgctgggacacggctttcgaccacgagaaggctcgtaaaacaggtcttataacaccaaaagctggcttcgacagcgactatgaccaagcactggccgatattcgggagaacgagcaaagcctgctggagtatcttgagaagcagcgcaaccggatcggctgtagaaccatagtttactggggcatcggtaggaataggtaccaacttgaaattcccgaaaatttcacaaccagaaatcttccggaggaatacgagctgaagtccacaaagaaagggtgtaaacgatattggacaaagactattgagaagaagttagccaacctgataaatgcagaggaaaggcgagacgtgtcgctgaaggactgtatgcggagactcttctataatttcgataagaattataaagattggcagtctgccgtcgagtgtatcgccgtactcgacgtgctactgtgtctggctaactactccaggggaggagacggtcccatgtgcaggcccgttattttgctgccagaggacacgcccccattcctggagctgaagggctctagacacccgtgtattaccaaaactttctttggggacgactttatccctaacgacatattgattggctgcgaagaagaggaacaggagaatggcaaggcctactgtgttctggtgaccggccccaatatggggggaaagagcacgctaatgcggcaggcaggtctgttggccgtaatggcccagatggggtgttatgtgccagcagaggtctgtcggcttaccccgatcgacagagtgtttacccggctgggcgcctcagacaggatcatgagtggcgagtccacgttcttcgtcgagctgagcgaaacggcctcaatcctcatgcatgccacagcccattccctggtattggtggatgagctgggcagaggaaccgccacatttgacgggaccgccatcgccaacgcagtcgtgaaggaattggcagagacaattaaatgccgcactctttttagcacgcattaccactcactggtcgaagactatagtcagaacgttgccgtgcggttagggcacatggcttgcatggttgaaaacgagtgcgaggatccgtctcaggaaactatcactttcctgtacaaattcattaagggcgcttgcccaaagagctatggattcaatgcggcgaggctagcaaacctgcccgaggaggtgatccagaagggccaccgtaaggccagagagtttgaaaagatgaaccagagtctgcgactatttcgcgaggtctgcttggcttcggaacgcagcaccgtcgatgctgaggccgtgcacaagttacttaccctcatcaaggagctatag

SEQ ID NO: 128958 - DNA, 2340 bp, Artificial Sequence
  Description of Artificial Sequence: Synthetic coding sequence
atggagggctcacgtcctagaagctctctgtcactggccagctctgcatctacaatctctagcctctcatctctctcacccaaaaaacctacgcgggcagtaaacaagatacatgcattcggaaagcgagggaatgctctgagaagggaccccaaccttccagtgcatatccgcggttggctccataaacaggactccagcggcctccgattgtggaaaaggcgctggtttgtgctgtctgggcattgtctgttctattataaggatagtagggaggaatcagtattgggatctgttctactgccctcatataatattcgccccgacggtcccggggcaccccggggccgccgtttcaccttcaccgctgagcaccctggcatgcgtacatatgtgctggccgccgacaccctcgaggacctgagaggctggctgcgggccttgggaagagcttcacgggctgagggggatgactacggacagccccgctctcctgcccgcccacagcctggggaaggcccgggcggaccaggaggtccaccagaagtgtctcgtggggaagaggggcgcattagtgagtctcccgaggtgactcgcttgagcagaggaaggggccgaccacggcttcttacaccttcaccaacaaccgatctacactccgggttgcagatgcggagggccagaagccctgacttattcacccccctcagtaggccgccaagtcccctgagcctcccgaggcctcgcagtgccccagctcggaggccgcccgcaccgtcgggtgacacggctcctcccgcccggcctcatacccccctctcacggatcgatgtaagacctcccctggattggggtccacagagacagacactcagtagacccccaacaccgcgccggggccccccttcggaggctgggggcgggaaaccacccagatcgccccagcactggtctcaggagccaaggactcaggcacattcaggctcccctacgtatctgcagcttcctcctaggcccccaggcactcgcgcctctatggtgctgttaccaggcccacctctcgaaagtactttccaccaatcgctggagacagataccttactcacaaagctgtgcggccaggatcgcctcttgagacgcctgcaagaggagatcgaccagaaacaggaggaaaaagaacagctggaagctgctttggagctgaccagacaacagttagggcaggccacccgggaggctggggcccctgggcgtgcctgggggaggcagagattgctgcaggataggctggtttcggttcgggcgacgctgtgtcatctaacccaggaacgcgaaagggtgtgggatacatactcagggctcgaacaggaactaggtaccctgcgtgagacactggagtacctgctgcatcttggttctccacaggatcgagttagcgcccagcagcaattatggatggtcgaagacacactagctgggctaggtgggcctcagaagccccctccacacaccgaacccgatagcccttcccccgtgctccaaggagaagaatcgtctgagcgagaatcccttccagagagcctggaattgagcagcccacgcagcccagagacggactggggtcgcccccccggtggggacaaggatctcgcgtctcctcaccttggcctgggcagtcctcgtgtctcaagagcatcaagtcctgagggaagacacttgcctagcccacagcttggaaccaaggccccggttgctcggccccgtatgagcgctcaggagcagctggaaagaatgcgtcggaaccaggagtgtggtagacctttccccaggcctacttcgccacgcttgctcacgctgggccggaccctgagcccagctagacgccaaccagatgtggaacagagacccgttgtgggtcattcaggcgctcagaagtggcttaggtcgtccggatcttggagctcgcctagaaacactaccccatatctgccaacatccgaaggtcaccgcgagagagttctcagcctgtcacaagccctcgccacggaggcctcccaatggcacaggatgatgacaggaggcaatttggactctcagggagatccactgccgggggtacctttgccaccctcagaccccacccgtcaagagactcccccaccccggtctccaccagtggcgaactccgggtccaccgggtttagtaggaggggttcaggaaggggcggcggccctactccttggggacctgcctgggacgccggcattgctccccctgttttaccacaggatgaaggtgcatggcccctgcgtgtaaccctgctgcagtccagcttctag

SEQ ID NO: 128959 - DNA, 1752 bp, Artificial Sequence
  Description of Artificial Sequence: Synthetic coding sequence
atggaagggagtcgccctcgtagcagtttgtctttagctagctccgcctccaccattagcagcctgtcaagtctgtcccccaaaaaacctaccagagctgtcaataagatccatgcttttgggaaacggggcaatgccctcagaagagatcccaatctaccagtgcacatcaggggctggctccacaagcaggactccagcgggttacgcctctggaagcgacggtggtttgtccttagcggtcactgtctgttttactataaagactctcgagaggaatccgtgctcggctccgtactgctcccttcctacaatattcgtcccgatggtcctggggcaccccggggcaggcggtttaccttcacggctgagcaccccggaatgaggacctatgttctggccgcagacaccctcgaagatctgcgagggtggttacgcgccctcggtagggcatccagggcggagggcgacgattatggtcagccgcgcagcccagcgagaccacaaccaggagagggacccggcggtcctggcggaccgcccgaggtttctcggggtgaggagggacggataagcgaaagtcctgaagtcaccagacttagcagggggaggggcaggccccggcttcttacaccatctccgaccactgatctgcatagtgggctgcagatgcgtcgcgcccgctcgcctgacttgttcacgcccctttcccggccaccttctcctctctccttgccgagaccccgaagtgcgcccgctcggaggccacccgccccgtcgggtgatactgcccccccggcccggccccacacacccctcagccgcatcgatgtcagacctcccctggactggggaccccagaggcagaccctgtcacgccctcctacgccaagaagagggccaccctccgaggctggcggcggtaaaccccctcgtagtccacagcactggtcacaggaacctaggacccaacccggtcctcctctggagagcacctttcaccagtccttggagaccgatacattacttacgaagttatgtggccaggaccgactgctccggcgcttacaggaggagatcgaccagaagcaggaagagaaagagcaactggaggccgcgctggagctgaccaggcagcaactcggtcaggccacgagagaagctggggcacccgggagggcgtggggaagacagagactcctccaggacaggctggtttctgtccgagctaccctgtgccacctaactcaggagagggaaagggtgtgggatacttactctggattggagcaggaactgggaacactgcgggagaccctagagtatctgttacacttagggagccctcaggatagagtaagcgcccagcagcagctttggatggtggaagacactctcgctggtctgggagggcctcaaaagcctcctccacacactgaaccggatagtccaagccccgtgctccaaggcgaagagagcagcgaacgtgaaagcttacctgaatcgctggaactgtcatcgcctaggtcacccgagaccgactggggacgccctccaggcggggataaagatctggcctccccgcatcttgggttgggttcgccacgcgtgtcccgcgccagcagtcccgaggggaggcacctgcccagtccacaattggggacaaagtcaaaggagcaccaccccctcctggctgactttcggcgaagccccggagctggctctcaacctctgccatcaccgggctattag

SEQ ID NO: 128960 - DNA, 3366 bp, Artificial Sequence
  Description of Artificial Sequence: Synthetic coding sequence
atggcagccgctaccgtggggcgagacaccctgcctgaacactggtcctacggcgtctgcagggatggacgtgtcttcttcattaatgaccagttgaggtgtacaacatggctgcatccacgtactggggaaccagttaactccggccatatgatccgaagtgacctaccacggggttgggaagagggtttcacggaggagggagcttcctacttcatagaccataaccagcagacgactgcgttccgacatcctgttacggggcagttttctcccgagaattcagaattcatcttgcaggaagaaccaaatccccatatgtccaagcaggacaggaatcaacgtccttccagcatggtgagcgaaacctctacagctgggacagcctccacactggaagctaaaccaggtcctaagatcattaagtcgtccagcaaagtacatagtttcggtaaaagggatcaggctatccgacgtaatccaaatgttccggtagtggtccgcgggtggctacacaaacaggactcatcaggaatgagattgtggaaacgacggtggttcgtcctggccgattactgcctgttctattacaaggatagtcgcgaggaggccgtgctaggaagcataccattgccttcatacgtaatcagtccggtggccccggaggatcgaatctcaaggaaatactctttcaaggccgtacacaccgggatgcgagcgctaatttacaattcctctaccgctgggtctcaggcagagcagtcagggatgcggacttattatttctccgctgacactcaggaggacatgaacgcatgggtgagagcgatgaaccaggctgcacaggtgctgagccgctcgtcacttaagcgcgacatggagaaggttgagagacaggctgtacctcaggcgaatcacacggaatcttgtcacgagtgtggacgcgttggaccgggacacacacgcgactgtcctcacagagggcacgacgacatcgtgaacttcgagcgccaagagcaagagggggagcaatataggtcccagcgtgatccacttgaaggaaaacgggatcgaagtaaggcccgctccccttatagtccagccgaagaggatgctctttttatggatttgcccaccggcccacgtgggcaacaagcgcagccgcagagagcggagaagaacggcatgttgcccgccagttatggcccgggtgaacagaatggtaccggaggctatcaacgggctttcccgccacgtacgaatcctgaaaagcattcccagaggaagtctaaccttgcgcaggttgagcactgggcgcgagcccagaagggggacagcaggtcactgcccctcgatcagacgctgccccggcaaggtcctgggcagtccctaagttttccagagaattaccagacactgccgaagagcacaagacaccccagcggtggaagtagtccgcctccccgaaatctcccttctgactacaaatatgctcaagaccgagcctcccatctgaaaatgtccagtgaggagagacgggctcacagagacggcacagtctggcagctgtacgagtggcagcaacgacagcaattcaggcatggaagccctaccgcccctatctgtctaggctcacccgagttcaccgatcagggtagatcacgttctatgctggaggtcccgcgtagcatctcggttcctcctagcccctcagacattccccctcccgggcccccccgggttttccctccacgacggccacacacccctgcagagagagtgaccgtgaagccaccggatcagagacggtccgtggatattagcctcggggatagtcctcgccgggcccgagggcatgctgtcaagaacagtagccacgtggatcgacgatcaatgccgtcgatgggatacatgacccacaccgtttctgcacctagcctgcacggaaaaagtgccgacgatacttacctacagctgaagaaggacctagaatatctggatttgaaaatgacaggccgcgatttgttgaaagaccgttcgttaaagccagtcaagattgcggaatcagacacagacgtcaagctgtctatcttttgtgaacaggaccgtgtgcttcaggatctcgaagacaaaatccgggctctgaaggagaataaggaccagctggagtccgtgctcgaggtactgcacagacaaatggagcaatacagggaccagcctcaacaccttgagaaaatcgcttaccagcagaaactcctccaggaggacttggtgcacattagagcagagctgtcccgggaatctactgaaatggagaatgcttggaatgagtatctgaagctcgagaatgacgtagagcagctcaagcaaactctgcaggaacagcatcgccgtgctttttttttccaagaaaaatcacagattcagaaagatttgtggcgaattgaagacgtcactgctggactatcagccaacaaggagaatttcaggatcctggtggagagtgttaagaatccggagcgcaaaacagtgccattatttccacatccccctgtccccagcctctctacatctgagtccaagccgccgccccagccaagcccccctacgagccctgtccggactcctctcgaggtcagactgtttccacagctccagacttatgttccataccgaccacacccaccgcagctgaggaaggtgacctcccctctgcagtctcctacaaaagctaaacctaaagtggaggatgaggcacctccccgacctccattacccgaattatatagtccagaggaccagccccccgccgtccctccgttgccaagagaggcaacaattatccgccatacctctgtaagaggtctgaagcggcaatctgatgagcgcaagagggatcgggaactggggcagtgtgtgaatggcgattccagagtggaactgcgctcttatgtgagcgagcctgagctggcgaccctctctggggacatggcacagccaagccttggactggtaggccccgaaagcagatatcagaccctgccaggccggggcttgagcggttcaactagcagattgcagcagtcatctaccatcgccccatatgtcacactcagaaggggccttaacgctgagagctcgaaggcgacttttcctagacctaaaagtgctctcgagagactatattcaggcgaccatcaacgcggcaaaatgtccgcggaggaacaactggagcggatgaagcgccatcaaaaggcacttgtccgggaaaggaaaaggactttaggtcagggagagcgcacagggctcccctcctctagatacctatctagaccattgccaggcgacctgggtagcgtctgttag

SEQ ID NO: 128961 - DNA, 3369 bp, Artificial Sequence
  Description of Artificial Sequence: Synthetic coding sequence
atggcagccgcgaccgttggcagagatactctgccagaacattggtcatatggcgtttgtagggacgggagggttttcttcattaacgaccagcttcgttgtaccacttggcttcatccccgcaccggcgagccagtcaactctggccatatgattcgctccgacctgccaaggggctgggaggaaggattcaccgaggagggagcttcctattttatagaccataaccagcaaaccacagccttccggcaccctgttaccggccagttttcccctgaaaattcagagttcatcctgcaggaagagcctaaccctcatatgagtaagcaggatcgcaaccagagaccaagttcgatggtgagtgagacctcaaccgccggaacagcgagcactttggaggccaaaccgggtcccaagatcataaagtcttctagtaaggtgcatagtttcgggaagagggatcaggccatccggcgtaaccctaatgtgccagttgtggtccgggggtggcttcataagcaagacagctcaggaatgagactgtggaagagaaggtggttcgtgctggctgattactgcttgttttattacaaggactcccgcgaggaggcagtgctcggatcaattcccttgccctcttacgtgatctctccagtggcacccgaggatcgtatcagtagaaagtactctttcaaggcggtccacacaggcatgcgtgcactgatatacaattcaagcactgcaggatcacaagctgagcagtccgggatgaggacctactacttctctgcagacactcaggaagacatgaatgcctgggtgcgagccatgaaccaggccgcacaggtgttgtcccgttctagtctcaaacgtgacatggagaaggtggagcgtcaggccgtgccgcaggcaaaccatactgaatcatgccatgagtgcgggagagtaggccctggacatactcgggattgtccgcaccggggccacgacgacattgtgaacttcgaacgccaggaacaagagggtgagcagtacaggtctcagagggatccgttagagggtaaacgagaccggtctaaagcgcggtccccatattcccctgctgaggaagatgcgctcttcatggatctgcccaccggaccaagagggcaacaggcccagccccaacgcgcagagaaaaatggcatgctacccgctagctacggaccaggggaacaaaatggtaccggggggtaccaacgcgcgtttcctccccgcacgaatccagagaagcatagccagagaaaatccaatctcgcgcaggtggaacattgggcacgagctcagaaaggcgacagcagatccttgccgctggaccaaacactccctaggcagggacccggacagagcctcagtttccccgaaaactatcagaccctgcccaaaagtacacgccatccctccgggggttccagtcctcctccgcgcaatctgccatcagactataaatatgcacaggatagagcaagtcatctaaaaatgagtagcgaagagcggagagctcacagagatggtacggtttggcaactgtatgagtggcagcagagacagcaattccgacacggatcccccaccgcccccatttgccttggcagcccggaatttacggatcagggccgcagtagatcaatgttggaggtgccacgtagcatttccgtgcctccaagcccatcagacatcccgccgcccggccctccgcgggtgtttccacctcgcagaccccacactcccgctgagcgagttacagtcaaaccgcctgatcagagacgatccgtggacatcagcctgggcgactctcccaggcgcgctcgtggccatgccgtgaagaactcttcccacgtcgaccgcaggagcatgccctcgatgggatacatgacccacactgtgtccgcccccagcctccacggaaagagcgcagatgacacatacctgcaactcaagaaggacttagaatatctggacttgaagatgaccgggcgggacctgctgaaggaccggagcctgaaacccgtcaagatagccgaatccgacacagatgtgaagctctccattttctgcgagcaagatagggtacttcaagacctcgaggacaagattcgggcacttaaagagaacaaggaccagcttgaatccgttctcgaagtactgcacagacagatggagcagtatcgtgaccagccccagcatttggagaaaattgcctatcagcagaaactgctacaggaggatctcgtgcacataagagcagaactctcccgggaaagcacagaaatggagaatgcatggaatgaatacctcaagctcgagaacgacgtggagcaacttaaacagacacttcaagagcaacacaggagggcatttttttttcaggagaaaagccaaatccaaaaggatctgtggaggatcgaggatgtgaccgctggcctgagcgctaacaaagagaacttccgaatcctcgtcgaatcagtgaaaaatcccgagcgtaagactgtgcccctcttcccacacccccccgtaccctcattgtctacttctgagtccaagccccctccccagcccagcccaccaacatctcccgtgcgcacacctttggaggtaagactgttcccacagctgcaaacctatgtgccctataggcctcacccaccacagctgcggaaagtgacctctcccctgcagtccccaacaaaagctaaaccaaaggtgcaagaagatgaagctccgcctaggccacccctaccagaactgtacagtcccgaagatcagcctcctgctgtaccaccgctcccaagggaggcgactatcatacgccacacaagcgtacggggccttaaacgtcaatccgacgaacgaaagcgcgatagagagttgggtcagtgcgtgaatggggactccagggtcgaactccgctcgtacgtcagtgagcccgaactcgctaccctgagtggcgacatggcgcagccctcactaggactggtgggacctgagagtcggtatcagacactgccagggcgcggattgtctggcagtacatcccggcttcagcaatcaagcactattgctccctacgttacacttaggagaggcttaaacgcggagtcatcaaaagctacctttccccgtcctaaaagcgctttggagaggttgtactcaggcgaccaccagagaggcaagatgtccgctgaggaacaacttgaaagaatgaaacgccatcagaaagccctggtacgagaacggaaacggaccctgggtcagggggagaggaccggtctacctagctcacgttatctgtctcgaccattgccaggcgacctcggttcggtttgttag

SEQ ID NO: 128962 - DNA, 2262 bp, Artificial Sequence
  Description of Artificial Sequence: Synthetic coding sequence
tgagatgcgctgtttatggacctgcccaccgggccccgggggcagcaggcccagccccaaagggcggagaagaacggcatgttgcctgcctcctatggaccaggtgagcaaaatgggacgggcggttaccaacgcgcttttcctccgcgaactaatccggagaagcattcgcagcgtaagtcgaatctggcccaagtcgaacactgggcgcgcgcgcaaaagggtgactcgcgctccctaccactcgatcagactctaccccgccaaggccctggccagtcactgagctttcccgagaattatcagaccctcccaaagagcactaggcacccttctggtggttcaagccctccccctcggaatctcccctcagattacaagtacgcccaagacagagcctcccatctcaaaatgagctctgaggaacgcagagctcaccgcgatggaacggtttggcagctttacgagtggcagcagcgccagcagtttagacatggaagccctacagcaccgatttgtctggggtcaccagaattcacagatcaagggcgcagccggagcatgctggaagtgccacgtagcatcagtgtgcctccttcaccttcagatatcccgcctcccggaccacccagagtcttcccccccagacggccccatacaccagctgaaagagttacagtgaagccacccgatcagcggaggtccgtggatatctctctgggggatagtccgcggcgtgcacgcggccacgcagttaagaacagctcacatgttgatagacgatcaatgccgtcaatggggtacatgacacacacggtatctgctccaagcttgcacggcaaatctgctgacgacacctacctgcagttgaaaaaagatctggagtacctggacttgaagatgacgggtcgagatcttctgaaggaccggtctctgaagcccgtgaagatcgcagaatcagacacagacgtgaaactgtccattttctgtgagcaagacagggtcctacaagacctggaagacaagattcgggctttaaaggagaacaaggaccagctcgagtccgtcctcgaggtgctccatcggcagatggagcaataccgagaccagcctcaacacttggaaaaaatcgcttatcagcaaaaactgctccaggaggacttggttcacattcgcgccgagttgtctcgcgagtccactgaaatggagaacgcctggaacgagtacttgaagctcgaaaacgatgtggaacagctgaaacagaccttacaggaacagcaccgtagagctttcttctttcaggagaaatcccagatacagaaggacctatggcgcatcgaagacgtgaccgccggcctgtcagcaaacaaggaaaattttaggatactggtggaaagtgtaaagaatcccgaacgcaagacagttccactgttcccgcatccgccggttcccagtctctcaacctcggagagtaagccacctccgcagccttccccacccacaagtcccgtgcggacacccttggaggtgcgcctctttccgcagttgcagacttacgtgccataccggcctcacccacctcagctgcgtaaggttacatctcctctccagtcccctacaaaagccaagcctaaagtgcaggaggatgaggcccccccaaggcccccactgccagaactgtacagcccagaggaccagcctcctgctgttccccccctccctagagaggctaccattataaggcatacgagtgttagggggctgaagagacagtcggatgagaggaagcgtgatcgcgagttggggcagtgtgtaaatggcgattcccgagtcgagctaagatcttacgtctctgagcctgaattggctaccctgtcaggggatatggcacagcccagtctggggttggtgggtccagaatctagatatcagactttgccaggacggggcctgagcggctccacatctagactgcagcagagctctaccattgccccttacgttactctgaggagaggattaaatgctgaatcatccaaagctacttttccaaggcctaagagtgctcttgagcgtctctatagcggtgaccaccaaagaggcaaaatgtcggccgaggaacagctggaaaggatgaaaaggcatcagaaggcattggtgcgggagcggaagcggaccctgggtcagggggaacgaactggattaccaagctcaaggtacctgagtcgacccttgccaggcgatctaggatccgtatgttag

SEQ ID NO: 128963 - DNA, 816 bp, Artificial Sequence
  Description of Artificial Sequence: Synthetic coding sequence
atgctgcaagcgtgtaaaatggagggtttccctctggtccccccccaaccttcagaagacctggttccctatgatacagacctctaccagcggcaaacccacgagtactatccctacttaagttccgacggggagagtcacagtgatcattactgggattttcatcctcaccatgtgcactctgagtttgagtcatttgccgaaaacaattttacagaactgcagtcggtgcagcctccacagctacagcagctgtacagacacatggaactcgaacaaatgcacgttctggacaccccaatggtccccccccacccaagtctggggcaccaagtgtcatatcttccaaggatgtgtcttcaataccccagcttatctccagcacagcccagcagcgacgaagaggaaggtgagcggcagtcgccgcctcttgaagtgagcgatggggaggccgacggtctcgagcctggaccaggtctgctccccggcgagactgggtctaagaaaaaaattaggttataccagttccttctcgatttgctgcggtctggagacatgaaggactctatttggtgggtggacaaggacaaagggacatttcagttctcatctaagcataaagaggccctcgcacatcgttggggcattcagaagggaaacagaaagaagatgacttatcaaaagatggcccgggccttgcgcaattacggcaagaccggagaggtcaagaaggtgaagaagaagttaacgtatcaattctcaggtgaagtactggggagaggtggactggcagagcggagacatcctccacactag

SEQ ID NO: 128964 - DNA, 732 bp, Artificial Sequence
  Description of Artificial Sequence: Synthetic coding sequence
atgtccccagccgccccggtacctccagacagcgcattggaatcaccttttgaagaaatggcactggtccgaggcggatggctttggcgacagagctctatcctcaggcggtggaagaggaactggtttgcgctgtggctggacggaacacttggctactaccatgacgagactgcccaggatgaagaggacagagttctgatccactttaacgtgagggatatcaaaattgggccagaatgtcatgacgtgcagccacctgaagggcggtcacgcgacggcctgctaacagtgaacttgcgcgaaggcggccgcctccacctatgcgccgaaactaaggacgacgccctcgcctggaagacagccttgctggaggcgaatagtactcccgctcccgccggcgccactgtccccccgcgttccagacgggtctgttcaaaagtcaggtgtgtgacgcggagctggtccccttgcaaggtcgagagaagaatctgggtgcgggtctactcgccttatcaagactactatgaggtggtgccgccaaacgctcacgaagctacgtacgtgcgatcttattatgggcccccttatgccggaccaggcgtaacacatgtgatcgtccgtgaggatccatgttactcagcgggcgccccgcttgctatgggcatgctcgctggagccgcaaccggggcggcattaggctccttaatgtggagcccatgctggttctag

SEQ ID NO: 128965 - DNA, 627 bp, Artificial Sequence
  Description of Artificial Sequence: Synthetic coding sequence
atgtcacccgcagctccggtcccccctgacagcgctcttgaatcacctttcgaagagatggcacttgtgcggggaggatggctttggcgacaatccagcattctgaggagatggaaacggaattggttcgcactgtggctcgacgggacactgggctactatcacgacgagactgcccaggatgaagaggatcgcgttctgatccactttaatgtccgggatatcaaaattggaccggaatgccatgatgttcaacccccagagggccggtccagagatggactgctgacagttaacctacgcgagggcggcaggcttcacttgtgtgccgaaacaaaggatgatgcgctggcttggaagaccgccctgctggaagcaaattcaactccggtccgcgtgtacagtccctatcaggactactatgaggtggtgcctccgaatgcgcacgaggctacttacgtcaggtcctactacggtcccccttatgccgggcccggcgtcactcacgtcattgtgagagaggatccatgctattcagcaggggccccgctggccatgggaatgctggccggggcagcaaccggcgccgccctcggatcattaatgtggtccccgtgctggttctag

SEQ ID NO: 128966 - DNA, 675 bp, Artificial Sequence
  Description of Artificial Sequence: Synthetic coding sequence
atggccttggtacgtggagggtggctgtggagacaatcatcaatcttgcgtcggtggaaacgaaactggttcgctctgtggctggatggaaccctcgggtactatcatgacgagacggcccaggatgaggaagatcgtgtgctgattcactttaacgtacgggatataaagattggacccgagtgtcatgacgtccaacctccagaaggcaggagccgcgacgggctcctgacagtcaacctgcgggaaggaggtaggctgcacctttgcgctgagacgaaggatgatgccctggcttggaaaacagcattactcgaagctaacagcactcctgcaccagcaggagctacagtgcccccccgttccagaagggtatgcagtaaagtgcggtgtgttacaagatcttggagcccttgtaaagtggagagacgaatctgggtgcgggtttactcgccgtatcaagactattatgaagtcgtgcctcctaacgcacatgaagccacttatgtgcggtcatattacggccctccgtacgcggggccgggcgttactcatgtaatcgtgcgggaggacccatgttacagcgccggagccccactagcgatgggaatgctcgccggcgcagctacgggtgcagccctaggttctcttatgtggagcccctgctggttctag

SEQ ID NO: 128967 - DNA, 570 bp, Artificial Sequence
  Description of Artificial Sequence: Synthetic coding sequence
atggccctcgtccgcgggggctggctctggcggcagtccagcatcttgagacgttggaaacgcaattggtttgctctgtggctggatggcaccctagggtactatcacgatgaaacagcacaggacgaggaggaccgtgtgctcatccattttaatgtccgcgacattaagattggtcccgaatgccatgatgtacagccgccagaggggcggtccagagacggactgctaacggttaatcttcgcgagggaggccggctccacttgtgtgccgagaccaaggatgatgccctagcatggaagacagctctcctggaagccaattctacacccgtgagagtgtattccccataccaggattactacgaagttgtgccccccaacgcgcacgaagctacctatgtacgcagctactacggacccccttatgcgggccctggcgtgacccacgtcattgtccgcgaagacccgtgttattccgccggggctccattagccatgggcatgctcgcaggagcggccacaggagccgcgttgggttctttaatgtggtcgccttgttggttctag

SEQ ID NO: 128968 - DNA, 354 bp, Artificial Sequence
  Description of Artificial Sequence: Synthetic coding sequence
atggcacttgtgaggggagggtggctgtggaggcagagcagcatcttgcgcaggtggaaaaggaattggttcgctctgtggctggacggcactctcggctattatcacgacgaaacagctcaggatgaggaagacagggtactgatccattttaatgtgagggatatcaaaatcggacctgagtgtcatgatgtgcagcccccagaaggaagatccagggatggcctcctgaccgtgaatctccgggagggtggacggctgcatttatgcgccgagacgaaagatgacgcactggcctggaagacagcactactggaggccaattctacacctgttcgcgtttactcaccatag

SEQ ID NO: 128969 - DNA, 492 bp, Artificial Sequence
  Description of Artificial Sequence: Synthetic coding sequence
atggcgctcgtacggggcggatggctgtggcggcagagctcaattctaagacgatggaaaaggaattggttcgcactctggttagatggtacactcggatactaccacgatgagactgctcaggacgaggaagatcgcgtactcatacacttcaatgttagagatatcaaaattggcccagaatgccatgacgtgcagcccccggaagggcgttcacgggacgggctgctaacagtgaatttgcgcgagggcgggagattgcacctgtgcgctgaaacaaaggacgatgcgttggcctggaaaaccgcgcttctggaggcgaacagcacacccgtgagagtgtacagcccatatcaggattactacgaagtcgtgcctcccaacgcccatgaagctacttacgttcgatcttactacggaccaccctatgctgggcctggtgtgactcatgtaatagtacgggaggacccgtgctattctgccggtgcatag

SEQ ID NO: 128970 - DNA, 480 bp, Artificial Sequence
  Description of Artificial Sequence: Synthetic coding sequence
atggcactcgtgagaggcggctggctctggcggcagtcaagcatcttaagaaggtggaagcgtaattggttcgcgctctggcttgatgggaccctcggatattatcatgatgaaactgcccaagatgaagaggacagggtgctgatacatttcaatgtacgagatattaaaattggcccagagtgtcacgatgttcaaccacccgaaggcaggagcagggacggactgctcaccgtgaacctgcgcgagggtgggcgactgcatctgtgcgccgagacaaaagacgacgcattagcgtggaagactgccctcctagaagcaaattctacacccatgattagactgaagcttattcatcctcacaacaagtacttactgagttgctacagtgccggagctcccttggccatgggcatgcttgccggtgctgccacgggggccgctctggggagtttgatgtggagcccatgttggttctag

SEQ ID NO: 128971 - DNA, 483 bp, Artificial Sequence
  Description of Artificial Sequence: Synthetic coding sequence
atggccctggtaagaggaggctggctttggagacagtccagtattctccgtaggtggaagaggaactggtttgccctgtggctggatggcacgctggggtactatcatgacgagaccgcacaggacgaagaggaccgcgtgttaattcactttaatgtgcgggatattaagatcggacccgagtgccacgacgtgcagcctcctgagggaaggtctcgagacggactactgacagttaacctacgcgagggaggacggctccacctctgtgctgaaaccaaagacgatgccctggcctggaaaaccgccttactggaagcaaactctactcctgcccccgccggtgccacggtcccacccagaagtaggagggtttgcagcaaagtccgctgcgtcacccgctcctggtcaccttgtaaggtggagcggcggatatgggtgagagtctactctccctaccaggactactatgaagtggtctag

SEQ ID NO: 128972 - DNA, 465 bp, Artificial Sequence
  Description of Artificial Sequence: Synthetic coding sequence
atggcactcgtccgcggaggttggttatggcgccaaagctctattctccgaagatggaagagaaattggttcgctctatggctggacggcactctgggttactaccatgatgaaacagcccaggacgaggaggatagagtgctcattcatttcaacgtgagggacattaagatcggtccagaatgtcacgacgtacaacctcccgagggacgaagcagggacggtctgcttactgtcaatttgcgtgaaggaggccggcttcatctgtgcgccgagaccaaagatgatgcactggcttggaagactgctttactggaggcaaatagcacgccagtgagggtctattctccctaccaggattactatgaagtggtgccaccaaacgcacatgaggcaacctatgtcaggagttactacgggcctccctacgcaggccctggggtgacacacgtaattgtgcgctag

SEQ ID NO: 128973 - DNA, 258 bp, Artificial Sequence
  Description of Artificial Sequence: Synthetic coding sequence
atggccctggtgaggggagggtggttgtggaggcaaagctccattctgcgaaggtggaaacgaaattggtttgctctctggctcgacggcaccctggggtactaccacgatgaaaccgctcaggatgaagaggacagagtactcatacatttcaatgtgagagacatcaagataggacccgagtgccatgatgtgcagcctcccgaagggcggtcacgggatgggttgttgaccgttaacctgagggaggggggctag

SEQ ID NO: 128974 - DNA, 3576 bp, Artificial Sequence
  Description of Artificial Sequence: Synthetic coding sequence
atggagaggcccctggagaacggcgacgagtctcctgattcccagggccacgccacggactggaggtttgctgtgtgttctttccgggacgcctgggaagaggaggagcctgcatctcagatgcatgtcaaggaccctgggcctccccgccctcctgccggcgcgactcaggacgaagaactacagggtagccccttgagtagaaagttccagctacctccagccgcagacgagagtggcgatgcccaacgcgggactgttgagagtagttcagttttatcagaaggccctggcccatccggagttgagtctctcctgtgccctatgtccagccacttgagcttggcccagggagagtctgacaccccaggagtcggtctggttggggaccctggcccctcacgagcaatgccatcggggctgtcccctggagccctggacagcgaccccgtaggcctcggggatccactatcagagatcagtaagctgttagaagccgccccaagcggatcgggcttacccaagcccgccgactgcttactggcacaggatctgtgctgggagctcttggctagtggaatggctacgctccccggcacccgagacgttcagggacgcgctgtccttctcctttgcgcacacagtccggcttggcttcagtcagagtgttcatctcaggagctcatacgcttgctgttgtatctccggtcaattccgcggcccgaggtccaggcactgggtttaactgttctcgtggatgccagaatctgcgccccctcaagctctctcttttctggtctgagccagctgcaggaggctgcccccggtgcagtttatcaagtgttgctggtgggaagcaccctgctgaaggaggtcccatccgggttgcagctggagcagctgccatcccaatcccttctgacgcatattccaacagcaggactgcctacttctctgggcggaggcctaccctactgtcaccaggcttggttggacttccgcagaaggctggaagcactcctccaaaattgccaggcagcgtgcgccctgctccagggcgctattgagagtgtgaaggctgttccacagcctatggaacccggcgaagtggggcagcttcttcaacaaacggaggtgctcatgcaacaggttttggacagcccatggctggcatggctgcagtgccagggaggaagagaactcacatggctcaagcaggaagtgccagaggtgactttaagtcccgattaccgaactgccatggacaaggcagatgagctttacgaccgagtagacggcttacttcaccagttaactctgcagtccaatcagagaatccaggcactggaactagtgcagacgctggaggcccgggagtctggccttcaccaaattgaggtttggctgcagcaagtcggatggcccgcacttgaagaagccggcgaacccagtctggacatgctcttacaggcacagggatcttttcaggagctataccaggttgcccaagaacaggtccgccaaggtgagaaatttctccaaccactgaccggctgggaagccgccgagctggacccaccaggggcacgcttccttgctctgcgcgcacaattgaccgagttctctagggcgctcgctcagcgctgccagaggcttgctgacgcggagagactgtttcagctgttccgtgaggccctcacctgggctgaagagggccagagggtgcttgcagagctcgagcaggagagacctggcgtcgtccttcaacagttacagctgcattggacccgacacccagacctcccaccagcccatttccgcaaaatgtgggctcttgcaactgggctaggctccgaagccattcggcaagagtgtagatgggcatgggcacgctgccaggacacatggctggcattggatcagaaactggaagcctcactaaagctaccgccagtgggatccactgcgtctttgtgcgtgtctcaggtgccagcagcacccgcacatcctccactgaggaaagcctattcgttcgataggaacctcgggcagtctctaagtgaacccgcttgccattgccaccacgcagctacgattgcagcctgccgcaggcctgaggccgggggaggtgcgttgccccaggcatcaccaacggtgccacctcctgggtcttcagatccaaggagcttgaaccggctgcagctcgtcctggctgaaatggtagctaccgagcgcgaatacgtcagagctttggaatacacgatggaaaattactttcctgagctggacaggccggacgtgccacaaggccttaggggccaaagagcacacctatttggcaacctggagaaacttcgcgactttcactgccacttctttcttagagaactggaggcctgcaccaggcatccaccccgtgttgcatacgcattcttaaggcatagagtccagtttggtatgtatgcattgtactccaaaaacaagccccgttcagatgctttgatgtcatcttacggtcacacattctttaaggacaagcagcaagcgctgggcgaccatttggacttggctagttacctgctgaaaccaatccaacggatgggtaagtatgctctcctgctgcaggaactggctcgtgcttgtggcgggcccacccaggagctatcagccctcagggaagcacaaagtctggttcatttccagctacgccacgggaatgaccttcttgctatggatgctatccagggctgtgatgtcaacctgaaggagcagggccaacttgtgcgccaggacgagtttgtggtgcggactggaagacataaatctgtgcgtcgtatcttccttttcgaagagctgctgctattttccaaacctcgacacggcccgacaggagtggacactttcgcctataaacgcagctttaaaatggccgatttggggctgaccgagtgctgtgggaactccaatctccgctttgaaatttggtttaggcggagaaaggccagagacacctttgtgctacaagcctcatcactggctatcaaacaggcatggactgctgatatatcacatttactgtggcggcaggcagtacacaacaaggaagttcggatggcggaaatggtttccatgggagtcggcaacaaagcatttagagatatcgctccgtcagaagaggcaataaatgaccgaacggttaactacgtgcttaagtgtagggaagtgagaagtagagccagcatcgctgtagcacccttcgatcatgattcactctacctcggtgcaagtaactctctgcccggcgatcccgccagctgcagtgtcctgggctccctgaaccttcacctctatcgagaccctgccctgttgggcctgcgatgcccactatatccttccttccctgaggaggcagcgctcgaggccgaggctgagcttggggggcagccgtcgctcactgctgaggacagcgaaatctcaagtcagtgccccagcgctagcgggagcagcggtagcgatagcagctgcgtcagcggtcaggctctgggacgcgggctcgaagatttgccttgtgtgtag

SEQ ID NO: 128975 - DNA, 3576 bp, Artificial Sequence
  Description of Artificial Sequence: Synthetic coding sequence
atggaacgtcctttggaaaatggggacgaaagcccagatagccagggacacgcgacagattggcggtttgctgtctgtagctttagggacgcatgggaggaggaggaacccgcttcccagatgcatgttaaggacccgggcccccctagacctccagccggggcaacccaggatgaggagctccagggcagccccctaagccgcaaatttcaactgcctccagcggccgatgaatctggagatgctcaacgtggcactgtggagtcctcttccgttttatccgaaggtcccggtccttctggggtggaaagtttgttgtgtcctatgagctcccacctttcactagcccagggagagagcgacacccctggggttgggctcgtgggtgatcccggacctagtcgagccatgcctagcgggctgtcacccggggctctcgattcagatcccgtgggcctcggcgacccactcagcgagatctcaaaactgctcgaggctgcaccaagcggatctggtcttcccaaacccgcggattgcctgctggcccaagatctctgctgggaactgctggcctctggtatggcaaccctgcccggaacccgcgatgtccaaggtcgggccgtattactgctctgcgcccatagccccgcctggcttcaaagtgagtgcagtagccaggaactcattcgtctactactgtaccttcgaagcatacccaggccggaagtgcaagccttgggattaacagtgctggtcgatgctagaatttgtgctccatcgtccagcctgttttctggactctcacagctccaagaagctgcccccggggctgtctatcaagtcctccttgtgggatccactttgctgaaagaggtccctagcgggctgcaattagagcagttaccatctcagtccctgctgacccacatacccactgcaggcctgcccacatcgctgggtggcggattgccttattgccatcaagcgtggctggattttcgcagaagactcgaggccctactccagaattgtcaggccgcctgtgcccttctacagggggcaatcgaatccgtgaaggccgttcctcaacccatggaaccgggggaagtaggtcaactgttgcagcagacggaggttcttatgcagcaggtgctcgatagcccctggctcgcctggctgcagtgtcaaggtgggcgagagctgacatggcttaaacaagaggtgcctgaggtaacactctcacctgattatcgcacagccatggacaaggcagacgagctctacgaccgcgtggatgggctactccaccagctgaccctccagtccaaccagagaatacaggctctggagctggtgcagaccctagaggcccgcgaatcaggcctgcatcagatcgaagtgtggctccagcaggttgggtggcccgccctggaagaagctggagagccatccctagacatgcttctgcaggcccagggctcattccaggagctgtatcaggtggcccaagaacaggtgaggcagggggaaaaatttcttcagccacttactgggtgggaggcagctgagctagatccccccggcgcgcgatttcttgccctgagggcacagctaacagaattttcacgggctctcgcccagaggtgtcaacgactcgccgacgcggaacggctgttccagctgttcagggaggccctaacctgggccgaagagggacaaagggtactcgccgagctcgagcaggagcggccaggtgtcgtgctgcaacaattgcagctacattggacgcgacatcccgatctcccaccggctcacttccgtaagatgtgggctctcgcaactggcttaggatctgaggcaatccgccaggagtgccgatgggcttgggcccgctgtcaggacacttggttagcccttgatcaaaagttagaagcgtctctaaagctgccccctgtgggttcaaccgctagcctgtgtgtgagccaagtgcctgctgcccccgcccatcctcccttgaggaaggcatattcattcgaccgcaatctcggccagagccttagtgagcccgcatgccactgtcaccacgctgcgactatcgctgcgtgtcgccggccggaagctggaggaggtgccttaccccaagcctccccaacggttccaccgccaggaagcagtgatcccaggtccctaaaccgactgcagctggtgttagctgagatggtggccaccgaacgggagtacgttagagctcttgagtatacaatggaaaactactttccagaactcgaccgaccagacgtaccgcaggggctcaggggacagcgagcacacctgttcggaaatctggagaagctcagggattttcactgccacttctttttgagagagctagaagcatgcacccgacaccccccccgtgtggcttacgcttttcttcgccaccgggtccagtttggcatgtacgctctgtacagcaaaaacaagcccagaagcgacgctctcatgtccagctatggccacacattctttaaggacaagcagcaggctctgggcgatcacttggatcttgcttcttatctactaaagccaatccagagaatgggcaaatacgcattgcttctgcaagagttggcccgcgcttgtggtggacccacccaggaactaagtgcactaagagaggctcagtcactcgtgcacttccagctgagacacggtaatgacctcctcgcaatggatgccatccaggggtgtgacgtgaatcttaaggagcagggccaactcgttaggcaagatgaattcgtagtacgaacaggcagacacaaaagcgtgagacggattttcctctttgaagagttactactgttcagcaagccacgccacggcccgacaggtgtggacacatttgcctataaacgctcttttaaaatggccgacttaggtcttacagagtgctgcgggaactcgaacctgcggtttgagatttggttccgtcgtcgcaaagcaagagacaccttcgtgttgcaggcaagttccctggcaatcaaacaggcctggaccgccgatattagccatctcctgtggcggcaggcggtgcataacaaggaggtccggatggccgagatggtgagcatgggcgtggggaacaaggcctttagggatatcgcaccatctgaggaggccattaacgacaggactgttaattacgttctgaagtgtagagaggtacggtcacgcgcctccatcgcagttgcaccctttgatcacgattccctgtatcttggcgcctcaaactccctgcccggagatcctgcatcttgcagtgtccttggatccctcaatctccatttgtacagagatcccgcactcctgggtttgaggtgtcccctgtacccatcatttcccgaggaggcagcactggaagctgaggccgagctcggtggccaaccctcactgaccgctgaggacagcgagatcagcagccaatgtccaagtgcttcaggatcttcgggctccgattcaagctgcgttagcgggcaggctctggggcgaggtctggaggacttgccgtgtgtgtag

SEQ ID NO: 128976 - DNA, 582 bp, Artificial Sequence
  Description of Artificial Sequence: Synthetic coding sequence
atggaacgaccactggagaatggagatgaatccccagatagccagggccacgctaccgactggagattcgcagtatgttcttttcgggatgcatgggaagaggaagagcctgccagccaaatgcacgtaaaggacccaggtccaccacgacctcctgccggagcaacccaggacgaggaactgcagggcagcccattatctcgtaaatttcagttgcctccagccgcggacgagagcggggacgcacagcgagggaccgtagaatcctcatctgtgttgtcagaggggcctgggccttctggagtggaaagcctcttatgcccaatgagtagtcacctaagcctcgcccagggggaaagcgacactccaggtgtcggactggtgggagaccccgggcctagtcgggcaatgccctccggattaagtccgggcgctctggactccgatccagtgggacttggggacccattatcagagatctccaaactattagaggctggcaaggagggatgggctagggaggtctgggaaggaaatggagatgcgtggagagacgagtgtcaggactttggcggactgtag

SEQ ID NO: 128977 - DNA, 3576 bp, Artificial Sequence
  Description of Artificial Sequence: Synthetic coding sequence
atggagaggcctctggagaacggggacgaaagccccgattctcaagggcacgctactgattggaggttcgcagtgtgtagctttagggatgcctgggaggaggaagaaccagcctcgcagatgcacgtaaaggatccagggcctccccgaccaccagccggggctactcaggacgaggagctccagggtagccccctgagtaggaaatttcagctccctcctgcagccgatgaaagcggagatgcgcagagaggaactgtcgaatctagctccgtgctgtcagaggggcccgggccaagcggggttgagagtctcttgtgtcctatgtcgagccacctgtccctggctcaaggagagagcgacacaccgggggtcgggcttgttggcgatccaggaccatctcgcgcaatgcctagcgggctgtctccgggcgcacttgattccgacccagtcggcctgggcgacccactctccgagatcagtaaactgctcgaggcagcaccatctggttccggtctgcccaaacccgctgactgcttgctggcacaggatctgtgctgggagctgctggccagcggcatggccactttgcctggaactcgggacgtccaggggcgggcagtgctgttactatgtgcacattctcctgcctggctgcagtccgaatgctctagtcaggagctcatccgtctgctcctttacctacgaagtatcccgcgcccagaggtccaggcgctgggcctaaccgtcctagtagacgcgaggatctgcgccccctcaagcagcttgtttagcggactgtcccagctgcaggaagccgcccccggagcagtttatcaggttttactggtgggttcaacacttctcaaagaagtccctagtggactccagctggaacagttgccctctcaaagccttctgactcacattcctacggctggcttgccgacctcactcggaggtgggcttccttactgccaccaggcctggttagactttcgcagacgcttggaggcactcctacagaactgccaagctgcctgtgctcttctgcagggcgcgattgaaagcgtaaaggcagttcctcagccaatggagccaggagaagtggggcagttgttgcaacaaactgaagtcctcatgcaacaggtcctggacagtccatggctggcttggctgcaatgtcagggaggcagggagcttacttggctcaaacaggaggtgccggaagtcacgctgtccccggattatagaacagccatggacaaggccgatgaactctacgaccgtgtcgatggcttactgcatcagctcaccctgcaatctaatcagcgaatccaggccctggagctagtccagaccctggaagcgagagaatctggtctgcaccagatcgaggtctggctgcagcaggttggttggcctgcactagaggaagccggtgaacctagtctcgacatgttgctccaggcgcaggggtcttttcaggagctctaccaggtggcacaagaacaagtaagacagggggaaaagtttttacagcctttgactgggtgggaggcggccgaactggacccccccggggcaagatttctcgctctgcgagcccagttaaccgaattctctagggccttggcacagcgttgccagcggctcgctgatgctgagcggctgttccagctattcagggaagcgttgacatgggccgaggaggggcagcgcgtgctggcagagctggagcaggagcgcccaggtgttgtgctgcaacaactccagttgcactggaccaggcatccagacttgccccctgctcactttcggaagatgtgggcacttgccactgggctgggctctgaggccatcagacaggagtgtcgatgggcgtgggcccgatgtcaagacacatggctggccctggatcagaaattggaggcctccctgaagctgcctcctgttggtagtacagccagcctttgcgttagtcaggtccccgcagccccagcccatcccccactgcgcaaggcttatagctttgataggaacctcggacagagcctgtctgaaccggcgtgtcactgtcaccacgctgcaacaatagccgcctgtagaagacccgaagccggaggcggtgcactgccacaggcaagcccgacagtgccacctccgggttcttctgatccgcgctctctaaaccgcctccagctagtgctggccgagatggtagcgacggagagagagtacgtccgcgcattagagtatacaatggagaactactttcctgaactggatagacccgatgtgccccagggcctacgcggccaacgggcacatctgtttggaaaccttgaaaagctcagggactttcactgtcacttctttctgagagagctggaggcctgcacgcgccaccctcctagggtggcatacgccttcttgaggcacagggtgcagttcgggatgtacgctctgtacagcaaaaataaacctagaagcgacgccttgatgagcagctatggacatactttttttaaggataagcagcaggccctcggagatcatctggacctggcaagctacctgctgaaacctatccagagaatgggcaaatacgctctgctcctccaggaacttgctcgtgcttgtggcggacccactcaggagctctccgccctgagagaagcccaaagcttggtacatttccagctccgccacggaaacgacttgctggctatggacgctatacaaggttgtgacgtgaatctcaaggaacagggccaattagtgagacaagacgaatttgtggtgagaacaggcagacataagagtgtcaggcggattttcttatttgaggagttattgctcttctccaagcctagacacgggcctaccggagtagacacattcgcctataagcgcagttttaaaatggccgatctgggcctgaccgaatgctgcggaaacagcaacctacgattcgagatctggtttaggcgccggaaagcccgggacacatttgtgctgcaagcttctagtctcgccataaaacaggcatggacagcagatatctctcatctgttgtggaggcaggctgtgcacaataaggaagtgcgtatggcggaaatggtgtcaatgggcgtgggcaataaggccttcagagacatcgccccgtccgaagaggccattaatgaccgcaccgtgaattatgtgctaaaatgtagagaggtgcgctctagggctagtattgctgtggctccgttcgaccacgactcactgtacctgggagcttcaaactctctacctggcgaccccgcaagctgcagcgtgctgggcagcctcaacttgcatctctatagagaccccgctctgctcggtcttcgctgtcccctctaccccagttttcccgaggaggccgcactggaagccgaggctgagctgggggggcagcccagtctgacggccgaagattctgagatttcaagccagtgcccctcagcaagcgggtcttccgggagcgattcctcatgcgtcagcggccaggctctgggaagaggtcttgaagacctgccctgtgtttag

SEQ ID NO: 128978 - DNA, 3333 bp, Artificial Sequence
  Description of Artificial Sequence: Synthetic coding sequence
atggagcgcccgttagagaatggcgatgagtctcctgactctcagggtcacgcaactgattggaggttcgcagtgtgtagctttagagacgcgtgggaggaagaggaacctgcctcacagatgcacgtgaaggatcctggtcccccccggcctccagccggcgctacccaagacgaggagctgcaggggagcccactgagtagaaaatttcagctgccccccgctgctgacgagagcggagacgcacagagaggaactgtggagtcatcctccgtcctgtccgagggccctggacccagcggggtggaatctttgttgtgccctatgtcctctcacctaagcctagcccagggcaccagggacgttcagggccgggcggtcctgttgctgtgcgctcattctcccgcatggctgcagtctgagtgctctagccaggagctcattcgactgctgctatatttgcgttccatcccacgcccagaggttcaggctcttggacttactgtgttggttgatgcaaggatctgcgcaccttcatcaagcctgttcagtggtttatcccagctccaagaagctgctccgggcgcagtgtatcaggtgctccttgtagggagcacccttctgaaagaggtaccctcaggactgcagctcgagcaattacccagccagagtctgctaacacacatcccaaccgcagggctgccaacctcattagggggaggtttaccttactgccatcaggcatggctggactttagaagacgccttgaggcccttttgcagaattgccaggcagcctgcgccctgctgcaaggtgctatcgaatctgtcaaagcggttcctcagccaatggagcctggagaggttgggcaactgctgcagcaaacagaggtcttgatgcagcaggtcttggactcgccttggctggcctggctacagtgtcagggggggagggagctaacatggctcaaacaagaagttccagaggtcacactgtcccccgactacaggactgcgatggataaagcagacgagctctacgatcgggttgacgggttattgcaccagctaaccctgcagtcaaaccaacgtatccaggctctcgagcttgtccagaccttggaagcccgggagagcggcctgcaccagattgaggtttggctgcaacaggtgggctggcccgccctagaagaggcaggtgaacctagtttggatatgctcttgcaggcccagggctcctttcaagagctctaccaggttgctcaagagcaggtccgccagggggaaaagttcttacagcctctgaccggatgggaagcagccgaactggatcccccaggggccagatttctagctctgcgggcccaactcacggagtttagcagggctctagcacaaaggtgccagcgactggctgacgccgagcggctctttcagctgttccgcgaagctctaacttgggccgaggaggggcagcgggtactcgccgagctggagcaagaacgccccggtgtggtgctccagcagttacagctccactggacccgtcaccccgatcttcctcccgcccactttaggaaaatgtgggccttggctacggggctgggaagcgaagccataaggcaggaatgccggtgggcatgggctagatgccaagacacttggcttgccctggaccaaaaattagaagcttcgttgaaactgcccccggtgggcagtaccgcatccctctgcgttagccaggtccccgcagctcctgcccacccaccattgaggaaggcttacagttttgacaggaacctcgggcaatcgctgtcagagccagcctgccactgccatcatgctgctacaatcgccgcatgccgccgccctgaagccggagggggcgccctcccccaggcaagtccaactgtcccgcctccaggatcaagtgatcctcgcagtctgaaccggcttcagttggtcctggcagaaatggttgcgaccgagcgcgagtatgtccgtgcactcgagtacaccatggagaattacttcccggaactagaccgccccgatgtgccccagggcctgcggggtcaacgtgcccacctctttgggaatcttgagaaactgcgggactttcactgtcatttctttttgagggaactagaggcatgcacaagacaccctccgagagtggcctatgctttcctgagacatcgcgtgcagttcgggatgtatgccttgtattctaagaacaaaccacgctccgacgcccttatgagttcctacggacacaccttttttaaggataagcagcaggctcttggggaccacctcgacctcgcatcatatctcctgaagccgattcaacgcatggggaaatacgcccttcttttgcaggaactggctcgtgcctgtgggggcccaactcaagaactgtcagctctgcgagaagcccagtctcttgtccacttccagctccgccacgggaacgacctcttagcaatggacgccatacaaggttgtgatgtcaaccttaaggaacagggccagttggtaaggcaagacgaattcgtggtaagaacgggtaggcacaagagtgtacggcgaattttcctcttcgaggaactgctgctcttcagcaaaccacggcacggacccacgggggttgatacatttgcgtacaagcgctcctttaagatggctgacttggggctgacggaatgctgcggcaattcaaatttaaggtttgagatttggttcagacgcagaaaagcccgcgatacattcgtgctgcaagcatcttctctggccattaaacaggcatggacggcagatatctctcacctgttatggagacaggcggttcacaacaaagaggtgagaatggccgagatggtaagtatgggtgtgggcaacaaggctttcagggacatagctccttccgaggaggccataaacgatcgcacagtgaattacgtcctcaaatgccgagaagtccgttccagagcctcaatcgccgtggcgccattcgatcatgactctctgtacttgggcgccagcaatagtctccctggcgatccagcatcttgtagtgtgttgggcagtctcaatctacatttataccgggacccagctctgctaggactgagatgccccctgtaccccagttttcccgaggaggctgccctcgaagcagaagccgaactgggtgggcagccaagtcttacagcggaggattctgaaatttcctcacaatgtcccagtgctagcggcagcagtggctctgatagcagttgcgttagcggacaggccctaggcaggggcctggaggacctcccttgcgtctag

SEQ ID NO: 128979 - DNA, 3021 bp, Artificial Sequence
  Description of Artificial Sequence: Synthetic coding sequence
atgcactacgatggccatgtacgcttcgacctccctccacagggatcggtgttggcccggaatgtcagcactcgatcctgcccgcctcgtacgtcgcccgccgttgatctcgaagaagaggaagaagagtctagtgtagatggcaagggggaccgtaaatctactggtctgaagttgtccaaaaagaaagcccggcgacgccacactgatgatcccagtaaagagtgcttcactctcaagttcgacttgaacgtggacatcgagacagaaattgtacccgccatgaagaagaagtctttgggggaggtcttactgcctgtgttcgagcgaaaaggcatcgccttgggtaaagtggatatctacttggaccagtccaacacgcccttgagcctgacattcgaagcttacagattcggcggacactatctccgggtgaaagccccagccaagccaggcgacgaagggaaggtcgaacaagggatgaaagatagtaaaagcctgtcactccccatcttacgcccggcagggacaggcccccctgccctcgagcgggtagacgcccaatcaagacgtgaatctctagatattctcgcgcctggcagacgcaggaaaaacatgagtgagtttctaggggaggccagcatccctggacaagaacccccgacaccctcttcctgctcacttccaagcggaagctccggctcaacaaacaccggcgactcctggaagaacagggccgccagcagattcagcggctttttctctagcggcccaagcacaagtgcctttggtcgcgaggtcgacaaaatggagcagttggagggtaaactccacacatattccctctttggactcccacgtttacccaggggcctgcggtttgatcacgatagctgggaagaagagtacgatgaagatgaagacgaagacaatgcttgtctccggctggaagacagctggcgggagctcatagacggacacgagaaactcactagacggcaatgtcaccagcaggaagccgtgtgggaattgttgcataccgaggcatcctatattaggaaactacgggttataataaatcttttcctgtgctgtttactgaacctgcaggagagcggtttactctgtgaggtagaggctgagagacttttcagtaacattccagagattgcacagttacacagaagactgtgggcttctgtaatggcccctgtcctcgagaaggcacgaaggacgagagcattattgcagccaggagatttcctaaaaggcttcaagatgttcgggtctttatttaaaccctatataaggtattgcatggaggaagaggggtgtatggagtacatgcgggggctcctcagggacaacgatttattccgtgcctatataacatgggctgaaaaacacccgcagtgccagcggttaaagttgagcgatatgttagctaaaccacaccaacggttgaccaagtatcccttgcttctgaagtctgttctgcgaaagacagaggaacctcgagccaaggaggccgtggtggccatgattgggtcggtggaaaggtttatacaccacgtaaacgcttgtatgagacaacgccaggaacgacagcgattggccgccgtagtgtcgcgcattgatgcctatgaggtagtggagtcctctagcgatgaggttgataagttgctgaaggagtttctgcatctggaccttacagccccaatccctggtgcatcgccagaagagacccgacaattgctcctcgagggaagtcttagaatgaaagaagggaaagattccaaaatggacgtgtactgctttctcttcaccgacttgctgctcgtgaccaaagctgttaaaaaagccgaacggaccagggtgatcaggccccctctcctagtggacaagatcgtgtgtagggagctgcgggatcctggttcattcttgctgatctaccttaacgagttccactcggcagttggtgcctacaccttccaggcctctgggcaggcactgtgcagaggttgggtcgacaccatctacaatgcgcagaaccagctccagcagcttagagcccaggagccaccaggatcacaacagccccttcagtccctggaggaagaagaggacgagcaggaggaagaggaggaggaagaggaagaagaggaggaaggcgaggatagcggcacctctgccgcctcttctccaacaattatgcggaagtctagcggctctcctgacagccagcactgtgcttccgatggaagcactgaaaccctcgcaatggttgtggtggagccaggtgatactttaagctcccccgagttcgacagcggccctttcagcagccaatccgacgaaacctctctctcaacaacggcaagctctgctacgcccacatctgaattgctccccctcggcccggttgatggtagatcgtgttccatggattctgcttatggaaccttgagccctacgagcctccaggacttcgtggctccgggcccgatggccgaattggtgcctcgggctccggagagcccccgggtgccatccccccccccatcaccacggcttaggagacggacccctgtccagctcttgagttgcccaccgcacctgcttaagagtaagagcgaggcctccctgttacagcttctggctggggccggtacacacgggaccccttccgcgccatcccgctctctgtccgaactctgtttagccgtgccagctccggggatcagaacccagggtagcccgcaagaggccggcccctcctgggactgtaggggggctcccagccctggcagcgggcccggactagttggctgtctggcaggagagccagctgggagtcatcgtaagcgctgcggcgatctgccctcaggagccagtccacgggtgcagcctgagccccctccgggcgtgtctgctcagcacagaaaacttaccctggcccagctgtaccgaatccgtacaacattgctgcttaactccaccttgactgcctctgaggtctag

SEQ ID NO: 128980 - DNA, 2793 bp, Artificial Sequence
  Description of Artificial Sequence: Synthetic coding sequence
atgcattacgacggtcacgtccgctttgatcttccaccccaggggagtgtgctcgcacgcaacgtcagtaccagaagctgtccaccccgtacctcccctgctgttgacctcgaagaagaagaggaagaatcctcagtggacggaaaaggcgaccgcaagagcacaggcttgaagctgagtaaaaaaaaagcccgccggagacacacagatgaccctagcaaggagtgcttcacgctcaaatttgacctgaacgtggatatagagaccgagatcgtgccagccatgaaaaagaaatcattgggggaggtgctgctccctgtttttgagcgtaagggaattgcactaggtaaggtagacatatacctggatcagtcaaatacaccactgagtctcacattcgaggcgtacaggttcggaggacattacttgcgagttaaggctcctgccaaacccggagacgagggtaaggtggagcagggcatgaaagatagtaagtcactctcactgcccatcttgcgtccagctggcaccgggccacccgcactggagcgtgtcgacgcccaaagccgcagagagtccctggatatcctggctccagggcgtagaaggaagaacatgagcgagtttctaggtgaagcaagtattcctgggcaggagcccccaactccctccagttgcagcctgccatcagggagctctgggtcaactaataccggagactcctggaaaaatcgcgctgccagtcggttctcaggattttttagttctggtccttctacatcagcatttggaagagaggttgataagatggagcagctggaaggcaaacttcatacctatagcttatttggattaccccgcctgcccaggggcctgcggtttgatcatgattcttgggaggaagaatacgacgaggatgaggacgaggacaacgcgtgtctcaggctggaggacagttggcgggagcttatcgatgggcacgaaaagttgacacgcagacagtgccaccagcaggaggcggtctgggaattgttacacacggaggctagctatatccggaaactccgtgtgattatcaatctttttctctgttgcttgttgaaccttcaggagagtggacttttatgcgaagtcgaagctgagcggctcttctccaacatcccggagatagcgcaactgcacaggagactgtgggctagtgtgatggctcctgtactagagaaggccaggagaacacgagccttgcttcaacccggggattttctgaagggcttcaagatgtttggcagtctgtttaaaccctatattaggtattgtatggaggaggagggctgtatggagtatatgcggggcctgctgagagacaacgatctttttcgggcatatatcacatgggctgaaaaacacccccagtgtcagcggttgaaactgtccgatatgctggccaagccacaccaacgactcacaaagtatccactcctgctaaagtccgtcctcagaaaaacagaagaacccagggctaaggaagctgtcgtcgccatgataggttccgtcgaaagatttattcaccacgtgaatgcctgtatgcgacaacgccaggagcgacagcgacttgccgctgtggttagcagaatagatgcctacgaagttgtggagagtagttcagatgaggttgacaagctgttgaaggaatttctacacctagatctcactgctccgatcccaggtgcatccccagaggaaactcgccagctactactcgaaggctcccttcgcatgaaggaaggaaaggacagtaaaatggacgtttattgtttcctgtttacagacctgctattggtaaccaaagccgtcaaaaaggcagagaggacccgagtcattcgtccccccttattggtggataagatcgtgtgtagagagctgagggaccccggctcctttctgctgatctacttgaatgaattccacagcgccgtgggtgcctatacattccaggcatcaggccaagcactgtgtcgcggctgggtcgatactatatataacgctcagaatcaactgcaacagctccgcgcacaggagccccccggctctcagcaacccctgcaatcattggaggaagaagaagacgagcaggaagaggaggaggaagaagaagaggaggaggaagagggcgaggactctggcacttccgccgcttcttcacctacgattatgcgcaagagctctggcagtcccgacagtcagcactgtgccagtgacggcagcaccgagaccctggcaatggtagtggtggagccaggagacactctctcctcacccgaattcgatagcggccctttctcctctcagagcgacgagacttctctgtctactacagctagcagtgcgacacccacctcagaactgctgccgcttggaccggtggatgggcgcagctgttccatggactctgcctacggcaccctgagccctacaagtttacaggattttgttgcacctggacccatggccgagcttgtgcccagagcccctgaatccccccgcgtcccaagcccacctccatcaccccgactccgacgtcgaaccccagtccagctgctgtcgtgcccaccacacctgcttaagagcaagtccgaggcgagcctactgcagttgcttgcgggcgcaggaacccacggtacaccttcagcgccttctcgctccctttccgagttatgcctcgctgtccccgcccctgctcaagaggccgatcctggcccagccttgcccaatcaagatcaccccgctgcctag

SEQ ID NO: 128981 - DNA, 3021 bp, Artificial Sequence
  Description of Artificial Sequence: Synthetic coding sequence
atgcattacgacgggcatgtgcgtttcgacctgcccccccaggggagcgtcctggcacggaacgtctccacaagatcctgtccccctagaacatcaccagctgttgatctggaagaggaagaagaagaaagttctgttgacggtaaaggggacagaaaatccacgggtcttaaactgtccaaaaagaaagctcggcgacgtcataccgacgacccctctaaggagtgctttactctgaagttcgatcttaacgtggacattgaaacagagattgtgcctgccatgaagaagaagtcgctgggagaagtgctgcttcctgtgtttgaacgcaagggcattgccttgggtaaggtcgacatttacctggatcagagtaacacccccctgagcttgaccttcgaggcttacaggtttggcggtcattatctgagggtcaaggctcccgcgaagcccggagatgaaggtaaggtcgagcagggcatgaaagactcaaaatcccttagcttacccattctgcggcctgccggcacaggtccaccggccttggagcgggtcgacgcccaatcgaggcgcgaatcccttgacattcttgcaccgggtcggcgcaggaagaacatgtctgaatttttgggagaggcttccattcccggtcaggagcctccaaccccctctagttgctccctcccgtccggctcatctggttccactaatacgggtgactcctggaagaaccgagccgcctccagattttcagggttttttagctctggcccctctacttctgcattcggtcgagaggtcgataagatggaacagctggaggggaaactgcatacttacagtttgtttggtctgccgcggctccccagaggcctcaggttcgatcatgattcatgggaggaggagtatgatgaggatgaagatgaagacaacgcttgcctccgactggaagatagttggagagaactaatcgacggacacgagaaactgacgagacggcagtgccaccagcaagaggcagtgtgggagctgttgcatacagaagcaagctatattagaaagctccgcgtgataatcaaccttttcctgtgctgcttactgaacctacaggagagtggtctgctgtgcgaggtggaggcggaacgccttttctctaacataccagaaattgctcagctccaccgccgactttgggcgagtgtaatggcaccagtgcttgaaaaggcaagacgaacccgggcgctgctccagccgggtgattttcttaagggcttcaagatgttcgggtctctcttcaagccatacatccgctactgcatggaagaggagggctgtatggaatacatgcgggggttactgagggacaacgacctcttcagagcgtatatcacctgggccgagaagcatccgcagtgccagcgactgaaactttctgacatgctggccaagccccaccagcgtttaaccaagtatccccttctgcttaaatctgttctgcgaaagactgaggagccccgggccaaggaggcagttgtcgcaatgatcggatctgttgagcgatttatccaccatgtcaacgcttgtatgcgtcagcgacaggagcggcagcgcctggccgccgtggtaagcagaattgatgcctatgaggtggtggagtcgagcagcgacgaagtggacaagctgcttaaggagtttttgcacctcgatttgactgctccgattccaggcgctagtccggaggagacgaggcaattgttgttagagggctcccttaggatgaaggaaggaaaagacagcaaaatggacgtttactgcttcctgtttaccgatttgttactggttacaaaagccgtaaaaaaagccgagaggactagagttatcagaccgccgttactggtggacaagattgtgtgcagagagcttagggatccaggttcatttctcctcatctacctgaacgagttccatagcgctgtgggggcctacactttccaggcatctggccaggctttgtgcaggggctgggtggacacaatttacaacgcgcagaatcagctccaacagctgcgtgcccaggagccgcccgggtcccaacaacccctgcagtccctcgaggaagaagaggacgagcaggaggaagaagaggaggaggaggaggaggaagaagagggtgaagactcgggcacatccgccgcgtcctcgcctaccattatgcggaagagctcaggatcacctgattcccagcactgcgcgagtgacgggtctacggaaaccctggcaatggttgtcgtcgaaccaggagataccttgagtagcccagaatttgattctggtcctttcagctcccagtccgatgaaactagtctcagcacaacggctagtagcgctacccccacctcggagcttcttcccctgggccctgttgacggccgcagctgctcaatggacagcgcgtacggtacgctgtcacctacttcattacaggatttcgttgccccaggtcccatggcggagctggtgccaagagcacctgaatctccccgggtgcccagtcctccaccaagcccacgattgaggcgtcgcaccccagtacagctgttatcctgtcctccacacctgttaaaatcaaaatctgaggcatccctgctgcaactccttgcgggagcagggactcacggtactccttcagccccttctaggtctttatcagagctgtgtcttgccgtccctgcacccgggatccgcactcagggaagcccccaagaggctggtccatcgtgggactgccgcggagccccctcccctggctctggcccaggtctggttggatgcctcgctggagaacctgcaggaagccatcgaaagcggtgcggcgacctgccaagcggagcctcaccgcgggtccagccagagccaccgcctggtgtctctgctcagcacagaaaactcaccctcgctcagttgtaccggattagaacaacactgcttctgaatagcaccctgacagcttccgaggtgtag

SEQ ID NO: 128982 - DNA, 3132 bp, Artificial Sequence
  Description of Artificial Sequence: Synthetic coding sequence
atggataaggggcgcgcagcaaaggtctgtcatcacgcagactgccaacagctacataggagagggcctttaaatctctgtgaagcatgcgactcaaagtttcactccaccatgcattatgacggccacgtgcgctttgatttgccaccccaggggtctgtcctggctcgcaacgtatctacaaggagttgcccccccaggactagccccgcagttgacctggaagaagaagaagaggagtcatccgtggatggtaaaggagacagaaaatctactgggttgaaactctccaaaaagaaggcaagacgcaggcacaccgacgaccctagcaaggaatgttttaccctgaagttcgatctgaacgtggacatagaaaccgaaatcgtgcccgcaatgaagaaaaagagcctcggggaggtgcttctaccagtctttgaacgcaagggtatcgccttaggcaaggttgatatctacctggaccagagcaacacccccctcagcttgacctttgaagcataccggttcggcgggcactatctcagagttaaagcccccgcaaagccaggagacgaaggaaaggtggaacagggaatgaaagattcaaagtccctaagcctgcctatactacgacccgcagggactggcccccccgccttggagagagtcgatgcccagtctcgacgtgagtccttggacattttggccccaggccgacgccgcaaaaacatgtccgagttcctaggtgaggcaagcataccaggccaggaaccccccacacccagctcctgttccttaccttccgggagctccggttcgacaaacacaggcgacagttggaaaaacagagcagcaagcagattctcagggttcttttcctctgggccttctaccagcgcattcggccgtgaggtagacaagatggagcagctggaagggaaactgcacacgtatagcctgtttggcctgcctaggctgcctagaggcctgaggtttgaccatgattcatgggaggaagagtatgacgaggacgaggatgaagacaacgcatgtctgcgcctcgaagattcctggagagagcttatagatgggcatgagaagttgacgcgccggcaatgccatcagcaggaagcagtgtgggagcttcttcataccgaggcctcctatatccggaagctccgcgtgatcatcaatctctttctgtgctgtctgctgaacctgcaggagagtggcttactttgcgaagtcgaagccgagcgactctttagtaatattccagagatagcacaactccatcgccgactgtgggctagcgtgatggcaccggtgttagagaaggcaaggcgtaccagggccttgctacagcctggagatttcctcaaaggatttaagatgtttggaagcctctttaaaccctatatacggtattgtatggaggaagaagggtgtatggagtatatgcgcgggcttctgcgggataacgacctcttcagggcttatattacgtgggcggaaaagcacccccagtgccagcgcctcaagctgtccgacatgcttgcaaagccccaccagagactgacaaaatatcccctccttttgaaatcggtccttcgcaaaactgaggagccccgtgccaaagaggccgttgtagcaatgatcggctctgtggagcggtttattcaccatgtaaatgcttgcatgcggcagcggcaggagcggcagcgcctcgccgccgtggtgagcagaatcgacgcctacgaggtggtggagagctcctctgacgaggttgataaactgctgaaagagtttctccatctggacctaacagcaccgatccccggagcatccccagaggaaactcgccagctcctgctagaggggtcattgaggatgaaggaagggaaggatagtaaaatggacgtgtactgttttctgtttacagatctgctcttagtcaccaaggccgtgaagaaagccgagagaactagagttataagacccccactgctggtagacaaaatagtatgccgcgaactgcgggacccaggatcatttctgctgatctatttaaatgaatttcacagtgcagtaggggcttatacgtttcaggcttccggccaggctctttgccgcggctgggtggatacaatctataatgcacaaaatcaattgcagcaacttcgagcccaggaaccccctggctcacagcaaccactgcagtctctcgaagaggaggaggacgagcaggaagaagaggaggaggaagaagaagaagaagaggagggcgaggattcaggaacatccgccgcttcttccccaaccatcatgcgaaaatccagtggttctccagacagccagcattgtgcatctgacggatcgaccgaaactctggcaatggtggtggtagaacctggggatacactatcatccccagaattcgatagcggtccattttcaagccaaagtgacgagacaagcctcagtacaactgcttcctccgccacgcccacatccgagctgctgccgcttgggccagtcgacggcaggtcttgtagtatggattccgcctatggaacgcttagcccaacgagcctccaggacttcgtggcacccggccctatggcggagctagttccccgggcacccgagagcccaagggttccatccccgccaccaagtcccaggttacggcgccgcacaccagtacagctgctttcatgccccccccacttgctgaaatctaaatcagaggctagcttgctgcagctgctggctggagccggaactcacggaaccccttctgcgccatctcgaagcctcagtgagctctgtctggctgtgcctgcgcccggcatacggacccaggggtctccccaggaggctgggccttcatgggactgtcgcggagccccctcacctggcagcgggccgggactggttggctgcctggctggggaacccgctggttcgcaccggaaacgctgtggtgatcttccaagcggcgccagtccaagagtccaacccgagcctccaccaggcgtatccgctcagcaccgaaagcttactctggctcagctataccgcatcagaacaaccctccttctgaatagtactctgaccgcttctgaggtgtag

SEQ ID NO: 128983 - DNA, 3021 bp, Artificial Sequence
  Description of Artificial Sequence: Synthetic coding sequence
atgcattatgacggacacgtacgtttcgacctccccccacaagggagtgttctcgcaaggaatgtctccacccgttcttgtcccccacggaccagccccgccgtggatttggaagaggaggaagaggagagctccgtggacggcaagggagaccgtaaatcgaccgggctcaaactttccaagaagaaggctaggagacgccacaccgacgatccctcaaaggaatgtttcaccctgaagtttgacctcaacgtagatatcgagactgagattgttcctgctatgaagaagaagtcgttaggcgaagttctcttgcctgtgtttgaacgaaagggcatcgctctgggtaaggtggatatctatctggatcaaagtaacactcccttaagcctgactttcgaggcgtatcgtttcggaggccactacttacgggttaaggcaccggctaaacccggcgacgaggggaaggtggaacaaggcatgaaagactccaagtcacttagtctgcctatcttacgtcctgccggaacagggcctcccgccttggaacgagtcgacgcgcagtcacgcagagagtcccttgacatcctggccccgggaagacggcgcaagaatatgtcagaatttctgggtgaggcgagtattcccggacaggagccacccaccccaagctcctgctccctcccatcaggctcttcgggttcgacgaatactggagatagctggaaaaaccgtgcagcctctagattcagtgggtttttctccagtggcccttccacctcagcattcggcagagaggtggacaagatggaacaactggagggaaaactccacacctactccctatttggcctcccgcggctgccaaggggtctgagatttgatcacgactcatgggaggaagagtatgatgaagatgaagacgaggacaacgcttgccttcgtctcgaagactcatggcgagaacttattgacggccatgaaaagcttaccaggcgccagtgtcaccaacaagaagcagtgtgggaactgttgcatacagaagcatcttatatcaggaagcttcgtgtcattatcaatctgttcctttgttgcctcttgaatctgcaagaatcaggacttctgtgcgaagtagaagctgaaaggttgtttagcaacattcctgagattgctcagctgcacaggagactgtgggctagcgtaatggcccctgttttagagaaggcaaggaggacaagggccttgcttcaaccaggcgactttctgaaaggcttcaagatgttcggcagccttttcaaaccttatatcaggtactgcatggaggaagaaggctgtatggaatacatgagagggctcttgcgagacaatgatctctttagggcttacatcacatgggctgaaaaacaccctcaatgccagcgcctgaaactatcggatatgctcgcgaaaccgcaccaacggctcactaaatatcccttactgctgaaatccgtgctgcggaagacagaggagccgcgcgctaaagaagccgtggtggcaatgatcgggtctgtggagaggtttatccaccatgtgaatgcctgtatgcgacaacggcaggagcgccagaggctcgcagctgtcgtgtctcggatagatgcatacgaagtggtggaatcctcgagcgacgaggtggacaagctcctcaaagagttccttcatcttgacttaaccgcacccatccctggggcgtcccctgaggagactaggcagcttctcctggaagggagcctgaggatgaaggaggggaaggattccaaaatggatgtgtactgctttttatttaccgatcttctgcttgtgaccaaggccgtcaagaaggcagagcgaacccgagtgatccggcctccgctgctcgtagataagattgtctgcagggagctacgtgacccagggtcattccttttaatctacttgaatgaatttcatagtgctgtcggcgcctatacctttcaggctagcgggcaggcactgtgcagagggtgggttgacaccatctataacgcacagaaccagttgcagcagctgcgggctcaggagccaccgggaagccagcaacctctgcagagtctcgaagaggaggaagacgaacaagaagaggaggaagaggaggaggaagaagaggaggagggggaagacagtgggacctccgccgcgtcctccccaaccataatgcgcaaaagctcagggagtcctgacagccagcattgcgcctccgatggtagtacagagaccctcgctatggtcgttgtagagcccggcgataccctgtcctctcctgagttcgatagtggtccattctcatctcagagcgacgagacatctctgagcaccacagcatccagcgcaacccccacatctgaattgttgcctctagggccggttgacgggcgctcctgttccatggatagtgcctacggcactttgagccccacgtccctgcaggatttcgtggcaccaggccccatggcggagttggttcccagagcccccgagagcccacgcgttccatcaccccccccctcaccacgattacgcagacgtacccctgtccagctgctgtcctgcccacctcacctgctgaagagcaagtctgaggcatcccttctgcagctgctggccggcgcaggcacgcacggaactccttctgcaccgtctcgttctctctcggaactctgccttgctgtcccggccccaggaatacgtacacaggggtcaccacaggaggcaggccccagttgggactgtcggggtgctccgagccctgggtcaggaccaggcctcgtgggatgccttgccggagagccagcaggttcccatcgtaagcgctgtggagatctgccctcaggggcctctccacgagtccagcccgagcctccgcccggagtgtccgctcagcatagaaagttgaccctggcccaactttacagaatccgcactacactgctgctcaatagcacactaaccgcctctgaggtctag

SEQ ID NO: 128984 - DNA, 2559 bp, Artificial Sequence
  Description of Artificial Sequence: Synthetic coding sequence
atgaattcagtgctaacaaagcatggtagtccaccgaggtcctggctctccctgtgtagtggcacagacgaccagtctcctgctgagaagaagggtctgcggtgtcagaacccggcgtgcatggacaagggacgagcagctaaggtgtgtcaccatgcagactgtcagcaacttcatcggagggggcctttgaacttatgtgaagcctgcgactcaaagttccacagtactatgcattatgacggtcatgtgcgattcgatctgccgcctcagggaagcgttttggcgcgcaacgtctctactcggagctgtccgcctaggacatcccctgccgtggatcttgaggaggaggaagaggaaagctctgtggacgggaaaggcgatcgaaagtcgaccggattgaaactgtcaaaaaaaaaggctagaagaaggcatacagacgatccatctaaggagtgcttcacccttaagtttgacctgaacgtagacatcgaaacagaaattgtgccagccatgaaaaaaaagtcactgggcgaggttctgctacctgttttcgaacgcaagggaatcgcactagggaaagttgacatctatctggatcaatccaacaccccactgagtttaacctttgaagcgtatagattcggtggacattacctgcgcgtgaaggcccctgccaagccgggagacgagggcaaggtggagcaggggatgaaggattccaaatcactgagcctgcctattctgcgtcctgcggggactggccccccagccctcgagcgtgtcgatgcacagagccgacgagagtccctggacatcctagcccccggtaggcggcgaaagaatatgtcagaattccttggggaagcctccataccgggacaggagccgccaacaccgtcttcttgctctttaccatctggtagctccggatccaccaatacaggagactcttggaagaatagggccgctagcaggtttagcggattttttagttctgggccatctacttcagccttcggtagggaggttgataagatggagcagctggagggaaagttgcatacatacagtttgttcgggctgccgcgcctgcccagggggctgcggttcgaccacgacagctgggaagaggaatacgatgaggacgaagatgaagataacgcgtgtttgcgcttggaagactcctggcgagaacttattgacggacatgagaaactcacacgccggcagtgccaccagcaggaagccgtgtgggaactgctacatactgaggctagttatattcgcaagttgcgcgttatcataaacctgttcctttgttgtcttctgaatttgcaggagagcggcttgttgtgcgaggtggaagccgaaagactgttttctaatattccagaaatagcacagcttcatcgacgcctctgggctagcgtgatggctcctgtacttgaaaaagctcggcggactcgggccctgctccagcccggagatttcctaaaaggatttaagatgttcggaagcctgtttaagccctatatccgctactgcatggaggaagaaggctgcatggagtatatgaggggcctgctgcgggacaacgatctcttccgggcgtatataacctgggcagaaaagcaccctcagtgtcagcgacttaaactatctgatatgctggctaagccacaccagcgtctcacgaagtaccccctcctgttgaagagtgtgctgagaaagactgaggaaccgcgtgctaaggaggcagtggtggccatgatcgggtctgtcgaacgattcatccatcacgttaacgcatgcatgagacaacgccaggaaagacagcggcttgcagccgtggtgtcacgaattgacgcgtacgaagtggtcgaaagttcatccgacgaagttgataaattgctgaaagagttcctgcatctcgacctgacggccccgatccccggggcctctccagaggaaacgcgccagcttctcctggagggctccctgagaatgaaggaggggaaggatagcaagatggatgtgtactgcttcttgtttactgatctgctcctggttactaaagcagttaaaaaggcagaaagaacgagagtgatccgacctcctctcctggttgacaagattgtctgtagagagctgcgggacccagggagctttttgctgatttacctgaatgagttccatagcgccgttggcgcgtatacattccaggccagtggccaggccctgtgtagggggtgggttgacaccatttataacgctcagaatcagctgcaacaacttagagcccaagaacctcccggctctcagcaaccgcttcaatccctcgaagaggaagaagatgagcaagaagaggaggaggaggaagaggaagaagaggaggagggtgaggatagcggcacgtccgccgcatccagcccgacaataatgcggaaatcaagcggctcccccgatagtcagcattggaagctaactttagcgcagctgtataggatcaggacaactttacttctcaatagtaccctcaccgcttctgaggtgtag

SEQ ID NO: 128985 - DNA, 3252 bp, Artificial Sequence
  Description of Artificial Sequence: Synthetic coding sequence
atgaattccgtgctcacgaaacatggctcccctccacgatcttggctgtcactgtgctcaggcacagacgaccagtcgcctgctgaaaaaaagggccttaggtgtcagaatcccgcatgtatggacaaaggcagagcagctaaagtgtgtcaccatgctgactgtcagcagctgcatcggcgtggacccctgaacttatgcgaggcatgcgactcaaaatttcatagcactatgcattatgacgggcatgtgcgatttgacctaccccctcagggatctgtgctggctcggaatgtttcgacacggagctgcccgccacgtactagcccagcggtggacctggaggaagaagaggaagagtcctctgtcgacggaaagggggacagaaaaagtacaggcctgaagctcagcaaaaagaaggcccggagaaggcacaccgacgaccctagtaaggaatgctttactctgaagtttgacctaaacgttgacatcgaaacagagatagtacccgctatgaaaaaaaaatccctcggcgaagtgctgttgcctgtctttgagcggaagggtatcgcactgggcaaagtagatatctacctcgatcagagcaacacaccgctctctcttacgtttgaagcctacaggtttggtgggcactatctgcgggtcaaggccccggccaaacctggggacgaaggcaaggtagaacagggtatgaaggacagtaaaagtctgtcactgcccatactgagacccgctgggactggcccacccgctctggaaagggtggacgctcaaagccggcgggagtcactggatatcctggcgccagggcgcagacgcaagaacatgagcgagtttctcggcgaggcttcgattcctggccaagagcctccaacaccgtcgtcgtgttctctgccttcaggatcatcaggaagcaccaacaccggagacagttggaagaatagagccgctagccgatttagcggattcttctcttccggcccgagcacatccgcattcggccgcgaagttgataaaatggaacagcttgagggaaaacttcatacatatagtctgttcgggctaccccggctgcccagaggcctgaggttcgaccacgactcctgggaggaagaatatgacgaagacgaagacgaagacaatgcttgtttgcgcctggaggattcatggagagaactcattgatgggcacgagaaactgactcgacgtcagtgccaccagcaggaggccgtgtgggaactgctgcatacggaggcctcatatattcgaaagcttcgggtgatcatcaatctgtttctatgttgtctgctgaatctccaggaaagcggcctcctctgcgaggtcgaggccgagcgcctgttcagtaacatacccgagatagctcagcttcatagaaggctgtgggcaagtgttatggcacccgtgttagaaaaggcacgccgcactagagcactactgcagcctggcgatttcctcaaagggttcaaaatgttcggctcccttttcaagccatacattaggtattgtatggaggaagaggggtgcatggaatatatgagaggcctgctgcgcgacaatgacctttttagggcttacattacatgggcagagaagcatccccagtgtcaaaggctcaagctgtcggatatgcttgcaaaaccccatcagaggctcacaaagtacccattactcctgaagagcgtactgaggaagacagaagaacccagagccaaagaggctgtcgtggccatgatcggctcagtggagcgcttcatccatcacgtcaatgcgtgtatgcggcagcggcaagagagacagcgcctggccgcagttgtgtcacgtatagacgcgtacgaggtcgtggaatcatcgtctgatgaagtggacaagctgctgaaggaatttctccacctggacctgaccgcacctatccccggggcaagtccagaagaaacaaggcagctgctgctggaaggatcccttcgaatgaaggaaggcaaggactctaaaatggacgtgtattgctttctgtttactgatcttctattagttaccaaagcagttaaaaaagccgaaagaacacgagtgatccggcccccactcctggtggacaaaatcgtctgtagggagctccgcgacccagggtccttcctgctcatctacctaaatgaatttcatagcgcagtgggtgcatacacctttcaggccagtggccaggcactctgccgaggatgggtggacactatttataacgcacaaaatcagctgcagcaattaagagcacaggagcccccaggttctcagcagcccttacaatccctagaggaagaggaggacgaacaggaagaagaagaggaagaggaggaggaagaggaggaaggcgaagattccggtacatcagccgctagcagcccaacaatcatgcgcaagagctctgggagtcctgattcccagcactgtgcatcagacggcagtaccgaaactctggccatggttgtcgtagagcccggagacactctgtccagtccagagtttgactccggacccttctctagccagagcgatgaaacttcattgtccaccactgcctcatccgctacaccaacttccgagttgttgcctttgggcccggtggatggcaggtcatgttctatggactcagcgtacggtactctttcacccacatccctgcaggacttcgtcgctcccggccccatggccgagttggtcccaagggcccccgagtcacctcgggtcccaagccctcctccctcccccaggttgcgacggagaactccagtgcagctcctctcctgccccccacacctgcttaagtccaaatccgaagcatctctgcttcagcttctggctggggctgggacacatggaaccccatccgcccccagccgcagcttgagcgagctgtgtctagctgtgcctgcccccggcatcagaacccagggctcgccacaagaggctggcccaagctgggactgccgcggtgccccctcacccggatctggcccgggtctggttggctgtttggctggagagccggctggctcccatagaaagcgttgtggagatttaccatctggagcgagtcctcgagtccagccggaaccaccacccggtgtgagtgcccaacatcggaaactgactctcgcccagctgtaccggataagaacaaccctgctactaaatagtaccctgaccgctagcgaggtctag

SEQ ID NO: 128986 - DNA, 3021 bp, Artificial Sequence
  Description of Artificial Sequence: Synthetic coding sequence
atgcactatgacgggcatgttaggtttgaccttcccccacagggtagcgtcctggcacgcaacgtatcgacccgtagctgccctcctagaaccagccctgccgtcgacttggaggaggaggaagaggagagttccgtggacggtaaaggcgacagaaaaagcaccggcttgaaactaagtaagaagaaagcccgacgacgtcatacagacgacccctctaaagagtgcttcacgctgaagttcgatttgaacgtggatattgaaacagaaattgttcccgccatgaagaaaaagagtctgggggaggtcttgctccctgtgtttgaacgaaaggggattgcactcggcaaggtggacatttacttggaccagagtaatacccctctgtcgcttacttttgaggcctatcggttcggcggccattacctgcgcgttaaagcacccgccaagccgggcgacgagggaaaggtggagcaagggatgaaggatagtaagagtttatccctgccaattctgcggccagctggcaccggcccacctgctctggaacgtgttgacgctcaatcccggcgagagtcattggacatactagcgccagggcggcgcaggaagaacatgtccgaatttctgggtgaagcatctatcccaggacaggagccacctacaccatcttcctgtagccttccatctggctcatctggcagcactaacacaggggactcttggaaaaaccgcgctgcctcaaggttctctggtttcttctccagtgggccatcaacgtccgcatttggaagggaggtggacaagatggagcagctcgagggcaagttgcatacctactccctgttcggcctgccgaggctgcccagggggctcagattcgatcacgacagctgggaggaagaatacgacgaggacgaggatgaagataatgcctgcctcagactggaggacagttggcgcgaactgatcgacggccacgagaagctgaccaggcgtcagtgccaccagcaggaggcggtgtgggagcttctgcataccgaggcctcttatatcaggaaattacgtgtgatcatcaatttattcctgtgctgtttactcaacctacaggagtccggcctactttgcgaggttgaggccgaaagactgtttagtaatattcctgagatagcccagctgcacagacggttgtgggcatctgtaatggcgccagtgctggaaaaagccagaagaaccagggccttactccagcccggcgatttcctgaagggattcaaaatgttcgggtcactgttcaagccctacattcggtattgcatggaagaggaaggctgtatggagtacatgcggggactgcttagggacaacgacttgttccgtgcctacataacctgggccgagaagcatccacagtgccaaagactgaagttaagcgatatgcttgccaagccacatcaacgcttaaccaaatacccactcttgctaaaatccgttcttcgcaagactgaagagcccagagcaaaggaggcagtggtagctatgatcggttccgtcgaacggttcatccaccacgtgaacgcttgtatgagacagcggcaggagcggcagaggctggcggctgtagttagtcggatcgacgcttatgaggttgtggaatcttcaagcgacgaagtggacaaattgctgaaggaatttttgcacttggatctgaccgcccccatccccggggcctctccagaggaaacaaggcagctcttgctggagggttcactgaggatgaaagagggtaaggacagcaaaatggatgtgtactgtttcctatttactgatctgttgcttgttaccaaagccgtgaagaaggccgagcgcacccgagttatcagacctcccctgctggtcgataaaattgtgtgtcgagagctccgggatccggggtcattcctcctgatttacctaaacgagttccattccgccgtcggagcatatactttccaggcatcaggacaggccctgtgtaggggctgggtggatacgatatataatgcacagaaccagctgcagcagttgcgggcacaagaacccccaggctctcaacaacccctgcagtccctagaggaagaagaagacgagcaggaagaagaagaggaggaggaggaggaggaggaagaaggcgaggactccgggacctcagcagcctcgtcgccgactataatgcgcaagagctctggctcccccgatagtcagcactgcgccagcgatggctcgacagagactcttgccatggtggtggttgagccaggtgacactctctccagccccgagttcgattccggacctttctcgtctcaaagtgacgagacttctctgtctacaactgcctcatccgcgactcccacaagcgaattgctcccgcttggacccgtcgatggcaggagttgctctatggactcggcctacggtacactctccccgaccagtctacaggatttcgtggccccgggccccatggcagagctggttccgcgcgcccccgagtcaccacgcgttccctccccacctccctcacccaggctgcggcggagaacaccagttcagctgctctcctgccccccccatcttttgaagtccaagtccgaggccagcttgctgcagctgctcgcaggggccggtacccacggaactcctagcgctccatctaggagcctctcggaactgtgcctggctgtccccgctcctggcatccgaacacagggtagcccgcaggaggcaggaccgagctgggattgtaggggcgctcctagccctggaagcggtccaggcctggtagggtgcttagcgggagagcccgctgggagtcaccgcaagagatgtggagatcttccgagtggagcgagccctcgcgtacagcccgagccgcctcctggagtgtctgcccaacatcggaaattaactctagcccagctgtatagaatccgaaccactctcctcttaaatagcaccttgacagctagtgaggtctag

SEQ ID NO: 128987 - DNA, 3189 bp, Artificial Sequence
  Description of Artificial Sequence: Synthetic coding sequence
atggacgatcagtcacctgcagaaaagaaggggttacgatgccaaaatcctgcctgcatggataagggtagggccgccaaggtgtgtcatcatgccgactgccagcagcttcatcgtagagggccgcttaatctgtgcgaagcgtgtgattctaaatttcacagcacaatgcactatgacgggcatgtgcgattcgatctgcctccccagggatcggtgctggcccggaacgtctcaacaaggtcttgtccgccccgcacatctcctgccgtcgacctggaagaggaagaggaggagtctagcgtggatgggaagggagacagaaaaagcacgggacttaaactgtcaaaaaaaaaagcacggcgccgacacaccgacgatcccagcaaggagtgtttcacactcaagttcgacctcaacgtggatatagaaactgaaatcgtgcctgctatgaaaaaaaagagtctgggcgaagttttgctccctgtgttcgaaaggaaaggaatcgccctcggcaaggtggatatatacctggatcagagtaatacacccctgagcttgactttcgaggcatacagatttggcggtcattatctcagggtaaaagctcccgctaaaccaggcgatgaaggtaaggtcgaacaaggcatgaaggacagcaagtctttatctttaccaatcctaagaccagcaggaacaggcccgccagcgctggagagagtggatgcacagtctagacgagagagcctcgacattctcgcaccggggcgccggcgcaaaaacatgtctgaattcctgggggaagcaagtattcctggacaggaaccccccactccctcatcatgctccctcccttctggaagttcgggttctaccaacaccggagactcctggaagaaccgggcggcttctcgcttcagcggatttttctcttccgggcccagtacttctgccttcggacgggaagtagacaagatggaacagctggagggcaaattacacacatactcactgttcgggctgccccgcctcccacgcggcctgagatttgatcatgatagctgggaggaggaatacgatgaggatgaggatgaggacaacgcctgcctacgactggaggacagctggagggagctcatagacgggcatgagaaattgacaaggcggcagtgccaccagcaagaagcagtctgggagcttctgcatacagaggcttcttacatacggaaactcagggtcattatcaacctgtttctctgttgtctcctgaacttgcaagaaagcgggttactgtgcgaggttgaggcagaaaggctgtttagcaatatacctgaaatcgctcagctgcacagaagactctgggcttccgtgatggctccagttctggagaaagctcgtcgcaccagggccctgctacagcccggggattttctgaaaggttttaagatgtttggaagcctttttaaaccttacatcaggtactgtatggaggaggaaggctgcatggagtacatgagggggctgctgcgtgataatgatctgtttcgtgcctatattacatgggccgaaaaacacccgcagtgtcaacgtctgaagctgtccgacatgctggccaaacctcaccagagacttacaaagtatcccctcctgctaaaaagcgtcctgcgcaagacggaggaaccgcgggcaaaggaagcggttgtcgcaatgatagggtctgtcgaaagatttatccatcacgtcaatgcctgcatgcgccagcggcaggagcggcagcgcctggctgccgtggtcagtcgaatagacgcatatgaagtagtggaatcatctagcgatgaggtggataaactactgaaagaattcctccacttggatctgacagcgcctattccaggagcttcaccagaggaaaccagacagctcttactggagggcagcctgcgcatgaaagaaggaaaagactctaaaatggatgtgtattgttttttgtttactgatctcctgcttgtaactaaggccgttaaaaaagcagagagaactagagtaattcgccccccactcctggtcgacaaaattgtttgtagagagctcagggaccctggctctttcctcctaatctacttgaatgagttccattccgcggtgggcgcatacacttttcaggcttccggccaggctctctgccgggggtgggtggacactatctacaatgcccagaaccagctgcaacaactcagggcgcaagagcctcccgggtcccagcagcccctacagtctttggaagaagaagaggatgaacaggaggaagaagaggaagaggaggaggaagaggaagaaggtgaagactccggcacgtcggccgccagtagcccaacgatcatgagaaagtccagtgggtcccccgacagccaacactgtgcctcggacgggtcgacggagacgttggccatggtggtagtggaaccaggcgacacactgtcctctcccgaatttgatagcggtccattcagttcccagagcgacgagaccagtctgtccaccaccgccagtagcgctacacccacctccgaactcttgccgctcgggcccgtggatggccgatcttgctcaatggattcagcgtacggtacattgagtccgacttcccttcaggatttcgtagctccggggccgatggccgagctcgtgcctcgggcccctgagagtccgcgagtgccatcacccccacccagcccacgactgcgccgccgaaccccagtgcagttattgtcctgccccccacatttgctgaaatcaaaaagcgaggcttcactcttgcaactgttggcaggggcagggactcacgggacgccctccgctccctcgcggtccctttctgagctgtgtctggcggttccagctcccggtatacgcactcagggaagtcctcaggaggccgggccatcgtgggattgtaggggtgctccatctcctggaagtgggccaggattggtgggatgccttgcgggtgaaccagccggatcccaccggaagcggtgcggcgaccttccaagtggagctagccctcgtgtgcagccagagcctcccccaggagtctccgcccagcaccgtaagctaaccctggcccagttatatcgcatcagaaccacgctcctgctcaattctactttgacagcctccgaggtatag

SEQ ID NO: 128988 - DNA, 3228 bp, Artificial Sequence
  Description of Artificial Sequence: Synthetic coding sequence
atgggcaccggtccgggagtctctgggaggctagctgctagcaggcccggacctggcttgcccttgagggattctgagccttcatgggccggcggaagggccagggatggtgattcgcaggtgtgtcaccacgcggactgccagcagctccatcggcgcggccctctgaacctctgcgaagcttgtgacagcaaattccattccacaatgcactacgatggtcacgtgcgtttcgacctcccgccccaggggagcgtgctggctaggaacgtcagcacccgtagttgccccccacggacatcaccagccgttgaccttgaggaagaagaagaggagagcagtgtcgacggtaagggtgatagaaaatcaacaggcctcaagctctctaagaagaaggcaaggaggaggcataccgatgaccctagtaaagaatgctttactctgaagttcgatctgaacgtcgatatcgagaccgaaatcgtacctgccatgaagaaaaaatctctgggggaggtgctgctgcccgttttcgagcggaagggaatagccctcgggaaggtcgatatctatctggaccaatccaacactccgctttcgcttacattcgaagcatacagattcggtggacattatctcagggtaaaggccccagcaaagcctggggacgaggggaaagtggaacagggtatgaaggacagtaagtccttaagccttcctattttgcgacccgctgggaccggaccaccggccctggaacgcgtagatgcacagtcaaggagagaatctctggacatcctggcaccaggcaggcggcgtaagaatatgagcgaatttctgggcgaggcctccatacccgggcaagagcccccaaccccctcttcctgtagcctgccgagcggttctagtggaagcactaataccggtgactcttggaagaaccgggccgcttctaggttctccggtttcttctcctccgggccaagcacctctgcattcggtagggaagttgacaaaatggagcaacttgagggcaagttgcacacatatagcctttttggcttgccccggctcccaagaggactacggtttgatcatgactcctgggaggaggaatatgatgaggatgaagatgaagataacgcctgcctgcggcttgaggacagctggcgggaactcattgacgggcatgaaaagctgaccagaaggcaatgccaccagcaggaagccgtttgggagctcctccacaccgaggcgagttacataaggaagttgagagtaattataaacttattcctgtgctgtctgttgaaccttcaggagtccgggctgctgtgcgaagtcgaggctgagcgtttattcagtaatattccagagatagcacagctgcatcgacggctgtgggcttccgtgatggcacccgttctggagaaggctaggcgtacccgtgcgcttttacaaccaggcgattttctgaaggggttcaagatgtttggctccctgtttaagccctatatcaggtactgcatggaggaagagggctgcatggagtacatgcgaggactgctgagggataacgacttgttcagggcatacatcacctgggccgagaagcatcctcagtgtcagcgcctgaaacttagtgatatgttggctaaaccacatcaaaggctgacgaagtaccctctcctccttaagtccgtacttagaaagactgaagaaccaagggctaaagaagccgtagtcgctatgattggatcagtggaaaggtttatccatcacgtcaatgcgtgcatgcggcaacggcaagagagacaaaggcttgcagccgtggtcagtcggatcgatgcttatgaggtggtcgaaagttcttctgacgaggttgataagctgctcaaagaattcctgcacctcgatctgacagcgcctatccctggcgccagtcctgaagaaacacgccagcttctgctagaaggctccctaagaatgaaggaaggtaaagattcaaaaatggacgtgtattgcttcctgtttacggaccttctgttagtgactaaagccgtgaagaaagcagagcgtacgcgcgtcatcaggccacctctgctggtggacaagatcgtctgccgcgaactgagggatccagggtcatttttactgatttatctgaatgaatttcactccgccgtgggcgcctatactttccaagccagcggtcaggctctgtgccgtggatgggtggacacgatctataatgcacagaaccagttgcagcaactgagggcccaggagcctccaggttctcaacaaccgcttcagtccctggaggaggaagaagacgagcaggaagaagaggaagaagaggaggaggaggaggaagaaggagaagacagtggtacttctgccgcatctagcccaacaatcatgaggaaatcgtccgggtctcctgactctcagcactgcgctagcgacggcagcaccgaaactctggccatggtggtggtcgaacctggcgatacactctcaagccccgaattcgactccggcccattcagtagccagtccgacgagacatccctatccacaacagcaagtagtgctacaccaaccagtgagctgctcccgctcgggccagtcgatgggcgtagttgttccatggactctgcctacggcacattgagcccaacctctctacaggacttcgtagctcctggccctatggctgagctggttccccgggcccccgagagcccacgcgtgcccagcccacccccctccccacggcttagaaggcggactcccgtgcagctattgagctgtccgcctcatttgctcaaaagcaagtctgaggcctcattgctacaactcttggccggcgctggtacgcacgggactccatcagctcctagcagaagtttgtctgagctatgtctggctgtgccagcccctgggattaggactcaggggtcgccccaagaagcaggacctagctgggattgcagaggcgcaccatcccctggaagcgggccaggcttggtgggatgcctggcgggggaaccagccgggagccatcggaagagatgcggcgatcttccatccggggcatcaccccgcgtgcagccagagcctcctcccggagtttcagcacaacataggaagctcactttggcccagctgtatcgcattagaactacactgctgctgaactctaccctgaccgctagcgaggtttag

SEQ ID NO: 128989 - DNA, 2739 bp, Artificial Sequence
  Description of Artificial Sequence: Synthetic coding sequence
atgaagaagaagtctctcggcgaggtgcttttgcctgtatttgagcgtaaggggatcgcgctggggaaggtggatatttatttggatcagagtaacacacccctgtccctgacctttgaagcctaccgtttcggtgggcattacttgcgggtaaaggcgcccgctaagcctggcgacgagggcaaggtggaacaggggatgaaagactccaaatccctgagcctgccaatactacggccagcaggcactggccccccagcactggagagagttgatgcacagtcacgcagggaatccttagacattctcgcccctggccggagacggaaaaatatgagtgagttcctgggcgaagccagcattccaggccaggagccccctaccccctcttcctgcagccttccctccggatcaagtggatctactaatactggggattcttggaagaacagggccgcctctagattctcggggttcttctcgtctgggccttcgacttcagctttcgggagagaagtggataagatggagcagttagagggaaaactccacacctattctcttttcggccttccacggttgcccaggggtctccgattcgatcatgattcttgggaggaggagtacgatgaagacgaggatgaggacaacgcttgtctcagattggaagacagctggagggagctgatcgatgggcacgagaaactgacgcgtcgtcagtgccaccagcaggaggccgtctgggagttgctacataccgaggcctcttacatccggaaactgcgcgtaataattaacctgttcctatgctgtctactaaacctgcaggagagcgggcttctgtgtgaggttgaggcagaaagacttttctccaacatcccagagattgcccagctccataggagactgtgggcttccgtcatggctcccgtgctcgagaaggcaagaagaaccagagctctattgcagcccggagattttctgaaaggctttaaaatgttcggctccctctttaagccgtacattagatactgtatggaagaagagggctgtatggagtatatgcgcggcctgctgagggataatgatttatttagagcgtatatcacttgggcggaaaagcacccacagtgccagcggctgaaactcagcgacatgctcgccaaaccccaccaacgtctcaccaagtatcccttgcttcttaaaagcgtactgcgaaaaaccgaggaacctagggccaaggaggctgtggttgcgatgatcggaagcgtggagcgtttcattcatcatgtaaacgcttgtatgcgccagcggcaagagcggcaaaggctggctgcggttgtttcaaggattgatgcatacgaagttgtcgagagctctagtgacgaggtcgacaaacttctaaaagaattcctccatctagacctcacagcacctattcctggagcttcgcctgaggaaaccaggcagttgttgctggaaggcagcctgaggatgaaagaaggcaaggactccaagatggacgtgtattgttttctttttacggacctgttactcgtgacgaaggcggtgaagaaagctgagcgaacccgcgtaatacgcccaccactcctcgtcgataagatcgtgtgccgggagctgagggatccaggtagttttttgctgatctatctgaacgagttccattccgcagttggcgcctacacctttcaggcatcaggacaggcactctgtcgcggctgggtcgatactatctacaacgctcagaaccaactgcagcaactgcgggcccaggagccacccggatctcagcagccactgcagagcttagaggaagaggaggatgaacaagaggaggaggaagaggaagaggaagaagaggaggagggagaagatagtggaaccagtgctgcatcgagccctactattatgaggaagtccagcggctcgccggattcacagcattgtgcctcagatggctcgaccgagactttagcgatggtcgtagtcgagcccggcgatactctgagtagtccagagtttgactccggaccgttttcgtcccagagtgacgaaacgagtctgtctaccacagcttccagcgcgacccctacaagcgaactgttgcccctcggccccgtggatggtaggtcctgtagcatggattctgcttatggaaccctatcacctacctccttacaggatttcgtggcccctggcccaatggctgaactggttccccgagcccctgaatcaccgcgggtgccatcccctcctccatctcccaggctgcgccggcgcactccagtgcagctcctgagttgccccccccaccttctaaaatctaagagcgaggcctcactcctgcagctgttggctggagccgggactcatggaactccgtccgcacccagccgatcgttgagtgaattgtgcctggctgtgccggcgcctggaatccggacccagggatccccacaggaggcgggcccctcatgggattgccggggcgctccaagccccggatcggggccaggactcgttgggtgcctagccggcgagccggcgggttcacacaggaaacgttgcggggatcttccaagtggagcctccccccgtgtgcagcccgaacccccccctggcgtgtctgctcaacaccggaagctgacactggctcagttgtatagaatccggacaactctgctcctcaatagcacgcttacagcttctgaagtgtag

SEQ ID NO: 128990 - DNA, 3258 bp, Artificial Sequence
  Description of Artificial Sequence: Synthetic coding sequence
atgtcactaggtgagagaggatcccctcaaacatttggaggcagttccgtcagcaaaggtagcgatgccggccacgatcagtcacctgccgagaaaaaggggctccgttgccagaatccagcatgtatggacaagggcagggccgcaaaagtttgccatcacgccgattgtcaacaactgcatagacgaggccctctgaatctgtgtgaggcttgcgactcgaagttccacagcaccatgcattacgatgggcatgtgaggttcgacctgccaccccagggaagcgtgctggcccggaatgtgagcactcggtcatgcccaccaagaacatcccccgctgttgatctcgaagaggaggaggaggagagctctgtggatggcaagggggacaggaaaagcacgggccttaagttgtctaaaaagaaagccaggcgccgccataccgatgaccctagcaaggagtgcttcacccttaaatttgacctaaatgtagatatcgagactgagattgtgcctgcaatgaagaagaaaagcttgggagaggtcctgctgcctgtctttgaacgcaaaggtattgccctggggaaagtcgacatatacctggatcagagcaatacaccgctgtccctaacattcgaggcctatcgctttgggggacactaccttcgcgtgaaggcgcccgcaaagcccggagacgagggaaaagtggagcaagggatgaaggactctaagagcttatcacttccaatattgcggcccgccggaacaggcccacctgccttagaaagagtggacgcgcagtccagacgcgagagcttggacattttagctcccgggcgtcgccgcaaaaatatgtccgaattcttgggtgaagcctctattccaggacaggaaccccccaccccctcttcatgttctcttcctagtgggtcttcaggttcaactaataccggtgattcatggaagaatcgcgctgccagtcgcttttctggcttcttcagctctggcccaagcacatcagcgttcgggcgggaggttgataagatggagcaactggaaggcaaactccacacctacagcttgtttgggctgccaagactgccgagaggcctgcgatttgaccatgatagctgggaggaggagtacgatgaagacgaagatgaggacaacgcatgcctgcggctagaggactcatggcgtgagctcatagatggtcatgaaaagctgaccaggaggcaatgtcatcagcaggaggctgtatgggagttgctccacaccgaggccagctacatcagaaaattgagggtcattataaatctgttcctgtgttgcctcctcaaccttcaagagagtggactcctttgcgaggtagaggcggagagattgttttctaatattcctgagatcgctcaacttcacagaagactgtgggcctccgtgatggcacctgtcttggagaaagctcgacggactcgggccctactccagccaggtgactttctgaagggcttcaagatgtttggaagtctctttaagccttatatccgttactgtatggaagaggagggatgcatggaatatatgcgggggctcctgagagacaatgatctcttccgcgcatacatcacctgggctgagaagcatcctcagtgccagagattaaaattaagcgacatgctggcaaaaccccaccagcgactcacaaaataccccctcttgctgaagtccgtgttacggaagacggaggaacctcgcgccaaggaggccgttgtggcgatgattgggtccgttgaaaggttcatacatcacgtgaatgcctgcatgcgccaacgacaggagagacagcgcctggctgcggttgttagccggatcgatgcctacgaggtggttgagagctcttcggacgaagtagacaagcttctcaaggagtttctgcatttggacttgaccgccccaataccaggtgctagtccagaagagacgcgtcaactgctgcttgaaggaagtctgcgcatgaaggaggggaaggacagcaagatggacgtctattgctttctctttactgatctgttattggttaccaaggcagtgaagaaggccgagcgtacacgtgtcataagaccaccactactggtggacaaaatcgtgtgtcgcgagctgagggacccgggctccttcctgcttatttatctgaatgaatttcattctgctgtgggcgcgtacacttttcaggctagcggacaggccctctgtcgggggtgggtggacacaatctacaatgcccagaatcagttacaacaattgagggcacaggaaccgcctggatcacaacagccattgcagtcccttgaagaagaagaggacgagcaggaagaggaagaggaggaagaggaggaagaggaggagggcgaagacagcggcacttcagcagcgtctagtccaactattatgaggaaatcatcggggagtcctgactcacagcattgcgccagcgatgggtcaacagagacgctggctatggttgtagtggagcccggtgacacacttagctcacccgaattcgacagcggacctttctcttcccagtcggacgaaacttccctctcaacaacagcctcatcagctacaccaacatctgagctcctcccactggggcctgtggacggccggtcgtgctccatggacagtgcttatggaaccctgtcacccacaagtttacaggacttcgtggcgcccggccctatggctgagcttgtcccccgcgcacctgagagtccacgcgtgccatcccctccaccttctcccagactgcgaaggcgtacccccgtccagctcctctcatgccctcctcacttgttaaaatctaagtcagaggcttcgctgttgcagctgctagccggggcagggactcacgggactccttccgcacctagcagatccctgagtgagctgtgcctggccgtgcctgctccaggaatccggacgcaggggtcacctcaagaggctggcccaagttgggattgccggggtgcgcccagccccggtagcggcccgggactggtgggctgccttgccggggagcccgcagggtcacaccgcaagcgctgcggggacctcccctccggcgccagcccacgggtccagccagagcccccccctggcgtgtccgcccagcatcggaagcttacattagcgcaattgtaccggataaggactactctccttctgaactccacgcttaccgcaagcgaagtatag

SEQ ID NO: 128991 - DNA, 2793 bp, Artificial Sequence
  Description of Artificial Sequence: Synthetic coding sequence
atgcattacgacggccatgtaaggtttgatctgccgccccaaggctcagtcctcgctcggaatgtgtctacaaggagctgccctccccggacatcccccgctgtggaccttgaagaagaagaggaagagtcctctgtcgatggtaaaggggatcggaaatcgactggactgaaactctccaagaaaaaagctaggagaagacacactgacgacccctccaaggagtgctttactctgaaatttgatttgaacgtggacatagagaccgagattgtgcctgctatgaagaaaaaatcgctgggagaggttctcctgcctgtgttcgagcgtaagggcatagccctgggcaaggtggacatctatttggaccagtcaaatactcccttgtccctgacttttgaagcctatcggtttggcggccattaccttcgtgtaaaggcacccgccaagccaggtgacgaagggaaagtcgaacagggtatgaaggatagcaagtctttgtctctccctatcctaagaccagcaggcacggggccgccagcgttggaacgcgtggatgcccaatccagacgtgagtcactggacatccttgcgcccggtagacgaaggaaaaatatgtccgagttccttggggaagctagcattcctggccaggagccacctactccctcctcatgcagtctgcccagtggatcctccggaagcactaatactggcgatagctggaagaaccgggccgcttcaaggttctcaggctttttctcttctggcccgagcacctcagcgtttgggcgtgaagtagataaaatggaacaactagaagggaaactccacacttatagtttgtttggactcccccgtctgccacggggcctgcgcttcgatcacgacagctgggaagaggagtacgatgaagacgaagacgaagacaacgcctgcttaaggttggaagacagttggcgggaactaatagacgggcacgaaaaactgacgcgccgccagtgccatcaacaggaggcagtgtgggagctgctgcacacagaggcctcatatatccgaaagctgcgggttatcatcaatttgttcctttgttgccttctgaacctacaggaaagcgggctcctgtgtgaagtggaagcagaacggctgttttctaatatccctgaaatcgcccagctccaccgccggttatgggcctccgtgatggctccagtcctggagaaagcacgacgcacccgggcactgttgcaacccggtgatttcctgaaaggattcaagatgttcggcagtttgtttaaaccctatataaggtactgcatggaggaggaagggtgtatggagtacatgagagggctgctccgtgacaatgacctgttccgcgcttacattacttgggcggagaagcacccccaatgccagagactgaagctgtctgacatgctcgcaaaacctcatcagaggctgaccaagtacccactgctccttaaatccgtgctgaggaaaactgaggagccacgggccaaagaggccgtggtggccatgatcggttccgtagagcggttcattcaccacgtcaatgcctgcatgaggcagcgacaggaacgacagagattggcagccgtcgtcagtaggatcgacgcctacgaagtggtcgaaagcagctccgacgaagtcgataagctgctgaaagagtttctccacctcgatctaaccgctcccataccgggcgcgtccccagaagagacacgtcagttactcctagagggcagtctgagaatgaaggaaggcaaagacagcaagatggacgtgtactgctttctgttcaccgatctgctcctggtcactaaagccgtcaagaaggcagagagaacccgggtgatcaggccccctttactggtggacaaaattgtctgcagggaactccgagatcccggctcgttcctgcttatttatctcaatgaattccattccgcggtaggcgcctacacctttcaagcctcaggtcaggcactgtgccgcggttgggtggacactatctacaatgcacagaaccagctgcaacagctgagggcccaggaaccaccaggcagccaacaaccattgcaaagtttagaagaagaggaagacgaacaagaagaagaagaagaggaggaggaggaagaagaagagggagaggattccggcacttccgccgcctcaagtcccacgatcatgcgtaagtcttctggctcccccgacagccagcattgcgcctcagatggaagtacagaaacgcttgctatggtggtggtggaacccggcgacactttgtcgagtccagagttcgacagcggccctttcagtagccaaagcgacgaaacctctctgagcacaactgcttctagtgcgacgccgacctctgagttactccctttaggccctgtggatggacgctcctgctcaatggactcagcgtatggtacacttagtcctacaagtctacaagattttgttgcccctggacctatggccgaactggtgccgcgcgcacctgagagcccccgcgtgccaagcccccctccgtcaccacggttaaggagaaggacccccgtccagctgctgtcctgcccgccgcacctgctcaagtcgaagtccgaggcgtcactgctgcaactgttggccggagctggcacccacggtacaccatccgccccttcccgtagtctctctgaactgtgccttgccgtgcccgctcctgctcaggaagctgaccctgggccagcactgcccaatcaggaccacccggcggcctag

SEQ ID NO: 128992 - DNA, 2373 bp, Artificial Sequence
  Description of Artificial Sequence: Synthetic coding sequence
atgaaggcctttggaccaccccatgagggccccttacaggggctcgtcgccagccgtatcgaaacatacggaggccgccaccgagcttccgcccagtcaaccgctggccgtctgtaccctagagggtaccccgtgttggacccatcccggaggagactgcagcagtatgtgccctttgccagaggcagcggtcaggcccgcggattgtccccaatgagactgcgtgatccagaacctgaaaagagacatggcgggcacgtgggagccggactactgcattctcctaagctgaaggagttgaccaaggctcacgagctcgaggtgcgcctgcacacctttagtatgttcggtatgccccgcctccctcccgaagatcgacgccattgggagattggcgaaggcggcgatagcgggttgacaatcgaaaaatcctggcgggagctggtgccaggccacaaggaaatgtcccaagaactgtgccatcagcaagaggccctgtgggagctgctgacaacagagttgatttatgtgagaaagctcaagatcatgactgacttgttggcggctgggctcctgaacctgcaacgagttggattactaatggaggtatctgccgaaaccctcttcggaaacgtccccagcctgatcagaacacatcgatctttttgggatgaagtgttaggccctactttggaagaaactagagcatcagggcagccactagaccctataggcctccagtccggttttctgactttcgggcagcgtttccacccttatgtgcagtattgccttcgggtgaaacagactatggcatatgccagggaacaacaggagactaatcctctgtttcacgccttcgttcagtggtgtgagaaacacaaacgctccggacgccagatgctatgcgacctcttaattaagcctcaccagcgaattaccaaataccccctcctattacatgcggtgctgaagaggtcccctgaggcccgagcccaggaggctctgaacgcaatgattgaggccgtcgaatcctttctcaggcatatcaacgggcaggtgcggcaaggagaggaacaggaatcccttgctgcggctgcgcagagaatcggcccatacgaagtgctggaacctccaagcgacgaagttgaaaagaacctgcgacccttctcaaccctcgacctcaccagccccatgcttggggttgcatccgagcacacaagacaactgctactggaaggtcccgtcagggtgaaagagggacgcgagggcaagctggacgtctatctgtttctgttctccgatgtgctattagttacaaagccccaacgaaaggcagacaaagcaaaggttatccggcctcccctcatgctggagaagctggtttgccagcctctcagggatccaaactccttcctgctgattcatttgacagaatttcaatgcgtgtcctcagccttactagttcactgcccctcccctaccgatagagctcaatggctggaaaaaacccagcaagcacaggcagccctgcagaagctgaaggccgaagagtatgtgcagcaaaagagagagctgctaacgctctaccgggatcaagacagagagtccccgagcacccgcccaagcaccccgtcattggagggctcacagtcgtcagctgagggtaggactccagaatttagcacgatcatccctcatctggttgtgactgaagacaccgatgaggacgctccactggtgccggatgacacctctgattctggttacggaactctgattcccggcactcccaccgggagtaggtcccctctgtctcgcctgagacaacgggcgttaagacgtgaccccaggctgacattcagcactctcgagctgagagatattcccctgcggccacacccccctgacccccaggcccctcagagacgctcagcccccgagcttcccgagggcatcttaaaagggggatcattgccccaggaggatcccccaacttggtcagaggaggaagacggcgctagtgaacggggcaatgtcgttgtggagaccttacaccgcgctcgtctgcgtgggcagctgcctagtagccccacgcacgccgattctgcgggtgagagtccttgggagagctctggggaagaggaagaggagggccccctttttcttaaagctgggcatacatcactgcgccctatgagagccgaagacatgcttcgggagattagggaggagttagcctcacagagaattgaaggagccgaggagcctcgcgactcacgaccacgcaagttaactcgggctcagctccagcgcatgcgaggacctcatataattcagctagatacacccctaagtgcttccgaggtttag

SEQ ID NO: 128993 - DNA, 963 bp, Artificial Sequence
  Description of Artificial Sequence: Synthetic coding sequence
atgtgcccaagggagggtggcagggcatcgactattcatcaaaagaccgaaaaggcattcggtcagctgctgtgccagcccttaggggaacccaagatccagcaccccttaaaggcagccctgcagaagttgaaagctgaggaatacgtccagcagaaaagagagcttctgacgctctatagagatcaggatagggaaagcccttccactaggcccagcacaccatccctcgaaggcagtcagtcatccgctgagggtcgtaccccagagttttcaactatcatcccacatctggtagttaccgaggatactgatgaggacgccccgcttgtgcccgatgacacatccgattcgggatacgggacactgatcccagggactcctaccggttctagaagcccgcttagccggctccgtcagcgcgcgctccgcagggacccccgtttaacattctcaaccttagagttgcgggatatccccttgcgaccgcacccgccagatcctcaggccccacaaagaaggagcgcaccagagctgccagagggcatactgaagggcggatctctacctcaggaggatccacccacatggagcgaggaggaggatggggcttccgaacggggcaacgttgtggtcgagactttacaccgcgcccggctgcgcggtcaattgcccagctcacccacacacgccgattccgctggtgaaagtccctgggagtcctcaggagaagaggaggaggagggccccctgtttctcaaagctggccacacctcactgcgcccaatgcgtgcggaggatatgttgagggaaattagagaggagttagcctctcaacgcatcgaaggcgcagaggaaccccgtgattctcggccccggaagctgactcgcgcccagctacagagaatgcggggaccccacattatccagctggatactccattgtcagcatccgaagtgtag

SEQ ID NO: 128994 - DNA, 2373 bp, Artificial Sequence
  Description of Artificial Sequence: Synthetic coding sequence
atgaaggcattcggcccccctcacgagggacctctgcaaggtctggtagcaagccgcattgagacctacgggggaaggcaccgcgcttccgcacaatctaccgctggacgactgtaccctagaggctaccccgttctcgacccaagccggcgtcgcctccaacagtacgtccccttcgcaagggggtctggccaggccagaggtctgagccccatgagactcagggatcccgaacctgagaaacggcacggaggccacgtcggggccggcctcctccatagccctaagctgaaggagctcacaaaagctcacgaactagaggtgagacttcatactttctcgatgtttggtatgccccgattgccacccgaggaccggcggcactgggagatcggggaaggcggagacagcggcctcaccatcgaaaagtcctggagggaactggtaccaggacataaggagatgtctcaggagttatgtcaccagcaagaagctctgtgggagctgctgaccaccgagctgatttatgtgcgaaaacttaagattatgacagacctgctggctgcaggcctcctcaacctacagagggtcggattgctgatggaagtttcagcggaaaccctgtttggaaatgtgccatctctgatccgcactcacagaagtttctgggacgaggtccttgggcctaccttagaggagacacgtgccagcggacagcccctggatccaatcgggctccaatccggattcttgacgtttgggcagagatttcacccttatgtgcagtattgtctccgcgttaaacagactatggcctatgctcgggaacagcaggaaactaatccattgtttcatgccttcgtgcagtggtgcgagaagcacaaaaggagcggacggcagatgctgtgcgacctcctgattaagccacatcaaaggatcaccaaatatcccctcctcctgcacgccgttcttaagaggtctcccgaggctcgggcccaggaagcactcaacgcaatgatcgaggccgtggagtcattcttgcgacatattaacggacaggtgcgccaaggcgaagagcaggaatctttagctgctgctgcccaaagaatcggcccttatgaggtactggagccacccagtgacgaggttgagaagaacctgaggccattctctaccctggatctaacttctccaatgctgggggtggcatcagagcacactcggcagctgctgctggaagggccagtcagggtcaaagagggccgcgagggcaaactggacgtctacctgtttctattttccgacgttcttctggtgacaaagccacagcgcaaggccgacaaggccaaggtgatccggcctccactcatgctggaaaaattggtgtgccagccactgcgagatcccaactcttttttgttgatacacttgacggagttccagtgcgtttccagtgccctgctcgtgcattgcccgagccccaccgacagggcacaatggctcgaaaaaactcagcaagcccaggccgcactccagaagctcaaagccgaagagtacgtccagcagaaacgagaattgctaaccctgtatcgggaccaggatcgcgagtccccatctacccggcccagcaccccatcattggaaggcagccagtccagtgccgaaggtaggactcccgagttcagcactattattcctcatttggtggtaacagaagacaccgacgaggacgcacctttagttcccgacgacactagcgatagcgggtacggcacgctgatccccgggaccccgaccggatccaggagtcccttgagccgattaaggcagagggccttgcgcagagacccccggctgaccttttccaccctggaattaagagacattcccctgcggcctcacccgccagacccccaggccccacaacgtcgctctgcccccgagctgccggaaggcatactcaagggcgggagcttgcctcaggaagatccccccacatggtctgaggaggaagacggtgcttcggagcgtggtaatgtagtggtcgagacactgcaccgggctaggcttcgtggtcagcttccgagctctccaacacatgccgactctgcaggtgagtcgccttgggaatcctctggagaagaggaggaagagggacccctatttctgaaggctgggcatacatcattacgccccatgagggccgaagatatgctgagagagatcagagaggagctagcaagccaacgtatcgagggggcagaagagccgagagacagccgaccacgtaagcttacccgggcccagctccagcggatgagaggcccacacattatccagctggatacaccactgtcagccagtgaagtatag

SEQ ID NO: 128995 - DNA, 2277 bp, Artificial Sequence
  Description of Artificial Sequence: Synthetic coding sequence
atgggatgcagactgcatgcccccggtgagaaggctgcccacgatcccagtcgccgtcgtttgcagcagtacgttccgttcgcaaggggatcgggccaggcccgcgggctgtcccctatgcggcttagagacccagagccagaaaaacgacatggcgggcatgtgggggcaggcctgctgcattcacccaagttaaaggaactcactaaggcccatgagctggaggtgaggcttcacactttcagcatgttcggcatgccccggcttccacctgaggaccggcgccactgggagataggagaagggggcgattctgggctcaccatcgaaaaaagctggagggagctagtccctgggcacaaggagatgtcacaggagctgtgccatcagcaggaagcattatgggagctgttgacaaccgagctaatatatgtgagaaagctaaaaatcatgacagacctgttggccgccgggctcttgaacttacagcgcgttggtctgctcatggaggtgtctgccgaaaccttgtttggtaacgtaccatctctgattcgcacacacaggtccttttgggacgaagtacttggacctactctggaagaaactcgcgcaagcgggcagccacttgatcccatcggtctgcagagcggcttcttaaccttcggtcagcgcttccatccttacgtgcagtattgccttagagtcaagcagacgatggcatatgcccgtgagcagcaggagacaaatcccctttttcatgcctttgtacagtggtgcgagaaacataaaagaagcggccgacagatgctttgcgatctgttaatcaaaccccaccagcgcatcacaaaataccccttattgttgcacgccgtgttgaaaagaagccccgaagctagggcacaggaggccctgaacgcaatgatcgaggcagtcgaatctttcctgagacacattaacggccaggtcaggcagggcgaggagcaagagagcctggcagcagccgcccaaagaatcggaccctacgaagtccttgagccaccatcggacgaggtagaaaagaacctgaggccgttttctactctggatctcacatcaccaatgctaggtgttgcttccgagcacactcgccagctattgctggaaggccccgtccgcgtgaaggaggggcgcgagggaaagttagatgtatacctgttcctgttttccgacgttcttttagtgactaaaccccagaggaaggccgataaggctaaagtaatcaggccaccacttatgttagagaagctcgtgtgtcagccactgagagatccaaactccttcctcctgatccacttgacagaatttcagtgcgtaagcagtgcactgcttgtgcattgcccatctcccactgatcgagcacagtggctcgaaaaaacccaacaggcccaagctgcgcttcaaaagctaaaggctgaggagtacgtacagcagaagagggagcttttgacgctctatagggatcaagaccgagaatccccctccactagaccatctaccccatcccttgaaggatctcaaagctcagctgaaggacgcacacctgaattctccactatcatccctcatcttgttgttactgaagataccgacgaggatgcgccactagtccctgacgacacgtcagactctggatatggaaccctcatccccgggactccaactggatctcgctctcctctgtcacgactccgacagcgagctttacgtcgggaccccagattaactttctccactcttgaattgcgagacataccattaagaccacatccccctgacccacaagcacctcagcggaggagtgccccagagcttcctgagggcatactgaagggcgggtctctgccacaggaggaccctcccacttggtccgaagaggaagacggggcttctgagagaggcaacgtggttgtggagactctgcatcgcgctcgcctgcggggccagcttcctagcagtcctacgcatgctgattcagcgggggagtccccgtgggagtcgtctggagaggaagaagaggaggggcctttgttcctcaaagctggccatacttctcttcgacccatgcgagccgaggacatgctacgcgaaatccgcgaagaactcgcatctcagcgcatagaaggcgccgaagaacctagagactctcgtcctcgtaaacttaccagagcccaactgcagaggatgcgaggaccgcatatcatacagctggatacacctctgagcgcctcagaggtttag

SEQ ID NO: 128996 - DNA, 4482 bp, Artificial Sequence
  Description of Artificial Sequence: Synthetic coding sequence
atggctgaactcagcgagcctgaggggcctgtcgactggaaggagcgctgtgtggccctggagtctcagcttatgaaattccgtgtgcaggcctctaagatcagggaactgctggcggagaagatgcagcagctcgagagacaggtcatcgacgcagagcgccaagccgaaaaagcttttcaacaggtccaggtaatggaggataagcttaaagctgcaaatattcaaacttctgaatccgagacgagactgtacaacaagtgtcaggacctggagtccttgattcaagagaaggatgatgtgattcagaatcttgagctccagcttgaagagcagaaacagatccgaattcaggaggctaaaattattgaagagaaggccgcaaaaattaaagaatgggtgactgtgaagttgaatgagctggagctggagaatcagaacctgagactcatcaaccaaaaccaaacagaagagattcgtaccatgcaatccaaactccaggaggttcaggggaaaaagtcatcaacggtgagcacattgaagttgtcggagggccagagactgtcaagcctcacctttggctgcttcctctcccgagcccggagcccaccacaggttgtgaagtcagaggaaatgtcaaagatctcgtctaaggagcctgaatttactgagggaaaagatatggaggaaatggagatccctgagaaatcagtcgataaccaggtgctagaaaacaatcgaggacagaggacgctgcatcagactccctgtggctcagaacaaaaccgcaagacacgcacttcctttgctaccgatggtggcatttcccagaattcgggcgccccagtgtccgactggtcttcagacgaagaggatggctccaagggacgctcaaaaagccggtgtacaagcactctcagttctcacacttcagaggagggtgttcagtgcagtcggatgggatcggaaatgtacctcaccgcttccgacgattcgtcatctatcttcgaggaggagacctttgggatcaaaagacctgaacataaaaaactgtattcgtggcagcaagaggcccagtggaaagccttaaactcgccgctgggcaagggtaacagcgaactgagcaaaaaagagcaggacagctcaagtgatgagctgaacaagaaatttcaatctcaacggctcgattactccagctcatcaagtgaggcgaacacaccctctcctatcttgacccccgccctgatgccgaagcatccgaactctctctccggtaaggggacccaattggtaccctcgagtcatctgcctccccccaaacttcggattccaaatgttttctcaatctctgtagctctcgctaaaagacacctgagccagccgcagctaagttccgaccgcatgttcggaaccaatcgcaacgccatatcaatgattcgacccctgagaccgcaggaaacagatctggacctggtggatggcgactccactgaggttcttgaaaacatggacacaagctgtgacgacggcctgtttagctacgattctctggacagtcctaatagtgatgaccaggagcactgtgatagtgcgaagaaggtcgcgtattccaaaccccccactccaccactccatagattcccgtcctgggaatctcgcatttacgctgttgctaagtccggtatcaggatgagtgaggcttttaacatggaatctgtgaacaagaattccgccgccaccctgtcctatactacatctggtctgtacacgagtctgatttacaagaatatgactacgccagtttataccactctgaaaggcaaggccacacagatcagcagctctccattcttggatgactcttcgggctcggaggaggaagattcctccaggagttcctcccggacgtctgaatccgactcccggagcagaagtggccccggaagcccgagggccatgaaaagaggagtaagcctatcaagtgtcgcttctgaaagtgattacgccatacccccagacgcgtattccaccgataccgaatatagccagcctgaacagaagctgccaaaaacttgtagttctagctccgacaacgggaagaatgagccactggaaaaatccggatacctactgaagatgagcggcaaagtgaaaagctggaagaggcggtggttcgtcctgaaaggtggtgagttgttatattataaatcaccttccgatgtaataagaaaaccgcagggccatatcgaattgagtgctagctgcagcattctgcgaggggataataaacagaccgtgcagctgactactgagaaacatacgtactacctcaccgccgattctcccaatatcttggaggaatggattaaagtgttacagaacgtgttgcgggtgcaggcagcaaatcccctctccctgcagccggaaggcaaacctactatgaaagggctgctgacgaaagtcaagcatggctacagcaagagggtgtggtgcaccctgattgggaaaaccttgtactactttcgaagtcaagaggacaagtttcccctggggcaaattaagctctgggaagccaaggtggaagaggtagatcgatcttgcgattccgatgaggactatgaagcatccggaaggtcactgctgtccactcattatactatcgtgatccacccaaaagatcaggggccaacatatctcctgatcggcagtaaacacgagaaagatacgtggctgtatcacctcacagtggccgccggatccaacaatgtcaatgtcggatcagaatttgaacagctggtatgtaagttgttgaatatcgacggagaacctagttctcaaatctggcgtcaccctacactctgccatagtaaagagggcatcattagccccttgacaactttgcctagtgaagcactccagaccgaggcaattaagttgtttaagacttgccagctgttcatcaatgccgcagttgactccccagcgatcgattatcatatttcgttagcacagagcgcactccagatttgcctcacacaccccgaactgcagaatgagatttgctgccagcttattaaacagacccggcgtcgtcagccacagaatcagcccggccctcttcaggggtggcagttactggccctgtgtgttgggctgttcctgccacatcacccttttctgtggctcctgagacttcatcttaaacgaaacgccgactctcggaccgaatttgggaaatatgccatttactgtcagcggtgcgtcgaacgaacccaacaaaacggagatagggaagctcggccctcaaggatggaaattttaagcaccctgcttcgtaacccttatcaccatagtttgcccttttcgatcccagtgcatttcatgaatggtatctaccaagtggtcggcttcgatgcgtcaaccaccgtcgaggaattcctgaataccctgaatcaagacacgggtatgaggaagccagcccagtccgggtttgctctgttcactgatgaccctagcggccgcgatctcgagcattgcctgcagggcaacattaagatttgtgacatcatctctaagtgggagcaagcctctaaagaacagcagccagggaagtgcgagggcacgcgtaccgttcgcctgacgtataagaaccgcctgtacttctctgtccaagcgcggggggaaacagaccgcgagaaattgttgctcatgtaccagacaaacgatcagattattaatggactgtttccactgaataaagacctggcactggagatggccgccctcttgtcacaggtcgaaattggcgacttcgaacggccgttttcgactccagctggacatgtgaccaatcagtgtaaagtgaatcagacactgaagcaggtgatcgagaagttttacccaaagcggtacagggatggatgcagtgaggaacagctgcggcagttgtgccagcggttgagtactcgatggatggcacttagggggcattcggctgcagactgcgtacgtatctacttgacagtcgccaggaaatggccattttttggagccaaattattcctcgccaaacctattactccttcctcgctgggatccactttcttatggcttgccgtccacgaagacggactgtcactactagaatacaactcgatgaggctgatcgtgagctatgtttacaagtctttgatgacattcggggggtaccaggacgactttatggtggtgatcaataacactcactccaaggataaacccacggagaaactactttttgctatggcaaagcccaagatcctggaaataacactacttatagcttcgtatataaacaatttccaccaacagaaggctgccttccatcatctcagcgcccctgccctcctcagtgcacagacgcgtggaccccaggccagaatgatgggtagtcagcccctgctctcctcatctcggcccaccaagggtccaacacttctttag

SEQ ID NO: 128997 - DNA, 2904 bp, Artificial Sequence
  Description of Artificial Sequence: Synthetic coding sequence
atggactggactccacgcctcccaagcaggcacattataagtgaactcgagcacctcacattcgtcaataccgatgtcggccgctgtcgagcctggttacggttagcactcaatgacggactgatggagtgttatctgaaactgctcctccaggagcaagccagacttcatgaatactaccagccgaccgctctgctcagggacgccgaggaaggagagtttctcctgtctttcctgcaaggcttaacaagtctgagctttgagctgtcttataaatcggccatacttaacgaatggaccctcacccctctggccctcagtgggctttgcccactgtcggagcttgaccctctgtccacttccggcgcggagctgcaaaggaaggagagcctagacagcatctcccatagctccggctcagaagacatagaagttcatcacagcggtcataagatcaggcgcaatcagaaattaaccgcctctagtctgtcacttgataccgcatcttcctcccagctgagctgttctcttaattccgactcgtgcctgctgcaagaaaatgggagcaagtcacctgaccactgtgaggaacccatgtcctgtgacagtgatctgggaacagctaatgccgaagattcggaccgcagtcttcaggaggtccttttagaattttctaaagcccaagtgaacagcgttccaactaatggcttgagccaggagactgaaatccccactccccaggcaagtctgtctcttcacgggctgaacacgtctacctacctgcattgtgaggctccagcagaacccctacctgcacaggccgctagcgggacacaggatggagtgcacgtccaggaaccccgaccccaagcgcccagcccccttgaccttcagcagccagttgagtccactagtggacaacagcccagtagcacggtgagtgagaccgcccgtgaagtgggccagggtaacgggctccagaaagcgcaagctcatgacggcgccggacttaagttagtggtctcttcgcccacttcaccaaaaaacaaatcttggataagtgaagatgacttctaccggccttcccgggagcagcccttggagagcgccagtgaccaccccattgcttcataccgcgggaccccaggcagtagaccaggtctgcataggcacttttcacaggagcctcgcaaaaactgctccctaggcgctctcgaccaagcctgcgtgccctcacccggcaggcgtcaggcacaggccgctccatcccagggtcacaaaagctttcgcgtggtccaccgcaggcagatgggcttatccaatcctttcaggggtttgatgaagcttggaacagtcgagagaaggggagctatgggaatatggaaggagttgttctgtgagctgtccccccttgagttccgcctctacctgtccaacgaggaacacacctgtgtcgagaactgctcgctgttgagatgcgaatctgtcggtcctgcgcatagtgacggccgattcgaattggttttcagcgggaaaaaacttgcgctgagagcctccagccaggacgaggcggaggattggctagacagggtcagggaggccttgcaaaaggtgcggccacaacaggaggatgagtgggtgaatgtgcagtatccggatcagccagaggaacctcctgaagcccctcaaggttgtctgagtccttccgacctgctaagcgagcccgccgcacttcaggggactcagtttgactggtcctcagctcaagttccagagcctgacgccatcaaggaatctctgctctatctgtatatggacaggacttggatgccatatatattcagccttagtttagaggccctgaagtgttttcgtattcgcaacaacgagaaaatgctcagcgatagccatggtgttgaaacaatccgcgatatcctgcccgacactagtctcggtggcccttctttcttcaagataattaccgcaaaagccgtgctgaaacttcaagccgggaatgcggaagaggccgcactctggagagatctggtaagaaaagtcttagcctcatacctggagactgccgaggaggcagtgacgctcggcgggtccctcgacgaaaattgccaggaggtactgaagtttgccacccgggaaaatggattcctgctccagtacctagtggcaatacctatggagaaagggttagattctcagggttgcttttgcgcaggctgtagccgtcagataggctttagttttgtgcggcccaagctgtgcgcatttagtggtctttattattgcgacatttgccaccaagatgatgcatccgtgattccagctcggattatccataattgggacttgacaaagaggcctatctgcagacaggccttgaagtttctgacgcagatccgagcacagccactcattaatttacagatggtaaatgcgtctttatatgagcatgttgaacggatgcacctgatcggccgcaggagggagcaactgaagctgctaggagattacctgggcttatgcagaagtggggctctgaaagaactcagcaagaggctgaaccatcgcaattacctgcttgaatcacctcaccggttcagcgtcgcggatctgcagcagattgccgatggagtttatgaagggtttctcaaggctctgatcgagttcgcatcccaacacgtgtaccattgtgatctgtgtacacaaagaggtttcatctgccaaatctgtcaacaccacgatatcatttttccctttgagttcgacacgacggtgcgctgtgccgaatgtaagaccgttttccaccagagttgtcaggctgtagtgaaaaaaggctgtccgaggtgtgccagaagacgcaaataccaggaacagaacattttcgcatag

SEQ ID NO: 128998 - DNA, 3171 bp, Artificial Sequence
  Description of Artificial Sequence: Synthetic coding sequence
atgctctccgtggtggaaaatgggttagatccgcaggctgctatcccggtaatcaagaaaaagctggtgggctccgtgaaggcattacaaaagcagtacgtgtccctggacacagtcgtaacctcagaagatggtgacgccaacactatgtgctcagccctggaggcggtgtttattcatggcttacatgctaagcacatacgggcggaagccggaggtaaaaggaaaaagagcgcccatcagaagcccctccctcagccagtgttctggcctctccttaaggccgtaactcataagcatatcatctccgaattggagcatctgaccttcgttaatacggatgttggaaggtgtagggcctggctcagactcgccctgaacgatggcctgatggagtgctaccttaagctgctgcttcaggagcaggcccgcttgcacgaatattaccaacccaccgccctgctccgtgatgcggaggagggcgaatttctactttctttccttcagggcctcacctcactctctttcgagttatcatacaaaagcgcgatcctaaacgagtggaccctgactcccctggcgttatctggcctgtgcccactaagcgaattggatcctctgtcaacatccggggccgagctccaacgcaaggagagcctagatagcattagccattcttcaggaagtgaagatatcgaagtgcatcattccgggcacaaaatcagaaggaatcagaaactcactgccagttctctgtctctcgacaccgccagctcctcccaactctcctgtagtctgaacagtgactcatgtttgttacaggagaatggatcaaaatctcctgatcactgtgaagaaccaatgtcttgtgattccgacctgggtaccgccaacgcggaggattccgacaggagtttacaagaggttctgttagagttctccaaggcccaagtgaactctgtgccaaccaatggcctcagccaggaaacggagatccccactccgcaggcctcattatcgctacatgggttgaatacctccacataccttcactgcgaggctccagctgagcctctgcccgcccaagccgctagtggtacccaggacggggtccatgtgcaagaaccacgccctcaggccccttcaccactagatcttcaacagcccgtggagagcacctccgggcagcaaccttcgtctaccgtgtctgagacagctcgggaagttgggcagggcaatggactgcaaaaggcccaggcacacgacggagcagggctcaaattagttgtgtcctctcctacttccccaaaaaacaagtcatggatctccgaagatgacttttataggccaagcagagaacagcctttggaaagcgcctccgaccaccctattgccagttatagaggtacccccgggtctcgccccggacttcatcgacacttttcccaggagccccgcaagaactgtagcctgggcgctctggatcaggcttgcgtgccgagccctggccggcgccaagcccaagccgctccctcccagggccacaagtcatttcgtgtagtgcacaggaggcagatggggctctcaaatccttttcgcggccttatgaagctggggaccgttgagaggagaggcgcaatgggtatctggaaggaattgttttgcgaactgtcaccactggagttccgcttatacctgtctaatgaggagcacacctgcgtggaaaattgctcactgctgcggtgcgaaagcgttggtccagcccactctgatggacgatttgaactggtattttccggtaagaaacttgcgttgcgagcatctagccaagacgaggcagaagactggttggaccgggttcgtgaggcactgcagaaggtgcggccacagcaggaggatgagtgggtgaatgtccagtacccggaccaaccagaggagcctccagaagctccccagggatgtttgtcgccatctgatctactgagcgagcccgcggcattgcagggcacacagtttgactggtccagcgcccaggttccagagccagatgccattaaagagtcactgctttacctctatatggataggacatggatgccatatatcttttctctgtctctggaagcactgaaatgcttccgtataagaaataacgagaagatgcttagtgacagtcacggtgtggagactattcgggacatcctgccggacacttctctcggcggcccatcgttcttcaaaatcatcactgccaaggcggtactgaaactccaggccggcaatgcagaggaggccgccctgtggagggacctggtgcggaaagtcttggcttcctaccttgagacggctgaggaagctgtgactctcggggggtctctggatgagaattgccaggaggtcctgaagttcgcaactagagaaaatggcttcctgcttcaatatctggtggcgattcctatggagaagggcctggacagccagggctgcttttgcgctggctgcagtcggcagatcggcttttctttcgtcaggcccaaactctgtgcgtttagtggcctctattactgtgatatatgccaccaggacgatgcctccgttataccagccaggattattcataactgggacctgaccaaaagacctatctgtagacaggcccttaagtttctcacacagatcagggctcaaccgctgattaatctgcagatggtcaatgcctcactgtacgagcatgtggagcgcatgcaccttattgggaggcggagggagcagttgaagctgcttggtgactatttgggtctatgtcgcagcggcgcactgaaagagctcagtaaacgtcttaatcacagaaactatctacttgaaagtccacacaggttttctgtagctgaccttcagcagatagccgatggtgtgtacgagggctttctgaaggcactcattgagttcgccagccagcacgtgtaccactgcgacttatgtacgcagcgcgggttcatttgccaaatctgccagcatcacgatataatattccccttcgagttcgataccacagtgcgatgtgcggaatgtaagacagttttccaccaatcttgccaggctgtggttaaaaaaggctgccccagatgtgctagacggaggaagtaccaggagcagaatatattcgcctag

SEQ ID NO: 128999 - DNA, 3003 bp, Artificial Sequence
  Description of Artificial Sequence: Synthetic coding sequence
atggtggagtgttttgaaagtgggggaacgagactctcactgtccagctttaacgtgtcatgtgactccttgagagagcaactacgggagtggagatgcttccagtggtggaggatggactggaccccaaggctgcccagtcgccacatcatcagcgaactcgagcacctgactttcgttaataccgatgtggggcggtgcagggcctggcttagacttgcattgaacgatgggctgatggagtgctatctgaaactcttgctccaggaacaggctcggctccacgaatattaccagcccaccgccctgcttagagacgccgaggagggtgagttccttctgtcatttttgcaaggcctgacatccctgagcttcgagctcagctataagagcgcaattctcaatgagtggactctgacgccattggccctgagtggactctgccctctgtctgagctggatcctctaagtacttccggtgccgagctccagagaaaggagtccctggatagtatctcccacagcagcggcagcgaggacatcgaagtgcaccactccggccataagatcaggagaaatcagaagctgacagcctccagtctcagtctcgatacggcttcgtcaagtcagttgagttgtagcctgaattccgactcctgcctgctgcaagagaacggcagtaagtcacccgaccactgcgaggagcctatgtcatgtgacagcgacttgggcacggccaacgcagaagattcagacaggagcctccaggaggttctactcgagttttcaaaggctcaagtcaacagcgtacctaccaacggactcagtcaggagaccgagatacctaccccacaggcatcactgagcctgcacggcttgaatactagcacctacctacactgtgaagcgcctgctgaacctcttccagcccaggcggcttctggcactcaggacggagtgcacgtgcaagagccccgccctcaagccccttccccactcgatctccaacagcccgttgaatccactagcggccaacagcctagcagcacggtgtcagagacagcaagagaagttggccaaggcaacggactgcagaaagcccaggctcacgacggggctggcctgaaattggtagtgtctagtcctactagccccaagaataagtcttggatttctgaagacgacttttatcggcctagtcgcgagcaacccctggagtcagcatccgatcaccccatcgcttcctacagaggtacccccggctccagacctgggctgcaccgccactttagtcaggagccccggaaaaattgtagcctgggagcgcttgaccaggcctgtgttccctcccccggccgacgccaggctcaggccgctccttctcaaggtcacaaaagttttagagtagttcacaggcgccagatggggctgtcaaacccgtttcgaggactgatgaaactcggaactgtcgaacggcgaggcgccatgggaatatggaaggagttgttctgcgagctgtctcctctcgagtttcgcctatatctctccaacgaagagcacacctgcgtcgagaactgttcactcttgcgctgcgaatctgtcggcccagcccattctgacggacgctttgagctggtgtttagcgggaagaagctagcacttcgggcgtccagtcaggatgaagccgaagactggcttgatagggttagagaggcgcttcagaaagttaggccacaacaggaggatgagtgggtaaatgtccagtatcctgatcagcccgaagagccccccgaagctccacagggttgtttgtctccttcggacctgctatctgagccagcagccctccagggcacgcagttcgactggagctctgctcaggtccccgagccggatgccataaaagagagtctgctgtacctttacatggacaggacctggatgccctacatcttttccttgagcctggaggcattaaaatgtttcagaatccgcaataacgaaaaaatgttgagcgactcgcacggtgtagaaacaatacgtgatattctgccagatacatctctaggaggtccctccttttttaagattataacagctaaggccgttctgaagctccaggccggcaatgccgaagaggctgccctgtggcgggacctggtgcgcaaggtcttggcctcttatctagagacagctgaagaggcagtgaccctgggaggtagcctggacgagaactgtcaggaagttctgaaattcgcaacccgtgagaacggcttccttctgcaatacttggtggcaatcccgatggaaaagggactggacagtcagggttgtttttgcgccggttgtagccggcaaatcggcttctcttttgtgaggcctaagctgtgcgcctttagcggactctattactgcgacatctgccaccaggatgacgcttctgtgatcccagcacgcatcatccacaattgggatctaactaagcggcctatctgccggcaagccctcaagttcctgacacagattagagctcagcccctgattaacctgcaaatggtgaacgccagcctctacgaacatgtggagcgcatgcacctgattggacgtcgtcgggagcagctgaagttgttaggggactacctcggcctttgcagaagtggagcattaaaggagctttcaaagcgcttaaaccatagaaattatctcctggaatctccccaccgtttttccgtggctgacttacagcagatcgccgacggtgtgtacgagggcttctcccctaaagtgccctctgaggcggccggcttacgcccatggggggccaggagtcccgaggccgcaagtgcattcagatgtattgattcttcaaggttaccctctctgcggaaggtggtgccgactctgttcctgaaatgttacttcatgcagtatacagtgccctcagagcagggctctggtcccgaggaaagcctacagtgtattgaaggaatagccgcggtctag

SEQ ID NO: 129000 - DNA, 5466 bp, Artificial Sequence
  Description of Artificial Sequence: Synthetic coding sequence
atgtcatgtgagcggaagggattgtcagagcttcgaagcgagctgtattttttaatagcgcgctttctggaagacggcccttgccaacaggccgctcaagttctgatcagagaggtagccgagaaagagctgctgccacggcgcaccgactggactgggaaggaacacccacgcacctaccagaacttggtcaagtactatcggcacctggcccctgaccatcttctacagatatgccatcggttaggtcccctcctggagcaggaaatccctcagtccgtcccaggcgttcaaactttgctcggtgcgggacgacagtcgttacttaggaccaataagagctgtaagcatgtggtgtggaaggggagcgccctcgccgccctccattgtggccgcccacctgagtcacctgtgaattatgggtctccaccaagcatagctgacaccctcttcagcagaaagctgaacggtaagtataggctcgaacgtttagtccccactgcagtgtaccagcatatgaaaatgcacaaacggatactgggccaccttagctctgtctactgtgttacttttgaccgtaccgggaggagaatatttaccggttctgatgactgtctcgtcaagatatgggctacagacgatgggcgacttcttgccactctgaggggacatgccgccgagatctctgacatggctgttaactatgagaataccatgatcgccgcaggaagctgcgataaaatgataagggtttggtgtttacgcacatgcgcccctctggcggttttacaaggacactccgcaagcatcacaagcttgcagttctcacccctctgctccgggagcaaaaggtatctgagtagcacaggagctgacggcaccatttgcttttggctgtgggacgccggcactcttaaaattaaccctcgccccgccaagtttactgaaaggcctagaccaggtgttcagatgatttgctctagcttcagtgccgggggaatgtttctcgcaacaggatctaccgaccatatcatccgcgtgtacttcttcggctcaggccaaccagagaaaataagtgaattggagtttcacactgacaaagtcgattcgatccagtttagcaacacttcaaatagattcgtgtccgggagccgggacggcaccgctcggatctggcagttcaaaagacgcgaatggaagtcaattctactggatatggccaccaggcccgccggtcagaacttacagggtattgaggacaagattaccaagatgaaggtcactatggtggcatgggatcggcatgacaatacagtgattacagcggtcaacaatatgaccctgaaggtctggaacagctacacggggcaattgatccacgtgctgatggggcacgaagacgaggtatttgttctggagccccatcctttcgatcctcgggttttgtttagcgccgggcacgatggcaacgtgatcgtgtgggatctcgctaggggcgtcaagattcgatcatacttcaatatgatcgaaggacaaggtcatggagcagtctttgattgcaaatgttccccagatgggcagcatttcgcgtgcacagatagtcatggccatctgctcatttttggctttggctcctcgtctaagtatgacaagatagcagatcagatgttcttccatagcgactatcgaccactgattcgcgatgccaacaatttcgtgttggatgagcagacccagcaggctccacatctcatgccccctccttttcttgtcgatgtagatggcaatcctcacccctcccgctaccagagacttgtcccgggtcgagagaactgcagagaagaacaactcatacctcaaatgggggtcactagctcaggtctcaaccaggtgctatcccagcaagctaaccaggaaatttcacctttggattcgatgatacagcgactacagcaggagcaggaccttcgcagaagcggcgaggctgtgatatccaatacaagccgcctcagccgggggtctatcagctcaacaagcgaagtacactcccctccaaacgtcgggctgcgtcgctccggacagattgagggggtgcgacaaatgcattccaacgctcctaggagcgagattgctacagagagagatctcgtcgcttggtccagaagagtggtggtccccgaattgtctgcaggggtagcatcccgacaggaagagtggcgaaccgccaagggcgaggaggaaattaagacctacagaagcgaagagaaacggaagcacctcaccgtccctaaggagaacaagatacctaccgtgagtaagaaccacgcacacgagcactttttagatctcggagaaagcaaaaaacaacagacaaatcagcacaactacagaacaaggagcgccctggaggaaacccccagaccttccgaggagatagaaaatggctcatcaagctccgacgaaggagaagttgttgccgtgagtgggggtacgagtgaagaagaggaaagggcctggcactccgacgggtccagctctgactattccagcgattacagtgattggacagcagatgcaggcatcaacctgcagcctccaaagaaagtgccgaagaacaaaactaagaaagcagagtcatccagtgacgaggaagaagagtctgagaagcagaaacaaaagcaaatcaagaaagaaaaaaagaaagtaaatgaagaaaaggatgggcctattagcccaaagaagaagaagccgaaggagcgaaagcagaaaagactggctgttggagagctcaccgagaacgggctcaccctggaggaatggctgccttctacttggatcactgataccatcccccgtaggtgtccctttgtccctcagatgggtgacgaggtttactacttcagacagggacacgaagcatatgttgagatggccaggaaaaacaagatctacagcattaacccgaaaaagcagccctggcacaagatggaacttcgcgaacaggaactaatgaaaatcgtgggcattaagtacgaagttggtcttcccaccctgtgctgtctgaaactggccttcctagacccagatacgggcaagctcacaggaggatcctttactatgaaatatcacgatatgccagacgtcatcgattttttggtgctcagacagcagtttgatgacgcaaaatacagacggtggaacatcggtgaccgctttagaagcgtgattgatgacgcttggtggttcggcaccatagagagccaggagccccttcaattggagtatcccgatagcctgtttcagtgctataatgtgtgttgggacaatggagacactgagaagatgagtccttgggatatggagttgattcccaacaacgctgtctttccggaggagttgggtacctcagtaccactgactgatggcgagtgtcgctcgctcatctataagccactggatggcgaatggggaacgaatccccgggacgaggaatgcgaaaggattgtggcaggcatcaaccagttgatgacactggacatcgcctctgcctttgtggcacccgtcgatctgcaagcatatcccatgtactgcacagttgtggcctatccaactgatctcagcacaatcaaacagagactcgagaaccgtttctacaggcgggtcagcagcctgatgtgggaggtgaggtatatcgagcacaataccaggactttcaatgaacccggaagtccaatcgtgaagtctgccaagttcgtgactgatctgttactgcatttcatcaaggaccagacgtgttataatatcattcccctgtacaacagtatgaagaaaaaggtcctgtccgactctgaggatgaggaaaaggatgctgatgtccccggcacatccacgcggaaaaggaaggaccaccaaccgcgccgtaggcttaggaaccgcgctcaaagctatgacatacaagcttggaagaaacaatgcgaagaactgcttaacttgatatttcagtgtgaagacagcgagcccttcaggcagcctgtggatctcctggagtaccccgactaccgtgatattatcgacactcccatggacttcgcaaccgtgcgtgaaaccctggaggcaggtaattatgaatctcccatggagctgtgcaaggacgttagactgatttttagcaactcaaaagcttatacaccaagcaagagatcccgaatatatagcatgagtcttcgactctctgcgttctttgaggagcatataagttccgtgttgtccgattacaaatcagccctgaggtttcacaaacggaacacaattacaaagagacgcaaaaagaggaatagatcgtcaagcgtgtcatcttctgctgcctcctcccccgaaaggaaaaagaggattcttaagccacagctgaaaagcgaatcaagcacctctgcctttagcaccccaaccaggagtataccgccacgccataacgccgcccagattaacggcaagaccgaatcttcttccgtggtacggacccggagcaacagggtagtggtggacccagtggtaacggaacagccaagtacttcttccgcagcgaagactttcatcactaaagccaacgcttccgccattcctggaaaaaccatcctggagaattccgtgaagcacagtaaagctttaaatactctttctagccctggtcaaagcagcttcagtcatggcacccgcaacaactcagccaaagagaacatggaaaaggagaagcccgtcaagcgaaaaatgaagagcagcgtgcttcccaaggccagtaccttgtctaagagttcggctgtgattgagcaaggggattgcaagaataatgccctggtcccgggtactatacaggtgaatggacatggtggccagcctagcaagctggtgaagcgtggaccgggcaggaagcctaaggtggaagttaacaccaacagtggggagataatacacaagaaaagaggacgcaagccgaaaaaactgcagtatgccaagcctgaggacctggagcagaataacgtccacccgatacgggatgaagttctgccatcctcaacttgtaattttctgtccgaaactaacaacgttaaggaagacttgcttcagaaaaaaaaccgcggcgggcgtaagccaaagaggaagatgaagacccaaaagctggacgcggacctgcttgtgccggcgtctgtgaaggttttgcgtcgttcaaaccggaaaaagatcgatgaccccattgatgaggaggaggaattcgaggagctgaagggctctgagccacatatgaggacccgcaatcaaggccggaggaccgctttctacaatgaagacgatagcgaagaggaacaacggcagctgttatttgaggatacttccctgacattcggaacctcctcacggggtcgagtgaggaaactcactgaaaaggcgaaggcaaatctgatcggctggtag

SEQ ID NO: 129001 - DNA, 1197 bp, Artificial Sequence
  Description of Artificial Sequence: Synthetic coding sequence
atgaagaagaaggtgctgtctgattcagaagatgaagagaaggacgccgacgtgccagggaccagcacgaggaaacgaaaggatcaccagccccgccgtcgattgagaaaccgcgcgcagtcctacgatatccaggcctggaaaaagcagtgtgaggagcttctgaatttaatattccagtgcgaagactctgagccattccgtcaacccgtggacctgctggagtatcctgattatcgagacattattgacacccctatggacttcgccaccgtgagagaaacactcgaagccggcaactatgaatctcccatggaactctgtaaggatgtgaggttaattttctcgaacagtaaggcatacaccccaagcaaacggagtcggatctattcgatgtccctgcgcctctcagcatttttcgaggaacatatttctagcgtattatctgactacaagtcagccctgcgtttccataagcggaacaccatcaccaagaggcgtaagaaacgcaataggagtagtagcgtcagctcttcagccgcctcctcccctgaacgtaaaaagcggatactgaagcctcagctcaaaagcgagtcttccacgtccgcgtttagtacacctactagatccatcccgcctcggcacaatgcagcgcaaatcaacggcaaaacggagagtagctccgtggtgcggacgcgatctaaccgggtggttgtggatcctgttgttactgagcagccgtccacctcctcagcggccaaaactttcataacaaaggctaatgcaagcgctatacccggcaagacaatcctggagaacagcgttaagcacagtaaagccctgaatactttgtcaagtcctggccagtctagtttctcgcatggcaccagaaacaatagcgcaaaggagaacatggagaaagaaaagcccgttaaacgtaaaatgaaatcgtctgtgcttccaaaagcttccactctgagtaaaagctcagccgtgatcgagcagggggattgtaagaataacgcactggtgcccggcaccatccaggtcaatggacatggcggccaaccaagtaagctcgtcaagaggggacctggaagaaagccaaaggtggaggtcaatattgtcgtgaagctctacacacgcaaaggggtggagagtcccaagtcttactccatgcagagtcagaagatctag

SEQ ID NO: 129002 - DNA, 1206 bp, Artificial Sequence
  Description of Artificial Sequence: Synthetic coding sequence
atgagacgggcccctgctgctgagcggttgctcgagttggggttccccccccgatgcggcaggcaggaacccccctttccgttgggggttacacgaggctgggggagatggccgatccagaagagacgcgaaggggcccggcctgtaccattcagcgaaaggtctcaggaagatgggcgcgggcctgctgcccgttctagcgggactctctggaggattaggactcggctttcattgtgccgtgacccagaacctccaccccccttgtgcctcttgagggtgtcactgctgtgcgcgcttcgcgccggcggccgcgggtcaagatggggggaggacggtgcgcggctgctcctgttgcctcctgcacgagctgctggtaacggtgaggccgaacccagtggtggcccgtcgtatgctgggcgcatgttagaaagttccgggtgtaaagcccttaaagagggagtccttgagaaaagatcagatggcctgctgcaactgtggaagaagaaatgctgtatactcacagaggaaggactcctactcatcccccctaagcagttgcagcaccaacaacagcagcagcagcagcaacaacagcagcaacaacaacagccgggccagggccccgcagagccatcccagccctccggccctgcagtcgccagcctcgaaccccctgttaagttaaaagagttgcacttttccaatatgaaaacagtggactgtgtagagcgcaaggggaagtacatgtactttaccgtggtgatggcagaaggaaaggaaatcgactttcgttgcccgcaggatcagggatggaacgctgagatcacacttcaaatggtccagtacaaaaatagacaggctatcttggctgtcaaatcaaccaggcagaagcaacaacatctggttcaacaacagcctccgagccagccacagccacagcctcagttgcaaccccagcctcagccacaacctcagccacagccacagccccagtctcagccacagcctcagccccagccaaagccccagccccagcagttacacccttacccccaccctcatcctcacccacacagccacccccatagtcacccccatcctcacccacatcctcacccccatcaaatcccgcacccccacccacagccccactcgcaacctcatggacaccgtctcctgcggagcacatctaattctgcgtag

SEQ ID NO: 129003 - DNA, 660 bp, Artificial Sequence
  Description of Artificial Sequence: Synthetic coding sequence
atgctcgaatcctcaggttgcaaggcgttgaaggagggcgtgctggaaaagagatccgacggcttattgcagctctggaaaaaaaagtgctgcatactgacagaggagggtctattactgataccacccaaacagcttcagcaccaacagcaacagcagcagcagcagcagcaacagcagcagcagcagccaggccagggacctgcagaaccaagccagcccagtggaccagccgtcgctagtctggaaccaccagtcaaactgaaggaattgcacttttccaacatgaagaccgttgattgcgttgagaggaagggcaagtacatgtacttcacggtggtaatggctgagggcaaagagatagatttccggtgtccccaggaccaagggtggaatgccgaaattacgctgcagatggtacaatacaaaaacagacaagccattctcgcagtaaaaagcactcgacagaagcagcaacatctggtgcagcagcagctgcacccctaccctcatcctcatccgcatcctcatagtcatccccacagtcacccacatccacacccccacccccacccacatcagattccacacccacacccccagccacattctcagccgcatgggcatcgcctgttgcgctccaccagcaactctgcctag

SEQ ID NO: 129004 - DNA, 459 bp, Artificial Sequence
  Description of Artificial Sequence: Synthetic coding sequence
atgaaaagcccggacgaagtgctcagagaaggcgagctggagaaacggtccgattctttgttccaactttggaagaagaagcgaggagtgctgaccagcgacaggttgtctctttttccagctagccctcgagctagaccaaaagagctgcgttttcactctattctcaaagttgattgtgtggagcggaccggcaagtacgtgtactttaccatagtgacaactgaccataaggagatcgacttcaggtgtgcgggggaatcatgctggaatgcggcaattgccctcgcactcatcgatttccaaaacaggcgagctcttcaggattttcgatcccggcaagagaggactgcccctgccgcccccgcggaagacgccgtcgccgccgccgccgctgccccttctgagccttctgaaccgtctagaccctccccccagccgaagcccagaactccttag

SEQ ID NO: 129005 - DNA, 3960 bp, Artificial Sequence
  Description of Artificial Sequence: Synthetic coding sequence
atggacgcccttaaccggaaccagattggaccaggctgtcagactcagacgatggtacagaagggcccgctcgatcttattgagactgggaagggactgaaggttcagaccgataaaccacacctggtcagcttggggtctggccgcttatccacggctattaccctcctccctctcgaggaggggagaactgtaataggaagtgccgcccgcgacatctcactgcagggaccgggactcgcgccagagcactgctacatcgagaatcttcgaggtactcttaccttgtacccctgcggcaacgcctgcacaattgacgggctgcccgtgcgtcaaccaacccgattgactcaaggctgtatgctctgcctcggccagtctacatttttgcggttcaaccaccccgctgaggctaaatggatgaagtccatgatcccagccgggggtcgcgcacctggacctccctattccccagtcccagctgaaagcgaatcattggttaatggtaaccataccccccagacggccaccaggggaccctcagcttgtgcatctcattcatcccttgttagtagtatcgaaaaagacctacaggagattatggactcccttgtgctagaggagcctggcgcagcaggtaagaagccagccgcgacatcacctttgtcaccgatggccaatggcggccgatacctgctcagcccacccacctcacccggggcgatgtcagtggggagcagctacgagaacactagccctgccttctcacccctgtcaagtcctgcaagcagtggcagctgcgcttcccacagcccctctggtcaagagcccggcccttcagtgcctcccctggttcccgctcggtctagctcctaccaccttgccctccagcccccccagtcaagacccagcggggcccgcagcgagtcaccacggctctctaggaaagggggacacgagaggcctccaagtcccggtctgcggggcctgttaaccgactcccctgccgctacggtcctcgcggaggccagaagggctacagagtccccaagactaggcgggcaactccctgtcgtggctatttccctgagcgagtatcctgctagtggcgccctttcacaaccgactagcatccctggaagccccaagtttcagccgccagtgccagcccccaggaataaaattggaaccctccaggataggccaccaagcccatttcgagagccccctgggtcagaaagggtgctcaccacttccccgtcaaggcaactggtgggacggaccttctctgatggattggctactagaacacttcagccccctgagagtcccagactgggccgtcgcggcctggacagcatgcgggagctgcctccactgtcaccatcattaagcagacgggccctgtcaccccttccaacccgtactacacctgatcccaagctgaatagagaagtggcggagtcaccacgaccgagaagatgggctgcccacggagctagtccggaagatttttctttgaccttgggggcgaggggccggagaaccagatccccttcaccaactctaggggaatccctggctccccacaaaggaagcttcagcggtagactgtcgcccgcatactcactgggcagcttgacaggggcttccccatgccagagtccatgtgtgcaacgcaaactttcctccggggatctgagggtcccagtcacacgtgaacggaaaaacagcatcaccgagataagcgacaatgaagatgacctgcttgagtaccaccggcggcagaggcaggagcgcttgcgcgaacaggagatggaaagactggagcgtcagcgcctagagactatcctgaacctgtgcgctgaatactcacgagccgatgggggaccagaggcaggggaactaccatccatcggagaggccacagctgccctcgcgctggccggtagaagacccagtaggggcctggcaggcgcaagtggtagatcttccgaggaaccaggcgtcgctacccagaggctctgggaaagtatggaacggtccgacgaagaaaacctcaaggaagagtgctcgtccacagagtccacccagcaggagcatgaagacgcaccctctaccaagcttcagggggaagtgctcgcactggaggaagagagagcccaggtgctgggccacgtggagcagttgaaagtccgtgttaaggagctggaacagcaattacaagagtccgcaagggaagcggagatggagagagccctcctccagggggaaagggaggctgagagagcactgcttcaaaaggaacagaaggctgtagaccagttgcaagaaaagttagtggcactggaaactggaattcagaaagagagagacaaagaggccgaggcgttagagactgagacaaaactattcgaagacctggagtttcaacagctggaacgtgaatctagggtggaagaggaacgggaactggcagggcagggtctcctgcggtccaaagctgagctgctgcggagcatcgccaagagaaaggagagactggctattctcgactcacaggccgggcagattagagcacaggcagtgcaggagtcagagcgcctagcacgtgacaagaatgcttccctgcagttgctgcaaaaggagaaagaaaaactgaccgtgcttgaaagacggtaccatagcctcacgggcggacggcccttcccaaaaaccacctccacgttgaaggaggtctatcggtccaagatggacggtgaggccacaagtcctcttccacgcacgaggagtggaccactgccatcttcctccggaagtagcagcagttcatcccagctgtcagtggccacactcggccgatcgccgtcccctaagagcgctctattaacacagaacgggaccgggtcactgcctcgcaaccttgccgcaacccttcaggatatcgaaactaaaaggcaacttgcactacagcagaagggccagcaggtaatcgaagaacagcgaagacgacttgcggaactaaagcagaaggccgctgccgaggcccagtgtcaatgggatgctctccacggcgcagcaccattcccagccggccccagtgggttcccaccactcatgcatcactccattctccaccacctccccgctgggcgcgagcggggggaggaaggtgagcacgcctatgatactctctccctggagtcttccgacagtatggagacgtctatttctacagggggtaattcagcctgctccccagacaatatgtcaagcgcctctggacttgacatgggaaaaatcgaggagatggagaagatgctgaaagaagcacatgctgagaaaaataggttgatggagagccgggagcgggagatggagctgcggcggcaggcactggaagaagagagacggaggcgcgagcaggtcgaacgccggctccaatcagaatcagctcggcgacagcagctggtcgagaaagaagtgaaaatgagggaaaagcaatttagtcaggccagaccactaacgaggtacctgcctattaggaaagaagattttgacttaaaaactcatattgagtctagtggacacggggtcgacacctgtttgcatgtggtcctctcttccaaggtctgtcgcggctatctagtgaagatgggggggaaaattaagtcatggaaaaaaaggtggttcgtgtttgaccggctaaaacgcaccctgagttattatgttgataagcacgagaccaaattgaagggtgttatctacttccaggcaatcgaagaggtctactacgatcacctgaggagcgccgcgaagtctcctaatcctgccctgacattctgcgtgaagacacacgataggctatactacatggtggcaccttctgcggaagccatgaggatctggatggacgtgatagttacaggcgccgaaggctatacccaatttatgaactag

SEQ ID NO: 129006 - DNA, 2193 bp, Artificial Sequence
  Description of Artificial Sequence: Synthetic coding sequence
atggagagaagtgatgaggagaatcttaaagaagagtgctccagtaccgaaagtacgcagcaggaacacgaagacgcaccgtccacaaaactgcagggagaagtgctcgctctcgaggaggaaagagcacaagtcttaggccacgttgagcaactcaaggtgcgcgtgaaggagctggaacaacaactacaggaatctgcaagagaagcagagatggagcgggcactgttacagggagaacgcgaggccgagcgcgctctgctccagaaggaacagaaggcagttgaccagctgcaggagaaactggttgcactggaaactggaatccaaaaagagcgagataaagagagagccgaactcgcagctgggcgacggcatctggccagacaggctctctacgcagaactccaaactcagttagataattgtcctgagtctgttcgggagcagctgcaagaacagctccgccgggaggctgaggccctcgagacggaaaccaaactattcgaggacctggagtttcaacagctggaaagggagagtcgtgtggaggaagagagggaattagctgggcagggcctgctgcgcagtaaagctgagctgctgcgctctatcgccaagcgcaaagaaagactggcgattctggattcccaagcaggccaaattagagcccaggcagtgcaggagtcagaaagactggccagggacaagaacgcatcactacagcttctgcagaaagagaaagagaaattgacagtgctggagaggcgttatcactcactgactgggggcagaccttttcccaagaccacctccactttaaaggaaatggaaaaactacttctgcctgccgttgatctcgagcagtggtaccaggagttgatggctggactgggtacgggccctgcagccgccagcccacactcttccccaccccccctccctgcaaaagcctcccggcagctccaggtttaccgaagtaaaatggatggcgaggcgacctctccactgccaagaactcgctccggaccccttccttcatcttctggttcctcatcctcgtcctcccagctctcggtggcaaccctggggagatcgccttctccaaaatccgcacttctcacacagaatggcactggatcactgccccgaaacctggccgcaacgcttcaggacattgagaccaagcgacagttggctctgcagcagaagggtcagcaggtgattgaagagcagcggcgccgtctcgcagagttaaagcagaaagcagccgccgaggcccaatgccagtgggatgcccttcatggcgccgcgccattccctgcaggcccgtcagggtttccaccactaatgcaccactctatactgcatcacctgccagctgggagggagagaggagaggagggagagcatgcttacgacacgctctccttggagtcctctgacagcatggaaacctcaatttctaccggcgggaattccgcctgctcaccggacaatatgtcgagtgcatcagggcttgacatgggcaaaatcgaggaaatggagaaaatgttgaaagaagctcacgcagagaagaatcgcttaatggagagccgcgaacgggagatggaactgaggaggcaagctcttgaagaggagaggcggaggagagagcaagtcgagcggcgtctccagtcagagtctgctcgtaggcagcaattggtggagaaagaagtgaaaatgagggaaaagcagtttagccaggccaggcccctgacccgctacctgccgatacgcaaggaagacttcgatctgaaaacccacattgaatctagtggacatggagtcgacacttgtttgcatgtagtcctgtcttccaaggtctgtcggggttacttggtcaagatgggtgggaaaattaagtcttggaaaaagaggtggtttgtatttgaccgccttaagaggaccttaagctattacgttgacaagcatgagaccaagctgaagggcgtcatctattttcaggccatcgaggaggtgtattacgaccatctgagatctgccgccaagtcacctaatcccgctttaacattttgcgttaagacccatgatcggctctactacatggtggcacccagtgccgaagccatgagaatctggatggacgtaatcgtgaccggcgctgaaggttacacccagttcatgaattag

SEQ ID NO: 129007 - DNA, 4134 bp, Artificial Sequence
  Description of Artificial Sequence: Synthetic coding sequence
atggatgcccttaatcggaaccagatcggaccagggtgtcagacgcagaccatggtccagaaaggaccattagaccttatcgagaccggcaaaggccttaaagtgcaaaccgataaaccccacctcgtctcactcggcagtggtagacttagcaccgcaataacattactcccattggaggagggcaggacagtgatcgggagcgccgctcgcgacatcagcttgcagggtcccggcctagctcctgagcattgttatattgagaacttgcggggtacactgactctgtacccatgcggtaacgcctgcaccattgacggcctgcctgtacgtcagcccacccggctcacacagggttgtatgctgtgtctggggcagagtacctttctgcggtttaaccaccctgcagaggcaaagtggatgaagtcaatgatccccgccggagggcgggccccggggcccccgtattctcctgtgccagctgagtccgagtctctggtgaacggaaatcacacaccgcagacagctactagagggccctcagcctgtgcctcccatagctccttagtcagtagtattgagaaggatctgcaggaaatcatggatagtctggttcttgaggaacctggtgctgcaggcaaaaagccagctgctacatcccctctgagcccaatggctaatggtggtcgttacttgcttagtccgccaacatctcccggtgctatgtctgtgggttcctcttatgagaatacttctccggctttcagccccctgtcctcccctgcctcctccggctcatgcgcatctcactccccgagcggtcaggagcctggtcccagtgtgccaccccttgtcccagctaggtcctccagttatcacctggcacttcagccgccgcagtcccgtcctagcggcgccaggagcgagtcaccaaggttgtctagaaagggggggcacgagcggcctccaagtcctggcttacgaggtctgttgaccgactcaccagctgcaactgtgttagctgaggctcgtagagccaccgagtctccaaggctggggggccagctcccagtggtggccataagcctcagtgagtaccctgctagtggggccctgtctcaacccacatcgatcccaggctcacctaaattccagccccccgtgcccgcccctcggaacaagatcgggacactgcaggatcggccaccaagcccatttagagagccccccgggagcgagcgcgtccttaccacgtcaccatcacgccagttggtagggcgaacattttccgatgggcttgctacgcgcaccttgcagcctccagaatccccacgccttggcaggagggggctggatagtatgcgggagctcccaccactttccccttctctgagccggagagccctctcacctctgcctacgcgtacaactccagatccaaagttaaaccgagaagtggcagaatcaccccgacctagacgatgggctgctcacggcgcttcgcccgaagacttcagcctgaccctgggagcacgcggccggaggacacggagtccatcacccaccctgggggagtctctcgcgccccacaaaggtagtttctctggacgtctctcccctgcgtatagcctcggatcgctgaccggtgcctctccttgccagtcaccctgcgttcagaggaagctgagctctggagatctgagggtcccagtgacccgcgaacggaagaactcaataactgaaatttccgataatgaggatgaccttctcgagtatcacaggcggcagaggcaggagaggttaagggaacaggaaatggagaggcttgaaaggcagagactcgagacaattctgaacctgtgcgcagaatactcacgagcggatggggggcccgaagccggcgagctgccttctataggcgaggctacagctgcattggctttggctgggaggcggccttcacgagggctggccggcgcatctggcaggagctcagaagagccgggtgttgcaacacagagactatgggaatcaatggaaaggagcgacgaagaaaatctgaaggaggaatgttcgtccaccgaatccacacagcaggagcacgaggatgctcccagcaccaaactgcagggggaagttctcgcattggaggaggaaagggctcaggtgcttggccatgtggaacagctgaaagtacgtgttaaggagctggagcaacagctgcaggagagcgcccgtgaagctgagatggagagggccctgctgcaaggggaacgcgaagctgagagggccttactacaaaaagaacaaaaagcagtggatcagctccaggagaagctggttgccctggagacaggaatccagaaagaacgggataaggaagcggaagccctcgaaactgagacaaagctgttcgaagacttagagttccagcagttagagagagagtctagggttgaggaggagagagagctcgcagggcaaggtctgcttcgcagcaaggccgagcttctccgttccatagcgaagcggaaagagcggctggctattctggactctcaagctggacaaattagggcccaggcggtccaggaatctgagaggctagcgcgagataagaatgccagcttacagctgctccagaaagaaaaagaaaagctgacggttcttgaaagaagataccactctctcacaggcgggcgcccattcccgaaaaccacctccactttgaaggagatggaaaagctcttgctgcccgccgtggatctggaacagtggtaccaggagttaatggctgggctgggtaccgggccagcagccgcctcgccacacagcagtccaccgcctttgcccgcaaaagcctccaggcagctccaggtctacaggtcaaaaatggacggggaggccacttctcctctgcccagaactagatctgggccactaccttcatcgagcggctcttcgtcttcgagctctcagctaagcgtcgccacgttggggagatcaccctccccaaagtccgctctgctgactcagaatggcactggatcgctccccagaaatctcgccgccacactccaggatatagaaacaaagaggcaattagctctgcagcagaaaggccagcaggtcattgaagaacaacggagacgtctagcagaactgaaacagaaagccgctgcggaagctcagtgtcagtgggatgccttacatggcgcagcaccgtttcctgcaggaccaagtggttttccgccattgatgcatcactcaattcttcatcacttgcccgccggtcgggaaagaggcgaggagggtgagcacgcatacgacacattgtccctggagagtagcgactctatggagacgagcatcagtactggaggcaatagcgcttgttcacccgataatatgagcagcgcctctgggctggacatgggaaagatcgaggagatggagaaaatgctgaaagaggcccatgcagagaaaaatagacttatggaatcaagggagcgggaaatggagcttcggcgacaggcacttgaagaagaacggaggcggagggaacaggtggagaggcggctccagtctgaaagtgcgcgtcggcaacaactggtagagaaggaggtcaaaatgcgggaaaagcagttctcccaggctcgccccctaacgcgatatttgcctattagaaaggaagacttcgacttgaaaacacatattgaaagctctggacacggagtggatacttgtttgcatgtggttctaagttccaaagtgtgtagaggctatctggtgaaaatgggtggaaagatcaaaagctggaaaaagcgctggttcgtgttcgatcgcctcaagaggaccctgagttactatgttgataagcacgagaccaagctgaaaggagtcatttacttccaagctattgaggaggtgtattatgaccatctgagaagtgcagcaaagaagaggtttttcagatttaccatggttacagagtccccaaaccccgcgttaaccttctgcgtcaagacccacgaccggttgtactatatggtggccccatctgctgaggctatgcgtatctggatggacgttatcgtgaccggcgcggagggttatacacagtttatgaattag

SEQ ID NO: 129008 - DNA, 3423 bp, Artificial Sequence
  Description of Artificial Sequence: Synthetic coding sequence
atgtctgttggctcctcctatgagaacacgtcacctgcttttagtcccctttcttcgcctgcttccagcggctcgtgtgccagtcacagtcccagcggccaagagcccggcccctcagtgcccccgctcgtcccggcacggagttcttcctaccatcttgcactgcagccccctcaatcgagacccagtggggcaaggtcagaaagccccagactgagccggaagggaggacatgagaggcctcccagtccaggccttcgtggcctactgaccgattccccagctgcgacagttctggcagaagcaaggagagccactgagagtcctaggctgggtggtcaactcccagtggtcgcaatcagtctgagcgaatatcccgccagcggcgcgttgagtcagcctacatctattccgggatctcctaaatttcagccacccgtgccagccccccggaacaagatcggtaccttacaagacaggcccccttccccatttcgcgagccccctggctccgagagagttctgaccactagcccgtctcgacagctggttggaagaactttttccgacggtctggcaactcggacactgcagccaccagaatccccacggctcgggcgccgcggcttagattctatgcgcgagctgccaccactatctcctagcctgtcccgcagagccctaagtcctctgcccacaagaaccacacccgatcccaaactcaacagagaagtggcagagagtcctagaccccgccgctgggctgctcatggagcttcacctgaggatttctctctaaccctcggagcaaggggacggaggacgcggtccccctcgccaacattgggcgaatcactcgcccctcataaggggtcgttctctgggagactgtctcctgcatattctttgggaagtttgactggagccagcccctgccagagcccttgcgtccagaggaaactgtcctctggtgacctgagagttccagtcacccgcgagcggaaaaatagcatcacggagatatcagacaacgaagatgatctactggaatatcacaggcggcaacgacaagagcggttacgggagcaggagatggaaagattagaaagacaaagattagagacaatactgaacctatgtgccgaatactcccgcgccgacggtggtcctgaagccggagagttaccgtcaatcggggaagctaccgcggccctggctttggccggacgcaggccttcgcgaggtttggccggggcctccggcagaagttctgaggaacccggtgtggcaactcagcgactctgggaatcgatggaaaggtcggacgaggagaacctaaaggaggaatgctcatccaccgagtctacccaacaggagcatgaagacgcacccagtaccaagctccagggagaggtgcttgctctagaagaagaacgagctcaggttttgggtcatgtagagcagttgaaggtaagagtgaaggaactggaacagcagttgcaggagtcagcgcgagaagccgagatggaacgagccctactccagggggagagggaagctgaaagggcactgcttcagaaagaacaaaaggccgtcgatcagctgcaagagaagctcgtggccctggaaacaggcattcaaaaagagcgcgacaaagaggctgaagcactcgagactgagaccaaactgtttgaggacctcgagttccagcagctggagagagaaagcagagtagaggaggaacgagaactggcgggtcagggcttgctgagatctaaagcggaactgctcagatcgatcgctaaacgtaaagagagacttgctatcctcgattcccaggcggggcagattcgtgcccaggccgtccaggaatcagaaaggcttgcacgagacaaaaatgcaagcctgcagttgttgcagaaggaaaaagagaagctgacagtcctggaacgaaggtaccacagcctgacgggcggacggccgtttcctaagacaaccagcacattgaaagagatggagaagttgctcctgccagccgtcgatttggagcagtggtatcaggagttgatggctggcctggggaccgggcccgcagctgcgagcccgcactcctcaccaccgccccttcccgccaaggcttctcgccagctccaggtgtaccgaagcaaaatggacggagaagccacaagccctcttcctagaacacggagcggacccctaccatcttcgtccggaagctcgagctcgagtagccaactctcagtagccacactcggaagatccccttcgccaaagtcagccctgctcacccagaatggaacgggttccctcccacggaatctcgctgccaccctgcaggatattgagacaaagagacagttagcgctgcaacaaaaggtggagtcactgccagctgaacctctcccaacggatgatccggccggccaacaggttatcgaggagcagcgccgtcgtctggccgaacttaaacaaaaagccgctgcggaagcacagtgccagtgggacgcgctccatggcgccgccccttttcccgcaggaccatcagggttcccgcccctcatgcatcactcaatcctccatcatctaccagctggccgtgaaaggggcgaggagggggaacatgcctatgatactctttctcttgagtcctcagattctatggaaacgagcatttcaactgggggcaacagcgcgtgctctcctgataatatgtcctccgcaagtggactagatatgggcaaaattgaggagatggagaaaatgctgaaagaggcgcatgcagagaaaaatcgtctgatggaaagtagagagcgggagatggagttgaggcgtcaggcattggaggaagagcggcgccggcgggagcaagtggaaagaagactgcagagcgagtccgctcggcgccagcaactggttgaaaaggaagtcaaaatgcgggagaaacagttctctcaggctcggccccttactagatacctgcccattcgaaaagaggattttgatttgaagacccatatcgagagctccggacatggcgtggatacctgcctgcacgtagtgctaagcagcaaggtgtgccgtggctatcttgtgaagatgggcggaaagatcaaatcgtggaagaaacggtggttcgtctttgacagactcaagaggacgttatcttactatgtagacaaacacgagactaagcttaaaggggtgatttacttccaagccatagaggaagtctattatgatcaccttcgctctgccgctaagtcgccaaatccagccctgaccttctgcgtcaagacgcatgatagactctactacatggtcgcgcctagcgctgaagccatgaggatttggatggacgtaatcgtcaccggagcagaaggatacacccagttcatgaattag

SEQ ID NO: 129009 - DNA, 306 bp, Artificial Sequence
  Description of Artificial Sequence: Synthetic coding sequence
atgggtggtaaaatcaagtcatggaaaaaacggtggttcgtgtttgacaggctgaaaagaaccctgtcctactacgtagacaaacacgagacaaaactgaagggcgtgatctattttcaagccatcgaggaagtctactacgaccatctgcggtctgccgctaaaagtcctaatcctgcactgacattttgcgttaagacacatgaccgactctattacatggtcgcccccagcgccgaggccatgagaatatggatggacgtgattgtgacaggcgcagaggggtatactcagttcatgaactag

SEQ ID NO: 129010 - DNA, 1119 bp, Artificial Sequence
  Description of Artificial Sequence: Synthetic coding sequence
atggatgctctgaaccgcaaccagattgggcctgggtgccagacacagacgatggttcaaaaggggccgcttgatctgatcgaaacgggcaagggactgaaagtccagacggacaagccccatttagtatccctaggtagcggcagactgagtacagcaatcaccttgcttcccctggaggagggaagaaccgtgatcggctccgccgcccgcgacatatctctgcagggacccggactagcacctgaacattgctatatagagaatttaaggggtaccctcaccctttatccctgcggtaacgcttgcaccatcgatggattgccagtgagacaaccaacgaggctgacacagggatgcatgctttgtctaggccagtccacctttctcaggtttaatcacccggccgaggcaaaatggatgaaaagtatgattcctgccgggggccgagcacccggccctccctatagcccggtgccggagtcagagagcctcgtaaatggaaatcataccccacaaacagccactcggggacccagcgcatgcgccagccattcaagcctagtatcatctattgagaaggaccttcaggagataatggattccctggtacttgaagagcctggagccgctggcaagaaaccggcagctacctcccccctgagtcctatggccaacggtggccggtacctgttgagccccccaacgagtcccggggcaatgtccgtgggctcgtcttatgaaaatacttctcccgctttctccccactgtctagtccagcgtcttcagggagctgcgcttcccacagccctagcggccaggagccagggccgtccgtccctccactggttcccgcccgcagctccagttaccaccttgccttacagcccccacagtctaggcctagcggagccagaagcgagtctcctagactgagtagaaagggtggccacgaacgaccccccagtccaggtctacggggccttctgactgattccccagccgcgaccgtcctggcggaagcacgcagagccacagagtccccacggctggggggccagctgcctgtcgtcgccataagcctctcggagtacccagcagcgcgccgttgcacctag

SEQ ID NO: 129011 - DNA, 744 bp, Artificial Sequence
  Description of Artificial Sequence: Synthetic coding sequence
atggatgcgttgaacagaaaccagatcgggccaggctgtcaaactcagacaatggttcaaaaaggcccactggatctgattgaaaccggcaagggtctgaaagtgcaaaccgataagcctcatctggtgtccctgggatcggggcgactctctaccgcaatcaccctcctgcctctcgaagagggccgaactgtgatcgggtctgccgcccgcgacatctctctccagggacctggcctcgcccccgagcactgctacatcgagaatctgcggggaacactgaccctttacccctgcggtaacgcctgtaccattgatggccttccagtgagacagcccaccagactgacccagggatgtatgttgtgtcttgggcagtccaccttcctgagatttaaccaccccgcggaagcgaaatggatgaagtccatgataccagccggcggacgcgcccccggccccccttactcccctgtgccagcagaaagtgagtcacttgtgaacggtaaccataccccccagactgccaccaggggacctagcgcctgcgcatcgcacagcagtttagtttcatctattgaaaaagatctgcaggagatcatggatagcctggtgctggaggaaccgggcgctgccgggaaaaaacctgctgctaccagcccactttctccgatggctaacggcggacgctacctcctgagcccacctactagccctggacacgtatgcgggctgcagttatag

SEQ ID NO: 129012 - DNA, 14055 bp, Artificial Sequence
  Description of Artificial Sequence: Synthetic coding sequence
atggtagctggcatgctgatgcctcgcgaccagctaagggccatctacgaggtcttgtttcgggagggagttatggtggcaaagaaagacaggcgaccccgcagtcttcatccccacgtacccggcgtcacaaaccttcaggtcatgcgggcaatggcctctttgagggcgaggggacttgtccgggagactttcgcctggtgccatttttactggtacctgacaaacgaggggatcgcccatttacggcagtatctacacctaccacctgagattgttcccgcaagtctgcagcgcgtacggagacctgtagcaatggtcatgcctgctcgtcgcactccccatgtgcaggccgtccagggccctcttgggtcacctcctaaacgggggccactgcccacggaggaacaaagagtgtaccgccgcaaggaactcgaggaagtaagtccggaaaccccagtggtaccggccaccacgcagcgcacgctggccagacccggaccggagcccgctcctgcgactgacgagagggaccgtgtgcaaaagaaaacgtttacgaagtgggtcaataaacacctgattaaggcccagaggcatatcagcgatctgtacgaggatctaagggacgggcacaatcttatcagtttactggaagttctgtcaggggacagtctaccacgggagaagggcagaatgcggttccacaaactgcagaacgtgcagattgccctcgattatctgagacaccgtcaggtgaaactggtgaacattcgtaacgacgacatcgccgacggtaaccctaaacttacattaggattgatttggacaattatactccactttcaaattagtgacattcaagtttccggacagagtgaggatatgacagccaaagagaaactcctgctttggtctcagcggatggtggagggctaccagggcctgaggtgcgataattttacttctagttggcgcgacggacggttgtttaatgcgatcatccacagacacaaacccctgctaatcgacatgaacaaggtgtaccgacagactaatctcgagaaccttgatcaagctttttcagtggctgaaagggacctgggcgtaacacggcttctcgaccctgaggatgtggatgtgcctcaacccgacgagaagtccattatcacttacgtgtcttcactctatgacgcaatgccacgggtacctgacgttcaggacggagtaagggctaatgagctacagctcagatggcaggaatatcgggaactagtgctgctcctgttgcagtggatgcggcatcataccgcggcctttgaggagagacgattcccatcttcctttgaggaaattgaaattttatggagccagtttctaaaattcaaagagatggagctgcccgctaaggaggcggacaaaaaccgatcgaaaggcatttatcagagcctcgagggagctgttcaggccggccagctgaaagtaccccctggctaccaccccttagacgtcgagaaggagtggggaaagctccatgttgcaattttggaacgcgaaaagcagctcaggagcgaattcgaacgacttgaatgtctgcagagaatcgtgaccaagctgcagatggaggcaggactctgtgaggagcagctgaaccaggctgatgccctgctgcaatccgacgtgcggctgttggctgccggaaaggttccccagagagctggcgaggtggagagggatttggataaggccgacagtatgatccgcctgctcttcaatgatgtgcagaccctaaaggatggcagacatccacagggcgagcagatgtatcggagggtgtataggttgcatgagcgcctcgtggctattcggactgagtataacctccggctgaaggccggagtcgctgcgcccgcgacacaagtggcgcaggtaacacttcaatcagtgcaaagaaggcctgagctggaagatagcaccctgcgctacctgcaggatttactggcatgggtcgaagagaaccagcacagagtcgatggggctgaatggggtgtggacctacctagcgtagaggctcagctgggaagccaccgcgggcttcaccaatcaatagaggagtttcgcgccaaaattgagagagcacgaagcgatgaggggcagttatctcccgcaactcgtggcgcctaccgcgactgcctgggccggctggatctccagtacgccaaactacttaattcaagcaaagctcggctgaggtctttggagagcctgcactcgtttgtcgctgccgccaccaaagagctgatgtggctcaacgagaaagaggaggaggaggtcggatttgattggagcgaccgtaacaccaacatgaccgcgaaaaaggaatcttatagcgctctaatgcgggaactcgagctgaaagagaagaagattaaggagctgcaaaacgccggggacaggctcttaagagaagaccaccctgctcggcccacggtggaatcctttcaggctgccctgcaaacccaatggagctggatgctgcagctgtgttgttgtatcgaggcccacctgaaagaaaatgcagcctacttccagttctttagtgatgttagggaagcagaaggtcagctccagaagctgcaggaagctctgagaaggaaatacagctgtgataggagcgctactgttactcggctggaggacctgttgcaggacgcccaggatgagaaagaacagctcaacgaatataaggggcatctgagcgggctcgccaagagagcaaaagcggttgttcagctgaagccaagacaccccgctcatcctatgagagggagactgcccctgcttgcggtatgtgattacaaacaagtggaggtcactgtgcataaaggggatgagtgtcaactggtcgggcccgcacaaccttcacattggaaggtcctgagctcctcaggaagcgaggccgccgttccctccgtatgtttcctcgtcccaccgcccaaccaagaagcccaggaggcggttacacggctcgaggctcaacatcaggctttagtgactctgtggcatcaactgcacgtcgatatgaaatccctactggcatggcaaagcctgcgcagagatgtgcaattgatccggtcatggagtcttgctacattccgcacactgaagcccgaagaacagaggcaggcactccacagtcttgaacttcactaccaggccttccttagggattctcaagacgccggggggttcggtccagaggatcgattgatggctgagcgggagtatggcagctgctcacaccactatcagcagctgttgcagtctttggagcagggcgcccaagaagaaagccgatgtcagcggtgcatcagtgagctgaaagatattcgactgcagctcgaagcttgcgagacaaggaccgtacaccgattgagactgccgctggacaaggagcccgctcgggagtgcgcccagcggattgcagaacaacagaaggctcaggccgaggtggaagggctcggaaaaggcgtggcccggctcagcgccgaagcagaaaaggttctggcacttcctgagcccagcccagctgcccctactttaagaagtgaactggagctcaccctcggaaagcttgaacaggtgcgctcgttgtccgcgatttatctggagaaactcaaaacaatctctctggtaattagaggaacccaaggcgcagaggaagtgctgagagcccatgaggaacagttgaaagaggcccaggcagtgcccgccaccctgcccgaactggaagccacaaaggctagcctgaagaagctacgggcacaagcagaggctcaacagccaactttcgatgctcttagagacgagctgcggggggcccaagaagtgggggaacgcctacagcagaggcatggcgagagggatgtggaagtagagcgatggagagaacgtgtggctcaactgctcgaaaggtggcaagctgtcctggctcaaaccgacgtgaggcagcgcgaactggaacagctgggaagacaattacggtattacagggaatccgcggatccgctgggtgcctggctccaggacgcaaggaggcggcaagagcaaatacaagctatgccactggccgactcccaggctgtacgcgaacagttgcgacaagaacaagccctgttggaagagatcgagcggcacggcgagaaagtcgaggagtgccaaagattcgctaaacagtacatcaatgccatcaaagattatgagctgcagctggtgacctataaggcccagctcgaacctgtcgcgagccctgcaaaaaaaccaaaagtgcaatcaggaagtgagagcgttatacaggagtatgtcgacctcaggactcactacagtgagctaacaacactgacgtcccagtacattaagtttatctctgagactctccggcgcatggaagaagaagaaagactggcggaacagcagcgggcagaagagcgcgaaagattggcggaggttgaggccgcactggagaagcagcggcagctggccgaggcccacgcacaggccaaagcacaggccgaaagagaggcgaaggaacttcaacagcgtatgcaagaggaagtggtgcgccgggaagaggctgcggtggatgctcagcagcagaaacgcagcatacaggaagagctccagcagctgcgccagagcagcgaggccgaaatccaagccaaagccagacaagccgaagcagccgagcggtcacgactgcggatcgaggaagaaataagggtggtgagactacagctcgaggcaacagaaagacagcggggcggtgccgagggagaacttcaggccctgagagcccgtgccgaagaagctgaagcacagaagagacaagcccaggaagaggcggaacggctcaggcggcaggtgcaggacgaatcccagcgcaaaaggcaggctgaagttgaactcgcctcgagggtgaaggcagaagccgaggccgcacgtgaaaaacaacgggcactgcaggcccttgaggaactccgactgcaggcagaggaggcagaacggagactccgtcaagcagaggtagagagagcacggcaggtgcaggtggctcttgagaccgctcagcgctcagccgaagctgagttgcaaagcaaaagggcatcattcgctgaaaagacagcacagctggaacgcagcctgcaagaggagcacgtggctgtggcgcagcttagggaagaggccgagcggcgagcacagcagcaggcggaagcagaaagagcgagagaagaagccgagcgtgaactcgagaggtggcagctgaaggctaacgaagcactgagacttaggcttcaggcagaggaggtcgcccagcagaagtcactggcacaagccgaagcagaaaagcagaaggaggaagccgagcgtgaggcgagacggcggggaaaagctgaagaacaggccgtcagacagcgtgaactcgcagagcaggagctggaaaaacagcggcagcttgcggaaggcaccgcgcagcagcgtcttgccgctgaacaggagttaattcgcctacgggctgaaaccgaacagggcgagcagcagcgtcaattgcttgaggaggaactggcccgcctacagcgcgaagcagctgccgccacgcaaaaaaggcaggagctggaggctgaactggccaaggtcagggcagagatggaggtactgctcgcaagtaaagctcgggccgaggaggaatccaggagcacaagcgagaaatccaaacaaaggctcgaggcagaggccgggcggtttagagaactggctgaagaggccgcgcgactccgcgccctggcagaagaggcaaagcgccagaggcagcttgcagaggaggacgccgcacggcagagggccgaagcagagcgtgttctggctgagaaactcgcagccataggagaagccactcgtctgaagaccgaagctgagatcgctctgaaggagaaagaggccgagaatgagcggttgaggaggctcgccgaggacgaagcgttccagcgtaggaggctagaggaacaggctgcgcagcacaaggccgatattgaggagagacttgcccagctccgaaaggcctccgattccgagctcgagagacagaaaggtcttgtcgaagacacgctgagacagcgcagacaggtcgaagaggaaatactcgcccttaaagcgtccttcgagaaagcggccgcaggcaaagccgaactggagcttgagcttggaagaattcggagcaatgctgaagacaccttgaggagcaaggaacaggcagaactagaagccgcccgccagcgccagcttgcagccgaggaggaaagacgacgacgcgaggcggaagagagggtccaaaagagtctagctgcggaagaagaagcagcccggcaacgtaaggccgccttggaagaggtggaaagactcaaggcgaaggtagaggaggctcgccgcctgcgagaaagagctgaacaggagtcagcccgtcaacttcagctggcacaggaggccgctcagaagaggctgcaggcagaagagaaagctcacgctttcgctgtccagcaaaaggagcaggaactgcagcagaccttgcagcaagaacagtctgtgctggaccagttgagaggtgaggccgaggctgcacgcagagctgcggaggaagccgaggaagcgcgggtccaggccgagcgggaggccgcacagagtaggagacaagtagaagaagccgaacgtcttaagcagagtgctgaagagcaggcacaggctcgggcccaggcacaggcagcagcagaaaaattacgcaaagaagcagagcaagaagccgcaaggagagcccaggcggaacaggccgctttgcgtcagaaacaggccgcagacgctgaaatggaaaaacataaaaaatttgccgaacagaccctgcgtcagaaggctcaggtggagcaggagttgacaacactacgactacagctcgaggaaactgaccaccagaaaaacctcctagacgaagaactccagagactgaaggctgaagcgaccgaggcagctaggcagcgttcacaggtggaggaagagttattttccgtgcgggtgcagatggaggagctgtctaaactcaaggcgagaattgaagctgaaaatagggcactaattctgagagataaggacaacacccaacgcttcctccaggaggaggctgagaagatgaaacaggtggctgaagaagccgctcggttaagcgtggcggctcaggaggcagcaaggcttcgccagctcgctgaagaagacctggcgcagcagagagccctggctgaaaagatgctgaaagaaaagatgcaggctgttcaggaagcgaccaggctgaaggcggaggccgagctcctccagcagcagaaagaactcgcacaggaacaggcgcggcggttacaagaagacaaggaacagatggcccagcaactggctgaagagactcagggatttcagcgcactttagaagcggaaagacaaagacagctagagatgtccgccgaagcagagcggctcaagctaagagttgctgagatgtctcgcgcccaggccagggcagaagaggacgcccagagattccggaaacaagccgaggaaattggagagaagctgcacagaacagagttagccacgcaagagaaagtaactttagtgcaaacactggaaattcagcggcaacagtctgatcatgacgctgagcgactgcgggaggccattgcggagctcgaacgagagaaagagaaactgcagcaggaagccaaactgttgcagctaaaaagcgaggaaatgcagaccgtacagcaggagcagctgctacaggagacccaggcccttcaacagtcctttctgtctgagaaggattccctgctacagagagagagatttatcgagcaggagaaggcgaagctcgagcagctgttccaggacgaagtggcaaaagctcagcagctccgggaggagcagcagcgacagcaacagcaaatggagcaggagaggcaaagactggtcgcaagcatggaggaagcaaggcgacggcagcacgaggcagaggaaggggtccggagaaagcaggaggaactccaacagctggagcagcagcgccgtcagcaagaagaactgctggccgaggaaaatcagagacttagagagcagctgcaactattggaagagcagcacagggccgcacttgcccactcagaagaagtgacagcctctcaggtcgcggccaccaagacacttcccaatggtcgggatgcgctggatgggccggccgcggaagcggaacctgagcatagcttcgacgggctccggagaaaggttagcgcccagaggcttcaggaggccggcatcctgtccgccgaggagttgcaacgattggctcagggccatacaactgtcgacgaactcgcaaggcgggaagacgttaggcattatttacagggcagatcaagtatcgctggccttctgttgaaagccactaacgagaaactttctgtctatgctgcattacagcgccaattgttgtctccagggacagcacttatacttctggaggcccaggccgccagcggcttcctcctggacccagtacgcaataggagactgacggtaaacgaggcagtcaaggaaggcgtcgtgggtcccgagttgcaccacaagctcctgtccgcagaacgggctgtaacagggtataaggatccctacacaggccagcagatttcgctgtttcaagcgatgcagaaggggctcattgtcagagagcacggaatccgcctactcgaagctcagatcgcaactggtggcgtaatagacccggtccattcccacagagtccctgttgacgtcgcttatcgccgcgggtactttgacgaggagatgaatcgcgtcctggctgacccctccgacgatactaaggggttctttgatccaaatacccacgagaatttaacctatctccagcttctcgaaagatgtgtggaggatcctgaaacaggtctgtgcctactgccattgacagacaaagccgctaaaggcggggagttggtgtatacagacagcgaggccagagacgtgttcgagaaggccactgtcagcgccccattcggtaaattccagggcaagactgttaccatctgggagattatcaactccgaatatttcactgctgagcaaagacgcgacctgttacgccagtttagaacagggcgtattacggtggagaagattataaagatcataatcaccgtcgtggaggagcaggaacagaagggcaggctctgcttcgagggccttcgttccctcgtcccggcggctgaacttttggaatccagagtaatcgaccgcgaactttatcagcaacttcagcggggcgaaaggagcgtgcgcgatgtcgcggaggttgatacagttcgtagggccctaaggggcgctaacgtgattgctggcgtctggctcgaggaggcagggcagaagctcagcatttataacgctttaaagaaggatttgctgccttctgacatggccgtagcgttactcgaagcccaggcaggtacagggcatatcatcgatcctgcaacttctgcaagattgacagtcgacgaagcagtaagggccgggttggtgggacctgaattccacgaaaaattgttaagtgcagagaaggctgtgactgggtaccgagacccctacacgggacagtcggtttccctcttccaagcactgaaaaagggactaatacctagagagcagggactgagactgcttgatgcccagctgtctaccggtgggattgtggatccttccaaatcgcaccgtgtccccctcgatgtggcctgtgcgaggggctgcctggatgaggagacttcacgcgctctgtctgcccctagggccgacgctaaagcttactccgatcctagcaccggcgaacctgctacatacggcgaattacaacagcgttgcagaccagaccagctgaccggcctgtcactgctgcctctctcggagaaagcggcaagggcccgacaggaggaactgtactctgagcttcaggcccgcgagacatttgaaaaaacgcccgtcgaagtgccagtcggtggattcaaaggaagaaccgttaccgtgtgggagctgatttcatccgagtacttcacggccgagcagcgtcaggaactgctccgccagtttaggactggaaaggttacggtggaaaaggtcataaagattttaatcacaatagtggaggaggtggaaactttacggcaggagagattgtctttttctgggttacgcgccccggtaccggctagcgaattgttagcttcaggggttctgagccgtgctcagtttgaacagctgaaagacggcaagaccaccgttaaagatttgtcagagcttgggtcagttcgcacactgctacaaggaagcgggtgcctggctggcatctatctggaagacacaaaagaaaaggtgtcaatttatgaagctatgcgcagagggctgctgagagctacaaccgcagcgttgctccttgaagcacaagctgcaacagggttcctggtggatcccgtgcggaatcagaggctttatgtccacgaagctgtgaaggccggggttgtcggccccgaacttcacgagcagttgctatcagctgaaaaggctgttacaggttatagagatccttactcgggctctaccatcagtctgtttcaagctatgcaaaagggattggtcttaagacagcacggcattagacttctagaggcacagatcgccacaggaggcataatcgatcctgttcatagccacagggtgccggtcgatgtagcttaccagaggggatacttctcagaggaaatgaatcgggtactcgccgacccaagcgacgatacaaaaggcttcttcgatcccaatacgcacgaaaatctgacctatcgccaacttcttgaacggtgtgtggaagaccccgaaacaggcctgaggttgctccccctcaaaggagcagaaaaggccgaagtagtagagacaactcaagtgtacacagaagaggagacacgacgtgcttttgaggagacccagattgatattccgggcggcggcagccacggtggaagcaccatgtctttgtgggaggttatgcagtccgacctgattcctgaggaacagagggctcagttgatggctgacttccaggccggaagagtgaccaaggagagaatgattattatcattatcgagataatcgagaaaaccgagataattaggcagcaggggctcgccagttacgattatgtcaggcgcagactgaccgccgaggacttgttcgaggcaagaatcatctctttagaaacctataacctgctccgagagggaacccgctctctgagagaagccctggaagccgagtccgcatggtgctacttatatggcaccggatcagtcgccggggtgtatcttccgggcagtaggcagactctgtccatttatcaggctctgaagaaggggctgctctccgccgaagtggcccgtctcctgctggaggcacaggcggctactggattcctgctggaccccgtcaagggggagcggttaaccgtggacgaggcggtgcggaagggcctcgtggggccagaattgcacgacaggctgctttcagccgagcgggccgtgacaggctatcgggacccgtacactgaacagacgatctctttgttccaggccatgaagaaagagctgattccgactgaagaggcccttagattactggatgcgcagttggccaccggagggatcgtagatcctaggctagggtttcatttacctctagaagtcgcctaccagagaggataccttaataaggacacacacgatcagttgtctgaaccctcagaagtgcgatcatacgtcgatccgtccaccgacgagagattgtcatacactcagctcctgcgccgctgcaggagagatgacggtaccggacagttactcctccctctgtcagacgcccgcaaactgactttccgcgggctgcgaaagcagatcacaatggaggagctggtccgctcgcaagtcatggatgaggctaccgctttgcagctgagagaggggctcaccagtatcgaggaggtcacaaaaaacttgcaaaaattcctcgaggggacctcctgtattgccggagtgttcgtagatgctacaaaagaacggctctctgtgtatcaggccatgaaaaaaggcattatcagaccaggcactgcttttgagttgctggaggcccaagcagccactgggtatgtgatcgatcccatcaaagggctcaaactcactgtcgaggaggcggtcagaatggggatagtgggcccagaattcaaggacaaactgctcagcgccgaacgcgcagtcacaggatataaagatccctacagtgggaagctgatcagcctgttccaggccatgaaaaaggggctgatcctcaaggatcacgggatacgactgttagaggcccagatcgcaacaggagggatcatcgacccagaggaatcgcatcggttgccagtagaagttgcctacaagaggggtctgtttgacgaagagatgaacgaaattttaactgacccctcagacgatacaaaaggctttttcgacccaaacacagaggagaacttgacatatctgcagctaatggaacgatgtataactgaccctcagacaggactatgtttgctgcctcttaaagagaagaagagggaaaggaaaacgtccagcaaaagctcagtgagaaagcgccgggtggtgattgtggatcccgaaacgggcaaagaaatgtccgtgtacgaagcatataggaagggattaatcgaccatcaaacatatcttgaactctctgagcaggagtgtgaatgggaggagatcacaatttcctcgagcgatggagtggtcaagtctatgatcatcgatcgtcgaagcgggcggcagtacgacatagatgacgccatcgctaaaaatctgattgacaggagtgcactcgatcagtacagagcaggaacgctgagcattactgagtttgccgatatgctgagtgggaacgccggtgggtttcgatcgcggagtagttccgtaggaagcagcagcagctaccctatttcgcccgctgtcagccggactcagctcgcttcctggtcagaccctacagaggagaccggccccgttgctggaattttagatactgagaccctggaaaaagtaagcatcaccgaagctatgcatagaaacctggttgataatataacaggacagaggctactggaagcccaggcgtgtaccggcggtatcatcgatccgagcactggggagcgctttcccgtgacagatgctgtcaataagggcttggtggacaagataatggtcgaccggataaacctggcccagaaggccttctgtggatttgaggatccacggactaagaccaagatgtcagctgctcaagcactgaaaaaggggtggctctactacgaagccggccaaagattcttggaagtccaatacctcactggcggactgattgagccggatacccccggccgggtccccctggacgaggccctacagcgcggcaccgtcgacgctcgcacagcccagaagttaagggacgttggtgcttacagcaaatacctgacctgccccaaaaccaagctcaaaatctcctataaagacgccctcgaccgttcaatggtcgaagaggggactgggcttcgcctgctcgaagcagccgctcagtcgaccaaaggctactatagcccctacagcgtgtctggctcaggatcaacagctgggagccggactggctcccgcacagggtcacgcgccgggagcagaagagggagttttgatgcaactggatcaggcttctccatgacattctcttcctcatcctactcctcaagcggctatggtagaagatacgcctccggctcttcagccagcctcggcggtcctgagtccgccgtcgcctag

SEQ ID NO: 129013 - DNA, 13644 bp, Artificial Sequence
  Description of Artificial Sequence: Synthetic coding sequence
atgtctcaacaccagttacgagttccacagccggaaggcttgggtcgtaagcgcacaagtagtgaggacaacctatatctcgcggtgttacgggcttctgaaggaaagaaagatgaaagagatcgcgtgcagaagaagacatttacaaagtgggtcaacaagcatctgattaaggcccagaggcacattagcgatctctacgaggatctgcgggacggacataacctcatcagcctcctggaagtactgtccggggattctttgccccgagaaaaagggcggatgcggttccacaagttgcaaaacgtgcagatagctcttgattatctgaggcatcggcaggtgaagctggttaacattcggaatgatgatatcgccgatggcaaccctaaactgacactgggcctgatctggacaattatccttcactttcagattagcgacatccaggtgagtgggcagtccgaggatatgaccgctaaggagaaacttttactttggagccagaggatggtcgaagggtatcagggcctgcgctgcgacaatttcaccagctcctggcgggacggacggctgtttaatgcaatcattcatcggcataaacccttactgatcgacatgaacaaggtgtaccgccagaccaacctcgagaatttggatcaggccttctccgtcgccgaacgcgatctcggagtgacaagactcttggaccctgaggacgtcgatgtccctcagcccgacgaaaaatcaattatcacttatgtgtcttctttatatgacgcaatgccaagggtaccggatgtgcaagatggagtgcgcgctaacgagttacagcttcggtggcaggagtatcgtgagttggtcctgttgctcctgcagtggatgaggcaccacactgccgcattcgaggaacggcggtttccttccagcttcgaggaaatcgagatcctctggagccagttccttaagtttaaagagatggagttgcctgccaaagaagctgataagaaccgatctaagggcatataccagtctctggagggggccgttcaagcaggacaactcaaggttccacccggctatcaccccctagacgtggaaaaagaatggggcaagttgcacgtggccatcctggagagggaaaaacagctgcgttctgagttcgaaaggctggaatgcctgcaaaggatcgtcacaaagctgcagatggaagctggactgtgcgaggagcagttgaatcaagctgatgcactccttcaaagcgatgtccggttattagcagcggggaaggtgccccagcgtgccggagaagtggagcgggacctggataaagcagactcaatgatcaggctcctgtttaacgacgtgcagacactgaaggatggacgacatccacaaggagagcagatgtataggcgtgtctatagactgcacgagaggctggtggccatccggaccgagtataacttgcgcttgaaagccggcgttgcagcccctgctacgcaggtggcccaggttacgctgcagtcagttcagaggcggccagagctggaggactctacgctgcgctatctccaggacttgctcgcttgggtggaggagaatcagcaccgagttgatggcgcagaatggggcgtggatctaccctctgtggaagcccagctgggcagccatagagggctgcaccagtctatcgaagaattccgtgccaagatcgagcgcgctcgctcggatgaaggacagctaagtccagcgacaagaggagcctaccgcgattgtcttggcaggctggacctacagtacgctaaactgctcaattcaagtaaggcacggcttaggtccttggaatcactgcacagcttcgtcgccgccgcgaccaaagaactaatgtggctgaatgagaaggaagaggaagaggtaggttttgactggtctgacaggaacacaaatatgactgccaaaaaggaatcctatagtgcgttgatgcgcgaattggaactgaaggagaaaaaaatcaaggagttgcagaatgctggcgaccgcctcctcagagaagaccacccagctcgccccactgtggagagtttccaggcggctttacaaactcagtggagttggatgttgcagttgtgttgctgtatagaggctcatctgaaagagaatgccgcgtacttccaattcttttccgatgttcgtgaggcagagggccagctgcagaagctccaggaggccttgagaaggaagtattcctgtgacaggtctgcaaccgttacaagactggaggacttgctgcaggatgcgcaggacgagaaggagcagctgaatgagtataaaggccatctgtctgggctggccaagagagccaaggctgtggtccaactgaagcctcgacacccagcccatcctatgcgcgggcgactacctttactggcagtgtgtgactataaacaggtggaagttacagtgcacaagggggacgaatgccagttggttgggccagcccagcctagtcattggaaggtcctgtcaagctctgggtccgaggcggccgttccctcggtgtgttttctggtgcccccaccgaaccaggaggcacaggaggccgtgactcggctcgaggcacaacaccaggcccttgtgacactgtggcaccaactgcatgtagacatgaaaagtctgctagcttggcaaagtctgcgtcgggacgtacagctcataagaagttggagcctggccacatttcgaacactgaagcccgaggagcagcggcaggcattgcatagtcttgaacttcactatcaagcctttctcagagactctcaggacgctggcgggttcggcccagaagatagattaatggccgagcgtgaatacggctcttgtagccaccattaccaacaacttttgcagagtttggagcagggcgcccaggaagagtccagatgtcagcggtgtatatccgagttgaaagacatccgactgcaattagaggcttgtgaaacccgcactgtacataggttacggctgcctctcgataaagaaccagctcgggaatgcgcacagcggatcgcagagcagcagaaagcgcaagccgaagttgaagggctcgggaagggcgtcgcccggctcagcgccgaagcggagaaggtcctggctctgcccgagccaagccccgccgcccccacactgagatctgagcttgaattaaccctcgggaaactcgaacaggtcaggtctctgagcgctatttatctggaaaaactgaaaacaatcagtctcgtgatccgcggtactcagggcgcagaggaggtactgagagcgcacgaagagcagcttaaggaagctcaggccgtcccggccacccttcctgagctggaggcaactaaggcctccctgaagaagctgagagcccaggccgaagcccagcagcctactttcgacgcactccgcgacgaactcaggggagcccaagaggtgggagaacgcctacagcagcggcacggggaaagagacgtggaggtcgagcgttggcgtgagcgtgtcgctcagttactggagcgttggcaggccgtgttggcccagaccgatgtgaggcagcgcgagctggagcagctgggcagacagctccggtattaccgggagtcagccgacccattaggcgcttggctgcaagacgcccgtcggagacaggagcagattcaggctatgccgctggcagactctcaggcagtccgagagcagctgaggcaggagcaggccctcctggaggagattgagcgacacggggagaaagtcgaggagtgtcaacggtttgcaaaacagtacataaatgctataaaagattacgagctgcaactggtgacatataaggcacaacttgagcccgttgcttcccctgcgaagaagccaaaggttcaatctggctcggagtccgtcatccaggagtacgtggatctgagaactcattactccgagctcaccacgctcacctctcagtacataaagtttatttccgaaacgctccgaagaatggaagaagaggagcgcctggctgaacagcagagggccgaggagagggagcgattagctgaggtggaagccgcccttgagaagcagcggcaactcgcggaggctcacgcccaggcgaaagcacaagcggagcgcgaagctaaagaactgcagcaacgaatgcaagaggaagtggtgaggagagaagaggcagccgtggacgcccagcaacagaagagatcgattcaggaggagctccagcagctcaggcaaagcagcgaagcggaaatacaagctaaggctcgtcaggctgaagcagccgagcgcagtcggctgcggattgaggaagagatccgtgtcgtgcgcttgcagcttgaagctacagaaagacagcggggtggggccgagggcgaactgcaagctctgcgcgccagggcggaggaggccgaggcgcagaaacgtcaggctcaggaggaagctgagcggctgagaagacaggtacaggatgaaagccagcggaagcgccaagccgaagtggagctggccagcagggtgaaggccgaggccgaagctgctagggagaagcagcgagcactccaggccctggaagaacttaggctgcaggcagaggaagcggagcggcggctcagacaggcagaggtcgaacgcgcacgccaagtacaggtggcgctggagacagcccaacggagtgccgaagccgagctccaatcaaagcgggcatccttcgccgagaagactgctcagctggaacgatcactgcaggaagaacacgtcgcagtggcacagttgagagaggaggctgagagacgcgcccagcaacaggcggaggctgagcgagccagggaggaggccgagagggagctggagcggtggcagctgaaggccaatgaagctcttaggctgcgcctgcaggcagaggaagtcgcccaacagaaaagccttgcccaggccgaagccgagaaacagaaagaggaagctgagcgcgaggcgcggagacgaggaaaagcggaggaacaggcggtgcgccagcgtgaacttgcagagcaggaattggaaaaacagcggcagctagctgaaggtacagctcagcagaggctggctgccgaacaggaactgatccgtctgcgggcagaaaccgaacagggcgaacagcagcggcagcttctcgaggaggagttggctcggctgcagcgagaggccgccgctgctacccagaagagacaggagctcgaggccgaactcgccaaggtccgtgctgaaatggaggtgctgttagccagcaaagcccgagctgaggaggagtcaagatcgacctctgagaaatcaaagcagaggctggaggctgaagcagggcggtttagagaattagccgaggaagccgcccgactgagggctcttgccgaggaggctaaacggcaacgccagctcgccgaagaagatgcagcccggcagcgggcagaagcagagcgggttctggccgaaaagctagccgccattggcgaggcgactaggctaaagacagaagccgagatagccctaaaggagaaggaagctgagaatgaaagactgcggagactagccgaagacgaggcctttcagcggcggcgtctggaggaacaggccgcccagcataaagctgatatcgaggagcgacttgcacagctgaggaaggcgagcgactccgaactggaacgccaaaaaggactcgtggaagatacccttaggcaacggcggcaggttgaggaggaaatattggcactgaaagcttcattcgagaaggccgcagcgggaaaggccgaattagaactagaactagggaggatccgttcgaatgctgaggacactctccgcagcaaagagcaggccgaactggaggccgctagacagaggcagttggccgcagaggaagaaaggcgaagacgcgaggccgaggagcgcgtacagaaatccctcgcagccgaggaagaggccgcacgacagagaaaggccgccctggaagaagtggagcgcctgaaggcaaaggttgaagaagcccgccgactgcgagagagggcagagcaggaatctgcccgacagctgcaacttgcacaggaggctgcccaaaaaagactccaagccgaagagaaggctcatgccttcgccgttcagcagaaggaacaagagctccagcagactctacaacaagagcagagcgttcttgatcaactgcgaggtgaagctgaggcagcccgtagggcagcagaggaggcagaagaggcacgagtgcaggccgaacgggaagctgcacagtcgaggaggcaggtcgaagaggctgagaggctgaagcaatcagctgaggagcaggcgcaagcaagggcgcaggctcaggctgcggctgaaaagctccggaaagaggctgaacaagaggcggccaggagagcacaggccgaacaggccgccttaaggcagaagcaggcagctgacgctgagatggaaaagcacaagaagttcgctgagcagaccctccgacagaaagcacaggtggagcaggagctgacgaccctgaggctgcagttggaggagaccgatcaccagaagaatcttctagatgaagagttgcaaagactgaaggcagaggccactgaggccgcccgtcagagaagccaagtggaggaagagcttttttccgtgcgcgttcagatggaggagctttctaagctgaaggcccgcatcgaagccgaaaatagagcgctgatcctgagggacaaggacaatacccagagatttctccaggaagaagcagaaaagatgaaacaagtggccgaagaggcggccagactttctgttgctgcgcaggaagccgccaggctgcgccagctggctgaagaagacttagctcaacagcgcgctctcgccgagaaaatgttgaaggagaaaatgcaagcagtccaggaggcaactaggctcaaagctgaggctgaactcctgcagcaacagaaggagctcgctcaggagcaagcacgccggttgcaggaggacaaggagcagatggcccaacaactcgccgaggagacgcaaggttttcagagaactcttgaggcagaaaggcagcggcagctggagatgagcgccgaggccgagcgcttaaagctccgcgtggccgagatgtccagggcccaagctcgggcggaagaggatgcacagcgtttccggaagcaggccgaggagataggggagaaactccataggaccgagttagccacacaggagaaggtcacccttgtccagacattagaaattcaaaggcaacagtccgaccatgacgccgaaaggctgcgcgaagcgatagctgagctggagagagagaaggagaagcttcagcaggaagccaagcttctgcagcttaagagtgaagagatgcagacggtgcagcaggaacagctcttgcaagagacacaggcgctgcagcaaagcttcctgagtgagaaggattcgctgctccagcgggagaggttcattgagcaggagaaggcaaagttggagcagctgtttcaggatgaggtagcaaaagcccaacagctgagagaggaacagcagcggcaacagcagcagatggagcaagaacggcagcgcctagttgcctcgatggaggaggcacggaggcggcagcatgaagccgaagagggcgttcgaaggaaacaggaagagctgcagcagctcgagcaacaacgcaggcagcaagaagaactcctggcagaggagaaccagcggctgagggagcagctgcagctgctggaagagcagcatagagccgcactggcccacagcgaagaggtaaccgctagtcaggttgccgcgacaaagaccttaccaaatggccgcgacgcactcgacgggcccgccgcagaagccgagccagagcacagtttcgatggactacggcgtaaggtgagtgcacagagactgcaagaagctgggattctgtcggccgaggagctacaaaggctcgcgcaaggccataccaccgtagatgaactcgcccggcgcgaagacgtccgacattatctgcaggggcgaagttcaatagccggtctgttactcaaagctaccaacgagaaactgtccgtttacgccgctctccaaaggcaactccttagcccaggaacagcactgatcctactggaggctcaggccgccagcggcttcctgctggatcctgtgcgcaacaggcgcttaactgtgaatgaagctgtgaaagaaggagtggtgggccctgaactgcaccataaactcttgtcggccgaaagggccgtgacggggtacaaggatccctacacaggacagcaaatttctctttttcaggccatgcagaaaggcctaatcgtgagggaacacggaatacgcctcttggaggcccagatagccaccggtggagtgatcgaccccgtgcactcacatagggttcctgtcgacgttgcgtaccgaagaggctacttcgacgaagagatgaacagggtgctggctgatccttctgacgatacaaaggggttcttcgatcctaatactcacgagaacctaacttacctgcagttgttggagcgttgtgtggaggaccctgaaaccggcctgtgcctgttacctctgaccgataaagccgccaaaggcggagaactcgtctacaccgattccgaagcaagagatgtctttgagaaggcaaccgtaagcgctccctttgggaaatttcagggcaaaacggtaacgatttgggagattattaattccgaatattttaccgccgagcaacgacgggatctcctccgtcagttcagaacaggacgaataacagtggagaagataattaagattatcataacggtcgtcgaggagcaggaacaaaaaggccgcctgtgctttgagggtcttagatccttagtgcctgccgccgaactgctagaaagtcgcgtgatcgatcgggaactttaccagcagttgcagagaggggagcggtctgttagagacgtggcagaggtggacacagtgagacgggccctaaggggagccaatgtgatcgcaggcgtgtggctggaggaggcaggtcaaaaattgtccatctataacgctctgaagaaggacttactgccctccgacatggccgtggctcttctggaagcacaagccggtactggtcacatcattgaccccgcaacttctgcccggctcactgtggatgaggcagtgagagccggcctggtgggaccagaattccatgaaaaacttctgagtgcggaaaaggccgtgactgggtaccgcgatccatacacaggacagtctgtttccctcttccaggcccttaagaaggggcttattccacgggagcaggggctgcggctcctcgatgcccaactttcgaccggcggtatcgtcgatcctagcaaatcacacagggtgccactggatgtggcctgcgctcggggctgtttagatgaggaaacgagtcgcgctttgtcggccccccgggcagacgccaaagcatacagtgatccgagcacgggggaaccagccacatacggcgagttgcagcaacggtgccggcctgatcagttgaccggcctatctctccttccactgtctgagaaggcggcaagagctcggcaggaagaactctacagcgaactgcaagccagagagacttttgagaaaactcccgtggaggttcccgtaggcggattcaagggacgcacagtaacagtctgggaactgatctcttccgaatattttaccgccgaacaaagacaggaattgcttcgacagtttcgcactgggaaagttacagtcgagaaagttataaaaatcctgattaccatagtcgaggaggtcgaaaccctgaggcaggaaaggttgagcttcagtgggcttcgtgctccagtcccagcctcggaactcctcgcttccggtgtcctcagccgagcccaatttgagcaactcaaagatggcaaaaccactgttaaggacctgtccgaactcggatctgtgcggactctgctccagggctctggttgcctcgccgggatctacctagaggatacaaaggaaaaggtttcaatctacgaagcaatgcggcggggcctgctccgcgcaacaacagcagcgttattgctggaagctcaggcagcgacgggatttctggttgacccggtccgaaaccaaagattgtatgtccatgaggctgtgaaagccggtgtggtgggcccggagctccatgagcagctgctgagtgctgaaaaagcagtcactggttatcgtgacccttatagcggcagcaccatcagcctgttccaagctatgcagaagggcctggtgctgaggcagcacggtatacgcctgctggaagcccagatcgcgactggcgggattatagaccctgtgcattcacatcgggtccctgttgatgtggcttatcagagaggctacttctctgaggagatgaatagggtgctggcagatccaagtgacgataccaaggggttcttcgacccaaatactcacgaaaacctgacctatagacagctgcttgagagatgtgtggaagaccctgaaaccggactgaggcttctcccattgaagggcgcggagaaggccgaggtggtggaaaccacccaggtgtacacagaagaggaaacacggcgtgctttcgaagaaactcagatcgacatcccaggcggtggctctcacggcgggtcaacaatgtcactgtgggaagtcatgcagagcgatctgatcccagaagaacaaagagcccaattgatggccgattttcaggccggccgtgtgaccaaagagaggatgattattattatcatcgagatcatcgagaagacggagataatcaggcagcagggcctggcatcctatgattatgtccggcgcagactcaccgcggaggacctcttcgaggcccgaatcataagcctggagacctacaatcttctgcgcgagggcaccaggtcgttaagggaagctcttgaagccgagtccgcttggtgctacctgtacggcactggcagcgttgccggagtgtatttgccggggtccaggcagaccctgtctatttaccaggcacttaagaaagggctactcagcgccgaagtggcccgccttctcctggaggcgcaggcggctacaggcttcctactggacccagtgaaaggcgaacgcctgaccgtggatgaggccgtgaggaagggcttggtgggacctgagctccatgacagacttctcagcgcagaaagagccgttacaggctacagagatccctacactgagcagactatttcgttgttccaggctatgaagaaggagcttatcccaacggaggaggcactgcggttgctggacgctcaactcgccactggaggaatcgtggaccctcgactgggtttccatctgccgctggaagtggcttatcagagaggctacttgaacaaagatacccatgatcagctgtcagaaccctctgaggtgaggtcctacgtggatcccagcaccgatgagcggctgtcgtatactcagttgttacgcagatgcagacgcgacgatggcacaggtcagctcctcctccctctatcggacgccaggaagctgaccttcaggggtctgcgaaagcaaatcacaatggaagaactagtgaggtcgcaagttatggacgaggcgactgcactccagctgcgcgagggactaaccagtattgaggaggtgactaaaaacttgcagaaattcttggagggaacatcttgtatagcaggagtgttcgtcgatgcaactaaggagcgcctgagcgtctatcaggccatgaaaaaaggtattattcggcccggcaccgcattcgagctcctggaggcgcaagctgccactgggtatgtgattgatccgatcaaaggtctgaagctcaccgtggaagaagcggtcaggatggggattgtaggtcccgagttcaaagacaagcttctcagcgccgagagagcggtcacaggttacaaggacccttactctgggaaactgatttcactgttccaggcgatgaagaaggggctgatcctcaaagatcatgggatccgcctcttggaggctcagattgcaaccggcggcatcattgatccagaggagagtcaccgactaccagtggaagtcgcttacaagagagggctgttcgatgaggaaatgaatgagatcttgactgacccctccgacgatactaagggcttcttcgacccaaacacagaggagaatctgacgtacctacagctgatggagcgctgcatcactgaccctcaaacgggactgtgcctgctgcccctaaaagaaaagaaaagagaaagaaagacatcctctaagtcctcggtgcgtaagaggcgtgtggtgatcgtcgaccccgagactggcaaagaaatgagtgtttacgaagcatacaggaagggcttaatcgatcaccagacctacctggaactatcagagcaggaatgcgaatgggaagagattaccatctcgtctagcgatggagttgtcaaaagtatgattattgaccggcgctcaggccggcagtacgacatcgacgatgccattgctaaaaatctgatcgaccggtccgccctggatcagtacagagcgggcacactttctatcacagagtttgcagatatgttatctgggaatgctggcggattccgatccagatcaagttcagtgggctcttcctcctcttatcccatctctcccgcagtttcgcgaacccagttggcaagttggagcgaccctaccgaggagaccggcccagtggctggcatacttgacaccgaaactctcgagaaagtatcaattactgaggctatgcaccgcaatttggtggacaatataaccggacaaaggctgttagaagcccaggcctgtacgggggggatcatcgacccctcgacaggcgaaaggttccctgtcacagacgccgtgaacaaggggctagtggacaagataatggtggatcgtatcaatttagctcagaaagcattttgcggttttgaggaccctcgcaccaaaacgaagatgagtgctgcacaggccttgaagaaaggctggctttactacgaggctggccaacgatttctggaggtacagtacctgactggtgggttaatagagcctgatactccagggagagttcctctcgacgaggctttgcaaagaggtacagtggacgccagaaccgcccagaagctccgcgacgtgggagcctactcaaagtatctgacgtgccctaagacaaaactcaagattagctacaaggacgcattagatcggagtatggtggaagagggcaccggcctgagactattagaagccgccgcgcagagcactaaaggctactacagtccctactctgtgtctggatccggctctaccgcaggaagcaggactggcagcagaaccgggtcccgggccggcagtagacgcgggagtttcgacgccactgggtctggtttttcaatgaccttttctagttccagttactcctcgagtggctatggtaggagatacgccagcggttccagtgcctctctggggggcccggaatctgctgttgcatag

SEQ ID NO: 129014 - DNA, 13644 bp, Artificial Sequence
  Description of Artificial Sequence: Synthetic coding sequence
atggaaccttcaggtagtctctttccttctctcgtcgttgtgggccacgtcgttactctggccgccgtgtggcactggcgtagaggccgcaggtgggcgcaggacgaacaggatgaacgcgaccgggttcagaaaaagaccttcacaaaatgggtgaacaagcatcttatcaaagcccagaggcatatctccgatctctacgaggacctcagggacggtcacaacctaattagcctgctggaggttctcagcggcgactcactccctagagagaaagggaggatgcgctttcacaaattgcagaatgtgcaaatagccctcgactacctcaggcaccgccaggtgaaactcgtgaacatcagaaacgacgatatcgcagacggcaaccccaaactgaccctcggattgatctggacaattattctgcacttccaaatttctgacattcaggtgtctggacaatcagaggacatgactgctaaggagaaactcctgctctggagtcaaagaatggtggaaggataccaaggactgcggtgcgataatttcacctctagttggcgcgacggtagactgtttaacgctatcatccatagacataagcccctcctgatcgacatgaataaggtataccgccaaacaaacctcgagaatctggatcaggctttctcagtcgctgagcgggatcttggagtcacccggctgcttgacccagaagatgtggacgtgcctcagccagatgaaaagtccataattacctatgtatcaagtctatacgacgccatgcctcgagtgcctgacgtgcaggacggcgtgagggccaatgaactccagctccggtggcaggaatatagagagctggtgctcctgctgctgcagtggatgagacaccacacggcagccttcgaagaaaggagattccccagcagttttgaggaaatcgaaatcctgtggtcacaatttctcaaattcaaggaaatggagctacctgccaaggaagccgataagaataggtcaaagggaatctaccagagcctagaaggcgccgtccaggcagggcagctgaaagtccctcctggctaccatccattagacgttgagaaggaatgggggaaactgcacgtggccattttagaacgagaaaaacaacttcgaagtgagttcgagaggctagagtgccttcagcgtattgtcacaaaattacagatggaggctgggctgtgcgaggagcaactgaaccaagctgatgcattgctccagagtgatgtgcgcctgctggccgctggcaaagtgcctcagcgggccggggaagttgagcgagacttagataaagccgactctatgattaggctcttattcaacgacgtacagactctgaaggatggtcggcacccccaaggtgagcaaatgtacaggagggtgtaccgcctccacgagaggcttgtcgccatcagaaccgaatataatctgcgcctcaaggccggagtagccgcacctgccacccaagtagcccaggttacgctgcagagtgttcagcggcgaccagagctagaggactcaacactccggtatctgcaggacttactggcctgggttgaggagaaccagcaccgcgtggacggagcagagtggggcgtggatctcccttccgtcgaggctcagctgggttctcatcggggattgcatcagagtattgaggaatttcgtgctaagatcgaaagagctaggagtgatgagggacagttaagtccagctaccagaggcgcttatagagactgtctagggaggctggacttacagtacgccaagctcctgaacagctccaaggccagactccgaagcctggagtcactgcattcattcgtagctgcagcaaccaaggaactaatgtggctgaatgagaaggaggaagaagaggtggggttcgactggagcgacaggaatacgaatatgactgctaagaaagagagctactcagctctgatgagagagctggagctgaaagagaagaagatcaaagaactgcaaaacgcaggcgacagattactgcgtgaagaccatccagcccggcctaccgtggagtccttccaagctgctctccagacacagtggtcatggatgctccagttatgctgttgcatcgaagcacacctgaaagaaaacgcggcctatttccaattttttagcgatgttcgcgaggccgaagggcagctacagaagctgcaagaggccctgcgtcgaaaatacagttgcgatcgttctgccaccgtcacccgcctagaggacctgcttcaagacgcccaggatgagaaagaacagctgaatgagtataaagggcatttgagcggtcttgctaagcgcgcaaaggccgtggtccaactgaaaccgagacaccctgcccacccaatgcgcgggcggcttccattactagctgtttgcgactacaaacaggttgaggtgaccgtccacaagggtgatgagtgtcaacttgttggccctgcccagccatcccactggaaggtactgagcagctctggaagcgaggcggccgtcccttccgtgtgttttctggtcccccctcctaaccaggaagcgcaggaggccgtcaccagactcgaggcccagcaccaagcactcgtgacgctgtggcaccagctgcacgtcgatatgaaatccctgctagcctggcagagcttgaggagagacgtacagctgattaggtcctggagccttgctaccttccggacactgaagccagaagaacaacgacaggccctgcactctctagagctgcattaccaagctttcttgagggattctcaggatgcgggggggttcggccccgaggatcggcttatggcggagcgagaatacggaagttgctctcaccactatcagcagttactgcagagccttgagcagggtgctcaggaagaatctagatgccaaagatgcatctctgaacttaaagatattaggctacaacttgaagcgtgcgagacacgcactgtgcatcgtctgcgcctgcctctggacaaagaacctgccagagagtgcgcacaacgcatagcagagcaacagaaagcccaagctgaggtggaggggttaggaaaaggtgtggcccgactgtcagctgaagctgaaaaagttctggcactgcctgagccttccccagccgcaccaactcttcgttcggaactcgagctgacactaggaaaactggagcaggtgaggtccctgtctgccatttacctggaaaagttgaaaacaatcagcttggttataagaggcactcaaggcgccgaggaagtgttgagggcacatgaagagcaactgaaggaggcacaggcagtcccagcgacacttccggaactggaggcgacaaaggcctccctgaaaaagctgagggctcaggccgaggcccagcagccaaccttcgacgcgctgcgtgacgaactgagaggtgcccaggaggtgggggaacggctgcaacagaggcatggcgagcgggacgtggaagtcgagagatggagagaaagggtcgcacaattgctggaacgatggcaggctgtcctggcacagacggatgttagacaacgggagctcgaacagctgggtcgccagcttagatattatagggagtctgcagatcccctcggggcatggctgcaagacgcaaggaggcggcaagagcagattcaggctatgcccttggccgacagccaggccgtgagggagcagctgcgccaagaacaagcacttttggaggagattgagcgccatggggagaaggttgaagagtgccagcggtttgcaaaacagtatatcaatgcaattaaggattacgagctgcagctggtgacttacaaggcccagctggaacctgtagcctctcccgccaaaaagcccaaagtgcagtccggttctgaatctgttatacaggagtacgttgacttgcggacacattactctgaactgaccactctgacatcccagtacattaagtttatttccgaaactctgcgtcgaatggaggaggaagagcgtttagccgaacagcagagggccgaagagagagagagacttgcagaggtggaggccgccctagaaaagcagagacagttagccgaggcacacgcacaagctaaggcccaggcagagagggaggctaaagaactgcaacagagaatgcaagaggaggtggtgaggagagaggaggcggctgtcgacgcacagcagcagaaacgctctatccaggaggaactgcaacagcttagacagtcttctgaggccgaaatccaggcgaaggctcgtcaggccgaggcagccgaacgcagtagactccgtatcgaagaagagatccgagttgtcaggcttcagctggaagccactgaaaggcagaggggaggtgcagagggagaactacaggcactgcgcgcaagggccgaagaagcagaagcccagaagagacaggcccaagaagaggcagaaaggcttcgcaggcaagtgcaggatgagtcacagaggaaaaggcaggccgaggtcgagctggcctctagggtcaaagccgaagccgaagcagcgagggaaaagcaacgcgctctgcaagcactagaagagcttaggctccaagcagaggaggctgaacgccgactcaggcaggctgaagtggaacgtgctaggcaagtgcaggttgccctagaaaccgcccaacgttcagctgaggcagagctacaatccaagcgtgcttcattcgccgaaaagacggcccagttggagcgctccctgcaggaggaacacgtggccgtcgcccagctccgggaggaggctgagcgccgggctcaacaacaggccgaagccgagagggcacgcgaggaggcagaaagggagctggaaaggtggcagttgaaggcgaatgaagcgctgaggctgagactccaggcagaggaagtggctcagcaaaagagcctggctcaggccgaggctgagaagcaaaaagaagaggccgaaagagaagcccggcggcgagggaaagctgaggaacaggcagttcggcagcgggagctcgctgaacaggaactcgaaaagcagcgtcagctcgctgaaggcacagctcagcagcggctggccgccgagcaggagctcatccgcttgcgcgcggagacagaacaaggggaacagcagaggcagctccttgaggaggaattggccagactgcagagagaggccgcggcggcgacccagaaaagacaggagcttgaggccgaacttgcgaaagttagggcagaaatggaagttctgctggcgtccaaagcgagagccgaggaagagagtcggagtacctcagaaaaatctaaacagagactggaagccgaggctggccgtttcagggaactggccgaggaggctgctcggctgcgggccctggccgaggaggccaaacgccagaggcagctggctgaagaggacgctgcgcggcagagggcagaggctgaacgtgttctcgcggaaaagttggcagctatcggtgaggccacccgcctgaagacagaggcagagatcgcactgaaagagaaggaggctgaaaacgaaaggttacgccgcctggcagaggacgaagcattccagcggcggagactggaagagcaggcagcccagcacaaagccgacatagaggaacggctggcacagctgagaaaagcttcggatagtgagctagaaaggcagaaagggctcgtggaggatacacttaggcaaaggagacaagttgaagaggaaatccttgccctgaaagccagtttcgagaaggcggcggctgggaaggccgaactggaactggaactgggccggatccggagtaatgcagaagatacgctccgaagtaaagaacaagcagagctggaagcagcgcggcagagacagttagcagcagaagaggaacggaggcgtcgagaggcagaggaacgcgtacagaagtctctggcggctgaagaagaggccgctcgccaacgaaaagctgccctggaagaggtcgaacgtcttaaagctaaagtggaggaggcccggcgcctcagagagagggctgagcaggaatcagccagacagcttcaactggcacaggaggccgcacaaaaaaggctacaggccgaggagaaggctcatgctttcgctgtgcagcagaaggaacaagaactgcaacaaacgcttcaacaggaacagtccgtactggatcagctgagaggcgaagccgaggctgcccgacgcgctgccgaggaagcagaggaggcccgcgtgcaggccgagcgggaagcagcccagagtcggagacaggttgaggaagcagagaggctgaagcagagcgccgaagagcaggctcaggctagggcgcaggcccaagccgcagcggaaaaactgaggaaggaagccgagcaggaagctgccagaagagcccaggctgagcaagctgccctgcggcagaaacaggccgcggatgctgaaatggagaagcacaagaaatttgctgagcaaacccttaggcaaaaagcccaggtcgaacaggaactaaccaccctccgattgcaactagaggagactgatcatcagaaaaacctgctggatgaagagttgcaaagactcaaggccgaggccaccgaggccgccaggcagaggtctcaggtcgaggaggaattattcagcgtacgagttcagatggaagagttatccaagcttaaagctcggatcgaagccgagaaccgcgccctgattttgcgcgacaaggacaacactcagaggttcttgcaggaagaggcagagaagatgaaacaagtggctgaagaagcggctcgattgtcagttgccgcccaggaagccgcccggctacgccagttggccgaggaagacctcgcccaacagcgggcccttgccgagaaaatgctgaaggaaaaaatgcaggctgtccaggaggcaaccaggttaaaggctgaagctgaattgctgcagcaacagaaagaactggcccaggagcaagctagaagactgcaggaggataaggagcagatggcccagcagcttgccgaggaaacgcagggtttccaacggaccctggaagccgagcgccagcggcagctggagatgtctgctgaggccgagcgactgaagctcagggtggcggagatgtcacgtgctcaagcacgggcagaagaggacgcgcagcgcttccgcaagcaggcagaggagatcggggagaagctccaccggaccgagttggcaacccaggaaaaagtaacactcgtgcagacgctcgagatccaaagacaacaaagcgaccatgacgcagaacgactcagagaagcgattgcagagctcgagagggaaaaggagaaactgcaacaggaagcgaaactgctgcaacttaaaagcgaagaaatgcagactgtccaacaagaacaacttctgcaggagacacaggccctccagcaaagttttctgagcgaaaaggatagcctgttgcaacgcgagagatttattgaacaagaaaaggcaaagctcgaacagctcttccaggatgaggtggctaaggcgcagcagctacgagaggaacagcagcgccagcaacagcagatggagcaagagcggcaaagactggtagcctctatggaggaggccaggcggcgtcaacacgaggcagaagagggggtgcgcagaaaacaagaggaactccaacagctcgaacagcagcgacggcagcaggaggaactgctcgccgaggaaaatcaacgactgcgcgaacagttacaactgttggaagagcaacacagagctgctctggcgcatagtgaagaggtgactgccagtcaagtagctgccacaaagacactcccaaacggacgggacgctctggatggacctgccgccgaagcagagcctgagcattcctttgatgggttgagaaggaaggtctctgctcagcgcctgcaggaggcagggatcttgagtgccgaagagctgcagagactcgcacaaggccacacaaccgtcgacgaactagccaggagggaggacgtccgtcattacctccagggaagatcttccatagccggtttgctgctcaaagcgacaaacgagaagctgagtgtgtacgcagctttgcaacgacagctgctgtctccagggaccgctctgatactactggaggcacaggccgcctctggtttcctcttggatcctgttcgaaaccgacggctgacggtcaacgaggccgtcaaggagggggttgtcggaccggagctccaccacaagctcctgtccgcggaacgagctgtgactggctacaaggatccatacaccggccagcaaatttctctttttcaggcaatgcaaaagggacttatcgtaagggaacatggtatcaggttgcttgaagcacaaatcgccaccggtggggtgattgaccctgtgcatagccatcgggtgccggtggacgtcgcgtacagacggggctattttgacgaagagatgaatcgagtcctggctgatcctagcgatgataccaaggggttcttcgaccctaacacacatgagaatctaacatacctgcagctgctggagcgctgcgtagaggacccggagaccggcctgtgcctgctgccactgaccgacaaagccgcaaaaggcggagaactagtctatacagactcagaggcccgcgacgtgttcgaaaaggccactgtttccgcccctttcggcaagtttcaaggcaaaactgtcaccatctgggagatcataaactcggagtatttcaccgccgaacagcgccgcgacctgttgaggcaattccgcaccggtcgcatcacagtcgagaaaatcatcaaaattattatcactgttgtggaggagcaggagcagaagggccgactgtgctttgagggattgaggagtctggtgccagcagcagagttgctggagtctagggtgatcgacagagagctctaccagcagttgcagaggggtgagaggagcgtgagagatgtagccgaagtggacactgtgcgccgcgccctgagaggagccaacgttatagccggcgtttggctcgaggaggcaggccagaagctttccatctataatgccttaaagaaagatctgctcccctcagacatggccgtcgcactgcttgaggctcaggcaggaaccgggcacatcatcgaccccgctaccagtgccaggctcactgtggacgaggccgtcagggccggcctagtcggaccagagttccatgagaagctcctcagcgcagaaaaggccgtcacgggctatcgggatccgtatactggacaatcagtaagtcttttccaggctctcaagaaaggacttatacccagggaacagggactgcggctgttagatgctcagctttccacgggagggattgtggacccgtctaagagccaccgcgtcccgctggacgtggcttgcgccagaggctgcttggacgaggagactagccgcgccctgagcgcccccagagccgacgcgaaggcgtactccgaccctagcaccggcgagccagcaacttatggcgagctacagcaaaggtgtcggcctgatcagttaaccggcctcagccttctacctctcagtgagaaagcagctagggcgcgccaggaggagctgtacagcgagctgcaggctcgcgagacttttgagaagacccccgtggaagtgccggtaggtggctttaaaggacggactgtgaccgtatgggaactcatcagctcagaatattttactgccgagcagcggcaggaactcctaagacagttccggaccggcaaagtcaccgtggaaaaagtgatcaagatcctaatcaccatcgtcgaggaggtcgaaacactcagacaagagaggttgagcttctcgggcttacgcgcccctgtgcccgcctcagagctcctggcgtccggagtgctgagcagggcgcagttcgaacagctcaaagacggaaagaccaccgtaaaagacctcagcgagctggggtctgtccggactctgctccagggctctggatgcctggccggcatttatttagaagacaccaaggagaaagtttccatatacgaggcaatgagaaggggcctgctcagagctacaacggcagcccttctgctggaggctcaggcagctaccggctttctggtggaccctgtacgcaatcaacgtctgtatgttcatgaagcagtgaaggccggtgtggtgggtccagaactgcacgagcagctgctgtccgccgaaaaagccgtcacaggatacagagacccctacagcgggtccacaatttccctgttccaggcaatgcaaaagggattagtcctcaggcagcatggaatacgtctgctggaggctcaaatagctactggtggaatcattgatcccgtgcattcacaccgggtcccagtggatgttgcctatcagagaggttatttctccgaggagatgaacagggtgttggccgacccaagcgacgacactaagggcttctttgaccccaatacccatgaaaacctcacctatcgtcagcttctcgaacggtgtgtagaggaccccgagacggggttgagattgctgcctctgaagggcgccgaaaaagcggaggtggtggagacgactcaggtgtacaccgaagaagaaacacgtagggcgtttgaggagacccagatcgacattcctggaggaggcagtcacggcggttcaaccatgagcctctgggaggtgatgcaaagtgacctcatcccagaagagcagcgggcccagctaatggcggatttccaggctggtagagtcaccaaagaacggatgattatcattatcattgagatcatagagaagaccgagattattcgccagcaaggcttagcctcctacgattatgttaggcgcagactgactgcggaggacctgttcgaggcaagaattattagcctggaaacctacaatctccttcgggaggggacaagatccttgcgcgaggcccttgaggctgagtctgcctggtgctatctgtacggcaccggaagcgtggcaggagtgtacctgcccggatcaagacagacgctgtcgatctaccaagccctgaagaagggtttactgtcagccgaggtggcgcgactcctgttggaggctcaagccgctaccggatttctcctggatcccgtgaagggggagaggctcactgtcgatgaggcggtgcggaagggcctcgtggggccagagctccacgataggttgctgtctgcagagcgggccgtgaccggatatcgcgacccttacaccgaacaaacaatcagtctgttccaggctatgaagaaggagctgatacccacagaggaggctttaaggctcttagacgcacagttagccactggtggaattgtagatccaaggctaggtttccacttgccattagaggttgcctatcagagagggtatcttaataaagatacacacgatcaactgagcgagccaagcgaggtaaggtcttacgtggatccgtcaacggatgaacgactgtcctatacacagctgctgaggcgatgccgcagggacgacggcacaggccagctgctcttaccgttatcagacgctaggaagctgacatttaggggcttacgaaaacagattacgatggaggagctggtgagaagccaggtgatggatgaagctaccgcgctccagcttcgagaaggactcacatcaatagaggaagttaccaagaacctacaaaagttcctggaaggaacttcttgcatagctggtgtcttcgtagacgctaccaaagagcgactatcggtctaccaggcaatgaaaaaaggcatcatccgcccaggcacggcatttgagctgctggaggcccaggcggccacaggctacgtgattgatcctatcaaggggctgaagcttactgtggaggaggctgtgcggatgggcatcgtgggaccagaattcaaagacaaactgctgtcggccgagagggcagttacgggatacaaggatccatactctggcaagctcatcagtctgtttcaggccatgaaaaagggcctgatcttgaaggaccatgggatccgattactggaagcccagatagcgactggcggcatcatagatcccgaggagtcgcacaggctcccagtggaggtggcttacaagcgcggattgttcgacgaggagatgaacgagattctgacagacccttcggatgatacgaagggcttctttgaccctaacaccgaggaaaacttaacatatctgcagctcatggagcgctgtattacggacccacagacgggcctgtgtcttctgccgctcaaagaaaaaaagcgggagcggaaaacgtcttctaagtccagtgtacgcaaacggcgagttgtcatcgttgatcctgagaccggcaaggagatgtccgtgtacgaagcgtatagaaaaggtttaattgatcaccagacctacctagagctcagcgaacaggagtgcgagtgggaagaaattaccatttcctcatccgatggcgtcgtgaaatcgatgatcatcgaccggcgatccgggcgccagtacgatatcgatgatgccatcgcaaagaacttgatcgataggtcagcccttgaccagtaccgcgccggtacgctgagtattaccgaatttgctgacatgctgagtggaaatgcaggcggcttcaggagtcgttcctcgagcgttggatctagttcaagctaccctatctcgccagcagtgagcaggacacaactcgcctcatggtcagatcctaccgaggaaacgggaccagtggccggaatcctcgataccgagacgctggagaaagtgtccatcactgaggctatgcatcgaaatctagtggataacataaccggacagagactgcttgaggctcaggcctgcaccggcggaataatcgatccatctaccggcgagagatttcctgtgacggatgcagtgaataaaggcctcgttgataagataatggtagaccgcattaacctagcgcagaaggccttttgcggctttgaagatcccaggactaagactaagatgagcgccgctcaagcattgaaaaaaggatggctgtattacgaagccgggcagcgcttcctggaagtgcaatacttgaccggggggctgattgagcctgacacacccggacgggtgcccctcgacgaggcactgcagcggggtacagtggatgcccgtactgcccagaaactccgggacgtcggcgcctactccaaatatctgacttgccccaaaacaaagctcaagatcagttataaagatgcactggatcgttctatggtcgaagaggggaccggattacggttgctggaggcagcagcccaatccaccaaggggtattactccccttactcggtgtcaggcagtgggagcaccgctggcagcagaaccggctctaggacaggtagtagggccgggtccagacgaggctcttttgacgcaactggctccggattcagtatgacattttccagcagctcctattcaagttctggctatggccgcagatacgcttccgggtccagcgcgtccctgggaggccccgagtcagctgtggcatag

SEQ ID NO: 129015 - DNA, 13578 bp, Artificial Sequence
  Description of Artificial Sequence: Synthetic coding sequence
atggacccctcacgggccatccagaacgagatctcttcgctaaaagacgaacgcgatcgggtgcagaaaaaaaccttcacaaaatgggtgaataaacaccttattaaagctcagcggcatatctctgacttgtacgaggatctgcgcgacggacataacctcatctccctgctggaggtcttgagtggtgactcattgcctcgagagaaagggagaatgcggtttcacaaactccagaatgtgcagatagccttggattatctgcgacaccgacaagtcaagctggtcaatattagaaacgatgacattgccgacggtaatcctaagctgacgctgggattgatctggacgatcattctgcactttcagatttccgacattcaagtgagtggtcagtcagaggatatgacggccaaggagaagttgctgttatggtcacagcgcatggtggagggttaccagggactgcgatgcgacaactttacctccagctggagagatggcagactgtttaatgccatcattcaccggcacaagcctttactcatcgacatgaacaaggtttaccgtcagacaaacctcgagaatctcgatcaggccttcagtgtggccgaaagggatctcggcgttacccgactgcttgacccagaggatgttgacgtcccccagccggacgaaaagtcaatcataacctacgtttctagtctatacgacgcgatgccaagagtgccagacgtacaggatggagttcgggctaatgaactccagctgcgatggcaggagtatagggagttggtcctgctgctgctacagtggatgaggcaccacaccgccgcctttgaggaacggcgatttccaagcagcttcgaagagatcgagatcctctggtcccagtttctaaagtttaaagagatggagttaccagctaaggaagccgataagaaccggtccaaagggatctaccaatcactcgagggggccgtacaggcaggtcagctgaaggttccccccgggtaccaccctcttgacgtggaaaaggaatggggaaaattacatgtggccatcttggaacgggaaaagcagctccggtccgagtttgaacgcttagagtgtcttcagaggatagtgacgaaactccagatggaggcagggctgtgtgaggagcagctaaatcaggccgacgctctgctccagagtgacgttaggctgcttgccgcggggaaggtgccccaacgggccggcgaggttgaacgcgatctggataaagcagatagtatgatcaggctgcttttcaatgacgtgcagactttgaaggatggacgacacccacagggcgaacagatgtaccgtagggtgtacagattacatgagaggctggtggcaattaggaccgagtacaatctgagattgaaggccggggtggccgcccctgcaactcaagtggcccaggtgaccttgcagtcagtccagagaaggcccgaactggaggatagcacgctgaggtatctgcaagatctcctcgcgtgggtggaggaaaaccagcaccgggtggatggagccgaatggggtgtggaccttcctagtgttgaggcccagctgggcagtcatagggggctccatcagtcgattgaggaattccgagcaaaaatcgaaagggcccgctcggacgagggtcagctaagtccagctaccaggggggcctacagagactgtttaggcaggttggatctacaatacgccaaactactgaacagttccaaagccaggttgcgatccctggagtcgctgcacagtttcgtggcagccgcaactaaagaactgatgtggctgaacgaaaaagaagaagaagaagtggggtttgattggtccgataggaacacaaacatgaccgcaaagaaagagagctacagcgcccttatgcgggaactcgagctcaaggaaaagaagattaaggagttgcagaacgctggcgacagattacttcgagaggatcatcccgcaaggccaaccgtggaatcctttcaagccgccctacagacacagtggagttggatgctgcagttgtgctgctgcatagaggcccacctgaaggaaaatgctgcctacttccagttcttctccgatgtgagggaggcagagggacagctgcagaaattgcaagaggccctgcggaggaaatacagctgcgaccgttctgccactgtaacccgcctcgaagacctgcttcaggacgctcaggacgaaaaggagcagcttaatgagtacaagggacacctgagcggcctggccaagagggctaaagccgtcgtacaactaaaaccccgacacccagcccaccccatgcgcggaaggctgcctctcctggctgtctgtgactataagcaggtggaggttaccgtccacaagggcgacgagtgccagctggtgggacctgctcaaccaagtcattggaaggtgctcagttcctcgggcagcgaggccgccgttccatcagtgtgctttctggttccacccccaaaccaagaagcacaggaggctgtgacccgcctggaagcacagcaccaagctctggtaacgctttggcaccagcttcatgtcgatatgaagtctctgctggcttggcaatcactgcgccgggacgtgcaactgattcggagttggagcctggcaacatttcggactctgaagcctgaggagcagcgtcaggccctgcattcactagaacttcactatcaggccttcctgcgcgatagccaggatgcaggagggtttggtcctgaagaccgactcatggccgaaagagaatatggatcatgcagccaccattatcagcagcttcttcagtccttggaacagggggcccaggaagaatctagatgtcagcggtgcatttctgagcttaaggacatacgcttacagctggaagcctgcgaaacacgtacggtgcacaggcttcggttgccactggacaaggaaccggctagggagtgcgcccagaggatcgcggaacagcaaaaggcgcaggccgaggttgagggccttggaaaaggagtggcaagactgagcgctgaggccgagaaggtcctggcactgccagaaccttcgccagccgcgcccaccctgcgcagcgaactggagctaactctgggcaaactggagcaggttcgatcactgagtgccatctaccttgagaaactgaaaaccatcagtctggtgatcagaggcacacagggggccgaagaggtcctgagagcccacgaagagcagctgaaggaggctcaggcagtccccgcaactttaccagagttagaggcaacgaaggccagtctgaagaaactcagagcacaggctgaagcccagcagcccacttttgacgctcttcgggatgagttacgaggcgcccaagaggttggtgagagactgcagcagcgacatggggaaagagatgttgaggtcgaaagatggagggaaagagtggcgcagctgctggaaagatggcaggcagtgctggcccaaactgatgtccgtcagagggagctcgagcagctgggtagacagctgcggtactatcgtgaatctgccgatccattgggcgcatggttgcaagacgcccggcgtagacaggaacagatccaggccatgccactcgccgactcccaggctgtgcgtgagcagctgcggcaggaacaggccctcctcgaggagatagagcggcatggtgagaaggtcgaggagtgccagagattcgccaagcagtatattaatgctattaaagattacgagctgcagttggttacgtataaagcgcagctcgagcccgtcgccagtcccgccaagaaacccaaggtccagtcaggatccgagtccgtgatccaggagtatgtggacctgcgcacacactatagcgaactgactacactgacttcccaatatattaagtttatttcagagactctgagacgcatggaggaagaggaacgcctggcagagcagcaacgggccgaggagcgggaaaggttggccgaggttgaggctgcacttgaaaagcaacggcagctagccgaagcgcacgctcaggccaaagcccaagccgagcgagaagccaaggaactgcagcaaaggatgcaggaagaggtggtgaggagggaggaggccgcagtggatgcacagcagcaaaaacggtctatccaggaagagctccaacagctgcgtcagtcgagcgaggccgaaatccaagccaaggcccgccaggccgaagctgccgagcggagcaggctccgcattgaagaggaaattagggtcgtgagactccagttagaggccacggagcgacaacgaggcggcgcagaaggggagctgcaagccctgagggcgagggccgaagaggccgaagcccagaagcgccaggcgcaggaagaggcagagaggctccggaggcaagtgcaagatgagtcgcagagaaaacggcaggccgaggtcgaacttgcaagccgcgtgaaggcagaggccgaggccgcacgggaaaagcaacgggccctccaggctctggaggagttaaggctgcaagccgaagaggccgagagacgcctcaggcaggcagaggtggaacgagccaggcaggtccaggtggcactggaaaccgcacagcggagtgctgaggctgagctgcaaagcaagcgcgcaagttttgccgaaaaaaccgcacagttagagcggtccctgcaggaggagcacgtcgccgtcgctcagttgcgggaagaagcagagcgccgggctcagcaacaggccgaagcagagagggcacgtgaagaggctgagagagaactggagagatggcagttgaaagccaatgaggctctgagacttcgcctccaagcggaagaggtggcacagcaaaaaagtcttgctcaggccgaggctgagaagcagaaggaggaggcagaaagggaggctcgcaggcgaggaaaggccgaggagcaggccgtgcgccagagagaactggccgaacaggagctggagaagcaaagacaactggcagaagggacggctcagcagcgtcttgccgcagaacaggagctaatcagactgagggccgaaactgaacagggagagcagcagcgacagctgctggaagaggagctggcccggttgcaacgcgaagccgccgccgccactcaaaagcgacaagagcttgaagccgagctggccaaggtcagggcagagatggaggtactgttagctagtaaagctcgggccgaggaggagtctaggtcaactagcgaaaagtctaagcaaaggcttgaggcagaggcagggcggtttcgggagctggctgaggaagccgcgaggctgagagccctggccgaggaagcaaaacggcaacgccaactagccgaagaggatgcggcacggcagcgagcggaggccgagcgggtgttggcggagaagctcgccgcaatcggcgaggctacacgactaaagaccgaagctgagatagcgctgaaggaaaaggaggccgagaacgagcgacttagaaggcttgcagaagacgaggccttccagcggcggcgcctggaagagcaagcagctcagcataaagcagatatagaggaaaggttggcccagcttcggaaggccagtgacagcgaactggagcgccagaaggggttagtggaagatacactgaggcagaggagacaggtggaggaagagatactcgctctcaaagcctcctttgagaaggctgcagcggggaaagcagagcttgaactagaactgggcaggattagatcaaacgctgaagacaccctgaggtcaaaggagcaggccgagctcgaagccgccagacaacgacagctggcagctgaggaggagcggagaaggcgcgaggccgaggagcgcgtgcagaaatcacttgccgccgaggaggaagcagcccgtcagagaaaagctgctctagaagaagtagagagactgaaagccaaggtcgaagaagcgcgccggctccgggaaagggcagagcaggaatcagcacgccagctgcagctggcgcaggaggccgcgcagaagcgccttcaggctgaggagaaagcccacgcatttgccgtccagcagaaagagcaggagctccagcaaacactccagcaggagcaaagcgtcctggaccaactgcgaggcgaagcagaggccgctagacgcgcggccgaggaggcagaggaggcaagagtgcaggcagagagggaggcagctcagtccagaaggcaggtagaggaagccgagaggctaaagcagtcggctgaggagcaagctcaggcacgtgctcaggctcaagctgcggctgagaagctgagaaaggaggcagaacaggaagctgcgcgtagagcccaagctgagcaagcggcgctacgtcagaagcaggctgccgatgccgaaatggaaaagcacaagaagtttgccgagcagactctgaggcagaaggcccaggtcgagcaggagctcacaacactgagactacagctggaggagacagatcatcaaaaaaacctccttgatgaagaacttcagcggctgaaggccgaggccaccgaggccgcacggcagcgcagccaggtggaagaggaactgtttagcgttcgagtgcagatggaggaactttcgaaactgaaagctcgaatcgaagcggaaaatcgcgctctgattctgagggacaaagataatacacaacggtttctccaggaagaggccgaaaagatgaagcaagtagcagaagaggccgccagactgtccgtcgcagcacaggaggcagcgagattgcgtcaacttgccgaggaagatctggctcagcagagagcactagcagagaagatgctgaaggagaagatgcaggcagtgcaggaagccaccagactaaaggctgaagccgagttactccaacaacagaaagagttagctcaggagcaagcaagaaggcttcaagaggataaagaacaaatggcccaacagttggcggaagagacacagggcttccagcggactctcgaggccgaaagacagagacaactcgagatgtctgccgaggctgagagattgaaactgcgtgtcgccgagatgagccgcgcacaggctcgggccgaagaggacgctcagagattccgtaaacaagccgaggaaattggtgaaaagctgcatcggaccgaattggctacacaggagaaggtcaccctggtccaaacattagagatccaaaggcagcaatctgatcatgacgcagaaaggctacgggaggccatcgctgaactagagcgggagaaggaaaaactgcagcaggaggcaaagctactccaactgaagtcggaggagatgcagacagtccagcaagagcagctccttcaggagactcaagccctccagcagtctttcctatccgaaaaagatagcctgttacagcgcgaaaggttcatcgagcaggagaaagcaaaactcgaacagttgttccaagacgaagttgcaaaggcccagcagctgagggaggaacagcaacgacaacaacagcagatggaacaggagagacagaggcttgtagcttccatggaggaagctcgcagaagacaacacgaggcagaagaaggggtccggcggaaacaggaagagttgcagcagttagaacagcaacgaagacaacaggaagagctcctcgccgaggaaaaccagcggcttagagagcagctgcagttactggaagagcagcatagggcagccctcgcgcattccgaggaggttacagcgtcccaggttgctgccacgaaaacactgcctaatggacgggacgccctcgacgggcccgcagcagaggccgagccagagcatagctttgatggcctccgacgcaaagtgagcgcacagcgactccaggaagccggtatcctctctgcggaggagcttcagagacttgcccaagggcacaccacagtggacgaacttgcaaggcgtgaggatgtccgacattatctgcaggggcgttcctccatcgccggtcttctactgaaggctactaatgaaaaactgtcagtttacgcggccttgcaaaggcaacttctttcaccagggactgcactgatcctgctcgaagctcaagccgctagcgggtttctgctggaccccgtcaggaataggagacttaccgttaacgaagcagtgaaggaaggtgtggtcggtccagagttacatcacaagctgttatccgccgaacgtgccgtgacagggtataaggatccttacactgggcagcaaattagtctttttcaggcaatgcaaaagggccttatcgtacgggagcacgggataagattgttagaagctcagattgccacaggaggcgtaattgacccagtccactctcatagggtccctgtcgatgtagcatatagacgggggtactttgacgaagagatgaaccgggtactggcggacccgtccgatgataccaagggcttttttgatcccaatacacacgagaacctgacatacctccaactcctggagcgatgtgtggaagatcctgagactggactgtgcctgttgccattgacagataaagctgccaagggcggagaactggtttataccgactcagaggcccgtgatgtttttgaaaaagccaccgtgtccgcgccattcgggaaattccaggggaaaacggtcaccatatgggagattatcaatagcgagtattttaccgcagaacagcgccgggacttgctgagacagttcagaacaggtaggattactgtggaaaagattattaagataataatcaccgtcgtggaagagcaggaacaaaagggacggctttgttttgaaggcctgcggtccctggtccctgccgccgagctacttgagtcccgggtcattgacagggaactctatcagcaactgcagcggggagagcggtccgtacgtgatgttgcggaggtagacactgtgaggcgagctctcaggggggctaatgttatcgcaggagtgtggctcgaggaagcgggccaaaagctgtcaatatataatgcactcaagaaagatctcttaccatccgatatggccgtggcccttctagaagcccaggctggaaccggccatattatcgatcctgcaacctcagccagactgacagtcgatgaggctgtgcgggccggtctcgtcggccccgagttccatgaaaaactactgtcggcggaaaaggccgtgactggctacagagacccctatactggccagagcgtatctctgtttcaagccttaaaaaaaggcctgatacctcgagaacagggactccgcctgctcgacgcccagctctccacggggggaattgtagacccttctaaatctcaccgcgtgcctctcgatgtcgcttgcgcaagagggtgcttagacgaggaaacctcaagggcattgagcgcgccccgggccgacgccaaggcttacagtgatccgagtaccggggagccagccacatatggggaactgcagcagagatgtagacctgaccaacttactggcctgagcttgctgcccttgtccgagaaggccgcccgcgctcggcaagaagagttgtattccgaactccaggcgcgggagacttttgaaaagactcctgttgaggttcccgtggggggatttaagggtcgcactgtaaccgtgtgggagctcatctcctctgagtacttcactgccgaacaacgacaggaactccttagacaatttaggactggaaaagtcaccgtagagaaggttatcaaaatcctaatcacgatcgttgaagaggttgagactctaagacaagaacgtctttcgtttagtggtctgcgcgcccctgttcctgcttcagagctgctggctagtggcgtcctgagccgtgcccaattcgagcagctgaaggatggcaaaactactgtgaaagatctctcagagctcggatcagtgcgaacactcctgcagggttccgggtgtctggccggtatctacctggaggacacgaaagagaaagtgtctatttatgaagcgatgcgtcgcgggcttttacgtgcgaccacagccgcccttctgcttgaagcccaagccgccacagggttcctcgtggaccccgtccggaatcaacggctctacgtccacgaggccgtgaaggccggggtggttggtcccgaactccatgaacaactgctgtcagctgagaaggccgtaacaggctacagggatccatatagcgggagcacaatttcactgtttcaagccatgcagaaggggctcgtgttgcggcaacacggtatcaggctgttagaggctcagatcgccaccggtgggattatcgaccccgtgcattcccatagagtgccggtggacgtggcttaccagcgtggttactttagcgaagagatgaatagagtgctagctgacccctccgacgacacgaaaggattttttgatccaaacacgcacgagaacttgacttatcggcagctgctggaacgatgtgtcgaggatcccgagactgggttgagacttcttccactcaagggggcggagaaggcagaggtcgtcgagacaactcaggtgtataccgaagaggagactcggcgggcattcgaagagacacagattgacatcccagggggcgggtctcacggcgggtcgacaatgagtctctgggaggtcatgcaatcagacctaattccagaggaacagagggcccagctgatggcagactttcaggccggccgagtgaccaaagaacggatgattatcatcatcatcgagatcattgagaaaacagagatcatccgacaacaggggttagctagttacgactacgtgagacggcgcctgacggccgaggacctgttcgaggcacgaataataagcctagaaacatacaatctcctaagggagggcacccggagccttcgggaagctctggaagcggagtcagcctggtgttacctgtatggtactggctcagttgcgggcgtgtacttgcccgggtcccggcagacgctttctatctatcaagccttgaaaaagggtctccttagtgccgaagttgcccgtctgctgctggaagcacaggccgcaacaggcttcttgctggatcctgtgaaaggagagcggctgacagtcgatgaggcagtcaggaagggcctggtcggccccgagctgcacgacaggttactgtctgcagaacgagctgtgacaggctacagggacccttataccgaacagactattagtttgttccaggcaatgaaaaaggagctcatccctacggaggaagcgctcagattgctggacgcccagctggctaccggcggcatcgtcgatcctaggttggggttccatctgccactggaggtggcatatcaaaggggctacctcaacaaggacacccacgaccagttatccgagccatctgaggtccgatcttacgttgatccgagcaccgatgagcgcctgtcatacacacagcttctgcgaaggtgtagacgggatgacggtaccgggcaattgttattgcctttgtccgatgcacggaaactgacatttcggggcctgcgcaagcaaatcaccatggaggagcttgtgagaagtcaggtcatggatgaagccactgctctccaattgcgggagggactgacatctattgaggaagtgactaaaaatcttcagaagttcttagagggtacatcatgtatcgccggagtttttgtcgacgccacaaaagagcgactatctgtgtaccaagctatgaagaaaggcatcatcagacctggtactgcatttgagcttcttgaggcccaggccgcaactggctacgtgatagacccaatcaagggtctcaaattaacagttgaggaggctgtgcggatgggcatcgtcgggcccgagttcaaagacaaactgctgtccgcagagcgcgctgtaacaggttacaaagatccgtacagtggcaaattgatttcgctctttcaggcaatgaaaaaggggctgattctgaaggaccatggaatacgcctcttggaggctcagattgctaccggaggaatcattgatccggaagagtctcacagactcccagtagaggtggcctacaagcgggggctgtttgatgaagagatgaatgagatcttaaccgaccctagcgatgacacgaaaggcttttttgatcccaatacagaagagaatcttacatatcttcagctgatggaacgctgtatcaccgacccacagactggcctatgccttcttcccttaaaagaaaaaaaaagggaacggaaaacttccagcaaatcatctgttaggaaaagacgcgtcgtgatagtggacccagagacaggaaaggaaatgtccgtgtatgaagcctacagaaagggtctcatcgaccaccagacctacctggaattaagtgaacaggagtgcgagtgggaagaaatcaccattagtagctctgatggagtcgtcaagtccatgatcatcgacagaagaagcgggcgccagtatgatatcgatgatgccatcgccaaaaaccttattgacaggtctgcattagatcagtatcgggccggtacacttagcatcaccgagttcgctgatatgctgagtggcaacgctggaggctttcgctctcgcagttccagcgtggggtcctcttcttcatatccaatctcccccgccgtcagccggacacagctggcatcatggagcgaccccaccgaggagaccggccccgtcgctggcattctcgacaccgaaactctggagaaagtgagcatcaccgaggcaatgcatcgaaacctcgtggataacatcacaggacaacgacttctggaggctcaagcttgtaccggtggcattattgatccctccacaggtgagcgcttccccgttacagacgccgtgaataaaggcttggtcgacaagataatggtggaccgtataaacctagctcagaaagctttctgtggctttgaagacccgcgaactaagaccaaaatgtctgcagctcaggcccttaaaaaaggctggttgtattatgaggctggccagaggttcctggaggtccagtatcttacaggaggtctgatcgagcctgacacgcctggtcgggtgcctctcgacgaagcccttcagcggggaaccgtggatgcccggaccgctcaaaagctgcgcgatgtcggagcatattctaagtacctgacctgcccaaagaccaagctgaagatatcctacaaagatgccctagatagaagcatggtggaggaaggcactggtctccgacttctcgaagccgccgcccagtctactaaagggtactacagtccttactcagtttcgggcagtgggtcaacagcgggatcaagaacagggtcgcgcactggttcccgggcagggtcaaggcgcggctctttcgatgccacaggctcggggtttagtatgaccttcagttccagttcctactcgtccagcggctacggcagacgctatgcctctggatcatcggcctccttgggtgggcctgaaagcgccgtggcatag

SEQ ID NO: 129016 - DNA, 13602 bp, Artificial Sequence
  Description of Artificial Sequence: Synthetic coding sequence
atggccggccccctccctgacgagcaggacttcatccaggcctatgaggaagtgcgcgaaaagtataaggacgagagggaccgtgttcagaaaaagacgtttaccaagtgggtgaataaacacctcatcaaagcccagagacacatctccgatctgtacgaggaccttcgagacggccacaacttgatcagcctgctggaggttctgagtggggacagcctccccagagagaaaggaagaatgaggttccataaactccagaatgtccaaattgccctggactatctccgccaccgccaggtgaagttagtgaacatccggaacgatgatattgccgatgggaaccccaaactaacacttggcctcatttggaccattatcttgcatttccaaatatccgacatccaggtttccggtcagagtgaagacatgactgctaaggagaagctcctgttgtggtctcaacgaatggtggaagggtaccagggcctgcggtgcgataatttcacaagtagctggcgggatgggcggttgtttaacgcaataatccacaggcacaagccactgctgattgacatgaacaaagtctataggcagacaaatctagaaaaccttgatcaggcgttcagcgttgcagaacgtgaccttggagtcactcgactcctggatcccgaggacgtggatgtcccgcagccggacgagaagtccattatcacttacgtgtcctccttatatgacgcaatgccccgggtgccggatgtgcaagatggtgtgcgggctaacgagttgcagttacggtggcaagaataccgggaactggttcttctgctgctgcagtggatgcgccatcacaccgcggcctttgaggagaggcgtttcccatcctccttcgaggagatcgagattctttggtcccaatttcttaaattcaaggagatggagctgccagctaaagaggcagataaaaacaggtcaaagggaatctatcagtcactagaaggagctgtccaggccggccagttgaaagtgcctcctggttaccaccctctggacgtggagaaggaatggggcaaactgcacgtagcgatcttggaacgcgaaaagcagctaagatctgagttcgaacggttggaatgtttgcagcggatagtcaccaagctgcagatggaggccgggctctgcgaggagcagcttaatcaggcagacgcgctgttgcaaagcgacgtaaggttgcttgccgctgggaaggtgccccagcgcgcaggagaggtggagagggacttggataaggccgactctatgattcgcctgctgtttaacgacgtgcagactttgaaggacggccgccaccctcaaggggaacagatgtataggcgtgtttacagacttcacgagcgtctggtcgctatcaggaccgagtacaatttgcgacttaaagctggcgtggcagctcccgccacccaggtggcccaggtgactttgcagagcgttcagcgccggcctgaactggaagattctacgctccgctacctgcaagacctgcttgcttgggttgaggagaatcagcacagggtcgacggagccgaatggggggtggacctgccatccgtagaagcccagttggggtcgcatcgtggactccaccagtccatcgaagagtttcgcgcaaagatagaaagggctaggagtgatgaggggcagctgtccccagcaacccggggggcttatagagattgtctgggacgactcgatttgcaatacgcgaagttgctgaacagtagtaaggccagactcagaagtctggagtctctccacagctttgtagcagcagccacaaaggaattaatgtggctcaacgagaaggaggaggaggaggtcgggttcgattggtccgatcgcaatacgaacatgacggccaagaaggaaagctacagcgctctgatgagggagctagaactgaaggagaaaaagattaaagaacttcagaatgccggggaccgcctacttagagaggatcaccctgctaggcccacagtggagtcttttcaggcagcgctgcagactcaatggtcctggatgctgcagctttgctgctgtatagaagcccacctgaaggagaatgcggcctacttccagtttttcagcgatgtaagagaggcagaggggcagctgcagaagctgcaagaggcattgagacgcaagtattcttgtgaccggtcagctacagtcactaggctggaggatctgttgcaggacgcacaggatgagaaagagcaattgaacgaatacaagggacatctgagtggactcgctaagcgtgcgaaggcggttgtccagcttaagccacgacatcctgctcatcctatgcggggaaggctcccactcctggctgtttgtgactacaaacaggttgaggttaccgtgcataagggtgacgagtgtcaattggtgggcccggcacagccttctcattggaaggtgctcagcagttcaggtagcgaggcagctgttccatccgtgtgcttcctagtgccaccccccaaccaagaggcccaagaggccgtgaccaggctcgaggcacaacatcaagctttggtgactctgtggcatcagcttcacgtcgatatgaagtctcttcttgcctggcagtccctgcggcgagatgtgcagctgatcagatcctggtccctcgcaacttttcgcactctcaaacctgaagagcagaggcaggcccttcatagccttgaattgcactatcaggctttccttagggattctcaggatgccggtggatttgggcctgaagatcgtcttatggccgaacgggaatatggctcttgctcccaccattatcagcagctgctgcagagtctggagcagggtgcccaagaggaatcacgttgccagcgttgcatttcagaattaaaggacatccggctccagttggaagcatgcgagactcgcactgtgcatagactgcggctaccattggacaaagaacccgctcgcgagtgtgcacagaggatcgccgagcagcagaaagctcaggccgaggtggaggggttgggcaaaggagtagcccggctcagtgctgaggccgaaaaggtcctggctttgccagaaccttcaccagccgccccgacactgaggtcggaattagagcttaccctgggaaaactggaacaagtgcgctcccttagtgccatctatctagaaaagctaaagacaatatctctggtaattcgcggtacacagggcgcagaggaggtgctgagggcacatgaggagcagctcaaggaagcacaggccgtgcccgccacactgcctgaactggaagcaaccaaggcatcgcttaaaaagctgcgcgcccaagcggaggcgcagcagcctacttttgatgcccttagggacgaactgcgtggagcacaggaggtgggcgagaggctgcagcagagacacggggagcgggacgtggaggtggaaaggtggcgggaaagggttgcacaactgctcgaacggtggcaggcagttcttgctcaaaccgacgtgaggcagagggagctggaacaactgggccggcagttacggtactatcgggagagcgccgacccactgggtgcctggctccaagatgcaaggcgcagacaggagcagattcaggccatgccgcttgctgacagtcaggccgtacgggagcaattaagacaagaacaagcgttactggaagagattgaaaggcacggtgaaaaggttgaggagtgtcagagattcgctaagcaatacataaacgccatcaaagattatgaactgcagctggtcacctacaaggcacagcttgagcctgtggcttcccccgccaagaagcctaaagtgcaatcagggtctgagtcagtcatacaggaatacgttgacttgagaactcattactccgaactgacaacgctaaccagccagtatatcaaattcatttctgagaccctacgaagaatggaggaggaggagcgcctcgctgaacagcaacgcgcagaagaacgggagagactcgcagaagtcgaagctgccctagagaagcagcgacagctggctgaggcacatgctcaggctaaggcgcaggccgagagggaggctaaagaattgcaacagcgtatgcaggaggaggttgtgcggcgcgaggaggccgctgtggacgctcagcagcaaaaacgaagtatacaggaagagctgcagcagctgagacagtcgtccgaggctgagattcaggccaaagctcgccaggctgaggcagctgagcgctctcgtctgcgtatcgaagaagaaatcagggttgtgcggctgcaattggaggcaaccgagcgtcaacggggaggagccgaaggagaacttcaggccctccgggccagggctgaggaagcagaggcacagaagcgacaggcccaggaggaggcggaacgattacgccgtcaagtgcaggacgagtcacagcgaaagagacaggccgaagtggaacttgccagccgcgttaaggctgaggctgaggccgcccgggagaaacagcgggcactgcaggccttggaagaactgaggctccaggcagaggaagccgagagacggttgaggcaggctgaggtggagcgggctcggcaggtccaggtggccctggagacagcgcagcgcagcgccgaggccgaactccagtccaaacgcgcttctttcgctgagaaaactgctcagctggagagatctctgcaggaggagcacgtcgctgttgcacagctgagggaagaggccgagcggagggcgcagcaacaagcagaagcagaacgggccagggaggaggcggagcgagagctggagaggtggcaactcaaggccaacgaggctctcagattgcgccttcaggccgaggaggtcgctcagcagaagagcctcgcgcaggctgaagccgagaagcagaaggaagaagccgaacgtgaggcacgcaggaggggaaaggcggaggaacaggcagtgagacagcgcgaactggccgaacaagaactcgaaaagcagcggcaactggcagaagggaccgcccagcagcggcttgcggctgaacaagagcttattaggctgcgggcagagaccgagcagggggagcagcagaggcagcttctcgaggaggaactcgcccgcctgcaaagggaggctgctgccgcaactcagaagaggcaggaattggaagctgaactcgccaaagtccgtgccgagatggaagtcctgctagcctctaaggcccgcgccgaggaagaatcgcgaagtacatctgaaaaatccaaacagaggctcgaagcggaagccgggagatttagggaacttgctgaggaggctgcacggctacgcgcattggctgaagaggcaaaaagacagcgtcagcttgccgaagaagatgccgctagacagagagctgaggcggaacgagtactcgctgaaaaactggcggccatcggagaggccacacggcttaaaactgaagccgaaattgcactaaaggaaaaggaagcagagaatgaacgtctgcggcgcttggcggaagacgaagccttccaacggaggagactggaggagcaggcagcacagcacaaagcagacattgaagaaagactcgcccagctcaggaaggcctctgacagcgaactggagcgacagaaaggactggtggaagataccctaagacaacggcggcaggtcgaggaagagatcttggccctgaaggcatcattcgaaaaggctgccgctggaaaggccgaactggagctcgaactgggcagaatccggagtaatgcggaagatactctacggagtaaggagcaggccgaacttgaggccgcgcggcagaggcagctggccgcagaagaagaacgacgtcggagagaggcagaagagagggtccagaaatcactggcagcggaggaggaggcagccagacaaaggaaagccgcccttgaggaagttgagcgacttaaggcgaaagttgaagaggcccgaagactgcgcgaaagggctgagcaggaaagtgcccgacagttacagctggcccaggaagccgcccagaaacgcctgcaggccgaagagaaggcccatgctttcgcggttcaacagaaagagcaggagctccagcagaccctccagcaggagcagtccgtgctggatcaattgcggggcgaagccgaagccgcgcgaagggctgccgaggaggcggaagaggctagagtacaggccgagagagaagccgctcagtcccggaggcaggtagaggaggccgagcgtctgaagcagtcggctgaggagcaagcacaggcgcgggctcaggcccaagcagcggcagaaaaacttaggaaggaagctgaacaggaagcggcacgacgcgctcaagccgagcaggccgccctgcgccagaagcaggcggcagatgctgaaatggaaaaacacaagaaatttgcggagcaaacactgcgccagaaggcgcaggtggagcaggaattgactactctgcgtcttcagctcgaagaaaccgatcaccagaagaatctccttgatgaggaactgcaacgcctgaaggccgaagccacagaagctgctcggcagcgcagtcaggtcgaagaagagttgtttagcgtgagggtgcagatggaggagttgtctaaattgaaggcgagaatcgaggctgaaaaccgcgcattaattctgagagataaggataatactcagagattcttgcaggaggaggctgaaaagatgaagcaggttgccgaggaagctgcccgcctttccgtagcagcacaggaagccgcccgtctacgacaattggccgaggaagatctcgcccagcagcgcgccctggctgaaaagatgctgaaagagaagatgcaggccgtccaggaggccaccagactcaaagccgaggccgaattgctgcagcaacagaaggagctggcccaggaacaggctagaagactacaggaagataaagagcagatggcgcagcagttagctgaggagacccagggttttcagcggacacttgaggcagagcggcagaggcagctagaaatgtctgcagaggctgaaaggttgaagctgcgtgttgcagagatgtcccgggcacaggctagagccgaagaagacgctcagcgctttaggaaacaggccgaggaaatcggcgagaaactgcaccggacagagctcgcgacccaggaaaaggttacgctggttcaaactctcgaaatccagaggcaacaatcagatcatgatgctgagcgcctgcgagaagctattgcggaactcgaacgggagaaagaaaaactgcagcaggaggcaaagctgttgcagttaaagtccgaggagatgcagaccgtacagcaggaacagttgctccaggaaacgcaggccctgcaacaaagctttctgtccgaaaaggactccctcctgcagcgggaacgcttcattgagcaggagaaagcgaagctcgagcagctgttccaagatgaggtggctaaagctcagcaattacgtgaagaacagcagagacagcagcaacagatggagcaggagagacagcgcctagtggccagcatggaggaggcacgacgtcgccagcacgaagcggaagaaggtgttcgacgaaagcaggaggagcttcagcagcttgagcagcagcgtcggcagcaggaggagctcttggccgaggaaaaccagagactgcgtgagcagcttcaactgttagaagagcagcaccgagccgcacttgcccacagcgaagaagtgacagcaagccaagttgccgccacaaaaacactgcccaacggccgcgacgccctggacggaccagctgccgaggcggaaccagagcattcattcgatggcctccgtcggaaggtgtctgcccagaggctgcaggaagccggcattctgtccgcagaggaactgcaacgcctggctcaaggacacaccactgtggatgagctggctcgcagagaggatgtccggcactatcttcagggaagatcctctattgcaggcctcctgctcaaggcgactaacgagaagctcagtgtctacgcggccttgcaacgccagctgctttcacctggaacagcccttatcttgctagaggcacaggcggcgagcggctttcttctggaccctgttcggaataggcgtctgacagtaaatgaagccgtcaaagaaggcgttgtgggacccgagctccatcacaaactactgtcagccgagcgggcagtcacaggatataaagacccatatacagggcagcagatttccctgttccaggccatgcagaagggactgatcgtcagagagcatgggattcggttgttggaggctcagatagcgaccggaggcgtcatcgatcccgtgcattcccatcgggtgcccgtcgacgtggcctatagaagaggttactttgacgaggagatgaatagagtgctggctgacccgtcagatgatacaaagggattcttcgatcccaatacccatgagaacctgacatacttgcaattacttgagaggtgcgtggaggatcccgaaaccgggctctgtctgcttcccctgaccgacaaagccgcgaagggcggagagctggtatatacagactcagaggccagggacgtgtttgagaaagcaaccgtatcggctccattcggaaagtttcaggggaagactgtgaccatctgggagattataaacagcgagtatttcaccgcagagcagaggagggacctgctgcggcagttccgcacaggacgcattactgtcgagaaaattataaaaattatcatcaccgtggtggaagagcaggaacagaaaggtcgcctgtgctttgaggggctcaggagcctcgtacccgccgctgaactgctggagagccgggtcattgacagggaactgtaccaacaactccaacggggggagcgaagcgtgagggatgtggccgaggtggacacggtgagacgggccctgaggggcgcaaacgtaattgcgggtgtttggctggaggaagctggccagaaattgagtatttataatgccttaaagaaagatctgcttccctctgatatggctgtcgcactgctagaggcgcaggccggtaccggtcacatcatcgacccagccacctctgcgagactgaccgtagacgaggccgtcagagctgggctggtcggtcccgagtttcatgaaaaattgctgtccgctgaaaaagccgtgacaggatatcgtgacccgtatactgggcagtccgtgagtctttttcaggctctgaagaagggcctgatccctcgggagcaagggttgcggctgcttgacgcccagctcagcaccggaggtattgtggaccctagtaaaagtcatcgagtgcctctcgatgtggcgtgtgccaggggctgcctggatgaggagacttccagggcactaagcgccccgcgcgccgacgccaaggcttattctgaccccagtactggggaacctgccacctacggagagctccagcagaggtgccggcccgatcagctcaccggattgtcgctgctccctcttagcgaaaaagctgctcgagcccggcaggaagagctttacagcgaattgcaggctagggaaacctttgaaaagacacccgtagaggtccctgtgggagggtttaaaggacgaaccgttaccgtctgggaactgatatcaagcgaatactttaccgcagagcaacggcaggaacttcttagacagttccgtacaggaaaggtgacagtggaaaaggtcatcaagatcctgatcacaatcgttgaggaagtcgagacactgaggcaagagcgcctgagcttcagtggactgagagccccagtgcctgcttcggaactgctcgctagtggagtgttgtcccgtgcccaattcgagcaactgaaggatggcaagaccaccgtgaaggacctatccgagctcggatcagtccggaccctattacaaggatccggctgcttggctggaatctatctggaagatacgaaagagaaggtgtccatctacgaggctatgcgccgcggcctccttagggctaccacagcagctctgctcctggaagcccaggccgctactgggttcctggtcgatccagttcgaaaccaacgcctctatgtgcacgaggctgtgaaggcaggcgtcgtcgggcccgaactgcacgaacagctgcttagcgcagaaaaagccgttacgggctatagggacccctatagtggttccacaatcagtctcttccaggctatgcagaagggccttgtgcttcgacagcatgggatcagactgctggaagctcaaattgccactggggggatcattgatccagtgcacagtcatcgtgtccctgtggatgttgcgtatcagcgcgggtatttttccgaagagatgaacagagtcttagcagatccctccgatgacacaaagggcttctttgacccgaatacccatgagaatctcacctaccgtcaattattagagcgctgtgtcgaagacccagagaccggacttagactgctgcctttaaaaggggccgaaaaggcagaggtagtggaaaccacccaggtgtacacagaggaggaaacaagacgcgcattcgaagagactcaaattgatatcccaggaggaggatcccatggaggatccactatgtcgctgtgggaagtcatgcagagcgatctgatacctgaagagcagcgtgctcagttgatggctgactttcaggcgggaagagttaccaaagaacgtatgatcattattatcatcgaaattatagagaagactgagatcattcgtcagcaagggcttgccagttacgattacgttcggagacggttgaccgcagaagaccttttcgaggcaaggatcatatcgctggagacttacaacctcctgagagaggggacacggtcactcagggaggccctggaggcagagagcgcctggtgctacctctatggtactggctcggtggccggagtctacctccccgggagtaggcagacactgtcgatctaccaagcgctgaagaagggtctgctgtctgccgaggttgcgcgattgttgttggaggcccaggcagccacgggttttctcctcgatccagtgaagggcgaacggctgaccgtagatgaggcggttcgcaaagggctggtcggaccagaactccatgaccgcctgctttctgccgagagggcggtgacgggataccgcgatccatacaccgaacagaccataagtctcttccaggccatgaagaaggagctcatcccaacagaggaagcattacgcctccttgacgctcagctcgccacaggcgggatcgtggatccccggctgggttttcacctgcccctggaggtggcctatcagagaggttacctcaataaagacactcatgatcagctgtctgagcccagtgaagtaaggtcctacgtagaccctagcaccgacgagcgtctgagttacactcagcttcttcgccgctgcaggcgggacgatggaactggtcaactccttctgcccctatccgatgcccggaagctgacttttcgcgggttgagaaagcagatcacgatggaagaactggtgcgcagtcaggtcatggacgaagcaacggcgctgcaactgagagaagggttaaccagcattgaagaggtgacaaagaaccttcaaaaattcctcgaaggaacatcctgcatagccggggtgtttgtggacgcgaccaaagaacggctaagtgtctaccaggcaatgaagaagggaatcatcaggccaggaactgctttcgaacttcttgaagcccaggcagccacaggctacgttattgatcctatcaaggggctcaaacttacagtggaggaggccgtacgcatgggcatcgtcggacctgagtttaaggacaagctgctgtcagctgagcgagctgtgacaggctataaggatccgtacagcggaaagctgatctccctctttcaagccatgaagaagggtctgatcctgaaggaccatggcattcggcttctggaggctcaaatagcaaccgggggcattatcgaccccgaagagagtcacagactacctgtcgaagtggcatacaaaaggggccttttcgatgaagaaatgaatgaaatcctgacagacccatctgatgatactaagggcttctttgaccccaacacagaagaaaacttaacatacttacagttgatggaacgctgtatcactgaccctcagacgggactgtgtctactgcctctcaaagagaaaaagcgagaaagaaagacctcttctaagtcctcggttcgcaaaaggcgggtagtgatagtcgatcccgaaacaggtaaagaaatgagtgtgtatgaggcttataggaagggcttgatcgaccaccagacatacctggagctgtctgagcaagagtgcgagtgggaagagattactatcagctctagtgacggagtggtcaagtccatgattatcgatcgtcggagtggccgccaatatgatatcgacgacgccatagctaaaaacctcattgatcgatcagcactggatcagtacagagccggtacgctaagcatcacggaattcgccgacatgctcagcgggaacgcgggcggctttcgaagtcggtcttcctcagtgggctctagctcctcctaccctatatctcccgcagtctccaggactcagcttgcttcatggtctgaccctaccgaggagacaggccctgtggcagggattctcgacactgagactttggaaaaagtcagtattaccgaggcaatgcacagaaatctggtggacaatattaccggacagaggctgctcgaggctcaagcctgtacgggcgggatcatcgacccaagcactggtgagcggttccctgtcacagatgctgtaaacaaggggctggtggacaagatcatggtcgatcggatcaatttggcccaaaaagctttctgtggcttcgaagatcctcggaccaaaaccaagatgtcggcagctcaagccttgaagaagggctggctttattacgaggcggggcagaggtttctggaagtgcagtatttgactggcgggctgatcgagcccgacactccaggccgggtaccactcgatgaagcattgcagcgggggacggtcgacgcacgcaccgcccaaaaactccgtgatgtcggcgcatacagtaagtatctcacatgtcctaaaacgaagttgaaaatttcgtataaggacgctcttgaccggtctatggttgaggaaggcacaggtctgaggctcttagaagctgccgctcagtccaccaagggatattactctccctactccgtatccgggagtggctcgacggcaggttctagaaccggatcgaggaccggaagcagagctggttccaggcggggcagcttcgacgccactggatctggcttcagcatgacattctctagttcctcatactcctcgtcaggatacggtcgaagatatgcctctggcagctcagcttcactcgggggcccagagtccgcagtggcatag

SEQ ID NO: 129017 - DNA, 13656 bp, Artificial Sequence
  Description of Artificial Sequence: Synthetic coding sequence
atgtcaggagccggcggagcattcgctagccctcgcgaagtgctgctggaaaggccctgctggttagacgggggttgtgaacctgcccgcagaggatatctataccagcagctgtgttgtgttgatgaacgagatcgcgttcaaaaaaaaacctttaccaagtgggttaataagcacctgattaaggcgcagcgccacatttccgatctctacgaagatctccgtgatggacacaatctcatttccctgctggaagttttgagtggagatagcctcccgcgcgagaaggggcgaatgcgctttcacaagctgcaaaacgttcaaatagctctcgattaccttcgtcatagacaggtgaagctggttaatatccgcaatgacgacattgcagacgggaatccgaaactaacacttgggttgatctggaccattattctgcacttccagatatccgacatccaggtgagtgggcagtccgaagacatgacagccaaggaaaaactcctcctctggtcgcagcgcatggttgaaggctatcaggggctgaggtgtgataactttacatcttcttggcgcgatggcagattattcaacgctattatccaccgccataagcccctcctaatcgatatgaataaagtttacaggcagaccaacctagagaatttggatcaggcttttagtgtcgcagagagggatttgggtgtcactcggctcctcgatccagaggacgtcgatgtccctcagcccgatgagaagtccatcattacgtacgtcagcagcctctatgacgcgatgccgcgcgtccccgatgtgcaggacggcgtcagagccaatgaacttcagctcagatggcaggagtatagagagctggttttgctgcttctgcagtggatgcggcaccacacggctgcttttgaagagaggagatttccgtcaagttttgaggagatagaaatcctgtggagtcagtttctcaagttcaaggagatggagttacctgctaaggaggctgacaagaaccggtccaaaggcatttaccagagtttagagggcgccgtccaggccgggcagttgaaggtgcctcccggataccaccccctcgatgttgagaaagagtgggggaaactgcacgttgccattttggaacgcgagaaacagctacgctccgagtttgagcgactggaatgcctgcagcggatagtcaccaaactgcaaatggaggccggcctgtgcgaggagcaacttaaccaggcagacgccctgctgcaaagcgatgtgagactcctcgccgcagggaaggtgccccagcgggcgggggaggtggaaagagatctggacaaggctgactccatgatcagattgctctttaatgatgttcagacgttgaaagacggccggcacccacagggggagcagatgtaccggcgagtgtatcgactacacgagaggttggttgccattcgaaccgaatacaatctccggctgaaggcaggagtggccgcaccagccacacaggtggcacaagtgaccctccagtccgtgcagagaagacctgagctggaagactccaccctcaggtacctgcaggacctgttggcttgggtggaagaaaaccagcatcgtgtggacggcgccgaatggggagtcgacctgccttccgtggaggctcaactgggatcccaccgaggcttgcatcagagcattgaagaattccgcgccaagattgagagggcccgcagcgatgaaggacagctgtcacctgctactagaggagcttatcgagattgcctgggcagactcgacctgcaatatgcgaaattgctaaattcatccaaggcccgtctgaggtctctagagtctttacactcgttcgttgcagccgccacaaaagagctcatgtggctcaatgagaaggaagaagaggaagtcggatttgattggtctgatcgaaacacgaacatgactgccaaaaaagagtcctactccgcactgatgagggagctggaacttaaggagaagaagattaaggaattgcagaatgccggggaccggctgctacgcgaagaccaccccgctaggcctaccgttgaaagcttccaggccgcattgcaaacgcaatggtcctggatgctgcagctgtgttgctgtatcgaggcccacctgaaggaaaacgcagcttacttccagttctttagcgacgtccgagaagcggaggggcagctccagaagcttcaggaggcactgaggcgcaagtattcatgcgatcgatccgccactgtcacacgattagaagatctactccaggacgcccaagacgaaaaggaacagctgaatgagtataagggacatttgtccgggctcgctaagcgtgcaaaggccgtcgtgcaattgaaaccccgacaccccgcacacccaatgcgtggacggttgcccctgcttgctgtgtgcgactataaacaggtcgaggttactgtccacaaaggagatgaatgtcagttggtggggcctgcgcaaccctcacactggaaagtgctatcttcctccggaagcgaagcagctgtaccatccgtgtgttttctcgtaccccccccaaatcaggaggcacaggaggccgtgacgcgtcttgaagctcagcaccaggcactggtcaccctctggcaccagttgcatgtggacatgaagagcttgcttgcgtggcaatcactgcggagagacgttcagctgattaggtcttggagtttagcgacttttagaaccctcaaaccggaggaacagaggcaggctctgcactcccttgagttgcactatcaggccttcctcagggactcccaagacgccggaggatttggtccggaagaccgcctgatggcagagcgggagtacggatcttgtagtcaccactatcagcagctcctacagtccctggaacagggtgcccaggaagagtcacggtgtcaacggtgtatctctgaactcaaggatatccgcctgcaactggaggcgtgcgagactcgcaccgtccacagacttagactgcccctcgataaagaaccagccagagaatgcgcacaacggattgcagagcagcagaaggcccaggccgaggtggagggactcgggaagggcgtggcaagactgtctgcggaggctgagaaggtgctagctttgcctgaaccgtccccagcggcgccaacccttagatctgagctcgagctgaccctaggcaaactggaacaggtgagatctttgagtgccatttacttggaaaagcttaagactataagccttgtaatccggggtacccagggagctgaggaggtccttagggctcatgaagaacagctcaaggaagcccaggccgtgccagcgacactcccagaactagaggcaactaaagcgagccttaagaagcttcgcgctcaggcagaggcgcaacagcccacatttgacgccctgcgcgacgagctccggggcgctcaggaagtgggggagcgattgcagcagcggcacggagaaagggatgtagaggttgagcggtggagggaacgcgtggcccagttgctggagcgctggcaggctgtcctcgctcagactgacgtgcgccagagggaactggagcagctcggccgccagttgaggtactacagagaaagcgcagatcctcttggagcctggctgcaggatgcacgccgccgccaggagcaaatacaggccatgcctctggccgattcacaagctgtccgcgaacaactcaggcaggagcaggcgctgctggaagagatagagaggcatggagaaaaggtggaagaatgccagaggttcgcaaagcagtatataaacgccatcaaagactacgaactgcagctggtaacctacaaggcccagctggagccagtggctagccccgccaagaagcctaaggtgcagagcggctcagagtctgtcatacaggagtatgtggaccttagaacacactattccgaactgacaactctgacgtcccaatatatcaagttcatttcagagacacttcgacggatggaagaagaagaacgcctcgccgagcagcagcgcgcagaagaaagagaaaggctggccgaagtcgaagccgcactcgaaaagcagcgccaactcgctgaggcacatgcacaagctaaggcacaggccgagagagaagccaaagaactgcagcagcggatgcaagaagaagttgtccggcgtgaggaagctgctgtcgacgctcaacagcagaaacggagcatccaggaggagttacagcaactgaggcagagcagcgaggccgagatccaagccaaagctagacaggctgaagccgccgaacgttcccgtctccggatcgaagaggaaatacgagtggtgaggctgcaattggaagccacggagaggcagagaggtggggccgaaggagaactgcaagcgcttagggctagagctgaggaggccgaggcacagaaacgacaagcccaggaggaggccgagcgtcttagacgacaagtccaggacgagtctcagaggaaaaggcaagcggaggtggagcttgcatctcgcgtcaaggcagaagccgaggccgcccgtgagaaacagcgagcactacaggccctcgaggaactcagactgcaggccgaggaagctgaacgcaggctacgacaggcggaagtagagcgagctagacaggttcaagtagcccttgaaacagcacagcgctccgcagaggcggagttgcagagcaagcgcgcctctttcgccgaaaaaaccgcccaactcgaacgctcactgcaggaagagcacgtggccgtggctcagttgcgtgaagaggcagagcgtcgcgcgcaacagcaggccgaggccgaaagggccagggaggaagccgagcgcgagctcgaacggtggcagctgaaagccaatgaggccctccgcctgcggctgcaagctgaggaggttgcccagcagaagtcactggcgcaggcagaggctgagaagcagaaggaggaagcagagcgggaagcaaggcggagggggaaagccgaggagcaggcagttcgtcaacgggagctcgccgagcaagagctcgaaaagcagaggcaactggccgagggcaccgcccagcagaggctcgccgccgaacaggagctgatccggctgagggccgagacggaacaaggcgagcagcagcgccagctgctcgaggaagaacttgccaggctccagagggaagcggctgcagcgacccaaaagcgtcaggagctcgaggccgaattagccaaggtccgagctgagatggaggtcctgttagcaagcaaggctcgcgcagaggaagagtccagaagcacctcagagaagagcaaacagagactggaggcagaggcaggtaggtttcgcgagctggccgaagaggctgctcgtttgcgcgctttggctgaggaagccaaaagacagcgccagcttgccgaggaggacgcagcacggcagcgcgctgaggctgagcgagtgctagccgagaaactcgcagcaatcggcgaagcaactaggctgaagaccgaagcagagattgccttaaaggaaaaagaggcggaaaacgagcgtctccgccggctggccgaggacgaggcgtttcaacggcggaggcttgaagagcaggccgcccagcataaagccgacatcgaagagaggctcgctcagctccgcaaggcctcagattccgagctggaaaggcaaaagggacttgtggaagatacacttaggcagcgcaggcaggtcgaagaagagattctggcattgaaagcgtccttcgagaaggccgctgcgggcaaagccgagctcgagttggagctcggccggattaggtccaacgctgaagatacactccggagcaaggaacaagctgaacttgaagcagcaagacagcgccagctcgccgctgaggaagagcggaggcggcgggaagcagaagagcgggtccaaaagtccttagctgcggaggaggaagctgccagacagaggaaggccgctctggaggaggtggagcggctgaaagccaaggtcgaggaggcacgcagactgagagagcgcgcagagcaggagagtgcccgccagttgcagcttgcccaggaggcagcacagaagcgtctgcaggctgaagaaaaggcccatgccttcgcagttcagcaaaaggagcaagaactccagcaaacgttgcagcaggagcagtctgtgctggatcagctcaggggtgaggccgaggccgccaggcgggccgctgaggaagctgaggaagccagggttcaggccgagagagaggcagctcaaagcagacgccaggtagaagaagcggaaaggctcaaacagagtgctgaagagcaggctcaggctcgggcccaggctcaggctgcagctgaaaagctgaggaaggaggccgaacaagaggctgcccgcagggcccaggccgagcaggctgcgctacgccagaaacaggctgctgacgcagagatggagaaacacaagaagttcgcagagcagaccctcaggcagaaggcccaggtcgagcaagagcttacaacgctgcgcctacagctggaggagactgatcatcaaaagaacttgttggacgaggagcttcagcgcttgaaggcagaggctactgaggccgctcggcagaggtcacaggtcgaagaggagctgttttccgtgcgggtgcagatggaggaactgtccaagttgaaagcccgcatcgaagccgagaaccgggctctgattctaagagataaggacaacacacagaggttcctccaggaggaagcggaaaagatgaagcaagtggcagaggaagcggctcgactgtccgtcgctgctcaggaggcggcacgactcaggcagctagccgaggaggacctggctcaacagcgtgctctagctgagaagatgctcaaggagaagatgcaagcggttcaggaggccacccggcttaaagctgaagcagagctgctccaacagcagaaggaactggcacaggaacaagcacgcaggctccaagaggacaaggagcagatggcccagcagctggccgaagagacccagggatttcaaaggactttggaggcagaaagacaaaggcaattagaaatgtcagccgaagcagaacggctgaagctccgcgttgctgagatgagccgggcgcaagcccgggccgaggaagacgcacagcgcttcagaaagcaggccgaggaaatcggggagaagctgcaccgcaccgaactggcaactcaagagaaagtcacattagtgcagaccttggagatacagcggcagcagagcgaccacgatgcagagcgcttgcgcgaggcaatcgcagagctggaaagggaaaaagagaagctgcagcaagaggccaagctgctgcaactgaagtcagaagagatgcagaccgtgcaacaggaacagctgttgcaagaaacacaggctctccagcagtccttcctttcagaaaaagacagtctcctgcagcgggagcgttttatcgaacaggaaaaggctaagctcgaacagctcttccaagacgaagtggcgaaagctcagcagctgagggaggagcagcagcggcagcagcagcagatggagcaggaacggcagcggctagtggcaagtatggaggaggctagaaggaggcagcatgaggccgaggagggcgtgcgaaggaaacaagaggaactgcaacagttggaacagcagcgacgacaacaggaggagttactggctgaagaaaatcaacgcctccgagaacagcttcaattgctggaggaacagcaccgagcagccctcgctcacagtgaagaggttaccgctagccaagtagccgcaaccaagaccctgcccaatggcagagacgctctcgatggacctgccgcagaagcagagccggaacattctttcgatggcctcaggcggaaagtcagtgctcagagattacaggaggcaggaattttgtccgccgaagagctccagcgtctggcccagggccacacaaccgtcgacgagctggctcgcagggaggatgtccgccattatttgcagggccgcagttcaatagccgggctcctgttgaaggccaccaatgagaaactgtctgtatacgccgccctgcagaggcagctccttagtcctggcactgcactgatactgctcgaagcacaagccgcctccgggtttctcctggacccagtgaggaatcgtaggctcaccgtgaacgaggcagtgaaagaaggcgtggtgggacccgaactgcaccataaacttcttagcgcggagcgcgcagtgaccggatacaaggatccttacaccggccagcagatctctctgtttcaggccatgcagaaaggcttgatcgtgcgcgagcacggcattagacttttggaagctcagattgccacagggggagtgatcgatccggtccattcccaccgggtccccgtagacgtcgcatataggaggggttattttgatgaggaaatgaaccgcgtgttggctgacccatcagatgacacaaaagggttctttgatcccaatacccacgaaaatctaacgtacctgcagctcttagaacggtgcgtcgaggacccagaaacaggcttgtgccttctgccactgacagacaaagcggctaaaggtggcgagttggtctacaccgactctgaggccagggacgtgtttgaaaaggctaccgtttctgcgccttttggaaagttccaaggaaaaactgtaaccatttgggagattattaactctgagtactttactgcagagcagcgtcgtgacttgcttcgccagtttcgcacaggccgaattacggtcgaaaagatcattaaaatcataattacagtagtggaggaacaggagcagaaagggcgcctctgttttgaaggactgaggtctcttgtcccggcagccgagctcctagagtctcgagttatcgatagggagctgtatcagcagctgcagcgcggggagcgttctgttcgtgatgttgcggaggtggacactgtgcgtagagctctgaggggcgcaaacgtcatcgctggagtatggcttgaggaggcaggtcagaaactgtccatctataacgccttaaaaaaggacctcttaccatctgatatggccgtggccctgcttgaggcacaggccgggaccgggcacattatcgatccggccacctccgctcgcttgactgtcgacgaagctgtgcgagcaggcctggttggacccgagtttcacgaaaagctgctctctgccgagaaggccgttacagggtacagagacccatacaccgggcagtctgtgtctttattccaggcactcaagaagggattaattccgagagagcagggactgcgactgctcgatgcacagctctccacaggcgggattgtagatccttctaagagccatcgtgtccccctcgatgtggcctgtgcgcgtgggtgcttggacgaagagaccagccgcgcactgtcagccccaagggccgacgctaaagcttactctgacccctcaaccggtgagccagcgacctatggcgagctacagcagcgatgcaggccagatcagctaaccggcctttctcttctgcccctgtcagaaaaggctgcaagagctagacaggaagagctttattccgagttgcaggcccgagaaacattcgagaagactcctgtagaggtgcccgtcggaggcttcaagggcagaactgttaccgtgtgggagctgattagttcagaatatttcaccgcagaacagaggcaggaactcctgcggcagtttagaaccgggaaggtgaccgtggagaaggtaattaaaattcttattaccattgtggaggaggttgagacccttagacaggaaaggctgtctttcagcggactacgggcccctgttccagccagcgagcttctggctagcggagtgcttagcagggcacagttcgagcagctgaaggatggaaagacaacagtcaaagacttgagtgagcttgggagcgtcaggacgctgctccaaggttcaggttgtctggctggaatttacttggaagacactaaggaaaaggtttccatttacgaagccatgcggcgtggactactacgcgctacgaccgctgctctgctgctcgaagcacaagctgcaaccggctttctggtcgacccagttcgtaatcagagactctacgtgcacgaggccgttaaagccggtgtcgtaggccccgagttgcatgaacagttactctccgccgaaaaggcagtaacaggataccgcgatccttattccgggtccacaattagtcttttccaggctatgcagaaaggcctggtcctacgtcagcatgggatccgtctcttggaggcccaaattgccactggaggaataatcgatcctgtgcattcacaccgcgtaccagtagacgttgcgtatcagagaggctacttcagcgaggagatgaaccgagtgctcgccgatcctagtgatgacaccaagggtttttttgatccaaacactcatgagaacctcacttatcgccaactgcttgaacgctgcgtggaggaccctgaaactggtctgagattgctccctctgaagggagccgaaaaggctgaggtcgtggaaactacgcaggtgtacacggaggaagaaacacgcagggcctttgaggaaacacagattgacatcccagggggaggaagtcatggagggtcaaccatgagcctatgggaagtcatgcagtccgacctgatcccggaggaacagcgagcacagctgatggctgattttcaggccggccgcgtcactaaggaaaggatgattattattatcatcgaaatcattgagaaaacagaaatcatccgtcaacagggcctggcttcctacgattacgtccgtcggcgcctgacagcagaggatctgtttgaagctaggattatttccctggagacatataatctgctgagggaaggtacacggagtttaagggaagccctcgaggcagagtcagcctggtgctatttgtacggcaccggatcagtggccggggtgtatctgcccgggtcacggcagacactatccatttatcaggcactaaagaaaggccttctgtctgcagaggttgctagactcctccttgaggcccaggctgccaccggattcctgttggaccccgtgaagggagaaagacttacagtggatgaagctgtacgtaaagggctggtaggacccgagctccatgaccgcttgcttagtgccgagcgcgcagtgacaggttacagggatccctatacggaacagaccatctcgcttttccaggccatgaaaaaagaactcataccaactgaagaagcattgcggctcctagacgcacaactggccaccgggggcatcgtggatccgcgcctgggctttcacctgcccttggaggttgcctatcagcgcggatatttgaacaaagacacacatgatcagttgagcgagccatcagaggtgagaagttacgtggacccgtctactgacgagcgacttagctatacacaacttctgcgtcgctgcaggagagatgatggtactggccagcttttgctccctctctcagacgctaggaaattaacattccgtggactgagaaaacagattactatggaggaactggtgcgtagccaagtcatggacgaggccacagccctgcaactgagagagggccttacgagcattgaggaagtgaccaagaatcttcagaagtttctcgaagggactagttgtattgccggggtgttcgtcgacgcgacaaaagagaggctgagcgtttaccaggccatgaagaagggaatcatccgtcctggcaccgccttcgagctgttggaggcacaggcagctacgggctacgtgatcgacccgattaaagggctgaaactcactgtggaagaagctgtgaggatgggcatagttggacctgagtttaaagacaagctgctgtccgcggaacgcgctgtcaccggatataaagatccatattccggcaagctgattagcctgttccaggcgatgaagaagggcttaatcctcaaggaccacggcattaggttgttggaagcccagattgcgacgggaggaattatcgacccggaagagagccatcgcctccctgttgaggtggcatacaagagggggctgtttgacgaggaaatgaacgagattttaacagacccaagtgacgacaccaaaggattctttgatccaaacaccgaagagaacctcacctacctgcagctgatggagagatgtattaccgaccctcagaccggcctgtgtttgcttcccctaaaggagaaaaaacgcgagcgcaagacttcctcgaaaagtagtgtgcggaaaagaagggtggtcatagtggatcctgagacagggaaggagatgtccgtatatgaggcctatcgaaaaggactaatagaccatcaaacgtacctcgagctgtctgagcaggagtgtgagtgggaagaaattactattagcagtagcgatggtgttgtgaagagtatgatcatcgaccgccgcagcggaagacagtacgatattgacgacgccatagccaagaaccttatcgatcgttcagcactggatcagtacagagccggcactttatccatcaccgagtttgcagatatgctcagtggaaacgccggcggcttcagatctcgtagctcttctgtcggttcatcttcttcttatcctattagcccagctgtgtctcgaactcagttggctagctggagtgaccctacagaggagaccgggcccgtcgcaggtatcttggacaccgagactctggaaaaggtctctatcacagaagctatgcaccggaatcttgtcgacaacatcacaggacagaggcttctggaagcgcaggcgtgcaccggcggcattatagacccctctaccggtgagcgtttccccgtgaccgacgctgtcaacaaggggctggtcgataagataatggtcgatcggatcaatctggcccagaaagcgttctgtgggttcgaagatccgaggacaaaaacaaagatgtcagccgcacaagctctcaaaaagggatggctctactatgaggctggccagagatttctggaagtgcagtacttgactggcggactcatcgagccggatactcctggccgcgtgccccttgatgaggcactccagcgtgggacagtcgacgcaagaacagcccagaagctgagagacgtgggtgcctactccaaatacttaacctgccccaagaccaagctgaaaatctcttataaagacgcacttgatagatctatggtggaggagggcaccggcctgcgtttgctggaggcggctgcgcagtcgactaaaggatattactcaccatattctgtgagtggcagcggctccacggccggctcgcgtaccggatcccgtacagggtctcgcgcaggcagtcgccggggttcatttgatgctacagggtccggatttagcatgacattctccagcagctcttattcatccagtggctatggccgccgctatgctagcggaagcagtgcatctctggggggtccagagagcgccgtggcctag

SEQ ID NO: 129018 - DNA, 13548 bp, Artificial Sequence
  Description of Artificial Sequence: Synthetic coding sequence
atgaagattgtgcctgatgagagagatcgggtgcagaagaagacctttaccaagtgggtgaataagcatctgattaaagctcagcggcacatcagcgatctgtatgaagatttacgggatggacacaatctcatctctctgctggaggtgttgagcggggatagcctacctagggagaaggggcgcatgagatttcacaaactacagaacgtgcagatcgccctcgactatctcaggcatcggcaggttaagttggtgaatatccggaatgatgatatcgccgacggaaaccctaagttaacactggggctgatctggacaatcatccttcacttccagatcagtgacatccaggtctcgggccaatcagaggatatgactgctaaagagaagctgcttctctggagccagcgcatggtagaaggctaccagggtctgcggtgcgacaactttacctccagctggcgcgatggacgtctcttcaatgccataatccacaggcacaagccgttgctgattgatatgaacaaggtttatcgtcaaactaacttagagaacctggaccaggccttttctgtcgccgaacgcgatcttggggtgacccgtctgctcgaccccgaagacgtggacgttcctcagccggatgaaaagtccatcattacctatgtgagcagtctctatgacgccatgcccagagttcccgacgtgcaggacggcgtccgagcgaacgagctgcagctccggtggcaggaataccgcgaactcgtccttctgttattgcagtggatgaggcaccataccgctgccttcgaagagagacgctttcccagctcgttcgaggaaatcgaaatactctggagccagttcctcaagtttaaggaaatggagcttcccgcaaaggaagcagataagaaccgctccaaaggcatctatcagtccctcgagggagcagttcaggcaggtcaactgaaggtgcctcccggctatcatcccctggacgtggagaaggaatgggggaagcttcatgtggctatattggagcgagagaagcagttgcggagtgaattcgagagattagagtgtttgcagagaatcgtaaccaagcttcagatggaagctgggctgtgcgaggagcagctcaatcaggcagatgccctactccaaagcgacgtgcggctgctggctgccgggaaagtgccccagagagccggcgaagtagaaagggatcttgacaaggctgattccatgattcgactcctcttcaatgacgttcaaactctgaaggacggtcggcatccacagggggaacagatgtataggcgagtttacaggctacatgagcggttggtggccatccgaaccgagtataacctacgactgaaagccggagtggccgccccagccacccaggtggcccaggtgacgctgcagtctgtacaacggcgtcccgagctggaggactcgaccctccgatacctacaggacttgctggcctgggtcgaagagaatcagcaccgtgtggatggagctgaatggggggtagatcttcctagcgtggaagcgcagttgggaagtcatagaggtctgcatcagtcgatcgaggagttccgggccaagatcgagcgggcccgttccgatgaagggcagttgtcccccgcaacccgtggcgcctatcgcgactgcctcgggcgcctggacctgcaatacgccaaacttctaaacagctccaaagccaggctgaggtcactggaaagtttgcacagtttcgtggcggccgctactaaggagctaatgtggctgaacgagaaggaggaggaggaagtcgggttcgattggtccgaccgaaataccaacatgactgctaaaaaagaatcctactccgcactgatgagggagctcgagcttaaggaaaaaaagataaaggagcttcagaatgcaggcgaccgtttactccgcgaagaccaccctgctagaccaactgtggagagcttccaggcggccctgcagacccagtggtcctggatgctgcagctctgctgctgcatcgaggcgcatctgaaagagaatgcagcctacttccagtttttcagcgacgtacgggaggccgaagggcaacttcagaagttacaagaagccctgcgccggaagtatagctgcgatcggagcgctactgtgactagattggaggatctactacaggacgcacaggacgagaaggagcaactgaacgaatataaagggcatctcagcggtctggcgaagcgcgcgaaggcggtggtgcaactgaagcctcggcacccggcccacccaatgagggggaggctgcctcttctggctgtgtgcgactacaagcaggttgaagtcactgtgcacaagggtgacgagtgtcaacttgtgggaccggcccagcctagccattggaaagtcttatctagttccggatctgaagccgccgttccttctgtgtgttttctggtcccgccccccaatcaggaagcccaggaagcagtcaccagacttgaagctcaacaccaggcccttgtcaccctctggcatcaactccatgttgacatgaaatctctgctcgcctggcagtcccttaggagagacgtgcagctcataaggagttggagcctggctacatttaggaccctgaaacccgaagagcagcgccaagccctccattcgctggagctccattaccaagctttcctgcgtgattcacaggatgctggaggctttgggcctgaggaccgactgatggccgaaagagaatacggcagctgttctcatcattatcagcagctgctccaatctcttgagcagggcgcacaggaagaatcccggtgtcagcgctgcatatccgagttgaaggatatccgactgcagctggaggcctgcgaaaccagaaccgtgcaccgtcttagacttcccctcgataaggagcctgctagggagtgcgcacagaggatcgcagagcaacagaaggcacaggcagaagtggaaggcctcggaaagggggtcgcaagactgtcggctgaggccgagaaggtgctagcactcccagagccttcacccgctgcgcccaccctgcggtctgagctggagttgaccctgggcaaactcgaacaagtgcggtcactgtccgctatatacctggagaagctcaagacaatttctctcgtaattagaggcacacaaggcgctgaagaggttctcagagcacatgaagaacaactgaaagaagcacaagcagtgccggctacgctccctgaactggaggccacaaaggcttccctgaaaaaactcagagctcaggccgaggcccagcagccaactttcgacgcgctgcgggatgaattacgcggcgctcaggaagttggggagcggctgcagcagagacatggcgagcgggatgtggaagtagagcggtggcgggaaagagttgctcagttattagagaggtggcaggcagtgctggctcagaccgacgtgaggcaacgagagttggagcagcttggccgccaactacggtattatcgggaaagtgctgaccctcttggcgcctggctgcaggatgccagaaggcgtcaggaacagattcaggcaatgccacttgcagatagtcaagcggttcgagagcagctgcggcaggagcaggcactactggaagagatagaaagacacggggaaaaggtggaagagtgccagcgatttgccaagcagtacatcaatgctataaaagactacgagctgcagcttgttacttataaggcccagttggaacccgtggctagccccgcaaaaaaaccaaaggtgcagagcgggtcggagtcggtgatccaggagtacgtcgacctccgtacacactactccgagctcaccacgttaaccagccagtatattaagtttatttcagaaacactccgccggatggaagaagaggaacgcctcgccgagcagcagcgggccgaagaaagagagagacttgccgaggtagaggctgccctagagaaacaaagacagctggccgaggctcacgcccaggcaaaagcgcaagcggaacgggaggcaaaagaattgcagcagagaatgcaggaggaagtagtgagaagggaagaggctgccgtggatgctcagcaacaaaagagatcaatccaagaagagctccagcagctgcgtcaatctagcgaagcagagatccaggccaaggcacgccaggcagaggctgccgaacggagtcgcctgaggattgaagaagagattcgtgttgttaggctgcagctggaagctacggagagacagagaggaggtgcagagggagaactgcaggccctgcgcgcaagagctgaagaagctgaagctcaaaagagacaggcccaggaggaagcagaacggttaagaaggcaggttcaggatgaatcacaacgcaaaagacaggcggaagtggaactcgccagccgagttaaggccgaagcagaggcagcaagagaaaagcagcgagctctccaggcccttgaggagctgcgcctgcaggcagaagaggccgaacggcgcttgaggcaggctgaggtggagcgtgccaggcaagtgcaggtggcactggagactgcccagagatctgccgaggctgagttacaatctaaacgggcctcctttgccgagaagacagcacagcttgaacggtctctgcaggaggaacacgtggccgtggcgcagttgagggaggaggccgaaaggagggctcagcagcaagccgaagcggagcgcgcccgggaggaggctgagagagagctcgaaaggtggcagctgaaagcaaacgaggccctcagactgcgattacaggcagaagaggtggctcagcaaaagtctctggcccaggccgaggcagagaaacagaaagaggaggccgaaagagaagcacgcagacgagggaaggccgaggagcaggcagtcagacagcgggagcttgcagaacaggagctagagaagcagcgccagctggctgagggcactgcccagcaacgtctggcagcagagcaggagcttatccggctgcgggccgagacggagcaaggcgaacagcagcgacaacttctcgaggaagaactggcccgacttcagagggaggccgcggccgcaacccagaagcgccaagagctggaggccgagctggctaaggtcagggctgagatggaggtgctgctagcctctaaggcccgcgctgaagaggagagccgatctacatcagagaaatctaaacagcgactggaagcagaggccggaagatttagggagctcgccgaagaagctgcccggctgagagcattggcagaagaagccaagaggcagcggcagttagcggaggaggacgcggcaagacaaagagcagaagcggaaagggttctcgctgaaaagctggccgctattggagaggcaactaggttaaagactgaagcggaaatcgccctgaaggagaaggaggccgagaatgagcgcctccgcagattggccgaggatgaagcgttccagcgtcgaaggttggaggagcaagccgcccagcacaaggctgatatagaagagaggctagcgcagctcaggaaggcctctgattcagagcttgagcggcagaaggggctggttgaagataccttgcgccagcgccggcaggtcgaggaagagatcctggccctcaaggccagcttcgagaaggcagccgctgggaaggcggagttagagctggaactcggcaggattcgatccaacgcagaggacactcttcggagcaaagagcaggcagaactggaggctgcacgacaacggcagctcgctgctgaggaagagagacgaagacgcgaagccgaggagcgagtacagaagtcattggcggccgaggaagaggccgctaggcagcggaaggccgccttggaagaggttgagcggctaaaggctaaggtggaagaagctcggcgcctacgggagagagcagagcaggaaagtgctcgccagctgcagctcgcacaggaggctgctcagaaaaggctgcaggccgaggaaaaagcccacgccttcgccgtacaacagaaagaacaggagctgcagcagactcttcaacaggagcagtccgttctggaccagctccggggcgaggcagaggcagcgagacgggctgccgaggaggcagaagaagcccgcgtccaagcagagagagaggccgcccagagcagaagacaagttgaggaggcagaaaggcttaaacagagcgcagaagaacaggcacaagcgagggcacaggctcaggcggcggctgaaaagcttcgaaaagaagctgaacaggaagccgcacgaagagctcaggcggagcaagccgctcttaggcagaagcaggcagccgacgctgagatggaaaagcacaagaagtttgccgagcagaccctgaggcagaaggctcaggtggagcaggagttaactacactgagactgcaactggaggagacagatcaccagaaaaatttgctggatgaagagctgcagcggctgaaggcagaggccaccgaggccgctcggcaaaggagccaggtggaagaagagctgtttagcgttcgcgtgcagatggaagagctatcaaaacttaaagcacggatcgaggcagagaatcgggctctgattctgcgggataaagacaatacacaacgctttctgcaagaggaggccgaaaaaatgaagcaggtggctgaggaagctgcaaggctgtctgtcgcagcccaggaagctgcccggctgcgtcagctcgcagaggaggacctcgctcagcagcgtgccctggctgagaagatgctgaaggaaaagatgcaagcggtgcaggaggcaactcgactcaaggctgaggctgaactgttgcaacagcagaaggagttagcgcaggagcaggccagacggctccaggaggacaaggaacagatggcccagcagcttgccgaggagacacagggttttcagaggacactagaggccgagaggcagcggcagctggaaatgagtgccgaggcggaaaggcttaaactaagggtagccgagatgtcaagagcccaagcccgcgcggaagaggacgcacaacggttccgcaaacaggccgaggaaatcggagaaaaactgcaccgaacagaactggccacccaagagaaggtaacactcgtgcaaacgctggagatccagcgacagcaatctgatcacgacgcagagcgtctgagggaagcgatcgccgagctcgaacgtgagaaggagaagttgcaacaggaagcaaagctgcttcagctcaaatctgaagaaatgcaaacagtgcagcaggagcagctgttgcaagaaactcaagccttgcagcaatcgttcctctcagagaaagactcccttctgcaaagagaaagattcatcgagcaggaaaaggccaagctagagcagctctttcaagatgaggtagctaaagcccagcaactacgcgaggagcaacagagacaacagcaacagatggagcaagaaaggcagaggctcgtggcatccatggaggaagctagaagacggcagcatgaagccgaagagggcgtgcggcgcaagcaggaggagctgcagcaattggaacagcagagacgccaacaggaagagttgctggcagaggagaatcaacgcctgagggagcaactgcaactgttggaggagcagcaccgtgcagccctggcccattccgaggaggtcacagcctcccaggtggctgctactaagactctacctaacggaagagacgctttagacggccccgctgccgaggctgaacctgagcatagctttgatggtctgcgccggaaggtctctgcacagcgcctccaggaggcagggatccttagcgccgaagaactgcagcggttggctcagggtcacaccaccgtggacgagctggctcggcgggaggacgttaggcactatctccaaggtcgttctagcattgccgggttacttcttaaagcaaccaacgaaaagctaagtgtgtacgctgccctccagcggcagctgctttcccccggaactgcattaatcctgttagaagcccaggccgcatcgggtttccttttggatccggtacgcaaccggagactgacagtgaacgaggccgtgaaggaaggtgtggtgggcccagagctgcaccataagctgctgtcagccgagcgagcggtgactgggtataaggacccttatacaggtcaacaaatctccctctttcaagcaatgcagaagggtcttatagtccgtgagcacgggatacgtcttctcgaagcgcagatcgctaccggcggcgtgatagacccagtccacagccacagagtccccgtggacgtggcctatagacggggctacttcgatgaggaaatgaatagggttcttgctgatccctcggacgacactaaagggttcttcgatccaaacacccacgaaaacctcacatacctgcagctcctcgaacgttgcgtcgaagacccagaaacgggcttgtgcctgctgccgctgacagataaggcggcaaaagggggtgagctggtgtacacagactccgaggctagggatgtattcgagaaagcgaccgtcagcgccccgttcgggaagttccaggggaagaccgtcaccatttgggagatcatcaacagtgagtacttcacagctgagcagcgaagagaccttttaaggcagtttcgcactggccgtatcactgtggaaaaaatcataaagattatcatcaccgtggttgaggaacaagaacagaagggcagactctgctttgagggactgagatcattggttcctgctgcagagctgctggagagccgagtcattgacagggaattgtaccaacagctacagcgcggggagagaagcgtgcgagatgtcgccgaagttgataccgtacgaagagcacttaggggggccaacgttattgcaggtgtgtggctcgaggaagcaggacagaagctttctatctacaatgccctgaagaaagatctgttgccctctgatatggctgttgccctgctggaggctcaggccgggacgggtcacatcatcgatcccgccacaagtgccagattaacagtcgatgaagccgtacgtgctggactggtggggcctgaatttcacgagaagctgctgagcgccgagaaggctgtaaccgggtaccgtgatccatatactggccagtcggtatcgttgttccaggcactgaaaaagggactcatcccccgagaacagggattgcgcctgctggatgcccagctgtcaaccgggggtattgtggatccctcgaagtctcatcgagtgcctctggatgtggcttgtgcgcgcgggtgtcttgatgaagaaacttcaagagcactgagcgcccctcgggcagatgcaaaagcctattcggatccctctaccggggagcccgccacctatggagagcttcagcagaggtgtcgccctgaccagcttacaggcctgtccctcctgcccctttccgaaaaggcggcccgggcccggcaggaggagctgtactctgagctgcaggcgcgggaaacttttgaaaaaacccccgtagaggtcccagtcggtggcttcaaggggcggaccgtcaccgtctgggaacttatttccagtgagtactttaccgctgagcagcgccaggagttattaaggcagttcagaaccggtaaagtaaccgttgagaaggtcattaaaatccttatcacgattgtagaagaggtagagaccctaagacaggagcggctgtcattctccggcctgcgcgccccagtcccagccagtgagttgctcgcctccggcgttctatccagagcccagttcgaacagcttaaggatggtaagacgacagtgaaagacctgagtgagcttggttctgttcggaccctgctgcagggcagtggttgtctagcgggtatttacctagaggacaccaaggaaaaggtgtcaatctatgaggccatgcgtcgtggcctgctcagggctactactgctgcgctgctcttggaggcccaggctgccacagggttcttggtggatcccgtcagaaatcagaggctgtatgtgcacgaggctgtgaaggcaggcgtagtcgggcctgagctccacgagcagctactgtctgctgagaaggctgttacgggttacagagacccttacagcggtagtactattagcttgtttcaggctatgcagaaaggtttagttcttcggcagcacggcatcagactccttgaagcacagattgcgacaggcggcattatcgacccggttcattctcaccgagtgccggtcgacgttgcatatcagcgtggctattttagcgaggaaatgaaccgagttttggcagacccatccgatgacaccaaagggttcttcgaccctaacacccacgagaatttgacctataggcagcttctagagcggtgtgtggaagatccagaaacagggttgcgcttacttcccctgaagggtgcagagaaggccgaggtggttgagaccactcaggtttatactgaggaggaaactagaagggccttcgaagagacccagatcgatataccaggcggcggctcccacggagggagtactatgagcctgtgggaggtcatgcagagcgatctcatacctgaggaacaaagggcccaattgatggctgacttccaggctggccgggtaaccaaggagcgcatgataataataattatcgagattattgagaaaaccgagattatccggcaacagggcctcgccagttatgactacgttcgtcgcaggttgacagctgaggatcttttcgaggcgcgcattatctccttggagacttataacctgctacgcgagggcaccagatccttgcgagaggcactggaagccgagtcagcatggtgttatctgtacggcaccggcagtgtggccggcgtgtatctccccggctcacgccaaacactaagcatctatcaagctctgaagaaggggctgcttagcgcggaagtagcacgacttttgctcgaggcccaggccgctactggatttctcttggaccccgttaagggcgagagactcacagtcgatgaggcagtgagaaagggtcttgtgggacctgagctccacgataggctgttgagcgccgaaagagctgtgacgggctatcgggacccttacacagagcagactatttcactgttccaggccatgaaaaaagaattgatccctactgaggaagcactcaggcttctggacgcacaacttgcaactggtgggatcgtcgacccccgtttgggcttccatctccctctcgaggtcgcttaccagagagggtacctgaacaaggacactcacgaccagttatccgagcctagtgaagtgcggagttacgtggacccaagcaccgacgagagactatcttacacccagttgctaaggcgatgtcgaagagacgacggaaccggccaactgttgttaccactgagcgacgctcgcaagctcaccttcagagggcttagaaaacagattaccatggaggagctggtcaggagccaagttatggatgaagctacagctctgcagctgagggagggacttaccagtatcgaggaagtgacaaagaacctgcagaagttcctcgaaggaacttcatgcatagctggcgtgtttgtggatgccaccaaggagcggctctccgtgtaccaggccatgaagaaagggatcatacgacctggcaccgcttttgaattgcttgaagcccaagcagctaccgggtatgttattgacccaatcaagggtctgaaacttacggtcgaagaggccgtcagaatgggtatcgtgggaccagagttcaaggacaagctcctctctgccgagcgcgccgttaccggttataaagacccatatagcggcaaattaatctctttgtttcaagcaatgaagaaaggcctaattctgaaagatcacggcatcagactgctggaagcccagattgccaccggcgggattattgatcccgaagagtcccatagactgccagtcgaagtggcttacaaacggggtctcttcgacgaggaaatgaacgagatactcacagatccatcggatgatactaagggcttctttgatcccaataccgaagagaatctgacctacctgcagctaatggagcggtgcatcacggatccacagaccggactgtgccttcttcccctaaaagaaaagaagagggagagaaagacttcaagcaaatcgagcgtgcggaaacgacgtgtcgttatcgtcgatcctgagacaggcaaggagatgtccgtttacgaggcttaccggaaagggctaatcgatcatcagacttatctggagttatctgagcaagaatgcgagtgggaagagattacaattagtagctcagatggtgttgtcaaatccatgatcattgatcgaagaagtggaaggcagtatgacattgatgatgccattgccaaaaacctaatagatcgctccgcgctggatcagtatcgggcaggcactctttcgattacagaattcgccgacatgctctctggcaatgccggaggcttcagaagtaggtcatccagcgtgggttcatcctcctcatatccaatcagccccgccgtttcacgaacgcaactcgcttcttggtctgatccaacggaagagaccggtcccgtagccggaattttggatacagaaaccctggagaaggtgtccattacggaagccatgcaccgaaaccttgtcgacaacatcacaggccagagacttctcgaagcccaagcttgtaccggtgggataatcgacccatcaaccggcgagagatttcccgtgacagacgctgtgaacaagggactggtggataaaatcatggttgatcgaatcaacctggcccaaaaagcattttgtgggttcgaggacccgcggaccaagacaaagatgagcgcagcccaggctcttaaaaagggatggctgtattatgaggccggacagcgattcttggaggtgcagtacctgaccggcggtctgatcgagccagataccccagggagagtccctctggatgaggctctgcagcgggggacagttgacgcacgaaccgctcagaagctgagggatgtcggagcatactccaagtaccttacatgtcctaagactaagttaaaaatttcctacaaggatgccctggataggtctatggtcgaagaaggtaccggcttgcgcctgttagaagctgccgcccaatctaccaaaggctactattctccatatagtgtctccggttctgggagcactgcgggcagtagaaccggcagcagaaccggatcaagggctggttctcggagaggctccttcgacgccactggatctgggttttcgatgaccttctccagctcttcttacagctccagcgggtacggtcgaagatacgccagtgggtcatcagcctctctgggggggcccgagagcgctgttgcctag

SEQ ID NO: 129019 - DNA, 13725 bp, Artificial Sequence
  Description of Artificial Sequence: Synthetic coding sequence
atgagtggagaagacgcagaagttagggcggtgtccgaagacgtgtcgaatggaagttccggatctcctagcccgggagataccttaccttggaatctgggcaaaacacagaggagcagacggagcggcggcggcgccggcagcaatggaagtgtgttggacccggctgagagggccgtcattcggattgccgacgaaagagaccgggtacagaaaaaaactttcactaagtgggttaataaacatttaattaaggcccagcgccatatcagtgatctgtatgaagacttgagagatggacacaatctgatttctcttctggaggtactcagtggagattccctcccaagggagaagggccgcatgcgtttccataagctccaaaatgtccaaatcgcgctcgactacttgaggcataggcaggttaagcttgtcaatatccgaaacgatgatattgctgatggtaatccgaaactaaccctcgggcttatctggactatcatcttacattttcagattagcgacattcaggtgagtgggcagtccgaagatatgacagcaaaggaaaaactgttgctgtggagccagcggatggtggagggataccaggggctccgctgcgacaatttcacctcttcatggcgagatggccggctctttaatgctatcattcaccggcataaacccctgctgatagacatgaataaggtgtaccgccagactaacctggagaatctggaccaggcgttcagcgtggccgaacgggacttgggggtcactaggctgctggatccagaagacgtggacgtgccccagcccgacgagaaatcaatcatcacctacgtctcctcactgtatgacgctatgccgcgggttcccgacgttcaagatggagtccgggccaacgaactgcagctgcgatggcaagaatacagagaattagtgttattgctgctgcaatggatgcggcaccatacagctgcgttcgaagaacgtcgattcccttctagcttcgaagagatcgagattctgtggtcccaatttctgaagttcaaagaaatggagcttcccgccaaggaagccgataaaaacaggtcgaaaggaatataccaaagtctggagggcgctgttcaggccggacaattgaaggttccaccagggtaccacccattggacgttgagaaggagtgggggaagctgcatgtggcaatcctggagagagagaaacagctccggagcgagtttgaaaggctagagtgcctgcaacgaatagttacaaaactgcagatggaggcggggttgtgcgaagaacagttgaaccaggcggacgccctgctacagtctgacgtgcggctgctggcagcaggaaaagttccacagcgggcaggcgaagtcgagagggatcttgacaaagctgactctatgatccgcctgctgtttaacgatgtccagacgctcaaagacggacgccatcctcaaggtgaacagatgtatcggcgcgtctacagactacatgaaaggctagttgccatccggaccgagtacaatctccgcctgaaggctggtgtggcagcgccagcgacacaagtggcacaggtaactcttcaaagcgtgcagcggcggcctgaactggaggactccaccctgcggtacttgcaggatctgctggcctgggtggaagaaaatcagcaccgagtcgacggggcggagtggggtgtggatcttccgagtgtcgaggcgcagcttggcagccacagaggcctgcaccagtcgattgaagagtttagggctaaaatagagagagcacgatctgacgaaggccagctatcaccagccacaaggggagcctacagagattgtctggggcggctggacctacagtacgcaaaactcttgaatagcagtaaggctcgcctgcgtagccttgaatccctccactcatttgtggcagctgctactaaggagttaatgtggctaaatgagaaggaagaagaagaagttgggtttgattggtcggaccggaatacgaacatgaccgccaaaaaggagtcgtactcagctctgatgagagagcttgaactcaaggaaaagaagatcaaggagttgcaaaacgcaggagaccgcctactacgtgaagatcatcccgcccggcctaccgtagaaagcttccaggccgccctccagactcaatggagctggatgctccagctgtgttgctgcatagaagcgcatctgaaagaaaacgccgcctactttcaatttttttcagacgtgagggaagccgagggtcagttacagaaacttcaggaggccctgcgacggaaatattcctgtgatcgcagcgccaccgtgaccagattggaggacctcctgcaggacgcacaggacgagaaagaacaactgaacgagtataaaggccatcttagcggtctcgccaagcgggcaaaggccgtggtacagctgaaaccgcgtcaccctgctcaccccatgcgtggcaggctccccctgctcgccgtgtgtgactacaagcaggtcgaagtgacggtccacaagggggacgagtgccagttggttggtccagcccagccatctcactggaaagtgttatcctcctctggatccgaggccgccgtacctagcgtgtgcttcctggtcccccccccaaaccaagaggctcaggaagccgtgacgcggttagaggcccaacatcaagctcttgttaccctgtggcatcagctgcatgtggatatgaagtctctcttggcctggcagtcactcagaagagacgtacagctcattaggtcttggagcctggccaccttcagaaccttaaaacccgaggagcagcgacaggccctgcattctctcgagcttcattaccaggctttcttacgcgattctcaagacgcagggggatttggcccagaggaccgactgatggctgagagggaatatggatcttgtagccatcactaccagcaattgctccaaagcctcgagcaaggtgcccaagaggagtccaggtgccagcggtgtatatcggaactgaaagatattcgcctgcagcttgaagcctgtgagacccgaacggtacatcggcttaggttgccattggataaagaacctgccagggagtgcgcgcagcgcatcgcagaacagcaaaaagcccaggctgaagtcgagggtctaggaaaaggggtggccagattgtcagcagaagccgaaaaagtgctagcactgcccgaaccatcaccagccgccccgaccttgcggagcgaacttgaactcaccttaggcaaactcgaacaggtgaggagtctaagtgcaatttatcttgagaagctgaagaccatctccttggtcatcagagggacacagggtgccgaggaagttctgagggctcacgaagaacaacttaaggaagcccaggccgttcctgccacccttcccgaactcgaggcgaccaaagcgtctctgaagaaacttcgagcccaggcagaggcccaacaaccaacctttgacgccctacgcgacgagctcaggggagcacaggaagtgggggagagactccagcagcggcacggtgagcgggatgttgaggtggagaggtggagagaaagagtggctcagttgttggagagatggcaggctgttctggctcagacggacgtcaggcagcgcgagcttgaacagttggggcgtcagctgcgttactaccgggaatccgccgatccccttggtgcctggcttcaagacgctcgtcgtcggcaagagcagatccaagcaatgccactggccgattcacaagcagttagggagcagctcaggcaggaacaggcactgctggaagagatcgagcgccacggcgagaaggtggaagagtgtcagagattcgctaaacagtacatcaacgcaattaaggactacgaattgcagctggtgacatacaaagctcagctcgagcccgtggcatcccccgcaaaaaaacctaaagtgcaaagtggatccgaatcagtcatacaagaatacgtggatttgcgcacacactattccgagcttacaacattgacctctcagtacatcaaatttatttcagagaccctgagacgcatggaggaagaggagaggttggccgaacagcagcgagccgaggaacgtgaacgcctggctgaagttgaggccgccttggagaagcaaaggcagttagcggaagcccatgcccaggccaaggctcaagccgagagagaagcaaaggagctccagcaaagaatgcaggaggaggtggtgcggagggaagaagcagcggtggacgcccagcagcagaaacgctcaattcaggaggagcttcaacagttgaggcagagttccgaggcagagattcaagctaaggcccgccaggctgaagccgctgagcgctcgaggcttcgtattgaggaggagattcgcgttgttagactgcagcttgaagcgacagaaagacaacggggcggagcagagggcgagctgcaggctttgcgcgcccgggcagaagaagcagaagcccagaagaggcaggcccaagaggaagctgaacgtttaaggcgtcaagtgcaggatgaaagccagcggaaacgtcaagcagaggtggaattggcctctcgagtcaaggccgaggcagaagctgcccgggagaagcagagagctctgcaggccctggaagagctgcgcctgcaagcagaggaggccgaaaggagactccgacaggcagaggtggaaagagcccggcaagtccaagtcgcccttgaaactgctcagcggtcggctgaagctgagctccagagcaagcgcgcttcctttgctgagaagaccgctcagctcgaacggtcacttcaagaggaacatgtcgccgtggcgcagttgagggaggaggccgagcgcagagcacagcagcaggcggaggcggaacgcgctagggaggaagccgaacgcgaactggaacggtggcagttgaaggctaatgaagcactgagactgcggctgcaagccgaggaggtggcccagcaaaagagcctagcacaagcagaggccgaaaagcagaaagaagaggcagagagggaggcgcgcagaagaggaaaagcagaggagcaggccgttagacagcgtgaactggccgaacaggagctcgagaaacaacgccaattagctgagggaacagcccaacagaggttggcggcggagcaggaactcattagacttagagcagagactgaacagggggagcaacagcgccagctgttagaggaagagctcgcacgcctgcagagagaagcggcggcggcgacacagaagcgccaagagctcgaggcagaactggcaaaggtcagagctgaaatggaggtcctgctcgccagtaaagctcgcgctgaggaagagtctcggagcactagcgaaaagtctaaacagagactcgaagctgaagcaggccggttcagagagctggccgaagaggccgcccggctcagagcccttgccgaagaggctaaacggcagaggcagctcgcagaagaggatgccgcccgccagcgcgctgaggctgagagagtgctggctgagaagctcgccgccattggagaggcaaccaggttgaaaacagaagcagagattgcccttaaggaaaaggaagcagaaaacgagcgcctgcgacggctcgctgaagacgaagccttccagagaagacggttggaagaacaagctgcccagcataaggcagatattgaggaacgtctggcccagctgcgaaaggccagcgattcagaactggagcggcagaaaggtctcgtggaggacactctcaggcaaagacggcaggtggaggaagaaatcctggcccttaaggcatcattcgagaaagccgcagccggaaaggctgagctggagttagaactgggaaggataagatccaatgccgaggacacattgagatcgaaggaacaagccgaactcgaggcagccagacagagacaactagctgccgaggaggagaggcgaaggcgtgaagccgaggagcgcgtccagaaaagcctggccgccgaagaagaggccgcgcgtcaacggaaggctgccctcgaggaggtcgagcggctgaaggctaaggtcgaggaggcccgcaggctgagggaaagagctgaacaggagtccgctcggcagttgcagctggcacaggaggctgcacagaagcgcctacaggccgaagaaaaagctcatgccttcgccgtccagcagaaggagcaggaacttcagcagacgctgcagcaggaacaatccgttctcgatcagctgaggggagaggctgaagctgctagacgggcagcggaagaagcggaggaggcacgggtgcaagccgagagggaagcagcacagtcgcgccggcaggtcgaggaggccgagcggctgaaacagtctgctgaggagcaggcccaggcaagggcccaggcgcaggcagccgcggaaaagcttcgtaaggaggccgagcaggaggcagctcggagggcgcaggccgaacaggctgccctccgccaaaagcaggccgccgacgccgaaatggaaaagcacaaaaagttcgccgagcaaacacttcggcagaaggcacaggtggaacaggagcttaccaccttaagactacagctggaggagaccgaccaccagaaaaatcttctcgatgaagagttacagcgcctgaaagcagaggcgaccgaagcggcgcgtcagcggtcccaggtagaagaggagctctttagcgttagggtccagatggaagagttgagcaaactgaaggcaagaattgaagcagagaatagggcactaatccttcgggataaggacaatactcagcggtttctccaggaggaggctgaaaagatgaaacaagtggccgaagaggctgcacggctcagcgtcgctgcacaggaggccgcccgcctgagacagctggcggaggaggatctggcccagcaacgagccttagctgagaagatgctgaaagagaagatgcaggcggttcaggaagctacccgactcaaggccgaggcagaactgttacagcagcagaaggagctcgcccaggagcaagctagaaggctgcaggaggacaaagagcagatggctcaacaactcgctgaagagacccagggatttcagaggacactagaggcggagagacagcggcagcttgaaatgagtgccgaggccgagcggctgaaacttcgagtcgctgagatgtctagagcgcaggctcgcgcagaggaggatgcacagcgtttccgcaaacaggccgaggaaataggggagaagctgcatcgaacagagctggctacgcaggagaaggtgacgcttgtgcaaaccttggagatccagagacagcagtctgaccacgacgccgaaaggcttagggaggccatcgccgagctcgaaagggagaaagaaaaattgcagcaggaggcaaagctgctccaactcaaaagtgaggagatgcagaccgtacagcaagagcagctgttgcaggagacccaagccttacagcagtcattcctgtccgagaaggactctctgctgcagagggaacgtttcattgagcaggaaaaggccaagctggaacagctgttccaggacgaagtggccaaggcacagcagttgcgggaggaacagcagcggcagcaacaacagatggagcaggagcggcagagattagtcgctagtatggaagaggcacgacggagacagcatgaagccgaagaaggagtccgcaggaaacaggaagagcttcaacagctcgaacagcagcgcaggcagcaggaagagcttctcgcggaggaaaatcagcgactgcgagagcaattgcagctgttagaagaacagcacagagccgctcttgcccacagtgaagaagtaactgcatcgcaggtggccgctactaagaccttgcccaatggtcgagatgccctcgatggccctgcggcagaagccgagccagagcacagcttcgatgggctgcggcgtaaggttagcgcccagaggctccaggaggccgggatcctgtctgcggaagagctccagcggttagctcaaggccacacaacagtggatgagttggcgcgccgtgaggatgtccgtcactacctgcagggcagaagctccattgccggcctattgcttaaggctacgaatgagaagctctccgtctatgcagcactgcagagacagctgctttctcctgggacggcacttatcctgctcgaagcacaggcagcatccggatttctgctcgatcccgttagaaaccgccggctcaccgtgaacgaggcggtcaaagaaggggtggttggccctgaacttcaccacaagctgctgtctgccgagcgcgctgtaacaggctataaggacccttatacaggtcagcagataagtctatttcaggctatgcagaaaggcctcattgtgagagagcatgggattcgcttgctggaggcgcagatcgctaccggaggagtaattgacccagtacactcccaccgtgtccctgtggatgtggcctaccgacgcggctatttcgacgaggaaatgaatagggtgcttgcagacccttctgatgatactaaagggttttttgaccctaacacacacgagaacttaacatacctacagctgctggagcggtgtgtggaggaccccgaaactggtctgtgcttgttaccccttacagataaagccgccaagggcggcgaattggtttacaccgacagcgaagctcgggatgtgttcgagaaggcaaccgtgtctgcccccttcggaaaatttcagggcaagaccgtgaccatctgggagattataaactccgagtacttcacggcagagcagcgtcgcgatctcttacgccagtttcggaccggtcggattacagttgagaagatcatcaagatcataattaccgtggtcgaggagcaggaacaaaagggtagactgtgcttcgagggactacgaagccttgtacctgccgctgagttactggagagcagggtaatagacagagagctctaccagcaactgcaaaggggtgagcgcagtgtgcgggacgtggccgaggtagacactgtgaggcgggccctccgtggcgccaacgttatcgctggtgtctggctggaggaggcgggacagaaattatcaatctataacgcgttaaagaaggacctgctgccaagcgacatggctgtagcactcctggaggcccaagccgggactggtcacatcattgaccccgctacatccgcaagactgacggttgatgaagccgtccgcgcgggtctagttgggcctgaatttcacgaaaagctcctctctgcagaaaaagccgtcacaggctaccgggatccttataccgggcaatccgtatctcttttccaggcactgaagaaagggcttattcctcgagaacagggtctacgactcctggacgcgcagctgagcactggaggaatcgttgatccaagcaagtcgcatagagttcctctggatgtcgcttgtgccagagggtgcctggacgaagaaactagccgggcactgagcgcccccagagccgatgctaaagcttattctgacccatccaccggcgaaccagctacttacggcgagctgcagcagcgatgccgccccgaccagctgacaggactgagcctcctcccacttagtgagaaggcggcaagagcacgacaagaagaactgtactcggaactgcaggctagagaaaccttcgagaagacacccgtcgaggttcccgtcggcggctttaaagggaggacagtaaccgtgtgggaactcatttcatccgaatactttaccgcagaacagcgtcaggagcttctccgccagttcaggactggaaaggtgacggtggaaaaggtgatcaagattctcatcaccattgtcgaggaggtcgagacattaagacaagaaaggcttagcttttctggtctccgggcccctgtcccggcctccgagctcttggcaagtggggtcctgtcccgggcgcaattcgagcagctgaaagatggaaagaccaccgtgaaagatcttagtgaattgggctccgttcgcaccctgctgcagggtagcggctgtttggccgggatttacctggaggatactaaagaaaaagtgtccatttacgaagcaatgagaaggggactgctgagagcgactacggctgcacttttattggaggcgcaggcggctaccggattcctcgtggacccggtgagaaatcagaggctgtatgtgcatgaggctgtgaaggccggtgtggttggtcccgaacttcacgagcagctgctcagcgcagaaaaggccgtaactggttaccgggacccctactcaggttcgacaatcagcctctttcaggccatgcagaagggcctggttctgcggcaacatggcattcggttgctggaggctcaaatagctacaggcgggattatagacccggttcattcacaccgtgtaccagtggatgtggcctaccaaagagggtatttttcagaggagatgaatagagttcttgccgacccttccgatgataccaaagggttcttcgacccgaacacccacgaaaacctcacatataggcagttactggaacgctgcgtggaggacccagagacaggactgcgacttctccccctgaagggtgccgagaaagcggaagtggtggagacgacacaggtatacaccgaggaggagactcgcagagcattcgaagaaacacagattgatatccctggcggaggctctcacggcggtagcacaatgtctctgtgggaggtgatgcagagtgatctgatcccagaggagcaacgtgcccaactcatggccgattttcaggcagggcgcgtcacgaaggagcggatgatcattatcatcatcgaaattatcgagaaaaccgagattatcaggcagcaggggctggcctcttacgactacgtgcggagacgcctgaccgctgaggatctctttgaggctcgcataatcagcctggaaacatacaacttattgagagaaggcacacgatcactgagggaagctctcgaggcggagtccgcctggtgttatctctatggtactggctcggtcgcaggggtatacctccctggatcccggcagaccctgtctatctatcaggctctcaagaagggcctgctgtctgccgaggtggctagactactactcgaagcacaagccgccaccgggttcttgcttgatccagtaaagggagaaagactcactgtggatgaagcggtacgcaagggtttagtgggcccagagctccacgacaggttgctgtctgctgagagagccgttacaggatatcgcgatccttataccgaacagactatctccctctttcaggcaatgaaaaaagaactgatccccacggaggaggcacttagactcttagacgcccagctagcgacgggcggcattgttgatcccagactgggttttcacctacccctggaggtcgcttatcagaggggctatctgaacaaagacacccatgaccagctcagtgaaccctccgaagtcaggtcttatgtcgaccccagtaccgacgagagactgtcatatactcaattacttaggagatgcagaagagacgatggaactggccagctcctgctgccattatcagacgcacggaagttgacattccgtggattaagaaagcagattactatggaggagctggttaggagtcaagtgatggacgaagccaccgccttgcagctgagggagggactgacttccatcgaagaggttacaaaaaatctgcagaagtttctcgagggcacctcttgcatcgctggagtattcgtagacgccaccaaggagaggctcagtgtatatcaggccatgaagaaggggattattagacccggcacagccttcgaactcttagaagctcaagccgcaactggctacgtgatcgacccgattaaaggacttaaactcaccgttgaggaagctgtgagaatggggattgttggccccgaattcaaagacaagctgctgagcgcagaaagggcagtcacgggatacaaagatccctactctgggaaactgattagtctttttcaggcgatgaagaagggcctaatcttaaaagaccatggcatcaggttactggaggcgcagattgctacaggcggaatcattgacccggaggagagccaccggcttcctgttgaagtcgcatataaaaggggcctgtttgatgaggagatgaatgaaatcctcactgacccgtctgacgataccaaaggcttcttcgacccaaatacagaagagaatctgacttacctgcaactcatggagaggtgtattactgatccccagactggattgtgcttactgccgttaaaggagaaaaaaagggaacgcaagaccagttcgaagtcatccgtgcggaaacggagggtggtgattgttgatccggagaccggcaaggagatgtcagtctatgaggcgtacaggaaaggattgatcgaccaccaaacttatctagagctgtcagaacaggagtgcgaatgggaggaaattacaatcagctcttcagacggagtggtcaagtcaatgatcattgaccgcagatcaggtaggcagtacgatatcgacgatgcaattgccaaaaacctcatcgacaggagcgctctggaccagtatcgtgccgggacgctctcaattacagaattcgcggacatgttgtccggaaatgctggcggcttccgaagccggagctctagcgtgggatcaagcagcagctatcctatctctcccgctgtttcccggacccaactagcgtcctggtcagatcctaccgaagagaccgggcccgttgcaggcatcttagacacagagaccctggaaaaggtttccataacagaagcaatgcatcgtaatctggtggacaatatcaccggacagcgtttgctggaggctcaagcctgcactgggggcatcatcgacccatctaccggtgaaaggtttccagtgaccgacgccgtaaacaaaggccttgtagataagattatggtggataggatcaatctggctcagaaggccttctgtggctttgaggacccccgcactaaaaccaagatgtctgccgcacaggcgctcaagaaggggtggttgtattatgaggctggacaaagatttttggaagttcagtacctcaccggtggcctgatagaacccgacacacccggcagagtccccctcgacgaagccctccaacggggtacagtagacgcacggactgcccagaaacttagggacgttggggcttacagtaaatatttgacctgcccaaagactaagttaaagatatcttataaggatgccttagaccggtcaatggttgaggaggggacgggattacgattgttagaggccgccgcgcagtccactaagggttactattcgccttattcggtcagtggcagcggaagcactgcgggcagccgaacagggtcacggaccggttccagggcgggaagcagaagaggcagcttcgacgccaccggctctggctttagcatgacattcagctcttctagctattcttcgtctgggtacgggcgccggtatgccagcggctcttcagcatcgctcgggggacccgaatccgctgttgcttag

SEQ ID NO: 129020 - DNA, 13713 bp, Artificial Sequence
  Description of Artificial Sequence: Synthetic coding sequence
atgagtggagaggatgctgaggtgcgggctgtgtcagaagatgtgtccaacggaagctcgggctccccctcccctggggatacccttccctggaacctggggaagactcagaggtctcgacgatcagggggaggtgccggatccaacggctctgtcctcgatcccgcagagagagcagtaatcaggattgctgacgaaagggatagggttcaaaagaaaacattcacaaagtgggtcaataaacacctgattaaagcccagcggcatattagtgacctgtatgaagatctacgggatggacacaacctgatttcactcctggaggttctgagcggggatagtttgccccgggagaaaggcaggatgaggtttcacaagctccagaacgttcagattgctctggattatcttagacatcgacaagtcaagctggtgaacatacgtaacgacgacatcgccgatgggaacccgaaactgaccctcggattgatctggaccattatcctgcatttccagatctctgatattcaggtaagcgggcagtccgaggacatgaccgcaaaagagaaactcctgctgtggagccagcggatggtggagggttaccaagggctacgctgtgataacttcacaagctcctggcgggatggtcgcctgttcaacgctatcatccacaggcataagcctctgctgatcgatatgaacaaagtctacaggcagacaaacctagaaaacctcgaccaggctttctctgtagctgaacgggacttaggcgtgacgcggttgctcgatccggaagacgtggacgtcccccagcccgatgagaaaagcataattacatacgtgtcatcactctacgatgcaatgccacgggtgcccgacgtgcaggatggagagctgcaactgcgatggcaggagtaccgcgagctggtgctgctactgttgcagtggatgagacatcacaccgccgcttttgaagagcgccgcttcccctcgtcattcgaagaaatagagatactgtggtcgcaattcctaaagtttaaggagatggagctacccgcaaaggaggccgacaaaaaccgcagtaagggcatctaccagtccttagagggagccgtgcaggctggacagcttaaggtcccgccgggctatcatcctctggatgtggaaaaggaatggggaaaactgcatgttgcgatcctcgaacgcgagaaacagttgcgcagtgagtttgagagactggaatgtctacagcgtattgtgacaaagctgcagatggaagcgggtctttgtgaggagcagctgaatcaggccgatgccctgttgcagagtgacgtcaggctactcgctgcgggcaaggtgcctcaaagagcaggtgaagtggagcgcgatctcgacaaagccgatagcatgattagactgctctttaatgacgtgcaaacacttaaggacgggcggcatccccagggggagcaaatgtataggcgagtgtacagactccatgagcggcttgtcgcgatcaggactgaatataacctgcgcctcaaggccggcgtggcggcccctgcaacccaggtggcgcaggttaccttacaatctgtccaaaggcggccagaactggaggacagtactttgcgctacctgcaggatcttttggcatgggtcgaagaaaatcagcatcgcgtcgatggcgcagaatggggcgtcgacctgccatcagtggaggcccaactcgggtcccaccggggcctccatcagtctattgaggaatttcgcgcgaaaattgaacgcgcccgcagcgatgaaggtcagttatctccagctacccgtggtgcttacagagactgcttgggccggttggacctgcagtatgccaagctgctcaactccagcaaagctaggctgcgcagtctggagtcattacactcttttgttgccgccgcaacaaaggagttgatgtggctcaacgaaaaggaggaggaggaagttggattcgattggagcgaccgaaacacaaacatgaccgcgaaaaaggagtcttactcagctctgatgagagaactagagttgaaagaaaagaaaattaaagagttgcagaatgccggcgaccggctgctacgggaggatcacccagctaggccaacagtggagtcattccaggccgctctgcagactcaatggtcctggatgctgcagctgtgttgctgtattgaggctcatttaaaggagaacgcggcgtacttccagtttttttccgatgtgagagaagcagaggggcaattacagaagttgcaggaggctctgcgacgcaaatactcctgtgaccgctcggcgacagtcactcgacttgaggacctactgcaggacgcccaggatgaaaaagagcagttaaatgaatacaaaggccacttatcaggactggcgaaacgcgccaaggctgtggtgcaattaaagccgcgtcacccagcccaccctatgcgcggaagactgcccctcctcgccgtctgtgactataaacaggttgaagtcactgtccacaaaggcgatgaatgccagcttgttggcccagcccagccatctcactggaaggtgctgtcatcgtccggatccgaggccgccgtccccagtgtgtgcttcttggttcccccccccaaccaggaagctcaggaggccgtgacgagactggaggcgcagcaccaagcacttgttactctgtggcaccagctccacgtggacatgaagagcctgttggcctggcaaagccttcgcagagatgtacaactgatccgaagctggagcttggcgactttcaggaccctcaaaccagaggaacaacgtcaagcattgcacagcctcgaacttcactaccaagcattcctgagggactctcaggacgccggcgggttcgggcccgaggatagacttatggctgagcgagaatacgggtcttgctcacatcattatcagcagctgctacagagtttggaacagggcgcccaagaggaaagccgatgccagaggtgtataagcgagctgaaagatatccggctgcagctggaagcttgtgagacaaggacagtgcataggctgaggctgccactggacaaagagcccgctagggagtgtgcccagcggatagcagagcagcagaaggcccaggcagaagtggagggattgggtaagggagtggcaagattgtctgcggaagcagaaaaggttctcgccctcccggaaccttcgcctgccgcaccgactttgagatcagagttagaactgactttggggaagttggagcaggtccgaagcctgtccgccatctacctggagaagctgaagaccattagcctggtgattcgcgggacacaaggggcggaagaggttctgcgcgcgcatgaagaacagctgaaggaagcacaggcggtaccagcgaccctgcccgagctcgaggcaaccaaggcaagcctgaagaagcttagggctcaggccgaggcacagcagcctacgttcgacgcactgcgggacgagcttaggggggcccaggaggtgggggagcggttgcagcagcgtcacggcgaacgagacgtcgaagttgaacgctggcgcgaacgcgtcgcacagcttctggagagatggcaggccgtactggctcagactgatgtcagacagcgggagcttgagcagctggggaggcaactcaggtattacagagaaagtgccgacccactgggagcctggttgcaggatgcgagacgtcgacaggaacagattcaggcaatgcccctggctgacagtcaagctgttcgggaacagttacggcaggaacaggctcttctggaggagatagagcgccacggtgagaaagtggaggagtgtcaaaggtttgccaaacaatatatcaacgccatcaaggactacgagctgcaactggtgacctataaggcccaactggaacccgtggcctccccagccaagaaaccaaaagttcagtcagggagtgagagcgtcatacaagagtacgtggacttaagaacgcattacagcgagctgacaacacttaccagccaatatatcaagttcatcagtgaaacacttagaagaatggaagaagaggagagactggccgaacagcagcgtgccgaggagcgggaacgcctcgccgaagttgaggcagctctggagaaacaacgtcaactggccgaggcccatgcacaagccaaagcacaggccgaacgagaagccaaggagctgcagcagcgaatgcaagaagaggtggtcaggagagaggaggccgccgtagacgctcagcagcagaaaaggtccatccaagaggaactgcagcagttgcggcagagcagtgaggcagaaatccaagctaaagcacgacaggctgaggccgcagagcgcagtcgcctgagaattgaagaagagatccgagtagttcggttgcagcttgaggccacagagaggcagcgcggcggcgctgagggagagcttcaggctcttcgggcccgggcagaagaggccgaggcacaaaagcggcaagcgcaggaggaggctgaacgcctgcgccgtcaggtgcaggacgagagtcagcgcaaacgacaggctgaggtcgaactcgcctcacgagtcaaggctgaagctgaagctgctcgggaaaagcaacgtgcccttcaggccttagaggaactccgactccaggctgaagaagcagaaaggaggctacgccaggcagaagtggagcgtgcccggcaggtgcaagttgcattagagacagcccagagatcagccgaggcggagctgcaatctaagcgggcttcattcgcggagaagacggcgcagctggaacggtcgctccaggaagaacacgtcgccgtggcacaattgcgagaggaagccgagcggagggcacagcaacaagcagaggccgagagagcgcgggaggaggcggagagggaactggaacgctggcaactgaaggccaacgaggcattgcgcttacgcttgcaggctgaggaggtggcccagcagaaatccttggcccaggcggaagctgagaaacaaaaggaggaggccgaacgggaagcccggagaagaggcaaagccgaagagcaggccgttcgccaaagggagctggcggaacaggaacttgagaaacagcgtcaactggctgagggcaccgcgcagcagcggctggcagcggagcaggaactcatacgtctccgcgctgagacagagcagggtgaacagcagaggcaattgctcgaggaagagctggcgagactgcagagggaagccgcagcagccacccagaaaagacaggaactggaagcggaactggccaaggtgcgcgccgagatggaagtgctgctggcttctaaggctcgtgcggaggaggaatccagatcaaccagtgagaaaagcaagcagaggttagaagccgaggcaggacgctttcgagagctggctgaggaggccgccaggttaagagcactggctgaagaggccaaaaggcagaggcagttagctgaggaggacgccgccagacaaagagccgaggctgaaagggttttggcggagaaactcgccgcaattggagaggccactaggctgaaaacagaggcagagattgctctcaaggagaaagaggcagagaacgagaggctccgccgtttggcggaggatgaagctttccaaaggagacgactggaggaacaggccgcgcagcataaggcagacattgaggaacgactcgcccagctgagaaaggccagcgattctgaactggagagacagaaagggctggtggaagatacgctgcgacagcggaggcaggtcgaggaggaaatcctcgcacttaaagcaagttttgaaaaagcggccgcggggaaggctgagctggagcttgagctaggccgcattcgctcaaacgctgaggacacccttcggagcaaagagcaggctgaactcgaggcagcacgccagagacagcttgcagccgaagaggagaggaggcgcagagaggccgaggagcgcgttcagaagagtctggccgcagaggaagaggctgcacgccagagaaaagccgccctggaagaggttgagcgtctgaaggccaaagtcgaggaagctcggcggctgagagagagggccgagcaggagagtgcccgccaactgcaactggcccaggaggccgcccaaaaacggctccaagccgaagaaaaagcacatgcatttgcggtacagcagaaggagcaagagctgcagcagactctgcagcaggaacagtccgtattggaccagttaaggggggaggcagaggctgcaaggagggccgctgaagaggcggaagaagcgagggtgcaagctgagagggaggcggcacaatcccgtcgccaggttgaggaagcagagcggctgaagcaatcagccgaagagcaggcccaggcccgcgctcaggctcaggcggccgcagagaagctgcgcaaggaagcagagcaggaagcagccagaagagcccaggctgagcaggccgccctgcgccaaaaacaggctgccgacgccgagatggaaaaacataagaagttcgctgagcaaaccctgagacagaaggctcaggtcgagcaggagttgacaaccctgaggctccaactcgaagagacagaccaccagaaaaacttactggatgaggagttgcaacgattgaaggccgaagcaactgaagccgcacgtcagcggtcccaggttgaagaggagcttttttcggtcagggtgcagatggaggagctgagtaaactgaaggctcgaatcgaggctgaaaaccgggctctcattttgagagacaaggataatacacaacgattcctacaggaagaagcggagaagatgaaacaggtggccgaagaagccgctaggctatctgtggccgcacaagaggcagccagactacgtcagctcgccgaggaagatctggcccaacagagggctctcgctgagaagatgttgaaagagaagatgcaggccgtccaagaagccaccagactgaaggcagaggccgaactcctgcaacagcagaaggagttggcacaggagcaggctagaagattacaggaagacaaagagcagatggcccagcaactggccgaggaaactcaaggatttcagaggaccctcgaggccgagcgccagcgtcagttggaaatgtcggccgaggccgagaggctcaaactgagagtggcagagatgagcagagcacaggccagagctgaagaggacgcccaaagatttcgcaagcaggcggaggagatcggggagaagctccatcgcacagaactggctactcaggaaaaggtcaccctcgtgcagacactggagatccaacggcagcaatccgatcacgacgccgagaggttgagggaggcaattgcagagctggagcgggagaaggaaaagctgcagcaggaggcaaagttattacagcttaaaagcgaagaaatgcagacagtgcagcaagaacaactcttgcaagaaacacaggctcttcagcagagctttttgtcggagaaagattctctgcttcagagagagcgcttcatcgagcaagaaaaggctaagctggaacaacttttccaagatgaggtggctaaggcccagcagctgagggaggagcagcaacgccagcagcagcaaatggaacaagagcgccagagacttgtagcatctatggaggaggccagacgcaggcagcacgaagcagaggagggtgttaggcggaagcaggaggagctgcaacagctcgagcaacagcgccgacagcaggaggaattgctggcggaggagaatcagcgattgcgcgagcagttgcaattgttggaggagcaacacagggctgccctggcacattccgaggaggtgactgccagccaagttgcagctactaagaccctgcccaacgggagagatgcactggatggccctgctgctgaggctgagcccgagcattcattcgatgggcttcgacggaaagtgagtgcacagagacttcaggaggcaggaatcctgagcgctgaggagctgcagcggctggcccaggggcatacgaccgtcgatgagcttgccagacgcgaggacgtacggcactatctgcaggggaggtcttctattgcagggctgctgctaaaagccaccaatgagaaactctctgtgtatgccgccctgcagcgccaattgcttagtcccggtacggctctcatcctgctggaggcccaagccgctagtgggttcctgctggatcccgtgaggaacagacggctgactgtgaacgaggccgtgaaggagggagtggtgggtcctgagctccaccataagctgctgagtgcagagagagccgtgaccgggtataaagacccctacactggacaacagatctcgctgtttcaggctatgcagaagggcctgatcgtgcgcgagcatggcattcgcctacttgaggcccaaatagctacagggggggtgatagacccggtgcatagccaccgcgtgccggtggatgtggcatacagaaggggttacttcgatgaagagatgaatagggttcttgctgacccttccgacgacacaaagggcttcttcgatcccaatacacacgagaatctaacctacctgcagcttcttgagcgttgtgtcgaggatcctgagacgggcttatgcctcctcccattaaccgacaaggcagctaagggcggagagctggtctacacagattcagaagctcgggatgtctttgaaaaggctactgtatcagccccgtttggaaagtttcagggaaaaactgtcacaatatgggagattataaatagtgagtattttactgcggagcagaggcgggatcttctgagacaattccggaccggtcggattacggtggaaaaaatcataaagatcattattactgtggtggaagagcaggagcagaagggacgactgtgttttgagggtctccgtagcctagtgcccgcggctgaactgctggaaagccgcgtgatagaccgcgaactctatcagcagttgcagagaggggaacggagtgtaagagacgttgccgaagtagatacggtgagaagagcgttgcgcggggccaacgttatcgctggagtgtggctggaggaagccgggcagaagctgagcatctacaatgcattaaagaaagacctcctcccatccgatatggccgtggctcttttagaggctcaggctgggaccggacacataatcgatcccgctacttccgccagactgactgttgacgaagctgttcgcgccgggctggtagggccagagtttcatgagaaattgttgagcgctgaaaaagcagtgactggatatcgcgacccatacacagggcagagcgtgagcctcttccaggctctaaagaaaggactcatcccgagagaacaggggttgcgcttgctggatgctcagctcagcactggtggaatcgtcgatcctagtaagtcccatagagttcccctggatgtagcttgcgcacggggatgtctagatgaggaaacaagcagggccctgtccgctccacgagccgacgccaaggcatactccgaccctagtactggggagccagccacgtatggagagttgcagcaacgatgccggcccgaccagctgaccgggctgtccctcttgcctcttagtgagaaggcagctcgggctaggcaggaagagctgtattctgaattgcaagccagggagacgtttgagaagacacctgtagaagtgcctgtgggcggcttcaaaggcagaacagtgacagtgtgggagctgatcagctctgaatacttcacagcagagcaaaggcaggagctgctgagacagttccggaccggaaaggtaacagtggagaaggtcattaagatcctgatcaccattgtggaggaagtcgaaactctgcggcaagaaagactttccttctctggactccgagcaccggttccagccagcgagctgctcgcctccggtgtcctttccagggcccagtttgagcagctgaaggacggaaagaccacagtcaaggatcttagtgaattgggtagcgtacgcaccctccttcagggcagcggatgtctcgctggaatttatctggaagacaccaaggagaaagtgtccatttacgaagccatgcggcgcgggctccttcgggccaccactgcagccctgctgcttgaggcccaggctgccaccggctttttggtagaccctgtgcgcaatcagcggctttatgtacacgaagcagtgaaagctggcgtggtgggacccgaactacacgagcagctcctctcagctgaaaaggctgtgaccggttacagggatccatattcagggagcacaatctcactattccaggctatgcagaaagggctcgtgctgcgccaacatggaatcaggttgctcgaggctcagatcgcaactgggggcatcatcgacccggtgcactcccaccgcgtccctgtggacgtggcgtaccagcggggctatttcagtgaggaaatgaaccgagtgctggccgacccctcagatgacaccaaaggatttttcgacccaaacacccacgaaaacctgacttatcgtcaactgctagaaaggtgcgtcgaagaccctgagacaggtcttcgtcttcttccattgaagggggcagagaaagctgaggtagtggagacgacacaggtctatacagaggaggaaacccggagggctttcgaagaaacgcagattgacatccctggcggggggtcgcacggtggctccactatgtccctctgggaagttatgcagtctgatcttattcctgaggaacagcgagctcagctgatggcagattttcaggctgggcgagtgaccaaggagcgcatgatcatcatcattatcgaaataatcgagaagacagaaattataaggcagcagggtctcgcctcatacgattatgttcggcgtcggctaactgctgaggacctcttcgaagcccgtatcattagcctggaaacgtacaatttgcttagggagggaactcgctcactgcgagaagccctggaggccgagtctgcatggtgttatctttacggaactggctcagtggccggtgtgtacctgcctggctctcggcagaccctcagtatttatcaagcgctgaagaagggccttttgagcgcagaagttgcccgcctgctgctggaggctcaagccgccacgggattcctgttggatcctgtgaagggcgagaggctgaccgtcgacgaggcggtgagaaaaggattagtcggcccagaactccatgacaggctgttgtccgctgagagagcagtgactggctacagggatccgtacactgagcagacgatctccctattccaggctatgaagaaggagctgatcccgacggaggaggctcttcgattgctcgacgcacagttggctacagggggaatcgtggaccctcgcctgggattccatctccccctggaggtggcctatcagcgcgggtatcttaacaaagacactcacgatcagttgtcagagcctagtgaagttcgatcctatgttgatccatccaccgatgaacgcctctcctatacacaacttctgcgcaggtgcagaagggacgacggaaccgggcagctgctactgccgctgagcgacgctcggaagctgacctttcgtggattgcgaaagcaaattacaatggaggaacttgtccgatctcaagtgatggatgaagcaactgcgttgcaactcagagagggccttacatcaattgaggaggtgactaaaaatctgcaaaagtttctcgaggggacctcctgcattgccggcgtgtttgtcgacgccacaaaagagagactctccgtctaccaagcaatgaagaagggaatcatccgccctgggacagcttttgagttactggaagcccaggccgccacaggctatgtgatcgaccctatcaaggggttaaaactcacagtggaggaagccgtgcggatgggcatcgtgggccctgagttcaaagacaagttactcagcgcggagagggctgtcacagggtacaaagacccatactctggcaaactcatttcccttttccaggcaatgaaaaaggggttgatcctgaaggaccacggcatcaggctgctagaggctcagattgctaccgggggaatcatagatcccgaggaatctcaccgtctgcctgtggaagtggcctataagcgaggtctgttcgacgaggagatgaacgaaatactcactgacccatcagacgatactaaaggttttttcgaccccaatactgaggagaacttaacctaccttcagttaatggagcgctgcattacagacccccagaccggactttgtctgctccctctgaaagagaagaaaagggaacggaagactagctctaagagctccgtgcgcaagcggcgcgtggtgatcgtcgatccagaaacgggaaaggaaatgtcggtatatgaggcttaccggaaaggtttgattgatcatcaaacctatctcgaactatccgagcaggagtgcgaatgggaggaaattacaatcagttcttctgatggcgtggttaaaagcatgattatcgataggcgctctgggaggcagtacgatattgacgacgctatcgccaagaacttgatagaccggtcagcccttgatcagtaccgggcgggaacactcagcataacggagttcgctgatatgctgtccggcaatgccggtggatttagatcccggtcttcaagtgtgggctcatcttcctcataccctatttcacccgccgtgtcccggacccagctggcaagctggtccgacccaacggaggaaacagggccggttgcaggcatcctggacactgaaaccctggagaaagtgagcatcaccgaggctatgcatcgaaatcttgtggataacataaccggtcagaggcttttggaagcccaggcatgtacggggggaattatcgatccctctacaggagaacgatttcctgtgacggacgctgtgaacaaaggcctggtggataaaatcatggtggacagaatcaacctggcccaaaaggctttctgtggattcgaagacccccgcactaaaacaaagatgtcagccgcacaagctctgaagaaaggatggctttactacgaagccggtcagcggttcctggaggtacagtacctgacaggcggcctcatcgaaccggataccccaggacgggtcccgcttgacgaggccttgcagcggggaacggtggatgcacgtaccgcgcagaagcttcgagatgtcggagcctatagtaaatatctgacgtgccctaagaccaagctgaagattagttataaggacgcccttgaccgaagtatggtcgaagaggggacaggtctgaggttgctagaagctgccgcccagtcgactaaaggatattacagcccatatagcgtgagcgggtcagggagtactgccgggagccgcactgggtcacgcactggctccagggctggttcgcgcagggggagcttcgacgctaccggcagtggattctcaatgactttcagctcctcctcctattccagttccggttacggacgacggtacgctagcggatcttccgcatccctggggggccccgaatctgcagtcgcttag

SEQ ID NO: 129021 - DNA, 1503 bp, Artificial Sequence
  Description of Artificial Sequence: Synthetic coding sequence
atggccacggttattcccggggatctctccgaggtccgcgatacccagaaagtgcctagcgggaaaaggaaaagaggtgagactaaaccgagaaagaatttcccgtgccagctgtgtgacaaggcttttaatagcgttgagaagctgaaggtgcacagctattcccacaccggcgaacggccttataaatgcatccagcaagactgtacaaaggcttttgtgtcaaagtataaactgcagagacatatggcgacccactcccccgagaaaactcacaagtgtaactactgtgagaagatgtttcaccgtaaagatcacctaaaaaaccatctgcacacacatgatccgaataaagagacatttaaatgtgaagagtgcggaaaaaattataacacgaagctgggctttaagcggcaccttgcgctgcacgccgccacctctggcgacttgacatgtaaggtctgtctccagacctttgagtccaccggcgttcttctcgagcacttgaaatcacacgccggtaagagtagtggcggagtcaaagagaaaaagcaccagtgtgaacactgtgatcggcgcttttacacgaggaaggatgtcaggaggcacatggtcgttcacaccggtcggaaggattttctgtgccagtactgtgcccaaaggtttggccggaaagatcacctgacacggcacatgaagaagtcccataatcaggagctgctgaaggtgaagaccgagccggtcgattttctcgatccattcacctgcaatgtgtcagtgccaattaaggacgagttgctgccagtaatgagcttgccatcctctgaattattatccaaaccattcaccaatacattgcagcttaatctgtacaatacaccgtttcagtctatgcagagcagcggctcagctcaccaaatgatcacaacccttcctctcggtatgacctgtcctattgacatggacacggtgcacccctctcaccacctctctttcaaatatcccttctcctctacttcctacgctatcagcattcctgagaaggagcagccactgaagggcgagatcgagtcctacctaatggaactccaggggggcgttccctcaagctctcaggacagccaggctagcagtagcagcaaactggggctggatccacagataggatctctggacgacggagccggcgatctgtccctcagcaaaagctccatttcgatatccgatccactgaacactccagccctggatttctctcagctctttaatttcattcccctgaacggccctccctacaacccactcagcgtaggaagtctgggcatgtcatacagccaggaggaggcacactcatcagtgtcccagctgccgccccagacacaggaccttcaggacccagccaacaccattgggctcggaagcctgcattcattatccgctgccttcacctccagtctatccacatctacaaccttgccaagattccatcaagcgttccagtag

SEQ ID NO: 129022 - DNA, 1257 bp, Artificial Sequence
  Description of Artificial Sequence: Synthetic coding sequence
atggctactcattctcctgagaagacccataagtgtaactattgcgagaaaatgttccaccgaaaagatcacctcaaaaaccacctgcatactcacgacccgaacaaggagactttcaaatgcgaagaatgtggaaagaattacaacacgaagctgggttttaaacggcacttggctctccacgctgccaccagtggggacctcacctgtaaagtgtgcctgcagacctttgagtcaacaggcgtcctactcgaacatctcaagagccacgcaggtaagagctctggcggagtgaaggagaaaaagcatcagtgcgaacattgcgaccggcgcttctatactagaaaagacgttaggcgtcacatggtcgtccatactgggcgaaaggacttcctctgccagtactgcgcccagagatttgggaggaaagatcatctgactcgacacatgaagaagagccacaatcaggagctgcttaaggtaaagaccgagccagtggatttcctagacccattcacctgcaatgtctccgtcccgattaaggatgaactgctacctgtcatgagcctaccttcttccgaacttctttcaaagcccttcacaaacacactccagcttaatttgtacaacacgcccttccaaagcatgcaaagttcagggtctgcccaccagatgattaccacactgccgttagggatgacctgtcctattgacatggacacagttcacccatcccatcatcttagcttcaagtacccgttctcaagcacatcgtacgcaatctccattcccgaaaaagagcaacccctgaagggcgagatcgaatcatacttgatggagctgcaggggggggtgccctcaagctcccaagactcgcaggcctctagctcaagcaaactaggcctagatcctcagatagggtctttggacgacggggcgggggacctttcactgtccaagagtagtataagtatttccgatccgctgaacacgccagcgctggatttcagccagcttttcaatttcatccctctcaacgggcccccttataacccactcagcgtggggagcctcggaatgtcctatagccaggaggaggcacacagctctgtatcccagctccccccccagacgcaggacctccaagaccccgcaaatacaattgggctgggctctctgcactcactctctgctgcctttacttcgtccctgtccacatccacaacacttccaagattccatcaagcatttcagtag

SEQ ID NO: 129023 - DNA, 1503 bp, Artificial Sequence
  Description of Artificial Sequence: Synthetic coding sequence
atggctacagtgatacccggggatctgagtgaagtgcgggatacacaaaaggttcccagcgggaagcggaaaaggggggaaacaaaacctcgaaaaaatttcccatgccagctgtgcgataaggcgttcaatagcgtcgagaaactcaaagttcatagttattcacacacgggcgaacggccatataaatgcattcaacaagattgtaccaaagcttttgtgtcaaagtacaagctccagagacatatggcaacccattccccagaaaaaacccacaagtgtaactactgcgaaaagatgttccatagaaaagaccatctaaaaaaccacctgcatactcacgaccctaacaaagagacattcaaatgcgaggagtgcggcaagaactacaatacaaagctgggattcaaacggcaccttgctctgcacgccgcgacctcaggcgatctcacttgcaaggtgtgtctacaaactttcgagagcaccggggttctcctggaacacctaaagtctcacgcgggcaaatcctccggcggcgttaaggagaagaagcaccaatgtgagcattgcgaccgtaggttctacaccaggaaggatgtgagacggcacatggtagtacatactgggcgcaaggactttctgtgtcagtactgtgcccagcgttttgggagaaaggaccatctgaccagacacatgaagaagtcacacaatcaggagttacttaaggtgaagacagaacccgtagatttcttggatccctttacatgcaatgtcagcgtgccaattaaggatgaacttttgccagtgatgagtctgccttcgtccgagctgttgtctaagcctttcacgaatacccttcagcttaacctctacaacacaccatttcagtctatgcagagctccggaagtgctcaccagatgatcactaccttgccactagggatgacatgccccatagacatggataccgttcatccttcccatcacctgtctttcaaatacccctttagcagcacttcttacgccatcagtattccggaaaaggaacagccactaaagggagagattgagtcatacctgatggaactgcaggggggcgtcccctccagctcccaggactctcaggcttcctccagtagcaagctaggtctggacccacagattgggagccttgatgacggcgccggggacctgtctctgtctaagagcagcatctccattagtgatccgcttaatactcctgccttagacttttcccaactttttaatttcatacctctgaatgggcccccttacaatcccctaagcgtcggctcactcggtatgtcgtatagtcaagaagaagcccattcctccgtatcccaactaccgcctcagacccaggatctacaggatcccgcaaatactatcggcctcggttctcttcactccttatcggcggcgtttaccagttctctgtccacaagtaccacccttcctcgatttcaccaggccttccaatag

SEQ ID NO: 129024 - DNA, 1392 bp, Artificial Sequence
  Description of Artificial Sequence: Synthetic coding sequence
atggccacatttccttgtcagttgtgcggcaaaaccttcttaaccttggagaagttcacgatacacaattactcccactcgcgggagcggccttacaaatgcgttcaaccggattgcggcaaggccttcgtgtcacgctataaattgatgagacacatggcgacccactctccacagaaaagtcatcagtgcgcccactgtgaaaagacattcaatagaaaagaccatctgaaaaatcacctgcagacgcacgaccctaacaagatggcctttggctgtgaggaatgtgggaagaagtacaataccatgctcggatacaaaagacatttggcgctgcacgccgcctcaagcggggacctgacgtgcggcgtgtgcgctcttgagcttgggagtacagaggtgctgctggatcacctgaaggcccacgcggaggaaaaacctccttccggaaccaaggagaagaagcaccaatgtgatcattgtgaacgctgtttctatactcgcaaagatgtgagaaggcatttggttgtgcacaccggttgtaaagactttctatgtcagttctgcgcgcagcgattcgggcgaaaggatcatctaaccagacacacaaagaaaacacactctcaggagttgatgaaggagtcacttcagacaggtgatctgctgtccacattccacacaatatcaccttcgttccagcttaaggctgccgcattgcccccttttccgctaggcgcctccgcccagaacggactggctagcagtctgcctgccgaggtccatagcctgactttatctccgcccgaacaggctgcccagcccatgcaaccattaccagagtccctagcatcattgcacccaagcgtttcacccggctctccacctccacccctgccaaaccataaatacaacaccaccagcacctcctattctcccctagcaagtctgcctctgaaagctgatactaaaggcttttgtaacattagcctgttcgaggacttacctctgcaggagcctcagagccctcagaagttgaaccccggtttcgatctcgctaaaggtaatgctggaaaagttaacctaccaaaggaactgccggccgacgccgtaaatctcacaattcccgctagcctggacctgagtcccctcctgggattttggcagctgcccccccctgccacccagaacacctttgggaacagcaccctggctcttggtcccggcgaatccctgccccacaggctgagttgtttaggccagcagcaacaagagccccccctggctatgggcacagtctctctgggacagctgccactgcctcccatcccacacgtgttcagcgccggcacaggtagcgcaattctgccccatttccaccacgcgttcagatag

SEQ ID NO: 129025 - DNA, 1392 bp, Artificial Sequence
  Description of Artificial Sequence: Synthetic coding sequence
atggcaacgtttccgtgtcagctgtgcggaaagacttttctaaccctagaaaagtttaccatccacaattatagccactcccgcgaaaggccatataaatgcgtgcagcccgactgcggtaaggcgtttgtgagtaggtacaaacttatgcgccatatggctacacattcaccacagaaatctcaccagtgcgcacactgtgagaaaacgttcaaccgcaaagatcatctcaagaatcacctgcagactcatgacccaaacaagatggcctttggttgcgaagaatgcggaaagaagtataacacgatgttggggtataagcgtcatcttgccttacatgcagctagctcaggagacctgacctgtggggtgtgcgccctggagctgggctcgacagaggtacttctggatcacctcaaggcccatgctgaggaaaagcctcccagcggaactaaggaaaaaaagcaccaatgcgaccattgcgaaagatgcttctacacaaggaaagatgtccggaggcacttagttgtgcacaccggatgcaaggatttcctatgccagttttgcgctcagcgttttggacggaaggaccatctaacacgccacaccaagaaaacccattctcaagagttgatgaaagaatcacttcagacaggcgacctcctctctacatttcacactatttcaccctcgttccagctcaaggcagctgctttgccaccctttcctctcggcgcctctgctcagaacggcctggcaagctccttgcccgcagaggttcattctctgaccctgtcccctccggaacaggccgcccagcccatgcagccactgccagagtctctagcgtcactccaccctagcgttagccccggtagccctcctccacccctcccaaaccataagtataatactacatctaccagttacagcccactcgcaagcttgcctctgaaggccgatacgaagggattctgtaacatttccctatttgaggacctgcctcttcaggaacctcaatctccccagaagctgaaccccgggtttgacctggcgaaaggaaatgccggaaaggtaaacctccctaaagaactgcctgctgatgccgtgaatctcaccattcccgcatcactggacctatcaccactcctgggcttctggcagctgcccccccctgccacgcagaacacgttcggcaacagtacactggccctgggtcccggggagtccttaccccacaggttgagctgtctgggccagcagcagcaggagcccccgctagccatgggcacagtatcgctggggcaactccccctaccgccaatcccccatgtattttctgccgggacagggtctgccatcctgccacatttccatcacgccttcaggtag

SEQ ID NO: 129026 - DNA, 1392 bp, Artificial Sequence
  Description of Artificial Sequence: Synthetic coding sequence
atggccacattcccgtgtcaactctgtggaaaaacatttcttactctggaaaagtttaccatccacaactattcgcatagtcgggaaagaccatacaagtgcgttcagccggattgtgggaaggcgtttgtttccagatataagctgatgcgccatatggcgacccacagcccgcagaagagccaccaatgcgctcactgtgagaaaaccttcaataggaaagaccacctgaagaaccaccttcagacacatgatcccaataaaatggccttcggatgtgaggaatgtggcaagaagtacaacactatgcttggctacaagcgacacctggccctgcatgccgcctctagtggagacctcacatgcggtgtgtgcgccttggagttggggagcaccgaggtcctgttggaccacctgaaagcgcatgcggaagaaaagcctcccagcggcactaaggagaagaagcaccaatgcgatcattgcgaacggtgcttctacacccgaaaggacgttagaagacacctcgtcgtccatacaggatgcaaggattttttatgccagttttgcgctcagcgattcggtagaaaagatcatttaactagacatacaaaaaaaacacattcgcaggaactgatgaaagaatccctgcagaccggcgacctgctcagcacgtttcatacaatctcacccagctttcagcttaaggccgccgccctcccaccattccccttgggagctagtgcccagaacggcttagcctccagtttgcccgctgaagtccactctttgactctgtcaccgccagagcaggccgctcaacctatgcaacctctgcccgagagcctcgccagtctacatcccagtgtgtcgccgggatccccaccgcctccactgcctaatcacaaatacaacaccacctcaaccagctattcacccctagcctcacttcctctcaaggctgacaccaagggtttttgcaacataagtctcttcgaggatttgccactgcaagagcctcagtccccacagaagctcaacccaggatttgaccttgcaaagggcaatgctggcaaggtaaacctgcctaaagaattaccagccgacgctgtcaatcttaccatcccagcaagtttggatttgtcacccctccttggattctggcagctgcctccacccgccacccagaacacatttggaaattcaacactagcgctcgggccaggggagtccctccctcaccgtttatcgtgcctggggcaacagcagcaggagccgcccctggccatggggacagtctctctcggacagctgccactccctcccatccctcacgtgttctcggcgggcacgggctcagccatcctcccccactttcatcacgcgttcagatag

SEQ ID NO: 129027 - DNA, 1236 bp, Artificial Sequence
  Description of Artificial Sequence: Synthetic coding sequence
atggccacacactccccccaaaaatcccatcaatgcgctcattgcgagaagacatttaaccgcaaggaccatttgaaaaaccatctccaaacacacgatcctaataaaatggccttcgggtgcgaggaatgcggcaagaagtacaacacaatgctcggctacaaacggcatctagcactccatgccgcttcctcaggggatctaacatgcggtgtatgcgcattagaactaggctctacggaggtgttactggaccacctcaaggcccacgctgaagagaagccacccagtggtacgaaggagaaaaaacatcagtgcgatcattgcgagcggtgtttctacacacgcaaggacgtcagacggcacctggtagtccataccggatgcaaggattttctgtgtcagttttgcgctcagcgattcggtcgcaaggaccacctaacacgtcacacgaaaaaaacacatagtcaggagctgatgaaagaaagtctccagaccggcgatctcctgagtaccttccatactatctcccccagttttcagctgaaggctgccgcgctgccccctttcccgctgggcgcctctgcgcagaatggattggcctcgtcactccccgccgaggtccacagtttgacactctcacctcccgagcaagccgcccaacccatgcagcctctgcctgaaagcctcgcatcactgcatccatctgtgtcacctggatccccgccaccacccttaccaaatcacaagtacaataccacatctacaagctacagcccacttgccagcctccctcttaaggctgacacgaagggcttctgcaacatcagtctctttgaagacctgccgctccaggaaccacaaagccctcaaaagctcaatcccgggtttgatttagcaaaaggaaatgccggcaaggttaacctgccaaaagaacttcctgctgatgccgttaatctgactattcctgcatccctggatctgtcacccctccttggattctggcagctgccaccaccagcaacccagaatacattcggaaacagcaccctggccctgggaccgggcgagtccctcccccatcgcctgtcatgtctgggccagcagcagcaggagccacccctggccatggggaccgtaagtcttggccagttaccactgcctcccatcccccatgtctttagcgccggaacaggctctgccatccttccgcacttccaccacgcgtttcgctag

SEQ ID NO: 129028 - DNA, 1236 bp, Artificial Sequence
  Description of Artificial Sequence: Synthetic coding sequence
atggccacccatagcccgcagaaatcacaccaatgtgcccactgcgagaagacattcaataggaaggaccacctcaaaaatcacctgcagacacatgacccaaataaaatggcttttgggtgtgaagaatgcgggaagaagtacaatactatgttgggctataaaagacatctggccctccatgcagctagctccggcgatctgacgtgcggcgtgtgcgccttggagctgggttccacagaggtcctcttggaccacctgaaggctcatgcagaggaaaaacctccatctggcaccaaagaaaagaaacaccagtgcgaccactgtgagcgctgtttttacactaggaaagacgttagaagacacttggttgtacataccggctgtaaggacttcctgtgccagttttgcgcccagagattcgggaggaaagaccacttaactcggcacacgaaaaaaacgcattctcaggagttaatgaaggagtccctccagaccggagatttgctgtcgaccttccacaccatcagcccaagctttcagcttaaggcagcagccttgccaccattccctttgggcgcctccgcccagaacggtctggcaagctcactccccgctgaagtgcatagcctgacactaagccctcctgagcaagcagctcaacccatgcagcctctcccggagagcctcgcatctctccacccttccgttagcccagggagtccgccaccgcctcttcccaaccacaagtacaacaccacaagcacctcttattcccctctggcgtccttgcccctgaaggccgataccaaaggcttttgcaacatctcactatttgaggatttgcctctccaggagccccaatctccgcagaaactgaaccctggctttgatttggccaagggtaacgccggaaaagtgaatctcccaaaagaactgcccgccgatgccgtaaacctcactatccctgcctcattagacctctctccacttcttgggttctggcagttgcccccacctgcaacccagaacacctttgggaactccacactggctctggggccaggtgagtcgctgccgcatcggctatcctgcctcggccagcagcaacaggaaccccctctggctatgggcactgtgtcattgggccagcttccactgcctcctatcccacacgtctttagcgctggaacgggttccgcaatactgccccattttcaccacgcctttagatag

SEQ ID NO: 129029 - DNA, 1392 bp, Artificial Sequence
  Description of Artificial Sequence: Synthetic coding sequence
atggccacattcccatgtcagctttgtggcaagacatttttgacgctcgagaagtttactattcacaattatagccactcccgcgagaggccctacaagtgcgtccagccggactgtggaaaggccttcgtgagcaggtacaaacttatgcgacatatggccacccactctccacagaagtcccaccagtgcgcacattgtgaaaagacgttcaatcgaaaagatcacctgaagaatcaccttcagacacacgacccaaacaaaatggcttttggatgtgaagaatgcggtaagaaatacaatacaatgttagggtacaaacgacacctggcactgcacgcagcgtccagcggagacctgacctgcggagtgtgtgcgctggaactgggatctacagaggtgctgctcgatcacctgaaggcacatgcagaagagaaaccaccttcagggaccaaggagaagaaacaccagtgtgaccactgcgagcgctgtttttacactagaaaggacgtgcggcggcacctcgtggttcacaccggctgcaaagactttctgtgtcagttttgcgcacagcgatttggacggaaggatcacttgactcggcatactaaaaaaacccactcacaggagttgatgaaggaatccctacagaccggtgatttactgagcacatttcacacaatcagcccttctttccagctcaaggcagccgctctgcctcctttcccactgggcgcaagcgcacaaaatggcctggcttctagcctccctgctgaggtacacagtctgacgctgtccccaccagaacaggccgctcaaccaatgcaacctctacccgagagtcttgcgtcacttcatccttccgtgagccccgggtcacccccacctcctctcccaaatcacaagtacaacactacttccacctcttatagtccactagcgtctttgcccctcaaagcagacaccaaaggattttgcaatatttccctttttgaagacttgcctctccaggaaccacaatccccgcaaaagcttaacccaggctttgacctcgcgaaggggaatgctgggaaagttaatcttcccaaggagctgcctgcagacgcggtgaacctgacaatacccgcttcactcgacctgtcaccactgttaggattttggcaactgcctccaccagcaactcagaacacttttggaaacagcactctcgccctcggcccaggcgagagcctccctcatagactgtcctgtttggggcagcagcagcaagagcccccactggccatgggaacggttagtttaggacagctgccacttccccctatccctcatgtgttttctgcgggaaccggatctgccattctccctcattttcaccatgcctttcgctag

SEQ ID NO: 129030 - DNA, 1392 bp, Artificial Sequence
  Description of Artificial Sequence: Synthetic coding sequence
atggcaacgtttccttgccagctgtgcggtaagaccttcctgaccctggaaaagtttacgatccataactattcccactcacgcgagcgcccatataagtgtgtccagcccgattgtgggaaggcatttgtgagccgctacaagctgatgcgccatatggccacacacagcccgcagaagagccaccaatgcgctcactgcgaaaaaacgttcaatcgcaaggatcacctgaagaaccacttgcaaacacacgaccccaataagatggccttcggatgcgaggaatgcggaaaaaagtataacacaatgttgggatacaagagacatctggcgctccatgcagcatcctccggggacctcacatgtggagtttgtgccctggaattggggtcaacggaagtgctactggatcatcttaaggctcacgctgaagagaaacccccttcaggaactaaagagaagaagcatcagtgcgatcactgcgaacgttgtttctacacaagaaaggatgtgcgacgccatttggtggtgcacacaggctgcaaggatttcctgtgccagttttgcgctcagagattcggccgaaaggatcaccttactaggcacacaaagaaaacccattcccaagaactcatgaaggaatcactgcagacaggagacctgctttctactttccacacgatatcaccctcgttccagctgaaggcggcagctctgcctcccttcccactgggtgccagtgcccagaatggcctagcttccagcctacccgccgaagtccacagcctcaccttatcgccgccggagcaagctgcacagcccatgcagcccctgcccgagtctttggcctctctacatccttcagtctctcccggctccccccccccaccccttccaaaccataaatataacactacatccacatcttactccccactggcttctcttcccctcaaagccgacactaaagggttctgtaacatttccctgtttgaagacctgcctctgcaggaacctcagagtccccagaagttaaatcctgggttcgatctggctaagggtaatgcaggtaaggtaaacctgccaaaggaattgccagctgatgctgtgaatcttaccatcccagccagcttagacctaagccccctcctgggcttctggcaactgcctcctcctgctacgcagaatactttcggaaattctacgcttgccctggggccgggtgagtctctgccccaccggctttcatgcctgggacaacagcagcaagagccgcctttggcaatgggaacagtaagtctcggccagctgccgcttccacccatcccacacgtgttctctgctgggaccgggtcagccattctcccccacttccaccacgcctttagatag

SEQ ID NO: 129031 - DNA, 531 bp, Artificial Sequence
  Description of Artificial Sequence: Synthetic coding sequence
atggctactcacagtccacagaagagtcatcagtgcgctcattgcgaaaaaactttcaaccgcaaggatcaccttaaaaatcacctccagacacacgatcctaacaaaatggcattcggctgcgaggagtgcggcaagaagtacaacactatgctggggtacaagcgtcacctcgccttgcatgcagcgagctcaggagatcttacgtgcggagtgtgtgccctcgaactagggagcacagaggtgctgctggaccacttaaaagcacacgctgaggagaagcccccgagcggcaccaaggagaagaaacatcagtgcgaccattgcgagcgttgtttttacactcgaaaagacgtacggcgtcatctggtcgttcatactggctgtaaagatttcctttgccagttttgcgcccagcgattcggcaggaaggaccatctcacacgccacaccaaaaaaactcactcgcaggaattgatgaaggaatccctccagaccggcgatctcctgagcaccttccataccatctag

SEQ ID NO: 129032 - DNA, 1392 bp, Artificial Sequence
  Description of Artificial Sequence: Synthetic coding sequence
atggctacctttccttgccagctctgcggcaagacgtttctaactctcgaaaagtttaccatccacaactacagccactcaagagaacgaccttataaatgcgtacagccagattgtggcaaagcttttgtctcaaggtataaactcatgcggcatatggccactcacagtccacagaaaagccaccaatgtgctcattgcgaaaagactttcaatagaaaggaccacctcaaaaatcacttacagactcacgatcccaataagatggcttttggctgcgaagaatgtgggaaaaagtacaataccatgctgggatataaacggcaccttgccttacacgcggccagctccggtgacctcacatgtggcgtttgtgccctggagctgggcagcacagaggttctgcttgaccaccttaaagcccacgctgaggagaagcctccaagtggaactaaagagaagaaacatcagtgtgaccactgtgaaagatgtttttatactagaaaggacgtgcgtcggcatttggtcgtgcatacaggctgcaaggattttctatgccagttttgtgcacagcgcttcggacgcaaggaccatctcacgaggcacactaagaagacccattcccaagagctgatgaaggagtccctgcagacaggcgacctgctctctactttccataccatctctccctcctttcagctgaaagcggccgcactaccacctttcccactcggtgcctccgcacagaatgggctcgcgtcttcactccccgctgaggtgcacagtctgaccttatcgccacccgagcaagcggcacaacccatgcagcctctccctgagagccttgccagtcttcatccatcagtctctccaggatcaccgcctcctcctttgccaaaccacaagtacaacactacttcgacgagctatagccctctggcctccctgccactgaaggccgatacgaaaggcttctgcaacatttcactctttgaagaccttcccctccaggagccgcaatcgcctcagaagctgaaccccggattcgaccttgcgaaaggaaatgcaggtaaggtcaacctgccaaaggaactgcccgctgacgctgtgaacttgacaatacccgccagtctggatctctcaccattgctggggttttggcagctcccgcctcccgccacccaaaacacttttggcaactccacgttagcactggggccaggtgaatcattaccgcaccggttgagctgcctcgggcagcagcagcaggaaccgcctctcgctatgggaaccgtctccttgggacagctccctctgcctccgatcccccacgtgttcagcgcagggactgggtccgcgattttgccacattttcatcatgccttccggtag

SEQ ID NO: 129033 - DNA, 1236 bp, Artificial Sequence
  Description of Artificial Sequence: Synthetic coding sequence
atggccacacattcccctcagaaaagtcaccagtgtgcccactgtgagaagacattcaaccgaaaagatcatttaaaaaaccacctgcagacacacgaccccaataaaatggccttcggttgcgaggagtgtgggaaaaagtataataccatgctaggctataagcggcaccttgcccttcacgccgcaagcagtggcgacctgacttgtggcgtgtgtgccctggaactcggcagcactgaggtactgttagatcacttgaaggcccatgccgaggagaaaccaccaagcggaacgaaagagaagaaacatcaatgcgatcactgcgagcgctgcttctatacaagaaaagacgtgcgccggcacctcgtggttcacactgggtgtaaggacttcctgtgccagttctgtgcacagaggttcggccgaaaagaccaccttacaagacacacaaaaaagacacacagtcaggaactcatgaaggaatccttacagaccggagatctcttgtctactttccatacgatttccccttctttccagctcaaggccgctgctctgccaccgtttcccctaggagcttccgcccaaaacggcctcgcctctagcctgcccgctgaggtgcatagcttgaccctgagcccgcctgagcaggcggcccagccgatgcagcccctcccagagagccttgcaagtctgcacccgtctgtatcacccggtagccctccacctccactgccgaatcacaagtataatacaaccagcaccagctattcccctctggcaagtttgcccctgaaggcggatacaaaaggcttctgtaacatttccttgtttgaggatctgccgttgcaggaaccccagagcccacagaaactcaatcctggctttgacttggctaaaggcaacgccggtaaggtcaatctcccgaaagaactgcccgccgacgccgtgaatttgacgatccccgcgagtctggatttatcacccctgctggggttttggcagctaccgccaccagctactcagaatacattcggcaatagtaccctggctttgggtcccggggagtctctgcctcacagattgagttgcctgggccagcagcagcaggagcctcccctagccatgggaacggtgtcattaggccagttgcctctcccccctatcccccatgtcttctcagcggggacgggcagcgctatacttcctcatttccatcacgcattcaggtag

SEQ ID NO: 129034 - DNA, 1392 bp, Artificial Sequence
  Description of Artificial Sequence: Synthetic coding sequence
atggcgacatttccgtgtcagctatgcggcaagacattcctgactctggagaagtttaccatccacaactatagtcatagcagggaacgcccttacaagtgtgtgcagcccgactgtgggaaagcgttcgtgagtagatacaaactcatgaggcacatggccacacacagccctcagaaatcccaccagtgcgctcattgcgagaaaactttcaacaggaaggatcacttgaaaaatcacctgcagacccatgatccaaataagatggccttcggatgtgaggagtgtggcaaaaaatataacaccatgctgggctacaagagacacctggccttgcatgctgcgtcatccggagatctgacctgtggtgtttgcgcgctcgagctcggatcaacagaggtgctgttggaccacctcaaggcccatgcagaggagaaacccccaagcggcactaaagaaaagaagcaccaatgcgaccactgcgaacgatgcttttatacaagaaaggatgtccgtcgacacctggtggttcatacgggctgtaaagacttcttgtgccaattctgcgcacagagatttgggcgtaaggaccatttgaccagacatacgaagaagacacattcccaggaactcatgaaagagtcgctgcagacaggagacctattgagtactttccacaccatctctccttctttccagctgaaggcggccgccctgcctccatttccattgggggccagcgcccaaaacggcctggcctccagtctgcccgcagaagtgcacagtctgacgctcagtccccccgaacaggctgctcagcccatgcagccactgcctgagtcgcttgcttctctgcacccctctgtaagccctggctccccacccccaccgcttcctaaccacaaatacaataccacaagcacctcttactcgcccctggcatccctaccgttgaaggccgacacgaagggcttctgcaatatcagtctctttgaggacttgcctcttcaggagccccagagtccacagaagctgaatccaggctttgatctggcgaaaggaaacgcagggaaagtaaatctccccaaggaactgccggctgacgctgtgaacttgaccattcctgccagcttggacctgtcacctctacttgggttttggcagcttccacccccagctactcagaacacattcggaaactcgacccttgccctgggaccaggcgagtctctgccacaccgtctctcctgtctgggacaacagcagcaagaacctccactggccatggggacggtttcactgggccagctgccactcccccctatcccccacgtgttttcggccgggacaggcagtgctatcctgccgcattttcaccacgccttccggtag

SEQ ID NO: 129035 - DNA, 759 bp, Artificial Sequence
  Description of Artificial Sequence: Synthetic coding sequence
atgaaggaaagcctccagacgggagatcttctgagcaccttccacacaattagcccttcattccagctgaaggcggccgctctgccaccgtttccattgggagcctctgcccagaacgggcttgcctcctcactgcccgcagaggtacactccctgactctatcccctcctgagcaagccgctcaaccaatgcagcctctgccagaatctttggcatctcttcatccctctgtgtcccctgggtctcccccccccccactccccaaccataagtacaacacaacatcaacgtcctacagtccgctggcaagcttgcctctgaaggccgatacaaagggattttgtaatatctctctgttcgaggatcttccacttcaggaaccccagtcgcctcaaaagcttaaccctggattcgatctggccaaaggaaacgctggcaaggtgaacctgcctaaagaactccctgctgacgcggtgaatctcacaatccccgcctccctagatctctctcccctgctagggttctggcagcttccaccccccgcgacacaaaatacgttcggcaactccaccctggctttgggtcccggggaatccctgccccatagattgagctgtttgggacaacaacagcaggagcctcccctagcaatggggaccgtgagcttgggtcagctgcccctgcctcccattcctcacgtttttagtgccggaaccggttccgcaattctaccccatttccatcatgcattccggtag

SEQ ID NO: 129036 - DNA, 1491 bp, Artificial Sequence
  Description of Artificial Sequence: Synthetic coding sequence
atgacaaccttcttcacctctgtgccaccatggattcaagatgccaagcaggaagaagaggtgggatggaagctggttccgagacctcggggccgcgaggcagagagccaagtcaagtgccaatgcgagatctccggaacaccattttcgaatggggagaagctgcggccgcacagcctgccccagccagaacagcggccctattcatgtcctcaactgcactgtgggaaagcctttgccagtaagtataagctctatcgacatatggccacccactcagcacagaagcctcaccaatgcatgtattgcgacaaaatgtttcaccggaaagaccacctcaggaaccacctccaaacgcatgatccgaacaaagaggcattgcattgcagtgagtgtggaaaaaactacaacaccaagctggggtataggagacatctggccatgcacgctgcttcatccggcgaccttagttgcaaggtttgcctgcagaccttcgagtcgacacaggctcttttggagcatctgaaagcccattccaggcgagtggctggcggggccaaggaaaagaagcacccctgcgaccattgcgacagacgattctatacacggaaggacgtgcgccgacaccttgtggtccatactggcaggaaggatttcctctgtcaatactgcgcccagaggtttgggcggaaagaccacctgaccaggcacgtcaaaaagtctcacagccaggagctgctcaagattaaaactgagcccgtcgatatgctgggcctcctaagctgctcctccacagtgtccgtaaaagaggaactttcgcctgtgctctgcatggcttcccgggacgtgatgggcaccaaggccttcccagggatgctgcctatgggtatgtatggagctcatattccaaccatgccaagcactggtgttccacactcattggtccacaacaccttgccaatgggaatgtcatacccccttgaatccagtccaatctcgtcgcccgcacagttgcctcctaagtatcagctagggagtacttcgtatctgcccgacaaactcccaaaggtggaggtggacagctttctggctgaacttcccggctctctttctctgtcatcggccgagcctcagcctgccagcccacagcctgccgctgccgcagcgctgttagatgaggccctgttggctaaatcccctgccaacctctccgaggcactgtgcgccgcgaacgtggacttctcacacctgttggggtttttaccgctgaacttgcccccatgtaacccacctggcgccacaggtggccttgttatgggatacagccaggcggaggcccagcctctacttactaccttgcaggcccagccacaagactcaccaggagccgggggccccttgaattttggcccccttcattctctgccgcctgttttcacctcggggctgtcaagcaccaccctgcccagatttcaccaggctttccaatag

SEQ ID NO: 129037 - DNA, 507 bp, Artificial Sequence
  Description of Artificial Sequence: Synthetic coding sequence
atgcaggcacagcaataccagcaacaaaggaggaaattcgctgcagcttttctggccttcatcttcatattagccgctgtggatactgccgaggccggaaaaaaagaaaaacccgagaaaaaggtcaaaaaaagcgactgtggagaatggcagtggagcgtgtgcgtccctaccagcggggactgtggcctggggacccgagaaggcactcgaaccggggccgagtgtaagcaaactatgaagactcagcggtgcaaaattccctgtaattggaagaagcagtttggggcagaatgtaaataccagtttcaggcctggggtgagtgcgatttaaatacagcactcaagacccggacagggtcccttaagcgggccctacacaacgccgagtgtcagaagactgtcaccatttccaagccctgcggcaaattgacaaagccaaagcctcaggccgaatccaagaaaaagaagaaagaggggaaaaagcaggagaaaatgttagactag

SEQ ID NO: 129038 - DNA, 1518 bp, Artificial Sequence
  Description of Artificial Sequence: Synthetic coding sequence
atggtagaggaagttcaaaagcattctgttcacacactggtcttccgtagtctcaaacgcacgcacgatatgttcgtcgcagacaacggaaaacctgtgcccttggacgaagaaagtcataagaggaagatggcaattaagctccgcaacgagtatggtcccgtccttcacatgcccaccagtaaagagaacctaaaggagaaaggccctcaaaatgctacagatagctatgttcacaagcaatatcccgctaaccagggccaagaagtggagtactttgtcgctggcgtggctctgaccgctgacaccaaaatccagcggatgcccagtgaaagtgctgcacagtcgctcgctgtggctttgcccctccaaaccaaggccgacgcaaaccgaaccgctccttctggatccgagtataggcacccaggggcgagcgatagaccacagcccaccgccatgaattcaatagtgatggagactgggaacactaaaaattccgctttgatggcaaaaaaggccccaaccatgcccaaaccgcaatggcatcccccttggaagctctacagggtgatctccgggcatctgggctgggttcgttgtatcgcagttgaacctgggaaccagtggttcgttactggctctgctgacagaacaatcaagatatgggacctcgccagcggaaagttgaaattgtccttgacaggtcatatctcaaccgtccgtggagtgattgtgtctacacgctccccctatctgttctcgtgcggagaggacaagcaagtcaagtgctgggacctcgaatataataaggttatcaggcattaccatggacaccttagcgcagtttatggtctggacctgcaccccactatcgacgtcctggtcacctgctcacgggatagcacagcccgcatctgggatgtgagaaccaaagcctccgtgcacactctgtccggccatacgaacgccgtagcaaccgtacggtgccaggccgccgagccacaaatcattactggctctcatgataccacgatcagactgtgggacctggtcgccggcaaaacccgcgttacactgaccaatcataaaaaatcagtcagggccgtggtcttacacccccgacactacacgttcgcatcgggcagtcctgacaatattaagcaatggaagtttccagatggcagctttatccagaatctatcgggtcacaatgccataattaatactctgacagtgaattcggatggcgtcctcgtctctggggccgataacggcactatgcatctgtgggattggaggactggatacaactttcagagggtccatgctgcagtgcagccagggagcctggattctgagagcgggatttttgcttgtgcgttcgatcagtcagaatctcggctgttaacagctgaggccgacaaaaccatcaaggtctatagggaagatgacactgccaccgaggagactcatcctgttagttggaaacccgaaattatcaagcgcaaacgtttctag

SEQ ID NO: 129039 - DNA, 1545 bp, Artificial Sequence
  Description of Artificial Sequence: Synthetic coding sequence
atgatttgtgaagtgcaaaagcacagcgtacatacattagtctttcgctctctaaagcgtacacacgacatgtttgtagcagacaacggaaagcccgtgccactggacgaggagtctcataaacgcaagatggccattaaactgagaaacgagtatggccctgtgctgcatatgccaactagtaaagagaatctcaaagagaaaggtccacaaaacgcaacagatagctatgtacataaacaatatcctgcaaatcagggccaggaggttgaatattttgtggcgggtacccatccctaccctccaggccccggggtcgctctaactgccgataccaagattcaaaggatgccgtctgagtccgctgctcagagtctcgcggtggccctgccactgcagaccaaggctgacgctaatcggacagctccctctggctccgagtaccgacaccctggcgccagcgaccggccacagcccactgccatgaatagcattgttatggagacaggcaacaccaaaaattctgcgcttatggccaagaaggcacccaccatgccaaagccacaatggcacccaccctggaagctatatcgagtgatctccggccaccttgggtgggtgcgatgtattgctgtggaaccaggtaaccagtggttcgtaaccggctcagcggacaggaccatcaaaatatgggatcttgccagtgggaaactgaagttgagcttgacgggccacatctctaccgtgcgcggggtgattgttagcacgcgttccccatacctcttctcatgtggagaggacaaacaggtgaaatgttgggacctcgaatataacaaagtaatacggcattaccacggccacctgtccgccgtgtacgggctggacctgcaccccaccatcgatgtgctggtaacttgtagtcgagacagtacagcaaggatctgggatgtgcgtaccaaagcgagcgtgcacaccctgtccgggcacacaaacgctgtggctactgtcagatgccaggccgctgagccccagatcattactggatcacacgacaccaccatcagactctgggacttggtcgccgggaaaacccgcgtcacactaaccaatcacaagaagagcgttcgggccgtagtgttgcatccacgacattatacatttgcgtctggttccccagataacataaaacagtggaaatttcccgatgggagtttcattcaaaacctgagtggtcacaacgctataatcaatactctgaccgtaaatagcgatggggtgctggtgtccggggctgataacggtacaatgcatttatgggattggcggacagggtacaacttccaacgtgtgcatgctgccgtacagcctggtagtttggactccgagagcggcatctttgcttgcgcatttgatcagtcagagagtcgtctactcactgcagaggccgacaagactatcaaagtgtaccgggaggacgacaccgccaccgaggagacacatcccgtgtcatggaagccagagattataaaacgaaaaaggttctag

SEQ ID NO: 129040 - DNA, 1545 bp, Artificial Sequence
  Description of Artificial Sequence: Synthetic coding sequence
atggttgaagaagtccagaaacactccgtacataccctcgtgtttcggtccctaaaacgcacacatgacatgtttgttgctgataatgggaagcctgtcccactcgatgaggaatcccacaagcggaagatggcgattaaattgagaaatgagtatgggccagtgttacacatgcccacctccaaagagaatttgaaagagaaagggccacagaatgctaccgattcttacgttcataaacagtaccccgccaaccaaggtcaagaggtggagtattttgtggccggaacccatccataccctccaggtcctggagtagcactgacagccgatactaaaattcagagaatgcccagcgagtccgcagcacagagcttggccgtggctttgccactgcaaaccaaagccgatgctaatagaacggcccccagcggcagcgagtatcgacaccccggcgcgagtgaccgtccccagcccaccgctatgaactcaatcgttatggagactggcaacacaaagaattctgccctcatggccaagaaagcccccacaatgccaaaaccacaatggcatcccccttggaagttgtatagggtaataagtggacacctggggtgggttcgctgtatcgcagtggaaccagggaaccaatggttcgtgacaggcagcgccgaccgcaccatcaaaatctgggacctggcctcggggaagctcaagctgtctcttacaggccatatttctaccgtgcgaggagttatcgtaagcacacggtctccatacctcttttcgtgcggcgaggataaacaggtcaaatgttgggacctcgagtacaataaggtcatacggcactatcacggccatctgagcgccgtttacggactcgatctccacccaactattgatgttctcgtcacctgctcccgagactctaccgcccgtatatgggacgtacgtaccaaagctagcgtgcatactctgtctggccatacaaacgcagtggcaaccgtccgctgccaggctgctgagcctcagatcatcacaggttcccacgacacaactataagactctgggaccttgtcgccggcaaaacacgcgtgacattaactaaccataagaagtctgtgagggccgtcgtgctgcatccccgccactacaccttcgccagcggttctcctgacaatattaagcaatggaagttcccggatgggagctttattcagaacctgtccggccacaatgccattattaatacattgactgtgaattctgacggggtcttggtaagcggcgcggacaatgggaccatgcatttgtgggactggagaaccggatacaacttccagcgtgtgcacgctgcagttcaacccgggtcactcgatagcgagagtggcatatttgcctgtgctttcgaccagagtgagagcagattgctgacagctgaagccgacaagacaataaaggtttaccgggaggacgatactgctaccgaagagacccacccagtctcttggaagcctgagatcataaagagaaaacgcttttag

SEQ ID NO: 129041 - DNA, 5622 bp, Artificial Sequence
  Description of Artificial Sequence: Synthetic coding sequence
atgtgggccgaagcaggattaccccgagccggcggaggctctcaacctccattcaggactttctcggcctctgactggggcctgacccatctggtggtgcatgaacaaaccggagaagtgtacgtgggtgcagtgaacaggatctacaaattgtcgggtaatttgactctccttcgagcccacgtgaccggcccagtcgaagataacgagaagtgctatccccctccctcagtgcagagctgcccccatggcctcggcagcacagacaacgtgaacaagctgctcctcctcgactatgcagccaaccggctcctggcttgcggctccgcgagtcagggtatttgccagttcttgcggctcgacgacctcttcaagctcggagaaccccaccacagaaaagaacattacctgagcagtgtgcaagaggctgggtcaatggccggagtcctgattgctgggccccctgggcagggccaggccaaactgtttgtcggaacgcccatagatggaaaaagcgagtacttcccaacattgagttcccgaaggctgatggctaacgaagaagacgccgacatgttcggttttgtctatcaagatgagtttgtgtcctcccaactcaagattccctccgacacactgtctaaattccccgcgttcgacatctattacgtgtacagtttccgctcagaacagttcgtgtactatctgacgttgcagttagacactcaacttacaagtccggatgcggcaggcgaacacttcttcacctccaagattgttagactctgtgtggacgatcccaagttttactcttatgtggagtttcccatcggatgcgagcaggccggtgtggaataccggctcgtacaagatgcctatttgagtagacctggaagggctctcgcacatcaattgggcttggcggaggatgaggatgtgttgttcacagttttcgcacagggtcagaagaaccgagtgaagcctcccaaggagtccgccctatgtctgtttacactcagagcgattaaggaaaagattaaggagcggatccagtcatgctacagaggtgagggcaagctgtctctgccatggctactgaataaggagctcgggtgcatcaactcccctctacaaatcgacgacgatttctgcggtcaagacttcaatcagccacttggaggcacagtcacaatcgaaggtacccccctttttgtcgacaaggacgacggactgaccgcggtcgcagcttatgactatcgcgggcggacggtagtgtttgctggaacacgctcaggccgcattaggaaaatattagttgacctctcaaatcctggcggaagaccagctctggcttatgagagtgtggtggcacaagaagggtcccctatactgagggacctggtactgagcccgaatcatcagtatttatatgctatgactgaaaagcaagtgactcgggtgccagtcgagagttgcgttcagtacacaagctgcgaactatgtttggggtcaagagatccccattgcggctggtgcgtgctgcactctatttgcagtcggcgagacgcttgcgagcgggccgacgagcctcagcggttcgctgcagacctactccagtgtgtccagctcacagtgcaacccaggaatgttagcgtaacaatgagccaggtgccactcgttctacaggcttggaatgttcccgatttgtcagcaggcgtgaattgttctttcgaggattttactgaatcagaaagcgtactggaagacgggcggatccattgtcgcagcccatctgctcgggaggtagccccgatcaccaggggacaaggagatcagcgcgtggtgaagctatatctgaaatcaaaggagacaggcaagaaattcgccagcgtggacttcgtgttctataattgtagtgtccatcagagttgcctgtcgtgtgtgaacggaagcttcccatgccattggtgcaagtacaggcatgtgtgcacacacaatgtggcagattgtgctttccttgaaggacgggtaaacgtttctgaggattgtccgcaaatcctgcctagcacccaaatctatgtgcctgtgggtgtggtgaagccaataaccctcgccgctcgcaacctccctcagccgcagagcgggcagagaggatatgagtgtttgttccacatacccggatcaccagcgcgcgttacagcgcttcgtttcaacagctcaagcctgcagtgtcaaaatagctcctatagctacgagggcaacgatgtgagtgatttgccggtcaatctgagcgtggtttggaatggaaattttgtgattgataatcctcaaaacattcaggctcacttgtataagtgtcctgccctgagggaatcctgtgggctgtgcctcaaggcagatccaaggtttgaatgcgggtggtgcgtggcagagcgacgttgctctctgcggcatcactgcgccgccgataccccagcttcctggatgcatgccagacacgggtctagccgctgtaccgatcctaagattctgaagttatctccagagacaggccctcgtcagggagggacgagactgacaattactggagagaatctcgggctccgattcgaggacgtgcgtctgggcgtgagggtagggaaggttttatgctctccagtcgaatccgagtacatctcagcagagcaaatagtctgtgaaattggggatgctagttcagtgcgcgcacacgacgcccttgttgaggtgtgtgtcagagattgctcaccccattacagggccttatctcccaaacggtttacttttgtgacacctacattttacagggtcagtccatcccgtgggccactcagcggcggcacatggatcggcattgagggctcccatttaaatgccggatctgacgtggctgtgtccgttggtgggaggccttgctctttcagctggcgcaatagtagagaaatcagatgtttgaccccacctggtcagtctccggggagcgctcctatcattatcaacatcaaccgcgcacaattaacaaaccccgaagtcaagtataactacacagaggaccccacaattctgaggattgaccccgagtggtctattaactccggcggtacactgctgacggtgacggggaccaatctcgccactgtgagagagccacggattagagccaaatatgggggaatcgagcgcgagaacggatgcctggtttataatgacactactatggtctgccgcgccccatccgtggctaaccctgtccggtccccacccgagctgggggagcggccagatgagctcgggttcgtaatggataatgtgcggagtttactggtcctaaacagtacatcgttcctgtattatccagacccagtattggagcctttgtccccaacaggcctgttagaactcaagccctccagcccactgattctgaaaggccgtaacctgctgcctccggccccaggtaactctcggctgaactacactgttctcattggatccacaccatgtactctcactgtctccgaaacccagttattatgcgaggctcctaacctcacaggccagcataaggtcactgtgcgcgccggtggctttgaattcagccccggtactctccaggtgtactcagattcactccttaccctgcccgcaatcgtcggtattggtggaggaggaggcctgcttctgctggtgatcgtcgccgttctcattgcatacaagagaaagagtagggacgcggatcgcaccctgaaacgtctgcagcttcagatggacaatttggaatcaagggttgcccttgaatgcaaggaggcttttgctgagttacagaccgatattcatgagctgaccaatgatctggatggagccggaattccattcttggactataggacatatgccatgcgcgtgctgttcccgggtattgaagaccatcccgtgctgaaagagatggaggttcaagcaaatgtagaaaaatctcttacactgttcggccagcttctgaccaagaagcatttcctccttacattcatccggactcttgaggcccagcgttctttttccatgagggataggggtaatgtggcgtctctgatcatgactgccctgcaaggtgagatggagtatgcaaccggcgtcctcaagcagctcttgtccgacctgatagagaaaaacctagaaagtaagaatcacccaaaacttttgctgaggcgcaccgagtccgttgctgagaaaatgctgaccaattggttcacgttcctcctgtataagtttctgaaggaatgtgccggagagcctctctttatgctatactgtgctatcaagcaacagatggaaaagggaccaatagatgccatcacaggggaggctcgctacagccttagtgaggacaagctcatccggcagcagattgattataaaaccttgaccttaaattgcgtgaaccccgaaaacgagaacgcaccggaggtgcccgtcaaggggctggactgtgacaccgtgactcaagccaaggaaaagctcctggacgccgcctacaaaggcgtgccctactcgcagcgccctaaagccgctgacatggatctggaatggaggcagggccgaatggcacggatcatcctgcaggatgaggatgtaaccaccaaaatagataacgattggaaaaggcttaacaccctcgcacattatcaagtgactgatgggagctctgtagcactcgtacccaaacaaacgtctgcctataacatctctaatagttctacgtttacaaagtccctctcaaggtatgaaagtatgctgaggaccgcctccagtccggactccctgcggtctagaacgcccatgatcaccccagacctcgagtccgggaccaagctgtggcacctggttaaaaatcacgatcatcttgatcagagagagggcgatcggggctcaaagatggtgtctgagatttatcttaccagattactggccacaaagggaactctgcagaaatttgtggacgacttgtttgagactatcttttctaccgcccaccgaggctctgctctgcccttggccataaagtacatgtttgattttctggacgaacaggcagacaagcaccagatccacgatgccgatgtgcgacatacctggaagagcaactgcctccctttaaggttctgggtcaatgtgatcaagaaccctcagttcgttttcgacatccataagaacagtatcaccgacgcctgcctttccgtcgtggcccagacgtttatggatagctgtagcacatcggaacataagctcgggaaagactcaccctctaataagctgctgtatgccaaagatattccgaactataagtcgtgggttgagcggtactacgccgacattgctaagatgccagccatttctgaccaggatatgtctgcatacttggccgagcagtcccggctgcacctctcgcagtttaattctatgagcgctctgcacgagatctacagctatataacaaagtataaagacgagatcttggcggccctggagaaggacgagcaagcacgcagacaacgcctgagatccaagctagagcaggtcgtcgatactatggcattgtcatcttag

SEQ ID NO: 129042 - DNA, 5691 bp, Artificial Sequence
  Description of Artificial Sequence: Synthetic coding sequence
atgccactaccacctaggagccttcaggtgcttctgctgctgttactgctgctgctccttctacccggtatgtgggcagaggctggtctgccaagagccggaggcggatcacagccaccatttagaacgttcagtgcctctgattggggcctcacccacttggtcgtacacgagcagacaggtgaagtctatgtgggggctgtcaaccgaatctataaactgagcgggaatcttacgctactacgagcacatgtcacaggacccgtggaagacaatgagaaatgttatcccccgcccagtgttcagtcctgtccccacggtttgggatcaacagataacgtgaacaaactacttctgttagattatgccgctaataggctcctggcttgcggaagtgccagccaggggatatgtcaattcctgaggttggacgatctcttcaagctcggggaaccccatcatagaaaagagcattatttgtcaagcgtccaagaggcgggtagtatggccggggtgttgatagctggccccccgggacagggccaggccaagctgtttgtcggcacacctattgatgggaagagcgagtattttccaacattatcttcaaggcggcttatggcaaatgaggaagacgctgatatgttcggctttgtataccaggatgaattcgtcagtagtcagctcaagataccatcggacacccttagtaaatttccagcctttgacatctactacgtctactcctttagaagcgagcaatttgtgtactatctgacccttcagctggacacccagttaacgagccccgacgccgctggcgagcatttctttacttctaaaatcgttagactctgtgtggatgatcctaagttctattcctatgtggaatttccgatcgggtgtgaacaggctggagtcgaataccggctggtccaggacgcttatttgagccgcccggggcgtgcacttgcccatcagctggggctggccgaggacgaggacgtgctgttcaccgtgttcgctcagggacagaagaatcgggtgaagccacccaaggagtccgctttgtgtttgtttacgctgagggcaatcaaagaaaagataaaggagaggattcagtcgtgctacagaggagaggggaagctcagtttgccgtggttgctgaacaaagagctcggatgcatcaactccccattgcagatcgatgacgatttctgtgggcaggactttaaccaaccgctaggcggcaccgtgaccattgagggtacgccccttttcgttgataaagatgatggcctgactgctgtggccgcctatgattaccgaggccggaccgttgtcttcgccggcacgcggtctgggaggattcggaagattctggttgacctctccaatcccggtggccggccggccttggcttacgaaagtgtggttgcccaagagggttcaccaatcctgcgggatctcgtgttgtctccaaatcaccagtatctgtacgccatgacagaaaaacaagttactcgggtgcccgtggaatcatgcgtccagtacacgtcctgtgagttatgccttggaagccgtgatccacattgtggttggtgcgtactacacagcatctgttcccgcagagacgcctgtgagcgcgccgatgaaccccagcggttcgctgccgacctgttgcagtgtgtccaactgaccgtgcagccacgcaacgtgtccgtgacaatgagccaggtgcccttggtcctccaggcttggaacgtacccgacctgagcgcgggcgtgaactgtagcttcgaggacttcactgagtccgaatccgttctggaggatggaaggatccactgccggagtccatcagctcgcgaggtggcacccataactcgggggcagggagaccagagggtggtgaagctctacctcaagagtaaagaaacagggaagaagtttgcgtctgttgactttgttttctacaactgctccgtccaccagtcttgcctgagctgcgtcaatgggtccttcccatgccattggtgcaagtacaggcacgtatgcacacacaatgttgccgactgtgcttttttagaaggcagggtcaacgtttcggaggattgcccacagatcctcccctctacacaaatctacgtacccgtcggcgtggtgaaaccaataacgttagccgcacgtaatctgccccagccacaaagcggccaacgcggctacgaatgcctttttcatattcccggttcccccgcgcgtgtgacggcccttcggttcaatagctcctcattgcagtgccagaattccagctactcctatgagggaaacgatgtgtcagacttacctgtcaatcttagcgttgtctggaacgggaactttgtaatagacaacccccagaatattcaggcgcatctgtataagtgtcctgctctgcgggaaagctgtggattgtgccttaaggctgacccccgctttgaatgcggttggtgtgtagccgaaaggcggtgtagcctgaggcatcactgcgcagctgatacccctgcgtcgtggatgcacgcccgccatgggagcagcagatgtacagaccccaagatccttaagctctctccggagaccggtccgcgacagggaggcacaagactcaccataactggggaaaacctgggactgaggtttgaagatgtgcgactcggggtcagggtgggaaaggttctttgcagccctgttgagagtgagtatatctcggcagagcaaatcgtatgcgagattggtgacgcaagcagcgtcagagctcatgacgcactcgtcgaagtgtgtgtgcgggattgcagcccacattaccgggccttgagccctaaacgctttaccttcgttactcccaccttctatcgggtttctccaagcagaggcccccttagtggcgggacttggatcgggattgaagggagccacttgaatgccggaagcgacgtggccgtttcggtcgggggaaggccctgttccttttcatggaggaatagccgggaaatcaggtgcctgactcccccaggacaatcacctggttcagcccctattatcatcaacattaaccgtgcccaactgacaaacccagaagtgaaatataactacacagaggacccgacaatcctcagaatcgatcccgagtggagcatcaattccggtggcacccttctgacagtaacaggtacaaatttggctaccgtacgtgagccacggatcagggcgaagtatgggggaatcgaacgggagaacgggtgtttggtgtacaatgatactaccatggtgtgtagagctccttccgtggcaaaccccgtgaggagtccacctgaactcggcgaaagacccgatgagctgggattcgtgatggataatgtgagatccctgctcgttctgaattcaactagcttcctgtattacccagatcctgtgttagaacccctgtctccgacggggctactggaactcaagccaagcagccccctgattctcaaaggccggaatcttctgcctccagcccctggcaatagcaggctcaactacacagtgctgatcggttccacaccttgcactttgaccgtgtctgagacccagctcctgtgtgaggctcccaatctgaccggacagcacaaggtcaccgtgcgggctgggggcttcgagttctcacccggtacgctgcaggtctacagtgattccctcctgaccctgccagctatcgttggtataggaggcggcggggggttgctgctgctggtgatagttgccgtgcttatcgcttataaaaggaagagtagagatgctgataggacactgaagcgcttgcaattgcaaatggacaatctggagagtcgcgtggcactagaatgcaaggaggcattcgccgagctgcagacggatattcacgaactgacaaatgacctggatggtgcaggaatcccttttctggactaccgcacttatgctatgagggtcctgttcccagggatagaagaccacccggtgctcaaggagatggaggtgcaagctaacgttgagaagagtcttacgctattcggccagctattgaccaaaaaacacttcttactgacttttatacgcacattagaggcgcaacgatcctttagtatgcgtgacagggggaacgtcgcatccctgatcatgacagccctgcaaggtgaaatggagtacgctacaggcgtgttgaaacagctgttatctgacctgatagagaaaaacttagaatcgaagaaccacccaaaactgctcctcagaagaaccgagtcagttgctgagaaaatgctaaccaactggtttacctttctgctttataagtttctaaaggaatgcgccggggaacctctctttatgctatactgcgccattaaacagcaaatggagaagggccccatagacgccatcacaggcgaggcccgctactccctttctgaggataaactcattcggcaacagattgactacaagactttgacgctcaactgtgttaatccggagaacgagaacgcacctgaggtgccagttaagggactggactgcgataccgtcacgcaggcaaaggagaagttgttggacgctgcgtacaaaggtgtcccttactctcagcgtcctaaggccgccgacatggatctcgagtggcgacagggcagaatggcccgtatcattctgcaggacgaggatgtcaccacaaaaatcgataacgattggaaacggctgaacactctggcccattatcaggtcaccgacgggagctcagtagctctcgtgcctaagcagacctcagcctataacatctctaatagctctacttttactaaaagcctgagcaggtacgaatctatgctacgcacagccagctctcctgactcactccgatctcggacccccatgattaccccagacctcgaatccggcacgaagttgtggcacctggtgaagaatcacgaccatttggatcaaagagaaggcgatagggggagcaaaatggtgagcgagatttacttgacccgattgcttgcaaccaaaggtactctgcaaaaattcgttgatgatctgtttgagacaatcttcagcactgcccacaggggctccgccctgcctctggcaataaagtatatgtttgacttcctcgacgaacaggcagacaaacaccaaattcacgacgcggatgtcagacacacctggaagtcaaattgccttcccctgaggttttgggtcaatgtgattaaaaatccccaattcgtcttcgatatccataaaaacagcataacggacgcctgtctgtctgtggttgcccagacatttatggacagctgttcaacctcagagcacaaattagggaaagattccccaagtaataaactgttgtacgcaaaagacatcccaaactacaagagctgggtggaaagatactacgcggacatcgcaaaaatgcccgccataagtgatcaggacatgtcagcttatctcgctgagcagtcccggctgcacttgagccagtttaattccatgtctgcattgcacgaaatctactcctatataacaaagtacaaagacgagattttggctgccctggagaaggatgagcaggccagaagacaacggttgcggagcaagctcgagcaggttgtcgatactatggccctgagcagctag

SEQ ID NO: 129043 - DNA, 5685 bp, Artificial Sequence
  Description of Artificial Sequence: Synthetic coding sequence
atggagcagagacgcccatggcctcgggccctggaagtggactctcgcagcgtcgtcctcctatccgtagtttgggtgctgttggcacctccagctgccggtatgccgcagttttccacatttcactccgaaaatcgtgactggacattcaaccacctaacagtgcatcagggaaccggggctgtgtacgtgggcgccattaatcgagtatacaagctgacggggaacctgaccattcaggtggcacacaagaccggacccgaagaagataataaatcgtgctatccacccctcattgtccagccctgttcagaggttctgaccctcactaataatgtaaataagctcttgatcatcgattactccgaaaacaggttattggcttgtggttcgctgtatcaaggggtgtgcaagctgcttaggctagatgacctgttcattctcgtggagccatcacacaagaaggaacattatctcagctccgtaaataaaaccggcaccatgtacggggtgattgtacggtccgaaggcgaagacgggaagctgttcatcgggacagccgtcgacgggaagcaggactatttcccgactctctcttcaagaaagctgcctcgggaccccgagtcatctgccatgctcgattacgaactgcactctgacttcgtctcctctctaataaagatcccgtcagatactctggctttggtgtcacacttcgacatattctacatctacggctttgcctcgggtggtttcgtctatttcctcacagttcagcccgaaacgccagaaggggtggccatcaacagcgccggcgatctgttttacacatcacggatcgtgagactctgcaaggatgacccgaaattccacagctacgtgagcctgcctttcggctgtactcgagcaggggttgagtatcggctgcttcaggccgcttatctggccaagccgggcgatagcttggctcaggcttttaacatcacgtcacaggacgatgtgttgttcgctattttcagcaaggggcagaaacagtatcaccatccccctgatgattctgctttatgtgctttcccaattagagcgattaatcttcaaatcaaggagaggctgcaatcctgttatcaaggagaaggaaatcttgagctgaattggctgttagggaaggacgtacagtgcactaaagctcccgttcccatcgatgacaatttttgtggtttggacataaaccagccactgggagggagtacccctgtggagggattaaccctctataccacctctcgggaccgcatgacgtctgtggcttcatacgtctataacggctacagcgtggtgtttgtcggcactaaaagtggaaagttgaaaaagattagggccgatgggccaccacacggcggggtccagtacgaaatggtatctgttttaaaggatggatctccaatcttacgagacatggctttcagtatcgaccagagatacctgtatgtgatgtcagagagacaggtgacgcgcgttcccgttgaatcctgcgaacagtacactacatgcggagaatgcttatccagcggggacccacattgtggatggtgcgctttacataacatgtgctcccgcagggataagtgtcagcaggcgtgggaaccaaatcgcttcgcagcttccatatcccagtgtgtcagtctagccgtgcaccccagttccatcagcgtgagcgaacacagccgtttgctcagccttgtcgttagtgacgcccctgacctgtcagccgggatcgcctgcgccttcggaaaccttactgaggtcgaaggccaggtaagtggctcccaggtaatatgcatatccccaggtcctaaggacgtgcctgtgattccgctggaccaagattggttcggcctcgagcttcagctgagatccaaggagaccggaaaaattttcgtcagcaccgagttcaagttttataattgctctgcccaccagctgtgtctgagttgtgtgaattccgcattcaggtgtcattggtgcaagtacaggaatctgtgcacgcacgatccaactacctgcagctttcaggagggccgaatcaatatttccgaggattgcccacagctcgtaccaactgaggaaatcttaattcccgtgggagaggtcaaaccaatcaccttaaaggctaggaaccttcctcaacctcagagcgggcagcgaggttatgagtgtgtgctgaatatccagggcgccattcaccgggtaccggcccttcgttttaattctagtagtgtgcagtgccagaattccagttaccagtatgatggtatggacattagcaatcttgctgttgacttcgccgtggtgtggaacgggaatttcataattgataacccccaagacctcaaagtgcacttgtacaagtgcgcggcacaacgggagagctgtgggctgtgcctgaaagccgaccggaagttcgaatgtggatggtgctctggggaacgcaggtgtactctccaccaacattgcacctccccttcatcaccatggttagactggtccagccacaacgtgaaatgcagcaacccacagatcaccgagatcctcacggtgtcgggtccaccagagggcgggacccgcgtgacgattcatggcgttaatcttggactcgacttttctgagatcgcacatcacgtccaagtggccggtgtgccatgcacgcccctgccaggggagtacatcatcgccgagcaaatcgtttgtgagatgggacatgccttagtgggtactaccagtggacctgtgagactctgcataggcgagtgtaaacccgaattcatgaccaagtctcaccagcagtacaccttcgtcaatcccagtgtgctctccttgaatcccatccgggggccggagtctggcgggaccatggtaaccatcaccggtcattatctgggcgctggctccagtgtcgcggtctatctgggcaatcagacctgtgagttctacgggagatctatgagtgagatcgtgtgtgtgtccccaccctcctccaacggtcttggccctgtgccggtatccgtgtctgtggatagagcacacgtagattcaaatctacagttcgaatatattgatgatccgagggtgcagaggattgagcccgagtggtctatcgcgtctggccacactcccctgaccatcaccggctttaatctggacgtaattcaggagcctaggatccgggtcaaatttaatggtaaagagtctgtcaacgtctgtaaagttgtcaacaccacaactttgacctgtctggcaccatcgttaaccacggactatagaccaggattggatacggtcgaacgcccagatgagttcggattcgttttcaataatgtccagagtcttctgatctacaacgacacgaagttcatttactatcccaaccccacattcgagctgctgtccccaaccggcgttctcgaccagaagcctgggagccctatcatcctcaaagggaaaaacctgtgcccccctgccagtgggggggccaagctcaattacactgtccttattggggagaccccttgtgcagtgactgtatctgagacacagcttttatgcgagccacctaacctaactggtcaacacaaagttatggtacatgtggggggaatggtgttcagtcccggttcagtgtcagtgatcagcgatagtctgttaaccctgcccgcaatcgtgtctatagccgctggaggttccttgctgttgattattgtcattatcgtgttgatcgcatataaacgcaaatcccgcgagaatgacctcactcttaaaagattacagatgcagatggataacttagagtctcgcgtagcgcttgaatgcaaagaggcctttgctgagttacaaacagatatcaatgaactaacctccgatctagaccgatccgggatcccatacctggattacagaacttacgctatgagagtgctgtttccggggatagaggaccaccccgtgttacgcgagctcgaagtacaaggtaacggacaacaacacgtggaaaaagcccttaaactttttgcccagctgatcaataacaaagtgtttcttctgaccttcattcgaaccttggagctccagcggtctttttctatgagagacagagggaatgtggcctctctcattatgaccggcttgcaaggcaggctggaatatgctaccgacgtcctgaagcagctcttgagcgacctgatcgacaagaacctggaaaacaagaaccaccccaaactgttacttcgcaggacagaatcagtcgctgagaagatgcttacaaactggtttgccttccttctgcataaattccttaaggagtgcgccggagagccactgtttatgttgtattgtgctatcaaacagcaaatggaaaaggggcccattgacgcaatcaccggggaagctaggtacagcttgagtgaagacaaactgattcgccagcagatcgagtacaaaactctgattttgaactgtgtgaaccccgacaatgagaactctcccgagatccctgtaaaagtcttgaactgcgacaccatcacccaggttaaggagaagattctcgatgccgtctataagaatgtgccgtatagtcagagaccacgggccgtagatatggatttggagtggaggcaaggcaggatcgctcgcgtggtgctgcaggatgaagatatcactactaaaattgaaggggattggaaaagactcaataccctaatgcattaccaagtgtcagaccgaagtgtggtggcgctggtgccaaaacagacgtcttcatataatatccccgcatcggccagcattagcagaacaagcatctcgcgctacgactccagctttcgctacacaggctcacctgacagcttgaggtcccgcgccccaatgataaccccagacttagagagcggagtgaaggtttggcatttagtgaaaaatcacgatcatggggaccagaaagaaggcgataggggctccaagatggtgagcgagatctacctgacacggcttctggcaacaaagggtaccctacagaaattcgtcgatgacttattcgaaaccctgtttagcaccgtgcaccgcggctccgccctgccccttgccatcaaatacatgtttgattttctggacgaacaagcggatagacactccattcacgataccgatgtaaggcacacctggaaatccaactgcctgcctttaaggttctgggttaacgtgattaaaaatccacagtttgtcttcgacatacacaagggatcaatcacagatgcctgtctatccgttgtggcccagacatttatggacagttgtagcacgtccgaacatcggctcggcaaggacagccccagtaataaactgctgtatgccaaggacatccccagttataaatcctgggtagagaggtattacgctgatatcgccaaactgccagccattagtgaccaggacatgaatgcttatcttgctgagcagagtcgactacacgccgttgagttcaacatgttgagtgcccttaatgaaatttacagctatgtgtcgaagtattccgaggagttgatcggggctctagagcaggacgaacaagcccgccggcagagacttgcctacaaggtggagcagctcatcaatgccatgagcattgagagttag

SEQ ID NO: 129044 - DNA, 5685 bp, Artificial Sequence
  Description of Artificial Sequence: Synthetic coding sequence
atgaaggctatgccctggaactggacttgcctgctcagtcacctcctgatggtcggcatgggtagtagcaccctgctaacacggcagcctgccccactgagccagaagcagcgctctttcgtgacctttcgcggggagcccgctgaggggtttaaccacctggtagtcgacgaacggactggccatatctacctcggagcggtgaaccgtatttataaactgagctctgatctgaaagttttagtgacccacgaaaccggaccagacgaagataacccaaaatgttacccacccaggatcgtgcaaacatgcaacgagccactgaccaccaccaataacgttaataagatgctcctgatcgactataaggaaaacaggctgattgcgtgtggttcactttatcaagggatctgcaagctgctgaggctagaggatctgttcaaactcggagagccatatcataagaaagaacattatctctccggagtcaatgagagtggaagtgtgttcggcgtgatcgtatcgtatagcaatttagacgataagcttttcatcgcaaccgccgtggacggcaagcccgagtatttccccactattagcagtaggaagttgaccaaaaattctgaagctgatgggatgtttgcgtacgtctttcacgacgagtttgttgcatctatgattaaaattccctctgacacctttaccataattccagacttcgatatatactatgtctacggatttagctccggaaatttcgtgtatttcttgacactgcagcctgaaatggtgtcaccccccggatccaccaccaaagaacaggtatacacttccaaattagtgcgtctctgcaaagaagatacagcttttaacagctatgtggaggtgccaattggctgcgagcgctctggagtggagtatcgcctgctccaagccgcatacttgtcaaaagctggagccgtgctagggcggacccttggcgtccacccggatgacgacctgctctttacagtgtttagcaaggggcaaaagcggaaaatgaaaagtctggacgaatccgctttgtgcattttcatcctaaagcagattaacgatagaattaaggagcgccttcagtcatgttatagaggcgaaggtacactcgatctcgcatggcttaaggtgaaagacatcccatgctcctccgctcttctcactattgacgacaacttctgcggactggatatgaacgcccccctcggagtaagcgatatggtacggggcatcccggtgttcaccgaagaccgggatcgtatgaccagtgttatcgcctatgtgtataaaaaccattccctggcatttgtcggtactaagtccggaaaactaaagaagattcgggtcgatggtccccgcgggaatgctctgcaatatgagactgtgcaggttgttgatccaggtcctgtgttgagagatatggcctttagtaaagatcatgagcagctctacatcatgtcggagcggcagctgaccagagtgcctgtcgaatcttgtggacagtaccagtcgtgcggcgaatgcctcgggtcaggcgatccccattgcggctggtgcgtgctgcacaatacctgtacgcgaaaggagcgatgtgagcgctctaaggagcctagacggtttgctagcgagatgaagcagtgtgtgagactcaccgtccaccccaacaatatctcggtaagccagtacaatgtgttgcttgtgctggagacatacaacgttccagaactctcagcaggtgttaactgtaccttcgaggacctcagcgagatggacggcttggtcgttggcaaccagatccagtgttactcacccgctgccaaggaggttccacgaatcataactgagaatggtgatcaccatgtggtgcagctccagctgaaaagcaaagaaaccggcatgaccttcgcgtctactagctttgtgttctacaactgttccgttcataattcctgcctgtcatgtgtggaatctccctatcgatgtcactggtgcaaatatagacacgtgtgcacacacgaccccaagacttgcagcttccaggagggacgtgtgaaactcccagaggactgcccccagctgctgagggtggataagatacttgtgcctgtggaggtgattaaacccattacgctcaaggcaaaaaatttgccccagccccaatctggtcagcgaggctatgagtgtatcctgaacatccagggaagcgagcagagagtcccggcattgaggttcaactcttcctccgtgcaatgccagaatacctcctattcatatgaaggaatggaaatcaataatctgccggttgagttaacggtggtgtggaacgggcatttcaatatcgataaccctgcacagaataaggttcatctctataagtgtggggccatgcgagagagttgcggactttgcctgaaagcggaccccgatttcgcatgtggatggtgtcaaggacctggccagtgcaccttgcgacagcattgtccagcgcaagagtcgcagtggctagaattgtccggcgctaaaagcaagtgtactaaccccagaatcaccgaaattattcctgtcacgggccctagagagggtggtactaaggtcaccataagaggggaaaatctggggctggaatttagggatattgcaagtcatgtcaaagtagccggtgtggaatgttctccgctggtcgatgggtacattccggctgagcaaatagtctgtgagatgggcgaggccaagcctagtcagcacgcaggatttgtggaaatctgtgtggctgtatgcaggccggagtttatggctagatcttcacagctatactacttcatgactctgactctgtctgatcttaaaccctctaggggacccatgtccgggggaacacaagtgaccataaccgggactaacttgaatgctgggagcaatgtggtggtcatgttcggcaagcagccttgtctattccacaggagaagcccatcttacattgtgtgtaacacaacctcatctgatgaggtacttgaaatgaaagttagcgtgcaggtagatagggccaagatccaccaggatctcgttttccaatatgtcgaagatcccacaatcgttcggatcgaacccgagtggagcattgtttctggaaatacacccatcgcagtttggggaactcacctcgaccttatccagaatcctcaaatcagggctaaacatggtggtaaggagcacatcaatatctgcgaggtgcttaacgccactgaaatgacttgtcaggctcccgcactagctttgggacctgaccatcagagtgacctgaccgaacggcctgaggaattcggcttcattctcgacaacgtgcagagcctccttatcctcaataagacaaattttacttactacccaaacccggtttttgaagccttcggcccgtcgggcattcttgagctgaaaccaggcactcctattattttgaaaggcaagaacctgataccacccgtggctggaggcaatgtgaagttaaactacacagtgctcgtgggggaaaagccctgtacagtcacggtgagcgatgtacaattgctgtgtgaaagccctaacttaatcgggcgtcataaggttatggcacgggttggcgggatggagtactcacccggaatggtttacatagcccccgactcacctctctccttgccagccatagtctcaatcgcggtcgccggcggtcttttgatcatcttcatagtggcagtgctgatcgcctacaagaggaaatccagggaatccgacctgacactaaagcgcctccagatgcaaatggataatctggaatcaagggtggcgctagagtgtaaagaggctttcgccgaattacaaacagacattcacgagctcaccagcgatctcgacggtgcagggattccgttcttggactacaggacatacaccatgagggtgctttttcctgggatcgaagatcaccccgtcttgagagacctcgaagtgcccggctatcgacaagagagggtagaaaagggattaaaattgttcgcccaactcattaacaataaggttttcctgcttagctttatccggactctcgagtcacagcgctccttttctatgcgagaccgtggcaatgtggcctcactgatcatgaccgttctgcagtccaaactggagtacgcaactgatgtactgaagcagctgttagccgatctcatcgataagaacctggagtccaagaaccacccgaagctcctgctgcgacggaccgagagtgtggccgagaagatgctcaccaactggtttacatttttactatataagtttttgaaggaatgtgctggggagccgctgttctcacttttctgcgccattaaacaacagatggagaagggacccattgacgccatcacaggggaagcaagatactctctctccgaggataagctgataaggcagcaaattgattacaagaccttggtgctctcttgcgtcagtccggacaacgccaacagcccagaggttcccgttaaaatcctgaattgtgatacaatcacacaggttaaggagaaaatcttggacgccatcttcaaaaacgtcccttgttcacaccgccccaaagccgctgacatggatttggaatggagacagggctcaggagcacggatgattttgcaagatgaggatataaccaccaagatcgagaacgattggaaacggctcaatactcttgctcattaccaagtgcccgacgggagtgtggtcgcactcgtcagcaagcaggtgaccgcttacaatgccgtgaacaacagcacggtctctagaacaagtgccagcaagtatgagaatatgatccgctatacaggatctccagattctttaagaagcaggacccctatgataactcccgacctcgagagcggagttaagatgtggcatctggtaaagaaccatgagcacggagaccagaaggagggcgaccgggggagcaagatggtctccgagatctacttgacgaggctgttagcaactaaaggcacccttcagaaattcgtcgacgatcttttcgaaactattttcagtaccgctcaccgcggctccgcattgcctctggctatcaaatacatgtttgactttctcgacgaacaggccgacaaacatggtatccatgacccacacgtgagacacacgtggaagtctaattgtttgcccctccgattctgggtgaatatgattaagaatccgcagttcgttttcgatatccacaaaaacagcatcacggatgcttgcctctctgtagtggcacagacctttatggattcatgtagcactagcgagcaccgattaggaaaagatagcccctccaataaactgctttacgctaaggacatccctagctacaaaaactgggtggagcggtactacagtgacatcgggaaaatgcctgccattagcgatcaggatatgaacgcttacttagccgagcagtctcggatgcacatgaatgagttcaacaccatgtctgctctaagtgagatcttctcatatgtggggaagtattcagaagagattttggggccccttgaccacgatgatcagtgcggtaagcaaaaactggcgtataagctggaacaagtgattaccttgatgagccttgacagttag

SEQ ID NO: 129045 - DNA, 5685 bp, Artificial Sequence
  Description of Artificial Sequence: Synthetic coding sequence
atgaaggcgatgccttggaattggacttgcctcctgtctcatctactgatggttgggatggggagcagtacgctgctcacgagacaacctgctcccttatcccaaaagcagcgtagcttcgtaacattcagaggagagcccgccgagggctttaatcacttagtggtagacgagcggaccggccacatctatcttggggccgtcaataggatctacaaactcagttctgatctgaaggtcttggttacccacgagacaggcccagacgaagacaatcccaagtgctacccaccaagaatcgtccagacctgtaacgagccgttgactactacaaacaatgtcaacaagatgctgttaatcgattacaaggaaaacaggctcatcgcatgcggctcgctctaccagggtatctgcaaactattacgcctggaggacctgtttaaactgggtgaaccctatcataagaaagagcattacttgagtggcgttaatgagtctgggtctgtttttggggtgatcgtgagttattcaaatctagacgacaaactctttatagcaaccgctgtggacgggaaaccagagtattttcccacaataagcagtagaaagcttaccaagaacagtgaggctgatggcatgtttgcctacgtgttccatgacgagtttgtggcctctatgataaagatcccttctgacacttttactataattccagactttgacatttactatgtttacggcttctcctccgggaattttgtgtattttctgactctgcagccggaaatggtgtccccccccggaagcactaccaaggagcaagtttacaccagcaaactcgtccggctctgtaaagaggatactgctttcaactcctatgtggaggtacctataggttgtgaacgcagtggcgtcgaataccggctcctacaggcagcctatctgtccaaggcaggcgccgtgttgggacgcacgttaggcgtacatcccgacgatgatctactcttcaccgtcttcagtaagggacagaagagaaagatgaaaagcctggacgaatcagcattgtgtatattcattctgaaacagattaatgacaggattaaggaaagacttcaatcctgctaccgcggcgaagggacgctcgacctggcttggctcaaggtgaaagacatcccatgctcttctgcccttttaacaattgatgataacttttgcggcctggatatgaacgccccactcggtgtctctgacatggtacgcgggatccccgtcttcacagaagatcgggataggatgacatcagtgatagcgtatgtgtacaaaaatcactccttagcctttgtgggcactaagagtggtaagctcaaaaagattagggtggatgggccccggggcaacgccctgcagtatgagactgtccaggttgtagaccccgggcctgtgctgcgggacatggctttctccaaagatcacgagcagttatacatcatgtctgagcgccaattgacgcgggtcccagttgagagctgtggacagtatcagtcttgcggagaatgcctcggatctggtgaccctcactgtggctggtgtgttctccacaacacctgtacacgtaaggagcggtgcgagcgcagcaaggagccacggagattcgcatcagagatgaaacagtgtgttcggctgaccgttcatcccaacaacattagcgtaagccagtacaatgtgcttctggtgttagaaacctataacgtgccagagttgtccgccggcgtgaattgtacttttgaggatctcagtgaaatggacggacttgtcgtcggcaatcagatacagtgctattcccctgccgctaaggaggtccctagaatcattaccgagaatggtgaccaccacgtggttcagctccagctaaagtccaaggaaactggaatgacatttgccagtaccagcttcgtgttctacaattgtagtgtgcataatagttgtctgagttgcgtcgaatccccttaccggtgccactggtgcaaataccgccacgtctgtactcacgaccctaaaacctgcagcttccaggaaggccgggttaagctccccgaggattgtcctcaactcttgcgtgttgacaagatactggtccctgttgaagtgatcaagccaatcaccctcaaggcaaagaatctgccacagccgcagtccgggcagagaggctatgaatgcatcctcaatatccaaggctccgaacagcgcgtgccagccttacggttcaacagctccagcgttcagtgtcagaatacctcgtactcctacgagggcatggagatcaataatctgcctgtcgaactcacagtggtctggaacggacattttaatatcgacaaccctgcccagaataaggtccatctttataaatgcggcgcgatgcgggagtcctgcggtttgtgtcttaaggccgatcccgacttcgcttgcggctggtgtcagggtccagggcaatgcacactacgacagcattgccccgcacaggaaagtcagtggctagagctctctggtgccaagagcaagtgcaccaaccctagaatcaccgaaatcattccggtaactggacccagggaaggcggaacgaaagtgaccattagaggagagaatctggggttggagttccgcgacattgcatctcacgttaaagtggcaggcgttgaatgttctccgctggtcgatggctacattcctgccgagcagatagtgtgcgaaatgggggaggcgaagccctcccagcacgctggatttgttgagatatgcgttgctgtttgcagacctgagtttatggctagatcgagccagttgtactacttcatgacacttaccttgtcagatctcaagcccagcagggggcccatgagcgggggcacgcaggtgacaattactgggacaaacttgaacgcggggagcaatgtggtggtgatgtttggaaagcaaccttgcctcttccaccggcgctcacctagctacatagtgtgcaatactacgagcagtgatgaagtcttggaaatgaaggtcagcgtgcaggtggacagggcgaaaattcaccaggatctcgtcttccagtacgtcgaggacccaaccatagtccgcatcgagcccgagtggtccatagtaagcggcaacacccctatcgccgtctgggggactcacttagacttgatccaaaacccccagattcgggccaaacatggaggcaaggaacatatcaatatctgcgaggttctgaatgctaccgaaatgacctgtcaagcccccgcactcgccctgggaccagaccatcagtctgatcttaccgagagacctgaagagtttgggttcattctcgacaatgtacagtcgctgctgattctgaataagaccaattttacatattatcccaatcccgtgttcgaggccttcggcccttcgggcattctcgaactgaaacctggtaccccaattattttaaagggtaaaaatttgattccccccgtagcaggcggtaacgtaaaactgaactacaccgtgctggtgggggaaaagccctgtaccgtgaccgtgtccgatgtacagctcttatgcgagagtcccaatctgatcggacgccataaggtgatggcccgagtcggagggatggagtactcccctgggatggtgtacattgctcctgatagtccccttagtctgccagcaatagtctccatcgcagtcgccggaggactgctaatcatctttatcgtggctgtgttgattgcttataaacggaaatcaagggagagcgaccttactctgaaaaggctgcaaatgcaaatggacaaccttgagagcagagtggccttagagtgtaaagaggcctttgctgagcttcagactgacatccacgagcttacatctgatctagatggcgctggtatacctttcctggactaccggacttatacaatgcgggtgctgtttccgggcatcgaggatcatcctgtgttgcgggacctggaggtgcccggctacaggcaagagcgtgtggaaaagggtctgaagctgttcgcccaattgatcaacaacaaggtcttcctgctgtcctttattcggacgctggaatctcaacgttcctttagtatgagggaccgcggtaacgtggcttcgctgattatgaccgtgttgcagagtaagctggaatatgccaccgacgtgttgaaacagctcttagccgatctcatcgataagaacttagaatctaaaaatcatccaaagctcctcctgagacgtacagagagtgtggccgaaaaaatgctgaccaactggttcacattcttgctgtataagtttctcaaggagtgcgctggagagccactgttcagtctgttttgtgctataaaacagcaaatggagaaagggccgatcgatgctattaccggagaggcccgatattcactcagtgaagataaacttattcgccaacagattgattacaaaacgttggtgctcagctgtgtttctcctgacaacgccaatagccctgaggtgcctgtgaagatactgaattgcgacacaatcacccaagtgaaagagaaaatcctggatgccatctttaagaacgttccatgcagccatagacccaaggctgctgacatggatctcgagtggaggcagggatctggggcccggatgatcttgcaggatgaggacatcaccacgaaaatcgagaacgactggaaaaggctgaacactctcgcccattatcaagtaccggatggatcagtcgtggccctcgtgtctaagcaggtgacagcttacaacgctgtaaataattcgaccgtgtcccgaacaagcgcctctaaatacgagaatatgattcggtatactggcagccccgacagtctccgctcacgcactccgatgattacgcctgacctggagagcggagtcaaaatgtggcatctggtcaaaaatcacgagcacggagaccagaaggagggcgacagagggtctaagatggtttcggaaatttacctcacacggctgctcgcaacgaagggcacattgcagaaattcgtagatgacctcttcgagacaatattctccaccgcccaccgcggcagcgctctgcccctcgcaataaaatacatgttcgatttcctcgacgagcaagctgataagcacggcattcatgaccctcacgtgcggcacacttggaagtctaattgtctaccactcaggttttgggtgaatatgataaagaatcctcaattcgtgtttgatatccataagaattctatcacagacgcgtgcctgtccgtggttgcacagacttttatggactcttgctccacaagtgagcacaggctaggcaaagactccccctccaacaagttgctctatgctaaggacatcccgagttacaagaactgggttgagcgatactacagtgacattgggaaaatgcctgccatatctgaccaggacatgaacgcctacttggccgagcagtctcggatgcacatgaacgagtttaatactatgagcgctctgtccgagatcttcagttacgtgggaaagtattcagaagaaatccttgggccactggaccatgacgaccagtgcggtaagcaaaaactcgcatacaagttagaacaagtaatcaccctgatgtctttagatagctag

SEQ ID NO: 129046 - DNA, 1569 bp, Artificial Sequence
  Description of Artificial Sequence: Synthetic coding sequence
atgaaagcgatgccatggaactggacgtgtttactttcccatctgctcatggttggtatgggctctagtacattgttgactcgccagcctgctcccctgtcccagaagcagcgcagcttcgtgaccttccggggcgaaccagccgaaggttttaaccatctggttgtagacgaaagaactggacacatttacctgggggcggtgaatagaatttataaattatcctccgacttgaaagtccttgtcacccacgaaaccggcccagacgaagacaacccaaagtgctacccccctcggatagtgcagacgtgtaacgagcctcttacgaccacgaacaacgtgaataagatgctcctcatcgactataaagaaaatcgcctgatcgcttgcggctctctgtatcaggggatttgcaagctgctccggctggaagatctctttaagctgggagagccttaccataaaaaggaacactacctgtcaggggtcaatgaaagtggttctgtgttcggcgtcatagtgagctactcaaacctggacgataagctcttcatagcgaccgccgttgacggcaagccagaatacttcccaacaatatcatcccgaaagcttacgaagaatagcgaagcagacgggatgttcgcctatgttttccacgatgaatttgtcgcatccatgatcaaaataccgtctgatacttttaccattattcctgattttgatatttactacgtgtacgggttttcatcaggaaatttcgtttactttttgacattgcagccggaaatggtgtcccctccagggagcaccaccaaggagcaggtgtacaccagcaaactggtgcgtctgtgcaaggaagacaccgcatttaacagctatgtggaggtcccgataggttgtgagagatctggagtggaatataggctgctgcaggctgcctaccttagtaaagcgggggctgtcctgggtcggacgctcggagtgcacccggacgatgacctattattcaccgttttcagcaaaggccagaaacggaagatgaaaagtttggatgagtccgccctgtgcatttttatcctgaagcagataaacgatagaattaaagagcgcctccaatcctgttataggggtgaagggactcttgatctcgcatggctaaaagtgaaggatatcccttgcagctctgccctgcttacaatcgacgacaatttctgcggactggatatgaatgccccactaggcgtaagcgatatggttcgagggattcctgttttcaccgaggaccgcgaccgaatgactagcgtgatcgcgtacgtctataaaaatcacagccttgctttcgtaggaactaaatctggaaaactcaagaagtcctttggcacagggccacagggaggcatcactcaggagtggatcggagttgagggggatcccccaggcgcaaatatcgccagccaggagcagatgctgtgcgtgtacctgcagtgttcaagtcacaaggccatttctgatcagcgggtccaaccactgttgtgttgctttttaaacgtgccaggaaattcctcctag

SEQ ID NO: 129047 - DNA, 1479 bp, Artificial Sequence
  Description of Artificial Sequence: Synthetic coding sequence
atgaaagcgatgccatggaactggacctgccttctgagtcatctcttgatggtcggcatgggctcttctacgctcttgaccagacagcctgcaccgctcagccagaagcagagaagctttgtgacgttcagaggcgaaccagccgaggggtttaaccacctcgtggtcgatgagagaacagggcacatttatctgggagcggtgaataggatttacaagctcagctccgacctgaaggtccttgttacacacgagactggccccgacgaagacaacccaaagtgctacccccctaggatagtccaaacctgtaatgagccacttaccacgaccaataatgtaaacaagatgttactgatcgattataaggaaaataggcttatcgcttgcggctctctgtaccagggcatctgcaaacttctccgactggaggatcttttcaagctaggagagccatatcacaaaaaggaacattaccttagcggcgttaatgaatccggcagtgtgttcggcgtgatcgttagctactctaatctggacgataaattattcattgctacagctgtggacggcaagcccgaatatttccccacaatatctagccgaaaattgacaaagaattctgaggcggacggtatgttcgcatatgtatttcatgatgagttcgttgcaagtatgattaagatcccctcggatacgtttaccataatccccgatttcgacatatactacgtctacggattttcaagtggaaacttcgtgtatttcctgacccttcagcccgaaatggtctctccccccggcagcactactaaagagcaggtatacacatccaagctcgtgcgtctctgcaaggaagacaccgccttcaattcttatgtggaagtcccaataggatgtgagcgcagcggcgtggaatatcggctgctccaagccgcttaccttagcaaggctggggccgtgcttggtcgaaccctcggcgtgcatcccgatgatgacctcctgtttacagtctttagcaagggacagaagcgtaagatgaagagcctggatgaatcagcactctgtatcttcatcctgaagcagattaacgacagaataaaagagcgactccaaagctgttatcgaggagagggcacgctggacctggcttggctcaaggttaaggatattccgtgctcgtccgccttgctaactatcgacgataacttttgcggcttagatatgaatgcccccctgggtgtctcagatatggttagaggcatcccagttttcactgaggaccgggaccggatgaccagcgtgatcgcttatgtctacaagaatcattccctcgcattcgtgggcaccaaaagtggcaagctcaagaaaatgcctggcaccagcctgtgtccaacccttgaacttcagaccggcccccgcagccatagggccactgtgaccctcgaacttctgttcagcagctgttcttctaactag

SEQ ID NO: 129048 - DNA, 5517 bp, Artificial Sequence
  Description of Artificial Sequence: Synthetic coding sequence
atggccttgcagctgtgggccttaacattgttgggactcctgggggcgggggccagccttcggccgaggaagctggacttctttaggagcgagaaagaacttaatcatcttgcggtcgacgaggcctctggtgtcgtctacctgggcgccgtgaacgccctctaccagctcgatgcaaaactgcagctcgagcagcaggtcgcaaccgggcctgccttggataacaaaaagtgcacacctcccatcgaggcctcccagtgccatgaagcagaaatgacggacaatgtcaaccagctcctcctgctcgacccccctaggaaaagactggtcgaatgtggcagtctgtttaagggcatttgcgctctccgtgctctgagtaatatttcccttaggctgttctatgaggatgggagcggcgaaaagagctttgtggcgagcaacgacgagggcgtagccaccgtgggacttgtgtcttctactggccccggcggggatagagtcttgttcgttggcaagggcaatggaccccatgacaatggtatcatcgtaagcactagactgctagaccgcaccgactcaagagaagccttcgaagcatacactgaccacgccacatacaaggccggttatttgagtacgaacacccagcagttcgtagccgcctttgaagacgggccatatgtcttctttgtcttcaaccagcaggataaacaccccgcgcggaaccggaccctcctcgccaggatgtgtagagaagaccccaactattattcctaccttgagatggacctacagtgtagggaccccgatatccacgccgctgccttcgggacatgcttagccgcctctgtcgcagcacctggctccggacgcgtgttatatgcagttttttctagagacagtagaagctcgggcggacccggagccggattatgcttatttcctcttgacaaggtacacgccaaaatggaagccaataggaatgcatgttataccggcactcgcgaggcacgggatatcttctacaaaccttttcacggcgacatccaatgtggcggccacgctccgggctctagcaagagtttcccatgtggcagcgagcatctcccatatccactcgggagcagggacggattgcgtggcacagctgtgctccagagaggcggtttgaacctgactgccgtcaccgtagcagccgagaacaatcatacggtggcatttctgggaacctccgacggtcggatcctaaaggtttatctaacaccagatggcaccagcagcgagtatgatagtatcttagtggaaatcaacaagcgggtcaaaagggatctggttctcagtggagacctggggagcctgtacgctatgacccaggacaaggtgttcaggcttcccgtgcaggaatgcttatcttaccccacttgcactcaatgcagggattctcaggacccatactgcggctggtgtgtggtggagggacggtgcacgcgtaaagcagaatgccccagagctgaggaggcctctcactggttatggagccgcagcaagagttgcgtagcagtcacttcagcccagccccagaacatgtcccggcgtgcccagggcgaagtgcagctcaccgttagccccctacctgccttatccgaggaagatgagctcctgtgtctgttcggggagagcccccctcatcccgcgcgggtagagggtgaagccgttatttgtaatagcccaagtagcattcccgtcacgcctccgggacaggatcatgtggcagtgacgattcagttactgctcaggcggggaaatatattcttaacttcttaccagtatcctttctatgactgccgacaggctatgtctctagaagagaacctgccttgtatctcctgcgtcagtaacagatggacctgtcagtgggacctcagatatcatgaatgtcgagaggccagccctaatcctgaggatggaatagtgagagctcatatggaggatagttgccctcagtttttgggaccttcaccattggtgatcccgatgaatcacgagaccgacgtcaacttccagggcaagaaccttgacactgtgaaaggtagctcccttcacgtggggtccgacctgctcaaattcatggagcccgttaccatgcaggaaagtggcacattcgcgtttcgcacgcctaaactgtcacacgatgctaatgaaaccctcccactacatctctatgtcaagtcatacggaaaaaacattgattcaaagctacatgtgaccctctataattgctccttcggacggtctgactgttcgctgtgcagagccgcaaacccagactaccggtgcgcgtggtgtggaggccagagccggtgcgtatacgaggctctttgtaatacaacatctgagtgtccgccacccgtcatcacaagaatccaaccagagactggcccactaggtgggggcattcgcatcaccatactagggagcaacctcggcgtccaagctggagatattcagcgtataagtgtggccgggaggaattgcagcttccagcccgaaaggtactccgtgtccaccagaatcgtttgcgtgatagaagctgccgagacccccttcaccggtggagtggaagtggatgtgtttggcaagctggggagaagccctccaaatgtgcagttcaccttccagcagccaaaacctctgtctgtggagccccaacaggggcctcaggccggtggcaccactctgacgatccacggtactcacctagacactggttctcaggaggacgtccgcgtcactcttaatggagtaccatgcaaggttacgaagtttggagcccagctgcagtgtgttactggcccccaggccactcgtggacagatgctcctagaggtgagctacggcggtagccctgtgccaaatccagggatctttttcacctatagagaaaacccggtcctgcgcgcctttgaacctttaaggagttttgctagcggaggtagaagcatcaatgtaactggccagggtttctctctaatccaaagatttgcaatggtcgttattgctgaacctttacagtcttggcagcctcctcgagaagctgaatcacttcagcctatgaccgttgttggaaccgactacgtcttccacaacgataccaaagtcgtcttcctcagccccgctgtgcctgaagaacccgaagcttacaacttaactgtgctaattgaaatggatggacacagggcattgcttcgaaccgaagccggcgctttcgagtacgtccctgacccaacttttgaaaatttcaccggaggcgtgaaaaaacaggtcaacaaactcattcatgctaggggaacaaacttaaacaaagctatgaccctgcaggaagctgaagccttcgtcggggccgagagatgcaccatgaaaaccctgacggagactgatctttactgcgagcccccagaggtgcaacctcctcctaaacggaggcaaaagcgggacacaacccacaatctgccagaattcatcgtgaaatttggcagtcgggagtgggttcttggtagagttgaatacgacactcgggtgtccgatgtgcccctgtctcttatccttcccctcgttatagtgccaatggtcgtggtaattgcagtaagcgtatactgctattggcgtaaaagtcaacaagccgagcgggagtacgagaagattaagagccagttggagggtctggaagagagcgtgcgggatcggtgcaagaaggaatttactgacctcatgatcgaaatggaagaccagacaaatgatgtgcacgaggcaggcatacctgtcctggactataagacctacacagacagggtgttttttctaccatccaaggacggagataaggacgttatgatcacagggaagctggatattcccgaacctcgtcgaccagtggtggaacaagcactctatcaattcagtaatttgcttaacagcaaaagttttcttattaattttattcacacgctagagaaccaacgggagttctctgctcgcgctaaagtttattttgcctcccttctaaccgtagccctgcacggtaagcttgagtactataccgatatcatgcacaccctgttcctcgaactgctggagcagtatgtggtggccaagaaccctaagctgatgcttcgacgctctgagaccgtcgtcgagcggatgctatctaattggatgtccatctgtctctatcaatatctgaaggacagtgccggagaacccctatacaagctcttcaaagcgattaagcaccaggtggagaaagggcctgtcgacgcggtccaaaagaaggccaaatacacactgaacgatacaggactgctgggagacgatgtggagtacgctccactgaccgtaagcgtcatagttcaagatgagggggtcgacgcaatcccagtcaaggtcctaaactgtgataccataagccaggtgaaagaaaagattatcgaccaggtgtaccgaggacagccatgttcctgttggcctcgccctgacagcgtagtcctcgaatggcgaccaggcagcactgcccagatactgtcagacctggaccttacatcccaaagggagggcagatggaaacgcgtgaacaccctgatgcactacaatgtgcgagatggagctaccctgatactgagcaaagtgggcgtttcgcagcagccggaagatagccaacaggacctacccggagagcgtcatgctttgcttgaggaagagaaccgcgtgtggcacctggttcgacctactgatgaagtcgacgaaggcaagagcaagcgcgggtcagtcaaggagaaggaacgaacaaaggcaatcacagagatctatctgacgcgactgctgtccgtgaaaggcactttacaacaattcgtggacaactttttccagtccgtgttagcccccggacatgctgtgccacctgcggtcaaatactttttcgacttcctggacgaacaggcagagaagcataacatccaagacgaggacactattcacatctggaaaaccaactccttacccctgagattctgggtcaatatcctcaagaatcctcatttcatttttgacgtgcatgtacacgaagtagtcgatgcctccctcagcgtcatcgcccagaccttcatggatgcgtgtacaaggactgagcataaattgagccgtgatagccccagcaataagctgctgtatgcaaaggaaatatcgacttataaaaagatggtggaggactactacaaagggatcagacaaatggtccaagtgagtgaccaggacatgaacacgcacctggctgagatcagtagagcacacacggacagtttgaatacccttgtagccctgcaccaattgtaccagtacactcagaagtattatgacgaaattatcaatgccttggaggaagaccctgccgctcagaagatgcaactagcctttcgactccagcagatagccgccgctcttgagaataaggttactgacctttag

SEQ ID NO: 129049 - DNA, 1044 bp, Artificial Sequence
  Description of Artificial Sequence: Synthetic coding sequence
atgcatactctcttccttgagctgttggaacaatacgtagtggccaagaacccgaaactgatgctccgtaggagcgagaccgttgtggaacggatgttaagcaactggatgtctatttgtctttatcagtacctcaaagattctgccggcgagccactctataaactgtttaaggctattaaacaccaggttgagaaaggtcctgtggacgcggtgcagaagaaggcaaaatatacactgaacgacaccggcttgctgggcgatgatgtggaatacgctcctctgacggtgtccgtgatcgtgcaggacgaaggggtggacgccattccggtgaaggtcttgaactgcgacaccatctcacaggtcaaggaaaaaattatagatcaggtttaccgaggacaaccatgtagctgtggtcccgggcaaaccgcatggagctggtccggcgtacgggcacctcaacggcgctctgtggggcctggacccgacgtaaccgcgggcggccctgtggaggctcggcaacatccctatgctctacaatgccctggatggtcacacccacacccagtgcagggggggggcctacctgccgccggggggcaacccgcaggacccgcttggagcgcaatgccccctggaggaggggaaccaggcgtagctccaggcgctgccgacagacgaggcggaagaggtcaggtgcaggaacgtcagagggagagagagggagccgatgaaggccaccatcgagacctgccggatgccgccgcactcagccagggccacacggccgccgtgtgcggacagttgcttcccgaaagggcaggagcctggcacgcagtccctccagcagttaaatactttttcgactttctggacgaacaggctgagaagcacaatatccaggacgaggataccattcatatttggaaaacaaatagtctgccgctgcgattttgggtgaacatcctcaaaaacccccactttatctttgacgttcacgtgacccgctggtggacccctaggtgccagagctctcggcgctag

SEQ ID NO: 129050 - DNA, 483 bp, Artificial Sequence
  Description of Artificial Sequence: Synthetic coding sequence
ggacccgacgtgactgcgggtggtcctgtggaggcaaggcagcacccatatgcattgcagtgcccgggctggtcgcacccccacccagttcagggcggaggactcccagccgcggggggacagccagcagggccagcgtggggggcgccttgccctccgggtgggggtgaaccaggtgtggctccaggagcggcagacagacggggcgggcggggccaggtgcaggaaagacaaagggaaagagaaggtgcggacgaagggcatcacagagacctcccagatgctgctgctctttctcaaggtcacaccgccgcagtttgtgggcagctgttgcccgagagagcagggctgggcacacggtgtcacttgcagtcaagcacatcatccaccagctggacatcccggcagagatccacaacatcaagaatgaaaaccccctcgacatcagggcggaggactgcctatagatccgggagtggatag

SEQ ID NO: 129051 - DNA, 1569 bp, Artificial Sequence
  Description of Artificial Sequence: Synthetic coding sequence
atggcactgcaactctgggccctcactctgctcgggctgctaggcgctggcgcctcattgaggcctcggaaactggatttcttccgatctgaaaaagagctcaaccatctcgccgtcgacgaagcttcaggcgtggtgtacctcggagctgtgaacgccttgtaccaactagatgccaagctgcagctggagcagcaggtggccacaggaccagccttagacaacaagaaatgcactccaccgattgaggcctcacagtgccacgaagccgagatgacagacaacgtgaatcagttgctgttgctggatccccctaggaaaaggctggtagaatgtggaagtctgtttaaaggcatctgcgctctaagagctctgagcaatatcagtcttaggctgttctacgaggatggatctggagagaagagcttcgtggccagcaacgacgaaggtgttgcaacagttggcttggtgagcagcacagggccaggaggggatcgcgtgctgtttgtgggcaaggggaacgggccccacgataatggcataatagtgagtaccaggctgttagatcgcacagactccagggaggcattcgaagcgtacacagaccatgccacgtacaaggccggatacctgtctacaaacacacagcagttcgttgcagcctttgaagacgggccatacgttttctttgtctttaaccaacaagacaagcaccccgcaaggaacaggacactcctggcccggatgtgccgtgaggaccccaactactacagttacctcgagatggatctgcagtgtcgggacccagacattcacgccgccgccttcggaacctgtttagccgcatccgtagccgctcccggatctggcagggtgttgtacgctgttttttctagagacagtcgctcgtccggtgggcctggtgccggactttgcctgttcccactcgacaaggtgcacgccaagatggaggccaatcgcaacgcatgctataccggcacaagagaagcacgcgatatcttttataaacccttccatggtgacatacagtgtggagggcacgcccccggttcctcgaaaagttttccttgcgggtctgagcatttaccataccctctgggcagtagggatggtctgcggggcacagccgttttgcaacggggaggcctcaaccttactgcagtgacggtcgcagctgaaaacaatcataccgtggcatttcttggcactagcgatggaagaatcctgaaggtgtatcttacccctgacggcacttccagtgagtacgatagcatcttggttgagatcaacaagcgcgtaaagagggatctggtcctttccggtgacctcgggtccctgtatgcaatgactcaggacaaggtgttccgcctgccagttcaagagtgtcttagttatccaacctgcacgcagctcccacccgccgccgagccggcttcaggggttcactgtagggttagctctgacctgaagatgtgtctcactcttccccgttggggtcagctggccagcgcttcagctcacgcgcctgccgccgcgtctatgccttag

SEQ ID NO: 129052 - DNA, 489 bp, Artificial Sequence
  Description of Artificial Sequence: Synthetic coding sequence
atggccctgcagctatgggccttaaccctcttgggcctcctgggtgccggcgctagtctgaggccaaggaaactcgatttctttagatctgaaaaggaattaaatcacttggctgtcgatgaggccagtggagttgtgtatctgggagctgtcaacgccctttaccaattagacgcaaagcttcaactggagcagcaggtagcaaccggtcccgccctggataataagaagtgcacaccaccgatcgaggcctctcagtgccacgaggcagagatgacagataacgttaaccagctcctcctgctagatccgccccgcaaaagactggtagaatgcgggtctctgttcaaagggatttgcgccctgcgcgcactgagcaacatatcgctccgtcttttctatgaagacggatctggggagaaatcttttgtcgccagcaacgacgaaggtgtcgccaccgtgggtctggtatcttcaacaggaccttag

SEQ ID NO: 129053 - DNA, 1434 bp, Artificial Sequence
  Description of Artificial Sequence: Synthetic coding sequence
atggccttacagttatgggctctgactctgttaggcctgctgggtgctggtgcaagcctgcgtccccgaaagctggattttttccgtagcgagaaagagttgaatcatctggcagtggacgaagccagtggcgtcgtctatctcggtgccgtgaacgctctgtatcaattggacgcaaagctgcagttggagcagcaggtagctactgggcccgcgttagacaataaaaaatgcactccgccaatcgaagccagccagtgtcatgaggctgagatgaccgacaacgtgaatcaactcttactactggaccctcccagaaagcgccttgtggaatgcggatcccttttcaagggcatttgtgcccttagagcgctgtcgaatatatccctgcgtctgttttacgaggacgggagcggggaaaaaagcttcgttgcttccaacgacgagggggtagccaccgttgggttagtgtctagcacgggccctgggggggacagggtgctctttgtaggcaaaggcaacggccctcatgataacggtatcatcgtcagcacgcgattgctcgaccgtacggatagtcgcgaggctttcgaggcttataccgatcacgcaacctataaggccggctatctgtccacaaacacccagcaattcgtggccgcattcgaggacggtccctatgtgtttttcgtgtttaaccagcaagacaaacacccagcaagaaacaggaccctgctcgccagaatgtgccgtgaggacccaaattactatagctacttggagatggacctccagtgccgggatccagacattcacgctgccgcctttggcacatgcctcgccgccagtgtggccgccccagggtctggaagggttttatacgcagtgttttcgagggacagccggtcgagtggcggtcccggcgcaggtctgtgcttattcccgctcgacaaagttcatgcgaaaatggaagctaatagaaacgcatgttatactgggacacgcgaggcaagggatatcttttacaaaccctttcatggagatatccaatgtgggggtcatgcgcccggatccagtaaatcatttccttgtggatctgaacacctgccgtaccccctgggttccagggacgggctccggggcacagccgtgctgcagcgcggaggactcaatctcactgctgtgaccgtggctgctgagaataatcatactgttgcattcttaggaacatcagatggacggatccttaaagtgtacctgactccagatgggacttcgtcagaatatgatagcattctggtggagattaataagcgcgtcaagcgcgatctcgtcctcagcggcgatctcgggtccctgtatgcaatgacgcaggacaaggtgtttcgcctcccggtccaggaatgtctgagctaccccacatgtactcagtag

SEQ ID NO: 129054 - DNA, 5517 bp, Artificial Sequence
  Description of Artificial Sequence: Synthetic coding sequence
atggcactccagctgtgggcgctcacgcttctgggcctgcttggcgcaggggcaagtctcaggcctcgaaagttagattttttccggtctgaaaaggagctcaatcacctcgctgtggacgaggccagtggggtggtctacttgggcgctgtgaacgcgctatatcagctcgacgccaagctacagttagagcagcaggtcgctacaggcccagccttagacaacaaaaaatgcactcctcctatcgaagcctcccagtgtcacgaagctgaaatgactgataacgtgaaccagctcctgcttctagatcctccacgtaagcgactggtggagtgcggctccctgttcaagggtatctgcgcattacgcgcactgtccaacattagcctccgactcttctacgaggacggctctggagaaaagtcctttgttgcctcgaacgatgagggcgtcgcaaccgtcggcctggtgagttctaccggcccgggaggcgacagggttctctttgtgggtaaaggaaacggtcctcacgacaacggcatcattgttagcacgagactgcttgaccgcaccgatagccgggaagcctttgaagcctacactgaccacgcgacttacaaagcgggatatctgtctacaaacacccagcagttcgtggccgcattcgaggacgggccatatgtgttttttgtgtttaatcagcaagacaagcacccagctcggaacagaactctgctggcaagaatgtgccgggaggaccctaattattattcttaccttgagatggacctacagtgccgagacccagacatacatgccgctgcatttggcacctgtctcgcagcctccgtagcggctcccgggtcaggaagggttctgtatgccgtgttctctagagactcacgaagctcaggggggcccggagccggcctttgtctctttcccctggataaggtgcacgccaagatggaagcaaacaggaacgcctgctacaccgggacgagagaggcgagggatatattttataagcccttccacggagatattcagtgcggtggtcacgcacctggttcatcgaagagtttcccatgcggctccgaacacttaccttacccacttggatctcgagacggcctgcgaggtacggccgttctgcaaagaggcggcctcaacctgacagcggtcactgtggctgccgagaacaatcacacggtagcgtttcttgggactagtgatggcaggattctgaaggtttatctgactcccgatgggacctctagtgaatatgacagcattttagtggaaatcaacaaaagagtgaagcgtgacctggtactttctggagatcttggaagcctttacgccatgacccaggacaaagtcttcaggctgcctgttcaagagtgtctatcataccccacttgcactcagtgcagagatagccaggacccctactgcggatggtgcgttgtggagggaagatgcacacggaaagccgagtgtcccagagccgaggaggctagccactggctgtggtctagatccaagtcctgtgtggccgtgacaagcgcccagccacagaacatgtcacgcagagcacagggagaagtccagttgaccgttagtccgcttcctgccttgagcgaggaggacgaactgctgtgcttatttggtgaatcccctcctcaccctgcccgagtggagggagaagccgtgatctgtaattccccaagctcaatcccagtgacaccaccaggccaagatcacgtagcagtaactatccagctcctgttgcgcaggggcaacatttttctcacgtcctatcagtatcccttctacgactgtcgtcaggctatgtcattggaagaaaacctgccttgtatctcttgtgtctccaatcgctggacttgccagtgggatctccgatatcacgagtgccgagaagctagccctaaccccgaagatggcatagttcgggcacatatggaagactcatgtccccagtttttaggaccttcaccgctggtgatccctatgaatcacgagacggacgttaacttccagggcaaaaatttagatactgtgaagggcagttccctccacgtgggcagtgatctgctgaaatttatggagcccgtgaccatgcaagagtcaggtacttttgccttccgaacccccaaactcagccacgacgccaatgaaacgctccccttgcatctgtatgtgaaaagttacggcaaaaatatagactctaaactgcatgtgacactatataattgttccttcggtaggagcgattgctccctgtgccgggccgccaaccccgactataggtgcgcatggtgtggaggtcaaagccggtgtgtgtatgaagctttgtgcaatacgaccagcgagtgcccccctcccgtcatcactaggatccagcctgaaaccggccctctgggtggcggcattcggataactattcttggaagcaatctgggcgtgcaggccggagacatccagagaattagcgtcgccggccggaactgctccttccagcccgaacgttattccgtgagcaccaggatagtgtgtgtgattgaggccgcagagacaccctttactggtggagtggaggtcgacgtgtttggaaaactaggccggtcaccccccaacgtgcagtttacattccagcagccgaagcctcttagcgtcgagcctcagcagggaccccaggcggggggaaccacactcacgatccacgggactcacttggatacaggatcccaggaagatgtgcgcgtcacactgaatggcgtgccctgtaaggtgacaaaatttggcgcccaactgcagtgcgtaaccggtccacaggcaactaggggccagatgcttctggaagttagctatggggggtcacccgtgcccaatccaggtatattctttacctacagagaaaatccggtactgagagcatttgagccccttagaagtttcgctagcggaggcagatcgattaacgtgaccggtcagggtttcagcctcattcagaggtttgctatggttgttattgctgagcctttacagagttggcagcctcccagggaagctgaatcactgcagccgatgactgtcgtgggcaccgactacgtgtttcacaacgatacaaaggtggtctttctgtcaccggcggtgcccgaagaacccgaagcatataatctgaccgtgttgattgaaatggatggtcaccgtgctctcctcagaactgaagcaggagcctttgagtatgttcccgatccaaccttcgaaaactttactgggggagtcaagaagcaggtgaataagctcatccacgcgcggggaaccaacttgaataaggcgatgaccttgcaggaggcagaggccttcgtgggagccgagcggtgtactatgaaaacgctgaccgagactgatctctactgcgagcccccagaggtgcagccaccccccaaacggcgccagaaacgcgatacaactcataaccttcccgaattcatcgttaagtttggcagtcgcgagtgggtattgggacgggttgaatatgacactagggttagtgatgtgccgctctcactgatactgcccctggttatagttccgatggtcgttgttattgctgtgtcagtttactgttattggcgcaagtcccagcaggcagaacgcgagtacgagaagataaagtcccagttggaggggctggaggagtcagtgcgagatagatgtaagaaagaatttactgatctgatgattgaaatggaggatcagactaatgatgttcacgaagcgggcattccagttctcgactataaaacatataccgaccgggttttctttctcccatcaaaggatggcgacaaggatgttatgattacaggaaaattagatattccagaacctcggagaccagtcgtcgagcaggctctctaccaattttcaaatttgctcaactctaagagttttctcatcaactttatccataccctggaaaatcagcgcgagttctcagcaagggccaaagtgtactttgcaagcctgctaaccgtggcccttcatggtaagctggagtactacactgacatcatgcacactctgttcctggaactgctggaacagtatgtggtggccaagaaccctaaattaatgctgcggcgaagtgaaaccgttgtagaaagaatgctgagtaattggatgtctatctgtttataccaatacctgaaggatagtgcaggggaacccctatacaaactgttcaaagccattaaacaccaggtggaaaagggacccgtggacgcagtgcaaaagaaagccaagtacacactgaacgacaccggacttttgggggacgatgtcgaatatgctccgctgacagtttctgtcatcgtgcaggacgagggtgtagatgccataccagtgaaggtccttaactgcgatacaataagtcaggtaaaagagaagatcatcgatcaagtgtatcgcggccaaccctgctcttgctggcctcggcctgacagtgtcgtgcttgaatggagacccgggtcgactgcacagatcttgagcgatctggatttgacaagccagcgagaagggagatggaagagagttaacaccttgatgcattacaatgttagggatggtgcaaccctgatcctgtctaaagtgggagtgtctcagcaacctgaagactctcagcaagacttgcctggtgaacggcatgcgcttttagaagaggagaatcgcgtgtggcacctagtacgtccaaccgatgaggtggatgaaggaaaaagcaagaggggaagcgtgaaggaaaaagaacgtaccaaagccatcacagagatctatcttaccaggctcctgtcagtgaaaggtaccctacagcagttcgtagacaactttttccagtcagtgctcgctcccgggcacgccgtaccacctgctgtgaaatacttctttgacttccttgatgagcaggccgaaaaacataatatccaggatgaagacactattcacatctggaagaccaattctctcccactccgtttttgggtaaacatcttaaagaatcctcattttatattcgacgtgcacgtgcacgaagttgtcgatgcctctctttccgttattgcacagaccttcatggacgcctgcacccgcacggagcacaaattatcaagagattcgccttcaaacaagctgttgtacgccaaagagatctcaacgtacaaaaagatggtcgaggattactacaagggaatcagacagatggtgcaggtgagtgatcaggacatgaacacacacctcgctgaaattagccgcgcccataccgacagtcttaacaccctggtggctctccatcagttgtatcagtatacccagaaatactacgatgagatcattaacgccctggaagaagaccccgccgctcagaaaatgcaattggcattccggctacaacaaattgctgccgccttggaaaataaagttacagacctgtag

SEQ ID NO: 129055 - DNA, 5730 bp, Artificial Sequence
  Description of Artificial Sequence: Synthetic coding sequence
atgtgtcacgcagcacaagaaactcctctcctccatcacttcatggcccccgttatggcaagatggcctccctttggtctgtgtctgctactgctgctcctttcgccgccccccctgcccctgaccggcgcacataggttttcagctccgaacacgactctcaatcacctggccctcgcccccggtcgaggaaccctgtatgtcggggccgtgaaccggttgtttcagttatcacctgagctccagctagaggcagttgctgtgactggtcctgtgattgattctcccgattgcgtcccatttagagacccagccgagtgtccacaggctcagctgactgataacgctaatcaattgctcctggtatctagccgagcccaagagttagtagcatgcggacaggttcggcagggtgtttgtgaaacaaggaggcttggagatgtcgcagaggtgctgtaccaggctgaggaccccggcgatggccagtttgtggcagcgaatactcctggggtggcaactgttggcttagtggtcccgctgcctggccgagacctattactcgttgcccgcgggcttgcgggcaaattgtctgcaggggtccccccgcttgcaataaggcaattggccggcagccagccattttcatccgagggactggggcggttggtagtgggcgatttcagcgattataataatagctatgtaggagcatttgccgatgccaggtccgcatatttcgtgttcagaaggagaggggcccgtgcacaggccgagtaccggagttacgtggcccgtgtgtgtctgggtgacaccaacctttattcttatgtcgaggtgccactggcctgtcaggggcaggggctgatccaggcggcttttctcgctcccgggaccctccttggcgtattcgctgcaggcccacgcggtacccaggctgcactgtgcgccttccccatggttgagctcggggcctctatggagcaagccagaaggctttgctacaccgccggcggtcgcggtcctagcggtgccgaggaagcaactgtcgaatatggtgtcacttctagatgcgtgaccctccctttggattcacccgagtcctacccgtgcggcgatgagcatacaccttcccctattgcaggaaggcagccactggaagtgcagcccctgctgaagctgggccagcccgtgagtgccgtggccgctctgcaggccgacggacacatgattgctttccttggtgacacacagggacaactatataaggtgttcctccacgggagccagggtcaagtctaccacagccagcaggtaggaccccccgggtctgccatctcccccgatctgctgctggactcttccgggagtcacctgtacgtgctcacagctcatcaggtcgacagaatccctgtagccgcttgtccccaatttcccgactgcgctagttgtctgcaggcacaggaccccctgtgtgggtggtgcgtactgcagggcaggtgtaccaggaagggtcagtgcggacgcgcgggacagttgaaccagtggctgtggtcctacgaggaagattctcattgtctgcatattcaaagtctgctccccggccaccacccccgccaggaacaagggcaagttaccctcagtgtgcccagattgcccatcctcgatgccgatgagtacttccactgcgcattcggggactatgattccctggcacacgttgaaggaccgcatgtcgcatgtgtgaccccgccccaagaccaggtgcccctcaatcctcccggaaccgatcatgtgacagtgcctctggccctcatgtttgaggatgtgaccgtggccgcaacaaacttcagtttctacgactgtagtgctgtgcaggccctagaggccgcggcaccctgtagagcctgcgtaggatccatctggcgctgtcattggtgcccccagagcagccactgcgtgtacggcgaacactgcccagaaggtgagagaaccatctactctgcacaggaagtggacatccaggttaggggtcctggtgcctgcccccaagtcgagggattggccggaccacatctggtgcctgtcggatgggagagccaccttgccctacgagtgaggaatctgcagcacttcagaggcctgccagccagcttccactgctggctggaactgcctggcgagctacgcggtcttcccgccactctcgaagaaaccgctggagactctgggctgatccattgtcaggcccaccagttttatccgtccatgtctcaacgcgagttaccagtgcccatctatgtaacacagggtgaagcacagcgtttggataatacccatgccctatacgttattctgtacgactgcgcgatgggacatcctgattgttcccattgccaggctgccaaccgctcactcggctgcttgtggtgtgcagacggccagcccgcatgtagatacggacctctgtgtccacccggcgccgtggagcttctttgtccagctccaagtatcgatgccgtcgaacccctgacagggcctcctgagggcggtttggctctcaccattttgggtagcaatctgggacgagcatttgcagacgtgcagtacgcggtctctgtggcatcaagaccatgtaatccggaaccaagtctctacaggaccagtgccaggatcgtgtgcgtgaccagtcctgccccaaacggcactacagggccagtacgtgttgcaatcaagtcccaaccgccagggattagctcacagcacttcacctaccaggaccccgttttgctttcgctgagtcctagatggggacctcaggccggaggcacccagttaacaatccgaggccagcacctccagactggtgggaatacaagcgcattcgtgggcgggcagccgtgtcccatcctcgagcctgtctgtccggaagccatcgtctgcagaaccaggcctcaggcagccccaggggaagccgccgttttggtggtattcgggcacgcgcaacgtactctgctcgcaagcccattcaggtatacagccaacccacagttggtggccgctgagccatctgcatcttttcgcgggggggggcgattgattcgcgttaggggcaccggtctggacgtggtccagcgtccattgctgagtgtctggttggaggccgacgcagaggtacaggcttctagggcccagcctcaggatccacagccaaggcggtcttgcggtgcaccagccgcagatcctcaggcctgcatccagctgggcggcgggttgcttcagtgttccacagtgtgctccgttaactcatcctccctgctgctgtgtcgttcccctgctgtccctgatcgagcacacccacagagagtgttctttacactcgataacgtgcaggtggacttcgcctctgctagtggaggccaaggcttcctgtaccagcctaatccccgcctggcgcccctgtcccgggaggggcctgcgcgaccctaccgcctgaagccggggcatgtgctagatgtggagggcgaagggctgaatctgggaatcagtaaagaagaggtgagagttcacattggaagaggagaatgcttagtgaagactctgacgcgaacccatctgtattgcgagccccctgctcatgcgccacagcctgccaatggatccggtctccctcaattcgtcgttcagatgggaaacgtgcagctggctttgggccccgtgcagtatgaagctgagcccccactgagcgcctttccggtggaggctcaggctggagtgggaatgggcgctgccgttcttatagccgcggtgttacttttgacgcttatgtatcggcacaagtccaagcaggccctgagggattaccagaaagtcttggtgcagctcgaaagcttggagaccggagttggagatcagtgtcgtaaagagtttacagatttaatgaccgagatgactgacttgagtagtgaccttgaaggctctggcataccttttctagattatcggacatacgcggagcgtgcctttttcccaggacacggtgggtgcccactgcagccaaagcctgaagggcctggggaagacggacattgtgctacggtgagacagggtctgacccaattatctaacctgctaaattctaagctgttcttactaacgcttattcatacgttagaggaacagccatctttctcacagcgagacagatgccatgtcgcctccttgctgtccctcgccctgcacggcaagctggagtatctgacagacatcatgcgcacactgctgggagacttagccgcgcactatgtccatcgtaatcccaagctgatgctgaggcgtaccgagacaatggttgagaagctcctgactaactggctgtctatttgcttgtacgctttcttgagggaggttgcgggcgaacccctgtatatgttgttcagagccatccagtatcaagtcgataaaggacctgtggatgccgtcacaggcaaggccaaaagaactctgaatgactcgaggctcctccgggaggatgtggaattccagcctctgactttgatggtgttggtgggtcccggcgctggaggagcagccggctcgagtgaaatgcagcgcgttcccgctcgggtgcttgacaccgataccattacccaggttaaagaaaaagttctcgaccaggtgtacaaggggactcctttttcccaacgacccagtgtgcatgcattggacctggaatggaggtcagggctggcagggcacctaacactgtccgacgaggacctaaccagcgttacacagaaccactggaagaggttgaacactctccaacattataaggtccctgacggggcaactgtggggctcgtgccgcaattgcaccgcgggtccactatctctcagtccctggcccagcggtgccccttgggggagaacattcccacactggaggatggagaggagggaggagtgtgcctctggcatttggtgaaggcaaccgaggaacccgagggcgccaaggttagatgttcttctttgagggagcgcgagcccgctcgggctaaagcaattccagaaatctacctaactcgactgctctcaatgaagggcaccctgcagaaatttgtggatgacacctttcaagctatcttgtcggttaataggccaattccgatcgcagtcaagtacctgttcgacctattggacgagctggcagagaaacacggcatagaagatcctggcactctccatatctggaaaaccaactctctgctgctgcggttctgggtgaacgccctcaaaaacccccaactcatatttgatgtgcgggtttcggataacgtggacgcaattctagccgtgatcgctcagacgtttatcgacagctgcaccacctctgagcataaagtcggaagagactcacccgtcaataaacttctgtacgcacgggagatcccacgttacaaacagatggttgagcggtattatgcagacatccgacagtccagcccggcgagctatcaggaaatgaacagtgccttagccgagctgagcggcaactatacctccgcaccgcattgccttgaagcgttacaggagctctataaccatatccataggtactatgatcagataattagcgcgctggaggaagatcccgtgggacaaaagcttcaactcgcatgcagactgcagcaggtagccgcactggttgagaacaaagtgaccgatctttag

SEQ ID NO: 129056 - DNA, 777 bp, Artificial Sequence
  Description of Artificial Sequence: Synthetic coding sequence
taaagtttagagacgggggtaggagaccagtgtaggaaggagtttaccgatctgatgacggagatgactgacctgtccagcgatctggaaggaagcggcatacccttcctcgattacagaacatacgcagagcgagccttctttccagggcacggcggttgtcccctccagccaaaacccgaaggccccggtgaggatggacattgtgctacggtccgccagggcttaacacagctgtcaaatctgcttaattctaagttgttcctgctgactctcatacatactttggaagagcaaccatccttctcccagcgtgatagatgccacgtggcctcactgttgtctctggctcttcacggaaagcttgagtatcttactgacatcatgcgcaccctgttgggtgatctagctgctcattacgtacatcggaatcctaaacttatgttacggagaacagagacaatggttgaaaagctgttgacgaactggcttagtatctgcttatacgctttcctcagggaggtcgcaggagagccactttacatgctctttagggcgatccagtaccaggtagataagggtccagtggacgccgtcaccgaatggcgctccggcctcgcgggacacctgacactgagcgatgaagacttaaccagtgtgactcaaaatcactggaagcgattgaatacattacaacactacaaggtccccgatggcgcgactgttggccttgtgccccagttgcatagaggttctactatttcccagtcgctatag

SEQ ID NO: 129057 - DNA, 531 bp, Artificial Sequence
  Description of Artificial Sequence: Synthetic coding sequence
taggcctcacaggggaccctgcagaagtttgtggatgacacatttcaggcgattctgtctgtgaatcgacctattcccatcgccgttaagtatctctttgacttgctcgatgagctggccgaaaagcacgggatagaggatcctggtactttgcacatctggaagaccaactctctgctcctgagattctgggtgaacgccctgaaaaatcctcaattaatctttgacgtgcgcgtttcagacaatgttgacgcaatactggcagttatcgcccaaacgttcatcgattcctgcaccactagcgagcacaaggtagggcgggtcagagccgtccccgcagcagcagccgggcgggggctaagacgaaagggcctatggggaaagccccgcggtctgtgcacagaactctgggtggggtcaggctccattatgggtgcacctagtcctccctccagttgtctggcgccccccctgccgcccgagcaggactccccggttaataaactgctgtacgcacgcgagatcccatag

SEQ ID NO: 129058 - DNA, 492 bp, Artificial Sequence
  Description of Artificial Sequence: Synthetic coding sequence
tagaaaagaactctgaacgacagcaggctcctgcgggaagacgtcgaattccaacctctgaccctgatggtccttgtggggccaggagccggcggggcagcaggttcaagtgagatgcaaagagtccctgcgagagtgctggacacagacaccataacacaggtgaaggagaaggtgctcgatcaagtgtacaaaggcacacctttctcacagcgcccatctgtacatgctctggacctggagtggaggtctggcctggcgggacacttaaccttatcagacgaagacctgacgtcagtaacacagaatcattggaaacgactaaatactctgcaacactacaaagtgccagatggtgctactgttggattggttccacagttgcaccgcggcagtacgatctcccaaagccttgctcagcggtgcccgctgggagagtcggaatccctaggacctgacctggggcccctggaaagtagactcgggcgatag

SEQ ID NO: 129059 - DNA, 2967 bp, Artificial Sequence
  Description of Artificial Sequence: Synthetic coding sequence
atgtgccatgccgctcaagagacgccactgctgcaccatttcatggactctcctgaaagctacccttgcggagacgaacataccccctctcctattgccggaaggcaaccactggaggtgcagcctttactgaaacttggccagcctgtttctgcagttgccgccctgcaggctgacgggcatatgattgccttcctgggggatacccagggccagttatacaaggtggaccgtatccctgtcgcggcatgcccccaatttccagactgcgccagctgtctgcaggcacaggaccccctgtgtggatggtgtgtgttgcagggacgatgtactaggaaaggacagtgtggcagggccggtcagcttaatcagtggctgtggagttatgaagaagactcacactgcctgcatatccagtcactcctgcccggccatcacccacggcaggaacaaggtcaggtgacgttaagcgtgccacggttaccgattttggacgccgatgagtatttccattgtgctttcggtgattacgactccctggcgcacgttgagggcccccatgttgcttgcgtgacacccccccaagaccaggtgccgttaaacccacccggcacagatcatgtaacagtgcctttggctctgatgttcgaagacgtcactgttgctgctactaacttttccttttatgactgtagcgccgtgcaggccctcgaagccgcggctccatgtagagcttgtgtgggctcgatctggaggtgccattggtgtccgcagagcagccactgtgtttacggggaacattgtccagagggcgaacggaccatttattctgctcaggaggtggacattcaagtgcgtggacccggggcgtgccctcaagtagaagggctggctggtcctcatttagtccctgtgggctgggagtctcacctggcactgcgagtgcggaacctgcaacatttccgaggactaccagcatccttccattgttggctggaactgccaggtgagctgagaggcctgcccgccacgctggaggagactgccggggactctggcctgattcactgccaggcacaccagttttaccctagtatgtcccagagggaacttcctgtgcccatctatgtaacacagggtgaagcccaacggctcgacaacacgcatgccctttacgtcatactctacgactgtgctatggggcaccccgattgtagccactgtcaggccgcgaatagaagcctcggatgcctgtggtgcgcggacggccaaccagcgtgtcggtacggacccctctgtccaccgggtgccgtcgagctgctctgcccggcccctagcatcgatgccgtcgagccactaacaggccctcccgaagggggactggctcttaccatccttgggtccaacctcggtcgggcttttgccgacgtgcaatacgccgtttccgttgcaagcagaccatgtaaccccgagccctccttataccgtaccagcgcacgtattgtgtgtgtcacgagccctgcaccaaatgggaccaccggccccgtgcgcgtcgctattaaaagccaacctcccggcatctcttcccagcacttcacctatcaggaccccgtcctccttagtctgagccctcgctgggggcctcaggccggaggcacgcagctaactataagagggcagcacttacagaccggcggcaatacatccgccttcgttggcggacagccttgccccattctggaacctgtgtgtccggaggctattgtgtgcagaaccagaccgcaggcggcaccaggcgaggctgccgtgctcgttgtctttggccacgctcagcgcacactgcttgcatcgccatttagatatactgccaacccccagctcgtagctgcagagccttcagcgtcgttcaggggcggcggcagattgatcagagtcaggggtaccggccttgacgtagttcagcgtccattgcttagcgtctggcttgaggcagacgccgaggtccaggcatcaagagcccaaccacaggacccccagcctcgacggtcctgcggcgccccagctgcagaccctcaggcctgtatccaactcgggggagggctgctgcagtgttccactgtttgttccgtgaatagtagctctctgctgctatgcaggagcccagccgtgcctgacagggctcacccacagagagttttttttactttggataacgttcaggtggacttcgcgtccgcatctggcggacagggcttcctctatcaaccaaacccgaggttagctcctctatcacgggaaggccccgctagaccgtacagactgaaacctggccacgtgctggatgtcgagggggaagggctgaacctggggatctctaaagaggaggtgagagtgcacatcggaagaggagagtgtctggttaagaccctgacaagaactcacttgtactgtgagccccctgcacatgcccctcaaccagcgaatgggagcgggctgccccagttcgtggtccaaatgggtaatgttcagctggccctcggacccgtccagtacgaggctgagccacccttgagcgctttccctgtcgaagcccaggccggtgtgggcatgggtgctgcagttttgatagccgctgtgctgctcctgaccctgatgtacaggcataagtccaaacaagctctgagagactatcaaaaggtgctggtccaactggaaagcctggaaacgggagtcggagatcaatgtcgcaaagaattcaccggcggatgtggaggtggaggcacaggctacccccggggactgaacagtcacttgggggcatcttggccaagacggccacacgatggggacgataggccgcaacagagacctggtggccagcgcgatccactcccaggactgccccatttaagaagggcacggcttctgccctggccctggaggctaccagccgccgctcaggcctag

SEQ ID NO: 129060 - DNA, 675 bp, Artificial Sequence
  Description of Artificial Sequence: Synthetic coding sequence
atgtgccacgctgcccaggagacccctcttctgcaccatttcatggtggacaggattcccgttgccgcgtgtccacagtttcccgattgcgcaagttgccttcaggcacaggatcctctctgtggctggtgtgtcctgcagggccgctgtacaaggaagggccaatgtgggagagctgggcaactcaatcagtggctttggtcctacgaggaagactcacattgtttacacatccagagtctcttacctgggcatcacccccgccaagagcagggacaggttacactgtccgtcccaaggttacccatactggatgccgatgaatacttccactgcgctttcggggactacgattcattagcacatgtggaaggcccgcacgtggcatgcgtgactcctccacaggatcaggtgcctctgaatccaccagggacggaccacgttaccgtccctctcgccctcatgttcgaggacgttactgtcgctgccactaatttttccttttatgactgctcggccgttcaggctctcgaagccgcagcccctgcttgtctgccgccaagcactgccggatggtcctgcctggagaatttcggtgactgcaggccaccgtggaggcgtcagcagggcatccaagctagcagcacggctcgcccgacaaggtcatccccatag

SEQ ID NO: 129061 - DNA, 4689 bp, Artificial Sequence
  Description of Artificial Sequence: Synthetic coding sequence
atgtgccatgctgctcaggaaacgcccctgttgcatcactttatggactctcccgagtcgtacccttgcggcgacgaacatacccctagccccatcgccgggcgacagcccctcgaggtgcagcccttactgaagttgggacagcctgtcagcgcagtcgccgccctgcaggccgacggtcacatgatcgctttcctcggcgatacgcaaggtcagctgtataaggttttcctacacggttcccaaggccaggtctaccacagccagcaggtcggaccgccagggtccgcaatcagccccgatctgttgttagactcttcaggtagccatctgtacgtacttacagcgcaccaggtggaccgtatccccgttgctgcttgccctcagtttccggattgtgccagttgcctgcaggcccaggaccctctctgtggttggtgtgtgctgcaaggacgctgtacacggaagggacagtgtggacgggcagggcaattgaatcagtggctgtggagctatgaggaggattctcactgtctgcacatacagagcctcctgcctggccatcaccctagacaagagcaggggcaggtgactctatccgtgccacggttgcccattctggacgctgatgaatactttcattgcgctttcggtgattatgactcgctggctcatgtggagggtccccatgtggcctgcgtcacccccccacaggaccaagtgccactgaaccctcctgggacggaccatgttacagtgcccctggccctgatgttcgaggacgtaacggtggctgccactaatttttcgttttatgactgtagcgctgtgcaggccctggaagccgcagctccctgtcgcgcttgtgtgggaagtatatggcgttgtcattggtgccctcagtcaagccattgcgtctatggcgaacactgtccagagggggagcgcaccatttactccgcacaggaggtggatatccaggtcagggggcccggagcctgccctcaggtggaaggtcttgcagggccccatctagtgcccgtgggctgggagagccaccttgcactgcgagtccgaaatctccagcatttcagaggcctgcctgcgagctttcattgttggctggaattgcccggagagttgaggggtctccctgccacgttggaagaaactgcaggagacagcggtctgattcactgccaagcgcaccagttttacccttctatgtctcagcgcgagctgcccgttccgatttatgtaacccagggggaagctcagcgcctggataatacacacgcattgtacgtgatactgtatgattgcgctatgggccaccccgattgcagccactgccaagccgccaaccggtctttggggtgcctctggtgcgcggatgggcagccagcttgccggtatggccccctatgcccccctggtgccgtggagctcctgtgcccggctcccagcatagacgccgttgaaccactcacgggaccccccgagggcggcctggcactgactattctcggttctaacctaggtcgcgctttcgctgacgtgcagtatgccgtgtcagttgcctccaggccatgcaacccagaaccatcactctaccgaacgtctgccaggatcgtgtgtgtcacatcccccgcacccaacggtaccacagggcctgttagggtagctattaagtcccagcctcctggcatcagttcccagcacttcacctaccaagaccccgtgctactctcgctgtccccaaggtggggcccccaggctggaggaacccaacttaccattaggggccagcacctccagactggcggaaatacctccgcctttgttggaggacagccatgcccaatactggaacccgtctgccctgaggccatcgtctgtcggacgcggcctcaggccgcaccgggagaggcggctgtcttggtagtgtttggacatgcacagcgcacattgctggcctccccctttaggtacactgcgaatcctcagctagtggcggccgaaccatcagcttcattcagagggggcggcagactgatcagagttcggggaacaggacttgatgttgtccagcgcccacttctgagtgtgtggctcgaggccgatgccgaagtacaggcctctagggctcagcctcaggaccctcaacctaggcggtcttgtggagctccagcagcagacccccaggcctgcatacagctgggcggaggcctgttgcagtgctcaaccgtctgttccgtgaactctagctctctgctgctgtgcaggtctcccgcagtccccgaccgtgctcacccccagagggtgttctttactcttgacaacgtgcaagtggactttgcaagtgcctcaggtggtcagggcttcctgtaccagccgaacccaagattggctcccttatcaagggaggggcctgcccgaccttatcgtcttaaaccaggacatgtgttggatgtggagggagagggcctgaatctgggtataagtaaggaagaggtgcgtgtgcatatcggacgaggagagtgcctcgtaaagactctgacccggacgcatctctattgcgagccaccggcacatgctccgcagccagctaatgggagtggcctaccccaattcgtcgtgcagatgggcaatgtgcagctggcgttggggccggtacaatacgaagccgaaccccctttgagcgcattccctgtggaagcccaggcaggcgtggggatgggggcagccgtgctgatcgctgctgtcctgctactcactctgatgtatagacataaatcaaaacaggcactgcgcgattatcaaaaagtcctggtgcagttggagtctcttgagaccggagtgggcgaccaatgccgcaaggagttcacggacctgatgacagagatgactgacctgtccagcgacctggagggctcaggaattccttttctcgattacagaacttacgccgagagagcctttttccccggtcacggggggtgcccattgcaaccaaaaccagaggggccaggagaggatggccattgcgccacagtcagacagggtctaacacagctgagcaacctgcttaattctaagctgttccttctcactctgattcatactttggaggagcaaccgtcatttagtcagcgagacagatgtcatgtagcctcactgctgtctctcgctctgcacggcaagttggaatacctgacagacatcatgaggactttactcggagatctggccgcacactatgtgcacaggaaccccaagctaatgctgcgccggacagaaacaatggttgaaaaactgctgactaactggctgtctatctgcctgtatgcctttctgagggaggtggcaggggagcctctctatatgctctttagagcgatccagtaccaggtagacaaaggtccagtggatgcagtgactggaaaagctaaacggacacttaatgattcccgcttgctcagggaggacgtcgagttccaacccctgactctaatggttctcgtaggacctggggccgggggcgccgctggatcctccgaaatgcagagggtcccagcccgggtgcttgacaccgatacgatcactcaagtaaaagaaaaagtcctggaccaggtgtacaaaggtacaccgttctcccagcgcccctctgtgcatgcgcttgatctcgagtggagatctggattagccgggcatctgacgctatctgacgaggatttaacttcagtcacccagaaccactggaaacggttgaatacactgcagcactacaaagttccggatggggccaccgtcggacttgtaccgcagctccatcgagggagtacgatcagccagtcccttgctcagcggtgcccgttaggagaaaacatcccaaccttggaagacggcgaggaaggaggggtgtgtctgtggcacctggtgaaagctacagaagaacctgaaggcgcaaaggtgagatgcagttccctccgagaacgtgagcccgcccgggccaaggcaatcccagaaatatacttaacaagactgctctcaatgaaaggcacccttcagaagtttgtagacgacacatttcaggctattctgtcggtcaaccgccccattccaatcgccgttaagtatctcttcgacctcctcgatgaactggcagagaagcatggaatcgaggacccaggcacactgcacatttggaagactaattcgttactactccgcttctgggttaacgccttgaagaacccacagcttatcttcgatgtgagagtgtcagacaatgtggacgcaattcttgctgttattgcgcagaccttcatagattcctgtactacctctgaacacaaggtagggcgcgactcacctgttaataagcttttgtacgcccgggagattccccgctacaagcagatggtagaacgatactacgcagatatacgacagagcagtccagcaagctaccaagaaatgaactccgccttggcagagctgagcggaaactatacaagcgctcctcactgcttagaagcattacaagagctctacaaccatattcacaggtattacgaccagattatttccgccctggaagaagatcccgtgggccagaaacttcaacttgcctgcagacttcagcaggtggccgctcttgtagagaacaaggtaacggacctctag

SEQ ID NO: 129062 - DNA, 5799 bp, Artificial Sequence
  Description of Artificial Sequence: Synthetic coding sequence
atggaactgactccagctagtagtctgacatgcagtctgctttctccgcgactgcccgggtcctttccccagctcaggcgggtgccaccttgctcaaggccctggcttcccaaggctcccgtgatggcccgctggcccccattcggcctgtgcctgttgcttttgctgctttcgcccccccccctgccactgaccggggcccacagattcagcgcccctaacacgactctgaaccacctggcactcgctccaggtagggggactttgtacgtgggcgccgtcaatcgactgttccaactctccccagagctacagctcgaagccgtggcggtaacggggccagtgatcgactctcccgactgcgtcccgtttcgggacccagcggagtgcccgcaggctcagctgaccgataacgccaatcaattgctcctcgtctctagcagagcccaggagctagtcgcttgtggccaggtcaggcaaggagtctgcgagactagacgcctgggggacgtagctgaagttctataccaggccgaagacccaggcgacggccagttcgtggccgctaacacacccggtgtggccacagtcggcctcgtggtccccctgccaggccgcgatctgctcctcgtggctcgggggctggcaggaaagctctctgctggtgttccacccctcgcaatccgtcagctcgctggaagtcagcctttctcaagcgagggcttaggtaggctcgtcgtgggcgactttagcgattataataacagctatgtgggcgctttcgctgatgcccggtccgcttatttcgtcttccgtcgaaggggcgccagggcccaggccgaatatcgctcttatgtagctagggtgtgccttggggacactaacctgtacagctacgtcgaagtccccctggcctgtcagggccagggattgattcaagccgcatttctcgctccgggcactctgctcggcgtctttgctgcgggcccccgtgggactcaggccgccttatgtgcctttcctatggttgaactgggcgcctccatggaacaggctaggcgcttatgttacactgcagggggacgtgggccttctggcgccgaagaggcaacagtggagtatggggtgactagtcgatgcgtgacgctgccgctcgatagtccagagtcttacccttgcggtgatgagcacacgccaagtcctatcgctgggagacagcctcttgaggtgcagcccttgctcaagctcgggcagccggttagtgccgtggcggcactgcaagccgacggacacatgatcgccttcctcggcgatacccagggccaactgtataaagtattcctgcatggcagccaaggtcaagtctatcatagtcagcaagtgggcccgccgggtagcgctatttcgcctgatcttttactggactcttccggaagccatctctacgtgctgactgcacaccaagtggataggatccccgtggctgcctgcccgcaattccctgactgtgcctcatgtctacaggcccaggatcctctatgtggctggtgtgtgctgcaagggagatgcacccgaaagggtcaatgcgggagagccggccagcttaaccagtggttatggtcctacgaagaggacagtcactgcctgcatattcagtcactactacccggacatcacccccgccaggaacagggacaggtcaccttaagcgtgccaaggctgcctattcttgatgcggatgagtacttccattgcgccttcggcgactatgacagtttagcccacgttgagggcccgcatgttgcttgtgtgactcctccacaggatcaggtgccattgaatccgccagggacggatcacgtcaccgtgcccctggcactgatgttcgaagatgtaacagtggccgctacaaacttctcattctacgactgttccgctgtccaagcgctggaggctgctgccccttgccgagcctgcgtgggaagcatctggcgctgccactggtgtccacagtcctcccactgcgtttatggcgagcactgccctgagggcgagcgcactatctattccgcgcaagaagtggatattcaggttcggggcccaggagcctgtccccaggtcgaaggtcttgcaggcccccacctggtgcccgtggggtgggagtctcatctggccttacgggtcagaaacttgcagcatttccggggcctccctgcgtccttccattgctggctcgaactgcccggggagctgagaggcctgcccgccacgctggaagagactgccggagatagcggcctgatccattgtcaagcccatcagttctacccctcaatgagccagcgcgagctgcctgtccccatatacgtcacccagggggaggcccaaaggctcgataacacccacgctctgtacgtcatcctgtacgactgtgccatgggccacccagactgctcccattgccaagctgcaaatcggtcacttggatgcctgtggtgcgccgacggccagccagcttgtagatacggcccactctgcccacctggagctgtcgaactcctctgtccggctccaagcatagacgccgtcgagcccttaactgggcctcccgagggtggcctggcactgactatcctagggtcaaatctcggacgggcattcgcagatgtgcagtacgcagtgtcagtcgcgagtcgcccttgtaacccagaaccatctctttatcgaaccagcgcaagaattgtgtgcgtgacctctcccgccccaaacggtacaacaggtcctgtgagggtggccatcaagtcacagcctccaggaatcagcagtcaacacttcacctatcaggatcccgtccttctgtccctgtctccccgctggggtccccaagcaggtggcacacaacttaccatccggggccagcatctgcaaacaggcgggaataccagcgcgtttgttggagggcaaccttgtcctatcctggagcccgtctgtcccgaagcaatcgtctgccgaacacgaccccaagcagcgcccggagaggctgccgtactggtagtgttcgggcatgcccaacgcacattgctggccagccctttcagatatacagctaacccccagctcgtggcagccgagcctagcgcctcctttcggggcggtgggcggttgataagagtcagagggactggactggatgtggtacaaaggccgctgctgagcgtctggcttgaggccgacgctgaggtgcaagctagtcgagcccaaccccaggatccccagccgcgccggtcttgtggggcccctgctgcagaccctcaggcatgtatccaactggggggcggactattacagtgctcgaccgtttgctctgtgaacagttcgtccctgcttttatgtaggagtcctgccgtccctgaccgcgcacatccacaacgagtcttttttacattggacaatgtgcaggtcgacttcgctagcgcttccggcgggcaggggttcctctatcagcccaaccctagactcgccccacttagtcgcgagggacctgctcggccgtatagactgaagcccggccacgtccttgacgtggagggcgagggccttaacctgggcatatcaaaggaggaggtgagagtgcatattggtcgaggcgagtgcttggtgaagaccctcaccaggacgcacctctattgtgaacccccagcccacgctccccagcccgcaaacggcagcggactgcctcagttcgtggtgcagatgggcaatgtgcagctggcccttggtcctgttcaatatgaagccgaacctcccttatcggcgtttccagtggaggctcaggccggcgtagggatgggagccgccgtactgatcgcagcagttttattgttgaccttaatgtacaggcataaatctaagcaagcattaagagattaccaaaaagttcttgtgcagctcgaatctttggaaaccggcgtgggagaccagtgcaggaaagagttcacagatttaatgaccgaaatgacagatctttcgagcgatttagaaggatccggtatcccctttctggactatcgtacatacgcagaacgtgcatttttcccaggccacggaggatgcccccttcaaccgaaacctgagggtcctggagaggacggtcactgcgccacggtgaggcaggggttgacacaactgtcaaacctgctgaacagtaagctgtttctgttaactctgatccacactctagaggagcagccctctttttcccagagggatcgttgtcatgtcgcctcactgttgtcccttgccctccacggcaaactggagtacctgaccgatatcatgagaactctgctgggcgacctggccgcccattatgtgcacagaaatcctaaactcatgctcagaaggaccgaaacaatggtggagaagctcctcaccaactggctttcaatttgtttatacgcattcctccgtgaagtggcgggcgagccattatatatgttattccgggctatccagtaccaggtcgacaagggccctgtcgacgctgtcacgggcaaggccaaacgtacactcaatgattcccggctactgcgggaggatgttgaattccagccactaactttaatggtgctggtgggcccaggagcaggcggggccgcgggatccagcgagatgcagagggtgcccgcaagggtactagacacagataccattacacaagttaaagagaaggtgctcgaccaggtatacaaagggacaccattctctcagcggcctagtgtgcacgcacttgatttagaatggagatccgggttagccggccacctcaccttgagtgacgaagacttgacctctgtcacacaaaatcattggaaaaggctgaataccctgcagcattataaggtcccagatggagcgaccgtcggcctggtgccccagcttcaccgcggcagtaccatctctcagagcctcgcccaaaggtgcccgcttggagagaacattcccacacttgaggacggagaagagggaggagtctgtctgtggcacttggttaaggcgacggaggaacctgaaggagcgaaagtccggtgttcttccttaagagagagggagcctgcaagagcaaaagcaatccctgaaatttatctgacccggttgctgagcatgaaaggcacactgcagaagtttgtggatgacactttccaggccatactatcagtgaatagacccataccaatcgccgtcaagtatttatttgatttactggacgaattagcggaaaaacacggcatagaggaccccggaactcttcacatttggaagacaaatagtctgttactgcggttctgggtcaacgcattaaaaaatccacagctgatctttgacgtgagggtctctgacaatgtcgatgctattctagccgtgatcgcccagacattcattgactcctgtacaacaagcgaacacaaagtggggcgagacagtcccgtcaacaagctgctctacgcaagggaaattccgcgatataaacagatggtcgagcgctattacgctgatattcgacagagctcgccagcatcctatcaggaaatgaattctgcgctggctgagctatccggaaattacaccagcgcaccccattgcctggaagctttacaggagttgtataatcatatccataggtattatgaccaaattatttctgccctcgaagaggatcccgtgggccagaagcttcagcttgcgtgccggcttcaacaggtggcggccctcgtagagaataaagtcactgacctgtag

SEQ ID NO: 129063 - DNA, 5778 bp, Artificial Sequence
  Description of Artificial Sequence: Synthetic coding sequence
atggctcctcgagcagccgggggtgcgccactgagcgcaagggctgcagccgcctcgccccctccgtttcagacacctcctcgttgcccagtgccattgctgctccttttgctgctgggcgccgcaagggctggcgctctcgagatccagagacgctttccttctccaactcccacaaacaactttgccctggatggagctgccggaacagtctacctcgcagctgtcaacagactgtatcagctgagcggggccaatctaagcctcgaggcagaggctgccgtcggacccgtccccgactccccactctgccacgcaccccagttacctcaggcctcgtgtgagcaccctcggagactaactgacaactacaataagatactgcagttggaccccggccagggcctggtggtcgtttgcggctccatctaccagggtttttgccagctgagacgccgagggaatatcagtgcagtggccgtcagatttccgccggcggccccacccgcagaaccagtgacggtgttccccagtatgcttaacgtggccgcgaatcaccccaacgccagtaccgtgggattggtgctcccccccgccgccggagcgggtggttccaggctattggtaggggcgacatacacaggctacgggagctctttctttccccgcaaccggtcgctcgaagaccaccgattcgaaaatacacccgagattgctatacgttctctggacaccaggggcgatcttgcgaaactgtttacattcgacctgaacccatcagatgataatatattgaagattaaacaaggtgccaaagagcaacacaagctgggatttgtgtcggccttcctccaccccagtgacccaccccccggagcacaaagctacgcatatctagccctgaactccgaggctagggctggagacaaggagtcccaagctcggagcctgctagcccgcatatgcctgcctcatggggccggcggcgacgccaagaaattgactgagtcgtacatccaactaggacttcagtgtgcaggtggggctggtagaggcgatctgtacagtcgcttggtatccgtatttcctgcccgggaaagactgttcgccgtgttcgagagacctcagggctcccccgctgccagagcagctcctgccgctctctgtgccttcaggttcgccgacgtgcgagccgccatcagggccgcccggactgcgtgttttgtggaacctgctcccgatgtggtcgcagtcctcgatagcgtggtgcagggaacaggaccggcttgcgagaggaaactcaatattcagctgcagcccgagcagctggactgtggtgcagctcatctgcagcacccactctcgatcctccagccactcaaagcaacgcccgtgttccgggcacccgggttaacttccgtggccgtggccagtgtgaacaattatacagcggtgtttcttgggactgtaaacggcaggcttctcaaaattaaccttaatgaatctatgcaggtggtctcaagacgtgtggtgacagtagcttacggtgaacctgtacaccacgtgatgcagttcgatcctgcagattcaggttacctctatctcatgaccagccaccaaatggcacgggtgaaggtcgccgcttgtaacgtccactccacctgcggcgattgtgtgggggctgcagatgcttattgtggatggtgcgccctcgagacccgatgcacactccagcaggattgtactaactcctctcagcagcatttctggacctcagcgtctgagggcccctcacggtgccccgcaatgactgttctcccctctgagattgatgtccgacaggaatacccgggcatgattctgcagatcagcggatccctcccctctttgagtggcatggagatggcctgcgattacggtaataacatcagaacagttgcgagagtacctggccccgctttcgggcaccagatcgcttactgcaatctgctcccacgggatcaattccctcctttcccccccaaccaggatcatgttacagttgaaatgtctgttcgagtgaatggacgcaatattgtgaaggccaatttcacaatatatgactgctcacggacagctcaagtgtatccacacacagcctgcaccagctgcctgtctgctcagtggccctgtttctggtgtagccagcaacattcatgtgtgtctaatcagtccaggtgcgaggcatcccccaatcccacctcgccacaggactgccctcggactctactctccccactcgctccagtgcctacgggagggtcacagaacattctcgtgcccctggcaaacacagccttctttcagggggccgctctggagtgcagcttcggactagaagaaatctttgaagcagtatgggtgaacgaaagcgttgtgcgctgtgatcaggtggtgctgcatacgactaggaaaagccaagtctttcccttgtcattgcaactgaagggtagaccagccaggttcctcgactcaccagaacccatgaccgtaatggtgtacaattgcgcaatgggcagtcctgactgctcccagtgtctgggcagggaggacctgggccatctttgcatgtggagcgacggatgccgtctccgtggaccattgcaacctatggccggaacctgcccagcgccagaaattcatgccattgaaccacttagcggccccctagacggaggaaccctgctgacgatccgtgggcgtaacctcggaaggcggctctctgacgttgctcatggcgtgtggattggcggcgttgcctgtgaacctctacccgacaggtatacagtgtctgaggagattgtgtgtgtgaccggcccggctcccggtccgttgtcaggagtggtgaccgtcaatgccagtaaggaaggaaaatcaagggacagattctcctacgtccttcctttggttcacagcttagagcctacaatgggcccgaaggccggtggcacccggatcacaatacacggaaacgatttgcatgtcggaagtgaacttcaagtgctggtgaacgatactgacccctgtacagaattgatgagaactgataccagtatcgcttgcacaatgccagaaggggccctgccagcaccagtgcccgtgtgcgtgcggttcgagaggcgggggtgtgtgcacgggaaccttaccttttggtacatgcaaaaccccgttatcaccgctatctctccccggcggtccccggtctccggcggacggacaatcaccgtggctggcgaacgcttccatatggtccaaaacgtgtccatggccgtgcaccacatcggtagggaaccgacattatgtaaagttttaaacagtacactgattacctgcccaagccctggtgctctttccaatgccagcgcacccgtggacttttttattaacgggagagcttacgcagacgaggtggccgttgccgaggaactccttgatccagaagaagctcagagaggctctagattccgcctcgactatttgcccaacccccagttcagcactgctaagagagagaaatggatcaaacatcacccgggcgaaccattgacactggtgatccataaagaacaggactccctgggactgcaatctcatgaataccgagtgaagatcggtcaggtttcctgcgacatccagatagtcagcgatcggataattcactgtagtgttaatgagtcactcggggccgccgtggggcagttgcctataactatccaggttgggaacttcaatcaaaccattgctaccttacagcttggcggatctgagactgctatcattgtgtccattgttatttgctccgtcctgctgctgctgagcgtcgtggccctattcgtcttctgcacaaaaagccgccgtgcggagcgatactggcaaaaaaccttgttacaaatggaggagatggaatcgcagataagagaggagattcgcaagggatttgctgagttacagaccgatatgaccgatctgactaaagaactgaaccgaagtcagggcattccttttctggagtataaacacttcgtgactcgaacattcttccctaaatgttcctcactgtatgaagaaagatacgttttaccctctcagacgctgaatagccaggggtcctctcaggcccaggagacccatccgctgctgggcgagtggaaaattccagagtcctgtcgtccaaacatggaagaaggaatctcactgttctccagcttgctcaataacaaacatttcctgattgtgtttgtccacgctcttgagcagcagaaggacttcgcagtgcgggacagatgtagcttggcatcccttctcaccatcgccctccatgggaaactcgaatattatacgtccatcatgaaggaactccttgtggatctgatcgatgcttcagccgcgaagaatccaaaacttatgttgaggcgaaccgaatcagtggtggagaagatgctaaccaactggatgtccatttgcatgtacagctgcttgagggaaacagtcggggagcccttttttctactgctgtgtgctataaagcaacaaatcaacaagggttccatagacgctattacagggaaagctaggtacacactgtcagaagaatggttgttgcgcgaaaatatcgaagcgaagccacgaaatcttaacgtctcgttccaaggttgcggcatggattcactttccgtgcgcgcaatggatacggataccctgacccaagtgaaagaaaagatactcgaggcgttttgtaaaaacgtcccctactcccagtggccaagagctgaggatgtggacttagagtggtttgcatccagtacacaatcgtatatcctgagggatctggacgatacgagcgtagtggaggatgggagaaaaaagttgaacaccctcgcacactacaaaattcctgagggcgcttcactagctatgtctctaatcgacaagaaggataataccttgggcagggtgaaagatctggatacagaaaagtatttccacttggtcctgcctaccgacgagttggcagaacccaagaaatcccaccgtcaatcccaccgtaaaaaggtgttaccagagatctacctcacccgcttgctgtcaacaaaaggcacgctccagaaattcctagatgatttatttaaggcaattctctccatcagagaggacaagccaccccttgccgttaagtactttttcgactttctagaggagcaggccgagaagaggggcattagcgatccagataccctacacatttggaaaaccaactctctacctctccgattttgggtgaatattctaaaaaatccccaattcgtgtttgacatcgataaaactgaccacatcgacgcttgcttatctgtaatagcccaggccttcatcgacgcatgttcgattagcgacctgcagctaggcaaggactccccaactaataagctgctctatgcaaaagagatccctgaataccgaaagattgtgcaaaggtattataaacaaatccaggatatgacacccttgagcgagcaggagatgaacgcacacctggcagaagaatccaggaaataccagaacgaatttaacacaaacgtcgcaatggcagaaatttataaatatgcaaagcggtataggccccagataatggccgctttagaggccaaccctaccgctcgccgaacacaattacagcacaagttcgagcaggtcgttgccctgatggaagacaacatctacgagtgctactccgaggcctag

SEQ ID NO: 129064 - DNA, 5358 bp, Artificial Sequence
  Description of Artificial Sequence: Synthetic coding sequence
atggcacctagggccgccggcggtgcaccactttccgctcgcgcggccgcagcttctccaccccccttccagacaccgccaagatgtccggtcccactccttctcttgcttctcctcggagcggctagagccggcgctctggaaattcagcggagattcccctcaccaacgcctactaacaacttcgccttggatggggccgctgggacagtttatcttgcggccgtaaatcggctgtatcaacttagtggcgcaaatctatccctggaagctgaagcggccgttggcccggttcctgactccccgctgtgccatgccccacaacttccacaggcctcttgcgaacacccaaggaggctgacagacaactataacaagatcctgcagctggaccctggtcagggactcgtcgtggtttgtgggtctatatatcagggcttttgtcagctgaggagaagggggaacattagcgcagtggccgtccgttttcccccggcggcgccacctgctgagcccgtaacggtgtttccttcaatgttgaacgtcgccgcaaatcaccccaatgctagcacagttggattggttttaccgcctgcagcaggcgccggagggtcaaggctgctggtgggggccacttatacaggctacggcagtagctttttcccacgcaaccggtctctcgaggaccaccggttcgagaataccccagaaattgccattcgtagcctggatacgcgcggggacctggctaagctatttacgttcgacctgaatccatcagacgacaacattttaaagatcaagcagggcgccaaggagcagcataaactaggattcgtaagcgcatttctgcatccatctgacccaccaccgggagcccaaagctatgcttatctcgctctgaattccgaagctcgcgccggagacaaagaaagtcaggcccgcagcctgctggctagaatctgtctacctcacggagctggaggggatgccaaaaagcttaccgagtcttacatacaactgggattacagtgcgccggtggggctggcaggggagacctgtacagtcgactagtaagtgtgtttccggcacgtgagcggctcttcgctgtgttcgaaaggccccaggggtctcccgccgctagagccgcccctgccgccctatgcgctttccggttcgcagatgtgcgcgccgcgatccgggccgcccggactgcttgctttgttgagcccgcccccgacgttgtagctgttctggattccgtggtccaagggacaggccctgcgtgtgaacggaagttgaacatccaactgcagcccgagcaactcgactgtggcgcagcacacctgcagcaccctctgtcaattttgcagccccttaaggccacacctgttttccgggccccaggattaacgtcggtggcagtggcctctgtcaacaattacacagcagtcttcctgggcaccgtcaatgggcgactgcttaaaatcaacttaaatgagtctatgcaggtggtgtccaggcgggtggtcacagtggcctacggcgagcccgtccaccatgtgatgcagtttgatcctgcagactccggatacttgtacctgatgactagccaccagatggcgagggtgaaggttgccgcttgtaatgtccatagtacctgtggtgattgcgtaggtgccgctgatgcctactgcgggtggtgcgctctcgaaacccggtgtactttacagcaggactgcactaattcttcacagcagcatttttggacgtccgcatctgaaggcccctctcggtgtccagccatgactgtgttgcctagcgagatcgacgtgaggcaggaatacccggggatgattttgcaaatttctgggtctttgccatctctgtcaggtatggaaatggcttgtgactacggaaacaatatccgcactgtggcccgcgtgccgggtccggccttcggacaccagattgcttattgtaacttgttgccgcgtgaccagttccctccttttccccccaatcaagaccatgtaacggtagaaatgagcgtcagagttaacggccgcaatatcgttaaggccaattttacaatatacgactgtagtcgaacagctcaggtgtatccccacacggcctgcacatcttgcctgtccgctcagtggccttgcttctggtgcagccagcagcattcatgcgtgtccaaccagtcaagatgtgaagcctcccctaatcctaccagtccacaagattgcccaagaaccctgctgtcccctctggcccccgtgccgaccggcggatcccagaatatcctggtcccactggcaaacacggctttttttcaaggtgccgccctggagtgcagtttcgggcttgaggagattttcgaggcggtctgggtgaacgagtctgttgtcaggtgtgatcaggtggtgctgcacacaacacgcaagagtcaggtgtttccgctctcgctgcaattgaaaggacggcccgctcggtttctggacagcccagagccaatgaccgtgatggtctataattgtgcaatgggatctccagattgcagccagtgtttgggccgcgaagacctgggccacttgtgcatgtggtcagatggatgcaggctcaggggtcccttacagcccatggctggcacctgccccgcacctgaaatccatgctattgaacccctgagtggacccctggacggagggacactactgactattaggggccgtaacctaggccgcaggctgtccgatgtcgcacacggcgtgtggatagggggcgttgcctgcgagcctttgcctgacagatacaccgtgagtgaggaaatcgtctgtgtcaccggaccagctcccggcccactatcgggggtggttacggtaaacgcctccaaagagggcaaatcaagggatagattttcgtatgtactaccattggtacattctttggagcccacgatgggcccaaaggccggaggcactagaattaccatccatgggaacgaccttcatgtggggagtgaactgcaagtgctggttaatgacacagatccctgcacagagctcatgcgaaccgacacatccatcgcatgcactatgccggagggagcattgccagcacccgtgcctgtctgcgtgcggttcgaaaggaggggatgcgtccacggtaacttgacattttggtatatgcagaatccggtaatcacagcgatcagccctaggagatctcctgtctcagggggcaggaccataacagtcgcaggcgagcggtttcatatggtacagaacgtctctatggcagtgcaccacattggccgcgagcccacgttatgcaaggtcctgaattccaccctgatcacctgtccgtcccccggcgccctcagcaatgcttcagcaccagtggatttcttcataaacgggagagcttacgcggatgaggttgctgttgccgaagagctgctggatccagaggaagctcaacggggctcaaggttccgcctggattatctccccaacccacaatttagcacagctaaaagggaaaagtggatcaagcaccatcccggcgaaccactcacgttggttatccacaaagagcaggacagcctggggctccagtcccatgagtacagagttaaaatcggtcaggtttcttgtgacattcagatcgtcagcgatcgaatcattcactgctctgtgaatgagtcattgggcgccgcggtgggccagctcccaattaccatccaggttggcaactttaatcagacaatagctacgctgcagctgggcggctcagagacagcgatcatcgtgagcattgttatatgctccgtgctgcttctgttatccgtggtggcccttttcgtattttgcactaaatcccggagggcagagagatactggcagaaaactctgctgcagatggaggagatggaatcccagatccgggaggagatccggaaaggattcgccgaactccagaccgacatgacggatctgaccaaagagttaaatcgctcacagggcataccctttctggaatataagcatttcgtaactcgcacgttcttccccaaatgcagctccctgtacgaagagaggtacgttctgcctagccaaacgctgaattcacaaggatcaagtcaggctcaggagacgcaccctcttctgggggaatggaaaattccagagtcctgcagacccaacatggaggaagggattagcctattctctagcctgctcaataacaaacattttctgatcgtgtttgttcatgccctggaacagcagaaggattttgctgtccgcgatcgctgctccttggccagcctgctaaccattgctctccacggaaagctggagtattatacttccatcatgaaagagttattagtggatctaatagatgctagcgctgccaaaaatcccaaactcatgttgcggaggacagagagcgtggtggaaaagatgctgacaaattggatgagcatatgtatgtattcctgtttgcgagagaccgtaggtgaacctttcttcctcctgctgtgcgcgatcaaacagcaaatcaataagggatccattgacgccatcactggaaaagcccggtacacccttagcgaggaatggcttctacgagaaaacattgaggccaagccgagaaacttgaacgtctcgtttcagggatgtggcatggactctttgtccgtgagagctatggatacagacacattgactcaggttaaagagaagattttagaggccttttgtaaaaacgtgccgtactcacagtggcctagagcagaagacgtggacctggagtggttcgcctcttctacccagtcctatatcctgcgcgacttagatgacaccagcgttgtggaagacggacggaaaaaactgaacaccctggctcattacaaaatccctgagggggcctccctggcaatgagtttaatagataagaaggataatacacttggaagagtcaaagacctagacaccgagaagtatttccacctcgtgcttcctacagatgaacttgctgagccaaagaaatctcatcgtcaatcccacagaaagaaggtgttgcctgagatctatcttaccaggctcctcagtacaaaaggtacactgcagaagtttctcgatgacctgtttaaggctatactgtccattcgtgaggacaagcctcccctcgccgtgaagtattttttcgattttctggaagagcaggctgagaagagaggaataagcgacccagacacactgcacatctggaagactaatcgctggaggccatcatcacccgtcctgggtgagcaccccgaggagccacccgtttgcctgtag

SEQ ID NO: 129065 - DNA, 1503 bp, Artificial Sequence
  Description of Artificial Sequence: Synthetic coding sequence
atgcgcggcgagttgtggctgttagttctggttcttagggaagctgcgcgtgccctgtcacctcagcccggcgcgggacatgatgagggaccagggtctgggtgggccgccaaaggcactgtacggggctggaatcgccgcgcacgggaatcccccggacatgtgagcgagccagataggacgcagttgtcgcaggatctgggcggcggaacactggcaatggacaccctgcccgataataggacaagggtggtggaggataaccactcctactacgtaagcaggctctatgggccctcagaacctcatagtcgcgaactgtgggttgatgtggccgaagctaatcgcagccaggtgaaaattcacaccatcctgtcgaacacccatcggcaggcctcacgcgtagtgctaagtttcgacttccccttctacggtcacccactgcgacagatcactattgctacaggaggcttcattttcatgggagatgtgattcacaggatgctgaccgccacgcagtacgtagcaccgctgatggcgaacttcaatcctggctattcagataactctaccgtggtgtacttcgataacggtactgtgtttgtggtacagtgggatcacgtttatctgcagggctgggaagacaaggggagtttcacattccaggccgccctccaccacgatggcaggattgtttttgcctataaagaaattccaatgagcgttcccgaaatctctagcagccagcaccctgtgaagaccggactctctgacgctttcatgatccttaaccctagcccggatgtgcccgagtcccggagaagatcaattttcgagtatcatcggatcgagcttgacccgagtaaagtcacttcaatgagtgctgtcgagtttaccccactgccaacgtgccttcagcacagaagctgtgacgcctgtatgtcttctgaccttactttcaattgttcctggtgtcacgtactgcagaggtgtagcagtgggtttgaccgatatcgccaggagtggatggactacggttgtgcccaggaggcggaaggccgtatgtgcgaagactttcaagatgaagatcatgactcagcctctcctgacacctctttttctccttacgatggagaccttaccacaacatcatctagtctgtttatagactccctcactactgaggatgacaccaagctcaatccttatgcaggcggagacggcctgcaaaataacctcagccccaagacgaaggggacaccggtacatcttgggaccattgtcgggattgtactggccgtgctgcttgttgctgcgatcatcctcgccgggatctacatcaacgggcatccgaccagcaatgccgcactgttctttattgagagacgcccccaccattggcccgctatgaaatttcgctcacatccagatcattccacgtatgccgaggtggaaccaagcgggcacgaaaaagagggctttatggaggctgaacaatgctag

SEQ ID NO: 129066 - DNA, 1014 bp, Artificial Sequence
  Description of Artificial Sequence: Synthetic coding sequence
atgcggggggagctgtggttactggtgctggttttgagggaagctgccagagcattgtcaccacagcctggcgccgggcacgatgaaggccctgggtcaggatgggcagccaaaggtactgtgcgagggtggaaccgacgagcccgcgaaagtccaggacacgtgagcgaaccggatcgaacacagctctcccaggatcttggaggcggaacactcgcgatggacacactcccagataataggacccgggtggtggaggataatcattcctactacgtttcaaggctgtacgggccaagcgagccccatagtagagagctatgggtggatgtcgctgaggccaatagatcacaggtcaaaatccataccattttgtccaacacacatcggcaagccagcagggtagtactgagtttcgactttcccttctacggacatcctctgaggcagatcacaatagccaccggcggctttatattcatgggggatgtcatccatcgcatgttgaccgccactcagtacgtggctcctctgatggccaattttaatccaggctacagcgataattcgacagttgtgtacttcgataacgggaccgtattcgtcgtccagtgggaccatgtgtatcttcaggggtgggaggacaaaggatcttttactttccaggctgccttacatcacgatggcaggatcgtcttcgcgtataaggaaattccgatgagtgtgcccgaaatatctagctcccagcatccggtcaaaaccggactgtctgacgcatttatgatcttgaatccatccccggacgtcccggaatcgcgtcggcgctcaatctttgagtatcacaggatcgagctggacccttctaaggtaacctctatgtcagctgtggagtttacacccctgcccacatgcctgcagcaccggtcctgtgacgcctgcatgagctcagacctcacctttaactgttcctggtgtcacgtgctgcagagcagggacgaagtgagcccctgctag

SEQ ID NO: 129067 - DNA, 1284 bp, Artificial Sequence
  Description of Artificial Sequence: Synthetic coding sequence
atggatacattgcccgataataggaccagggttgtggaggataatcactcatattatgtaagtaggctctacggaccaagcgagcctcatagtagggaactgtgggtggatgttgcagaagccaacagatcccaggtaaaaatacataccatcttaagtaatactcacaggcaggcaagtcgtgtcgtcttatccttcgatttcccgttttacggccacccactgcggcagattaccattgccaccggagggttcatctttatgggtgatgtgatccaccgcatgctgaccgccacccaatatgtggcccccctcatggccaacttcaatcctggttactctgacaacagtactgtggtttatttcgacaacggaaccgtattcgtcgtgcagtgggatcatgtgtacctgcaagggtgggaagataaagggagttttaccttccaagcggcactccatcatgatggaaggatcgtgtttgcctataaggagatacccatgtctgttcctgagatctcctccagtcaacatcctgtaaagacaggcttgagcgatgcatttatgatcttgaatccatcaccagacgtgcctgagagtagaagacgctctatcttcgagtaccatagaatcgaactggatccttctaaagtgacttccatgtctgccgtcgagttcacgcctttgcccacctgtctccagcatcggtcatgtgacgcttgcatgagctcagaccttactttcaattgttcttggtgtcatgtactgcagcggtctctcaataaccaggatgaaaatacctatgttaactgtttggactcacagcagtgccacggctccagtgagtccagaagacctttccaagacgaagatcatgacagcgcaagcccagatacctccttcagcccttacgacggggatctgacgactacctcgagcagtctgttcattgattctttgacgacggaggacgacaccaagctgaatccctatgcgggaggagatggtttacaaaacaacctcagccccaagaccaaaggcaccccagtccacctcggaactatagtcggaatcgtgctggctgttctgctggtcgccgcaatcattttggcagggatatacatcaacggtcacccaacttcaaacgctgcactgttcttcattgaaaggagaccgcatcactggcccgccatgaaatttaggtcccatcccgaccattcaacatatgctgaagtggaaccatctgggcatgagaaagaaggatttatggaggccgagcagtgctag

SEQ ID NO: 129068 - DNA, 375 bp, Artificial Sequence
  Description of Artificial Sequence: Synthetic coding sequence
atggatactctcccagacaatcgaacccgggtggtggaggacaaccactcttactacgtttcccgcttatatggaccctcagaaccacactctcgggagctttgggtcgacgtcgccgaagccaatagatctcaagttaagattcataccattcttagtaatacccaccggcaggcctcgcgggtcgtgctgagcttcgactttccgttctacgggcacccattgcggcagattaccattgccacaggaggcttcatcttcatgggtgatgtgattcataggatgctcaccgctacccagtacgtggctccactgatggcaaattttaatcccggctattccgataactctaccgtcgtgtacttcgataattag

SEQ ID NO: 129069 - DNA, 669 bp, Artificial Sequence
  Description of Artificial Sequence: Synthetic coding sequence
atggacactctgccagataataggacacgagtagtcgaggacaatcattcatattatgtgtcgaggctgtacggcccctcagaaccccactctagggaattatgggtggatgttgcagaagctaatcggtcccaggtgaagattcacacgatattgagcaatactcacagacaggcctctcgcgttgtgctgtcttttgatttcccattttatggccatccactgcggcagatcactattgccacaggtggttttatttttatgggcgatgtcatccaccggatgctgaccgcaacacagtatgtggcccctctgatggctaatttcaaccctgggtactcggataactctacagtggtctacttcgacaatggaacggtttttgtcgtccagtgggaccatgtctacttgcaaggatgggaagacaaggggagcttcaccttccaagccgcactgcaccatgacggccgcattgtctttgcctataaggagatccccatgtcagtgccagaaatcagctcaagccaacaccctgtaaagacgggactctctgacgcattcatgatattgaacccaagccctgacgtcccagagtctaggcgacggtcaatctttgagtaccatagaatagagcttgatcccagcaaggtgacatccatgtccgcctag

SEQ ID NO: 129070 - DNA, 198 bp, Artificial Sequence
  Description of Artificial Sequence: Synthetic coding sequence
taatctttcacctttcaggcagccctccaccatgatggccgcatcgtattcgcatacaaggaaatcccaatgtccgttccggagatctcctcaagccagcatcctgtgaagacaggtctatctgatgcgttcatgatacttaacccgagtcctgatgtgcctgggtttagtgcagagagcgctaaacacttgtggtag

SEQ ID NO: 129071 - DNA, 1383 bp, Artificial Sequence
  Description of Artificial Sequence: Synthetic coding sequence
atggccctgtcagtgcgtacccttccactgagaggcttcctggttcctcgaccacaaccaaccagatctcaggatgcgcctagtccgcgtctgccgctgagcagtgcaccagctccctgcagacacaaaaatgaggaagacaatcactcctactatgtgtcccggctctatggtccttcggaaccccactctcgcgagctctgggtggatgtggccgaagccaaccgttcccaggttaagatacatactattttgagcaacacccaccgtcaggcctccagagtggtgctgtctttcgatttcccattttacggccacccactgcgacagattacaatcgcaacgggcgggtttatctttatgggagatgtcattcacagaatgctcaccgcaacgcaatatgtcgcgcctctaatggccaacttcaaccctggctactccgacaactccaccgtggtgtacttcgacaacgggacagtgtttgtggttcagtgggaccatgtttacctgcaaggctgggaggataaagggagctttactttccaggccgcactgcaccacgatggtcgaatagtctttgcgtacaaagagatccccatgtctgttcctgagatttcttcctcacagcatcccgttaagacgggtctgtctgacgcctttatgattctcaacccctcgccagatgtccctgagtctagacgccgctcaatcttcgagtaccacaggatcgaactcgatccttcaaaggtgacctctatgagtgctgtagagttcacgcctctcccaacatgcttacagcatcggtcttgtgacgcatgcatgtcatctgacttaacatttaactgtagctggtgccatgtcctccagagatgttcttctggctttgatagatacagacaggaatggatggattatggatgcgcccaagaggctgaaggacgcatgtgcgaagactttcaggatgaggaccatgattccgccagcccagatacatcttttagcccatatgatggcgacctgactacaacgtcatcttccctcttcattgactcgcttacaactgaggacgataccaagttgaatccttacgcaggcggcgatggtctccagaataaccttagccctaagacaaagggcactcctgtccatcttggcactatcgtaggaattgtcctggccgtgctgcttgtggccgctattattctggcgggaatttacattaatgggcaccccacctccaatgctgcgcttttcttcattgaaagaagaccacatcactggccagctatgaagttccgtagccaccccgaccattcaacttacgctgaggtggaaccctctggccacgagaaagaggggttcatggaagcggagcaatgttag

SEQ ID NO: 129072 - DNA, 723 bp, Artificial Sequence
  Description of Artificial Sequence: Synthetic coding sequence
atggacacactgcccgataatcgcaccagggtggtcgaggataatcactcatactacgtatccaggttgtacggcccttccgagccacattcccgggagctctgggttgatgttgctgaggctaataggtcacaggtgaaaatacacactattcttagcaatacacatcgacaggccagcagagtggtgctgagcttcgacttccctttctacgggcatccactcagacagatcactatcgccaccggtggcttcattttcatgggcgacgttatccaccggatgctcactgcaacccagtatgttgccccactgatggcaaacttcaatccaggctatagcgacaacagtaccgtggtctatttcgataacggcacagtgttcgtggtgcagtgggaccacgtgtatctgcaggggtgggaggataagggctcatttaccttccaggcagcacttcaccacgatgggagaattgtcttcgcttataaggaaatccctatgtcagtccctgaaatctcgtcctcacagcaccccgtgaaaaccgggttgagcgacgcctttatgattctcaatcctagccccgatgtgccagagagtcgtagacgctcaattttcgaatatcaccggatagagctggacccttctaaggtcacgtccatgagtgcagtggagttcaccccccttccttctccttccactaccaggatgaagacaagaatgtag

SEQ ID NO: 129073 - DNA, 1179 bp, Artificial Sequence
  Description of Artificial Sequence: Synthetic coding sequence
atggaaaaagacaaagttaagatccacggcatcctttccaatacccaccggcaagccgcgcgcgtcaacctctcttttgatttccctttctatgggcacttcctgagggagatcacagtggccactggggggttcatctatactggtgaggtggtccaccggatgctgacggccacccaatatattgcacccctgatggctaactttgatccctcggtgtcccggaattcaacggtcaggtactttgataacggaactgccctggtggttcaatgggatcacgtgcacctccaagataattacaatctcggatcattcaccttccaagctaccctcctgatggacggaagaatcatttttgggtataaggaaattcctgtgctcgtcactcagatctcttctaccaatcaccccgtcaaggtcggcttgtccgacgcttttgtggtcgtgcaccgaatccagcagatacccaacgtgcggcgacgaaccatctacgaatatcatcgggtcgagcttcagatgtcaaagatcacaaacatctccgctgtggaaatgacgccactccctacctgtctccagttcaaccggtgtggcccgtgtgtcagttcccagatcggattcaactgttcctggtgttcaaagttgcagagatgtagttctggatttgaccggcaccgccaggattgggttgacagcggctgtcctgaagagagtaaggaaaaaatgtgtgaaaacacggagcctgtggaaacatccagcaggactacaaccaccgtaggggccacaacaacacagttcagggtgttgactaccactcgacgggcggtgacctcccagtttcctacctctctccctactgaagatgacactaagatcgccctacatttaaaggacaatggcgcaagcacagacgactctgccgccgagaagaaaggcggtactctacatgccggactgatcattgggatcctgatcctcgtgttgatcgtagcgaccgcaattctcgttacagtctatatgtatcaccaccccaccagcgccgctagtattttcttcattgagagacggccaagccggtggcccgcgatgaagttcagacgcgggagtgggcatcccgcctatgccgaggtcgaaccagtgggtgagaaggaaggattcattgtatcagagcagtgctag

SEQ ID NO: 129074 - DNA, 1443 bp, Artificial Sequence
  Description of Artificial Sequence: Synthetic coding sequence
atggctcgctttccaaaggcagatctggccgcagcaggcgtgatgcttctctgtcacttcttcaccgatcagttccagtttgccgatggaaaacccggcgaccagatcctcgattggcagtacggggttacccaggccttcccacatactgaggaagaagtggaggtagactcccacgcctacagtcacaggtggaagcgtaacctggacttcttgaaagctgttgatacaaacagggcaagcgtaggacaagatagccctgagccccgcagctttactgatctgttgctcgacgatggtcaagataataatacgcagatcgagagggtgaacctttcgtttgactttcccttttatggacattttcttagagagattactgtggccacgggaggcttcatctacaccggcgaagtggtacacagaatgctcaccgctacacagtatatcgcaccactaatggcaaatttcgatccttcagtaagccgaaactccaccgtccgttacttcgataacggcaccgccctcgtggttcagtgggaccacgtgcatctgcaggacaattacaatctcggcagttttacattccaggcaaccttgctgatggacgggcgcattatctttgggtacaaggagatccccgtcctcgtgacgcagatttctagcaccaaccatcccgtaaaggtgggattgtccgatgcattcgtagtagtgcaccgcatacagcagatccccaatgttcgtagacgcactatctatgagtatcaccgggtggaactgcagatgagcaaaattaccaacatttctgctgtagagatgacccccttaccaacatgcttacagttcaaccgatgtgggccttgcgtgagcagccagataggcttcaattgctcgtggtgttcaaagttgcaaaggtgtagcagcggcttcgatcgccaccgccaggattgggttgatagcggttgcccagaggagagcaaggaaaaaatgtgcgaaaataccgagccggtggagaccagtagcagaactactaccaccgtcggggctacaaccactcagttcagggtcctgactacaacacgtcgagctgttacaagccagttccccacttcgctgcctaccgaggacgataccaagatcgccttgcacctcaaggacaacggcgcttctaccgacgattccgccgctgaaaagaagggtggtacattgcacgccggcctgatcataggtatcctcattcttgtactgattgtcgccacggccatcctggtgaccgtctacatgtaccaccaccccacaagcgctgcctccatattctttatcgaacggcgcccatccagatggcccgccatgaaatttcgaagaggatctggtcaccccgcttacgccgaagtcgagcccgttggggagaaggaaggcttcattgtgtctgagcaatgctag

SEQ ID NO: 129075 - DNA, 1590 bp, Artificial Sequence
  Description of Artificial Sequence: Synthetic coding sequence
atggcacgtttccccaaggcagacctcgctgcagccggtgtgatgttactgtgccactttttcaccgaccagtttcaattcgcggatggaaagcccggcgaccagatattggactggcaatatggcgtaacccaggccttcccacacaccgaggaagaggtggaagtggattcccacgcctattcccaccgttggaaaagaaatttagatttccttaaagctgtagacacaaacagggcaagcgtgggacaagattctccagaacctcgttccttcactgatctactcctcgatgatggacaagacaacaatacacagattgaggaggacaccgatcataactactacatatcccggatctatggaccaagcgattcagcaagcagagacctctgggtgaatattgatcagatggagaaagataaggtgaagatccacggcatcctttcaaacacacacaggcaggcagctagggtgaatctgtcttttgatttcccattctacggacactttttgagggagatcaccgttgctactgggggattcatttatacgggtgaagtggttcaccggatgttaacagccacacagtatattgcgcctcttatggcaaacttcgacccttctgttagtagaaatagtactgtgcggtacttcgacaatggaacagcgctcgttgttcagtgggatcacgtgcacctccaggataactataatctggggtcgttcacgttccaggcgactctgctgatggacggacgcatcatctttggatataaggagattcccgtgctggtcacccagatctcctccaccaatcacccagttaaagtgggactgtcagacgctttcgtggtggtgcatcggattcagcagatcccgaacgttagacgacgtacaatctatgaatatcacagagtcgagctccagatgtcaaagattacgaatataagcgccgtggagatgacgcctctccccacatgtctacagtttaatagatgcggcccttgtgtctcctcccagataggcttcaactgctcctggtgttccaaactgcaacgctgcagcagtggattcgacaggcatcgacaggactgggtcgactcggggtgtccggaggagtccaaagagaagatgtgcgagaatactgagccagttgagacttctagcaggaccacaaccacagtgggtgccaccaccactcagtttcgcgtgctgaccactacacgacgggcagtcacctctcagttccctacctcactccctaccgaagacgacacaaagatcgcgttgcatctaaaggataacggagcctcgactgacgactcggcggccgaaaagaagggcggtactttgcatgccggccttattattggaatactcatcctggtactgattgttgcgacagccattctggtcaccgtgtacatgtatcaccatcctacgtcggcggccagcatttttttcattgagaggcgcccatctaggtggcctgccatgaagttcaggcgcggatcaggtcatcccgcgtatgccgaggttgaaccagtcggggaaaaggaaggctttatcgtgtcagagcagtgttag

SEQ ID NO: 129076 - DNA, 1548 bp, Artificial Sequence
  Description of Artificial Sequence: Synthetic coding sequence
atgttgctctgccatttttttacggatcagttccagttcgccgatggcaaaccgggtgatcagatactcgactggcaatacggggtgacccaagcttttcctcataccgaagaagaggtagaagttgactcccacgcctattcacacagatggaagcggaatcttgatttcctgaaggcagttgatactaaccgcgcctcagtggggcaggattcccctgagccacgcagtttcacggacttgttactggacgacgggcaagataataacacccagatcgaagaggatacagaccacaactattatatctcccggatctacggtccgagtgactcagccagcagggacctgtgggtaaatatcgatcagatggagaaagacaaagtgaagatacacggcattctctccaacactcaccggcaggccgccagagttaatttgtctttcgacttcccattctatgggcactttctgcgcgagattaccgtcgcaacgggcggattcatatataccggagaagtagtacaccgaatgctgacagccacacagtacatcgctccactcatggccaacttcgatccctccgtgtcgcgcaactcaactgtgagatacttcgataacgggaccgctctcgtggtccagtgggatcacgtgcatctgcaggataactataatctgggatctttcaccttccaggcaaccctcctcatggatggaagaatcatattcggatataaggaaatcccagtcctggttacccaaatttcaagtacaaaccatccagtgaaggtggggctgagcgatgctttcgtggtggttcaccgtattcaacagattcctaacgtgcggcgcaggacaatctacgagtaccacagggtagaactgcagatgtccaaaattacgaacatctcagccgtggagatgactccgctcccaacctgtctgcagttcaatcgctgtggaccctgcgtgtcttcccagattggcttcaactgcagctggtgttctaagcttcaacgatgttcatcgggtttcgaccgccaccgccaggactgggtggattcagggtgcccagaggaaagtaaggagaagatgtgtgaaaatacggaaccagtggagacgagttctaggaccaccacaacggtgggggctacaacaacgcagtttagagttctgactaccacaagacgggcagtgacaagccagtttcctacctctcttcctacagaggatgatacgaaaatagcacttcacctcaaagacaacggggcttccaccgatgactctgccgctgagaaaaaaggaggcactctgcacgctggcctgattatcggaatcctcattctggtgctcattgtggcgactgcgatcctcgtcacagtctatatgtatcatcatccaacaagcgcggcttccatcttttttattgagcgcagacctagcagatggcccgccatgaaatttcgtcggggcagcggccaccccgcatacgccgaagtcgagcctgtgggtgagaaggagggatttatcgtcagcgagcagtgttag

SEQ ID NO: 129077 - DNA, 1581 bp, Artificial Sequence
  Description of Artificial Sequence: Synthetic coding sequence
atgcgctgtgcactggcactcagcgccctcctgctgctgcttagcacgccccctctgctaccttctagcccgtccccttcaccatctcctagtcaaaacgccacccagactacaactgattcgagcaataagacagcccctacacccgcctcaagcgtcactataatggctacagataccgctcagcagtcaacggtgccgacatctaaagccaatgaaattttagcgtcagtaaaggctacaaccttaggggtgagctccgatagccccggaactacgacgcttgcccagcaggtgtctggtcccgtgaacaccaccgtagcaagaggtggggggtcaggaaacccaaccacaactattgaatctccaaaatcaaccaagagtgctgacacaaccaccgttgccacttccaccgctaccgcaaagcctaacacgacatccagccagaatggagctgaagacacaaccaactctggtgggaaatccagtcactctgttacaacagatttaaccagtacgaaagctgagcatttgactacacctcacccaacgtctcccctttcacccaggcagccaacatctacccatcccgtggccacacctacgtcatccggtcacgaccacctgatgaagataagttcgtcttccagcaccgtggctatcccaggctacaccttcacaagtcccggcatgacaactacactgccgtcaagtgtcatttctcaacgtactcaacagactagttcccagatgccggcgtcaagcacggctccgagttcccaggaaaccgtgcagcctaccagccctgccacagcgctccgaacgccaacattgcccgaaactatgtcctcaagcccgactgcagccagcacaacacaccgctatcctaagactccatcaccaacagtggctcatgagtctaattgggcaaagtgcgaggatctagaaacacagacccagagcgagaaacagctcgtactaaacctgactggcaacaccttgtgcgccgggggggcctctgatgaaaaacttatctctctgatctgccgagcagtaaaggccacatttaatcccgcgcaggataagtgcggcatccgcctcgccagtgtgcctggctcccaaactgtagtggtaaaggaaattacaatccacaccaagctccccgccaaagatgtgtacgaaagattaaaggacaagtgggacgagctcaaagaggctggcgtgtctgacatgaaactgggcgatcagggcccccctgaggaggccgaagatcggttctcaatgccgctcataatcacgatcgtttgtatggcgtcgttcttgctgctggttgcggcattgtatggttgctgtcatcaaagactaagtcagagaaaggaccagcagaggctgaccgaggagctccaaaccgtggagaacgggtaccatgacaaccctactctcgaggtcatggaaacatcctccgaaatgcaggagaagaaagtcgtatcactgaatggagagttgggtgattcctggattgtccctcttgacaacttgacaaaggacgatctggacgaggaggaggacacacacctttag

SEQ ID NO: 129078 - DNA, 1677 bp, Artificial Sequence
  Description of Artificial Sequence: Synthetic coding sequence
atgaggtgcgctttagccttgtcggccctccttctgctgctaagtacacctcctttgctcccatcttcaccttcgccatcaccgagcccaagccaaaacgctacacagactactacggattcttctaacaagaccgcccccacaccagcaagctccgtgactattatggccacagacacagcccagcagtctacggtgcctacgtccaaagcaaatgagatcttagctagtgtcaaggccactactctcggagtttcctcagattctcccggtaccacaacccttgcgcagcaggtttctggacccgttaatacaaccgtcgctcgtggcggggggagtggtaatcccacaaccacaatcgagtcccctaaaagcacgaaatcggcggacactactaccgtggcgacctcaactgccactgctaagcccaatacaacgtcttcccagaacggggccgaagacaccaccaactcaggcggcaagtccagtcacagcgtcactaccgacttaacttccacaaaagccgagcacttaaccacaccgcatccgacttcccccctctctcccagacagcccaccagtacacacccagttgctacccctacttcatctgggcatgatcatttgatgaagatctctagctcctcctccacagtggctattcctgggtacacttttacttcccctgggatgaccaccacactactggagacagtgtttcaccatgtaagtcaggccggactggaactgctgacctctggtgacctgccaactctggcctcccaaagtgctggcatcaccgctagctccgtgataagtcagagaacccagcagacttcatctcagatgccagcctcttccactgctccctcatcacaggagactgtccagccaacaagccccgctaccgcattgaggactcccacattgcctgaaaccatgtcttcatcccccaccgccgcctctacaacccataggtaccccaaaaccccctcccctaccgtagctcacgagtctaactgggctaagtgtgaagatcttgagacccagactcagagtgaaaagcagctggtcctaaatctgactggtaacactctctgtgccggcggagcgtcagatgaaaaattgattagtctgatctgccgtgctgtaaaagccacttttaatccagcccaggacaagtgcggcatccgcctggcctccgtgcccggtagccagaccgtggtcgtgaaggagatcacaatccacacaaagttgccagccaaagacgtttacgaaagattaaaagacaagtgggacgagcttaaagaggccggagtttctgacatgaaacttggtgaccaggggccacctgaggaagctgaggatcggttttccatgccgttaataatcacgatcgtgtgtatggcatcctttctgctgttggtagccgcattgtatggatgttgtcaccagcggttatctcagcggaaagatcagcagcgactgacagaggagctgcagacggtcgaaaacggctaccatgacaatcccaccctcgaagttatggaaaccagctccgaaatgcaggaaaaaaaagtagtttccctgaacggggagctcggcgattcttggattgtccctctggataacctgacaaaggacgatctcgacgaggaggaagacacacacctctag

SEQ ID NO: 129079 - DNA, 1581 bp, Artificial Sequence
  Description of Artificial Sequence: Synthetic coding sequence
atgcgatgtgccctcgccttgtctgccttgctcttactgttgtcaacaccaccgctactcccgtcctcacccagccctagtcctagcccaagccagaatgcaactcagacaactacggacagctccaacaagaccgcccccaccccggcttcgtcagtcaccattatggccactgacaccgctcaacagtccactgttcctacttcaaaagctaacgagatccttgccagcgtgaaagccacgacattaggggtttcaagtgatagtccaggaactactaccctggcacagcaggtgtccggacctgtaaacacaacagtcgccaggggcggtggctcgggcaatcctactacaacaatcgaaagcccaaagagcacaaaaagcgctgataccacaaccgtggccacctctaccgccaccgctaaacccaacaccacgtccagccagaacggggctgaagacactacaaatagtgggggcaagtcctctcatagcgtcaccacagacttgacgagcacaaaagctgagcatctgaccacaccgcaccccactagcccactgtcccccagacagccaacgtctacacatcccgttgccaccccaacatcttcaggacacgaccatctcatgaaaattagctctagtagtagcaccgtggcaatcccaggatacacctttacgtctcctggaatgacaactacactgccctcttcagtgatcagtcagaggacccagcagacaagctcccagatgcccgcaagttcaaccgctcctagcagccaagagaccgttcagcctacctcacccgccacagctctgcgtacgcccactttacctgagacaatgtcgagtagtcccactgctgcctccaccacccaccggtatccaaagaccccttcaccaacagtagcacacgagtccaactgggtcaccccggccggggtgggcactcagactcgggttgaggaagccctccgacaggccctgacacactccttattaccagctggaggcgcctctgatgagaaattaatctcgctgatttgccgcgccgttaaagccacattcaatcctgcacaggacaaatgcggcattcggctagccagcgtccctggctcccagactgttgtggtgaaggagattactatacataccaagttgcctgccaaggatgtgtatgagcggctgaaggacaaatgggatgagctgaaagaggccggagtgtcagatatgaaactcggggaccagggacctccggaggaagcggaggatagattcagcatgcctctgatcatcactatcgtgtgtatggcctcctttctcctgctcgtcgccgccttatacgggtgttgccaccagcggcttagtcagaggaaagaccagcagcgcctgacagaggaactgcagaccgtggagaacggctatcacgacaaccccacacttgaagtaatggagacttctagtgaaatgcaggagaagaaggtggtcagtttaaacggggaactcggggattcctggatagttccactggataatctgactaaggatgaccttgatgaggaagaggacactcatctttag

SEQ ID NO: 129080 - DNA, 1683 bp, Artificial Sequence
  Description of Artificial Sequence: Synthetic coding sequence
atgcggtgcgccctggctctctctgccctgctgctcctgctgagcaccccccctttgctcccatcatccccatctccatcaccgtcaccaagtcaaaatgagacagcgacgcagacaactactgatagctcaaacaaaacggcccctacgccagcctcttccgtgactataatggccactgacaccgcacaacaaagcactgtcccaacctctaaggcaaacgaaatcctagcgtctgtcaaagcaaccactttgggagtctcgagcgactcccctgggacaaccacactggcccagcaggtcagtgggcctgtgaataccacagttgcgcgcggaggaggaagtgggaatccaacaactacaatcgaatcacctaagtcaacaaagagcgcagacacaaccaccgtggctacctcgaccgcaactgctaaaccaaacactacatcctcacagaacggcgccgaggacacaacaaactccggcggaaaatcaagccattccgtgactacggacttaaccagtactaaggcggaacacctgacaaccccccatcctacttcacctctgtcgccaagacagccaacgagcacccacccagttgctacacccacgagctctggacacgaccatctaatgaagatcagctctagtagctccacagtcgctattcctggctacacattcacttccccaggcatgactactacgcttctcgaaacggtgtttcaccacgtctcccaagcaggactagaactgctcacgagcggagatctacccaccctggcttcgcagtcagctgggatcaccgcctctagtgtgatttcccagcgcactcagcaaactagtagccagatgcccgcaagctcaacagcacccagctcgcaagaaacggttcagccaacatcccctgctaccgccttacgcaccccaactctgccagagactatgtcttctagcccaacagctgcgagtactacacaccgctatccaaaaacaccatccccaaccgttgcccatgaaagtaattgggcaaaatgcgaggatttggaaacccagactcagagtgaaaagcagttggttctgaatctgacagggaatactctctgtgccggcggtgcttctgacgagaagctgatttccctgatctgcagagccgtcaaagctacattcaaccctgcccaggacaaatgcggcatcagactggcgtctgtgcccggaagccagactgtcgttgtcaaggagataaccatccataccaaactcccggccaaagatgtgtacgaacggcttaaggacaaatgggacgaactcaaggaggctggggtgtccgatatgaagctgggagaccagggaccgccagaggaggctgaagaccgttttagcatgcctctgattattacaattgtctgcatggcatcctttctgctgctggtggcggccttgtacgggtgctgccatcagaggctaagtcaacgaaaagatcagcaacgccttaccgaggagctgcagacagtcgagaatggctaccatgacaaccccaccctcgaggtgatggagacgagttccgaaatgcaagagaagaaagtcgtatctctgaatggggagctcggagatagctggatcgttccccttgataatctcactaaagatgatttagacgaggaagaagacacgcacctctag

SEQ ID NO: 129081 - DNA, 1551 bp, Artificial Sequence
  Description of Artificial Sequence: Synthetic coding sequence
atgcgatgtgccctggctctttcggccctcctgctactgctgtccacctcgcccagtccatcgcagaacgccacacagaccactacagattcgagcaataaaactgcccctacccctgcttcatccgttaccattatggccacagatactgcacaacagagtaccgtgcccaccagtaaagccaacgagatcctggcctccgtcaaagccaccaccctgggagtgtccagcgattctcccggaacaactacattggcacagcaggtctctggcccagtaaacacgacagtagcacgaggcggaggatccggcaaccctacaaccacaatagaatctcctaagagcacaaaaagtgccgacactactacagtcgccactagcaccgcaaccgcaaagcctaacactaccagcagccaaaatggagccgaggacaccacgaacagcggtggcaaatctagccattcggtcacgactgaccttacctcaaccaaagccgaacatcttacgaccccccaccccacttctccactctccccacgccagcccacaagtacacatccagtggcaacccccaccagctccggccatgaccacctcatgaaaatttcctcctcaagttcaaccgtcgcaatccccggctacaccttcacttccccgggtatgaccacaacgcttccgtccagtgttataagtcaacgaacacaacaaacgagctctcagatgccggcctcctctaccgcgccgtcctcacaagagacggtgcaacccacctctccagcaacagctttgagaacaccaactcttcctgaaaccatgtctagtagcccaaccgccgcaagcaccactcatagatatccaaaaacacccagcccaacagtcgctcatgagagcaactgggccaaatgcgaggacttggaaacccagacacagtccgaaaaacagctggtattaaacctcacgggaaatacactgtgcgccggaggagccagtgatgagaagctcatttcgttaatctgtcgcgcagttaaggccacgtttaaccccgctcaggacaagtgcgggatccgacttgcctccgttcctggctcacaaactgtggtagtgaaggagataactatacatactaagctgccagctaaagacgtatacgagcggctaaaggataagtgggatgagttaaaggaggccggcgtaagtgacatgaaactgggggatcaaggacctcccgaggaggcggaggatagattcagcatgccactcataataaccatagtgtgcatggcatccttccttttgctggtggccgccctctatgggtgctgtcaccaaaggctcagccagaggaaagatcagcagagattgactgaagagctccagaccgtggagaacggttatcacgacaatcccacacttgaggttatggagacgagttctgagatgcaagaaaagaaagtcgttagcctgaatggagaactcggggattcatggattgtacccctggacaacctcacgaaggatgatttggacgaggaagaggacactcacctctag

SEQ ID NO: 129082 - DNA, 1986 bp, Artificial Sequence
  Description of Artificial Sequence: Synthetic coding sequence
atggagggagcaagggcacgcggtgcccaactgagactgggagaacgcgtaaggcctgtcgggagaagaagcgctccaggtcggtctaggttccggcagccatggcggcccggggcctctgatagcgccccgcctgctggcactatggctcagtctagggttctgctgcttcttctccttttacccccacaattgcacctcggcccagtgctcgcagtcagggcgccaggattcgggcgctccggtggccactccctgagccctgaagaaaatgaattcgcagaggaggagcctgtgttggtgttgtctcccgaagaaccgggccctgggcctgcggccgtgagctgtcccagggattgcgcttgtagccaggagggagtcgtggactgtggtggtattgatctgcgtgaattccccggtgatctgcctgagcacaccaaccatctgtcccttcagaataaccagctagagaaaatttatcccgaggagctgtcacgtctgcatcgactggagactctgaatttgcaaaacaaccgtctcactagccgagggctgcccgagaaggcatttgagcacctcactaacctgaactatctgtatttggcgaataacaagctgactctggctcctcgcttcctccctaatgctcttatttccgtggactttgctgccaactatctgactaagatctacgggctgacttttgggcagaagcccaatctgcgctccgtttatctgcataataacaagctcgcagatgccgggctgccagacaatatgtttaacggcagttccaatgttgaagtcctcattcttagtagcaattttttgcggcacgtgccgaaacacctgccacccgccctgtataagttacacctgaagaataataagctcgaaaaaattcccccaggtgcattcagcgagctctctagcctacgcgagctctacctgcagaataactacctgaccgacgagggtctggacaacgaaacattttggaagctgagttccttggaatatctcgacttgagctccaataatctgagccgtgtacctgcggggctgcccaggtccctggtactgctgcaccttgaaaaaaacgcgatacgctctgtcgacgcgaacgtcttgaccccaatccgatccctcgaatatctgctcctccactctaatcagctccgtgagcaggggatccatcccctggcttttcaaggcttaaagcggctacatacagtgcatctttataataacgccctggagcgcgtgccatctggcctgcctaggcgagtacgaactttgatgatcctgcacaatcagataaccggaattgggcgggaagacttcgctactacctattttctggaggaactgaaccttagctataacaggattacgtcaccacaggttcatcgagatgctttccggaaactccgattactccgcagccttgacctgtccggaaatcgtcttcataccttgccaccggggttgcctcgtaacgtgcacgtcctaaaagtgaagagaaacgagcttgcggcactggccagaggcgcgttggttgggatggcccagctgagagagctgtatctgacctccaacaggctccggagtcgcgctctcggccccagagcgtgggtggacctggctcacttacaactcctcgacatagctggaaatcagctgaccgagatccccgaaggactccctgagtcgctcgagtacctgtacctgcagaacaataaaatcagcgctgttcctgctaatgcctttgactcgacacccaaccttaagggcatttttctccgttttaataagttagcggtgggcagtgtcgtcgacagcgcatttagacgattgaaacatctgcaagttctggacatcgaggggaatctggagtttggagatatctctaaagaccggggacggctgggcaaagaaaaggaggaggaagaggaggaagaggaggaggaagaagaaaccagatag

SEQ ID NO: 129083 - DNA, 1929 bp, Artificial Sequence
  Description of Artificial Sequence: Synthetic coding sequence
atggaaggcgaggaggccgagcagccggcctggttcaggcagccctggaggcctggtgctagcgacagcgccccacctgccgggactatggcccagagccgcgtcctgctactcctcttattgctgcctccccagctgcaccttgggcctgttctggcagtgcgcgctcccggattcgggcggtcaggaggacactcccttagcccagaggagaatgaatttgcggaagaggagcctgtgttggttctgtcacctgaggagcctgggcccggcccagcagctgtgtcgtgtcccagagactgcgcctgcagtcaggagggcgtggtggattgcgggggcattgatctgagagaattccccggcgacctgcccgaacacacaaaccacctttcgctgcaaaataatcagctggagaagatttacccagaggagctcagtcgcttgcatagactggagactctgaacctgcagaacaacagactgacctctaggggcctgcccgaaaaggcttttgagcacttaacaaaccttaactacctgtatctggccaataataagctgacactcgctccaaggttcttgccaaatgctctaatttccgtcgacttcgccgctaactatttgaccaagatttacggtctaacattcggccagaaaccaaacctgagatctgtctatctgcacaataataagcttgcggatgctggccttccagataatatgttcaatggtagtagcaacgtggaggtccttattctaagtagcaactttctgagacatgtccctaagcacctgccaccagcactttacaagttgcacctgaagaataataaactggaaaaaatcccacctggtgccttttccgaactgagtagccttagggaactctatttgcaaaacaattatctcacagacgaagggttggacaacgagaccttttggaaactctcttctttggagtacctggacctcagctcgaacaacctctctagggttcccgccggtctccctcggtctctggtcttgctccatctagaaaagaatgcgattagatctgtggatgccaacgtgttgacacccattcgcagcctggagtatttgctactgcacagcaaccagctgagagaacagggaattcacccccttgccttccagggactaaagaggctgcatactgtgcacctttacaacaacgccctggagcgcgtgccctcagggctgccacggcgcgttagaactctgatgatactccacaaccagatcaccggaatcgggagagaagacttcgccaccacatactttttggaagagctaaacttaagttacaacagaataacatccccacaggtgcacagagatgctttcagaaagttgaggctgctcaggtcattggatctgagcggtaacaggttgcacacacttcccccagggctcccacgtaacgtccacgttttaaaagtgaagagaaacgagctggccgccctggcccgcggcgccctcgtaggtatggcccaattgcgggagctgtatctgacctccaacaggttacgctctagagcgttaggaccacgggcatgggtggacctggcacacctacagctgctggacattgccgggaaccagctgacagagattcctgaggggttaccagagtctcttgaatatttgtacctccagaataacaagatctccgcagtgcctgctaatgcattcgactcaacacctaacttgaaaggcatttttctccggttcaacaagctggcagtgggcagcgtggtggactccgcttttcgccgactcaagcaccttcaagtgctggatatcgaagggaatctggaattcggggatatctcaaaagaccggggccgactgggtaaggaaaaggaagaagaggaggaggaggaggaggaagaagaagagactcggtag

SEQ ID NO: 129084 - DNA, 1560 bp, Artificial Sequence
  Description of Artificial Sequence: Synthetic coding sequence
atggaaggggccagagcccgcggagcgcaactccggctcggggagagagttcgaccggtgggaagacggtccgcacccggcaggagcagatttcgacagccgtggcgccccggagcctccgatagtgcgccaccagcaggtacaatggcacagagccgtgtccttctccttcttctgctgctgcctccccagttgcatttgggacccgtgctggccgtaagggctcctggctttggccgctccggcgggcacagcctgagccctgaggaaaacgagtttgccgaggaggagccagtcctcgtcctctctcccgaagagcctgggccaggacccgccgccgtgagttgcccgcgcgactgtgcttgttctcaggaaggagtcgtggactgtggaggcatagacctgagggaatttcccggcgatctaccggagcacactaaccacctgagcctgcaaaataacaaactagaaaagattccgccaggcgcattctctgagctctcttcgctgagagagctctatctgcaaaacaactacctgacggatgaaggtctggacaatgagactttttggaaattgtcttctctagagtacctggatctgagtagcaataatctgtccagagtcccagccggtctgccaagaagtctcgtgctcctccatctggagaagaacgcaattcgaagcgttgacgccaacgtgttaacacctatccgtagcttggagtacttgcttctgcattcaaaccaattaagagagcagggtatacatcctctggccttccagggacttaagaggctgcacacagtccacctgtataataacgcccttgagagggtcccaagcggtctccctcgccgagtgcgcaccttaatgattctgcacaatcagattaccggaattggacgcgaggactttgccaccacttacttcctcgaggaacttaacttgagctacaataggatcacttcgccgcaggttcaccgcgacgcatttcgtaaactgaggctgttgcggtctctggacctatccggcaatcgtttgcatactctcccgccggggcttcctaggaacgttcacgtactgaaagttaagcgcaacgaactggcagcccttgcacgaggagctttggtgggtatggcacaactcagggaactttatctcacatctaaccgactccggtcgagagctttggggcctagggcctgggtggacctagctcacctacaactgctagacatagctggcaatcagcttacagaaatcccagaaggcttgccagagagtttggagtatctatatctgcagaacaacaaaatttccgcagtacccgcgaacgccttcgacagcacccctaaccttaaaggaatctttctgcggttcaataagctcgccgtcggttcggtcgtggacagcgcatttcgtcgtcttaaacacttgcaggtgctggacatcgaggggaatctcgaattcggagacatttccaaagaccgggggcgactgggcaaagagaaagaagaggaagaagaagaagaagaggaggaggaggagacccgctag

SEQ ID NO: 129085 - DNA, 1095 bp, Artificial Sequence
  Description of Artificial Sequence: Synthetic coding sequence
atggctagggccatggctgccgcttggccccttctgctcgttgcgcttctggtgcttagttggcctcccccggggacgggcgatgtagtggttcaggcaccgactcaggttcccggctttttgggagatagcgtcaccctcccatgctacctgcaggtaccgaatatggaggtaacacacgtgagccagcttacttgggcgcgacatggagagtctggctcgatggccgtgtttcaccagacacaagggcccagttacagcgagagtaagaggcttgagtttgtcgcagctcgattaggagccgagcttaggaatgcaagtctccggatgttcggccttagggtggaggacgagggcaattacacctgtcttttcgttacctttcctcagggtagccgctcagttgacatctggctccgagtgctggccaaacctcagaacacagccgaagtgcagaaggttcaactaacaggggaaccggtacccatggcacgatgtgtgagcactggcggccgacctcctgcacagataacgtggcactccgacctgggggggatgcccaacacatcccaggtgcccggatttctctccggaaccgtcaccgtcactagtctatggatcctcgtgccttccagtcaagtggacggtaaaaatgtcacgtgtaaagtggagcacgaatcgttcgagaagccgcagcttctgacagttaatctgacagtctactacccccccgaggtgagtatttctggttacgataataattggtacctgggccagaacgaagcgacccttacgtgtgacgctcggtctaatccagaacctaccggatataattggagcactaccatgggaccactgcctccatttgctgtggcccagggtgctcagcttcttattcgccctgtggacaaacctattaacacaacactgatttgtaacgtgactaacgccctgggcgccaggcaggcagagttgacagtgcaggtgaaaggtaccgagcacgccagtgcctcagcgaacggccacgtgagttacagcgccgtgtctcgcgagaattccagctcccaggacccccaaacagagggcacgcgatag

SEQ ID NO: 129086 - DNA, 1119 bp, Artificial Sequence
  Description of Artificial Sequence: Synthetic coding sequence
atggcccgggccatggcagctgcttggccactcctgttagtggcattactcgtcctgtcttggcctccccctggcactggggatgtcgtagtgcaggctcccactcaggtcccaggctttctgggagactcagtgaccctgccatgttacctgcaggtaccgaatatggaggtgacccatgtgagtcagcttacgtgggctcgacatggagaaagcggcagtatggctgtgttccatcagacacaaggacccagctactctgaaagcaagagattggagtttgtggccgcccggctaggggcagaactcaggaatgcgtcgctccgcatgttcggtctgcgcgtggaagatgaaggcaattatacatgcctcttcgttactttcccacagggatccaggtctgtggatatctggcttagagtgttagctaaaccacaaaacacagcggaggttcaaaaggtgcagctgactggggaaccagtgcccatggccaggtgcgtctcaaccggtggtcggccacctgcccagatcacttggcactccgacttgggcgggatgcctaatactagccaagtcccaggatttttaagcggcaccgtaacggtcacctcactgtggatcctggtcccttcatcccaggttgacggcaagaatgtaacatgcaaagtggaacacgaatcattcgaaaagcctcagctattgaccgtgaacctgacagtgtactaccctcccgaagtgtcaatctcaggctatgacaataattggtatctgggtcagaatgaggccaccctaacatgtgatgcaagatctaatcctgaaccaacaggctataattggtctaccaccatgggacccctgccgccatttgctgtagcccaaggggcacagctgctaatccggccggtggataagcctattaacacaaccctgatctgtaatgttactaacgcgttgggagcacgccaggctgagttaaccgtccaggtgaaggagggccctcctagtgagcatagcgggaccgaacacgcctccgccagcgccaatggtcatgtgtcatactccgctgtttctcgcgaaaattcttcttcccaggatccacagaccgaagggacccgttag

SEQ ID NO: 129087 - DNA, 1179 bp, Artificial Sequence
  Description of Artificial Sequence: Synthetic coding sequence
atggctcgggctatggctgccgcctggccactgctgctcgtagccctactggtgctgtcatggcctcctcccgggactggtgacgtggtggtccaggctccgacacaggtgcctggattcctgggagatagcgttacacttccctgttatcttcaggtgcctaatatggaggttacacacgtctcacagttgacctgggccagacatggggaaagtggctcaatggccgtgttccaccagacccagggacctagctactctgaatctaagcgcctagaattcgtggccgcccgcctgggggctgagctacgaaatgcaagcctacggatgttcggcctcagggtggaagatgaaggcaactatacctgtctcttcgtgacttttccacagggtagtagaagtgttgatatctggctgagggtcctcgcgaagccgcagaatacagccgaagtgcagaaagtgcagttgaccggagaaccagtgccaatggcgaggtgcgtgagcactggtgggagaccccccgcacagatcacttggcatagcgacttagggggcatgcctaatacctcccaggtacccggttttttatccgggactgtcactgtaacttctttgtggattcttgttcccagttctcaggtggatggaaagaatgtgacttgtaaggtcgaacacgaatctttcgaaaaacctcagctgctaactgtcaatctaaccgtgtactatcctcccgaggttagcataagtgggtatgacaataactggtatctcggacagaacgaagcgactctgacatgtgatgcccgctctaatccagaacccaccggctacaactggagcacgactatggggccccttcccccgttcgcagtagcgcagggtgctcaactgttgatccggcctgtcgacaaacctatcaacacaactctgatctgtaatgtgaccaatgcactgggcgcccgccaggcagaacttactgtccaggttaaggaaggacctccctccgagcattccgggatctcccggaacgcaattatttttctggtgttgggcatcctagtcttcctcatcctgctaggcattgggatctacttttactggtcaaaatgctcccgggaggttctctggcactgtcacctgtgcccatccagtgaacatcatcaatcatgtcgtaactag

SEQ ID NO: 129088 - DNA, 1254 bp, Artificial Sequence
  Description of Artificial Sequence: Synthetic coding sequence
atggcgcgagcgatggcagcagcctggcccctcttgttggttgccctgcttgtgctttcctggcctccacctggaaccggagatgtcgtcgtgcaggcacccactcaagtgccgggctttctcggagactcagtgaccctcccatgttacctgcaggtcccaaatatggaggtgacccatgtgtcacagcttacttgggcacgacacggcgagtccggcagcatggctgtctttcaccagactcagggaccctcctattctgaatcaaagcggttagaatttgtggctgctcggttaggggctgagttgcggaatgcctctctgagaatgtttggcctgcgagtggaggatgaagggaactacacgtgcctgttcgttacgtttccccagggatcaagatcagtggatatctggctgcgggttctggctaagccccaaaatacagctgaagttcaaaaagtgcaactaacaggagagccagtgcctatggcaaggtgtgtgtctactgggggcagaccaccagcgcaaattacctggcattccgatttggggggtatgccaaatacttcccaagtgcccggctttttgtcaggcacagttaccgtgacttctctgtggatcctggtacccagtagtcaggttgacggcaagaacgtgacttgcaaggtagaacatgaaagtttcgaaaaaccccagctgctaactgttaacctgaccgtgtattaccctcccgaggtatctatctcaggctatgataataattggtacttgggccagaacgaggccaccctcacttgcgacgcacgttctaacccagaaccgactggctacaactggtctacaacgatgggaccacttcctcctttcgcagtggcccagggagctcagctcctgatcaggccagtggacaagcccatcaacaccacactcatctgtaacgtcacaaacgctcttggcgcacgccaggccgagctaaccgtacaggtcaaagaaggacccccatcggagcattctggcatatcaagaaatgcaatcatattcctggtattgggcatcttagtctttttaatactgctggggattggcatctatttctactggtctaaatgcagccgcgaggtcctgtggcattgccatctgtgcccaagctccacggagcacgcgtccgcatccgccaatggccacgtaagctactctgcagtctcccgggaaaactcctcatctcaagacccccaaaccgaggggacacgatag

SEQ ID NO: 129089 - DNA, 1554 bp, Artificial Sequence
  Description of Artificial Sequence: Synthetic coding sequence
atggcaagaatgggattagctggggcagccggccggtggtggggattggctctaggtctgactgctttttttctcccaggggtgcattcccaggtcgtacaagtgaatgattccatgtatggattcatcggcaccgacgtggtactgcattgttcctttgccaatcccctaccctcagtaaagataacacaggtgacctggcagaagagcacgaacggaagcaagcagaatgtagctatttataatcccagcatgggtgtgtcagtcctcgctccatacagagagcgggtcgagttcttacggcctagtttcacggacggaacgattcgcctgtccagattggaactcgaggatgagggcgtgtacatctgcgagttcgcgacctttccaaccggcaaccgtgaaagccagcttaatttaaccgtgatggcgaagccgacaaattggattgaggggacccaggccgtattacgggctaaaaaagggcaggatgacaaagtactggtggctacctgtaccagcgctaacgggaaacctcctagtgttgtttcctgggagacacgattaaagggcgaagcagagtaccaagagattagaaacccaaatggaactgtcaccgtcatctctagataccgcctagtgccaagccgcgaagcgcaccaacagtccctggcctgcattgtcaactatcacatggatcggtttaaggagtctctgaccttgaatgtgcagtacgagccagaagtgaccattgagggctttgacggaaactggtacctgcagaggatggatgttaaactgacttgcaaagctgacgcaaatcctccagccacggaataccactggaccacgttaaacggctcactgcctaagggggtggaagctcaaaaccggaccctgtttttcaaggggcctatcaattattctctggctggcacttacatctgtgaagccactaaccccattggtacaagaagcggccaagtagaggtgaatatcaccgagtttccctacacgccaagccctcccgaacatggcagaagggctggcccggtccccacggccatcataggtggcgtagctggttctatactgcttgtcctcattgtcgttggcggcattgtggtggcattgcgccgcaggaggcacaccttcaagggggactattcaaccaagaagcacgtctacggaaatggttactcaaaggcagggatccctcaacatcatccccccatggcgcagaacctccagtaccccgacgatagcgatgatgagaaaaaggccggcccattaggcgggtcctcttatgaagaagaagaggaggaggaggaaggaggtgggggaggcgagcggaaagttgggggaccacaccctaagtatgacgaggacgctaagagaccctactttacggtggatgaggctgaagcccggcaagatggatatggcgatcgcaccctcggttatcagtatgatccagaacaactggaccttgctgaaaacatggtgagccaaaatgatgggtcctttattagtaaaaaggagtggtatgtgtag

SEQ ID NO: 129090 - DNA, 1059 bp, Artificial Sequence
  Description of Artificial Sequence: Synthetic coding sequence
atggcccgaatgggcttggccggggcagctggccggtggtggggtctggctctggggcttacagccttttttcttcctggagttcactctcaggtggtccaagtaaacgactctatgtacgggtttataggcaccgatgtggtgctccattgctcctttgcaaaccctctgccctcagtgaaaatcacccaggtgacctggcagaagtcgactaatggatcaaagcagaatgttgcaatctacaatccttcgatgggagtaagcgtgctcgctccataccgcgagcgcgtggagttcctacggcccagctttaccgacggtaccattaggctgtcccggctggagttggaggatgagggcgtatatatttgcgagtttgcaacttttccaactggcaatcgggaatcacagctcaacttgaccgtgatggccaaacccacgaattggatcgagggaacgcaggccgtcctaagggctaaaaagggccaggacgacaaggtcctcgtggccacgtgtacaagcgctaatggcaagccgccaagcgtggttagttgggaaactaggcttaagggcgaggccgaatatcaagagatcagaaacccaaacgggacggtgactgtaatctctaggtacagactcgtaccgagccgcgaggctcaccagcagtccctcgcttgtatagtcaactaccacatggacagatttaaggagtctctgactttaaatgtgcaatacgaaccagaagtgacgatagagggcttcgacggaaattggtatctacagcggatggatgtaaaattgacatgtaaggcagatgccaacccgccagccaccgagtatcattggacaaccctgaatgggtcactaccaaaaggggtggaggctcagaacagaaccttattcttcaagggacctattaattacagcctggccggcacttatatctgcgaggcgacaaatccgataggaaccagatctggccaggttgaagtcaacatcactgcattttgtcagttaatctaccctggaaagggcagaacccgggctaggatgttctag

SEQ ID NO: 129091 - DNA, 1377 bp, Artificial Sequence
  Description of Artificial Sequence: Synthetic coding sequence
atggcgagaatgggattggcaggtgccgcgggacgatggtgggggctcgctcttggcctgactgcattttttctgccaggagtgcattcccaggtggttcaagtgaatgactcaatgtatggttttataggtactgacgtggtgctacactgtagcttcgctaatccactgccttccgtgaagatcactcaggtgacgtggcagaagagtactaatggcagcaaacagaatgtagcaatctacaacccctcaatgggcgtgtcggtcctggctccctacagggagagagtagagttcctgaggccttcctttacagacggtaccatccggttgtctaggctcgaactggaagacgaaggtgtctacatctgcgaattcgcaacttttcctacaggcaaccgggagagtcagctgaacctaacagtgatggccaagcccactaactggatagagggtacccaggctgttctcagagctaaaaaagggcaagacgataaggtcctcgtcgccacttgtacatccgcaaatggcaagccaccctctgtggtcagttgggaaactcgcctgaaaggagaggccgagtatcaggagatccgaaatccgaacggtacggtaaccgtgattagccgctacaggcttgtccccagccgagaggctcatcagcaatcccttgcttgcattgtaaattaccacatggatcgattcaaggagagtctaaccctgaacgtccagtatgaaccagaggtgaccatagagggttttgatggcaattggtaccttcagaggatggacgtcaagttaacttgcaaggccgatgccaacccgcccgccaccgagtaccattggactactttgaatggcagcctgcctaaaggggtagaagctcaaaatcgcactcttttttttaaaggacccatcaactattctttagccggcacctacatatgtgaggccaccaacccaatcggaacccgcagtgggcaggtggaggtgaacataactgaaaagccgaggccccagcggggactgggatccgccgccagattgctggccggaaccgtggccgtgtttctgattctggtggctgtgcttaccgtcttcttcctgtacaacagacagcaaaaatctcccccagaaaccgatggtgcaggtacggaccagcccctaagccagaagcccgagccttctccttccaggcagtcctcccttgtgcctgaagacatccaggtcgtgcatctcgaccccggaaggcaacagcaacaggaagaagaagacctgcagaaactgagcctgcagcctccctactacgatttaggtgtaagcccctcatatcatcccagcgtgcgcacaacggaaccaagaggagaatgcccgtag

SEQ ID NO: 129092 - DNA, 1617 bp, Artificial Sequence
  Description of Artificial Sequence: Synthetic coding sequence
atggccagagccgccgcattactaccatcccggtcaccgccaactcctttgctctggcctctcctgcttctcctactgttagaaacaggcgcacaggacgtgcgggtgcaagtcctgcctgaagtgcgtggtcaactcggaggtaccgtcgagctcccctgccacctcctgccccctgttccaggcctgtacatctctctggtgacatggcagaggcctgacgctccagccaaccaccaaaacgtagctgcattccatcccaagatgggtccaagtttccccagcccgaagccaggaagcgagagactgtcctttgtttcggctaaacaaagtactggacaggacacagaagccgagctgcaagacgctactcttgcactccatggtttaacggtcgaggatgaaggaaactacacgtgtgaatttgctaccttccctaaggggtctgttaggggaatgacctggctgagagttatcgcaaagcctaagaatcaggcagaggcacagaaagtcacgttcagccaagatcccacaacagtggcgttatgcatctccaaagagggaagaccacccgcaaggatttcttggttatcaagcctcgattgggaggccaaggagactcaagtgtccggaaccctcgccggaactgtgaccgtcacatcccgcttcacgctggtccccagcgggcgggcggacggagtcaccgtcacttgcaaagtggaacacgagtccttcgaggagcctgccctaattcctgtcaccttgtccgtgcggtacccccctgaagtttctattagcgggtatgacgataactggtacctgggcagaactgacgcaacactgagttgtgacgtgagaagcaatcctgagccgacaggctatgattggagcactaccagcggcacatttccaactagtgccgtggcacaaggcagccaactggtaatacatgcagtggacagcttattcaacaccacattcgtgtgtacggtgaccaacgctgttggcatgggccgggctgagcaggtaatattcgtacgcgagacaccgaataccgctggcgcgggggcaactggcgggatcatagggggcatcatagcagcgatcatcgccactgcagtggccgccaccggaatcctgatctgtcgccagcagaggaaggaacagacgctccaaggcgcagaggaagatgaggaccttgagggacccccctcctacaagcccccgacccccaaagccaagctggaggctcaggaaatgccatcccagcttttcacccttggcgcctcagagcattctcctttaaaaaccccttactttgacgcgggagcttcttgcaccgagcaggaaatgccacgatatcacgaactgccaacactggaagaaaggtctggacctttgcatcctggggccaccagtctcggaagcccaatacccgtgcctcccggaccacccgccgtggaggacgtttccttggaccttgaggacgaagaaggcgaggaggaggaagagtatctcgataagattaaccccatatacgatgcactctcctattctagtccttccgacagctaccaggggaaaggattcgttatgtctcgggcgatgtatgtgtag

SEQ ID NO: 129093 - DNA, 1440 bp, Artificial Sequence
  Description of Artificial Sequence: Synthetic coding sequence
atggcacgcgcagctgccctgttgccgagtagatccccccccactccgctgctgtggccactcctgttgctgctcctgctggagacaggtgcccaggatgtccgggtccaagtgctgcccgaggtgaggggacagcttggcggtactgtggaactgccctgtcatctgttgcctcccgtcccaggtctctatatatccctggtcacatggcagcggcctgacgctcctgccaatcaccagaacgtggcggctttccaccctaaaatggggccatcatttccgagtcccaaaccagggagtgaacgcttaagttttgtaagtgccaaacagagcacagggcaggacactgaggcagaactgcaggatgctacgctggctctgcacggtttaaccgtcgaggacgagggaaactatacatgcgaattcgcaactttcccgaaaggttctgtaaggggcatgacgtggttgcgcgttattgctaaacctaaaaaccaggcagaagctcagaaggtgacctttagtcaggaccccacaacagtcgccctttgcatttcaaaggagggccgccctcccgctaggattagctggttatcgtccctagattgggaggctaaggaaacacaggtgtccggcacactggccggcacagtgacagtgacctctagatttactctcgtgcccagcggaagggccgatggcgtgaccgtaacgtgcaaggtagagcacgagagtttcgaagaacctgcactcattcccgtgacactttccgtgcggtaccccccagaagtttccatcagtggttacgacgacaattggtatcttgggcgaacggatgctacgctaagctgcgatgtcaggtctaaccctgaaccaacagggtacgattggagcaccacgtctggaacatttcctacttcagcggttgcccagggttcacagctcgtgatccatgccgtggactcgctattcaacacgacctttgtatgcaccgtaactaacgctgtggggatgggacgcgccgagcaggtgatatttgtgcgggagactcccagagcttcacctcgcgatgtgggtcctctcgtatggggagcagtgggtggcaccctattagtgcttttactgttagccgggggctcactggcgttcatcctgcttagggtacgccgtagacgaaagtcgccgggcggggcggggggaggagcttcaggagacggagggttctacgacccaaaggcacaggtgctggggaacggcgaccccgtgttttggactcctgtggtaccaggccctatggagccagacggtaaagacgaagaagaagaggaggaggaggagaaggctgagaaaggcttaatgctgccacctccacctgctctggaagacgacatggagagccagctcgacggtagtctgatcagtcggagagcggtgtatgtgtag

SEQ ID NO: 129094 - DNA, 1101 bp, Artificial Sequence
  Description of Artificial Sequence: Synthetic coding sequence
atggctaggaccttgcgaccatcccccctctgcccaggggggggcaaggcccagctctcaagcgcctcccttttgggggctgggctgctactgcagccccccacaccccccccgttactgctgctgctcttcccacttctgctgttctccaggctgtgtggagcactagccggacccatcatcgtagaaccccacgtgaccgccgtgtggggcaagaatgtgtcactgaagtgtctgatagaggtgaacgagaccatcactcagatcagctgggagaaaatccacggaaaatcttctcagacggtcgctgtccaccatccacagtatggtttttcggttcagggagaatatcagggtcgagtgctgttcaaaaattatagcctgaacgatgctaccataactttgcataacatcggattttcggacagcggtaagtacatctgcaaggctgttactttcccactcggaaacgctcagtcttctactacagtgacagtgttggtcgagccaactgtaagcttgatcaaggggcctgactcactcatagacggtggtaatgagacagtagctgctatttgtatcgccgctaccggaaagccagtggcgcatatagactgggagggtgacttgggagaaatggagagcacaactacctccttccccaacgagactgccaccataatcagccagtacaagctgttccccacaaggttcgcgagaggtcggcggataacatgcgtcgtgaagcatcctgccctggaaaaagatattcgctattctttcatcctggacatacagtatgcccctgaggtgtcggtgactggatatgacggcaattggtttgtggggcgcaaaggagtgaatttaaaatgtaatgccgatgccaatccccctccttttaagagtgtgtggtcccgcctggatggtcagtggccggatggacttcttgcctccgacaacaccctccactttgttcatcccctgacgttcaactatagcggagtgtacatttgtaaggttaccaatagtctgggccagaggtctgaccagaaagttatctacatttccgcatacaatagtgtggcaagtctgaactgttag

SEQ ID NO: 129095 - DNA, 1650 bp, Artificial Sequence
  Description of Artificial Sequence: Synthetic coding sequence
atggcccgcacactgcgaccctccccattgtgccctggcggtgggaaggcgcagttgagcagcgccagtctgctgggcgctgggctgcttttgcaaccgcccaccccacctccgctgcttctgctactgttcccgttgttattattttcccggttgtgcggcgctctggctgggcccattatcgttgagccccatgtcacagctgtttggggcaagaatgtttcattaaagtgtctgatcgaggtgaacgaaaccataacccagatttcctgggaaaaaattcacggcaagtcgtcccagacagttgcagtgcatcaccctcagtacggcttctcggtacagggggagtatcaaggcagagtgctcttcaaaaactactccctaaacgacgcaaccattacattgcataacattggcttctccgactctgggaaatatatctgtaaggccgtgactttccctctgggaaatgcccagtcatccaccactgtcacagtcttggtagaacccacggtgagtctgattaaaggccctgacagcctgatcgacggtggcaatgagaccgtggctgcaatttgcatcgctgccacaggcaaacccgtagcccacatagactgggagggggatttgggggagatggagtctaccaccacatccttcccgaatgagaccgcgaccatcatctcacagtataaactcttccccacaagatttgctcgcgggagacgcattacttgtgttgtgaaacatcccgcactggaaaaggacattagatattccttcatcctggatattcagtatgcgcctgaagtgagtgtgactggatacgacggcaattggttcgtgggtaggaaaggggtgaatctgaagtgcaatgcggatgccaaccctccacccttcaagagtgtctggagtagacttgacgggcagtggccggacgggttgcttgctagcgataatacactgcacttcgtccaccccctgacctttaactacagtggagtctatatatgcaaggtgaccaattccctggggcagcggagtgatcagaaagtgatatatatctcagaccctccaacaactaccacattgcaaccaactattcagtggcatcctagtactgctgatatcgaagacctcgcaactgagccaaaaaagttaccatttcccttaagcacactggctacaatcaaagatgatacaatcgcaacaatcatcgcatccgtcgttgggggtgccttgttcatcgttctagtcagtgtcctggccggcattttctgttatcgccgcagacgaacattcagaggcgattattttgctaagaactacatacccccctctgatatgcagaaggaatcacagatcgatgtcctacaacaggacgagctcgattcataccccgattccgtcaaaaaggaaaacaagaatccagtgaacaatctaattcggaaagactacctggaagagccggagaagacccagtggaacaatgtcgaaaatctgaaccgattcgaacgacctatggattattacgaagatctgaagatggggatgaaattcgtctctgatgagcactacgatgagaacgaagacgacctagtctcccacgttgacggttccgttatcagtcggcgggagtggtacgtgtag

SEQ ID NO: 129096 - DNA, 1464 bp, Artificial Sequence
  Description of Artificial Sequence: Synthetic coding sequence
atggcggagggatggagatggtgtttcgtcagaagaacaccagggttattaagagggccactcctccctaggtctttctccggaaatcctcgcgcactggctgggccaattatcgttgaaccccatgtcaccgctgtgtggggtaaaaatgtgtctctgaagtgcctgattgaggtgaacgagactatcacccagatatcctgggaaaagattcatggcaaatcctcccagaccgtggccgtccatcatccccagtacggcttttctgtgcagggtgagtaccagggccgagttctgtttaaaaattattcactaaatgacgcgacgatcaccctgcacaacatcgggttctccgacagtgggaaatacatctgcaaggccgtgacattcccgcttgggaacgcccagagcagtacgactgtcactgtgctcgtagagcctactgtgagtctgattaaaggtcctgattcgctgattgacggtggcaatgagacagtcgccgcaatttgcatcgcggcaacaggcaaaccagtggcacacatagattgggagggcgacctgggcgagatggagagcaccactacatccttccccaacgagactgctacgataatatcgcagtacaagctgtttcctacacggttcgcacgggggcgtcggatcacatgcgttgtaaaacatcccgccctggaaaaggacatccgatactctttcatccttgatattcagtacgctcctgaagtgtcagtcacagggtacgacggtaactggttcgtgggcaggaaaggtgtgaacttgaagtgcaatgctgacgcaaatccgccacccttcaagagcgtgtggtcgaggttggacggacagtggcccgatggcctgcttgccagcgataacaccctgcacttcgtgcatcctcttacctttaactactctggcgtgtacatctgcaaggtgacaaactctctcggacagcggtctgatcagaaagtgatctatatttccgacgtgcccttcaaacaaacaagcagcatagcggttgccggggccgtaatcggtgctgtactcgcactttttatcatagctatctttgtgaccgtcttgctcacaccgaggaagaagaggccttcatatttagataaggtgattgatctgccccccacccacaaaccacctccgctatacgaggaacgcagtccacctttaccacagaaggacttgtttcagcctgagcatttgcctctgcagacccagttcaaggagcgcgaagtcggcaacttgcagcattccaatggcctcaattcccggtccttcgactatgaagacgaaaaccccgtgggagaggatggaatccaacagatgtatcctctctataaccagatgtgttatcaagatcggagtcccggtaagcaccaccagaataacgatcccaagagggtgtatattgatcccagagaacactacgtgtag

SEQ ID NO: 129097 - DNA, 1533 bp, Artificial Sequence
  Description of Artificial Sequence: Synthetic coding sequence
atgcctctttccctgggcgcagaaatgtggggcccggaagcttggctcctgctacttttgctgctcgccagtttcacaggccgctgtccggccggcgagttagagacatcggatgtggtgactgtggtgctggggcaggacgcaaaactgccatgtttctaccgcggcgactcaggcgagcaggtcggacaggtggcctgggcaagagtcgacgctggcgaaggcgctcaggaacttgcactgctgcactccaagtacggccttcatgtgtcacctgcgtatgagggtagagtagaacagccacctccccccagaaatcctctcgacgggtcagtgctgctccggaacgcagtgcaggccgatgagggcgagtacgaatgccgagtaagtacttttcccgccggctcattccaggcccgtttgcgcctgagagtcctcgtgccaccattgcccagcctaaatcctggacctgccctggaggagggtcagggccttacactcgcagccagttgtacggctgaggggtcgcccgcaccatccgtaacatgggacacggaggtgaaaggtaccaccagtagtagaagcttcaaacattcacggagcgctgcagtcacaagcgagtttcacctggtgccttcaaggagcatgaacggacagccactgacttgtgtggtgagccatccagggcttttgcaagatcagcgtatcactcatatcctgcacgtttcatttctcgccgaggcatctgtgcggggactggaagatcagaatctgtggcacataggtagagagggcgctatgctgaagtgtctgtccgagggccagccacctccttcctataattggacccgactggacgggcccctccccagtggcgttcgtgtcgatggagatacgctgggattcccgcccctgacaacggagcactctggcatatatgtctgtcacgtgtcgaacgagtttagcagcagagacagccaggtgactgttgatgtcctcgatccccaggaagattccggaaagcaggtcgatttggtctcagcgagcgtggtcgtggtcggagtaatagccgcccttctgttctgtctgctggttgtcgtggtggtcctcatgtctagataccaccgacgaaaagcgcaacagatgactcagaagtatgaagaagagctcactttgacacgggagaattctataagacggcttcatagccaccatacagaccccagatctcagcccgaagagtccgttgggctgagggcagaaggacaccctgattctcttaaagacaactcttcatgttctgtcatgagcgaggagcccgagggccggtcctatagcaccctgacaacagtgcgagagatcgagactcaaaccgaattgctaagcccagggagcggccgggctgaagaagaggaggaccaagatgaggggatcaagcaagcaatgaatcattttgtgcaggagaatggtactcttcgcgcaaagccaaccggcaacggaatatatatcaatggcagaggccacctcgtgtag

SEQ ID NO: 129098 - DNA, 660 bp, Artificial Sequence
  Description of Artificial Sequence: Synthetic coding sequence
atgttgaaatgccttagcgagggtcagccaccccccagctacaattggaccaggcttgacggccctttgccttctggagtacgggtggatggggacaccctcggatttcctccgctcaccaccgaacacagcggcatttatgtctgccacgtcagcaacgaatttagttcccgtgatagtcaagtaacagtcgatgtgctggatccccaggaggactcagggaaacaggtggacctggtttccgcctcggtcgtggtggtgggggttattgctgcactgctgttctgtctactggtggtagttgtggtacttatgtctagataccataggcgaaaggcccagcaaatgacacaaaaatacgaggaggagctcacacttaccagagaaaattccatccgccgcctgcactctcatcatacggatccccgctcccaatcagaggagccagaaggccgttcctacagcacactgacaactgtgcgggaaattgagactcagaccgaactgctgagtccaggctctggaagagccgaggaggaggaggatcaggacgaagggattaaacaagccatgaaccacttcgttcaagagaatggcactctgcgggctaagcctacggggaacggcatctatatcaacggccgcggacacttggtctag

SEQ ID NO: 129099 - DNA, 2058 bp, Artificial Sequence
  Description of Artificial Sequence: Synthetic coding sequence
atggagctgctgaggacgattacgtaccagcccgcagcatcaactaagatgtgcgagcaggcattagggaagggttgcggcgctgatagcaaaaagaagaggcctcctcagccgccagaagagagtcaacccccacagagccaagctcaagtccctcccgcagctccacatcaccatcatcatcacagtcattcaggcccggaaatttcgcgcattattgtggacccaactacagggaaaaggtattgtaggggtaaggttcttggtaaaggaggtttcgccaaatgttacgaaatgaccgacctgaccaataacaaagtctatgccgctaagattatcccacattctagggtcgctaaaccccatcagagggagaagatcgataaggagattgagttacatagaatcctccatcacaaacacgtcgtgcagttctaccattacttcgaggataaagagaacatatatatactccttgagtactgtagcaggaggtctatggcccatatcttaaaagccagaaaagttcttaccgagcccgaagttaggtactacctacggcagatcgtgtccggcctcaagtatctgcatgagcaggaaatcctgcaccgcgatctgaagctcggcaactttttcattaacgaggcaatggagctgaaagtgggtgactttgggctggccgcgaggctcgaacccttggagcatcgccgacgaacaatttgtggtacacccaattacctgtcccctgaggtgttaaacaaacagggacatggctgcgaaagcgacatatgggccctggggtgcgtcatgtacactatgctgctggggaggccccccttcgagactacaaacctgaaagaaacttacaggtgtatcagagaagcacggtacactatgccatcgtcgcttctcgccccagccaagcacctcatcgcttccatgttgtcaaagaatcctgaagaccgaccttcattggatgacataatcagacatgacttttttctgcaaggattcacccctgaccgcctgtccagttcttgttgtcatactgtgccagatttccacttgtcttctcccgctaaaaatttcttcaaaaaggcagccgccgccctgtttggaggaaagaaggacaaggctaggtacatagatactcacaatagggtgtctaaagaagatgaagacatctataagctacgccacgacctgaaaaagacttccattactcagcagccgagtaaacaccgaacagatgaggagttgcagccacccacaactacagtggcacgttccgggacccccgctgttgagaacaagcagcagatcggcgacgccatcagaatgattgtccggggcacactggggagctgttcatctagctcagagtgtctagaagacagtaccatgggttcagttgctgatacagtcgcacgtgtgctaagaggatgtctggagaacatgcccgaagccgattgcatccccaaagagcaattgtcaacctctttccagtgggtgactaagtgggtggattatagtaacaagtacggatttggataccagctctctgaccacactgtgggcgtgttgtttaacaacggcgcccatatgagcttactgcctgacaaaaagacagtgcactattacgcagaactgggtcagtgctccgtttttcctgcaaccgacgccccggaacagttcatctctcaagtaacggttctgaaatatttcagtcactacatggaagagaatctcatggacggaggcgacttgccttctgttactgatattcgcaggccacgtctgtatctgctgcaatggcttaaaagtgacaaggccttgatgatgctctttaacgatgggacatttcaggtgaatttctatcatgaccacacaaagatcattatctgtagtcagaacgaagaatacctgttaacctacattaacgaagaccgaatcagcactaccttccggctgactaccttgctgatgagtggctgctcctccgagctgaagaaccggatggaatatgccctaaacatgctgttgcagaggtgtaactag

SEQ ID NO: 129100 - DNA, 1164 bp, Artificial Sequence
  Description of Artificial Sequence: Synthetic coding sequence
atggaactccttagaactatcacttatcaacctgccgcatccaccaagatgtgcgagcaagcactgggaaagggctgtggtgccgactccaaaaaaaagcggccgccacagccgcctgaagagtctcagcctcctcaatcccaggcccaggtccccccggaaatcagcagaatcattgtggatccaactactggcaagaggtattgcagaggaaaggtgctcggtaaagggggctttgcaaagtgttatgagatgaccgatctgacaaacaacaaagtatacgccgctaagataattccacactcacgggttgccaagccgcaccaaagggaaaagatagacaaggaaattgaactacatagaattctgcaccataaacacgtggtgcagttctaccattacttcgaggataaggagaacatttatatcctgctggaatactgctcgcgtagatccatggctcatatcctgaaagcgcggaaggttctaaccgagcccgaggtccggtattatctgaggcagattgtgtcaggcctaaaatacctacacgagcaagaaattctgcaccgcgacctgaagctagggaattttttcattaatgaggctatggagctaaaggttggcgattttggcctcgccgcccggctagaacctttggaacatcgcagaaggacgatttgtggaactcctaactatctttccccagaggtcttgaataaacagggccacggctgcgaatccgatatttgggctttaggatgtgtgatgtatacgatgttgctgggtagacctccattcgagaccactaatcttaaggagacatatagatgcatccgggaggcgagatatacaatgcccagctcgttgctcgctcccgcaaagcacttaatcgcctccatgctttccaagaaccctgaggatcggccgtctctcgatgacattattcgccacgacttcttctgcagggcatccttacgtaccgattgcctgctggccgttgtgatccaatttcagatctctacataccaagcccagctacgcatcagcctcagaaaacagctgctcctctttttggtcgccaagaaaaccaagcaggatattcttacgcacatcattgagtgtttaaaaaagatgaaaactagcacatcattgggtatgatatag

SEQ ID NO: 129101 - DNA, 1140 bp, Artificial Sequence
  Description of Artificial Sequence: Synthetic coding sequence
atggaacttctaaggacaataacttaccagccagctgcctctactaaaatgtgcgaacaagctttgggtaaagggtgcggagcagactctaagaagaaacggccaccacagccccccgaggagagtcagcccccacaaagccaggctcaggtcccccccgccgccccccaccaccatcaccaccattcacattcaggccccgaaatcagtcgtataatagttgaccctacgactggtaagagatattgtcggggaaaggttctcggaaagggaggattcgccaaatgctacgagatgaccgatctgacgaataacaaagtctatgcagctaaaataattccccactctcgggttgccaaacctcaccagagggaaaagatcgataaggaaatcgaactgcacaggattttacatcacaagcacgtggtgcaattctaccactacttcgaggataaggaaaatatatacatattgttagagtactgctcgagaaggtctatggcacatatcttaaaggcacgcaaagtgctcacagaacccgaggtccgttattacctaaggcagatcgtatcgggattaaagtaccttcatgagcaagagattctgcatcgggacctgaagctgggtaatttcttcataaacgaggctatggagctgaaggtaggagattttgggcttgccgctagacttgagcctctggaacacagaagacggacaatttgcggcactccaaattacctgagtcctgaagtgctgaacaagcaaggccacggctgtgagtcagatatttgggcactgggatgcgttatgtataccatgctgctggggcgcccccccttcgaaacgacgaacctcaaggagacttatcgatgcatccgggaagctcggtatacaatgccctccagtcttctcgctcctgcaaagcatttaattgctagcatgctctctaagaatcccgaagatcgtcctagcctcgatgacattatcaggcatgacttctttctccaaggtttcactccagaccgtctgtcttcttcgtgttgccacactgttcccgattttcacctcagcagccccgccaagaatttttttaagagagccgcggagcatatcatctcagtcggacaccagatgggctag

SEQ ID NO: 129102 - DNA, 1476 bp, Artificial Sequence
  Description of Artificial Sequence: Synthetic coding sequence
gtagatctcctgcgagctggcgaggttccaaagccattccccactcattacaaggacctgtgggacaataagcatgtcaagatgccctgtagtgagcagaacctttaccctgtcgaagatgagaatggggagaggacagcgggctcccgctgggaactaatccagacagcgctcctcaataaatttacacgaccccagaacctgaaggacgctattttaaaatacaacgttgcttactccaagaaatgggactttacagcgctgatcgacttctgggataaggtcctcgaggaggcagaagcccagcatttgtatcaatctatactcccagatatggtgaaaatcgctctgtgtctgcctaacatttgcacccagcccattcctcttctgaagcagaaaatgaaccactccataaccatgagtcaagaacagattgcgagtctcttggccaatgccttcttctgcacctttccgagacggaacgccaaaatgaagtcagagtactcatcctatcccgacattaacttcaacagattgttcgagggacgctctagccgtaagcccgaaaaacttaagaccttgttctgttactttaggagagtcacggagaagaagcccaccgggttggtcacgtttacccgtcaatccctcgaggatttccctgaatgggagcgttgcgagaaacctttgacacgcctgcacgtgacttacgagggcacaattgaggaaaacgggcaggggatgttgcaggtcgacttcgcgaataggtttgtgggagggggagtgacctcagcgggcctggtgcaggaagagattcgcttcctaattaatcccgagcttatcattagccggctgttcacagaggtgttggatcacaatgagtgtctgattatcaccggtaccgagcagtactctgagtatactggctacgcagagacgtatagatggtccagatcccacgaagatggatcagagcgagacgattggcaacgcaggtgcacagagattgtggcaattgacgccctgcacttcagacgatatctcgaccagttcgtgcccgagaagatgcggcgagagctgaataaggcgtactgcggctttctaagacccggcgtctcttctgaaaatctttcagctgtcgctaccgggaattggggatgtggcgcctttggcggcgatgcacgtctgaaggcccttatccagattctggccgcggccgcagctgagagggatgtggtgtacttcacttttggggacagcgaattgatgcgagatatctattccatgcacatcttcctcactgagagaaaactgacggtgggggatgtatataaattactgctgcgctattataatgaagagtgcaggaattgttcaacaccaggtcccgatattaaactctacccttttatctatcacgcagtggaaagttgtgcagagaccgccgaccattccggccagagaaccggaacctag

SEQ ID NO: 129103 - DNA, 579 bp, Artificial Sequence
  Description of Artificial Sequence: Synthetic coding sequence
taaaccgaacagtattctgaatatacagggtatgctgaaacatatcgctggtctcgctcacacgaagacggttccgagagagatgattggcagaggcggtgtaccgagattgttgctatagatgccctgcacttcagacgctacctcgatcagttcgtaccagaaaagatgcgcagagaactgaacaaagcatactgtggcttccttcgacccggagtgagcagcgaaaacctgtcagccgtagctactggcaattgggggtgtggagctttcggcggggacgctcggctcaaggccctcattcagatactcgcagccgccgctgccgagagagatgtcgtgtatttcaccttcggggacagcgaactgatgcgggatatatactctatgcacatctttttaactgaaaggaaactcacggttggggatgtttacaagctactgctaagatattacaatgaggaatgccgaaattgctctacgccggggcctgacattaagctgtacccctttatataccacgccgttgagagctgtgccgagactgcggatcatagtggccagcggacgggcacatag

SEQ ID NO: 129104 - DNA, 468 bp, Artificial Sequence
  Description of Artificial Sequence: Synthetic coding sequence
atggctgagagctccgacaaattatatcgggtggagtacgctaagtcgggccgggcttcctgcaagaaatgctctgaatcgattccaaaggattctttgagaatggccattatggtgcagagccctatgttcgacggcaaggtccctcattggtatcacttttcgtgcttttggaaagtaggccatagcattagacaccctgacgtggaagtcgatggattcagtgagcttcggtgggatgatcagcagaaggttaagaagacagccgaagctgggggcgtgactggagtctatatcctcgggcagcatgggcattctgcccctactctgaaactgcccgggggccccaggctccgggagcagtccaagcctcctccggcgtgtcctttgcctcatgtgcaaatcaagaggatggtacctatgctgttccagcaacacctgcttgattccgccagcagtgttgcatag

SEQ ID NO: 129105 - DNA, 327 bp, Artificial Sequence
  Description of Artificial Sequence: Synthetic coding sequence
atggcagagtctagcgacaaactgtatagagtagaatacgccaagtccggaagagcatcctgtaagaagtgtagtgaatctatcccaaaggatagtcttcgtatggcgatcatggtacagagcccaatgttcgacgggaaggtcccgcactggtaccatttctcgtgtttctggaaggtggggcatagtattcgacacccagacgtggaggtcgacggtttctccgagttacgttgggatgaccaacagaaggtcaagaaaacggccgaagccggtggagttaccgagcctcctatcccatgcggtattgaagtcatgggacgctag

SEQ ID NO: 129106 - DNA, 327 bp, Artificial Sequence
  Description of Artificial Sequence: Synthetic coding sequence
atggccgagtcctcagacaaattgtatagagttgagtacgccaagtcgggtcgcgcgagttgcaaaaaatgcagtgagtcgattccaaaagacagtctgcggatggccatcatggtgcagtcccctatgtttgatggcaaagttccacactggtaccatttcagctgcttttggaaggtcggtcattccatacggcatcctgacgtcgaagttgacgggttctctgaactgagatgggatgatcagcagaaagttaagaaaacggctgaggccggcggtgtgactgaaccaccaatcccgtgcggcatcgaagttatgggcaggtag

SEQ ID NO: 129107 - DNA, 3045 bp, Artificial Sequence
  Description of Artificial Sequence: Synthetic coding sequence
atggccgaatcctctgataagctgtaccgcgttgagtatgccaagagcgggagagcatcttgtaagaaatgttctgaatctatcccaaaggattcccttcggatggccattatggtacagtccccaatgttcgatggcaaagtcccacactggtatcactttagctgcttctggaaggtgggacattctatccggcacccggacgtagaagtagacggcttctccgagcttagatgggatgatcagcagaaggtgaaaaagacagccgaggctggtggggtaactggaaagggtcaggacggaatcggcagtaaggcagaaaaaaccctgggggactttgcggctgagtatgctaagtctaatcgcagcacctgcaaaggctgcatggagaagatcgaaaaagggcaagttcgtctttcaaagaaaatggtggaccccgaaaaacctcagttgggaatgatcgacagatggtatcaccccggctgttttgttaaaaaccgcgaagaattgggcttccggcccgaatatagcgcctcgcaactgaagggcttttccttgctcgcaaccgaagataaagaagccttaaaaaaacagcttcccggtgtaaagtccgaagggaagcgcaaaggtgatgaggtggatggagtcgacgaagtagctaagaagaagagcaaaaaggagaaagataaggattcaaaactcgaaaaggcactcaaggcccagaatgacctcatctggaacatcaaggatgaactgaaaaaagtgtgcagtaccaatgacctgaaagagctcttgatatttaacaagcaacaggtccctagcggagaaagcgccatcctggatcgcgtcgccgacggcatggttttcggtgctctgttgccatgtgaagagtgtagtggccaattagtattcaaatcagacgcatattactgcactggtgatgtcacagcgtggacgaaatgcatggtgaagacacagacaccgaaccgaaaagaatgggtgacccccaaagagtttcgcgagatctcatacctgaaaaaactgaaggttaagaaacaggatcgcatttttccacctgaaacttcagcttcagttgccgccacacccccccccagtactgcctcagctcctgccgcagtcaacagttccgcttcagcggataagccactatcgaacatgaagatcctgacactgggtaagctctcgagaaacaaggacgaagtcaaggccatgatagagaaattgggagggaagctcaccgggactgcaaataaagcatctctttgcatctcaactaaaaaagaggtggaaaagatgaataaaaaaatggaggaagtaaaagaagcaaatatcagagtggtatcagaggacttcctgcaagacgttagtgccagcacaaagtcattgcaggagttgtttctcgcccacattctctcaccctggggcgctgaggtgaaggccgaaccagttgaggtggtggcaccaagaggcaagagcggcgccgcactttctaaaaagagcaagggccaggtgaaggaggaggggatcaacaagtccgagaagcgcatgaagctaactctcaaggggggcgccgctgtggatcccgattctgggctggagcactccgcacacgttcttgagaagggcggaaaggttttctccgctacactcggcctggttgatattgtgaaggggaccaacagttactacaagctgcagctcctggaggatgataaggaaaatcgatactggattttccggtcctggggacgggttggtactgtgatcggttcaaataagcttgaacaaatgccgagtaaggaggacgccattgaacacttcatgaaactgtatgaagagaagactgggaacgcttggcactccaagaattttacaaagtaccctaagaagttctacccgttagaaattgattacggccaggacgaggaggccgtaaaaaagctcacagtaaatcctggcaccaagtctaaattacccaagcccgtgcaggatctgattaagatgatcttcgatgtagagagcatgaagaaagcaatggtggagtatgagattgacctgcagaaaatgccattgggtaagctgtcaaagcgccagattcaggccgcttactctatcctctcagaggtccaacaggcggtaagccagggctcatccgacagccagatcctagatctgagtaaccgcttctatactctaatcccccatgatttcggcatgaaaaagcccccgctcctcaacaacgccgattcagtgcaagccaaggtagagatgctggacaatctccttgatatcgaagttgcctactccctgcttcggggcggatccgacgatagcagcaaagaccctatcgacgtgaactatgaaaagctaaagactgacataaaagtcgtggaccgggattcagaggaagcagagatcattcggaagtatgtgaagaatacacacgccacaactcacaatgcctacgatctcgaagtcatagacatcttcaagatcgaaagagaaggagagtgtcagcgttataagccattcaagcagttacacaacaggcgccttctgtggcatggcagtcgcacaactaattttgcaggaattctgtcccagggtctgaggatcgcaccccccgaggcccccgttacaggatacatgtttgggaaggggatctacttcgctgacatggtttctaaaagtgccaattactgccatacgtcccagggcgatccgataggcttgatactgttaggtgaggtggctttgggcaacatgtatgaattgaagcacgccagtcatatcagtaagctgcctaaggggaagcatagtgttaaagggctgggaaagaccacgcctgacccgtccgccaacatatctctcgatggggtcgatgtaccgctaggaacaggaataagttccggtgtgaacgatacaagtctcctatataacgagtacattgtctatgatatcgcacaggtgaacctgaagtatcttttgaaattgaaattcaatttcaaaacatctctgtggtag

SEQ ID NO: 129108 - DNA, 753 bp, Artificial Sequence
  Description of Artificial Sequence: Synthetic coding sequence
atggctgagagctctgacaagctctaccgagtggagtatgctaaaagcgggcgcgcctcctgcaagaagtgctctgagtcgatacctaaggattctttgcgcatggcaattatggtgcagtccccgatgttcgatgggaaagtgccccattggtaccattttagttgtttctggaaagtgggtcatagcattcgccatcccgacgtggaagtggacggattctccgaattgcgttgggatgaccagcagaaagttaagaagactgcggaggccggcggcgtgaccggcaagggccaagatggcatcgggtccaaggcagagaaaactctgggcgatttcgctgcagagtatgctaaaagtaacaggtctacatgcaagggctgtatggagaagatcgaaaagggccaggtgaggctgtctaagaagatggtagaccccgagaagccgcagttgggaatgatcgacagatggtatcacccggggtgctttgtaaagaatcgcgaagagctgggatttcggcccgagtacagtgcgtctcagctgaaggggttctctctgttggccacagaagataaggaggctctgaaaaagcagctgcctggcgtaaagagcgagggcaagaggaagggggacgaagtagacggggtagacgaagttgctaaaaagaagtcgaaaaaggaaaaagacaagaagaagaagaagaaaaagaagaaggaacgtaagaagaaaaagaaaaagcggaaaaagaagtag

SEQ ID NO: 129109 - DNA, 2133 bp, Artificial Sequence
  Description of Artificial Sequence: Synthetic coding sequence
atggatttttccatggtggccggcgccgcagcctataatgaaaaaagtgaaaccggcgcactgggtgagaattactcctggcaaatcccgatcaatcataacgatttcaagatattgaagaacaatgaaagacagctctgcgaggtgctgcagaataaatttggatgtatctcaacattagtgtcacccgtacaggaggggaatagcaagtccctccaggtatttagaaagatgctgacgccacgcatcgagctgtcggtctggaaagacgatcttactacccatgctgtcgatgctgtcgtgaacgctgctaatgaggatttgctccacggcggcggccttgccctggctttagtgaaggccggcggattcgaaatacaggaggagtcaaaacagtttgtggctaggtacggcaaggtttccgcaggtgagattgccgtgacaggcgcgggcaggctgccatgcaagcagatcatccatgcagtgggaccacgctggatggaatgggataaacagggttgtacgggaaaacttcagcgggcgattgtgtccatacttaactacgtaatatacaagaacacgcacatcaagacggtagccatacccgccctttcatcgggaatctttcagttcccgctgaatctgtgtactaagactattgtggagacaattagggtcagcttacagggcaaacccatgatgtctaatctgaaagaaattcatctggtttctaacgaagaccctactgtcgccgcctttaaggctgcaagcgaatttatccttgggaagtccgaacttggtcaggagaccacacccagtttcaacgcgatggtagttaacaacctcactctccagattgtacagggccatatcgagtggcagactgccgacgtcatcgtcaactccgtaaaccctcacgatattacagtgggaccagtggccaagtcaatactgcaacaggctggcgttgaaatgaagagtgaatttctggctaccaaagccaagcagtttcagcgcagtcagctggtcctggttacgaaaggcttcaacctgttctgcaaatacatctatcatgtgctgtggcactcagagtttccgaagccccaaattctgaagcacgctatgaaggaatgtctcgaaaaatgtatcgagcagaatattacctctattagtttccccgccctggggaccgggaatatggagatcaagaaggaaacagccgctgaaattttattcgatgaggtgttaacgttcgccaaggaccacgtcaagcaccaattaacagtgaaatttgtcatcttcccaacagaccttgagatttataaggcattttccagcgagatggctaaaaggagtaagatgttatccctgaataattatagtgtcccccagtcaacacgcgaagagaagagagaaaacggcttagaagccaggtctcctgcaattaacctgatggggttcaacgtggaagagatgtacgaggcccatgcttggattcagcgaattctttcactccagaatcatcacataattgaaaacaaccacattctgtacctagggcgaaaagagcatgatatcctgtcccagcttcaaaagacctcgtcagtatcaatcaccgagatcatttctccaggtcgcaccgaactcgagatagaaggggctagagctgatcttatcgaggtcgttatgaacattgaagacatgctatgtaaggtgcaggaagaaatggcccgtaagaaggagcggggattgtggcggagcttggggcagtggacgattcaacaacagaagacccaggatgagatgaaggagaacataatcttcctcaaatgtccagtcccacctacgcaggagctcctggatcagaaaaaacagtttgaaaagtgcggtttgcaggtgttaaaagtggaaaagattgacaacgaagtactaatggcggcattccagcgcaagaaaaagatgatggaagagaagctgcataggcaacctgtgagccacagacttttccagcaggttccgtaccagttctgtaacgtagtgtgcagggtgggttttcagagaatgtattcaaccccttgtggcaggtgtcaatgtctgatcatcggagcaacactctggaacctggtatcttag

SEQ ID NO: 129110 - DNA, 2460 bp, Artificial Sequence
  Description of Artificial Sequence: Synthetic coding sequence
atggattttagcatggtcgccggagcggctgcttataatgaaaaaagtgaaacgggggcactgggtgagaattattcttggcagatccctataaaccataacgacttcaaaatcttgaagaataatgaacgccaactttgcgaggtcttgcagaataaattcggatgcataagcaccctggtgagccctgttcaggaggggaattctaagtctctccaggtgttccgaaagatgctgactccaaggatcgaactttctgtttggaaggatgatctgaccacccatgcagtcgacgccgtggtgaatgccgccaacgaagacctattacacggaggagggttggcgctggccttggtgaaggctggtggcttcgagatccaagaggaaagcaagcagttcgttgcgagatacggaaaggtgtccgcaggggagatagcagtcacaggcgccggtcggttgccctgtaagcagatcattcatgctgttggtccacgttggatggagtgggataagcaggggtgcactggcaaattgcagcgggccatcgtatctatcctgaattacgtaatttataagaatactcacatcaagactgtggccatccccgcattgtcatcagggattttccaatttcctctcaatctgtgcactaagaccattgtggaaaccatcagggtgtctctgcagggcaagcccatgatgagtaatcttaaggagatccacctggtgtcgaatgaagacccaacagtggctgcctttaaagcggctagtgaattcattcttggaaaatctgaactggggcaggagacaactccaagtttcaatgccatggttgtgaacaacttgactctgcagattgtgcaggggcacattgagtggcagacggcagacgtgatagttaactcggttaacccacacgatataactgtgggtccggttgcaaaatcaatactgcaacaggctggcgtggagatgaaatccgaatttctggctacaaaagccaaacagttccagaggtctcaactggtactggtgaccaagggatttaatcttttctgcaaatatatctatcacgtgctttggcattcggagtttcctaagcctcagatactgaagcatgctatgaaagagtgcttggagaagtgtatagagcaaaatatcacaagcataagctttcctgcactgggcaccgggaatatggagattaagaaagagacagcggccgaaatattattcgatgaggtgttgaccttcgccaaagaccatgttaagcaccagctgaccgttaagtttgttattttccctaccgacctcgaaatctacaaagcgttcagcagcgagatggccaagaggagcaaaatgctctcactaaataattactctgtccctcagtcaactagggaggaaaaaagagagaacggtcttgaggctaggtcgcctgccataaatcttatggggtttaatgtcgaggagatgtacgaggcccacgcctggatccagcggatcctgtcgttgcaaaatcaccacattattgagaataatcacatcctgtacctgggtaggaaggagcacgacattttgtcccagctccagaagacctcctctgtgtcaattaccgaaattatcagtcccgggcgcactgagcttgagatagaaggcgctagagccgatctgatcgaagtggtgatgaatattgaagacatgctttgcaaagtgcaagaggagatggcacggaagaaagaaagggggctctggagaagtcttggacagtggactatccagcagcagaaaacccaggacgagatgaaagagaacattatttttttaaaatgccctgtcccgcctactcaggagttgttggaccaaaagaagcagttcgagaagtgtggtctgcaggtgttgaaggtcgagaaaatcgataatgaggtcctgatggcagcttttcagaggaaaaagaagatgatggaagagaaacttcaccggcaacccgtttcccaccggctgttccaacaagttccctaccagttttgtaacgtcgtgtgcagggttgggtttcagcgcatgtacagcaccccctgtgaccccaaatacggcgctggaatctacttcactaaaaacctcaagaatcttgcagagaaggcgaaaaaaatttccgctgccgataagttgatttacgtgttcgaggcagaggtgctgactggctttttctgccagggccaccctctgaatattgtgcctccgcccctgtcccctggtgctatcgatggtcatgactccgtggtggataacgtgtcatctcctgagactttcgtgattttctccggcatgcaggccatcccccagtacctttggacttgtacccaggagtacgtgcaatcccaggactatagctctgggccaatgcggccgttcgctcagcatccatggcgtggctttgcatctggctcaccagtggactag

SEQ ID NO: 129111 - DNA, 2106 bp, Artificial Sequence
  Description of Artificial Sequence: Synthetic coding sequence
atggcccaggctggagtggtcggagaggtcactcaagttctgtgtgccgccggcggggccctggaacttccagagctgcggcggaggctccgtatggggctatccgccgacgccctggagagactgctacgccagaggggccgtttcgtggttgccgttcgtgccggaggtgccgcagccgctccagagcgcgtggtcttagcggcaagccctctgaggctgtgtagagctcaccaaggttcaaaaccaggctgtgtgggactctgcgctcagttgcatttgtgtcggttcatggtgtatggggcatgcaagtttttgcgtgccggcaagaactgccggaactctcacagtttgacgacagaacacaatctgagtgtgctcaggacccacggggtcgatcacttgtcatataatgagttgtgtcagctgttgttccagaatgatccatggctgctgccggagatttgtcagcattacaataaaggagatggtccccacgggtcctgcgctttccagaagcagtgcattaagctacatatctgtcagtacttcctacagggcgagtgcaaattcggtactagttgcaagcgctcacatgatttttctaactccgaaaacctggaaaagctcgaaaaactgggtatgtctagtgacctcgtaagtaggctgccaactatatacaggaacgcccatgatatcaagaataaaagcagcgcaccgtctcgtgttcctccgctgttcgtccctcagggtacaagcgagcgcaaggattcctctggcagcgtgtcacctaacacactgtctcaagaagaaggtgaccaaatttgtctgtaccatattagaaagagctgctcattccaggataagtgccatagggtgcatttccacttgccatatcgatggcaattcctcgataggggaaagtgggaagacctcgataatatggaactaatcgaagaggcctattgcaacccaaaaatagagcgaatactctgctctgaaagcgcgtccaccttccacagccactgcctgaactttaacgcaatgacatatggggcaacacaagcgcggaggctgtctactgcgagctccgtcactaagccgccacacttcatactgacaaccgactggatctggtattggagcgatgaatttggctcgtggcaggaatacggccggcagggaacagttcacccagtcactacggtatctagcagcgatgttgagaaggcctacttagcttactgtactccgggctcagatggtcaggcggccacactcaaatttcaagctggcaaacataattatgaattagatttcaaagcgttcgttcagaaaaatctcgtttacgggaccacaaagaaggtttgccgccgccctaaatacgtcagtcctcaggacgtcactacaatgcaaacctgtaataccaaattccctggcccgaaatcaatccccgattactgggattcatccgccctacctgaccccgggtttcagaaaataactcttagttcctcatctgaagagtatcaaaaagtttggaatcttttcaataggacactgcccttctatttcgtgcagaagatcgaacgtgtccagaacctggcactgtgggaagtgtaccaatggcaaaagggccagatgcaaaagcagaatggtggaaaggcagtggacgaacgacagctgttccatggcacgtcagcaatttttgttgacgcaatctgccaacaaaatttcgactggagggtgtgtggcgtgcacggtacgtcctacggcaaagggagctactttgctagggacgctgcttattcacatcattactcaaagtccgatactcagactcacactatgtttctggctcgcgttcttgtgggtgagttcgtgcgcgggaatgcaagctttgtcaggcccccggctaaggaggggtggtccaatgccttttacgactcgtgtgtgaacagcgtttccgatcccagcatatttgtgatctttgagaaacaccaagtttatcccgagtacgtgattcagtacactacaagttctaaacctagtgttacaccatcgattttgctggcgctgggctctcttttttcatcacgccagtag

SEQ ID NO: 129112 - DNA, 393 bp, Artificial Sequence
  Description of Artificial Sequence: Synthetic coding sequence
atgttcctggcacgtgtgctcgttggcgagtttgtgaggggaaacgcaagcttcgtcagaccacctgccaaggaggggtggagcaacgccttttacgattcatgcgtgaactctgtgtcagaccccagcatcttcgtgatcttcgaaaagactaggagtacccagtcaatgagttctagcacaccaccccctccttctcccaggtctcatcccccttcctgttggccctgggcgccttgttcggcagctgacagcgagagaaccggagtgtttcaggcgttccatctactctgcctagagatggctatatgggccttcccatttttgttcaaacagaaattgctaatgaactgcagcttgaatatcgatctgtctatgaaactctgctcttag

SEQ ID NO: 129113 - DNA, 849 bp, Artificial Sequence
  Description of Artificial Sequence: Synthetic coding sequence
atgagtaagttggcctcctttctgggatttagtaagcagtcgccacaaaagaagaatcatctggttctcgaaaagaagacagagagcgcaacattcagagtttgcggggaaaatgtgacctgtgtagagtacgcaatatcctggctccaagatctgatagagaaggagcaatgtccatacacatctgaggacgagtgcattaaggatttcgatgaaaaggagtaccaggagctgaatgagctgcagaagaagttaaatattaacatcagcctggaccataaacgacctctgattaaggtactggggatttcacgggatgtgatgcaggcccgagacgagatcgaagctatgatcaaacgagtgagactggcaaaggagcaagagtccagagccgactgcatttcagagttcatcgagtggcagtacaacgataataatacatcccactgttttaacaagatgaccaatctaaagctggaagacgcccgtcgagaaaagaaaaaaactgttgacgtgaagataaatcaccgtcattacacggtgaaccttaacacatacaccgccaccgacaccaaagggcatagtctgtccgtccaacgcctgaccaaaagcaaagtggacatcccagctcactggtccgacatgaaacagcagaacttttgcgtcgtggagctcctcccctccgaccctgaatacaacaccgtggcttcaaagttcaaccagacatgctctcactttagaatagaaaaagtgaatgttatgatcagggcctgttcgccatcctactgggaagccgaggttgagggtttgcatgagcccaggtcactcacaccagtgtgggtgacctag

SEQ ID NO: 129114 - DNA, 2394 bp, Artificial Sequence
  Description of Artificial Sequence: Synthetic coding sequence
atgtacttgaggcgcctgttgcgccccctacagatgctgctggtgaaagagggggtgcaaaacgccaaaaccgatgtagtcgtgaatagtgtgccgctcgacctggttttaagtcgcggccccttgagcaaaagcttactagagaaggccggccctgagctccaggaggagcttgacactgtaggccaaggagtggcagtcagcatgggcaccgtgctaaaaacctcctcttggaatctggattgcagatacgtgcttcatgtcgtggctcccgagtggagaaacggaagtacatcaagcttaaaaatcatggaggatatcataagggaatgtatggaaatcactgagtcccttagcctgaaatctattgctttccccgctattgggactgggaaccttggttttccgaaaaatatctttgctgaactgatcatttctgaggtttttaaattctcatccaagaatcaactcaaaaccctgcaggaagtgcatttccttctgcacccaagcgaccacgaaaacattcaggcgtttagcgacgagttcgcacgtcgggctaacgggaatttagtctcagataaaattcctaaagcgaaagacacccaaggattttatggcaccgtgtctagcccagacagtggcgtgtacgagatgaaaataggctcaataatcttccaggtggcctcaggagacatcaccaaagaggaagccgacgtgattgtgaacagcacgagcaactccttcaatttgaaggcgggcgtgtctaaggcaatcctcgagtgcgccggccaaaacgtggagagagaatgctcccaacaggctcagcagaggaagaacgactatatcataaccgggggaggcttcctgagatgtaagaatataattcatgttattgggggcaacgacgtgaaaagcagcgtgtcttccgtattgcaggaatgcgaaaagaagaattattcttccatatgcctgccagcgatcgggacaggcaatgctaaacagcatcccgacaaggtggcagaggcaattatcgacgccattgaagacttcgtccagaaaggttcagcccagtctgtcaagaaggttaaggtggtgatcttcctaccacaggtgctagacgtgttctatgcgaacatgaagaagagagaaggcacacagttgtcctctcaacagagtgtcatgtcaaagcttgcctcatttctgggcttctccaagcagtcaccacagaaaaagaatcacctggttctcgaaaagaagaccgagtccgcaaccttccgagtttgtggggagaatgtgacctgcgtcgagtatgctatttcctggttacaagacctaatcgagaaggagcaatgcccatacacctcagaggatgagtgcataaaggatttcgacgagaaagagtaccaggagttgaacgagttacagaagaaacttaacatcaacatcagtctcgaccacaagaggccacttatcaaggtgttaggtatttctagagatgtcatgcaggccagggacgagattgaagccatgattaaaagggtacggttggccaaggagcaggagtcccgcgctgactgcatatctgagttcattgagtggcaatacaatgacaataataccagccattgttttaataagatgacaaacctgaagctcgaggacgcacggcgggagaagaaaaagactgtcgatgtaaaaattaaccaccggcactatacagtcaatctcaatacatatactgctactgacaccaagggacactccctctcagtacaacgcctgacaaagagcaaggttgatattccagcccactggtctgacatgaagcagcaaaatttctgcgtcgtggaactgctgccaagcgacccggaatacaacaccgtagcttcaaagtttaaccagacctgttctcacttcagaatcgagaagatcgagcggattcagaaccccgatctgtggaatagttaccaggccaaaaagaagaccatggatgctaagaacgggcagacaatgaatgagaagcagctgtttcatggaacagatgctggatcagtcccccacgtcaatcggaatggtttcaatcggagttatgccggcaaaaatgccgtggcctacgggaagggcacttacttcgcggtgaatgcaaattatagtgccaatgacacctattctcgccctgacgccaacggacggaaacatgtctactatgtccgcgtgctgacagggatatatacacacgggaatcactctctgatcgttccaccatctaagaacccccaaaatcctactgatctgtacgatacagtcacagacaacgtgcaccatccctctttgttcgtagctttttacgattatcaggcctacccggaatacctcatcacattcagaaaatag

SEQ ID NO: 129115 - DNA, 5163 bp, Artificial Sequence
  Description of Artificial Sequence: Synthetic coding sequence
atggccgtgccaggctcctttcctctgctagtcgaaggttcctgggggcccgacccaccgaagaatctgaacacgaagctccagatgtattttcagtccccaaaaaggtctggagggggtgaatgtgaagtacgccaggacccgagaagcccttctcgctttctggtgtttttttaccctgaagacgtgcgccagaaggttctagaaaggaagaatcacgaacttgtatggcaggggaaaggtacctttaaactgactgtgcagttaccagccacaccagacgaaatcgatcacgtcttcgaagaggagttactgaccaaggaatctaaaactaaagaagacgtaaaagaacccgacacaattaggtttgtcgacgactgtacaaaacatcactcaatcaaacagctgcagctgtccccaaggctcttggaggttactaatactatccgagttgagaaccttccccccggggccgatgactattctctaaaattattctttgagaacccctataacggagggggacgggtggccaatgtcgaatacttcccagaggagtcttccgcactgatcgaatttttcgatagaaaagtccttgacaccattatggccacgaaactggactttaataagatgcctcttagcgtgtttccatactacgcttcactgggtacagcattatacggaaaggaaaagcccttaattaaactgccggccccctttgaggagagcctggatctccccttatggaagttcctacagaagaaaaaccacctgattgaagaaataaatgatgagatgagacgctgccattgcgagctgacctggagtcaactcagcggcaaagttacgatcagaccagcagctaccctggtgaatgagggaaggccacgtatcaagacctggcaggcagatactagcacaaccctcagctcaatacggagcaagtataaagttaatcctataaaggtggatccgacgatgtgggatacaattaagaacgatgtgaaagacgaccgcatacttatcgaatttgacacgctgaaggaaatggtaatactggcgggcaaatcagaagacgtgcagtctattgaagtgcaagtgagggaactgattgaatccaccacacaaaagatcaagagagaggaacagtctctgaaagaaaagatgattatttctccaggccggtacttcctgctgtgtcactcttccctgctggaccatctcttgacggagtgcccagaaattgagatttgttacgatcgggtgacgcagcacctttgcttgaagggaccctccgctgatgtatacaaagctaagtgtgaaattcaggagaaagtatatacaatggcgcagaagaatattcaggtgtctccagagatattccaattcctgcagcaggtaaattggaaggagttcagcaaatgcttatttatcgctcagaagatcctagcactctacgaattggaagggaccaccgtcctgttgacctcatgttcctcagaagcattgcttgaggccgaaaaacagatgctttcagcactaaattacaagagaatcgaggtggaaaacaaggaggtgctccatggaaaaaagtggaaagggctcactcacaatctcctcaagaaacagaattcctccccaaatactgtgataatcaacgagcttacaagcgagaccacggccgaggttattattaccggctgcgtcaaggaagttaatgagacctacaaactgctttttaattttgtcgagcaaaacatgaaaatcgagaggctggtagaggtgaagccatcactggtgatcgattatttgaagactgaaaaaaaattgttctggccaaagattaagaaggttaatgtgcaggtgtcatttaatccagagaacaaacagaaaggcatccttctgacaggtagcaaaactgaggtgctcaaggcagtggacatcgtgaaacaagtttgggactccgtttgcgtcaagagcgtgcacactgataagcccggcgcaaagcagttctttcaagacaaggcgcgcttttaccagagcgaaatcaagcggctcttcgggtgttacatcgagttacaggagaacgaagtgatgaaagagggtgggagccctgcaggtcagaagtgcttctcgagaactgttcttgcaccgggggtggtgctaatcgtccagcagggggacttggctcggctgccggtcgacgtggtggtcaatgctagcaatgaggacctcaaacattatggaggactggctgctgctctgagcaaggccgctggcccggaactgcaggctgattgcgaccagatcgtgaaacgtgaggggcgtcttctgccaggtaacgcaacgatcagtaaagctggaaaactgccttaccaccatgtcatccacgcagtgggaccccgctggagcggctacgaagccccccgatgcgtatatctgctaaggagggcagtccagcttagcctgtgcctggcagagaaatacaaatatcgaagcattgcaatacccgccattagctctggggtgttcggattccctctgggacgctgtgtagaaaccatcgtgtctgccatcaaagagaactttcagtttaaaaaggatggccattgtcttaaagagatttatcttgtggatgtgtctgagaaaactgtggaggcctttgcggaggccgtgaaaacggtatttaaggcaactttgccggacacagccgcacctcccgggctcccccccgcagcagctggacccggaaaaactagctgggagaaaggaagcctcgtgtctccagggggattgcaaatgcttcttgtgaaggaaggagttcagaacgcgaaaacagacgtggtagttaactcagtgccgctagacctcgtcttatcacgcggcccgctgagcaaatccctgctggaaaaggccgggccagagctgcaggaggagcttgatacagtaggtcagggggtagcggtatccatgggcacggttctaaagacatcctcctggaacctcgactgccgatacgtgttgcacgttgtagcccctgagtggagaaatggaagtacctcctcgctaaaaattatggaagacatcattagggagtgtatggagatcaccgagtcactttccttgaagtctatcgcttttcccgccattgggaccggaaatctcggctttcctaaaaacatttttgctgagctgataatttctgaggtttttaaattcagttcaaagaaccagttgaaaacactgcaggaggtgcactttctgcttcatccctctgatcacgaaaatattcaagcattctctgatgagttcgctcgtcgcgccaacggcaacctagtcagcgacaaaattccgaaggccaaggacacacaggggttctacgggactgtgagctcaccggatagcggtgtgtacgagatgaagatcgggtccattatctttcaggtcgctagcggagacatcaccaaggaggaggcagacgttatcgtgaattccactagcaatagttttaacctaaaggtcggcgtgtccaaagctatccttgagtgcgccggtcagaacgtcgaacgggagtgctctcaacaagctcagcaaaggaaaaatgattatatcatcacgggtggcggttttttgagatgcaagaacatcatccacgtgattgggggaaacgacgtcaaatcctcggtgagttcagtgctgcaggagtgtgagaagaaaaattactcttcaatttgtctgccggccattgggacgggcaatgcaaagcagcaccctgataaggtagcagaagctatcatcgatgcgattgaggacttcgtgcagaaaggatctgctcagtccgttaagaaggtgaaggtcgtcatttttctcccccaggtgctcgacgtgttctacgctaacatgaaaaaaagggaaggtactcagctcagttcccagcaaagtgtgatgtccaagttagcctcttttctggggtttagcaagcagtcacctcagaagaagaaccacctggtgctggaaaagaaaaccgaatccgcaacttttagggtctgtggagaaaatgttacctgtgtcgaatacgcaatttcttggcttcaggatctgatcgagaaagaacaatgcccatacaccagcgaagatgaatgcatcaaagactttgatgaaaaggagtatcaggagctcaatgagctgcagaagaagctaaatattaacatctcactcgatcacaaacggcctctgatcaaagtgttgggaatcagcagagacgtgatgcaggctagagatgagatcgaggcaatgattaagcgggtcagactcgccaaagagcaggagtcgcgcgctgattgtatctctgaattcattgaatggcagtataacgacaacaacacgagccattgttttaacaagatgacaaatttaaaacttgaagatgctcgccgagaaaaaaagaagacagtggacgtcaaaattaaccatcgtcattacacagtcaacctgaatacatacaccgcaaccgacactaaagggcactcgttgagcgtgcagcgtctaaccaagagcaaagtggatatacctgcgcattggtctgatatgaagcagcaaaacttttgtgtcgtagagctacttcctagtgaccctgaatacaacacagtggcttcaaagttcaaccagacatgttcccactttcggattgagaagatcgagaggattcagaaccctgacctatggaatagctatcaggcaaaaaagaagaccatggacgcgaaaaatgggcaaactatgaatgagaaacagctgtttcatggcacggacgcaggtagcgtaccccatgttaatcggaacggattcaacaggagttatgctggcaaaaatgcagttgcctatggcaaggggacctactttgcagtgaatgcaaattactcagccaacgacacctattctagaccagacgccaacgggcggaagcatgtctattacgtgagagtgcttaccggaatctacacccatgggaatcactccctgatagttcccccctctaagaacccccagaacccaactgacctctatgataccgttacagacaacgtccatcatccatctctgttcgttgctttctatgactatcaggcgtatccagaatacctgattacttttcggaagtag

SEQ ID NO: 129116 - DNA, 5406 bp, Artificial Sequence
  Description of Artificial Sequence: Synthetic coding sequence
atggctgtgccaggctccttccctctcttagtggaaggtagctggggccccgatcctcctaaaaacttaaacaccaaactccagatgtacttccaatcacccaaacgaagcgggggaggcgaatgtgaggttcgacaggaccctcggagccccagccgatttcttgtgttcttctacccagaagatgtgaggcagaaggttctggagagaaaaaatcacgagctcgtctggcagggtaagggcacctttaaactgactgtgcagctgcccgctacccctgacgagattgaccacgttttcgaagaggagctgctgaccaaggagagcaagaccaaagaggacgtcaaagaacccgatgtgtccgaagaactggatactaaactgcccctggatggaggcctagacaagatggaggacatccccgaggagtgcgagaatatcagctcgcttgtggctttcgaaaatttgaaagccaacgtcacagacattatgctcattctgctcgtagagaacatctctggactgtccaatgatgacttccaggttgagattatcagagacttcgacgtcgccgtggtaacgtttcagaagcacatagatacaatcagattcgtcgacgactgtacgaaacaccacagtatcaagcaactccagctcagcccgaggctcctagaggtaacaaacacaataagagtagagaatctcccacccggcgctgacgattacagcctcaagctcttcttcgaaaacccctacaacggaggaggccgcgttgctaatgtcgaatactttccagaggaatcttcagctcttattgaatttttcgacagaaaggtattagacactattatggcgactaagctcgactttaacaagatgccgctcagtgtgtttccatactatgccagcttgggtaccgcactgtatggcaaggagaagcctctgataaagctgccagcaccttttgaggagagcctcgacttgcctctctggaagttcctgcagaaaaaaaaccatctcatagaagagattaacgatgagatgaggaggtgccattgcgagctcacttggtctcagctgtccgggaaggtcaccatccggccagctgcaacgctcgttaatgagggacgccctcgtatcaaaacctggcaagcagatactagtacaaccctatcctctattcgaagcaagtataaggtcaatccaatcaaggttgatcctaccatgtgggacacaataaagaatgacgtcaaggatgacaggatccttattgagttcgataccttaaaagaaatggtcattctcgcggggaagtctgaagatgtgcagagcatagaagtccaggtacgtgagctgatcgagagcacaacccaaaagattaagagagaggaacagtccctgaaagaaaagatgatcatttctcccgggcgctactttctgctctgtcattcgagccttctcgatcacctgctgacagagtgcccagaaatcgagatttgttacgatcgcgtcacccagcacctgtgcctgaagggaccttcagccgacgtctataaggcaaagtgcgaaattcaagagaaagtgtatactatggcccagaaaaacatccaggtgtctccagaaatctttcaatttctccagcaagtgaactggaaagagttttcaaagtgcttattcatagcacagaagatcttggcactgtacgagcttgagggcaccaccgtgttactcacatcttgttcttctgaagccctgttggaggccgagaaacaaatgctcagtgcactaaattacaaacggatcgaggtggagaacaaagaggtgctgcacggcaagaaatggaagggtttgacacataacctgttgaagaaacagaacagctcgcccaacacagtcatcatcaacgagcttacatcagagactacggcggaggtcattatcaccggctgcgtgaaagaagtgaacgagacttacaaattactgttcaacttcgttgagcagaacatgaagattgagagactcgtagaggtcaaaccctctctggtgattgattatcttaagaccgagaagaagctgttttggccaaagataaagaaggtgaacgtgcaggtctcatttaatccggagaacaagcagaaggggattctgctgacgggaagcaagaccgaagtattaaaggcagttgatatcgtcaagcaagtatgggacagtgtctgtgttaagagcgtccatactgacaagcccggggctaagcagttttttcaagataaggcaaggttttaccagtccgagatcaaacggctgttcggttgctatattgagctgcaagaaaacgaagtgatgaaggaaggcggttcaccagctggccagaaatgcttttcacgaacagttctcgcccccggagtggtactgatagtccagcaaggagacctagctagattacctgtggacgtcgtggtgaacgcctccaatgaagatctgaagcactatggagggctcgccgccgccctgtctaaggctgcggggcccgagctgcaagcggattgcgaccagatagtgaagcgtgaagggaggcttctgcccggcaatgccacgatttccaaggccggtaagctaccataccaccatgtgatccatgccgtggggcctaggtggtctggttacgaggcacctcggtgtgtatacttactgcggcgtgctgtgcagctgtcactctgcttagccgaaaagtacaaataccgctcgatcgctatacctgccatctcgtctggagtgtttggcttccccctgggtcggtgcgtggagacaatcgtgagcgcaattaaggaaaatttccagttcaagaaggatggtcattgcctcaaagaaatttatctggtagatgtgagcgagaagactgtcgaggcctttgcggaggccgtgaagaccgtgtttaaggctacattgcctgacaccgccgcaccccccgggctgcccccagctgcagcagggccaggaaagacatcctgggagaagggatctctcgtatcacctggcggcctccagatgcttctagtgaaggaaggagtgcaaaacgccaagactgacgtggtagtaaattccgtgcctctcgacctcgttctgtcaagagggccactgtccaagagtttgctcgagaaggccggaccagagctccaggaggaactagatacggtgggccagggagtcgctgtttccatggggaccgtgttaaagacctccagctggaacctcgattgtcgatacgtactgcacgtggtcgcaccagaatggcgcaatggtagcacatcttcactgaagattatggaggacatcattagagaatgcatggagatcaccgagtcactgtccctaaaatctattgcttttccagcaatagggaccggcaacctcggcttcccaaagaatatttttgccgagctgatcatttcagaggtatttaagtttagttcgaagaaccagctaaagacccttcaagaggtacacttccttctgcacccaagtgaccacgaaaacatacaggcgttctccgatgaattcgctcgacgtgccaatggtaacctggttagcgacaaaattccgaaagccaaagatacacagggcttttacggaacagtgagtagccctgattctggtgtgtatgagatgaagattggcagcatcattttccaagtagcttcaggggatattactaaggaagaagcagacgtaattgttaactctacgtcaaatagcttcaaccttaaagccggcgtctccaaagcgatcttagagtgtgcagggcagaatgttgagcgagaatgtagtcagcaggctcagcagcgcaaaaatgattatatcattacgggcgggggtttcttgagatgcaaaaatattattcatgtgataggagggaacgacgtaaagagctccgtctcatccgtgctccaggagtgcgagaagaagaactattcttctatatgcctgccagctattggaacgggcaatgccaagcagcacccggataaagtcgccgaagctatcatcgatgccattgaggattttgtgcagaagggctcagcgcaatccgttaagaaagtgaaggtggtgattttcttgcctcaggtcctcgacgttttttatgccaatatgaagaaacgcgaaggcacccaactttcttcccaacaatcggttatgagtaagctcgcttcatttcttggattctctaagcaatcgcctcagaagaaaaatcacctagttttagaaaagaaaaccgagtccgcaacatttcgtgtctgtggcgaaaacgttacctgcgttgagtatgctatatcttggctgcaggatctgatcgaaaaagagcagtgcccctacacctctgaagatgagtgtattaaagactttgatgagaaggagtaccaggagctgaacgagctccaaaaaaagttgaatataaatatcagtctcgaccacaaacggcccctaatcaaggtactgggtatcagcagagatgtaatgcaggcacgggatgaaatcgaagcaatgatcaagcgcgtgagactggctaaggagcaggaatctcgtgccgattgcattagcgaatttatagagtggcagtataacgataacaatacatcgcactgctttaacaaaatgacgaaccttaagctggaagacgctagaagggagaagaagaagaccgtggacgtgaagattaaccaccgacactatacagttaatcttaacacctataccgctaccgatacgaaaggacactcattatcagtgcagcgactgactaagtccaaagtagacattcccgcccattggagtgacatgaagcaacagaacttttgcgtggtagaactcttgccttccgaccccgaatacaacactgttgcctcaaaatttaatcagacttgcagccacttccgaatagagaaaatcgagcgtattcagaatcctgatctgtggaactcctaccaggcaaagaagaaaactatggatgccaaaaatggccagactatgaatgagaaacagctcttccatggaactgatgccggttctgtgccccacgttaaccgtaacgggtttaatcggagctatgctggcaaaaatgccgtggcctatggtaagggaacatacttcgccgtaaatgctaattactccgcaaacgacacttactcacgtcccgacgccaacggacgcaaacacgtgtattatgtaagggtgctgacgggcatctacacacacggcaatcactccctgatcgtgccgcctagtaaaaatccacagaatcccaccgacctctacgacaccgtcactgacaacgtgcaccacccttcactctttgtggcgttttacgactatcaggcctaccctgagtacttaataacttttagaaaatag

SEQ ID NO: 129117 - DNA, 585 bp, Artificial Sequence
  Description of Artificial Sequence: Synthetic coding sequence
tgagtcaggaggcgcgccgaattacgcatggccgtcccaggttcgttccctctgttggtagaagggagctgggggccggaccctcccaaaaacctaaacaccaaactgcaaatgtactttcagagccctaagagaagcggcggaggagaatgcgaggtcaggcaggatcccagatcaccctcccggtttctcgtgttcttctaccccgaggacgttcgtcagaaggtgctcgagcgcaagaaccacgaactcgtctggcagggaaaagggacctttaaattgaccgttcagcttcctgccacacccgacgagatcgaccatgtgttcgaggaggagcttcttacgaaggaaagtaaaaccaaggaagacgtgaaggagcctgatactatccgattcgtcgacgattgcacaaagcatcattctataaaacaactccaactgtcaccccggctgcttgaagttacaaacaccattagagtggaaaatctgccccctggagccgacgactatagcctcaagcttttttttgaaaatccctacaatgggggagggcgggttgccaacgtggagtattttccagaatag

SEQ ID NO: 129118 - DNA, 1335 bp, Artificial Sequence
  Description of Artificial Sequence: Synthetic coding sequence
atgttgcagaggatcggccttatctttctccataacattgtagtagtgtccaattgcttttatttccaggcctttctcgacgaattcactaactggtctagaattaatcctaacaaggcgaggatccccatggccggagacactcagggtgttgtcggcaccgttagcaagccgtgcttcactgcatacgaaatgaagataggagccatcaccttccaagttgcgaccggcgatatcgccactgagcaggtagatgtaattgtgaacagcactgcccggacgtttaatcggaaaagcggcgtgagccgcgccatcctggagggggctggccaggcagtcgaaagcgagtgtgctgtgctggccgctcaacctcacagagatttcatcatcacccctggcggatgtctgaaatgtaaaatcattatccacgttccaggtggcaaggatgttcgcaagaccgtgacctctgtgctggaggaatgcgaacaacgaaagtacacttctgttagcctgcccgccatcgggactgggaatgctggcaagaatcccattactgtggctgataatatcattgacgctatcgttgacttttctagccagcacagcacccccagtctcaaaaccgtaaaggtggtgatttttcagcccgagttattaaacattttttacgactctatgaaaaagcgagatttgtccgctagtttgaattttcagagcacattcagtatgaccacgtgcaacctgccagagcactggacagacatgaaccatcaactcttctgcatggtgcagctggaaccagggcagtctgagtataataccattaaagataaatttacaaggacttgcagtagctacgcgattgagaagattgagcggatccagaacgctttcttgtggcagtcttaccaggtaaaaaagcgacagatggacataaaaaacgaccacaaaaacaacgagaggctgctgttccatgggaccgacgctgactcagtgccctatgtaaaccaacacgggttcaacagatcttgcgctggaaagaacgctgtgtcctatggcaagggtacctacttcgctgtcgatgcctcctacagtgccaaggacacgtactccaaacccgacagtaacgggaggaaacacatgtacgtagtcagagtccttacaggcgtattcaccaagggaagggcaggactcgttacccctccccccaaaaaccctcacaatccaaccgatctcttcgatagtgtgaccaacaatacgagaagccctaaactattcgtcgtctttttcgataaccaggcctacccggagtacctcattacctttacagcttag

SEQ ID NO: 129119 - DNA, 2037 bp, Artificial Sequence
  Description of Artificial Sequence: Synthetic coding sequence
atggcggccccgggacccctaccagctgctgcgctgtctccaggggcccccacgccccgagagctgatgcacggagtggctggagtgacgagtcgcgctgggcgggacagagaggctggaagtgtcctcccagcgggaaatcggggcgcgcgaaaggcttcccgtcggagctcatctcggagcatgagtcgcgacaacaagttttccaaaaaagactgtttgagtattcgcaatgtcgtcgcctctatccagactaaagagggcttaaatctcaagcttatcagtggtgatgtactgtacatttgggctgacgttattgtcaactcagtccctatgaatttgcagctcggcgggggccctctgtctcgcgcgtttcttcagaaagcaggacccatgttgcaaaaggaattggacgataggcgaagggaaaccgaggagaaagtgggcaacatcttcatgacgagtggatgtaacctggactgcaaagcagtgctgcatgcagtagccccttactggaacaacggggcagagacgagctggcagataatggccaacataatcaagaagtgtctgactacagtggaggtcctgagcttttcatctatcaccttccccatgatcgggacagggtccctacagtttcccaaggctgtattcgcaaagctcatcctctctgaagtgtttgagtattcttcgagcactcgaccaattacctctcccctccaggaggtgcattttctcgtgtataccaacgatgatgaaggatgtcaggccttcttagatgagtttacaaattggtcccggattaatcccaacaaggcccgcattcctatggcgggcgacacccaaggtgttgtgggtacagtgtctaagccgtgcttcactgcctacgaaatgaagattggtgccattacctttcaggtggccactggagatatcgccaccgagcaggttgacgtgattgtgaacagcacggcccgtaccttcaataggaaatctggagttagtcgcgcaatccttgagggagccggacaggcagtggaaagcgaatgcgccgtcctagcagcccagcctcatcgggactttatcatcactcctggaggatgtttgaaatgcaagattataattcatgtgcctggcggaaaagatgtaaggaagacggtgacgagtgtgcttgaggagtgtgagcagagaaagtatacatccgtcagtctccccgctatcggtaccggaaacgcagggaagaatcccattacagttgccgataacattattgatgccatcgtggactttagtagccagcactccaccccctcattgaagacggttaaagtggtaatatttcagccagagctgctcaacatattctatgattcaatgaaaaagcgggacctttctgcctccttgaattttcaatcaacattcagcatgacaacatgtaacctccctgagcattggacagatatgaaccaccagttattttgcatggttcagctggagccagggcagtcggaatacaatacaatcaaagacaaattcacccgcacatgttcctcgtatgctatcgagaagatcgaaagaatccagaatgctttcctttggcaatcataccaggtgaaaaaaagacagatggatatcaagaatgatcataaaaacaatgagaggttattgttccacggaactgacgctgacagtgtgccctatgtaaaccagcatgggttcaataggtcctgtgcagggaaaaacgccgtctcctacggtaagggaacatatttcgccgtggacgctagctacagtgctaaagatacttattccaaacctgatagcaacgggcgcaaacacatgtacgtagtaagggtgctgacaggagttttcacaaaaggaagagccggtctggtcacacccccacccaagaacccccacaaccccaccgatcttttcgactccgtcaccaacaatacaagatcccctaagctcttcgtggtattctttgataaccaggcttatccggagtacttaatcacctttaccgcttag

SEQ ID NO: 129120 - DNA, 1278 bp, Artificial Sequence
  Description of Artificial Sequence: Synthetic coding sequence
atgaaacataccgccttcttggacgagttcactaattggtctcggatcaatcccaataaagccaggatccccatggccggtgatacccagggggtggtaggcacagtctctaagccatgcttcaccgcctacgaaatgaaaattggtgccattactttccaagtggcgactggcgatattgccacagagcaggtggacgtcatcgtaaattccactgccagaacatttaaccggaagtctggtgtgtctagggcaattctcgaaggggctggtcaggccgtggaaagcgaatgcgccgtgctggcagcgcaacctcatcgggactttattatcacaccaggtggatgccttaagtgcaagatcattattcacgttccaggtggtaaggacgtgaggaagacggtgacaagtgtcttggaggaatgcgagcagaggaagtatacttcagtgtccctccctgctatcggaaccggcaacgccggaaagaatccaataacagttgcagataacataatcgacgcaattgtggatttctccagtcagcatagcaccccatcactaaaaaccgtgaaagttgttatctttcagcccgaactgttgaacatcttttatgattctatgaagaagcgcgacctttccgcgagcttgaactttcagtcaacgttttccatgacgacctgcaatctgcctgagcactggaccgatatgaatcaccaactgttctgcatggtgcagctggagcctggtcagagtgaatacaataccataaaggataagttcaccaggacatgtagctcctatgctattgagaaaatcgaaagaatacagaacgccttcctgtggcagtcgtaccaggtgaagaagcgtcagatggacatcaagaatgaccacaagaacaacgaaagactcctcttccacgggaccgacgcagactccgtcccctacgttaaccagcatgggttcaataggtcttgcgccggaaaaaacgccgtaagctatggtaaagggacatattttgccgtggatgcctcctacagcgcaaaagacacctatagtaaaccagattcaaatgggcgaaaacatatgtatgttgtgcgagttctgactggagtctttacaaagggtcgtgcgggattggtcacacccccacctaagaacccccacaatcccaccgatctgtttgattctgtaactaataacacaagatcacctaagcttttcgtagtgttcttcgataaccaggcctatcctgaatacttgattacgttcacagcctag

SEQ ID NO: 129121 - DNA, 2565 bp, Artificial Sequence
  Description of Artificial Sequence: Synthetic coding sequence
atggacttttcaatggtggccggggctgccgcctataacgagaaatctggcagaattacctccttgtcactgctgtttcagaaggtgtttgcacagatcttcccccagtggaggaagggaaatacagaggagtgcctgccgtataagtgtagcgagacgggagccctgggcgagaattattcatggcagatcccaattaaccacaacgacttcaagattctaaaaaataacgagaggcagctatgtgaagtactacaaaataagttcggatgcatttccacattagtgtccccagtgcaagaagggaattctaagtctctgcaggttttccggaaaatgctgacgcccagaattgaactctctgtctggaaggacgatcttactacccatgctgtggatgcagtggtcaatgcagctaacgaggatttgctacacggtgggggactcgccctagcactcgtcaaagccggaggctttgaaatccaggaagagagcaagcagttcgtcgctagatacggaaaggtttccgctggcgagattgccgtcactggcgccggaagattgccctgcaaacagatcattcatgcggtgggtcctagatggatggagtgggataagcaagggtgtactgggaagctccagcgggccatcgtgagcatcctaaactatgttatctataagaacacacacattaagaccgtggccattcccgccctgtcttcgggtatctttcagttccccttaaatttgtgcaccaagaccatagtggagaccatcagggttagcctgcagggaaagcctatgatgtccaacctgaaggaaattcacctggtaagcaacgaggacccaacagttgccgccttcaaagcagcctcagaattcatcctgggcaagagtgaactcggccaggagactacgccctcattcaacgctatggttgtcaacaacttaacgctccaaatagtgcagggtcatatcgagtggcagactgccgatgtcatagtgaactctgtaaatccccacgacatcactgtgggtcccgttgccaagtcaatccttcagcaggccggcgtggaaatgaaatccgaattcctggctaccaaagcaaaacaattccagaggtctcagctggtattggtcactaagggctttaacttgttttgcaaatacatataccacgtactctggcacagcgagtttccaaagcctcagatccttaagcacgctatgaaggagtgtctcgagaagtgcattgagcaaaacattaccagtatatcgttccccgcattaggtactggaaacatggagattaagaaggaaaccgccgctgagatcctttttgacgaagtactcacttttgccaaggatcacgttaagcaccagctgacagtcaagtttgttatcttccctactgacctggagatctacaaagcctttagttccgaaatggccaagaggtctaagatgctctccctcaacaactattcagtgccccaatccacacgggaggagaaaagggaaaatggtttggaagccaggtcaccagctataaatctgatgggctttaatgtggaagagatgtatgaggctcatgcatggatacagagaatccttagcctgcaaaaccaccacattatcgaaaataaccacatcctgtacctaggaaggaaggaacatgatatcctgtctcagttgcagaagacatccagcgtctccatcacagagataatatcccctgggcgtaccgagttggaaatagagggagcgcgggctgacctcatcgaagtggtaatgaacatcgaggacatgctttgcaaggtgcaggaggaaatggctcgaaagaaagagcgcggcctctggcggagcctggggcagtggaccattcagcagcaaaaaacacaggacgagatgaaggaaaacatcatttttctcaagtgtcctgtaccacctacgcaggagctgctggatcaaaagaaacagtttgaaaaatgtggactacaggtgttgaaggtggaaaaaattgacaatgaagttcttatggctgcattccagagaaaaaaaaagatgatggaagagaagcttcaccgccagcccgtgtcccaccggctgttccagcaggttccgtatcaattctgtaacgtggtttgtcgggttggcttccagagaatgtacagtaccccatgtgacccgaaatacggagccggaatctacttcacaaaaaatttaaaaaacctcgccgagaaggctaagaaaatatccgccgctgacaagctgatttatgtgtttgaggcagaagtgctgacggggttcttctgccaaggacaccctctgaacatcgtgcctccacctctgagccctggagctattgatggacacgattcggtagtggacaatgtgagtagccccgaaacgtttgtgattttctcagggatgcaggccatcccccagtacttgtggacgtgcacgcaggagtacgtgcagagccaggactactcgagtggtccaatgcgccctttcgctcagcacccttggagaggtttcgctagcggcagccccgtggactag

SEQ ID NO: 129122 - DNA, 2334 bp, Artificial Sequence
  Description of Artificial Sequence: Synthetic coding sequence
atgagtgtgtcctgcgtcaagtcctcaagaatctctcttgccgtcagtctgccatggagccttcagttccggaaggccaccgcaaacctttgcgtgtttagaaaaatgttgacaccacgcatcgagctgtccgtgtggaaagacgacctaacaacccatgccgtggatgccgttgtgaatgctgcgaacgaggatttgcttcacggagggggacttgccttggccctggttaaggcaggggggttcgaaatccaggaagagtctaagcagttcgttgccaggtacggcaaggtgagcgcaggggagatcgcagtcaccggggcaggacgccttccctgcaagcaaattatccatgccgttggacctcgttggatggagtgggataagcagggttgcactggaaaattgcagagagctatcgtatccatccttaactacgtaatttataagaatacccacatcaagacagttgccattccagcgttgtcctcagggatttttcaatttcctttgaacctgtgcaccaaaactattgtggagacaattcgggtgtcgcttcagggtaaaccaatgatgtctaacttgaaggagattcacctcgttagcaacgaggacccgactgtggccgcatttaaggccgcctcagagttcattttaggaaaatctgagctcgggcaggaaaccacaccaagcttcaatgccatggtcgtgaacaaccttacgctgcagatcgtacagggccatatcgaatggcagaccgccgatgtgatcgtgaactccgtgaatccccatgacatcacggtgggacctgtggccaaatccatcttgcagcaagctggcgtggagatgaagtctgagttccttgctacgaaggctaaacagttccagcgtagtcagctggtgttagtgaccaagggcttcaacctattttgtaaatacatttatcatgtgctgtggcatagcgaattccccaagcctcagatccttaaacatgccatgaaggaatgcctcgagaagtgcattgaacagaacataacgtctatttcctttccagccctgggaaccggcaacatggagattaaaaaggagaccgcagccgaaattctgtttgatgaagtgctgacattcgcgaaagatcatgtgaaacatcaacttactgtcaagtttgtaatttttcccacggatcttgagatttacaaggccttcagtagtgaaatggcaaaacgttccaagatgctctctctcaacaactattcagtaccgcaatccactcgggaggagaaacgggaaaacggccttgaggcacggtctccggctatcaacctgatgggcttcaacgttgaagagatgtacgaagctcatgcctggattcaacgtattctgagtcttcagaatcatcacatcattgaaaacaaccatattctgtacctgggaaggaaagaacatgacattctgagtcagctgcagaagaccagttccgtgagcatcaccgagatcatttcccccggacgtacagaactggagatcgagggggctcgcgctgacctgattgaggtggtgatgaacatagaggacatgctctgtaaggtacaggaagaaatggctcgaaagaaggaaagaggcctatggaggagtctgggtcagtggacaatacagcagcaaaagactcaggacgaaatgaaggagaacataatcttcctgaaatgccccgtccctcccacacaggaactgttggaccagaagaagcaatttgagaaatgcggtttacaggtcctgaaagtggaaaagattgacaatgaagtgctgatggctgcttttcagaggaaaaaaaagatgatggaagagaagctccatcgacagccggttagccatagattatttcagcaggtgccgtatcagttttgcaatgtagtctgcagggtgggctttcaacgcatgtactctaccccctgcgatccaaagtatggggccggtatctattttaccaaaaacctcaagaaccttgccgagaaagcgaaaaagatttcggccgctgacaaactgatctacgtcttcgaagctgaggtgctcactgggttcttttgtcaaggccaccctctgaacatcgtccccccacccctgtcaccaggagccattgacggccacgacagtgtcgtcgacaatgtttcctctccagaaacctttgtcatcttttccggcatgcaggccatcccccagtatctctggacctgcacccaggagtatgtccagagccaggattattcttctggaccaatgcgcccattcgcccagcatccctggcgcggtttcgccagcggtagccccgtggattag

SEQ ID NO: 129123 - DNA, 2460 bp, Artificial Sequence
  Description of Artificial Sequence: Synthetic coding sequence
atggacttcagcatggtggccggcgctgcggcttataatgaaaaatcggagactggcgcgctgggggaaaactactcctggcaaattcccattaatcacaatgatttcaagattctgaaaaacaatgagcgccagctgtgcgaggtcttgcagaacaagtttgggtgcatttcaaccctcgtctctccagtacaggagggaaactcaaagtcgctgcaagtgtttcgcaaaatgctaactccaaggattgaactgtccgtatggaaggacgacttgacaactcacgcagtggacgctgtcgttaatgccgccaacgaagatctgttgcacggcggaggactggcactggctctggtgaaggccgggggcttcgaaatccaggaggagtccaagcagtttgtagcacggtacggtaaggtcagcgccggcgagattgccgttaccggcgccggaagattaccttgcaaacagataatacacgcagtgggacctcggtggatggagtgggacaagcaaggctgcactggtaagctgcaaagagcaatagtgtctatattaaattacgtgatctacaagaatacacacattaagaccgttgccatccctgccttatcctccgggatttttcaatttcctctgaatttatgcacaaaaacaatcgtggagactatccgggttagtcttcagggaaagccgatgatgtcaaacctgaaggagatccacctggtgagcaatgaagaccctaccgtggcggcttttaaggctgcaagcgagtttatccttggaaagtccgagctgggccaagaaacaacgcccagctttaacgctatggtagtgaataacctgaccttgcagatcgtccaggggcacattgagtggcaaacagccgatgtcattgtgaattcagtcaacccacatgacataacagtgggaccagttgctaagagtattttgcagcaggccggcgtggaaatgaaatcggaatttcttgccaccaaagcgaaacagtttcagaggtcccaactggtcctcgtgacgaagggttttaatctcttttgtaagtacatctaccacgtactctggcattcggaatttcccaaacctcaaatattaaagcacgcaatgaaggagtgcctagaaaagtgcattgagcagaatataacttctatcagctttccggccctcggcactggaaatatggagatcaaaaaagaaacagcagcagagatattgttcgacgaggttctcactttcgctaaggaccacgttaagcaccaactgaccgttaaatttgtgattttccccacggatctggagatttacaaggctttttcatccgaaatggcaaaacgtagcaaaatgctcagtctgaacaactacagcgttcctcagtcgacacgggaggaaaagcgtgaaaacgggctggaggctaggagccccgctatcaacctgatgggcttcaacgtggaagagatgtacgaggcccatgcctggatccagcgaatcttgtcgctccagaaccaccatattattgagaataaccatatcctctatctgggccggaaagagcacgatatcctttcacagctccagaagactagttcagtgtctatcactgagataatctcaccaggtcgtaccgaactggaaatcgagggagccagggcagacctgattgaagtggtcatgaatatcgaggatatgctgtgcaaagtgcaggaagagatggcgagaaagaaagagcgggggctttggaggtctctgggccagtggactattcaacagcagaagactcaggacgaaatgaaggaaaacattattttcctcaagtgccctgtcccgcccactcaggaattgcttgaccagaagaagcaattcgaaaaatgtggcctgcaggtcctcaaggtcgagaaaatcgacaatgaggtgttgatggccgcatttcagcgcaagaaaaaaatgatggaggaaaagctgcaccgtcagccagtgtcccaccgattgtttcagcaagttccctaccagttttgtaacgtggtgtgccgcgtgggatttcagaggatgtactcgacgccatgcgatccaaaatatggcgctggaatctatttcaccaagaatctcaagaacctcgccgagaaggcaaagaaaatcagcgctgccgacaagctgatatacgttttcgaggccgaagttttaacgggatttttttgccagggtcatccacttaacattgtacccccaccactgtccccaggagccattgatggccatgactcagttgttgacaatgtttccagtccagaaacgtttgtgattttttcaggaatgcaggcaattcctcagtacttgtggacttgtacccaggaatatgttcagtctcaggactattcctctggtcccatgcggccttttgctcagcacccatggcgtggctttgccagcgggtctcctgtcgactag

SEQ ID NO: 129124 - DNA, 1440 bp, Artificial Sequence
  Description of Artificial Sequence: Synthetic coding sequence
atgtctgatggatttgatcgcgctccaggcgccggcaggggaaggagtagaggcctgggtaggggggggggagggcccgaggggggagggttcccgaatggtgctggccccgccgagcgtgctagacaccaacccccacaacccaaggctcccggattcctgcagcccccacctctgagacaaccaaggaccactccaccacctggggctcagtgtgaggttcctgctagccctcagcgacctagcaggcctggcgccctcccagaacagacacgacccctaagagcgcctcctagttctcaggacaaaattcctcagcaaaactcagaaagcgctatggcgaagcctcaggtcgtcgttgctccagtgctgatgtctaagctgagtgttaacgctcctgagttctaccctagtgggtattcctcaagttatactgaaagctacgaggatgggtgtgaggattacccaacgctgagcgaatacgtgcaagacttcttgaatcaccttactgagcagcctggaagttttgaaacagagattgaacagttcgctgagaccttaaacggatgcgttaccaccgacgacgcgctgcaggagctggttgaactcatctaccagcaggcgacctccataccaaattttagttacatgggggctcggctgtgtaattatctcagtcatcatctcacgattagcccgcagagcgggaatttcagacagctcttgcttcaaaggtgcaggaccgagtacgaggttaaagaccaggcagccaaaggcgacgaagtgacaagaaagcggttccacgcattcgtgctcttccttggggaactctatctgaacctggagatcaaaggcacaaatgggcaggttaccagggctgacattcttcaggttggattgagggagctattaaatgccctgttctccaatcccatggatgacaacctcatctgcgcggtgaagcttctgaagttgaccggcagcgtgctggaggatgcttggaaagaaaaaggcaaaatggacatggaagaaatcattcaaagaatcgaaaatgtggtgttagacgccaattgcagccgggacgtcaagcagatgcttcttaagcttgtggaactgagatcgtctaattggggaagggtccatgcgacatctacctaccgggaggcaacaccagagaatgaccccaactatttcatgaacgagcccactttttataccagtgacggagtgcctttcaccgccgcagaccctgattaccaagagaagtatcaagaattgttagagcgggaagacttttttcctgactatgaggaaaacggaacagatctgtccggagccggtgatccttatttagacgacatcgatgatgaaatggaccctgagattgaggaggcttatgagaagttttgcctggagtctgagaggaagagaaaacagtag

SEQ ID NO: 129125 - DNA, 1104 bp, Artificial Sequence
  Description of Artificial Sequence: Synthetic coding sequence
atggcaaagccacaggtcgtcgtagcgcctgtactgatgtcaaagctgagtgtcaatgccccagagttctatccaagtggatactcgagctcatacacagagtcctacgaggatggctgtgaagattatcctactctgagtgagtatgtgcaagactttcttaatcatctgaccgaacagccagggtcttttgagaccgagatcgagcagttcgcagaaacgttgaacggctgcgtcaccaccgacgacgcactgcaggagctggtggagctaatttaccagcaggccaccagcatccctaacttcagctacatgggtgcccggttgtgtaactacttaagccatcatttaacaatctcaccccaatctggcaactttcgccagctgttgctgcaaaggtgccgcaccgaatacgaagtcaaggaccaggccgctaaaggggatgaagtcacgaggaagcgcttccacgctttcgtgctcttcctgggtgaactctacctgaatctagagattaagggaactaatgggcaggtgacgcgcgccgacatactccaagtgggcctgcgggagctcctgaacgctcttttcagcaatcccatggacgacaatctgatttgcgcagtgaagctgcttaagctgaccgggtccgtgttggaagatgcctggaaagaaaaaggcaagatggacatggaggagatcattcaacgtattgagaacgtggttctcgatgccaattgcagtagggacgtgaagcagatgttgctcaagctggtggagctgagatcttcaaactggggccgggtgcatgccacatccacctaccgggaggccacaccagaaaacgaccctaattatttcatgaacgaacccactttctatacgtccgatggggtcccttttaccgctgcagaccctgactaccaggaaaaatatcaggagctcctggaaagagaagatttcttccccgattatgaggaaaatgggaccgatcttagtggcgccggtgatccctacctggatgacatcgatgacgagatggaccccgaaatagaggaagcatatgagaaattttgtttagagagcgagcggaagcggaagcaatag

SEQ ID NO: 129126 - DNA, 1203 bp, Artificial Sequence
  Description of Artificial Sequence: Synthetic coding sequence
atgtctgacggttttgacagagcaccagagcagacacgcccactgagggcacctcctagttcacaggataagatcccccagcagaacagcgagtccgctatggccaagccccaggtcgttgtggctcccgtactgatgagcaagctgtccgttaatgctcccgaattctatccctccggctactcgtcttcatatactgaaagctacgaagacggctgcgaagactaccctaccttgtcagagtacgttcaggactttctcaatcatcttactgagcagcctggcagtttcgagacagagattgaacaatttgctgagaccctgaatggttgtgtgaccacagatgacgcacttcaggagttggtggagcttatttatcaacaggcaactagcattcccaacttctcttatatgggcgcccggttatgcaattacctgtcgcaccacctcacaatctccccccagtcaggcaacttcagacagttacttttgcagcggtgtcgaactgaatatgaggtcaaggatcaggccgccaaaggtgatgaagtgactcgcaaaaggtttcacgccttcgtccttttcctgggagaattatatctgaatctggagataaagggtaccaatggtcaggtaacccgggccgatatcctccaggtgggattgagagagttactgaacgctctcttcagcaatccaatggacgacaatttaatttgcgctgtgaaactgcttaaactcacaggaagcgtgttagaagacgcctggaaagagaaaggcaagatggacatggaagagatcattcaacggattgagaatgttgtgttagacgccaattgctcacgggacgttaaacagatgctgctaaagcttgtggaactcaggtcttccaattggggccgagtgcatgcaacgtctacttacagagaggcgaccccagagaatgaccccaactacttcatgaacgagcccacgttctacacctccgatggagtgcccttcactgctgccgaccccgactaccaggagaagtatcaggagttactagagcgagaggacttctttcccgactatgaagagaacggaactgatctgtccggcgctggtgatccctaccttgatgatattgacgatgagatggacccagagatcgaagaagcttatgaaaaattttgtctggagagcgaacgcaagcggaagcagtag

SEQ ID NO: 129127 - DNA, 507 bp, Artificial Sequence
  Description of Artificial Sequence: Synthetic coding sequence
atggccaaaccgcaagtggtggtagcccctgttctgatgagcaaattgagcgttaatgcgcctgagttctatccatcaggatacagctcatcctacacagaaagctatgaagacgggtgcgaggattatccaaccttatccgaatacgtccaagatttcttaaatcaccttacagaacagcccgggtctttcgaaactgagatcgaacagtttgctgagactctgaatggctgcgtcactactgatgacgcgctccaagagctcgtggagctcatatatcagcaggctacgtccattccaaatttcagctacatgggggccagactctgcaattacttgagtcaccacctgactatttctccccagtcagggaacttccgtcagctgctcctccagcggtgtagaaccgaatatgaggtgaaggaccaagccgccaagggggatgaggtcacaagaaagcggttccacgcattcgtgttgtttttgggcgaactgtacttgaactag

SEQ ID NO: 129128 - DNA, 603 bp, Artificial Sequence
  Description of Artificial Sequence: Synthetic coding sequence
atggcaaaacctcaggtggtggtggcgcccgtgttgatgtcaaaactgtccgtgaatgccccagaattttacccttctggctatagcagcagctataccgagagctacgaggatggatgcgaagattacccgaccctctcggagtacgtgcaggattttctgaatcacctgaccgagcaaccgggctcttttgaaacagagatcgagcagtttgcagaaacattaaacgggtgcgtgaccacggatgacgcccttcaggaacttgtggaacttatttaccagcaggcaaccagcatccctaacttctcttatatgggtgcacggctttgtaactatctttcccaccatctgactatctcccctcagtccggcaatttccggcaactacttttgcagcggtgccggacggagtacgaagtgaaagatcaggctgccaagggtgacgaagtaacccgtaagagattccacgcctttgtgctcttcctgggcgagctttacctcaacctggagatcaaaggtacaaatggacaggtgacacgggctgatatcctccaggttgggctccgagaactcttgaatgctcttttctcaaatcctatgtag

SEQ ID NO: 129129 - DNA, 1056 bp, Artificial Sequence
  Description of Artificial Sequence: Synthetic coding sequence
atgagtgacggttttgatcgagctcctgagcagacaaggccgttgagggctcccccttccagccaggacaagatcccccagcagaatagtgagagcgcaatggctaagcctcaggttgtggtcgccccggttctaatgtccaagctctccgtgaacgcacctgaattttatccaagtggatattcttcttcgtatacagagtcttacgaggacgggtgtgaggattatcctacactgtcagaatacgtgcaggatttcttaaatcacctcactgagcagcctggatccttcgagacggaaatcgaacagtttgctgaaacccttaatgggtgtgtcactaccgacgatgcactgcaggagctggtggagctgatttatcaacaggctacgtccatccccaacttctcttacatgggcgctaggctgtgcaattacttatctcatcatctgaccattagtccacagtccggtaactttcgccaactgctcctgcagagatgcaggacggagtatgaagtcaaggatcaggccgccaagggagatgaagtgacacggaaacggtttcatgcgtttgtcctgttcctgggggagctctatttaaacctggaaatcaaagggaccaatgggcaggtaacacgcgcagacattctccaggtagggttgcgggagctgttaaacgcccttttcagcaatccaatggacgacaatctgatctgtgctgtgaagttattaaaacttactggatcagtactcgaggatgcttggaaggaaaaaggcaagatggacatggaggagatcatccagcgcatcgagaatgtggttctcgacgctaactgctcgagagacgtgaaacagatgctgctgaaactggtcgaactgcgctcttctaactggggtcgcgtccacgcaacatctacctaccgcgaggcaacccctgagaatgaccccaactactttatgaacgaacctacattctacacgtctgatggagtccccttcactgccgccgatccagacacgtggatgattctgatgatgagatggacccaaagatag

SEQ ID NO: 129130 - DNA, 288 bp, Artificial Sequence
  Description of Artificial Sequence: Synthetic coding sequence
atggcgaagccacaggtggtcgtcgcaccagtgttgatgtctaaactgagcgtgaatgcacccgagttttacccctctggctatagctcctcatacaccgagtcttatgaggatggatgcgaggactacccaaccctgagcgaatatgtgcaggattttttaaatcatcttacggagcagcctggcagtttcgagacggagatcgagcagttcgccgagacccttaatggatgcgtgaccaccgacgatgcactccaggagctggtggagctgatctatcagcaatag

SEQ ID NO: 129131 - DNA, 384 bp, Artificial Sequence
  Description of Artificial Sequence: Synthetic coding sequence
atgaaagacccctcaaggtcgtccacttccccaagcattattaatgaggatgttataatcaatggccactctcatgaagacgataatcccttcgcagaatatatgtggatggaaaacgaagaagagttcaatcggcaaatcgaggaagagctgtgggaggaagagttcattgagaggtgtttccaggagatgctcgaggaggaggaggagcatgaatggttcattcccgctcgggacctgcctcagacaatggaccagatccaagatcaatttaacgacctcgtgatcagcgacggctccagtctggaagatctggtggtcaagtccaatctcaacccaaatgcgaaggaatttgtgccaggggtaaagtacgggaatatttag

SEQ ID NO: 129132 - DNA, 384 bp, Artificial Sequence
  Description of Artificial Sequence: Synthetic coding sequence
atgaaggatccttcccgaagtagtactagcccttctatcatcaacgaggacgtgatcatcaatggccactctcatgaggacgataatccatttgcggagtacatgtggatggagaacgaagaggaatttaatcggcagatcgaggaagagctgtgggaggaagaatttattgagaggtgttttcaagagatgctggaagaggaagaggaacacgagtggttcatccccgcgcgtgacctgccccagaccatggaccagatccaggaccaattcaatgatctggtgatctcagacggctcttcactggaggacctcgtggtgaaatccaatttgaacccaaacgccaaggaatttgtgcccggcgtgaaatacggcaatatctag

SEQ ID NO: 129133 - DNA, 282 bp, Artificial Sequence
  Description of Artificial Sequence: Synthetic coding sequence
atgaaagatccttcccgctcatctaccagccctagcataattaatgaggatgtcataatcaacggccacagtcatgaagacgataacccctttgctgaatacatgtggatggaaaatgaagaagagttcaaccgccagatagaggaggagctgtgggaggaagagtttatagaaagatgctttcaggaaatgcttgaggaggaggaagagcatgagtggttcattccagccagggacctgccccagacgatggaccagatacaggaccagtttaacgactag

SEQ ID NO: 129134 - DNA, 384 bp, Artificial Sequence
  Description of Artificial Sequence: Synthetic coding sequence
atgaaggaccctagtaggtcatccacctctccctccatcatcaatgaggatgtcataatcaatggccattcacacgaagatgacaatccttttgctgagtacatgtggatggaaaatgaagaggaattcaaccgtcaaatcgaggaggaactttgggaggaagagtttatcgaacggtgtttccaggagatgctggaagaggaagaggagcacgaatggtttatacctgcccgggacctgccccaaactatggaccagatccaagatcagtttaatgatctggtgatttccgatgggtccagtctggaagatctggtggttaagtccaatctgaatcctaacgccaaggagtttgttccgggcgttaagtacggaaacatctag

SEQ ID NO: 129135 - DNA, 372 bp, Artificial Sequence
  Description of Artificial Sequence: Synthetic coding sequence
atgaacgggtccaatatggcaaacaccagcccctctgtgaaatccaaagaggaccaaggtctaagcggccatgacgagaaagaaaatccttttgcagagtacatgtggatggagaatgaggaagatttcaacagacaggtcgaggaagagttgcaagagcaggatttcctggaccggtgctttcaagagatgctggacgaggaggatcaggattggtttatcccttcccgagacctcccccaggccatgggacagcttcagcagcagctaaatggtctgagcgtctccgagggccatgacagcgaggatattctctccaagagcaacctcaaccctgacgctaaagaattcatccccggagaaaagtattag

SEQ ID NO: 129136 - DNA, 1896 bp, Artificial Sequence
  Description of Artificial Sequence: Synthetic coding sequence
atgaatccgtcaacgccgtcctatcctaccgccagcctgtacgtaggagatctgcaccctgacgttacggaggcaatgctgtatgaaaagtttagtcccgcaggaccgatacttagcataagaatttgcagggatttgataacctcagggtccagtaattatgcttacgtaaacttccagcataccaaggacgctgagcatgcacttgatacaatgaactttgacgtcattaagggaaaaccagtgaggattatgtggagtcagcgcgacccaagcttaaggaaatcaggcgtgggcaacatctttgtaaagaatcttgacaaaagcattaataataaggctctctacgacactgtatcagcctttggtaatattctatcttgcaatgtcgtatgcgacgagaatgggagcaagggctacggatttgtacacttcgagactcacgaagcagccgagcgagctataaagaagatgaatggcatgctactgaacggccggaaggtgtttgtggggcagtttaagtctcgcaaggagcgggaggcagaactaggcgccagggcgaaggaattcccaaatgtctacattaaaaattttggcgaagatatggacgacgagaggctcaaggatttgttcggtaaatttggacccgccctgtctgtaaaggtaatgacagatgagagtggcaagtcaaaaggctttgggttcgtgtcttttgaaaggcatgaggacgcccagaaagcagtggacgagatgaatggtaaggagttaaatgggaaacaaatctacgtgggtcgggcccagaagaaggttgagaggcagacagagctaaagaggaccttcgaacagatgaagcaggacaggataacaagataccaggttgtgaacctgtatgtgaaaaacctcgacgatgggattgacgacgaacggctccggaaagccttcagcccgtttgggacgattaccagtgcaaaggtcatgatggaggggggtagatccaagggctttggctttgtctgcttttcttcccctgaggaagccactaaggccgtgacagagatgaacggacgtatagttgcgacaaaacccctttacgtcgccttggcgcagcgtaaggaggaaagacaggcgtaccttactaacgagtacatgcagcgtatggccagcgtgcgcgccgtgcccaaccagagggcgcccccaagcggctactttatgacagctgtccctcaaacccagaatcatgctgcttattatccgcccagccaaatagctcggctgagacctagcccccggtggacagctcagggcgcccgcccccatccttttcagaacaagccatccgccatcaggccaggggcccctcgagtaccgttttccaccatgcggcccgctagcagccaggtccctcgcgtgatgagtactcagagagttgcaaatacctctacgcagacagtgggtccaaggccagccgcggccgctgctgccgctgccaccccagccgtcagaactgttccacgctacaagtacgccgctggagtgcgcaatccacagcaacaccgtaatgcccagcctcaggtaacaatgcagcagcttgccgttcatgtacagggtcaggaaaccctgaccgcatcaaggctggcttcagcgcccccacagaaacagaagcagatgttgggcgagcgtttgtttcctctcatccaagccatgcaccctactctggcaggaaagattacggggatgcttctggaaatcgataactccgagttgctctacatgttagagtcacctgagtcactcagaagtaaggtggatgaggctgttgctgtgttgcaagcccatcaggcgaaggaggctacacaaaaggccgtgaacagcgctacaggcgtcccaacagtctag

SEQ ID NO: 129137 - DNA, 1896 bp, Artificial Sequence
  Description of Artificial Sequence: Synthetic coding sequence
atgaatgctgccgctagttcttaccctatggctagtctttacgtcggggacttgcactcagacgtcaccgaggccatgctgtatgagaagttctcccctgccggtcctgtgctgtcaatccgggtgtgcagagacatgatcacccgcaggtccttaggttacgcctacgtgaactttcagcagccagctgatgccgagcgggctttagataccatgaatttcgatgtcattaagggaaaacctattcgcatcatgtggtcgcagcgcgacccttctctgcggaagtccggcgtcggcaacgtgtttattaagaacctggacaaaagcatcgacaacaaagcactctatgatacctttagcgcattcggcaatatcctaagttgcaaggtcgtctgtgacgaaaacggcagcaaagggtatgcattcgtgcactttgaaacccaggaggctgctgacaaagcgattgaaaaaatgaacggtatgctcttgaatgacaggaaagtctttgtggggaggtttaaaagcaggaaggaacgcgaggctgagcttggcgcgaaggctaaagaattcaccaacgtctacatcaagaactttggggaagaggtggatgatgagtcactgaaagaactgttcagtcaattcggcaagaccctgagcgttaaagtgatgcgggaccccaatggaaaatccaagggatttgggtttgtcagctatgaaaaacacgaagacgccaacaaagcagtggaggaaatgaacggcaaggagatttcaggtaaaattatctttgtcggtcgcgcccagaagaaagttgagcggcaggccgaactcaagagaaagtttgagcaactgaagcaagagagaatctctcggtaccagggcgtgaatctctatattaagaacctggacgatacaattgacgatgagaaactacgcaaggagttctcccccttcgggtccatcacgtctgccaaagtgatgctggaggatggcagatcaaaaggctttggttttgtgtgtttctccagcccagaagaggccaccaaggctgttaccgagatgaatgggcgaatcgtcggcagtaagccactatacgtggctctcgctcaacggaaggaggagagaaaggcacatttgactaatcagtacatgcagagagtagctggtatgcgcgcccttccggccaatgcaatcttaaaccagttccagcccgccgctggaggttactttgtgcccgctgttcctcaagcgcaaggcaggccaccctattataccccaaaccaactggcacaaatgcgccctaacccgcgctggcagcaaggaggccgacctcagggatttcagggtatgccctccgctatcagacagtccggcccaagaccaaccctgaggcatctggcccctactggaaatgcccctgcctcacgagggctccccaccaccacacagagggttggggtccctaccgccgtccagaatctggcacctagggctgcggttgcagccgcggctccacgcgcggtggccccctataaatatgctagcagcgtgaggtcccctcacccggcaatacagcctcttcaagccccacagcctgctgtccacgtccagggccaggaaccgttgactgcctctatgctggctgccgcgccgccgcaggagcaaaagcagatgctcggcgaaaggctattcccccttatccagactatgcattcaaacctggccggtaaaattaccggcatgcttctggaaatagataattctgaattactccacatgttggagtctccagaaagcctccgttccaaggtcgatgaggcagtggctgtgctccaggcccaccatgctaagaaggaggccgctcagaaggtgggggccgtggctgcagccaccagctag

SEQ ID NO: 129138 - DNA, 1935 bp, Artificial Sequence
  Description of Artificial Sequence: Synthetic coding sequence
atgaacgcagccgccagctcttatccaatggcctccctgtatgtcggagatctccactccgacgtaactgaggccatgctgtatgaaaaattcagccccgctgggcccgtcctgagtattagagtctgccgggacatgatcacccggaggagtctagggtatgcatacgtgaacttccagcagcccgcggacgccgagcgagccctagacaccatgaattttgacgtaattaaaggtaagcccattcggatcatgtggagccagcgggatccctctctgcgaaagtctggagtgggtaacgtgtttatcaagaatttggataagagcatcgacaacaaggcgctgtatgatacgttttcagcttttggcaatatcctttcctgcaaagtggtttgcgatgagaatggaagtaagggatacgcctttgtgcattttgagacgcaggaagccgctgacaaggccattgagaagatgaacggtatgctgctgaatgacaggaaggtatttgttggacgatttaagtcaagaaaggaacgggaagcagaactgggcgccaaagccaaggagtttacaaatgtgtacatcaagaactttggggaagaggttgacgatgagtctcttaaggagctgttcagtcagtttggaaaaacactgtctgtcaaggttatgcgggatcctaatggtaagagcaaaggctttggtttcgtatcttatgagaagcacgaagatgcaaataaggctgtggaggaaatgaacggaaaggagatctccggaaagataatatttgtcggacgggcccagaagaaagtcgaacggcaagccgagctgaagcgaaagtttgaacaattaaaacaggaacggataagccgatatcagggtgtgaacctgtacatcaaaaaccttgatgatactattgatgatgagaaactgcgaaaagaattctctccattcggctctatcaccagtgcaaaggtcatgctggaagatggccgctcgaagggattcggctttgtttgtttctcctcaccagaggaggccactaaagcagtgactgaaatgaacgggagaatcgtgggcagcaaaccgctgtatgtggcgctcgcccaacggaaggaggagcgtaaggctcatctcaccaaccagtacatgcagcgggtagccgggatgcgggcactcccagccaacgcaattctgaaccaattccaacctgccgcgggggggtattttgtaccagccgttccacaagctcagggacggcccccatactatacaccaaaccagctggcccaaatgaggcccaatcctcggtggcagcagggtggaagaccgcagggtttccagggtatgccctcagcgatccgtcagtctggaccgcggccaacactgcgacatctggctcctacaggcagcgaatgtcctgacagacttgctatggatttcgggggtgccggcgcagctcagcagggcctcacagatagctgtcagtcagggggcgtgccgaccgcagtccaaaacttggcaccacgggcggctgtcgcagccgctgccccacgcgctgttgcaccctataagtatgcctcctctgtgcgatcacctcatccagccattcagcccctgcaggcaccgcaacccgctgtgcatgtgcaggggcaggaacctcttaccgcaagtatgctagccgccgccccccctcaggaacagaagcagatgctgggagaacgtttgttcccactgattcagaccatgcacagtaacctggctggcaaaatcaccggtatgcttctggaaatcgataactccgagttgctgcacatgttggaaagccctgagtccttgcgctctaaggtagacgaggctgtcgcagtgctgcaggctcaccacgccaagaaagaggccgcacagaaggtcggtgccgtcgccgcagctacgtcatag

SEQ ID NO: 129139 - DNA, 1983 bp, Artificial Sequence
  Description of Artificial Sequence: Synthetic coding sequence
atgaacgccgcagcctcttcataccccatggcaagcctctacgttggcgacttgcactcggatgtgactgaagccatgctttacgagaaattctcccccgccggtcctgttctctccatacgcgtgtgtcgcgacatgataacgcggcggtctctgggctacgcatatgtgaattttcagcagcccgcggatgctgagagggccctggatactatgaacttcgatgtgatcaaaggaaaacccatacggatcatgtggagccaacgggacccatctttaagaaagtcaggcgttggaaatgtgttcattaagaatctggacaaatctattgataacaaggctctgtacgacactttcagcgccttcggtaatatattgagctgcaaggtggtgtgcgatgaaaatggaagcaagggctatgcatttgtgcacttcgagactcaagaagcagccgataaggctattgaaaagatgaacggcatgctgctgaacgacagaaaggtgttcgtcgggagattcaagtcacgcaaggaacgggaggccgaattaggcgccaaggcaaaagaatttaccaacgtttatattaagaactttggcgaggaggttgacgacgaatcattgaaagaactgttcagtcaatttggcaagacgctgagtgtaaaagtaatgcgggacccaaacggtaagtctaaagggttcggctttgtgagctacgagaaacacgaggacgctaataaggctgttgaagaaatgaacggcaaagaaataagtggaaagattattttcgtgggtagagcacagaaaaaagtcgagcgccaggcagaactcaagcgcaaattcgagcagctgaagcaggaaaggatctccagatatcagggggtgaacctgtatattaaaaatctcgacgatacaatagatgatgagaagctgcgaaaagagttttcccctttcggtagcattacctcagccaaagtcatgttggaggatggtagatccaagggcttcggcttcgtctgttttagctccccagaggaggcaacaaaagccgtcacagagatgaacggccgcatagtgggaagcaagcccctatacgtggctcttgctcagcgcaaagaggaacgaaaagcacatcttaccaaccagtatatgcagcgcgtggctggcatgcgggcactccctgccaatgctatccttaatcaatttcaacccgcagcaggagggtatttcgtgcctgccgtgccacaagcccaaggtaggcccccctattatacccctaatcaactggctcagatgagacccaatccaagatggcagcaaggaggaagaccacagggattccagggcatgccatctgccatccggcagtccggccctagaccaacgctgagacacttggccccaaccggaaatgcaccagcctccagaggtttgcccaccaccacccaaagagtgggatcagaatgtccagatcgattggccatggatttcgggggcgccggcgctgctcagcagggcctgactgattcttgccaatctggaggcgtgccaaccgccgtgcagaacttggctccccgagctgccgtcgccgccgccgcccccagagccgtagccccctacaagtatgctagcagcgtgcgcagtccccacccagccattcagccgttgcaagcgccacagccagccgtacatgtgcaggggcaggagccactgaccgcaagtatgttggccgccgcccccccccaggaacagaagcaaatgcttggtgagagactgttcccgctcatccagacgatgcattcgaacttggccggcaaaatcacaggcatgttgttggagattgataattccgagttgttacacatgctggagagccctgagagcttgcggagtaaggtcgacgaagccgtggcagtactccaggcccaccacgccaaaaaagaggccgcacagaaagtgggagctgtggcggctgctacctcttag

SEQ ID NO: 129140 - DNA, 390 bp, Artificial Sequence
  Description of Artificial Sequence: Synthetic coding sequence
atgaatgctgccgcaagcagttatcctatggctagtctctatgtcggagacctgcactctgatgtgacagaagccatgttgtatgaaaagttttctccagctggccccgtgctcagcataagggtgtgccgggatatgatcacacgccggtccctgggttacgcctacgtgaacttccagcaacccgccgatgccgagcgcgctctggacaccatgaattttgatgtgataaagggcaaaccgatacgtatcatgtggtcccagcgtgacccatcgctgcggaagtctggcgtggggaatgtcttcatcaagaatttggataaaagcatagataacaaggccttgtacgacaccttttctgcctttggcaacattctcagttgcaagtag

SEQ ID NO: 129141 - DNA, 207 bp, Artificial Sequence
  Description of Artificial Sequence: Synthetic coding sequence
tgactgattcagactatgcatagtaacctggcgggaaagattactgggatgcttctcgaaattgacaactctgagctgctgcacatgctggagtcacccgagtctctccgcagcaaggttgatgaggctgtcgccgtactacaggctcatcatgctaaaaaagaggcagcccagaaagtgggcgcagttgccgccgctacaagttag

SEQ ID NO: 129142 - DNA, 120 bp, Artificial Sequence
  Description of Artificial Sequence: Synthetic coding sequence
atgaatgctgcagcttcaagctaccccatggcctcactctacgtaggcgatttgcatagtgacgtaaccgaagcaatgctgtacgaaaagttctctcccgccggacccgtcctgagctag

SEQ ID NO: 129143 - DNA, 1149 bp, Artificial Sequence
  Description of Artificial Sequence: Synthetic coding sequence
atgggttccggtgaacctaatccagctggtaagaaaaaaaaatatcttaaggcagccctctacgtcggcgacctcgatcctgacgtcaccgaagatatgctgtataagaaatttcggccagcaggcccactccggtttactcgcatctgccgagaccctgtaacacggagcccgctgggttatgggtacgtgaattttcggttccccgctgacgctgagtgggccctaaatacaatgaatttcgatctcattaatggtaaaccctttcggctgatgtggtctcagccggatgaccggctaagaaaatcgggggtaggaaatatctttattaagaacctggataagtccatcgataatagagccttattttacctgttctctgcctttggcaacatactgagctgcaaggtggtttgtgatgacaacgggtcaaagggttacgcctacgttcattttgactccctggctgccgctaacagagccatttggcatatgaacggagtgcggcttaacaacaggcaggtttatgtaggtcgattcaagttccccgaggaaagggccgccgaggtcaggaccagagaccgtgccacgtttacaaatgttttcgtcaaaaatatcggcgacgatatcgatgatgagaaacttaaggagctgttttgtgagtatgggcccacagaatccgtgaaggtcatccgcgatgcctcaggaaagtctaaaggtttcggctttgtccgctatgagactcacgaagctgcacagaaggctgtattggatctacacggcaaatctattgacggaaaggtcctctacgtagggagagcacagaaaaaaatcgaacgtttggctgagctgagaaggcgcttcgaacgcctccgtttgaaggaaaaatcaaggcccccaggtgtgccaatttacataaagaacctcgacgagaccatcaatgacgaaaagctaaaggaggaattttcttcgtttggaagtatttccagagctaaagtcatgatggaagtcgggcagggaaaaggcttcggcgtggtctgttttagttccttcgaggaggccacaaaggctgtcgacgagatgaacggtcgcattgttgggtctaagcctttgcacgtcacactcggacaggcccgccggcggtgttag

SEQ ID NO: 129144 - DNA, 657 bp, Artificial Sequence
  Description of Artificial Sequence: Synthetic coding sequence
atgaacggtgtccggcttaacaatcgccaggtttacgttggcaggttcaaattccctgaggaacgggcagccgaggttcggacaagagatagagcgacatttactaatgtattcgtgaaaaatattggggatgatatcgacgacgagaagctcaaggagcttttttgtgagtatggccctacggaatcagtgaaggtgattagagacgcctcgggcaaaagcaaaggattcggcttcgtacgctacgagacccatgaagcagcccagaaggctgtcctcgatctgcacggcaaatctatcgatggcaaggtcctgtacgtcggaagggctcagaagaagatcgagcgcctcgccgagctccggcggagatttgagagactccggcttaaggaaaaatctagaccccctggcgtccccatctacattaaaaaccttgatgagacaataaatgatgagaaattaaaggaggaattcagcagctttggtagtatcagtcgtgccaaagtgatgatggaggtcgggcaaggcaagggctttggagtcgtctgtttttcatcgtttgaagaggcgactaaagccgtggatgagatgaacgggcgaattgttggttcaaagccactgcatgtgaccctgggtcaagcacgccgaagatgctag

SEQ ID NO: 129145 - DNA, 1053 bp, Artificial Sequence
  Description of Artificial Sequence: Synthetic coding sequence
atgctgtataaaaagttcaggcccgccgggcccctccgtttcacacgcatttgtcgggaccctgtgacccgctcacccttgggctacggttatgtgaacttcaggtttccagccgatgccgagtgggcgttgaacacaatgaacttcgatcttatcaacggcaagccctttaggctaatgtggtctcagcctgatgaccgactccgtaagtctggtgtgggtaatatctttatcaaaaatctcgataagagcatagacaatcgggccctgttttatctgttctcagccttcgggaacattctaagctgcaaggtggtttgtgatgacaatgggagtaagggctatgcatatgtgcacttcgactcccttgcagctgccaatcgcgccatctggcacatgaacggagtgaggctgaacaaccgccaggtgtacgtgggaaggtttaagtttcccgaggaaagagccgccgaagtgcgcactcgcgatagagcaaccttcacgaacgtgttcgtgaagaacatcggagatgatattgatgacgaaaagctgaaagaattattttgtgagtatgggcctaccgagtctgtcaaggttattagagatgcaagcggcaaatctaaaggctttggattcgtgcggtatgaaacgcatgaggccgcccagaaagcagtgctggatttgcacggtaagtcgattgacggcaaggtcctgtatgttggcagagctcagaagaagatcgaacgtctagcagagctgcgacgacgctttgaaaggctgagactaaaggagaagtctcgcccacctggcgtgccaatatatatcaagaacttagatgagacaattaacgacgagaaactgaaagaagagttttccagctttgggtccatcagtagggccaaagtgatgatggaagtgggacaaggcaaaggcttcggcgtcgtgtgttttagttcttttgaggaagctacaaaagctgtggatgagatgaatggtcggattgtgggctctaagccactccacgtcaccctgggtcaagcccgtaggaggtgttag

SEQ ID NO: 129146 - DNA, 957 bp, Artificial Sequence
  Description of Artificial Sequence: Synthetic coding sequence
atgcccaagcgcggcaagaaaggagccgtggccgaagacggagatgagttgcgaacagagcccgaggccaagaaatccaaaaccgcagccaagaaaaacgataaggaagctgctggggagggtcctgccctctatgaagaccccccagaccagaagacttccccaagcgggaagcctgctacccttaaaatctgttcctggaacgtcgacgggctgagagcctggataaagaagaagggactggattgggtaaaggaggaagcacctgatatcctatgtctgcaggaaaccaagtgtagtgagaacaaactgcctgcggagctgcaagagctgcccgggcttagccaccagtattggtcagcaccctccgacaaagaaggctattcgggcgtcggcttactgtcacggcagtgtcccttgaaggtgtcctatggaattggcgacgaggaacacgatcaagaggggcgggtgattgtggccgagttcgattccttcgtgctggtcaccgcttatgtcccaaacgctggacgcggtttagtgaggttggagtaccggcagaggtgggatgaagcttttagaaagttcctgaaaggcctggctagccgcaaacccctggtactttgcggtgacttaaacgtcgcacacgaggagatcgacctgcgcaaccctaaaggcaataaaaaaaatgctggttttacacctcaggagagacagggcttcggggaactcctgcaagcagtgccattagcagatagctttagacatctgtatcccaacacaccatacgcttacaccttttggacatacatgatgaacgcccggtctaaaaacgtcggatggcgcctcgattacttcctgctgtcacacagtttgttgcccgccctctgcgatagcaagatccggagcaaagcacttggtagcgatcattgcccaataaccctgtacctggccctgtag

SEQ ID NO: 129147 - DNA, 891 bp, Artificial Sequence
  Description of Artificial Sequence: Synthetic coding sequence
atggccgctgccgccgccgccgcagcggcggccggggccgctggaggacggggaagcggcccagggcgcagacgccacctggtgcccggggccggaggggaggccggcgaaggggctcccggtggagctggagattatggcaatgggcttgagagtgaggaactggagccggaggagttgcttcttgagccagagccagagcctgagcctgaggaggagccccccagaccaagagctcctccaggcgccccaggtcccggccctggaagtggtgcacccgggagccaggaagaagaggaggaacctgggttagtagaaggggatccaggggatggcgcgatcgaggatcctgaactggaagctataaaagctagagtgcgtgaaatggaggaagaggctgaaaagctgaaagagcttcaaaacgaggtcgagaagcaaatgaacatgtcccctcccccgggaaatgccggccctgtaataatgtccattgaggaaaagatggaggcggacgcacggtccatttacgtgggtaatgtggactatggggcaacagcggaggagcttgaagcccattttcacggctgcgggagtgtgaacagagtcacaatactgtgtgacaaattcagcggtcacccaaaggggtttgcttatatcgagttctccgacaaagaatccgtgcgtacatctttggctctggacgagtccctgtttagaggacgccaaattaaggtgattcctaagcgaactaaccggccaggcatatctactacagacagaggctttccccgcgcgaggtatagagctcggactacaaattacaattcatccagaagccggttttactccggcttcaacagccggccccggggcagagtttatagaagcggatag

SEQ ID NO: 129148 - DNA, 1557 bp, Artificial Sequence
  Description of Artificial Sequence: Synthetic coding sequence
atgtcctgcgtgaagctgtggccatctggggcacctgccccactcgtctcaatcgaagaactggaaaatcaagaactcgtgggcaaaggagggtttggaacagttttcagagcccaacatagaaaatggggctatgatgtcgctgttaagattgtgaactcgaaggccattagccgcgaagttaaagccatggcatccctcgacaatgaatttgtgctccgattggagggcgtcatcgaaaaggtgaactgggatcaggacccaaaaccggcccttgtaaccaagtttatggagaatggatccctgagtggcctcctgcaaagccaatgtcctcgaccgtggcctttactttgccggctactgaaggaggtcgtccttggcatgttttacctacatgaccagaaccccgtgctccttcaccgggatctgaagccctcgaacgtgctgcttgaccccgagctccatgttaaactggccgatttcggattaagtacatttcaaggcggcagccagagtggcaccggcagcggtgagcccggcggaacactcggctaccttgcacccgagctgttcgtcaatgtgaatcgtaaagcatcaacagcttccgatgtgtattcttttggcattttgatgtgggcagtcctcgctggccgcgaagtagaattgcctaccgagccttcgctagtatatgaggcggtgtgcaacagacagaatcgtccaagcctggcagagctgcctcaagcaggccccgagacccctggcctcgaggggctgaaggagctgatgcagctctgctggtcttccgagccaaaggatcgaccctctttccaagaatgtcttcctaagactgatgaagtgttccagatggtcgagaataatatgaacgcagccgtttcaaccgtaaaagactttctgtcacagctccgctccagcaaccgtcgtttcagtattccagagtctggccaagggggaacggaaatggacggttttaggcgtactatcgagaatcagcacagccggaatgatgttatggtcagcgaatggctaaataagctcaacctagaggagcctccaagctcagtgccaaaaaaatgtcctagcctaaccaagcgcagccgagcccaggaagagcaggttcctcaggcttggactgcgggcacttcgtcagactctatggcgcagccccctcaaaccccagaaacaagtacctttcggaaccagatgccctctccaacaagtaccggcaccccctctccaggtcccagaggaaaccagggcgcagagcgacagggaatgaattggtcatgccgtacacccgagcctaaccccgtaacgggtcgacccctggttaatatttataattgctccggtgtacaggtgggagacaataattacctgactatgcaacagacgactgccctcccgacctggggcctggctccatcagggaaaggtcggggccttcaacatccccccccggtcgggtcgcaggaggggccaaaggatcctgaggcctggtccagaccacagggctggtacaatcattctggtaaatag

SEQ ID NO: 129149 - DNA, 2223 bp, Artificial Sequence
  Description of Artificial Sequence: Synthetic coding sequence
atgctgggtaggagaggatccgattgggccgtgcctgccccagaaaccatgcctttcccggtgacaactcaggggtcacagcagacacaaccaccccagaaacactacggcatcacctcccccatctccctggccgcccctaaagagacggactgcgtactgacacaaaagctaatagagactcttaaaccattcggggtgtttgaggaagaggaagaactccagcggaggattctgatcctgggtaagttaaacaatcttgtgaaggagtggatcagagagatctccgagagcaagaacttgccccaatcagttatagaaaatgtaggtggaaaaattttcacatttgggtcttacaggctcggggtgcatactaaaggcgccgacatcgatgccttgtgtgttgctcctcgtcatgttgacagaagtgatttttttacatctttctacgataaactgaaactccaggaagaggtgaaagacctgcgggcagtagaggaggccttcgtgcccgttattaaactgtgctttgatggcattgaaatagacatattattcgctagactggcattgcagaccattcccgaggacctcgatctgagggacgattcgctgctgaagaacctggatatcagatgtatcagatcacttaatggctgtagagtgactgacgagattctccatctggtacctaacatcgataattttaggttaaccttgagggccattaagctctgggcgaagaggcataacatctacagcaatattctgggatttctcggtggcgtgtcctgggcgatgctggtcgccaggacatgccagctttatcccaacgctattgcttcaacactagtgcacaagtttttcctggttttttcaaagtgggagtggcctaacccggtgctactcaaacaaccagaagagtgcaatctgaacctccctgtatgggatcctagggtcaaccccagcgataggtatcacctgatgcctattattactccagcttaccctcaacagaactccacttataatgtgtcagttagcacccggatggttatggtggaggagtttaagcaggggctggccattaccgacgagatcctgctcagcaaggcagagtggagcaagctatttgaggccccaaactttttccagaagtataagcactatatcgtgttgttagcctctgcacctactgaaaaacagagactggagtgggtaggcctggtggaatccaagattaggatactggtcggaagtctggaaaagaacgaattcatcaccctagcccacgtgaatccccagtcatttcccgccccgaaggaaaacccagacaaggaggaattcagaactatgtgggtgatcggtttggtgttcaaaaagaccgagaattctgaaaacctgagcgtcgacctgacctacgacatccaaagttttaccgacacagtttatagacaggccatcaacagcaagatgttcgaggtcgacatgaaaatcgctgccatgcatgtcaaaaggaagcagctgcatcagctgctcccaaatcacgtcctgcaaaaaaaaaaaaagcactctacagagggagtgaaactgacagcgctgaatgattctagcttggacctgtcaatggattccgataactccatgagtgtcccctcgcccactagtgctaccaagacaagccctctcaactcttcaggctctagtcagggacgtaacagtcctgcacccgcggttacagcagccagcgtgacaaacatccaggcaactgaagtgtctgtaccccaagtgaacagttccgaatcttccggtggtacttcctcagaatcaatcccccagaccgcgacccagcccgccataagtccaccaccaaaacctactgtgtcacgggtggtgtcatccacccggctggtgaacccaccccctcggtcgtccggcaatgccgcaacttcaggtaacgctgcaactaagattcccaccccaattgtcggcgttaagcgtacttcttccccccacaaagaagagtcccccaaaaagacaaagaccgaggaggaacagctggatactgagactagcaccacacagtccgaaacaattcagaccgctgctagcctgctggctagccagaaaaccagcagcactgacctgagcgatattccagcgcttcctgccaatccgatcccggtgattaagaattctatcaagttgagacttaacaggtag

SEQ ID NO: 129150 - DNA, 858 bp, Artificial Sequence
  Description of Artificial Sequence: Synthetic coding sequence
atgcctttcccagtgaccacccagggctcccagcagacgcagccccctcagaaacattacggtattacatctcctatttccctagcggccccaaaagagaccgattgcgtactaacgcagaagctcattgagactctaaaaccgttcggtgtgtttgaggaggaggaggagttgcagagacggatactgatcctcggcaaactgaataatttggtcaaagaatggatcagggaaatttccgaatcaaagaacttacctcagtccgtgatcgaaaacgtaggcggcaagatcttcactttcgggagttatagactgggagtgcacaccaagggagctgacatagatgccctttgcgtcgcacccagacatgtcgaccgctcggattttttcacaagtttctacgataagctcaagttgcaggaagaggtaaaggacctgagagcggtcgaggaggcattcgttcccgtgatcaagctgtgcttcgatggtatcgaaatagatattctgttcgctcgcctggccctgcagaccatccccgaagacctggacttgcgggacgactcccttctcaagaacttggatattaggtgcattcgatcattaaacgggtgccgcgttacggacgaaatcctgcacctcgtgcctaacatcgacaattttagactcaccctccgtgcgatcaaactttgggctaagcggcacaatatttacagcaatatccttgggtttctggggggggtcagctgggccatgctcgttgcacgaacttgtcagctttaccccaacgctatcgcgtcgactctagttcataagttttttctggttttctccaagtggtacgtgtttcgtttatactag

SEQ ID NO: 129151 - DNA, 1911 bp, Artificial Sequence
  Description of Artificial Sequence: Synthetic coding sequence
atgccatttccggtgaccactcaggggcccccccagccagccccacccccaaaccggtatggcgtctcctccccaatttccttagccgttcccaaagagaccgattgtcttttaacccaacgcctcatcgaaacactgcgtccctttggcgtctttgaggaggaagaggaactgcaacgcagaattctggtgcttgaaaaactgaacaacctagtcaaggaatggatacgcgaaatctcagaaagcaaatctctcccccagtcagtgatcgagaatgtgggcggcaagatcttcacctttgggagttacagattaggtgtgcatactaaaggggccgatattgatgctctctgcgtggccccctctcatgtggaccgctcggacttcttcacatcgttctacgcaaagctgaaacttcaggaagaagttaaggatctgagggccgtggaggaggcctttgtgcctgtgatcaagttgtgttttgatgggatagagattgacatccttttcgcccgattagctctgcagacaattccagaggacctggacctgcgcgatgacagcctcctgaagaacctggacatacggtgtattcggtccctaaacggctgtcgagtcaccgatgaaatcctacatctggtgcctaatatcgacaacttccgcttgaccttgcgggcaataaagctctgggctaagtgtcacaacatctacagcaatatcctaggtttcctgggtggcgtgtcgtgggctatgctggtggctagaacatgtcaactttaccccaatgccgtggcctccaccctggtgcgtaaatttttcctggtcttttccgagtgggaatggcccaaccccgtcctgcttaaggagcccgaggaaagaaatctgaatctgccggtctgggaccccagggttaatcccagcgacaggtatcacttgatgccgattatcacgccagcatacccgcagcagaattcaacttataatgtaagcatcagcacgagaatggtgatgatcgaggaatttaaacaggggttggctatcacccatgaaatactgctgtccaaggctgagtggagcaagctgttcgaggcaccaagttttttccagaagtacaaacattacatcgtgctcttagccagcgccagcaccgagaagcagcatttagaatgggtgggactcgtggagtctaaaatccgcattcttgtgggtagcctggagaagaacgagtttatcacattggctcatgtaaacccccagtctttcccagcaccaaaagaaaaccccgatatggaagagttcagaactatgtgggtcattggccttggcttgaagaaacctgacaattccgagatcctaagtatcgacctcacttacgatattcaaagttttactgacacggtgtaccgtcaggccgtgaatagcaaaatgtttgagatggggatgaagatcactgccatgcacctacgacgcaaagagctgcaccaactcctccctcaccatgtgcttcaagacaagaaggcccactcaaccgaggggagaaggcttaccgatctgaacgactcttccttcgacctgagtgcaggctgcgagaattcaatgagcgtgccaagttctacctcaacaatgaaaacaggccccttgatatcaagcagccaaggacggaactcccccgctctggccgtaatgactgccagtgttgctaatatccaggccacagagttctccctccagcaggtgaatacaaatgagtcctctggagtggctctgaacgaatcaattccccatgctgtgtcccagcccgcaatctcaccatcccccaaagctatggtcgccagggttgtgtcctccacatgtctcatttctcatccagacttacaggagacccagcagcaaacgtacttaatattatag

SEQ ID NO: 129152 - DNA, 1737 bp, Artificial Sequence
  Description of Artificial Sequence: Synthetic coding sequence
atggacttcctgctgttccaatttggcctgtgcacgtttaagtacgactacacagatagcaagtatatcactaaaagctttaatttttatgtgtttccgaaaccatttaatcggtcaagccctgacgtgaagttcgtgtgtcaatctagtagcattgatttcctagcctcccaggggttcgatttcaataaagttttcaggaacgggataccctatctgaaccaggaggaggagagacagctccgggaacagtatgacgagaagagaagccaggcaaatggagctggagctctttcctacgtgagtcccaatactagcaaatgccctgtgactatcccagaagaccagaagaagttcattgatcaggtggttgagaagatcgaggatttgctgcagtcagaagaaaataagaacttggacttagaaccatgcacgggcttccagaggaaactcatatatcagactttgtcctggaagtaccccaaggggattcatgtggagaccctcgagaccgagaagaaggagcgatacatagtcatcagtaaagttgacgaagaagaaagaaagcggagggagcagcagaaacatgcaaaagagcaagaggaactgaacgatgccgtagggttcagtcgcgtcatacacgccattgccaattcaggcaaactggtgataggccacaacatgctgttagacgtcatgcacactgttcatcagttttattgccccctgcctgcggatctttcagagttcaaggaaatgaccacttgtgtcttcccaagactcttagacactaagctgatggccagtacccagccattcaaggatatcataaacaatacttcgctggcagaactcgagaagcggttaaaggaaacacccttcaatcccccaaaagtcgaatcggccgaagggttccccagctacgacacagcctctgagcaactgcacgaagccggctacgacgcctacataactggtctgtgcttcatttctatggctaactacctcggcagtttcctgagcccccctaagatccatgtgtccgcgagatccaaacttattgaacctttttttaacaaactattcctgatgagagtgatggatattccttacctgaacctcgagggacccgacctgcaaccaaagagggatcatgttctgcacgttaccttccccaaagaatggaagactagcgacctctaccagctgttctccgcctttggcaatatccagatcagctggatcgatgacacttcagccttcgtgtctctttcccagcctgagcaggtgaaaatcgccgtgaacactagtaaatatgcagagtcttacagaattcagacctacgccgaatacatgggtcgaaaacaagaagagaaacagattaaacgcaaatggaccgaggatagctggaaggaagcagacagtaaacggctgaatccccagtgtataccctacactctccaaaaccactattacagaaacaattcgttcactgcacctagcacagtgggaaagcgaaacttatcaccttctcaggaagaagcaggcctggaagacggcgtttccggggaaatatccgatacggagttagaacaaacagactcttgcgcggagccgttgtccgagggacggaaaaaggctaagaaactcaagcgcatgaaaaaggaactgtcccctgccgggtcaatcagcaagaattcaccagctacactttttgaagtgccagatacttggtag

SEQ ID NO: 129153 - DNA, 1782 bp, Artificial Sequence
  Description of Artificial Sequence: Synthetic coding sequence
atggagataatcaggtcaaatttcaaatcgaatctgcacaaggtttaccaggctattgaagaagccgacttcttcgccattgatggtgaattttctggaatctcagacggaccctccgtttctgccttgaccaacggcttcgacacccctgaggagcgcagtagccccgacgtcaaatttgtgtgccagtcatcaagcattgacttcctggcctcccaggggtttgatttcaacaaggtgttcaggaatgggatcccttacctgaaccaggaggaggagcggcaactcagagagcagtatgatgagaagagatcccaggctaatggggccggcgcgctcagttatgtgtctccaaatacctcaaaatgtcccgtgactatcccagaagatcagaagaaattcattgaccaagtagtcgaaaagatagaggatctcctgcagagtgaagaaaacaagaatctggatctggaaccctgtacaggttttcagagaaaactgatctatcagactttgtcctggaagtaccccaaaggcattcatgtagaaactcttgagaccgagaagaaggaacgatacatcgtaatctccaaggtcgatgaggaggagcgaaagaggcgggagcaacagaagcatgcgaaagagcaggaggaactaaatgatgctgttgggtttagcagggtcatccacgcaatcgctaatagtggtaaattggttatcgggcataatatgctgctcgacgtcatgcataccgtacaccagttttactgccccctgcccgcagacctgtcagaattcaaagagatgaccacgtgtgtcttcccccggttgctggacactaagctcatggccagtactcagccatttaaagacatcattaataacacaagcctggcagaactggagaaacggttgaaggaaacgccttttaaccctcccaaggtggagtccgcagagggcttcccatcctatgatacagctagtgagcagcttcacgaggcaggttacgatgcctacattactggactgtgctttatcagcatggccaactacctgggcagctttctcagcccaccaaaaatacatgtcagtgcccggtctaagctgatcgagccattttttaacaaactgtttctcatgagggtgatggacatcccatacctaaatctggagggaccagatctgcagcctaaaagggatcacgtgttgcacgtcaccttccccaaggagtggaaaactagcgacttgtatcagctgttttccgctttcggcaacatacagatatcttggattgacgataccagcgccttcgtcagcttgtcacaacccgaacaagtaaagatcgctgtgaacacttctaagtacgctgagtcgtatcgcatacagacatacgcagagtacatgggacgcaagcaggaggaaaagcagatcaagagaaaatggaccgaggacagctggaaggaggccgactccaaacggctcaacccacaatgcattccatataccctgcagaaccattattaccggaataacagcttcacagcgccaagcactgttggtaagcgcaatctatccccgtcacaagaagaggcgggactcgaggacggagtgagtggcgaaatcagcgacacagagctggagcagacagattcgtgcgcggagccactgtccgagggtagaaaaaaggccaagaaactcaaacgcatgaagaaagaattgtctcccgccggctctatctcaaaaaattcccctgccaccctgtttgaagtgccggacacatggtag

SEQ ID NO: 129154 - DNA, 1920 bp, Artificial Sequence
  Description of Artificial Sequence: Synthetic coding sequence
atggagattatcaggtccaatttcaagtccaacctccataaagtctatcaggccattgaagaggcggatttcttcgccattgacggtgagttctcaggtattagtgatggtccgagtgttagtgctttgaccaatggatttgacacaccggaagagaggtaccaaaagctgaaaaaacactcaatggactttcttctttttcagttcgggctttgcacttttaagtacgactatacagactccaaatatatcaccaaaagtttcaatttctacgtgtttcctaagccctttaaccgatcatcccccgatgtcaagttcgtctgtcagagtagctctatcgactttctcgcaagccagggctttgatttcaacaaggtttttagaaatggtatcccttatctgaatcaggaagaggaaagacagctcagagaacagtacgacgaaaaacggagccaggcaaatggggctggcgctctctcatatgtatctcccaataccagtaaatgtccagtgaccatcccagaggatcaaaagaagttcatcgaccaagtagtcgagaagattgaagatctgttgcagagtgaggagaataaaaacctcgatctggagccttgtacaggctttcaaaggaagctgatttaccagacgctgtcatggaagtatcctaaggggatacatgtcgagacactggagaccgaaaaaaaagagaggtatattgtgatttcaaaggtggacgaggaagaacgaaagaggagagaacagcagaaacatgccaaggaacaagaagagctgaacgatgctgtcggcttctctcgggtaatccacgcaattgccaactccggtaaacttgtcattggccacaatatgctgctggatgtgatgcacacagtccaccagttctattgtccgctcccagcagatctgtccgagttcaaggaaatgaccacatgcgtgttccctcgtctcctggatacaaaattgatggccagtactcagccgtttaaagatatcataaacaacactagcctggccgagctcgagaaacgacttaaagaaacgccttttaaccctcctaaggttgagagcgccgagggcttcccttcctatgatacggctagcgagcagttgcatgaagccgggtatgatgcgtatatcacagggctctgctttatctccatggccaactatttggggtctttcctgtcaccccctaagatccatgtcagtgcccgttctaagttgatagagcccttctttaataagcttttcctgatgcgcgtcatggacatcccatacctcaatctggagggacccgatctacagcctaaaagggaccacgttctgcacgtgactttcccaaaagaatggaagacgtctgatctctaccagctcttcagcgctttcggtaatattcagatttcttggatagacgatacatctgcgttcgtatcccttagccagcctgaacaggtcaagatcgccgttaatacatccaaatatgccgaaagttaccggattcaaacgtacgccgagtacatgggcagaaagcaggaggaaaaacaaattaaacggaaatggaccgaggacagttggaaagaagcggactctaagcggcttaacccccagtgtataccatatacactgcagaatcattactatagaaataactcatttacagcacccagcacagtgggaaagcgcaacctaagtccaagccaggaagaagccgggcttgaagatggcgtttccggggagatcagcgataccgaactcgagcagaccgatagttgtgcagaacctttgtctgaaggacgtaaaaaagcaaagaagctgaagcgtatgaaaaaggagctgtcaccagctggttcaattagcaagaattccccagccacccttttcgaggtgccagacacctggtag

SEQ ID NO: 129155 - DNA, 624 bp, Artificial Sequence
  Description of Artificial Sequence: Synthetic coding sequence
atggagatcattagaagcaatttcaagagcaaccttcataaagtctatcaggccatcgaagaggcagactttttcgcgatcgatggagagttttcgggcatctctgacggcccatcagtgagtgccctgaccaacggcttcgacacccccgaagagagatatcaaaagctgaaaaagcactctatggattttctgttattccagtttggcctgtgcactttcaagtacgattatacggattctaagagctcgcctgatgtgaagtttgtttgtcagtcgagttctattgatttcttagcctcccaggggttcgattttaataaggtgtttcgcaatggtatcccatacttgaatcaggaggaagaacggcaattgcgggagcagtacgacgagaagaggtcgcaagcaaatggagccggggccctcagctatgtctctcctaacacctctaagtgccccgttacgattccagaagaccaaaaaaagtttatagaccaggtggtggaaaaaatcgaagacctcctccagtcagaagaaaacaaaaatctagatttggaaccctgtaccggttttcaacgcaaactgatctaccaaactctgtcctggaagaggagcgacatctag

SEQ ID NO: 129156 - DNA, 1395 bp, Artificial Sequence
  Description of Artificial Sequence: Synthetic coding sequence
atggaaattatccgatctaatttcaagagtaatctgcataaggtgtatcaggccatagaagaggcggatttttttgccatcgacggggagttctctggaatctccgatggcccttctgtgtccgcactgacaaatggatttgacacacctgaagaacgttaccaaaaattgaagaaaaaagaacggtacatcgtaatcagcaaggtcgacgaggaggagaggaagcggagagagcagcaaaagcacgccaaagaacaggaggaactcaatgacgctgttggcttcagccgggtgattcatgcgatagccaactcaggcaagttggttatcgggcataacatgcttttggacgtgatgcacacagtgcatcagttttattgcccgctgcctgctgacctgagcgaatttaaagaaatgacaacatgcgtgtttcctagactgttggacaccaagctgatggccagtacacagccctttaaggatatcattaataatacctctctggccgaacttgagaaacgtctgaaggaaaccccctttaatcccccaaaggtcgagagtgcagagggctttccaagctacgacactgctagcgaacagctccacgaagcaggatacgacgcttatataactggcctgtgttttatttctatggccaactacttagggtcattcctgtcaccacccaagatccacgtgtccgccagatctaagctgatcgaacccttctttaacaagctcttcctgatgcgggtaatggacattccttatctcaacctcgagggccctgacctgcagcccaagcgggaccacgtgctccatgtgacatttccaaaggagtggaagacctccgatctgtaccagctctttagtgcttttgggaatatccaaattagttggatcgatgatacaagtgcttttgtgtccctgtctcagccagaacaggtgaaaatagccgtgaacacgagtaaatacgcggaatcttacagaattcagacgtacgcggagtacatgggccgcaagcaggaggagaagcagatcaaaaggaaatggaccgaagatagctggaaggaagctgattctaaacgtcttaacccccagtgcattccttacacattacaaaatcactattacagaaataattcttttacggccccatcaactgttgggaaacgaaatttgagccccagccaggaggaggccgggctggaggatggggtttctggggagataagcgacacagaactagaacagacagactcatgcgctgagcctctgagcgagggaagaaaaaaggctaagaaacttaagcgaatgaagaaggaactaagtcctgccggtagtatctccaaaaactccccagcaactttgtttgaagtgcctgatacatggtag

SEQ ID NO: 129157 - DNA, 1071 bp, Artificial Sequence
  Description of Artificial Sequence: Synthetic coding sequence
atggatgccggggtcaccgagagcggattgaatgttacattgacaatccgtctactgatgcatggcaaagaagttggctcgatcatcggcaaaaagggcgaatcagttaagagaatccgggaagagtccggggctaggatcaatatctccgagggtaattgccctgagagaatcattacactgactgggccaaccaacgcaatctttaaagccttcgcaatgattatcgacaaactggaagaggatattaatagctccatgacgaattccaccgcagcctcgagacctccagtaaccctgagactggtagtccccgctactcagtgcgggagcctaatcggtaaagggggttgtaagataaaggagatcagagagagcacaggggcccaggtccaggtcgccggggacatgctccctaactctacggaaagggccattacaatcgctggagtcccgcagagcgtgacagagtgtgtcaaacagatctgtcttgtgatgttggagaccttgtctcagagtccacaggggcgtgtcatgaccatcccctatcagccaatgcctgcttccagcccagtcatatgtgctggggggcaggaccggtgctcggacgcagccggctatccgcacgccactcacgacctagaaggcccacccctggatgcgtatagcatccaggggcagcatacaatcagccccctagatttagcgaagttgaaccaggtcgctcggcagcaatctcacttcgccatgatgcacggcggcacaggctttgccggtatcgacagttcatctccagaagtgaagggctattgggctagtctagacgcctccactcaaaccactcacgagttgacaattcccaacaatttgatagggtgcatcatagggcgccaaggagcgaatatcaacgagattcgacagatgagcggcgcccagattaaaattgccaatcctgttgaaggctcttcaggacgtcaggttaccattactgggtccgccgcgagcatttctttagcacagtatttgattaacgcgaggttgtcatcagaaaagggcatggggtgcagttag

SEQ ID NO: 129158 - DNA, 957 bp, Artificial Sequence
  Description of Artificial Sequence: Synthetic coding sequence
atggacacgggagtgatcgagggaggcctgaatgtcacactgacaattagactgctgatgcatggcaaggaagtaggcagtataattggaaagaagggagaatccgtcaaaaaaatgcgagaagagtcaggagctcgcatcaacatcagtgaggggaattgtcctgaacgcattatcaccttggctggtccaacgaatgccattttcaaggcattcgccatgattattgataaattggaggaggatatctcatcctcaatgacaaatagcactgccgcctctcgccctccagtgaccctgcgcctggtggtgcccgcatctcagtgcggtagcctgattggcaagggggggtgcaagatcaaagaaatacgggagagcacaggcgcccaggttcaagtagccggggatatgctcccgaacagtacggaaagagctatcaccattgctggtatcccccagtccatcattgaatgtgtgaagcagatctgcgtggtgatgctggaatctccccctaaaggtgtgacaattccctaccggcccaagccaagtagtagccctgtgatttttgcgggcggacaggcctacaccatccagggccagtacgctattccacagccagacctgacgaagttgcaccagttggcgatgcagcagtctcatttccccatgacccacggaaacaccggattttcagccgggcttgacgcctctgcccagaccacttctcatgagttgaccatacccaatgatcttatcggctgcattatcgggcgccaaggtgctaagatcaatgagataaggcagatgagtggggcccagatcaagattgccaaccctgtcgagggatcaaccgaccgccaggttaccatcaccggcagtgccgcaagcatctccctggcccagtatctgattaatgttagactatccagtgaaactggcggtatgggcagtagctag

SEQ ID NO: 129159 - DNA, 1098 bp, Artificial Sequence
  Description of Artificial Sequence: Synthetic coding sequence
atggatactggagtgatcgagggagggctgaacgtcaccctgaccattagattgctgatgcacgggaaggaggtggggagcatcataggcaagaagggtgaatcagtgaagaaaatgagagaggagtccggagcccgcattaatatctctgagggaaattgcccagagcggattattactcttgccggacctactaatgccatatttaaggctttcgctatgatcatcgacaaactcgaggaggatataagtagtagcatgacgaactcaacggccgcaagccgcccaccagtcacattacggctggtcgtgcctgccagtcagtgtgggtccctgatagggaaaggggggtgtaagataaaggagatcagggagagtacaggtgctcaggtgcaggtggccggcgacatgttgccaaactccaccgagcgcgccataaccatcgctgggattccccagtccattattgaatgtgtcaagcagatttgcgtcgtgatgttggaaaccttgtctcagtccccaccaaaaggtgtcacaattccatacaggccgaaaccgagttcctctcccgtgattttcgccggaggccaggacaggtatagcactggaagcgactccgcttccttcccccatacaacgccgagcatgtgcctgaatcctgaccttgagggccctccactggaggcctacacgatacaggggcagtatgcgatcccgcagcctgacctgactaagctgcaccagctggccatgcagcagagccacttccccatgactcacggaaatacaggtttcagcggtatcgagagtagctcacccgaggtgaagggttactggggcttggacgcctctgcgcagactacttcccatgagctgacaattcccaatgaccttattggatgcattatcggcagacaaggcgcgaagattaacgagatcaggcagatgtctggagcccagatcaaaatagctaatccggtggaagggtccacggatcgacaagttacaatcacgggatcagccgcctccatttctttggcccagtatttaataaatgtgcggttatcttcggagacaggcggaatgggctcatcctag

SEQ ID NO: 129160 - DNA, 1008 bp, Artificial Sequence
  Description of Artificial Sequence: Synthetic coding sequence
atggacaccggcgttattgaaggtggactgaacgtgaccttgaccatccggctcctcatgcacggcaaagaggtgggtagcattatcggaaaaaagggggagtcggtgaagaagatgagagaagagtccggcgctcgcatcaacattagcgaagggaactgccctgagagaattattaccttggctggccccacgaacgccatatttaaggcattcgcaatgataatagacaaacttgaagaagacatctctagctccatgacgaacagcacggccgcgagccggccgccagtgacactgaggcttgtggtgcctgcctcccagtgtggctccctgatagggaaaggcggttgcaagataaaggaaattagagagtccaccggcgcccaggtgcaggtggctggagacatgctgcccaactctacagagcgcgctattactatcgctggcattccccagtccattatcgaatgtgttaaacagatctgcgtggtaatgctcgagaccctctcccaatccccgcccaaaggcgtcaccatcccctataggcctaagcctagtagttcaccagtcatcttcgccggaggtcaagcttacacgatccaaggccaatacgccattcctcagcccgatctcacgaaactccaccagctcgcaatgcagcaaagtcattttccaatgacacatggcaatactgggtttagcgggattgaatccagcagcccagaagtaaagggctattgggctggacttgatgcctcagcacagacaaccagtcacgagttgaccattcctaatgatttgatagggtgtataatcggcaggcagggagccaaaatcaatgagataagacagatgagcggggcccagattaagatcgctaatccagtggaaggctccaccgatagacaggtgactattactgggagcgcagcatccattagtctagcccagtatctgattaatgtgcgcttatcttcggagactggaggcatgggcagctcctag

SEQ ID NO: 129161 - DNA, 906 bp, Artificial Sequence
  Description of Artificial Sequence: Synthetic coding sequence
atggatacgggggttattgagggtggactcaacgtgaccctgacgataagattgctgatgcacgggaaagaagtcggctcaatcataggcaaaaagggagagtccgtcaaaaagatgcgagaggaatccggggcacggatcaacatctcagagggtaactgcccagagagaatcatcactttagccggacccactaacgccatatttaaagcctttgctatgatcattgataagcttgaagaggatataagctcatcaatgacgaacagtactgccgcctccagacctcccgttacactccggctggtggtgcctgcatcccagtgcgggtctctgatcgggaagggagggtgcaaaattaaagagattagggagtctaccggggcacaggtgcaggtagcaggagacatgctccctaattcgaccgagcgtgcgatcactatagcgggcattccacagtccattatcgagtgtgtcaagcagatatgtgtggtgatgctcgaaagtcctcctaagggagttaccattccttacagacctaaaccttcgtcaagccccgttatcttcgccggggggcaggaccggtattctaccggatctgactcggcctctttccctcacaccactccttctatgtgcctcaatccagatctcgagggtcctccactcgaggcttacaccattcaggggcagtacgcaattccccagccagacctaactaagctccatcagcttgccatgcagcagtctcacttcccgatgacccacggaaacactggattcagcggtatggataccagcgtgttcatctcagtgcggtgctcagcaagagaacggccagttccgaggagccagctggacatttgtctcaagcaaactagcctgtctagcatcctactcgtatag

SEQ ID NO: 129162 - DNA, 1089 bp, Artificial Sequence
  Description of Artificial Sequence: Synthetic coding sequence
atggacactggagtgattgagggtggacttaacgtaacattgaccatcagacttctcatgcatgggaaggaagtgggatccattatcggcaagaaaggggaatcggtcaaaaaaatgcgggaagagtccggggcacgcatcaatatcagcgaaggaaattgccccgaaagaatcatcaccctggcgggccctaccaacgctatttttaaggctttcgctatgattatcgataagctcgaagaagatatttcctcaagcatgacaaattccacagccgcaagtcggcctcccgtgactttgcgcctggtggttccagcatcgcagtgcggaagtttgatcggcaagggcgggtgtaagatcaaggaaatcagggagtcaactggagcccaggttcaggtggccggagacatgctgcctaactctacggaacgcgctatcaccatcgctggcatacctcaatcgatcattgaatgcgttaaacagatctgcgtcgtgatgctcgaatcgccgccaaagggagtgacaatcccctaccggccaaaaccttcttcaagtcccgttatctttgctgggggtcaggaccgctactcaacaggatctgacagcgccagcttcccgcacacaacaccctccatgtgcctaaaccccgatctggaagggccacccctcgaagcctacacaattcaagggcaatatgcaatcccccagcctgatctgacaaagctgcatcaactcgctatgcagcaatctcacttccctatgactcacggtaatactggattcagcggcattgagagtagcagccccgaggtcaaaggctattgggcaggcctcgacgccagtgcgcaaaccaccagccacgagttgaccatccctaacgatctgatcggatgcattatcggacgacagggagccaagataaatgaaattaggcagatgagcggagcacagatcaagatcgccaaccctgtcgagggctccactgacaggcaggtcacaatcaccgggagcgcagcctccataagtctggctcagtaccttatcaacgtgcgcctgtccagcgagaccggaggaatgggatcaagctag

SEQ ID NO: 129163 - DNA, 996 bp, Artificial Sequence
  Description of Artificial Sequence: Synthetic coding sequence
atggatacaggggtgatcgaaggggggttgaatgttacccttactattcgattgttgatgcacggcaaggaggtcggctctattatcggaaaaaagggggagagcgtgaagaaaatgagggaagaatccggagcccgaatcaacatatccgaaggtaattgtcccgagaggattatcaccctcgctgggcccacgaacgccatcttcaaagcctttgccatgatcatcgacaaactggaggaagatatcagctcatctatgaccaattctaccgcagcaagcagaccacccgtgacccttcgcctagttgttcccgcatcccaatgtgggagtctgatcgggaagggaggctgcaagatcaaagaaatcagagagtcgacgggagcccaagtgcaggtggccggagatatgttacctaatagcacagaacgggccatcacaattgcaggtatccctcagtcgatcatcgaatgtgttaagcaaatttgcgtagtgatgctggaatccccccctaagggggtcaccatcccatataggcctaaaccttcaagctctccagtcatatttgcaggaggccaagcatatacgattcagggtcagtatgcaattccccaacccgacctgaccaagctccatcagctcgccatgcaacagtcccattttccaatgacacatgggaatactggcttctctgggattgaatcctcctctcccgaagtcaaaggctactgggctggcctcgatgcttctgcccaaacgacctcccacgagttaacgatccccaatgacctcatcgggtgcatcatcggtcgccaaggcgctaaaattaacgaaatccgccagatgtccggtgcacaaatcaagattgctaacccagtggagggtagtaccgaccgccaagtgacgattacaggtagcgctgcttcaattagtctggcacaatatctcattaacgtgcgactgtcttccgaaactgggggtatggggagctcctag

SEQ ID NO: 129164 - DNA, 1101 bp, Artificial Sequence
  Description of Artificial Sequence: Synthetic coding sequence
atggacactggggtaatcgaaggaggcctcaatgttacgcttacaattaggctgttgatgcatggcaaagaagtgggaagtatcatcggaaagaaaggagagagcgttaaaaagatgcgggaggaatctggcgcacgcataaacatctctgaggggaattgccccgagcggataataacactggctgggccgaccaacgccatcttcaaagcctttgccatgataatcgataagttggaggaggacatcagctcttctatgaccaacagcacagctgcttccaggcctcccgtgaccctcagacttgtggttcccgcttctcagtgcggctctctaattggcaaaggcggatgtaaaatcaaggaaattagagagtctacaggcgcacaggtccaagtcgcgggtgatatgctgccaaactctactgagcgggccatcacaattgctggcataccacaatccatcattgaatgcgttaaacaaatttgtgttgtgatgctggagacgctgtcccagtcccctcccaaaggagttaccatcccctaccgtccgaagccctcttcttctccagtgatcttcgctggggggcaagaccgctacagcaccgggtctgacagcgcctcattcccccatacaaccccatctatgtgtctgaatccagacctcgagggcccgcctctcgaagcgtacacaattcaaggccaatacgctattccgcagccagatctgaccaagctgcaccagctggcaatgcagcagtctcatttccctatgacccacgggaataccggcttttccggtatcgaatcttccagtccagaagtgaaagggtactgggccggcctcgacgcaagcgctcagaccacctcacacgaacttacaatacctaatgacctgatcggatgtattattggcagacaaggagccaaaataaacgagatcagacagatgagtggtgctcagattaagatcgccaatcccgtggagggctccaccgatcgccaggtgacaattactggaagcgccgccagcatctctttggctcagtatctgattaacgtgcgtttgtcttcagaaaccggcggcatgggctcttcctag

SEQ ID NO: 129165 - DNA, 1086 bp, Artificial Sequence
  Description of Artificial Sequence: Synthetic coding sequence
atggatactggagtgatcgaaggtggcctcaacgtgacactcaccatacggctgttaatgcatggaaaggaagtgggttctattatcggcaaaaagggcgaaagtgtgaaaaaaatgagggaggagtcgggagccagaatcaacatctctgagggaaactgccccgaacgtattatcaccctcgccggcccaaccaacgctattttcaaggcctttgcaatgattattgataaactggaggaggacatctctagcagcatgacgaatagtacagctgcctctcgtccgccagtcacacttcgcctggtggttcctgcatcacagtgcggcagcctgattggaaaggggggctgtaaaatcaaggaaatcagggaatctaccggggcccaggtgcaagttgcaggcgacatgcttcccaatagcactgagagggccattaccatcgctgggatcccccagtccattatcgaatgtgtgaaacagatatgcgtcgtcatgttggagtcacctcctaagggcgtgaccattccttaccgtcccaaaccttcgagtagccctgtgatcttcgcagggggccaggacagatacagtacagggtctgattctgcatcgtttcctcatacaacaccctcaatgtgtcttaatcccgacctggagggccccccactcgaggcctacaccatacagggccagtacgccataccccagcctgatttaacgaaactccaccagctggctatgcaacagtctcactttcccatgactcacggcaacacgggcttttctgggattgaaagctctagtcctgaggtgaagggttattggggtctggacgcctctgcacaaaccacctcccatgagctgacaatccccaatgacttgatcggatgcatcatcggacgacagggtgccaagatcaacgaaattagacagatgtctggagcccagattaagattgcaaatcccgtcgaagggtctacggataggcaggtcaccatcacaggctccgccgccagcatcagcttggcccagtacctcatcaacgtgcgtctttcgtccgaaacgggggggatgggaagctcatag

SEQ ID NO: 129166 - DNA, 1056 bp, Artificial Sequence
  Description of Artificial Sequence: Synthetic coding sequence
ttgtctccaggggacgctttctgggcaccaagcgtcctgccacactcgactctatcgacactgtcccatcatcctcagccccagttcggcagaagaatggaaagcaaagtgagcgaaggcggcttaaacgttaccctgacaataagactactgatgcacgggaaagtccggggcgccgccatcgttagcaaaggggagaccgtgaagaagatgagagaggaaagtggcgcacggatcaacatctcggagggcaactgtcctgagaggatagtcaccataactggcccaaccgacgcaatatttaaggcctttgccatgatagcctataaattcgaggaagacataatcaatagtatgagtaacagcccagctacatccaaaccgcccgttacactgcggctagttgtccctgcgtctcaatgcgggtctctgattggcaagggaggcagcaagatcaaagaaattcgggagtcgacaggcgctcaggttcaagtcgccggcgacatgctgcccaattcaacggaacgggcggttaccatctcaggcacacctgatgcgatcattcagtgtgtgaaacaaatctgcgtcgtgatgcttgagtctcctcctaagggagctaccatcccttaccgtccgaagcccgcctcaacaccggtaattttcgccgggggacaagcatacaccattcaggggcaatacgcaatacctcacccagatcagctcacaaagctgcaccagcttgctatgcagcagactccgttcccaccgctggggcaaaccaaccctgccttcccgggcctggacgcttctcctcctgcgtcaacgcacgaactaactatccccaatgatcttatcgggtgcattattggccgccagggaactaaaatcaacgagatcaggcagatgtccggggcgcaaatcaaaatcgccaacgctactgagggaagttccgagcggcagatcaccatcacaggtacccctgcaaatatttccctggcccaatatctgatcaatgcccgattgacgtccgaagttactggcatggggacactttag

SEQ ID NO: 129167 - DNA, 969 bp, Artificial Sequence
  Description of Artificial Sequence: Synthetic coding sequence
ccacagcctcagtttggtcgccgaatggagtctaaggtgagcgagggggggctcaacgtgacgctcacgatccggctccttatgcacgggaaggaggtgggcagtatcattggcaagaaaggcgagactgttaaaaaaatgagagaagaaagtggagcacgaatcaacatatctgaggggaactgcccagagcgcatcgtgaccataactggcccaacagacgctattttcaaagctttcgccatgatcgcctataaattcgaggaagacattataaacagcatgagtaactcacctgcgacttcaaagcctccagtcacactgagactggtggtgcctgccagccagtgtggctccctcatcggcaagggcggctccaagatcaaagaaatacgcgaatccacaggtgctcaagtccaagttgctggcgatatgcttcctaatagcacagagcgtgccgttacaatctcaggaactcctgacgcaattatacaatgtgttaagcaaatttgcgtggtgatgctcgaagcttataccattcaagggcagtatgctatcccccatcccgaccagctgacaaagctccaccagctcgccatgcagcagactccatttcctcccctggggcagacgaaccccgctttccccggtgagaaactgcccctacacagctctgaagaagcacagaatcttatgggccagtcatctggtctcgatgcctcaccccccgcctcgacccacgagttgacaattccaaatgacctcatagggtgcataattgggcggcagggtactaagatcaacgagattagacagatgagcggggctcagatcaagatcgcgaatgccactgagggatccagcgagcggcagatcactatcacgggaacgcccgccaatatatcccttgcccagtacttgatcaatgcaagacttacctcagaagtgaccggcatgggcaccttgtag

SEQ ID NO: 129168 - DNA, 1038 bp, Artificial Sequence
  Description of Artificial Sequence: Synthetic coding sequence
atgggcgaaggcgacgccttctgggccccctcagtgctgccccattccaccctctctacattgtctcaccacccgcaaccccagttcggtcgccgaatggaaagcaaggtgtcagaaggcggacttaacgtgaccctgacgattcgtctactcatgcacggtaaggaggtcggctccatcattgggaagaagggtgaaacggtgaagaaaatgagggaggagtccggggctaggataaatatttctgagggcaactgccccgagcggattgtgaccatcactggacccactgatgccatattcaaggcattcgccatgatcgcttataagtttgaagaggatataatcaactccatgagcaactctcccgccacatcgaaaccccccgtaaccctgcgactggtagtgcctgcaagtcagtgcggcagtctgattgggaaaggcggatcaaagatcaaggagataagagaatccaccggggcgcaggtgcaagtagccggagatatgctgcccaatagtacagaacgggcagtcacaatctccgggacacctgatgcaattatccagtgcgtgaagcagatctgcgtcgtaatgctggaggcctatactattcaggggcaatacgcgatccctcaccccgaccttactaaactccatcagctcgctatgcagcagacccccttccctccacttggccagaccaatcctgcgtttcctggagaaaagctccctctgcactcttcagaagaagcccagaacctcatggggcagtcgtccggtctagatgcctcccctcctgcttctacacacgaactgacaattcccaacgatctgattggctgcattattggaagacagggcactaaaatcaacgagattagacaaatgagcggtgctcagatcaaaattgcaaatgccactgaaggatcaagcgagaggcagatcaccatcacaggaacaccggccaacatcagtctcgcacagtacttgatcaacgccagactcacatcagaagtgaccgggatggggaccctgtag

SEQ ID NO: 129169 - DNA, 1113 bp, Artificial Sequence
  Description of Artificial Sequence: Synthetic coding sequence
atgggggagggggatgccttttgggccccttcagttctgccccactcaacattatctaccctgtctcatcatcctcagccccagtttgggagaaggatggagtcaaaggtgtctgagggggggctgaacgtaaccctgactatccgacttttaatgcacggtaaggaggtgggcagcatcattggaaaaaaaggcgaaacggttaaaaagatgagggaagaatccggggcccggattaacatttccgagggtaactgccccgagcggatcgtaactatcaccggtccaaccgatgctatctttaaggctttcgcgatgatcgcctataaatttgaggaagatataattaactccatgagcaattcaccggctaccagtaagccacctgtgacacttcgcctggtcgtaccagcttcccaatgtggtagtctgatcggcaagggggggtccaagatcaaggagataagagaatctacaggggcacaggtccaggtggcgggcgacatgcttcctaacagtactgagcgcgctgtaactatttctggaacgcctgatgccataattcagtgtgtgaagcaaatctgtgttgtcatgctggaaagcccaccgaagggtgctaccattccatatagaccaaaacctgcttcaactcctgtcatttttgctggcggacaggcctacactatccagggccagtatgccataccacatcctgatctgactaagctccatcagctagccatgcagcaaaccccatttcccccactcggccagacaaaccccgcgtttccgggcgagaagctgcctttgcacagttccgaggaggcgcagaatctaatgggacagtcgagtggcctggatgcctccccccccgcttctacccatgagttaacaatccccaacgacttgattggttgtattattggccgccaggggaccaagattaatgagatccgccagatgagtggagcacagataaagattgccaacgccacagaaggtagctcagagcgacaaatcaccatcacaggcacaccggctaacattagtcttgctcaatatttgattaatgccaggctcacctccgaagtgaccgggatgggaacactctag

SEQ ID NO: 129170 - DNA, 1056 bp, Artificial Sequence
  Description of Artificial Sequence: Synthetic coding sequence
atgggagaaggagatgccttttgggcaccgtctgtgctccctcattcaactctgtctacactttctcaccaccctcagccacagttcggccggcgaatggaatccaaggtttcagagggcggactcaatgtgaccctcaccatcagactattaatgcacggaaaagaagttggttctataataggtaaaaagggcgagacagtgaaaaaaatgagagaagagtcaggcgccaggataaacattagtgagggtaattgcccggaacgaatagttacaatcacaggccccacagatgccatttttaaggcctttgccatgatcgcctataagtttgaagaggacattataaactctatgagcaactcccctgctacaagcaaacctcccgtgacactccgactggtggtgcctgcttcccagtgcgggtctctgattgggaagggtggtagcaaaataaaggagataagagagtccacaggagcgcaggtgcaggtggccggcgacatgctcccgaatagcaccgagcgggcagttactatctccgggacacctgatgccattattcagtgcgtcaagcagatatgcgtggtgatgctcgagtcaccccctaagggagccaccattccctatcgccccaagcctgcctccactcctgtgatctttgccggcggtcaggcatatacaatccaggggcagtacgcgatcccacacccagaccaactgactaagctccatcagttagccatgcaacagacccccttccctccccttggacagaccaaccctgctttcccaggcttggacgcgagccctcctgcttccacccacgagctcacaatccctaatgacctcataggctgtatcattgggcgccagggcaccaaaatcaacgagattagacagatgtccggagctcaaattaagattgcaaatgcaaccgagggatcatccgaacgtcagatcacgatcaccggtacgccagctaatatctctctcgcccagtacctgatcaatgcacgtcttaccagcgaagtcactggcatgggcaccctttag

SEQ ID NO: 129171 - DNA, 1116 bp, Artificial Sequence
  Description of Artificial Sequence: Synthetic coding sequence
atgggtgagggggatgctttctgggccccttccgttttgcctcacagcacactgagcaccctgtctcaccatccacagcctcagtttggtcggcggatggaatctaaggttagcgaaggtgggctgaatgtcaccctgacaattagactgctgatgcatggcaaagaagtgggctctatcatcggcaaaaaaggagaaaccgtgaagaagatgcgagaagagagcggcgccagaattaacatttctgagggcaactgccctgaacggatcgttacgattaccgggccaaccgatgcaatctttaaggcttttgcgatgatcgcctacaaattcgaagaagacatcatcaattcaatgtccaattctccggctacctccaagccccctgtgacactacggctcgtggtccctgcgtcccaatgcgggtctctgattggcaaaggaggctcaaaaatcaaggagattcgtgaatctacgggagctcaagttcaggttgcaggagacatgctgcccaattcaaccgaaagggcagtgaccatatccggcactccagacgccattatacagtgcgttaagcaaatatgcgtggtgatgttagaaagcccccctaaaggagccacaatcccgtacagacccaaaccagcatccacccccgtcatcttcgcaggaggacaggcctacactatacagggccagtacgctatcccgcaccccgatcagctgactaaactacatcaactggctatgcagcagaccccctttcctcccctaggtcagacaaaccctgccttccctggggagaaactccccctgcattcatctgaggaagcccagaatcttatgggccagagcagtggattggatgcttccccccccgcatcaacccacgagctgaccatccctaatgatcttatcggatgtatcattggaaggcaggggactaaaattaatgagatcaggcagatgagtggtgctcaaattaagatagcaaatgcaacagaggggtctagcgaacggcagataactattaccggcacaccggcgaatataagcttggcccaatatctcatcaacgccaggttaacttctgaggtcaccgggatgggtactttgtag

SEQ ID NO: 129172 - DNA, 1116 bp, Artificial Sequence
  Description of Artificial Sequence: Synthetic coding sequence
atgggggaaggtgacgcattctgggctccaagtgtgctcccccactccacattaagcacactttctcatcatcctcagccacaatttggcagacggatggaatctaaggtaagcgagggagggttgaacgtcactttaaccatccgcctgcttatgcacggcaaggaagtaggttccattatcggaaagaaaggggaaactgtgaagaagatgagggaggaatctggcgctcgaataaacatctccgagggcaactgtccagagagaattgttacaattactgggccaactgacgccatttttaaagcattcgctatgatcgcctacaagttcgaagaagacatcattaactctatgagcaattccccagcaacttccaagcctcccgtcactttgcgacttgtggtgcccgcatcgcagtgcggcagtctgattggcaagggggggtccaagatcaaggagattcgcgagagtactggagcccaggttcaggtggccggagatatgctcccgaactccacggagagggctgttaccatttcagggacccccgacgctattattcagtgcgtgaaacaaatatgtgtcgttatgcttgagtcacccccaaaaggcgctacgattccctatcggcccaagccagcaagtacacccgtgatttttgctggcggccaggcatacaccatccagggacagtacgctatcccccatccggatcagttgacaaaactgcaccagttggcaatgcagcaaaccccattccctccactgggccaaactaaccctgcctttcccggcgaaaagctcccactgcattcctccgaagaagcccaaaatttgatgggccagtcaagtggtctggacgctagtccccccgcaagcacccacgagttgactattccaaatgacttgatcggctgcattattggcaggcagggcacgaagatcaacgagatcagacagatgtccggcgcacagataaagatcgctaatgcaactgaagggagcagcgagcgccagataactatcaccgggactcccgccaacatttcactggcccagtatttaataaacgctaggcttaccagcgaagtcactggcatgggaacactctag

SEQ ID NO: 129173 - DNA, 18 bp, Artificial Sequence
  Description of Artificial Sequence: Synthetic coding sequence
atggagagtaaagtatag

SEQ ID NO: 129174 - DNA, 5070 bp, Artificial Sequence
  Description of Artificial Sequence: Synthetic coding sequence
atgggatcaaagagacgtcgggccacatctcccagtagctccgtgtcgggggactttgacgatggacatcactccgtctcaactcccggcccatctcgaaagagacggcggttaagcaacctgcccaccgtagaccctatcgccgtatgccatgaattgtacaatacaattagagactataaagatgagcagggcagattgctgtgtgagttgtttattagggcgccaaaaagacggaatcaacccgattattacgaagtggtgtcgcagccaatagatctgatgaaaattcagcaaaagctcaaaatggaggagtacgacgatgtgaatctgcttactgccgatttccagctgttgttcaacaatgctaagagctattacaagcccgattcgcccgaatacaaggctgcttgtaaactctgggatctgtacctgagaactcgcaatgagtttgtccagaagggggaggcggacgatgaggatgacgacgaggatggtcaagacaaccagggtacggtcaccgagggctcttctccagcgtatctgaaggagatcctggagcagctgctggaagccatcgtcgtggccacaaatccctcaggccgactgattagcgagctgttccagaagctacccagcaaggtgcagtaccccgattattatgccattatcaaggagcctattgacctaaaaaccatcgcacagcgcatccaaaatggttcttacaagagcatacacgcgatggctaaggacatcgacctattggccaagaacgccaagacttacaatgaacctggatcgcaggtgtttaaggacgctaactcaatcaaaaagatcttctatatgaagaaagcagagatcgagcatcacgaaatggccaagtccagcttacgcatgaggacacctagtaacttggccgccgccagactgactggcccatcccatagcaagggctcactgggcgaggaaagaaacccaacctcaaaatactatagaaataagcgtgccgttcagggcggccggctgtcagctatcaccatggctttgcagtacggctccgagagcgaggaggacgccgccctggcagcggcacgttacgaagaaggcgagtccgaagccgaaagtatcacttcattcatggacgtctcaaatccattctaccagctatatgacaccgtccgttcttgccgaaacaaccagggccaattgatagcagaacctttttatcacctgccgtctaagaagaaatatcctgattattaccagcaaattaagatgcctatctctctgcagcagattaggacaaaactcaaaaaccaggagtacgagactttagaccacctcgaatgtgacttgaatctaatgttcgaaaacgctaagcgctacaacgtgccaaactcagctatttacaagagggtgctaaagctgcaacaggtgatgcaagctaagaaaaaagagctggcccgccgggacgatatagaggatggagacagcatgatcagtagcgctacatccgacactggctccgctaagcgaaagtcaaagaagaatatccgaaaacagcggatgaaaatcctgtttaatgtggtattggaagcccgggaacccggttccggcagacggctttgcgacctgttcatggtgaagccatccaaaaaggactatccagactattacaaaataatcctggagcccatggatctaaaaatcatagagcacaatattaggaacgacaagtacgctggagaagaagggatgatcgaggacatgaagcttatgtttagaaacgcgaggcattacaacgaagaaggtagtcaggtatacaacgatgctcatattctggagaaactcctgaaagagaaaagaaaggagctagggcctctacctgacgatgatgatatggcatcgccgaaactgaagctctcccgaaaatctggcatatcccccaagaaaagtaaatacatgaccccaatgcagcaaaaactgaatgaggtgtatgaggccgtcaagaactatacagacaaaagggggcggaggctgtccgccatattcctgaggctgccatctaggtcagagttgccagactattatctgacaatcaagaagcccatggacatggagaagatccggtcccacatgatggcgaacaaatatcaggatatagacagcatggtggaagactttgtgatgatgttcaataacgcttgtacctataacgagcccgagtctctaatctacaaagacgccctcgtgctgcacaaggtcctgttagagacacgacgcgatctggaaggcgacgaggatagccacgttcctaacgtcaccctgctgattcaggagctcatccacaacttgttcgtgagtgtcatgtcacatcaagacgatgagggacggtgctactctgatagtcttgccgagatccccgccgtggatccaaacttcccgaataaacccccactcacgtttgacatcatccgcaagaacgtggagaacaacaggtaccggaggttggacctctttcaggagcacatgtttgaagtgttggagcgagctcggcgcatgaatcggacagattccgagatctacgaggacgccgtcgagctccagcagttcttcataaaaatccgagacgagctttgcaaaaacggagaaatcctgctctcccctgccctgtcttacaccaccaaacacttgcacaacgatgtggaaaaggagcggaaggaaaagctaccaaaggaaattgaggaagataagctcaagagggaggaggaaaagagagaagcagagaaatcagaagatagcagcggagctgccgggctttctggcctgcacaggacctacagtcaggactgctcctttaagaactccatgtatcatgtgggtgactatgtctatgtggagcctgccgaggcaaacctccagcctcacatagtctgtattgaaaggctctgggaggactccgcaggagagaaatggctatacggatgttggttttaccgaccaaatgaaacatttcacctggccaccaggaagttcttggagaaggaagtgtttaagtctgactactacaataaagtgccggtttccaaaatcctgggcaagtgtgtagtgatgttcgtgaaagagtacttcaagctctgtccagaaaattttcgagatgaggatgtgttcgtgtgtgaatcacgatacagtgctaagacgaagtcattcaaaaagattaagttatggacaatgcctatcagctcagttagattcgtgcctagggacgtgccattgccagtggtgagggttgcttcggtatttgcaaatgcagacaagggagatgatgaaaaaaacacagacaactccgaagacagcagggctgaagacaatttcaaccttgaaaaagaaaaggaggacgtgcccgttgagatgagcaatggagaaccggggtgccactacttcgaacaactccactacaacgacatgtggctgaaggtgggggactgtgtatttattaaatctcacgggcttgtgagaccgagagtgggcagaattgaaaaagtttgggtgcgcgatggggctgcctatttttacggaccgatattcattcatcccgaagaaaccgagcatgaaccgactaaaatgttctacaaaaaggaagtatttctgtcaaacctcgaggagacatgtcctatgacctgtattttaggaaaatgtgccgtcctctccttcaaggacttcttgtcctgccgtcccacagaaattcctgagaatgacattctgctatgtgaatcacgttacaatgagtcggacaagcagatgaagaagttcaagggactgaagaggttcagccttagcgccaaagtagtggacgatgaaatttattatttcaggaagccgatcgtgcctcagaaggaacctagccccctactagagaagaagatccaactacttgaagccaaattcgcggagctggagggcggagacgatgatatagaggagatgggggaggaagatagcgaggtgatcgagccaccaagccttccccaattgcagacccccctggccagcgagcttgacctcatgccttacactccacctcagtccacacccaagtcagcgaaaggctctgctaagaaggaaggcagtaagagaaagatcaacatgtccggttacattcttttctctagcgagatgcgagccgttatcaaagcacagcatcccgactatagctttggagagctttcacgactagtcggaactgagtggagaaatctggagaccgccaagaaggcggagtacgaagaaagggccgccaaagtcgcggaacagcaagaaagggagcgtgccgcacagcagcaacaaccgagcgcctccccacgtgctggcacccctgtcggggcgctgatgggtgtcgtaccgccacccaccccaatgggaatgctcaaccagcaacttacaccggtggcaggtatgatgggcggatatccacccggcctgcccccactgcaagggcccgtggatggccttgtgtcaatgggaagcatgcagcctctgcacccaggcggtccacctccacaccacttgccccctggcgtgcctggtctacctggaattcctccgccaggagtgatgaaccagggcgtagccccaatggtgggaaccccagcccctggtggttctccctacggccagcaggtcggggtcctagggcctccggggcaacaagccccacctccgtatcctgggcctcacccagccggccctccggtgattcagcagcctacaactcctatgtttgtggcgccaccgcctaagactcagaggctgttgcacagcgaagcttacctgaagtatatcgaggggcttagcgcagagtccaacagtatctcgaagtgggatcagacgctggccgcccgacgcagagacgtgcacctgtcaaaggagcaggagagcagactcccaagtcactggctgaagtcaaagggggcacatacgacaatggccgatgcactttggcgactgagggacctaatgctcagggatacattgaacatccgacaagcgtacaatttggagaacgtgtag

SEQ ID NO: 129175 - DNA, 4749 bp, Artificial Sequence
  Description of Artificial Sequence: Synthetic coding sequence
atggggagcaaacgccggcgagcgacatcacctagctctagcgtctccggggactttgatgacggccaccacagcgtttccacgccagggccctcccggaaaagaagaagactgtctaaccttccaaccgtagacccaattgccgtgtgccacgagttgtacaatactataagggactataaggacgagcagggcagactcctatgcgagcttttcatccgtgctccaaaacgacggaaccagcctgattactacgaggtcgttagtcaacctatcgacctcatgaaaatccaacagaagctgaagatggaagaatatgacgacgtcaacctgcttacagccgattttcaactgctatttaataatgccaaatcgtattataaacccgattcccccgagtacaaagcggcctgtaaactctgggacctttatttgcgaacccggaatgaattcgtgcagaaaggtgaggccgacgacgaagatgatgacgaggacggtcaggataatcaggggacagtgactgagggttcttcacctgcatacttgaaagagatcttagaacaactgttggaggccatcgtcgttgccactaacccgtcaggtcgcctcattagcgagctgttccaaaagttgccatctaaagtgcagtacccggattactatgctatcattaaggagccaattgatttgaagactattgcacaacgtattcagaatgggtcctataagtctatccacgctatggcaaaagatatcgatttgctggctaagaacgccaagacttacaatgaacctgggtcccaggtgtttaaggacgctaatagtatcaaaaaaatcttctatatgaagaaggctgaaatcgaacaccacgagatggctaagtcctctcttcgcatgaggacaccatcaaatctggccgctgcccgtctaactgggccttcgcactccaagggcagcctaggagaggagagaaaccctactagcaaatattataggaacaaaagagctgtgcagggcggcaggctgtccgccataaccatggcactccagtacggatccgagtctgaagaggacgcagctctcgccgctgcccgatacgaggagggagaatctgaggccgagagtatcacgagttttatggatgtgagtaaccctttctatcagttatatgacacggtgcggagctgccggaacaaccaggggcagctgattgccgaaccattctatcacttacctagtaaaaaaaagtatccggattactaccaacagatcaaaatgcccatttctctgcagcaaatccgtaccaagcttaagaatcaggaatatgaaaccctggaccacctcgagtgtgacctcaatctgatgtttgagaatgccaagcgctacaacgtgcctaatagcgctatctacaaacgggtcctcaagcttcaacaggttatgcaagccaagaagaaggagctggcacgcagagacgacattgaggacggcgatagcatgataagctcggctacgagtgacacaggaagcgcaaagagaaagtctaaaaagaacatacgtaagcagcggatgaaaattctgttcaacgtggttttggaggcgagggaacctggcagtggacggcgattatgcgacctatttatggttaaacctagcaagaaggactatccagattattacaaaattattctagagcccatggacctaaagattatagagcataatatcagaaacgacaagtatgcgggagaggagggcatgatcgaggacatgaagttgatgttcaggaacgcgcgacattacaatgaagagggctcacaggtatacaatgacgcccatattttagaaaaattgctcaaggagaagcggaaagagttgggccctctgcccgatgacgatgacatggccagccctaagttgaagctgagccgaaaatccggcatttcccccaaaaagtccaaatacatgacccctatgcagcagaagctgaatgaggtatacgaggccgtaaagaattacacagataaaagaggccgccgtctgtcagccatcttcttaaggctccctagcaggtcagaactcccagactattatcttaccatcaaaaaaccaatggatatggaaaaaataaggtcacacatgatggcgaataaatatcaggacattgacagcatggtagaggattttgtgatgatgtttaacaacgcctgcacctataatgaaccggagagtctaatctacaaggacgcccttgtcttacataaggtgcttctcgagacacgccgcgatctagaaggtgatgaagattcccacgtccccaacgtgacactgctgatccaggaactgatccacaacctttttgtgagtgtcatgtctcatcaggatgacgaaggccgctgctattctgatagtctcgctgagattccggctgtggacccaaactttccaaacaagccccctttaacattcgatatcattcggaagaatgtggaaaacaataggtaccgacggctggacctgtttcaagagcacatgttcgaggtattagaacgtgccagaaggatgaatcggaccgactctgaaatttatgaggatgccgtcgagctgcagcagtttttcatcaagattcgagatgagctctgtaaaaacggcgagattttactgagccctgccttatcatatacgacgaagcatctacacaacgatgtagaaaaagaacgcaaagagaaacttcccaaggagattgaggaagataagctgaagagagaagaagagaaacgcgaagcggagaagagtgaagatagttccggcgctgccggcctctccggcctacacagaacgtactctcaggactgtagttttaaaaattcaatgtatcatgttggtgattacgtgtacgtcgaaccagctgaagccaatttacagcctcatatcgtttgcatcgaaaggctatgggaggattcggccggggaaaagtggctgtacggctgttggttttataggccaaacgagacatttcatctggcgactcggaaattcttggaaaaggaggtgttcaaaagcgactattataataaagtccccgtaagtaagatactaggtaagtgcgtcgtgatgttcgtgaaggagtacttcaaactttgtccagaaaacttcagagatgaggacgtgttcgtctgcgaatctcgttattctgcaaagaccaaatcctttaagaaaatcaaattatggactatgcccatttcttccgttagatttgtgcctcgggacgtaccactgcccgtggtgcgggtcgcatcagtcttcgctaacgccgacaaaggggacgatgagaaaaacacagacaattcagaagatagtcgcgctgaggacaatttcaatctggagaaagaaaaagaggatgtgccagtggagatgtctaatggcgaacctggctgccactactttgaacagctccactataacgacatgtggctcaaggttggcgattgcgtcttcattaagtctcatgggttggtacggccacgagtaggtcgcatcgaaaaagtttgggtgcgggatggagcagcctatttctatggaccgatattcatccaccctgaagaaactgaacacgaacctaccaaaatgttctacaaaaaggaagtctttctgtcaaatctcgaagaaacgtgccccatgacatgcattctgggcaagtgtgccgtcctgtccttcaaggacttcctctcctgccgtccaactgagattcctgagaacgatatcttactgtgcgagagcagatacaacgagtccgacaagcaaatgaaaaagttcaaaggcctgaagcggttttccctcagcgctaaggtggtcgacgatgagatttactactttcggaaacccatcgtaccccagaaagaaccgagcccattgctggaaaagaagattcagttgctcgaggccaaatttgcagagctggaggggggggatgacgacatagaagaaatgggcgaggaagacagtgaagttattgagcctcccagcctgccccaactgcaaacacctctagcctctgagttggacctgatgccctacactcctccacagagtacacctaaatctgcaaaaggtagcgccaagaaggagggcagtaagcgcaaaattaacatgagtggctacatacttttttcatcagagatgcgggctgtgatcaaggcccagcacccggactactcttttggggaactgtcccgcctagtggggacagagtggagaaacctcgaaaccgctaaaaaagcagaatacgaaggagtgatgaatcagggcgtggccccgatggtgggcacccctgctccagggggatccccgtatggacagcaggtcggcgtactgggcccacctggacagcaagccccccctccttatccagggccccaccctgcagggccaccagtgatacagcaacccactactccaatgttcgttgctccccccccgaaaacccagcgcctgttgcactcagaagcctatctgaaatatatcgaaggactctccgccgagtctaacagcatttcaaagtgggatcagacccttgcggccaggcgtcgagatgtacatctttctaaggaacaggagtccagactcccctcccactggcttaagagcaagggtgcacacaccaccatggccgatgccttgtggcgtttacgggacctgatgctccgggacaccctgaacatcagacaggcctataaccttgagaacgtgtag

SEQ ID NO: 129176 - DNA, 4809 bp, Artificial Sequence
  Description of Artificial Sequence: Synthetic coding sequence
atgggaagcaagaggcgaagagcgacatccccttcctcatctgtcagtggtgacttcgacgatgggcaccatagcgtgtcgacccccggaccttcacgcaagagacggagactgtcgaatctaccaacggtggaccccatagctgtgtgccatgagctctataatactattagagactacaaagatgagcagggtcgcctgctctgtgagttatttattagagctcctaaaaggagaaaccagccagactattacgaggtagtgtcccagccaatcgaccttatgaagatccaacaaaagcttaagatggaggagtatgacgatgtgaacctcttgaccgccgactttcagctgctttttaacaatgccaagtcctactacaagcccgacagccctgaatataaggcagcgtgtaaactctgggatctctacctcagaaccagaaacgaattcgtgcaaaagggcgaggccgatgacgaggatgacgatgaagatggacaggataatcaggggacagtcacggaaggtagtagtcctgcttatctaaaagaaatcctggagcaactgttagaggccattgtcgtggctacgaatcctagcgggcgactcataagtgaactgttccagaagttgccttccaaggtgcagtacccggattactacgccatcattaaggaaccaatcgacctaaaaacgatcgcccagcgtattcagaatggtagctataaatccatccatgcaatggcaaaagatattgatctgctggctaaaaatgcgaaaacctacaatgagccaggatcacaagtgttcaaagatgcaaactctatcaagaaaatcttctatatgaagaaggccgagatagagcatcacgaaatggccaagtcttccctgagaatgtctaacaagagagctgtccaagggggacgtttgtcagcaattaccatggctctacagtacggttccgagagcgaggaggatgctgcattggcggcggcaagatacgaggagggagagagcgaagcagagtctataaccagcttcatggatgtgagtaatccgttctatcaactgtatgacactgtccgctcctgcaggaataatcagggccagttgatcgcagagcctttctaccatttgccttctaagaagaagtaccccgattactaccagcagatcaaaatgccaatttcgttgcagcagatccgtaccaagctgaagaatcaggagtatgagactctcgaccatttggaatgcgatcttaatctgatgttcgagaatgccaaaagatacaatgtcccaaatagtgcaatttacaagcgggttctcaagctgcagcaagtgatgcaagccaagaagaaggagctggctcgcagggatgacattgaagatggtgattccatgatcagttcagctacttctgacaccggatccgccaaacgtaaatcgaaaaaaaacatacgcaaacagaggatgaaaatccttttcaatgtcgtattggaagcaagggagccaggtagcggcaggcgcttgtgcgacctgtttatggtaaagccaagcaaaaaggattacccggactattacaagataattctcgagcctatggatttgaaaatcatcgagcacaatatcagaaatgataagtatgccggtgaagaggggatgattgaagacatgaagctgatgttcaggaacgcaagacattataatgaggagggaagccaagtttataatgacgctcacattctggaaaagctgctaaaagaaaagcgcaaggaactcggtcctctgcccgatgacgacgacatggcctcccccaaactcaagttgagccgaaaatcaggcatatctccaaaaaagagcaagtacatgacgccaatgcagcaaaagctcaatgaagtctacgaagcggtgaagaactacacagacaaacgggggaggcggctgtcagctatcttcctccgcctacctagcagatctgaattgcccgattattaccttacaatcaagaaacctatggacatggagaagattcgatcccacatgatggccaacaagtaccaagatatcgattcgatggtcgaggacttcgtcatgatgttcaataatgcctgtacatataatgagccagagtcactcatctataaagatgccctagttttgcataaggttctgctagaaacaagaagagaccttgaaggagatgaggactcccacgtccccaatgttaccctcctaatccaggagctcatacacaacctctttgtgtctgttatgtctcaccaggacgacgagggtagatgttattctgatagcctggccgagatccccgcagtagatccaaattttccaaacaagcccccactcacgtttgacatcatccgtaaaaacgtcgagaacaacaggtatcggcgactggatctgttccaggaacacatgtttgaagttctggaaagagcccgccggatgaatagaacggactcagaaatctacgaagacgccgtggaactgcagcagttttttataaaaataagagacgagctctgcaagaacggggagattcttctctctccagccctttcatatactaccaagcatctacataatgatgtcgagaaggagcgcaaggagaaactcccaaaagagatagaagaggataaactgaaacgcgaagaggagaaacgggaagccgaaaagagtgaggattcctctggcgccgctggactctccggcctgcacagaacctattcccaagactgttcattcaagaactctatgtatcacgtgggtgactacgtctatgtcgagcctgccgaggccaatctacaaccacacatagtgtgtatagaaagactgtgggaagactccgccggtgaaaagtggctgtatgggtgctggttctaccgcccaaatgagaccttccatttagctacgaggaaattcctagagaaggaggttttcaagtccgattattataataaagtacccgtatccaagatcttgggaaagtgtgttgtgatgttcgtgaaagagtacttcaagctgtgtcctgagaacttccgagatgaggacgtttttgtgtgcgagtccagatactctgctaagacgaaaagtttcaagaaaatcaagctctggacaatgcctatttcatctgtgaggttcgtgccacgcgatgttcctctgccagtggtgagagttgcctctgtcttcgcaaacgcagacaagggagatgacgagaaaaacaccgacaactctgaggactcaagggccgaagacaatttcaatctcgagaaggagaaagaagacgtgccagtcgagatgagcaatggggagcctggctgtcattacttcgaacaactccattacaacgatatgtggctcaaggtgggagattgcgtcttcattaaatcacacggcctggtaaggccacgcgttgggaggattgaaaaagtgtgggtccgggatggagccgcctacttttatggtccaatttttatccacccggaagaaactgaacacgaacctacaaagatgttttataagaaggaggtttttctgtcaaacctggaggagacttgcccaatgacatgtattctgggcaagtgcgccgttcttagtttcaaggacttcctgtcctgccgccctacagagatcccagaaaacgacatccttctctgcgaaagccgctataacgagagtgataagcagatgaagaaattcaagggtctgaagcggtttagtctgtcggcaaaagtggtcgacgatgaaatctattacttcaggaagcccatcgtgccgcagaaggaacccagtccactcctcgagaagaaaatacagctcctagaggccaagttcgctgaattggaaggcggcgacgatgacatcgaagaaatgggagaagaggattctgaagtcatagaacccccctccctccctcagctgcagacccctctggctagcgagctggaccttatgccttacactcctcctcaatcaacccctaaaagcgccaagggaagtgctaagaaagagggaagtaaacggaagatcaatatgagtggatatatcctgttctcctcagagatgcgcgctgtgataaaggctcagcaccctgattactcgtttggggaattatcaagactggtggggacagaatggagaaacctcgagacagcgaagaaggccgagtatgagggcatgatggggggatacccgcctgggttgccccccttgcagggcccagttgacgggctggtcagtatgggttcaatgcagcccctgcatcccggcgggccgccacctcaccacttgccacctggcgtgccaggtctccccgggataccaccaccaggagttatgaaccagggcgtagccccaatggtcggcacccccgctccaggtggcagtccttacggacagcaggtgggtgtgctcggacctccaggccagcaagcccctccgccgtaccctggaccccaccctgccggaccacctgtcatccagcagcctacgacacctatgtttgtcgctccccctcccaaaacccagcgacttctccattcagaggcctatctgaagtatatagaaggtttgtccgccgaaagcaacagtattagcaaatgggaccagacattggccgctcgcagaagagacgtgcacctgtcaaaagagcaagagagtagactgccaagccactggctcaaaagcaagggggctcataccactatggccgatgcactgtggcggctgagggatctgatgctacgcgatacccttaacattcgtcaggcctacaacctcgagaatgtttag

SEQ ID NO: 129177 - DNA, 4749 bp, Artificial Sequence
  Description of Artificial Sequence: Synthetic coding sequence
atgggaagcaaaagacggagagccacatcccccagtagttctgttagcggggatttcgatgacgggcaccacagcgtgagtacaccaggaccttcgcgaaaacggagacgcctgtccaacctcccgactgtggaccccatcgccgtgtgccacgaactatataatactattcgtgattacaaagacgaacagggaagactgctgtgcgaattgttcatccgtgcaccaaaaagaagaaatcagccggattattacgaagtggtctctcaaccaatcgaccttatgaagatacagcagaagctcaaaatggaagagtacgatgacgttaacctgctcacagccgactttcagcttttgtttaacaatgccaagtcctattacaaaccggactcgcctgagtacaaggcagcatgcaagttatgggatctgtacctccggacccggaatgagtttgtgcagaaaggcgaagcggatgacgaagacgacgacgaggatggccaagacaatcaagggaccgtcaccgagggctcttcccccgcttatttgaaggagatcctggagcagttgttggaggcaattgtggtggccaccaacccgtctggtaggctgattagtgaacttttccagaagctgccatctaaggtgcagtatcccgactactacgccattataaaagagccaatcgaccttaagactattgcccagcgcatccaaaacggctcatacaagagtattcacgcgatggctaaggacatcgatctcctagctaaaaatgccaaaacatataatgaacccggaagccaggtgttcaaagatgcaaactccatcaagaagatcttctacatgaagaaggcagaaatagagcaccacgagatggctaagagtagccttcgaatgaggaccccctcgaacctggctgcggccagacttacagggccatctcactctaagggctctttaggagaggaaagaaaccctaccagcaaatattaccggaataagagagccgttcaaggtggacggctttcagccatcaccatggccctgcaatacgggtctgagtccgaggaagacgccgctctcgccgccgcccggtatgaagaaggagaatctgaagcggagtcaattacaagcttcatggacgtctctaatcctttttaccagctgtacgacaccgttagaagctgtcggaataatcaaggacaactcatagctgagcccttctatcacctgcctagcaaaaaaaaatacccagactactaccagcagatcaagatgcccataagtctgcagcagattcgcaccaaactaaagaatcaggagtacgagactctggatcatctcgaatgtgatctgaacttgatgttcgaaaatgcgaaaaggtacaatgtgcctaatagcgccatttacaagcgtgtgctcaaactacagcaggtgatgcaggctaagaagaaggagttagcccgacgcgatgatattgaagacggtgattctatgatctcaagtgccacgagtgacaccgggagcgctaagagaaaaagtaaaaagaatattcgaaaacagcgcatgaagatcctgtttaatgtggtacttgaagccagagaacctgggagtggccgacgactctgcgacctcttcatggttaaaccttcgaaaaaggattatccagattactataaaataattctggaaccaatggatctgaagattatcgagcacaatattaggaacgacaaatatgccggtgaagagggaatgatagaagatatgaagttaatgttcaggaacgctaggcactacaacgaagagggctcacaggtatacaatgatgcgcacatactggagaagctgctgaaagagaagagaaaagaactgggaccactgccagatgatgatgatatggccagtccaaaattaaaactgtcgcggaagagtggaataagccctaaaaaaagcaagtatatgacgccaatgcagcagaaactgaacgaggtctacgaagccgtcaaaaactacacagataaaagaggccgccgtttatccgctattttcttgcggttgccctcaagaagcgagttgcctgattattatctgaccattaaaaaacccatggatatggaaaagattcgaagtcatatgatggctaacaagtatcaggacatcgattcaatggtggaggattttgtgatgatgtttaacaacgcatgcacctataacgagcctgagtccttaatttacaaggacgcccttgtcctacataaagtcctactggaaacaaggagggatttggagggcgacgaggacagccacgtgccaaacgtgacactgttaattcaagagcttattcacaatctgttcgtgagcgtgatgagtcatcaggatgacgaaggcagatgttacagtgattctctggccgaaatccccgctgttgacccgaatttcccgaacaaacccccactcactttcgatataattcgaaagaatgtcgagaataataggtatcggcgcctagacctattccaagagcacatgttcgaggtcctagaacgggctaggcggatgaaccggacggattcggaaatctacgaagatgccgtagagctgcaacagtttttcattaaaatccgcgacgaattgtgtaagaacggggagattctgctatcaccagccctttcgtacactaccaagcacttgcacaacgatgtcgaaaaggagagaaaagagaagctgccgaaggagatcgaggaggacaagctgaagcgggaggaggaaaagagagaggctgagaagagcgaagacagcagcggtgcagcagggctgagtggcctccatcggacttactcacaggactgtagctttaagaactcgatgtaccatgtaggcgattacgtctacgtagaaccggcagaggcaaacctccagccccacatcgtttgtattgaaaggctctgggaggattccgctgaaaaagaggtttttaaatctgactattataacaaagtgcccgtatcaaagatcctggggaagtgtgttgtgatgtttgttaaagagtatttcaagctatgtccagagaactttcgtgatgaagacgtgtttgtgtgtgagagtagatactcagccaaaaccaagtcttttaagaaaattaaactgtggaccatgccaatctctagcgttcgctttgtgccaagggacgtacctttacccgtggtgcgtgtcgctagcgtgttcgccaacgctgataaaggggatgatgagaaaaataccgacaacagcgaggacagtcgggccgaggataattttaacctagaaaaggaaaaagaggatgtgccggtcgaaatgtcaaacggggagccagggtgccactactttgagcagctgcactacaatgacatgtggctgaaagttggggattgtgtgtttatcaaaagccacggattagtaaggccacgggtgggccggatcgaaaaagtatgggtcagagatggtgcggcttacttctatgggccaatatttatccacccagaggaaactgagcatgagcctaccaaaatgttttacaagaaagaggtcttcctaagcaatctggaagagacttgtccaatgacctgcatactaggcaaatgtgcggtactgtctttcaaagatttcttgagttgtagaccgactgagattcccgagaatgacatcctgttgtgtgagagtagatataacgagtcggataagcaaatgaagaaatttaaagggcttaaaaggtttagtttgtctgccaaagtggtggacgatgagatttattattttcgcaagccgattgtgccacagaaggagccctcgccccttctggagaagaagattcagctgcttgaagcaaagttcgccgagttagagggcggtgacgatgatattgaggagatgggtgaggaagactcggaatcaacaccgaagagtgcaaaaggtagcgcaaaaaaggaaggttccaagcgaaagatcaacatgtctgggtacatcctgttttcttctgagatgagggcagtgattaaagcgcagcacccggattacagctttggagaacttagccgattggtcggaacagaatggcgtaatctggagactgcaaaaaaagccgagtacgagggaatgatgggcggataccccccaggactaccccctctccaaggcccggtggacggccttgtgagcatgggtagtatgcagccactacacccaggggggcccccgccccaccacctgccgcccggcgtgcccggactgccgggcattcctccgcctggggtcatgaatcagggtgtcgcccccatggtcggtaccccagcccccggagggtctccatatggccaacaagtgggcgtgttgggccccccaggacagcaggcacccccgccctacccgggcccacacccagccgggcctcctgtaatccagcagcccacaacaccaatgtttgtagctccaccacctaaaacacagaggctgttgcatagcgaagcttatcttaagtacatagagggcttatctgccgagtccaacagtatttccaaatgggatcagactcttgctgccaggaggcgcgacgttcacctttcgaaagaacaggagtcccgtttaccatcccactggctgaagagtaaaggtgcacatacaactatggccgatgctctgtggaggctgcgggacctcatgcttcgggacaccctgaatatcaggcaagcgtacaacctggagaacgtatag

SEQ ID NO: 129178 - DNA, 4905 bp, Artificial Sequence
  Description of Artificial Sequence: Synthetic coding sequence
atgggcagcaagagaagacgggcaacttctccctccagtagcgtgtccggcgattttgacgatggacatcactcggtcagcacccccggccctagtcggaagagacgacggctgtccaatctgccaacagtggaccctattgcagtgtgccacgagctatacaataccatacgggactataaagacgaacagggacgccttctttgtgaactgttcatcagagctcccaaaaggagaaaccagcctgactattatgaggtggtgagccaaccaatcgaccttatgaaaatccagcagaagttgaagatggaggaatacgacgatgtgaacctgctgaccgccgacttccaactactgttcaataatgctaagtcctattataagcctgactctccagagtacaaagctgcctgtaagctctgggacttatatttacggacacgcaatgaattcgtgcaaaaaggcgaggcagatgacgaagatgacgatgaagacgggcaggacaaccagggaaccgtcactgagggcagctcccctgcgtatttgaaagagatcctggaacaactcctggaggccattgttgtggcgacgaacccaagcggccggctgattagtgaattgttccagaaattgcccagcaaggtccaatatccagactattatgccatcataaaggagcctatagatctgaagacaatcgcccaaagaatccaaaacgggtcgtataagtctattcacgcaatggccaaggatattgatctgctcgctaagaacgccaaaacatacaatgaaccaggttctcaggtctttaaggacgctaactccattaaaaaaatcttttatatgaaaaaggccgagatagaacatcatgagatggctaaaagttcactgcgcatgagaaccccttccaatctggcggctgcacgcttgaccggcccaagccatagtaaaggtagcctgggagaagagagaaacccgactagtaaatactatcggaacaagcgtgcagttcagggagggagactgagcgccatcacaatggccctgcagtacgggagcgagtcggaagaggatgcggctctcgctgctgcgcggtacgaggagggtgagtctgaggcggaaagtattacttctttcatggacgtgtccaaccctttctaccagctgtacgatactgtcaggtcctgtaggaacaaccaggggcagttgattgccgagccattttatcacctgccctctaaaaaaaagtacccggattactaccagcagatcaagatgccaattagtctccagcagattaggaccaaacttaagaaccaggaatatgagacactggaccacctggaatgcgatctgaacctcatgtttgagaacgctaaaaggtacaacgtccccaacagtgcaatttacaagcgtgtgctaaaactgcagcaggtaatgcaggccaaaaagaaagaacttgcccgccgtgacgacatcgaagatggtgattccatgatttcatccgcgacgtctgacactggctccgccaagagaaagtccaagaagaatatcagaaagcaacgaatgaagatcctctttaacgtggtgctggaagccagagaaccagggagcggtcgccgtctgtgtgatctcttcatggtgaaaccctccaagaaggattaccccgactattacaagattatcctagagccgatggaccttaagattatagagcacaatatcagaaatgacaagtatgccggtgaggaaggtatgatcgaggatatgaaactgatgttccgcaatgctcgacactacaatgaggaaggttctcaggtctataatgatgcacacatccttgaaaaattgctaaaggaaaagcgaaaagaactgggaccactgcccgacgacgatgatatggctagtcccaagctgaaactctcccggaagtcaggcattagtccaaaaaagtctaaatatatgactcctatgcaacaaaaactgaacgaggtatacgaggccgtgaaaaattataccgacaagcgcggtcgccgactcagcgcaatcttccttagactgcccagccggagcgaactgcctgactactatttgaccatcaaaaagcccatggacatggaaaagatcagatcacacatgatggctaataagtaccaggacatagactccatggtggaggactttgtcatgatgttcaacaacgcatgtacctataacgagccagaatcactgatctataaggacgcattggtcctacacaaagttctgctggagacaaggcgagacttggaaggagatgaagattcccatgtaccaaacgttacactgctgatccaggaactgatccacaatctattcgtgtctgtcatgtcccatcaggatgacgaggggcggtgctattctgactcgttagctgagataccagctgtagatcctaacttccccaacaaacctcccctcacatttgatattatccgtaagaacgtagagaacaatcgttaccgaaggctggacctcttccaggaacatatgtttgaagtactcgaacgggcaagaaggatgaaccggacagattccgaaatctacgaggacgcagtcgaattacagcagttctttatcaagattcgcgatgagctgtgtaaaaatggggaaatcctgctcagccctgcactgtcctataccacgaagcatttacacaacgatgttgaaaaagagcgcaaggaaaagctgcccaaggaaatcgaggaagacaaactgaaacgcgaggaagaaaaacgcgaggcagaaaaaagcgaggacagcagcggggcagccggactaagtggtttacatcgtacctattcccaagactgctccttcaaaaatagtatgtaccacgtgggcgattacgtctatgttgaaccggcggaggccaacttgcagccccacattgtttgcattgaaagactttgggaagattccgctggcgaaaagtggttgtacggatgttggttttatagacccaacgaaaccttccacttggctactcgcaaattcctggagaaggaagtctttaagtctgactattataacaaggtccccgtctcaaagatcttggggaaatgtgtagttatgttcgttaaggagtatttcaagttgtgcccggaaaatttcagagatgaagacgtgtttgtgtgcgaaagtaggtattctgcaaaaactaaatcgttcaagaagatcaaattgtggaccatgcccattagtagtgtccgcttcgttccaagggatgtgcctctacctgtggtgagagtcgcctccgtgtttgccaacgcggacaagggagacgatgagaagaatacagataactcagaggactccagggcagaggacaactttaatctggagaaggagaaggaggatgtgcctgtcgagatgtcaaacggcgaaccaggttgccactacttcgagcagctgcattacaacgacatgtggttaaaggttggcgattgcgtgttcatcaagagccacggccttgtgaggcccagagtcggtaggatcgaaaaagtttgggtcagagacggcgctgcctacttttacggtcccatctttatccatcccgaggagacggagcacgagccaactaaaatgttttacaagaaggaagtctttctttccaatctcgaggagacctgcccaatgacttgtattctcggaaagtgcgccgtactgtcttttaaagacttcctcagctgtaggcctacagagattcctgagaacgatattctcctgtgtgaatcacggtataatgagagtgataaacagatgaagaagttcaagggcctaaagagattctccctttcagcaaaggttgtagatgatgaaatctactattttaggaagcctatcgtccctcagaaagagccaagtcctctgctcgagaagaagattcaactgcttgaggcaaagtttgcagaactcgaaggaggtgatgacgacattgaagagatgggcgaggaggactctgaggtgatagagccaccctcactgcctcagcttcagacacccctagcatcagagctggatctaatgccatatactccaccccaatcgactcccaaaagcgcaaaaggcagtgctaagaaggagggttcaaaacgcaagattaatatgtctgggtacatcttgttctcttccgaaatgcgtgccgtgatcaaggcacagcatccagattattccttcggcgagctgagtcgcttagtcggtacagagtggagaaatcttgagaccgctaaaaaggccgagtatgaaggcatgatgggcggttacccccccggcctgcctccactgcaggggccagtggatgggctggtgagtatgggttctatgcagcctttacaccccggtggaccaccccctcaccatctgcccccaggagtgccaggccttcccggtattcccccacctggagtcatgaaccagggggtggcccccatggtgggaacccctgctcccggaggaagcccttacggccagcaggtgggggtgctcggcccgccgggacagcaggctcctcccccttaccccggtccccatccagctgggccaccggtgatccagcagccaaccacaccaatgtttgtggctcccccccctaaaacccagcgactcttacacagcgaggcatacctgaaatacattgagggcctatctgctgagtctaactccatctccaagtgggatcagactctcgcagcaaggcggcgtgacgtgcatctgagcaaggagcaggagagtaggctccctagtcactggcttaaaagcaagggcgcacacaccaccatggcggacgcattatggagattacgcgaccttatgctacgagacactctcaacatcaggcaggcctacaaccttgagaatgtctag

SEQ ID NO: 129179 - DNA, 459 bp, Artificial Sequence
  Description of Artificial Sequence: Synthetic coding sequence
atgggtagtaagcgacggagggctacttccccctctagttcagtgtccggcgacttcgatgacggacatcactctgtgagtacccccggcccttcccggaaaaggcggaggctgtcaaatctccccaccgttgatccaatcgctgtgtgccatgagctctacaacactatcagggattataaggatgagcaggggagactcctgtgcgaactgtttattcgagcccctaaacggagaaaccagccagactactatgaggtggttagtcagcccattgatctgatgaagatccagcagaagttgaagatggaggagtacgatgatgtgaacctgctgacagctgacttccagttgctctttaacaatgctaagtcctactataaacctgactcccctgagtacaaagcagcttgcaaactgtgggacttgtatctcaggacacggaatgaatttgtgtag

SEQ ID NO: 129180 - DNA, 81 bp, Artificial Sequence
  Description of Artificial Sequence: Synthetic coding sequence
atgggatccaagcgccggagagctacctccccctctagtagcgtgtcgggtgattttgatgacggacaccacagcgtgtag

SEQ ID NO: 129181 - DNA, 693 bp, Artificial Sequence
  Description of Artificial Sequence: Synthetic coding sequence
atgggaagcaagcgacgccgagccaccagtccatcctcctcagtgagtggcgactttgacgatgggcaccacagcgtgtccaccccgggcccttctagaaaaaggagaaggctctcaaacttgccaacagttgacccaatagccgtgtgtcacgaactctataacactatccgggattataaagatgagcagggtaggctgctttgtgaactttttattagagcccccaagagacgtaatcagcctgactactatgaagtggtgtctcaaccgattgacctaatgaagatccaacagaagctaaagatggaggaatacgacgatgtgaacctccttactgcggactttcagttgctgttcaacaacgcaaagtcatattacaaaccggattcccctgagtacaaggccgcgtgcaaattgtgggacctctacttgaggacccgtaacgagttcgtccagaaaggagaggcagacgacgaagatgacgacgaggatggacaggataatcagggaaccgtaaccgaaggtagctctccggcgtatctcaaagagatactggagcagctgttagaagctattgttgtggccactaaccctagcggacgcctaattagcgaactgtttcagaaactgcccagcaaagtgcagtacccagattattatgcgatcattaaggaaccaatcgatctctag

SEQ ID NO: 129182 - DNA, 132 bp, Artificial Sequence
  Description of Artificial Sequence: Synthetic coding sequence
atgggatctaaaaggcgccgcgctacgtccccctctagcagcgtgagtggcgactttgatgacggacatcactctgtgagcacccccggaccctcccggaagcgccgccgactcagcaatttacccacatag

SEQ ID NO: 129183 - DNA, 357 bp, Artificial Sequence
  Description of Artificial Sequence: Synthetic coding sequence
atggggtctaagcgccggcgggctacttccccgagctcatctgtcagtggagacttcgacgatgggcaccattccgtcagtacacctggccctagtagaaagcggcggagactgagcaacttgcccaccgtggaccccatcgcggtgtgccatgaactgtacaacacaattcgagattacaaagacgagcagggaagacttctctgtgagctgttcatcagggccccaaagcggaggaaccaacccgactactatgaggtggtttcccagcccattgacctaatgaaaattcagcagaagctgaagatggaagaatacgacgacgtgaacctcttgaccgctgatttccaattgtag

SEQ ID NO: 129184 - DNA, 264 bp, Artificial Sequence
  Description of Artificial Sequence: Synthetic coding sequence
atgggctcaaaacggcgcagagccacaagcccatcttcctcggtgagtggagactttgatgacggccatcattctgtgtctacacccggcccttcacgcaaacggagacggctcagcaatctcccaactgtagacccaattgccgtgtgtcacgagctatacaacaccatccgtgattacaaggatgagcagggaagactgttgtgcgagctcttcattagggcacccaagcggaggaatcaacccgactactacgaggtgtag

SEQ ID NO: 129185 - DNA, 132 bp, Artificial Sequence
  Description of Artificial Sequence: Synthetic coding sequence
atgggtagtaaaaggcggcgcgccaccagcccctcttcgtcagtatctggagattttgatgacgggcaccactctgtgtcaacaccaggaccgagcaggaaaaggagaagactttctaatttgccaacttag

SEQ ID NO: 129186 - DNA, 828 bp, Artificial Sequence
  Description of Artificial Sequence: Synthetic coding sequence
atggaaggagtcgctgtcgtgactgccggctcagttggagctgcgaaaacagagggcgccgcggctttaccccccccgcctccagtgtctcccccggccctgacaccagcccccgcagccggggaagaggggccggcccctttgagtgagaccggtgctccaggatgttctggcagtcggcctcccgagctggagcccgagcggtcgctgggtaggtttcggggccgatttgaggatgaagatgaggaactcgaggaggaggaagaactcgaagaggaggaagaagaagaggaggaggacatgagccacttcagcctccggctggaaggtgggagacaagactccgaagatgaggaggaacggcttattaatttgagcgaactgacgccatatattttatgttccatctgtaagggctacctcattgacgctaccacaattacagagtgtcttcacacattttgcaaatcttgcattgtgaggcacttttattactccaaccgatgtcctaaatgtaatatcgtggttcaccagacacagcctttatataatatttccgccaacgagggaacgggccactttaagccgttagagaagaagtttgtaagggtctcaggggaggcgaccatcggtcatgtcgaaaagtttttgagaagaaaaatggggcttgatccagcctgtcaggtagacatcatatgtggcgaccacctgctggagcagtatcaaaccttgcgggagatccgaagagctatcggcgacgctgccatgcaggacggcttattggttcttcactatgggctggttgtctcgcccctcaagattacatag

SEQ ID NO: 129187 - DNA, 1053 bp, Artificial Sequence
  Description of Artificial Sequence: Synthetic coding sequence
atggagggggtggctgtagtgacagctgggtctgtgggggccgccaaaaccgagggagccgccgctttacctcccccccctccagtatctccacctgcactgacacccgcacccgccgcaggggaagagggcccagcacctctgtctgaaacaggggcacccggctgcagcggcagcagacctcctgaattggagcctgagagaagtctcggccgattcagaggcagattcgaagatgaggacgaggaactcgaagaggaagaggaacttgaagaggaggaagaagaagaggaagaggacatgtcacacttctccttgcgcctagagggaggacgtcaggacagcgaagatgaggaggaaaggctgatcaatctgagcgagcttacaccttacatactctgcagcatttgcaaaggatacctgatcgatgccactacaattactgagtgtctgcatacattttgcaaatcctgcattgttcggcacttctattattctaatagatgtcccaaatgcaatatagtcgttcatcagactcagcctctttacaacattcgactagatagacaactgcaggacatcgtgtacaaactggtgataaatctcgaggaacgagaaaagaaacaaatgcacgacttctacaaggagcggggattggaagtgccaaagcccgccgtccctcagccagtacctagttcaaagggtcgatccaaaaaggtgttggaatcagtgtttagaataccaccagagctggatatgtccctgctgctggaattcatcggagcaaacgaaggcaccggccattttaagccgttggaaaagaaatttgtacgggtgagtggcgaagccacaattgggcatgtcgaaaaatttctgagacggaagatggggctggacccagcatgtcaggtagacatcatttgcggggaccaccttttggaacaataccagacactgagggagatcaggagagctatcggagatgctgctatgcaagatggcctgctggtcctgcattacggcctggtggtgtctccgcttaagatcacttag

SEQ ID NO: 129188 - DNA, 10191 bp, Artificial Sequence
  Description of Artificial Sequence: Synthetic coding sequence
atgactgcctggctcatttcactaatgtcaattgaggtcctgctactggcggttaggcacctgagtttgcacattgagccggaagaaggctcacttgctgggggaacttggataacagtcattttcgacggacttgaactgggtgtgctgtacccaaacaacggatctcaactggagattcacctcgtaaacgtgaatatggtagtgcccgccttacggagcgtaccttgcgatgtgtttccagttttcctcgatttaccagtagtaacctgccgaacccgatcagttctgtccgaagcccacgaggggctctacttcttggaggcctatttcggcggacagctcgttagctctcccaatcccggcccgcgagacagctgcacttttaagttttcgaaagcccagacacctatcgtccaccaagtgtatccaccgtctggcgtcccgggaaaactgatacatgtatatgggtggatcattacaggaaggctggagacttttgatttcgatgcggaatatatcgattcccccgtaatactggaagcgcaaggcgataagtgggtcactccttgtagccttattaatcggcagatgggtagttgttatccaattcaagaagatcatggtcttggtacactgcagtgtcacgtggaaggtgactatatcggttctcagaatgtctccttctctgttttcaacaaaggaaagtccatggtgcacaagaaggcttggcttatctctgcaaagcaagacctgttcctataccagacccactcagagattctatctgtgttccctgagactggctcacttggcgggagaactaacatcacaattaccggtgatttcttcgacaactcagcacaggtcaccatcgcgggtattccctgtgatatacgccacgtaagtccaaggaagatcgaatgcaccacccgcgcccctggcaaagatgttaggctgaccaccccccagcccggcaatagaggcctgctgtttgaggtcggcgatgctgtggaggggcttgaactcacggaggccaccccgggctaccgctggcaaatagttcccaatgcttccagtccttttggattctggagccaagagggacagccatttcgcgccaggctgtccggctttttcgtagcccccgaaaccaacaattacacattttggattcaagctgattctcaagccagtctccatttttcatggagcgaggaaccccggacgaaggtgaaggtggcgtctatatcagtggggactgcagattggttcgatagctgggagcaaaatcgagacgagggcacatggcagcagaaaaccccaaagcttgagctgcttgggggagcgatgtattatttggaagccgagcaccacgggatcgcaccttcaagaggaatgcggatcggcgttcagatccataatacttggttgaatccagacgtggtgacaacatacctgcgcgagaagcaccagatccgagtaagggcccagcgacttcccgaagtgcaggtcttaaacgtttccggaagaggaaacttttttttgacatgggataacgtttccagtcagcccattccagcaaacgccaccgctcatctgatccagaccacaatcgaagaactcctggccgttaaatgcaagctcgaacccctgtggagtaatatactactgcgcctgggcttcgagagggggcccgaggtgtctaacagcgacggagatttaactagtggcaccgagccgttttgtgggcgctttagcctgaggcagccacggcatcttgtgctgacccctccagctgcacagaaagggtatcgattggatcaatacacccacctctgccttgcatataagggccacatgaataagattcttaaaatgattgtgagcttcactattggttttcagaatatggtgaagaacacaacatgcgattggtcactgaccagaacatccccagaatcatggcagtttgactgtacagatctctgggagacatgtgtcagatgcttcggggacctgcagccgcccccagccaattctccagtgttggtgcaccaaatcaaccttcttcctcttgcccaggaaacgggcctcttttacgtggacgaaataattatagctgatacgaatgtgactgtgtcccaagccgactccggaaccgctaggccaggcgggaacctagtcgaatcggttagcgtcgtcgggagcccacctgtctattctgtaaccagctggctcgcaggctgcggtacagagctacctctcattaccgcaaggagtgtccccaccgagggcactgaagaaggatctggactcgttctcgtcactacacaaagaaggcagaggactagccctcctctgggaggacacttccggatccagctgccgaacaccgtaatcagcgacgtgcctgtccagattagtgcgcatcaccttcaccagctgctgcagaataacgctgatgatttcacttctagatatctgaacgcgagcgacttcaccgtgaaggaggatctgtacacatgttacgagcacgtgtggactctgagttggagcacccagatcggtgacttgcctaattttatcagggttagcgatgagaacttgaccggcgttaacccagctgccgcaactcgggtggtgtatgacggcggggtcttccttgggcccatcttcggcgatatgctggccaccgcaaaccaacacacgcaggtggtggtgagggtgaatgatgtgcccgcacattgccccggctcatgcagctttcagtatttgcagggctccactccttgcgtccactccgtatggtacagtattgatggcgacattaatttgatgatatacatcaccggaacaggattctccggagattcccagtttctgcaagtaaccgtaaacaagacctcttgtaaggtgatatttagtaaccaaaccaatgtggtatgtcaaacagatctgttgcctgtaggtatgcatcggatacttatgctcgtacgaccgtctggattggccataagtgccacaggggaggatctgttcttgaacgtcaaaccaaggcttgacatggtcgagcctagtcgggcagctgatattggcggcttgtgggccaccattcgaggcagcagcttggaaggggtatcccttattctattcggctcctatagctgcgctataaatgttgctacctctaactcttcccgaatacagtgtaaagttcctccaagaggtaaggacggacgcatcgtgaacgtcaccgtcatcagaggggactatagtgccgtcctgccccgcgcatttacatacgtttctagtcttaaccctgttatagtgacgctcagcagaaatatctccaatatcgccggcggtgaaaccttggtgattggtgttgccagattgatgaattacacggatctggatgtagaggtacatgtacaggatgctctcgctcccgtacatacccagtcagcctggggactggaagtagccctccctccactcccagcaggcctgcacaggattagcgtgagcataaatggcgttagtatccactcccagggagtggatctgcatattcagtatcttaccgaagtgttctcaattgagccgtgctgcggaagcctgcttggaggcacaattctatccataagtgggattggcttttcacgagacccagccttggtctgggtgctggtcgggaatcgatcctgcgacattgttaacttaacagaggcctcaatttggtgcgaaaccctgcctgccccccagattcccgacgctggtgccccaaccgtccctgcggcggtggaggtttgggctgggaataggttcttcgcgaggggaccctcgccgagtctagtgggcaaaggattcacattcatgtatgaggctgccgccactccagttgttaccgccatgcagggcgaaatcacaaacagctcattgtcactgcacgtaggaggcagtaatcttagcaattctgtgatccttttaggcaatttaaattgcgacgtcgagacacagtcgtttcagggcaacgtctctctgtccggatgttctataccgctacactccctcgaggctggcatctaccccttacaagtaaggcagaaacagatgggcttcgctaatatgagtgtggtgctgcagcagttcgccgtgatgccgaggattatggccatctttccaagccagggctcggcatgcgggggaaccatcctcaccgtacgcggcctcctcctgaactcaaggaggcgcagcgtgagagttgacctgagcggcccgttcacatgtgtcatcctgagcctcggcgaccacacaatcctctgccaggtgagcctggagggagaccctttgccaggggcttcctttagcttaaatgtcaccgtattggtcaatggcttgacaagcgagtgtcaaggcaactgcactctgttcattagggaggaagcaagcccagtgatggacgccctgagcacgaataccagtggtagccttaccactgttctcatccgtggacagcgcctggcaaccacagccgacgaaccaatggtgtttgtggatgatcaactgccctgtaatgtaacctttttcaacgcctctcacgtggtatgtcagaccagggacttggctccaggacctcactacttaagtgtattttacacccgaaatggatatgcctgctccgggaacgtcagccggcatttctacatcatgccccaggttttccactatttccccaaaaatttttccctgcacggaggctcattattaaccatcgaaggaactggcctcaggggccaaaacactacctcagtgtacattgatcagcagacctgccttacggtgaacatcggggcagagttgattcgatgtattgtccccacaggtaacgggtcagtggctttagagatcgaggtcgacggcctgtggtatcatattggagtaatcggatacaacaaggccttcacaccagaactcatttcaataagccagagcgacgacattctgacattcgccgtcgcgcagatctctggtgccgccaatatcgacatctttattgggatgtccccctgtgtgggcgtgagtggaaatcacactgtcttgcaatgtgtcgtgccatcactcccagccggggagtatcacgtgcgaggatacgactgtattcggggatgggcatccagcgctttggtgtttacatctcgggtgatcatcactgccgtaacggagaactttggatgcctcggaggtcgtctcgtgcatgtgtttggcgccgggtttagccccggtaacgtcagcgccgcagtatgtggcgcgccgtgccgagtgctcgctaacgccaccgttagcgccttctcctgcctcgtcctgcctttggacgtctcattagcttttttgtgcggattgaaaagagaggaggattcttgtgaagctgcacgccacacctacgtgcaatgcgacctaactgtggccatggcaactgagcagctactggagagctggccttacctctacatctgtgaggagagttcccagtgcttgttcgtgcctgaccactgggctgagagcatgttcccatcattcagtggtctcttcatatccccaaaacttgagagagatgaagtgctgatatacaatagttcttgcaatatcacaatggagaccgaagcagaaatggagtgcgaaactcctaatcagcctatcactgtaaaaatcactgaaatccgaaagaggtggggccagaacactcaagggaacttttcactgcagttttgcaggcggtggagccggacccactcttggttccctgaacggctcccccaggacggggacaacgtcaccgtggaaaatgggcaactcctcctgttggatactaatacgtctattctgaacctccttcacatcaagggtgggaagctgatctttatggcacccggaccaattgaactgcgggcccatgcaattttggtttccgacggaggcgaattaagaatcgggagcgaagataaacccttccagggaagagctcaaattacgctctacggaagctcatactcaaccccctttttcccatatggtgtcaagttcctcgccgtccgtaacggaaccctgtccctgcacggatccttacccgaagtcatcgtgacatgcctgagagccactgcccacgctttggatacggttttggcattggaggatgcagtggactggaatcccggagacgaagttgtcattataagcggtactggcgtgaaaggagcaaaacccatggaagaaatagtgacagttgagacagtgcaggataccgatctctacctgaaatcccctttgcgctatagtcacaatttcaccgagaactgggtcgcaggggaacaccatatcctaaaggccacagtagccttgctctcccgctctatcacaatccaaggaaacctcactaacgagagggaaaagctgctagtgagctgccaggaagccaacgccccggaaggtaacttacagcactgtttgtacagcatgtccgagaaaatgctgggatccagggacatgggtgcccgcgtgatcgtacaaagctttccggaagaaccatcacaggtgcagctcaagggggtccagttccaagtgctcggacaggcattccataagcatctgagttctttgaccctcgtcggcgcaatgagagagtccttcatccagggatgcacagtacggaatagtttttctcgggggctctcgatgtgtgggaccttggggctgaaggtggactccaacgttttctacaacatactggggcatgctcttcttgtcggcacttgcacagaaatgcgatacatttcgtgggaggccattcacggacgcaaggacgactggtctggacatggtaatattattcggaataatgtgattatacaagtgtctggtgcagagggcctctccaacccagagatgcttactccttccggcatctacatttgctcacctaccaacgtgattgaagggaaccgcgtttgcggggcaggttatggctacttcttccacctcatgacaaatcagacatcccaggcacctctgctctctttcacacaaaatatagctcacagctgtacaagatatgggcttttcgtgtaccccaagttccagccgccttgggacaacgtgacagggacaacactgttccagagttttactgtttgggagtccgctggaggggctcaaatctttcggagcagtaatttgaggctgaaaaatttcaaggtctactcttgccgcgactttggcatcgatgtgctagagtcagatgctaatacgtccgtcactgacagcttgttgctcggccactttgcgcataaagggtcattatgtatgtcctccggcattaagactcctaaaaggtgggagctcatggtttccaatacaacttttgtcaattttgacctaatcaactgcgtggctatccgcacttgtagcgattgttcacagggccaaggcgggttcactgttaagacctctcagttgaaattcacaaattcaagcaatttggttgccttccccttcccccacgctgctattttagaggacctggatggctctctgagcgggaagaacagatcccacatccttgccagcatggagaccctaagtgccagctgcttggtgaactctagctttggccgagtagtgcacggaagcgcctgtggcgggggcgtgctctttcatcggatgtctattggtcttgccaatacaccagaggttagttacgacttgaccatgaccgattcaagaaacaaaaccactacagtaaactatgtccgggacacattgagtaacccaagaggatggatggcactcctcctggatcaagagacttatagcctgcagagcgaaaacctgtggattaatagatcactgcaatacagcgcgacatttgataactttgctccgggtaattacctactgctggtacataccgacctccccccataccctgacatccttctccgctgcggctcacgggtgggcctgtcctttccgttcctccccagtcccggtcagaaccaggggtgtgactggtttttcaacagtcaacttagacagttaacatatttggtgtcaggcgagggtcaggttcaggtgattttgcgtgtcaaggaaggcatgccccctactatcagtgcatcgaccagcgctcccgagagcgccctgaagtggtctctccccgagacttggcaaggagttgaagagggttggggcggctacaacaacacaatcccagggcctggggatgacgtgctaatattacccaatcgaactgtcctcgtggatacagatctcccctttttcaaaggactttacgtgatgggaacattggactttccggtggatcgtagtaacgtactgtccgtagcttgtatggtgattgctggcggagagttaaaagttggaacacttgagaatccactggagaaagagcagaaactcctgatcctgttgagagccagcgaaggtgtcttttgcgaccggatgaatggcatccatatcgaccccggtaccataggcgtgtacggcaaggtgcacttgtattccgcgtatcctaagaactcatggacacatttaggagccgacattgcctcgggaaatgagagaatcattgtggaggatgccgtggactggaggcctcacgataaaattgtgctttcctccagctcatatgaaccacacgaagctgaggtcctcaccgtcaaagaagtgaagggacatcacgttcgtatatacgagcggctcaaacacagacatatcgggagcgtgcatgttaccgaggacggacggcacatccgcttggctgctgaagtcgggctgcttactaggaacatacaaatccaacccgacgtcagctgcagaggtcggctcttcgtcggaagcttccgcaagagctcacgtgaggaattctcaggagtccttcagttactaaacgtggaaatacagaattttggtagccccctgtactcctcagttgagtttagtaacgtgtctgctggaagctggatcatcagctcaaccctgcaccagagctgcggcggaggcattcatgcagccgcctctcacggcgtgcttcttaatgacaacatcgtcttcggcacagccgggcatggcatagaccttgaagggcaagcctataccgtgaccaacaatctcgtggtgctcatgactcaaccagcatggagcaccatttgggtcgccggtatcaaggtcaaccaagtaaaggatataaacttgcatggaaacgttgtggcgggctctgaacgcctgggattccacattcgcgggcataaatgtagctcttgcgagttgctctggagcgacaatgttgcccactcctctctccatggcctgcacttatacaaggagtcaggactggacaactgtacccggatatcaggattcctggctttcaaaaactttgattatggtgccatgctccacgtcgagaattcggtcgagattgagaatataacgctagtggataataccattggactgttggccgtagtttacgtttttagtgcccctcagaattctgtcaaaaaggtgcagattgtgctgcggaactccgtgatcgtcgcgacatcctctagtttcgactgtatccaggacaaggtgaaaccccatagtgcaaacctcacgtccactgatcgcgcaccatctaacccgcggggaggcagaattggcattctgtggcctgtcttcacctcggagccaaatcagtggccacaggagccgtggcataaggtgcgcaatgaccatagcatctccggtattatgaagctgcaggacgtaacctttagctcctttgttaagtcctgctatagtgatgacctggacgtctgtattcttccaaatgctgagaactctggcatcatgcatcccatcactgcggaacggacaaggatgttaaaaattaaggacaaaaacaaattctacttcccttcactgcaaccccgcaaagaccttggtaaagttgtgtgtcctgagctggactgtgcatcccctcgaaagtacctgttcaaagacctggacgggagggcgcttggcctgcccccgccagtatcagttttccctaagaccgaggctgaatggaccgcctccttttttaatgcagtcaccactgagcaggcactgaaaataagtgagtag

SEQ ID NO: 129189 - DNA, 12225 bp, Artificial Sequence
  Description of Artificial Sequence: Synthetic coding sequence
atgaccgcttggctcatcagcctcatgtcaattgaggtcctgctactggccgtcaggcatctgagcctgcacattgaacctgaagagggctccttagcagggggcacgtggatcaccgttatatttgacggtttagagctgggcgtgctgtacccaaataacgggagtcaattagagattcatctggtgaatgtgaatatggtggtacctgcgcttcgctctgtgccatgtgatgtgtttccagtgtttctcgacctgcccgtcgtgacctgtagaactcgtagcgtactatctgaggctcacgaaggcctgtactttttggaggcatatttcggagggcagctggtgtccagcccgaatcccgggccacgagactcatgcacgttcaagttctctaaagcgcagaccccgatcgtccatcaggtgtatccaccaagcggagttcctgggaagttgatccatgtctatggctggatcattacagggagactggaaacatttgacttcgatgcagagtacatcgactctccggtgattttggaggcccagggagataaatgggtgacaccctgcagtctgatcaatcgccagatgggcagctgttaccccatacaggaagaccacgggttaggaacactgcagtgccatgtggagggagactacatcgggtcccagaatgtttcattttcagtgtttaacaaaggaaaaagtatggtccacaagaaggcttggctaatctcagctaagcaagatctctttctgtaccaaacacatagcgagattctcagtgtgttcccggaaactgggagcttgggcggcagaacgaacatcaccatcaccggcgatttctttgacaatagcgcacaggtcacgatcgccggtatcccttgcgatatccgccatgtgtccccgcgaaaaatagagtgcacgacgcgggctcctgggaaggacgttaggcttacgacgccccaacctggtaatagaggccttcttttcgaagtaggcgatgcggtggagggcctggagctcactgaggcaacccccggatacagatggcagattgtacccaacgcgtcaagccccttcggattttggagccaggaggggcaacctttccgcgcccgcctcagtggatttttcgtggcccctgagactaacaattacaccttctggattcaggcggatagtcaggcgtcacttcacttctcctggagcgaggagccccgcacaaaagtgaaagtggccagcatttcagtcggcacagccgactggttcgatagctgggaacaaaatcgagacgagggtacctggcagcagaaaacgcctaaattggagttactcggcggggcaatgtactaccttgaggcagagcaccacggaattgccccctctcgcgggatgagaatcggagtccagattcacaatacttggctgaaccccgatgtagtgacgacgtatctgagagaaaagcatcagattagagtgagggctcagaggctgcccgaagtacaggtcctaaacgtcagtgggcgggggaattttttcctcacttgggataatgtatctagccagccaatccctgctaacgctaccgcccacttaatacagactactatagaagagcttctggcggtaaaatgcaagctggagccactgtggtcaaatattttgctcaggttaggctttgagcgaggtccagaggtgagtaacagtgatggagacttgacctcgggaacggagcctttttgcggacggttttctctgcgccagccacgacacctagttctgactcctcctgccgctcagaaaggttacaggctggaccagtatacacatctgtgcctggcctacaagggacacatgaataagatcttgaagatgatagtcagcttcactattggattccagaatatggttaagaacactacgtgcgattggtctctgacgaggacgtcacccgagtcctggcagtttgattgcacagacttgtgggagacatgtgtcaggtgttttggggacctgcagccaccccctgcaaacagcccagtgttagtccaccagattaacctcttgccactggctcaagaaaccggcctgttttacgtggatgagatcataatcgccgatactaatgtgaccgtgtctcaggccgactcaggcaccgccaggcccggtggaaacctggtggaaagcgtgtcagttgtggggtcccccccagtatactccgtcactagttggctcgcaggctgtggaacggaactgcccctaattaccgccagatcagtgcccacggaagggaccgaagagggttcaggattagtgctggtcacgacccagcgacggcagagaacctctccaccattaggcggccatttccggattcaactgcccaataccgttatctccgatgtccccgtccagatttctgcccatcacctccatcaacttctgcagaataatgcggatgatttcacatcccgctacttaaatgcctcagatttcaccgtgaaagaagacctatacacctgctatgaacatgtgtggactttatcttggtcaactcagataggcgaccttcctaattttataagagtgagtgatgagaatctgaccggcgtgaatcctgctgctgcgacccgggtcgtttacgatgggggtgtttttttaggaccaatattcggcgacatgctagctacagctaaccagcacacacaggtggtggttcgcgtgaatgatgttccagcccactgcccaggttcctgctcgtttcagtatctgcagggtagtactccttgcgttcattcagtgtggtactctatcgatggcgatatcaatctcatgatatacatcaccggcactggcttctcgggcgatagccagttccttcaggtaacagtaaataaaacctcttgcaaggtgatcttcagtaaccagactaacgtcgtgtgtcaaacggaccttctccccgtaggaatgcacaggatcctaatgctagtcaggccctccgggctagccattagcgccaccggggaggacttgtttctgaatgtgaagccccggctggacatggttgaaccttctcgcgctgctgatatcgggggcctctgggcgaccatccgcggaagttccctcgagggagtatcccttatcctgttcggatcttacagctgcgccataaacgtggccacaagcaacagctccaggatccaatgcaaggtcccaccacgtgggaaggacggtcggattgtcaatgtcacagtgattcgcggcgattactccgctgtgctgcctcgcgccttcacctatgtctccagtttgaaccctgtgatagtgaccctgtcccgcaacatctccaacatcgccggaggcgaaactcttgttatcggtgttgctagacttatgaattatacagacctcgacgttgaggtgcatgtccaggacgccttagcaccagttcatacacagtccgcttggggacttgaggtggctcttcctccactgccggccggcttacataggatctccgtgtccatcaacggggtctcaattcacagccagggtgtggatcttcacattcagtatttgactgaggtcttctctatcgagccctgctgtggatcgctcctgggagggacgatcctgtctatctctgggatcggtttttcacgcgacccggccctcgtgtgggtgctcgtgggcaaccggtcttgtgatatcgtgaacctgacagaagcgagtatctggtgcgaaacactacccgcacctcaaatccctgacgccggggcccctacggtcccagctgcagtcgaagtctgggccggtaaccggtttttcgcgcgagggccaagtcctagcctggtgggaaagggtttcaccttcatgtacgaggctgccgctacgcctgttgttactgcgatgcagggggaaatcaccaattcatccctgtcacttcatgtggggggttcaaacctgtcgaactcagtcattctcctggggaacttaaattgtgacgtggaaactcagagtttccaagggaacgtttcactgtccggctgctctattcctctgcactccctggaggcagggatctaccctctacaagtgaggcagaaacagatggggttcgctaatatgagcgtcgtgctgcaacagtttgcggtgatgcctcgcataatggcaatctttccctctcaagggagtgcttgtggcgggaccatactcaccgttagaggcttactgctcaacagccggcgccgaagcgttcgggtggacttgtccgggccattcacatgcgttatcctctcgttaggcgatcacaccattctatgtcaggtctcattggagggggaccccctcccaggggcatcttttagcctgaatgtgacagtcctcgtgaatgggttgacttccgaatgccagggaaattgcaccctgttcattcgggaagaggcgagtccagtgatggatgcgctctctactaacacgagcgggtcccttaccacagtgctgatcaggggccagcggctagcaaccaccgctgacgagcccatggttttcgtggatgatcaactaccttgcaatgtcaccttttttaatgcaagccatgtggtatgtcagactagagatttggcccctgggcctcactacctgagcgtgttttacaccagaaacggatacgcttgcagcggaaatgtgtcccgacatttttatatcatgcctcaagtttttcattattttccaaaaaatttcagcttacacggcgggtcccttcttacaatcgaaggaactggcctgaggggacaaaatacgacttcagtgtacattgatcagcaaacatgcctgacagtgaatatcggggcagagttaattcggtgtatcgtccccaccgggaacgggtccgtcgccctggagatcgaagtagacggcttatggtatcatatcggcgtcatcgggtacaataaagcttttacccctgaacttattagcatcagccagtccgatgatatcctgacctttgctgtggcccagattagcggagcagcaaatatcgacatattcattggtatgtccccatgtgtgggggtctctggaaatcatacagtactgcaatgcgtggtgccttcactccccgcaggagagtaccacgtgcggggatacgattgcattcgtggctgggcatcatccgctttagtgttcacaagcagagtgatcatcactgccgttacagagaattttggctgcctgggcggaagacttgttcatgtgttcggcgccggcttctcacccggaaatgtaagtgccgctgtctgtggagctccatgtcgagtcttggccaacgccaccgtgagcgcattctcctgcctcgttctgcctctggatgtgtccctggctttcctgtgtgggttaaagagggaagaggattcctgtgaagcagcccggcatacttacgtgcagtgcgatctcactgtcgcaatggccacagagcagctgctcgaaagctggccatatctgtatatttgtgaggagtccagccagtgcttatttgtaccagatcactgggctgaaagcatgttcccctcattctcaggccttttcatctcacccaaactggagcgggatgaggttctgatctacaacagttcttgcaacatcactatggagactgaagcagagatggaatgcgagactcccaaccagcctataaccgttaaaatcacagaaatccgcaagaggtggggacagaacactcagggcaactttagtttgcagttctgtaggcggtggtctcgaacccatagctggttcccagagcgactgccccaggacggcgacaatgttacagtggaaaatggccagctcctactgctggatacaaacacaagcattctgaacctgctccatatcaagggtggcaaattgattttcatggcccccggccccatcgagctcagagcccatgccatactagttagcgacggcggagaattgcgaatcggatcggaagacaagccattccaggggcgagcacaaatcaccctatacgggtctagctactccactcctttttttccttatggcgttaagttcctggcagtcagaaatggaacccttagcctgcacggtagcctgccagaagtgattgtcacctgcctgagagcgacggctcacgccctggacaccgtgctggctcttgaggatgctgtggactggaatccaggagatgaagtcgtcatcatctcaggcaccggggtgaaaggggcgaagccaatggaggaaattgtcaccgtcgagactgtccaggacaccgacctgtatctgaagagcccactgaggtacagccataactttaccgagaactgggtggccggcgaacaccatatactgaaggctacagtggctttgctgtctcgctctatcacgatccagggaaaccttaccaatgagcgtgagaaactcctagtgagttgtcaggaagctaacgcacctgaaggcaaccttcaacactgcctgtatagtatgagcgaaaaaatgctcggaagcagggacatgggcgcacgcgttatcgtccaatcattcccagaagaaccctctcaagtccagcttaagggagttcagtttcaggttctcggtcaggcgtttcataagcatcttagctcgctgacactggtcggcgctatgcgagaatccttcatacaaggatgtacagtgagaaacagcttttctagaggcttatcaatgtgcggtacattgggcctcaaagtcgactcaaacgttttctataatattctgggccatgccctactggtcgggacctgcaccgagatgcgctacattagctgggaggcaatacacggacgaaaggatgactggtccggccacggaaacattatacgtaacaacgtgattattcaggtgtcaggtgctgaggggctttcaaatccggagatgttaactccttctggtatctacatctgttctccaactaatgtgatcgagggaaatagggtttgcggtgcaggatatgggtatttcttccacctgatgaccaatcagacgtctcaagcaccactgctgtctttcacccagaatatcgcccattcgtgcacacgctacggcctgtttgtataccctaagttccagcctccttgggacaatgtgacaggaacaactttattccagtcctttacagtgtgggaaagcgcagggggagcacagattttccgaagctcgaatttacggctgaagaatttcaaagtgtacagttgtagggattttgggattgacgtcttagagagcgacgccaacacttcagtgactgactccctgctgctcggacacttcgcccacaaaggatccctctgtatgtcgtccggcataaagacgccgaagagatgggaattgatggtctcaaacacgacatttgtgaactttgatctgattaactgcgtggctatcaggacttgctccgactgcagtcagggccaggggggcttcacagtaaagacctcgcagctgaaattcacaaattcatctaacttagtagctttcccatttccccacgcagccatccttgaggacctcgatggctccctcagtggtaaaaatagaagccacatcctggcgagtatggagacattatctgcctcttgtctcgttaactcctcattcggccgggtggtgcatggttctgcatgtggcggaggggtcctgttccaccgtatgagcattggacttgccaatacacctgaggtgtcctacgatctcacaatgacagattccaggaacaagaccactaccgttaattacgtgcgggataccttgtctaaccctcgaggctggatggcactcctgctcgaccaggagacatattccctccagagcgaaaacttatggataaataggagtctgcaatacagcgctacctttgataattttgcacctggcaactacctgctgctggtccacacagacctccctccgtatccggacatattattgaggtgtgggagcagagttggactatcatttcccttcctccccagccctggccaaaaccaaggctgtgactggttcttcaattctcaactccggcagctcacatacctggtgtccggcgaggggcaggtccaggtgattttgagggtgaaagaaggaatgccccccactatctctgcctcaacatcggcacctgaatccgctctgaagtggtccctgcccgaaacatggcagggcgtcgaagaaggctggggcggctacaacaatacgattcccggccctggtgacgacgtgctcattttgcccaatagaactgtacttgttgacacggacctccctttcttcaaggggctttatgttatggggacgctggatttcccagttgatcgcagcaatgtgctgtctgtggcatgtatggtgatcgcgggcggcgagcttaaagttggcacactagaaaacccactcgaaaaggaacaaaaactcctgattttacttcgggcaagtgagggagttttttgcgatcgcatgaacgggatccacattgatcctggaaccatcggcgtgtacgggaaagtacatctgtatagcgcttaccctaaaaattcatggactcacttaggcgctgacatcgcttcaggtaacgaacgcatcattgtcgaggacgccgtcgattggcgtcctcacgacaaaatcgtcttgtcttcatctagttatgaaccacacgaagccgaggtgctgacagtaaaagaggtcaaaggacaccacgtgaggatctacgaacgattaaaacatagacatatcgggtcagtccatgtgaccgaggatggcagacatatacgcttggcggccgaggttgggttactgaccaggaatatccaaattcagcccgatgtatcctgtcggggacggctgttcgtggggtcatttcgcaaatcctctcgggaagaattcagtggagtactccaattgctcaatgttgaaatccaaaatttcggatcaccactttatagttcagtggagttttccaacgtatctgctgggagttggataatctcgagcaccctgcatcagtcatgtgggggcggtatccatgccgctgcctctcatggcgtcctcctgaatgataacattgttttcggcacagctggccacggcatcgatctggaggggcaggcttataccgtaacaaacaatctagtggttctgatgacccagcccgcttggagtactatctgggtcgctggaatcaaggtaaatcaggtgaaggacatcaatctgcacggaaacgtagttgcagggagcgagcggctggggtttcacatcagaggacataagtgttcaagctgcgaactgctctggagcgacaatgtggcccactcttcattgcacggattacacctctacaaggaatctgggctggacaactgtactcgtatatccgggtttctcgccttcaagaactttgattacggagctatgctgcatgtggaaaatagcgtggaaatcgaaaacattacactggtagacaatactattggtctgctggcagtagtgtatgtattctccgctccccagaactcagtaaagaaggtgcagatcgtattgaggaattctgtaatcgtggccacctcttcttctttcgactgtatacaggataaggtgaagccacatagtgcaaatctgacctcaaccgatcgcgcaccatccaacccacgaggcggccgcattgggatactttggcctgtgttcacatcggagcctaatcagtggccgcaggagccgtggcacaaagtccgcaatgatcattccatctcaggtatcatgaaattacaggacgtgacatttagcagcttcgtgaagagttgctattctgatgacctggacgtctgtatcctccctaacgctgaaaacagcggtattatgcaccctattactgccgagcgaactcggatgcttaaaatcaaggacaaaaacaagttttattttccatcgcttcagccacgtaaggacttggggaaagtcgtctgtccggagctagattgcgcgagcccacgcaagtatttattcaaggacctggatgggagagccctgggtcttccaccgcccgtgagtgtgtttcccaagaccgaagccgaatggacagcctccttcttcaatgccgggaccttccgggaagaacaaaaatgtacgtaccagtttctgatgcaggggtttatatgcaagcagaccgaccaggtggtgctgatcctggactccgccgacgcaatctgggcaatccaaaaactgtatcctgtggtgtctgtgactagcggcttcgtcgatgtcttctcatctgtgaatgccaatatcccttgtagtacctccggatctgtgtcgacgttttacagcatcctccccatccggcaaatcaccaaagtctgcttcatggaccagaccccacaggttctgaggttctttctgctagggaataaatcaacctccaaactcctgttagccgtcttttatcatgagctgcagtccccccatgtttttctgggcgaatctttcattcctcctacacttgtccagagcgcctccctgctgctcaacgagtcgattggtgccaactatttcaacataatggacaacctgttgtacgtcgtgctgcagggcgaagagccgatcgaaatccggagcggcgttagcattcacctggctcttacagtgatggtgagcgtgttggagaaaggctgggagattgtgatcctcgagagattaactaatttccttcagattgggcagaatcagattaggttcatccatgagatgccaggacacgaagaaaccctgaaggccatcgctgacagccgagcgaaaagaaagagaaattgccccacagtaacctgcacgtcacattaccggagggtaggccagaggaggcctctaatgatggaaatgaattctcatcgtgcctcccctccgatgacagtggagacgataagtaaagttattgtgatcgagatcggcgactcacctacagtcaggtcgaccgggatgatcagcagtctgtcaagcaacaaactgcagaacctcgctcaccgcgtgatcaccgctcaacagacaggtgtactggaaaacgtcctcaacatgacaattggggctctcctagtcacccagtctaagggtgtgatcggctatggtaataccagttctttcaagacgggaaatctgatttatatcaggccttatgccttgagcattcttgttcagccctcagacggtgaggtcggaaacgagctgccagtccagcctcagctggtatttctagacgaacaaaaccgccgggttgagtctcttggaccaccttccgaaccctggacaatctctgcctctctggaaggagcatccgattccgtgctgaaaggttgcacacaggctgaaacccaggacggttacgttagcttctacaacttggccgttctcatttcaggctccaactggcattttatttttactgtcacgagccccccgggagtaaattttactgccagaagcaagcctttcgccgtgttgccggtcaccaggaaggaaaaatccacaattatactggccgcctccctgtcgagcgtagcatcctggctggcactttcatgccttgtatgttgctggctcaaacggagcaaatccagaaagaccaaaccagaagagatcccagaatctcagacaaacaatcaaaatatccacatccacatctcctctaagcgacgggagagccagggacccaaaaaggaagacaccgtggttggggaagatatgaggatgaaggtgatgctgggcaaagtcaaccagtgccctcaccaacttatgaacggcgtgtcccggcgtaaagtttcccgccacatcgttcgcgaggaggaggccgccgtgccagctcccggaacaactggcataacatctcatggccatatctgtgcccccggtgccccagcccagcaggtgtacctccaagaaactggaaactggaaggaaggccaagaacagctgcttagataccagttggcaggtcagaaccagctgcttctcctgtgtcctgacttccgccaggaacggcagcagctgccgggtcagtccagattgtccaaacagagcggatctctcggtctcagtcaagagaaaaaggccagctgcggtgctacagaagcattttgtcttcattctgtccatcccgagaccattcaagaacaactgtag

SEQ ID NO: 129190 - DNA, 10191 bp, Artificial Sequence
  Description of Artificial Sequence: Synthetic coding sequence
atgaccgcttggctgatcagcctcatgtcaattgaagttttgttacttgcagtgcgccacctgagtttgcatatcgaacctgaagagggttcgctggcggggggaacatggatcacagtaattttcgacggtctggagctcggcgttttataccctaacaacgggtcccagttggagatccacctggttaacgtgaacatggtcgtgccagcattgagaagcgtaccctgtgacgtcttccccgtttttctggacttgcctgtcgtgacatgcagaacaaggtccgtcctgagtgaagcgcacgagggactgtacttcctcgaggcttactttggcggtcagttagtgtcctcgcccaacccagggcctcgagactcgtgcaccttcaaattttccaaagcccagacacctatcgttcaccaggtctatccaccgagcggagtacccggcaagttgatccatgtgtacgggtggataatcacaggaaggctggagaccttcgattttgatgccgagtacatcgactcccctgttatcttggaggcccagggcgataagtgggtaaccccatgtagcctcattaatcggcaaatggggtcttgctaccctatccaggaggatcacggtttaggtacgctgcaatgccacgtcgagggagactacattggtagccagaacgtttcttttagcgtcttcaataaaggcaagtcgatggtccacaaaaaggcatggctcataagcgcgaaacaggacctgtttctctaccagactcattctgaaatattgagcgttttccccgagactggctctctcggtggcagaacaaatattacaatcacaggcgacttttttgacaacagcgcccaagtcaccatcgcgggaattccttgtgatattaggcacgtgagtccccgtaagattgagtgcacaaccagagcacctgggaaagacgtgcgcctaaccacgccacagcctggcaacagggggctgctgttcgaagtgggcgatgccgtcgaagggctcgagctgaccgaggctacccctgggtacaggtggcagattgtgcccaatgcctctagtccctttggcttctggagccaagaggggcagcccttccgcgcaaggctctccggattctttgtggctcccgaaaccaacaactacaccttttggatccaggcagactcccaggcaagtctgcacttttcgtggtccgaggagcctcggacaaaagttaaggtggcaagcatcagcgtgggtaccgccgattggtttgactcctgggagcagaaccgcgacgaaggcacttggcagcagaagactcctaaactggagctgctgggtggtgccatgtactacctggaggccgagcatcatgggatcgcgccgtcccgcggaatgagaatcggagtccaaattcacaacacatggctcaaccccgatgtggtcaccacttacttgagggaaaaacaccagatccgcgtcagggcccagcgcttgcccgaagtccaggtgttaaatgttagcgggaggggcaatttcttcctgacgtgggataacgtatctagtcaacctataccagccaacgcaaccgcacaccttattcagactaccatagaggagctgctcgcagtgaagtgcaagctggagcccctgtggtctaatattctcctgcggttaggctttgagcggggtccggaggtgtcaaacagtgacggcgatctgacttccgggaccgagccgttctgcggccgcttcagcttgaggcagcctcggcacctggtgctcaccccaccagccgcacagaaagggtatcgcctggaccaatatacgcacttgtgtttagcctataaagggcacatgaataagattctgaagatgattgttagttttacgattggctttcagaacatggtgaagaacactacctgtgattggtctcttactagaacatctcctgaaagctggcagtttgactgcacagacctttgggaaacctgtgtgagatgcttcggggacctgcagccaccacccgcgaactctcctgttttagtccatcagattaacctgctcccactggcccaggagaccggcttattttacgtcgatgagatcatcattgccgacacaaatgtaactgtgagccaggctgattccggaaccgcaaggccaggtgggaacctcgtcgaatcagtcagcgtggttggttctcctccagtgtattctgtgactagttggttggccggctgtgggactgaacttcctttgatcaccgcaagaagtgtgccaacagaggggaccgaggaaggttccggtctagtgcttgtgaccacgcagaggcggcagcgaacgtctcccccactcggaggacacttccgcattcaacttcccaatacagtgattagcgacgtcccagtccagatttccgcccaccacctgcaccagctcctgcagaacaacgctgatgattttacttctaggtacttgaacgcctcagactttacagtcaaagaagacctctacacctgttatgagcacgtctggacattgagctggagcacgcagattggcgaccttccgaatttcatcagagtgtccgatgagaatctgacaggtgtgaaccccgccgctgcaacccgggtggtctacgacgggggagtgtttctgggccctattttcggggacatgctggccactgcaaatcagcacacacaagtcgtggtgagagtaaatgacgtgcccgcccattgccccggatcttgctccttccaatacctacagggatccactccatgcgtccattctgtatggtattctatagacggggatattaaccttatgatctacattaccggcacaggttttagcggagactcccagttcctgcaagttactgtgaataagacatcttgcaaggtcatattctctaaccagaccaatgtcgtttgccagacagaccttttgcccgttgggatgcaccggatcctgatgttggtgcgacccagtggtctagctatttctgccaccggtgaggatttgttcttgaacgtaaagccgcgcttggatatggtcgaaccgagtagggccgccgatataggggggttatgggccactattcggggctcttctctggagggggtctccctgatactatttggttcctacagttgcgctataaacgtggccacatcaaacagctcaagaattcagtgtaaggtaccaccgcgggggaaggatgggagaatcgtgaatgtgacggtcatcagaggagattatagcgccgtgctcccccgcgcctttacatacgtcagttcactcaaccccgtcattgtaacactgtcgcgtaacatcagtaacattgcgggtggggaaacactcgtaatcggtgtggcgcgtctaatgaattacaccgacttagatgttgaagtgcacgtgcaagacgctctcgcccctgtacacactcagagcgcatggggccttgaagtggcattgccccctctccctgccggcctgcaccgtatcagcgtgtcgatcaacggcgtatccatacattcacagggtgtggacttgcatatacagtatctgaccgaggtgttttcaattgaaccttgttgcggctcgcttctcggtggcacaattctgtccatctccggcatcggcttctctcgcgacccggcgcttgtttgggtcctcgtaggtaataggtcctgtgatatcgtgaatttgaccgaagcttctatctggtgcgaaacactgcctgcacctcagatccccgatgcaggagctcccacagtgccggcagcagtagaggtttgggctgggaatcggtttttcgcacgaggccctagcccaagccttgtaggcaaaggattcacatttatgtacgaggccgcagccaccccagtggtgacagcaatgcagggagagattactaatagctcactttccctccatgtggggggcagcaatctgtcaaattccgttattctcctgggaaacctgaactgcgacgtggaaacacagagttttcagggtaacgttagtctgagtggatgttccatacccctccactccctcgaagccggcatatacccactgcaggtgaggcagaagcaaatgggatttgctaatatgagcgtggtgctacagcagtttgctgttatgccaagaataatggccatttttccttcccagggttctgcatgtgggggaacaattctgactgtgcgcggacttctacttaattcaagaaggagatccgtcagggtggatttgtccggtcctttcacctgtgtcatcctcagtctcggtgatcacacaatcctgtgtcaggtttctctcgagggagacccactgccaggggcttctttttctttgaacgtaactgtcctagtgaacgggctaaccagcgagtgtcagggcaactgcacactgttcattagagaagaagcaagccctgttatggatgccctatccactaacacaagcggctcactcacaacagtgctgatcagggggcaaagactcgcaaccaccgcagacgaaccgatggtgtttgtggacgatcagctaccttgtaatgtgactttcttcaatgcttcccacgttgtttgtcaaactagagacttagctcccgggccacactacctgtccgtgttctatacacggaatggatacgcctgtagtggtaatgtatccagacacttctacatcatgccacaagtttttcactactttcctaaaaactttagcctgcatggcgggagcctcctgacaatagagggcacaggcctccgcggccagaatacgacatccgtctacattgatcagcagacttgtttgaccgtgaacattggtgccgaactcatcaggtgcatcgtgcccacagggaacggaagtgtcgcactggagattgaggtggatggtttgtggtaccacatcggggttattggttacaacaaggccttcactcccgaattgatcagtattagtcaaagtgacgacatcctgacattcgcggtggcacagattagtggggccgccaatatagatatttttattggtatgagcccttgcgtgggggtaagcgggaatcatacagtgctccaatgtgtggtcccgtctctgcccgctggagagtaccatgtgaggggatacgattgtatccgaggctgggcgagttcggctttagtttttacttcacgggtgatcattacagccgttactgagaatttcggctgtctgggaggccgcctggtccacgtcttcggtgcagggttttcaccggggaatgtgtccgccgccgtatgcggagcaccctgccgagtcctcgccaacgcaacagtgagtgcgttctcatgcctcgtcctgcccctagatgtgagccttgctttcctttgcggcctcaaacgagaggaggactcctgcgaagccgctcgccatacctacgtacagtgcgatctcacagtggccatggctacggagcagttactcgagtcatggccctatctttatatatgcgaggaatcctcacagtgtcttttcgttcccgaccattgggctgaaagcatgttcccttctttcagtggcctgttcatctcccctaagctcgagagagacgaggtgcttatctacaactcttcttgtaatattaccatggaaacagaggcggagatggaatgcgaaacgccaaatcaacctatcacagttaagatcactgaaattaggaagcgttgggggcagaatacccagggaaactttagtctccagttctgtagacgctggagccgtacacattcctggttccccgagagacttccacaagacggcgacaatgtgacagtggagaacggacaactcttactgctggacactaacacatcaattctgaacttgcttcacatcaaaggcgggaaactcatcttcatggcaccaggcccaatcgaattaagggcccacgcaattctcgtgtcagatggtggggaactcaggattggatctgaagacaagccattccaaggcagggcccagattacgttgtacggatcttcctattcaaccccgtttttcccttacggggtgaagtttctggcagtgcgcaacggaacactgagcctccacggttcgctgcccgaggttatagtaacctgcctgagagcgacagcccatgccctcgacacagtgctggccctcgaggatgccgtggattggaaccctggagacgaggtcgtgatcatcagcggcaccggggtcaagggagctaagcctatggaagaaatcgtgactgtagagaccgtacaggacacagacctctacctgaaatctcccctgagatacagccataactttactgagaattgggtcgccggtgagcaccacattcttaaagcaacagtcgcactccttagtcgctctatcactatccagggtaacttgacgaacgagcgcgagaagcttctcgtgtcatgccaggaggccaacgctcctgaggggaacctacagcactgcctgtactccatgtccgagaaaatgctgggcagtcgcgacatgggagcaagggttatcgtgcagtcgttcccagaggaacccagccaggtgcagctgaaaggcgtgcaatttcaggtcctcgggcaggcctttcacaagcatttgtcctcactcaccttagtaggagctatgagggaaagcttcatccagggatgcacagttaggaattctttctctcgcgggctgagcatgtgcggaacactcggcctgaaggtcgactccaacgtgttttacaatatcctgggccacgcactgctcgtggggacatgtacagaaatgcgctatatcagctgggaggccattcacgggagaaaggatgattggtcaggacacggcaacatcatcaggaacaatgtgatcattcaggttagcggagccgaggggcttagcaatccggagatgttgactccctccggaatatacatctgctctcctacaaacgttatcgaagggaacagggtgtgtggagctgggtacggttattttttccatcttatgaccaatcagaccagccaagcaccactgttgtcatttacacagaatatagctcacagctgtactcggtatgggctctttgtgtaccccaaattccagcccccatgggataacgttactggcacgaccctgttccagagctttacggtctgggagagtgcaggaggcgcccagatctttcggtccagcaacctccgcctgaaaaactttaaagtctatagttgccgcgattttggcatcgacgtactggaatccgacgccaacacaagcgtaacagattccctgctcctcggccattttgcacacaagggcagcttatgtatgagtagcgggataaagaccccaaaacggtgggaactgatggtctccaacaccaccttcgttaacttcgatctgataaattgcgtggcaatccggacctgtagcgattgcagccagggccaaggcggatttaccgtaaaaacatcccagttaaaattcacgaactccagtaacttggtcgcttttccttttcctcacgccgcaattctcgaggatcttgacgggtccctgtctggaaagaaccggtctcacatccttgcgtccatggaaactctctcagcctcctgcctcgtgaacagttccttcgggcgcgttgtgcacggaagcgcctgcggcgggggcgtcctctttcatcggatgtctatcggactggcgaatacccctgaagttagctatgatctgaccatgacggacagcaggaataaaactaccaccgtcaactatgtccgtgacaccttgagtaatcctagaggctggatggccctgttgctcgaccaggaaacatacagcctccagagcgagaatctgtggattaacaggtcgctgcaatacagtgcgacctttgataactttgcccccggaaactacttactgctcgtgcacactgatctgcccccctatccagatattcttctgcgttgcggctcacgagtgggtctgagcttcccctttcttccgtctcccggacaaaaccagggctgcgattggttttttaattctcagttacgtcagctgacctacctggtatccggcgaaggtcaggttcaggtgatcttacgcgtaaaggaaggtatgccgcctaccatttccgcatcaacaagcgcaccagagagtgcactaaaatggagtttaccagaaacctggcagggggtggaagaggggtggggcggttacaacaatacaatccccgggcctggggatgacgtcttaatccttcctaatcgaaccgtattggtggatacggatctgccgtttttcaagggcctgtacgttatgggaaccctcgacttccctgtagatcggagtaacgtgttatcagtcgcttgcatggtgatcgctgggggagagctcaaggttggaactcttgagaaccctcttgaaaaggagcagaagctgcttattctactgcgggctagcgaaggcgtgttctgtgataggatgaacggaattcatatcgatccaggtacaataggggtgtatggcaaagtccatctgtacagcgcatatcctaaaaacagttggacccacttaggtgcagacatcgcttcaggtaacgaacgaatcatcgtcgaggatgccgtcgattggagacctcatgataaaatcgtgttgagctccagctcctacgaacctcacgaggccgaagtgctgaccgtaaaggaggtcaaaggccaccacgtgcgtatctatgaaagactgaaacaccgacacattgggtccgttcatgtgacggaggacggtcgccatatcagattagcagccgaggtcggactactgacacgaaacatacagatccagcctgacgtgtcttgtcgagggcggctgtttgtagggagctttcgtaagtcctcaagggaggagtttagcggcgtcctccagctccttaatgtggaaatccagaacttcggttcgcccctgtactcgagtgttgaattctctaatgtgtctgccggaagctggatcatctcgtcaacgttacatcagtcctgtggcgggggcatccatgcggcagcctcacacggcgtgctcctgaacgacaatatcgtttttggtaccgctggtcacggcatcgacctcgagggtcaagcttacacggtcacaaacaatctggtggttttgatgacacagcccgcatggtcaacgatttgggtcgctggaataaaagtaaaccaggtgaaggatatcaatctacatggaaacgttgtcgcaggctctgagcggcttggatttcatatcagaggtcataaatgctcctcttgcgaactactttggagcgacaatgtggcccattccagcctgcacggcctacacctgtataaggagagtggactagacaattgcaccagaatcagtggtttcctcgccttcaaaaatttcgattacggggccatgcttcatgttgagaactcagtcgaaattgagaatattactctggtcgataatacgattgggctgctcgcagttgtgtacgtttttagcgccccgcagaatagtgtgaagaaggtgcagattgtcttacgcaacagcgtcattgtcgcaacatcctcaagcttcgattgcatccaagataaggttaagcctcatagtgccaacctgacatcaaccgatcgtgccccgtcaaaccctcgcggaggcaggattggcattctgtggccagtgttcacaagtgaacccaatcagtggccgcaggaaccatggcacaaggtgagaaatgatcatagcatcagcggcattatgaaattgcaggatgtcaccttctcttcatttgtgaaatcgtgctactctgacgatttagacgtgtgcatcctgcccaatgcagagaattcaggcattatgcatcccattaccgcagagcgtaccaggatgctgaaaattaaggacaagaacaagttctatttcccgagtctgcaaccaagaaaagatctgggcaaagtagtgtgccctgagctggactgtgcttctcctcggaagtatctgtttaaagacttggacgggagagcactcggtttacctcccccagtgtcagtattccccaagaccgaagccgaatggacagcttcattcttcaacgcaggcaccaaagagcaatctatcgagatcaatgtatag

SEQ ID NO: 129191 - DNA, 12732 bp, Artificial Sequence
  Description of Artificial Sequence: Synthetic coding sequence
atgggacacttgtggcttctcggaatatggggactgtgcgggctgctgctgtgtgccgccgacccttcaactgatgggtcccagattatcccgaaggtgacggagatcattcccaaatatggatccataaatggcgcgacgcgtctcacaatacgcggagaagggttttctcaggctaatcaattcaattacggggtggacaacgctgagctcggaaatagtgtgcaattgatatcatctttccagtctattacatgtgacgtggaaaaagacgcgtcacatagtacccagatcacctgctacaccagagcgatgcctgaggactcttacaccgtgcgggtgtcagtagatggggttccagtcacagaaaataatacctgcaaggggcatatcaattcatgggagtgtacattcaacgcgaagagctttcgcactcctaccattcggagcattacccctcttagcggtacaccaggcaccctcatcacaatccagggacggatctttacagacgtgtatggctccaacatagcgcttagcagtaacggcaagaatgtgcggatccttcgggtgtacatcgggggcatgccctgcgaactgctgattccacagtccgacaatctctacggcttgaagctcgatcacccaaatggtgatatggggagtatggtgtgtaagacaacaggcacattcattggtcaccataacgtctcatttatcctggacaatgactacggcaggtcatttccccaaaaaatggcttacttcgtgagttcactgaataagatcgctatgttccagacttatgccgaggttactatgatttttcccagccaaggcagcattcgcgggggaacaacgcttacgatttcggggcgtttttttgatcagacagatttcccagtccgcgtcctggtcggaggtgaaccctgtgacattctgaacgtcactgaaaactctatctgttgtaagacccctcccaagcctcacattttgaagaccgtgtacccaggcgggcgtggcctgaaactcgaagtgtggaacaatagccgtccaatcagactggaggagatccttgaatataacgagaaaactcctggctatatgggggcaagttgggtggacagtgcaagctacatttggctgatggagcaggacacattcgtcgcgaggttctctggctttctcgtagcccccgacagcgacgtatacagattctatatcaaaggggatgacagatatgccatctacttttcccagaccggtctcccagaggacaaggtgaggatcgcttaccatagcgcaaacgccaacagctactttagtagtcctacccaacgttccgatgacatacatctgcagaaagggaaggagtactacatcgagatactcctccaggaataccggctctcagctttcgttgacgtggggctgtaccagtaccgaaatgtttacaccgaacagcagactggcgatgccgtgaacgaggaacaggtaattaaaagccagagtacgattctacaggaggttcaggtgatcacgcttgaaaactgggaaacaacaaacgctatcaatgaagttcagaaaatcaaagtgactagcccctgtgtcgaagcaaatagttgtagcctctatcaatacagactaatatacaatatggaaaagaccgtttttctgcccgcggatgcctcagagttcatactgcaatcagccctgaacgacctgtggtctattaagcccgatacggtgcaggtcatacgcacacagaacccccagagctatgtttatatggtaacttttatcagcacccggggggatttcgatctactgggctacgaagtggtggaaggaaacaatgttacccttgacattactgagcagactaaaggaaagccgaaccttgaaactttcaccctcaattgggatggaatagccagcaagccactaacactgtggagtagcgaggccgaattccagggcgcggttgaggaaatggtgtcaacaaagtgtccacctcaaattgcaaacttcgaggaaggtttcgtcgtcaagtattttagggactacgagaccgatttcaacctcgagcatattaaccgggggcagaaaacagcagaaacggacgcctactgtggcaggtactctctcaaaaatcccgccgtcctcttcgactcagctgacgtcaaaccaaaccggaggccctacggagatatactgttgtttccctataaccagctctgcctagcatacaaagggtttttggcgaattacatcggactgaagttccagtatcaagataacagcaaaatcaccaggagcactgacacacaattcacctataattttgcatacggaaataattggacctacacgtgtatcgacctcttggatctggtacgcactaaatacaccggaaccaacgtgagtctacagagaatctctctccacaaggcgagcgagtcccaatccttctatgtggacgtcgtctatattggacacacttcaacaatcagtacactcgatgagatgcctaagcggcggcttcccgctctagccaataagggaatcttcctcgagcatttccaggtaaaccaaaccaaaactaacggcccaacaatgacgaatcaatacagtgtaacaatgacctcctataactgcagctataatatacctatgatggccgtctcgttcggtcagattatcacccacgaaaccgagaacgaattcgtgtatcgaggaaacaactggccaggtgagtccaagatccacatccaaagaattcaggctgcttctccaccactgtctgggtcttttgatattcaggcttacggtcacatcttgaagggcctgcctgccgcagtgagcgccgcagacctacagttcgcgctgcaatctctggaggggatgggccgaatctcagtgaccagagaagggacgtgcgcgggctatgcatggaacatcaagtggcggagtacttgtgggaaacagaacctcctgcagataaatgattctaatataattggcgaaaaggccaacatgacggtaactcgtataaaggaggggggcttgtttcgacaacacgtcctaggcgaccttcttcggactccaagtcagcagccccaggtggaagtctatgtgaacggcatccccgccaagtgttcaggtgattgtggcttcacctgggattcaaacatcacccccttggtcctcgcaatcagccctagccagggctcctatgaggaaggcacaatcctgacaatcgtaggaagtggattctccccctcaagcgcggtcaccgttagtgtcgggcctgtagggtgtagcctcctgtcggtcgatgagaaagaactgaagtgccagatcctgaacgggtcagcaggacacgcaccagttgccgtgtccatggcagacgttggcctggcacagaacgtgggtggtgaggagttctattttgtgtatcagtcccagataagccacatatggcctgattcagggagcatagccggagggactctgctgactctttccgggttcggatttaacgagaatagcaaggttctcgtgggaaatgaaacctgtaatgtgattgagggagaccttaaccgtattacatgtagaacccctaaaaagacagagggaacagttgacatttctgttaccaccaacggatttcaggccactgcacgagatgctttctcttataactgtctccagacgccaattataaccgacttctctcctaaggtgcggactattctgggcgaggttaatctgacaataaaggggtataatttcggaaacgaattaactcagaatatggccgtctatgtcggaggcaagacgtgccagatcttgcactggaactttaccgacattcggtgcctcctccctaaactttcacccgggaaacacgacatctatgtggaggtgcgtaattggggtttcgctagcacccgggataagctgaactccagcatccagtatgtcttggaagtgacatctatgtttccccaacgaggatctctgtttgggggcacagagattacgattcggggatttggcttttcaacaattcccgctgaaaacaccgttctgctgggcagtattccatgcaacgtcacatcctccagcgaaaacgtcataaagtgcatcctgcacagcaccggcaacatatttagaataactaataatggaaaggacagcgtccatggattgggttatgcttggtccccgcccgttctaaatgtttccgtgggcgataccgtggcctggcattggcagactcatcccttccttcgggggatcgggtacaggattttttccgtgagcagtccgggtagtgttatctacgatgggaagggcttcactagcggccggcagaagtccacttcaggatcgtttagttatcagttcacgtctccaggtatccactactactctagtgggtacgttgatgaggcacatagcatcttcctgcagggcgtcatcaatgttctaccagcggaaacccggcatatccccctccatctgttcgtgggacggagtgaggcaacctatgcctatgggggaccagaaaacctgcacttagggtctagcgtggctggttgcctcgccacagagcctttgtgtagtttgaataacacccgtgtcaagaactccaagagactgctttttgaggtcagctcatgcttctccccaagcattagtaacatcactcctagtactggtacggttaatgagctaatcacaattatcggccacggcttcagtaatctgccctgggccaacaaagtcacaatagggtcatatccatgtgttgtcgaggaatcatccgaagacagcatcacctgccatatcgatccccagaatagtatggatgtcggtattcgggaaaccgtcaccctgaccgtgtataatctggggaccgctatcaatacactgtctaatgaattcgatcggaggtttgtcctgctccctaacatcgacctggtgttgccgaatgcaggaagtactactggcatgacaagcgtaactattaagggctctggattcgcggtgtccagtgccggtgtcaaggtgctcatgggccactttccctgtaaggtactttccgtgaactatacagctatcgagtgtgagaccagtcccgctgcacagcaactcgttgacgtcgatctgttgattcacggggtcccagcacagtgtcagggcaactgcaccttttcctacctggaatctattacaccttatataacaggcgttttccccaattctgtgatcggcagtgtcaaagtgctgattgaaggagaagggttgggcacagtcttggaagacatcgccgtgttcattggtaaccagcagtttcgggcaatagaggttaacgagaataatattactgcgctggtaacacccctgccggtgggtcatcactcggtatccgtcgtggtcggcagcaagggactagccttaggaaacctcactgtgtcctctcccccagttgcaagtctgtcaccgacgtccggctccattggcggaggaactactctggtgatcaccgggaacgggttctaccccggaaatacaaccgtgaccataggagacgagccctgtcagattatttcaattaacccaaacgaggtgtattgtcgaacgccggcgggaaccactggcatggttgacgtgaagatcttcgtgaacacaattgcttatccacccctgctgttcacatatgcattagaagatacccctttcctgagagggatcatcccaagccgagggcctccaggtacggaaatcgagatcacggggtccaattttggctttgagatcctagaaataagcgtcatgatcaataacatacagtgcaacgtgaccatggccaacgactctgtggtgcagtgcattgtcggggatcacgcggggggcacattccctgtcatgatgcaccataagaccaaagggtcagcaatgagcactgtagttttcgagtatccgcttaatattcaaaacattaacccgagtcaggggtcatttggaggcgggcagaccatgacggtaacaggtacgggtttcaacccacagaacagcatcatcctcgtgtgtggctctgaatgcgcaattgatagactcagatctgactatacaactttgctgtgcgaaatcccgtcaaataacggtaccggagctgaacaagcgtgtgaagtgagtgtggtaaatggcaaggacctcagccagtcaatgactccgtttacatatgctgtctctcttacgcctcttattacagccgtcagtccgaagagaggttctacagctgggggtacaagattgaccgtcgtggggagcggtttttcagaaaacatggaagacgtgcatattaccatcgccgaagctaagtgcgatgtggagtactctaataagacccacatcatctgcatgacggacgcccacacactgtcaggctgggctccagtgtgcgtgcacatcaggggcgtgggaatggcaaaactggataatgcagactttctctatgtggatgcttggagcagcaacttctcatggggagggaagagtccgcccgaggaggggtcgctggttgttatcacaaagggacagacaatcctgcttgaccagtcaactcctatcctcaaaatgctgctcatccagggaggaacactgatttttgatgaagcagacattgagctccaagccgaaaatatccttataacagatggaggcgttctgcaaattggcaccgagacgtcaccatttcaacacaaagccgtcattactctgcatggccatctaaggagtccagaactccccgtgtatggtgctaaaacacttgctgtgagggagggcattctggacctgcatggtgtgcccgtccctgtcacgtggacccggcttgcccatacggctaaggccggcgagcgaatcctgattctccaggaggccgtcacatggaagcctggcgataacatcgtcatcgccagcacagggcaccgacatagccagggggagaatgagaagatgactatagctagcgttagcgctgacgggattaacattacactgtctaatcctttgaactatacccacctcggaataacagtcacattgcctgatggcacattattcgaagccagggcggaggtaggcatactaacaagaaatatccttatcagagggtcagataacgtggaatggaataacaaaatcccagcatgccctgatggcttcgacacaggagaatttgctactcagacgtgtttacagggcaaattcggcgaggagattggctccgaccaattcggaggctgcgtgatgttccatgctccagttcccggcgccaacatggttaccggtcgcatcgaatatgttgaagtatttcacgcaggccaggcgtttagactgggtagatacccaatacactggcacttgcttggagacttgcaattcaaatcgtatgtccgcggctgtgcaattcatcaggcctataacagagccgtgacaatccacaacacacaccatctcctcgtggagcgcaacatcatctacgacatcaaagggggagcgttctttatagaagacgggattgagcacggtaacatcctccagtacaacttggccgttttcgttcagcagtcaactagcctgctgaatgacgacgtcacaccagccgctttctgggtgactaacccaaacaacacaattcgccataacgccgtcgctggagggactcattttggcttttggtacaggatgaacaatcaccccgatgggccttcctatgacaggaatatctgccagaagcgagtgcccttgggcgagttctttaacaacacggtccatagtcagggttggttcggaatgtggatcttcgaggagtactttccgatgcagactggaagctgtaccagtactgtcccggcccctgccatttttaatagcctcacaacgtggaactgtcaaaagggcgcagaatgggtaaatgggggagccctacagttccacaattttgtgatggttaacaattacgaagcaggcatcgagaccaagcgtattctggccccttatgtgggtggctggggagagactaacggagcagtgatcaagaacgccaaaattgtcggccacttggacgagttagggatgggatctgcattctgtacggctaagggcctcgtgttaccattttctgagggcctgacggtgtctagcgtccactttatgaactttgacagaccaaattgcgtggcgttgggtgtgactagcatctctggggtctgcaacgacagatgcggaggctggagtgcaaagttcgtggacgtgcagtactctcatacacctaataaggctggattccgttgggagcacgaaatggtgatgatcgacgtggatggatcactgaccggccacaaaggacacacagtcattccacattctagcttgcttgatccatcacattgtacgcaggaggcagagtggagtataggctttccgggctctgtgtgtgacgcgtcggttagtttccaccgtctcgcgttcaaccaaccctcaccggtctcgctgctggagaaagacgttgttttatccgatagctttggaacctccattattccttttcagaaaaagaggttgacccacatgtccggctggatggctcttatacctaacgccaatcatattaactggtactttaaaggggtggaccatatcactaatatcagctatacctccactttctatgggtttaaagaagaagattatgtcattatttcacataattttactcagaaccccgacatgttcaacatcatcgatatgcggaacggatcaagtaaccctttgaactggaacacgtccaaaaatggggattggcatttggaagccaacactagcacactgtactatctagtctcagggaggaatgatctgcaccaatctcagttgatcagcggaaacctggaccccgacgtcaaggatgttgtgatcaatttccaggcttactgttgcatcctccaagactgttttccggtgcacccgccgtcccgaaaacccatccccaagaagagacccgcgacgtataatctctggagcaatgacagcttctggcagagctctcgagaaaacaactatactgtgcctcaccctggcgctaatgtcattatccccgagggcacatggattgttgccgacatcgacatgccttctatggagaggctcatcatttggggggtccttgaactcgaggacaaatataatgtgggggccgctgagtcctcttatcgggaagtggtgttaaatgccacttacatttccttacaggggggccggttaattggcgggtgggaggacaatccatttaaaggcgatttaaagatagttttgcgcgggaaccacaccacccaagactgggccttacctgaggggccgaatcagggagccaaagtgctgggcgtgtttggggagctggatttacacggaattcctcattcaatatataagacaaagctgtccgaaaccgctttcgcgggtagcaaggtgttgtccctgatggatgcagtcgattggcaagagggcgaggagatcgtgattacgaccacatcctacgatttccatcagactgagacccggtcgattgtgaagatactgcatgaccacaagatcctgatcctcaacgattcactgtcatatacccacttcgccgagaaatatcacgtaccgggcaccggcgagtcttatacattagccgctgacgtgggcatcctttctagaaacattaagatagtgggcgaggactaccctgggtggagtgaggatagctttggggccagagtgcttgttggttcctttaccgaaaacatgatgactttcaagggcaacgcgagaatttccaacgtggagttctatcacagtggccaggagggtttccgtgacagtacggatccaaggtatgctgttacatttctgaatctgggtcaaatccaggagcacgggagctcctacattcgaggctgtgcgttccaccacggcttctctcccgccatcggcgtgttcgggactgatggactggacatcgacgacaacattattcattttacagtcggagagggtatccgcatctggggcaacgcgaaccgggtccggggaaaccttattgcgctatcagtatggccaggcacctatcaaaacaggaaggatctctctagcactctctggcatgcagccattgagatcaatcgggggacaaacacagtcctgcagaacaacgtagtcgccggcttcggtcgggctggatacagaatcgatggcgaaccttgccctggtcagtttaatccagtggagaagtggtttgataatgaggcccatgggggtctttatggtatttatatgaatcaagacggtttgccaggatgctcactgatccagggattcactatttggacatgttgggactatggaatctatttccagacaacggagtctgtccatatttacaacgtaactcttgtagacaacggcatggccatcttccccatgatctatatgcccgcggctatctctcacaagatatcatctaagaatgtgcagattaaaagtagccttatcgtaggatcttccccaggattcaattgttccgacgtgctaacaaatgacgaccccaatattgaacttaccgcagctcataggtcaccgcggtcgccttccggaggaagatccggcatctgctggcccaccttcgcttctgcacacaatatggcgccacgcaaacctcacgccggaatcatgtcctacaacgcaattagtggcttgcttgatattagtgggtcgacatttgttggctttaaaaatgtatgttccggagagactaatgttatcttcattaccaacccactaaatgaggaccttcagcaccccatacatgtgaagaacatcaagctggtggacaccaccgaacagtctaagattttcatacatcgtccagatataagtaaggtcaatccatctgactgcgtcgatatggtttgcgacgccaagcgaaaaagctttctgagggatattgacgggagctttctgggtaatgcgggctctgtcataccccaggccgaatatgagtgggatggcaactcccaggtgggcataggtgattatagaattcccaaggctatgttgacttttctcaacggctcacgcatccctgtcaccgaaaaagcccctcacaaaggtattatccgcgactccacctgtaaatacctgccagaatggcaatcatatcagtgcttcggaatggagtacgccatgatggtcattgaatctctcgatcccgacacagagacgcggcgtttgtcaccggtggctatcatgggaaacggatacgtagacctgattaatggtccacaggaccatgggtggtgcgctggctacacttgccagcgccgtctttcattgtttcatagcattgtggccctgaacaaatcctatgaggtctatttcaccggaacttcaccacagaacctgagattaatgctgctgaacgttgaccataataaggcggtcctcgtcggaatttttttctcaaccctccagaggcttgatgtgtacgtgaacaacctgctggtgtgtccgaagacaaccatttggaatgctcagcagaagcattgcgagctgaataatcatctctacaaagaccagtttctgccgaacctcgattcaactgtgctgggagaaaactacttcgacgggacttatcagatgctatacctgctggtgaaaggcaccattcctgtggagatccacacagcaacggttattttcgttagttttcagctgtccgtggcgacggaagacgatttctacacaagccataatctagtaaagaatttggccctcttccttaaaattccctccgataagatacggatctcaaagatcagggggaagagcttgcggcggaagcgaagtatgggctttataatcgagatcgagattggcgaccctcccatccagttcatttctaacggtactaccgggcagatgcagctcagtgagctgcaagagattgcaggaagtctgggacaagccgtgattcttggcaatatttcgagtattctgggctttaacatctcttccatgagtattacaaaccccttacccagtccttctgatagcgggtggatcaaagtgactgcccagccggtggagagaagtgcttttccagttcatcatgtagctttcgtgtccagcctgctcgtcattacacagcctgtggccgcacagcctggacagcctttccctcagcagccaagtgtgaaggccactgacagcgacggcaattgcgtcagcgtgggcattactgccctgaccctccgcgccatactgaaggactctaataacaaccaagtgaacggtctgagcgggaataccaccatcccattcagtagctgttgggctaactacactgatctgacgcccctgagaaccggaaagaactacaagatcgaatttatccttgacaacgtggtaggtgtggaatcgcgcactttttccttgctagccgaatccgtgagcagctcgggttcatcctcctcgagtaactcaaaagcgtcgaccgtggggacgtacgcacaaatcatgaccgtcgtgatcagctgcctcgtgggaaggatgtggctcttggagatcttcatggcagctgtcagcactttaaacatcaccctgcgaagttattag

SEQ ID NO: 129192 - DNA, 6762 bp, Artificial Sequence
  Description of Artificial Sequence: Synthetic coding sequence
atgaggcctgggcccgctctcctcttgctgggtgtggggttgtcactaagtgtaggcaggctgcctcttccaccggtgccacggggagcccaggcggccgtctcgggagccccaggggggctgcttaggggagccccagggttgggagtcaggggcggccgggccttgttgagcctccgaccttcagcggtgagagccggcggcgccgtcctctcaggcaggggtagtctctgttttccgcacgggggcaccggaaggcggtggtattgtctagacctccgcgtgctgttgtcagctcaacgccttccatggccggctgccccagccctggccctcgtagaccttcagctttcagctcgaggtggaaggctatccctaacatggtctgtgcggttgcctaggagtcccgggcggctcgcgtgggctttcaggctcaggctgctcgggcccggagctgcccgtcctgcttcacctgcggcacgggtgtccccaagaagtgcagcccctggcccccggcctcaacagggattcgtcgccaggaccgaatgtcccacagatggcccagcaagggtgatgctgcaggccgtgaatagtagtagccacagggcggtcgagagttcagtctcatgtcaaattaacgcctgtgtgatccagcgagttcggatcaatacggaccagaaaggcgctccagttcggctgtcgatgcaggccgaggccaccataaacgcgtccgttcagctggattgtcctgccgcaagggccatcgcccagtattggcaagtatttagtgtcccagctgtcggccaggcacccgactggacacaacccttggatcttcctcaactggagatcagaaactcaccgctctttatccacattccaaacaacagcctgcagtggggtgtgtatgtgttcaattttacagtgtcaatcaccaccggaaacccaaagatgccagaggtgaaagatagcgatgctgtctatgtgtggatcgttagatcttcactgcaagctgtaatgctgggcgatgcaaacataaccgctaacttcacagagcaactcatcctcgacggatcaacttcttccgatcctgacgcagattcccccctccagggtctgcagtttttctggtactgcaccacagaccccagaaactacggtggggacaggatcattctcggttctaaagaggtttgtcacccggagcaggctaacctgaaatggccctgggcctcagggccagtgttgactctgctccctgagactttaaaaggtgatcacgtctacttcttccgaatggtcatcagaaaggactcccgtactgcttttagcgacaagagggtgcatgtgctccaaggccccaaggccatcgcccacatcacatgcatcgaaaactgcgaaaggaacttcatcgtgtccgaccgattctctcttttcttgaattgtaccaactgtgcctcacgagatttctataagtggtccattctcagctcttccggtggggaaatgttatttgattggatgggcgaaactgtgacaggtcgcaacggcgcttatctatctatcaaagctttcgccttccgccattttctagaggcagagttcagcatctctctgtatctggcctgttggtccggcgtgacaagcgtttttcgtcattcctttattattaatcatggccctcagatcggggagtgcaagattaacccggccaagggtattgcactgattacgaagtttgtagttcagtgttctaacttccgggataagcacgttccgctcacttacaagatcattgtgtccgaccttcacagtgtgggtgaaatctctagcgtgaaagagaatactctgggcactattttatacttgggcccccagagcaccgtccccccgtccttcctcccagtggggatgcttgcgtcacagtacgggcttaaaatctatgcccaggtgtacgactcactcggggcttttagccaggtgacgctgcatgcgactgcacaggccccaactgataagaattcgtctaagaccgttctaaaccagctgttgtcgtttaccgttggcccctccagcttactctcgacacttattcaaaagaaggattttctaccggctggatacctgctgtacattgttgcaagcgtcctcaacaacatgaagacagagctacctcttcgtgatgatcgcgtgaacctgcgaaaacacttgattgatcagtccttcctgctaccagtgtccaccctggtcgaaattggccaagttgtgatgactataactaaactcactcagaagcccagcgagttcacatgggacgcacagaagcgggccaccatgcgcgtctggcaggcaaatcaagccctgcaggagtatcagcaaaaagacaaaaggttcagaagcgagcagatagaaatcgtcagcacaggcatactcatgtccctgtccaatatactgaagatgacttccccacatcaggtggtgaaggaccctttttacgtcatagaaagtctgtcggacactattctggctaataaagtgcccggaaacaagacgacctcaatgcgaactcccaattttaatatgtacgtgaaaaaagtggagaagtgggggattaaccagctgtttcgcaacgaaaaacattgccgtaactgcttctaccccacacttaacgtgtcaagcgtgccaggactatctgcaaatggtcccataagcaccatgttttgcgacttcacaaatgatctctttccttggttgaacgatcaggaaaacacatccgttgaagtgtcagggtttaggatgactggagtggcagacaacggtagtgtgctggagatcactcctgacgtggccgaggtctacctcgttcgaaaaaatcttacattcgctgcattcaatctgactgtgggaccaaacagcgaagtggatggcagtctgaaaaaaaccacgggaggctttagcttccaggtggacagtactgttctgcgcgaggttctggtacacattgtaacggaagtgatggtcttgttcaccgtgttagtatatactggcagccagattacacctacagcccttgtcgcaaccttcctggtgccacatgatattcctccttttgccagccagtctgcactgttcgaccctgcctgcactgtcaagaaggcccgggttgtctgtctccctgtgtcccttctgcaattgatagcacagcacagtcactccccccactgcacagtcagcattgtgttgcaggcccccaggttcgtgatgaagctgaatgataagctggttagaatctcaattttctcagtccagtgcttggacatgtacggcatccagagcgagtggcgagaggggtactgtattctaggcgagaagacatcatggtatgaagtccactgtatctgcaagaacgtggtgagagcacgccgacagctcggaactataggcctaacaggtattcatcttcacactcattacgtcatggcaaaagtgatcgttatccctaacccagtggacctacgactgaatatcatcaaatcattgcatcagaaccccgtgactctttttacggtgctgttcattattttgctctatgttggactggcattttgggccctttaccgagacgagatggaccagcacctgcgaggccacgtcatcgtgctaccggataatgacccttacgacaacttgtgctatctcgtgacaatcttcactggctcacggtggggctccggcactcgcgccaatgtgtttgtccaactacgtggcactgtttcaaccagtgacgtccactgcctgagccatccccattttacaacactgtaccgtggatccatcaacactttcctgcttaccacaaaatcagatctaggcgacatacacagcatcagagtttggcataacaatgaaggtcgttcaccatcctggtatctgtctagaataaaggtggagaacctgttctctcgccatatctggctgttcatctgtcagaaatggttatccgtggatactaccctggatcgaacctttcatgtgacccaccccgacgagcgtctcacacggaaagatttcttctttatagatgtttcctctaacctgaggaaaaatcatatgtggttctcaattttcgcctccgtggtggcgaagacctttaatagactacagagactgagctgctgcttggccatgttattgagttccttgctgtgcaacattatgttttttaacctcaacaggcaggagcagaccgaatcccgggagcggaagtacatgaggagtatgatgataggaatagaatccgttctgatcaccatccccgttcaacttctcatcactttcctgttcacgtgttcccagaggaagccacaggctgatttaaaagaggtcagccctcaaaagcatcccctgatgtcagaagcatctgagcactgggaagaatatctgcgcaagtggcatgcttacgagaccgccaaggtgcatccgagagaggtcgccaagccagcatcaaaaggaaagccgcggcttccgaaggcctctcccaaggccacctcgaagccaaagcaccggcacagaaaggcccagattaagactcctgaaaccttaggccccaacaccaatagcaataataacatcgaagacgaccaggacgttcattcggagcagcatccctctcaaaaggacctccagcagctgaagaaaaaacctcggattgtccttccctggtggtgtgtttatgtggcatggtttctggtttttgccaccagttccatttcctccttttttatagtgttctacggattgacttatggatatgataagagtatcgagtggctctttgccagtttttgcagcttttgccagtcagttctgctggtgcagccttcaaagataatactattatccgggtttagaaccaataagcccaagtactgcaagaatctctcctggtcgaccaaatataagtataccgaaatcaggctggacggcatgcgcatgcatcccgaggagatgcagaggatacatgaccagatcgtgcgcatccgcggaaccaggatgtaccagccgctgacagaggacgaaatacgaatcttcaagcgtaaaaagcgaattaagagacgggccttacttttcttatcttacattcttacccatttcatcttcctggccttactcctgattctcatcgtgcttctccggcatactgactgcttttattataaccagttcattagagatcggttttcaatggatctggcaaccgtaaccaaactcgaagacatctaccggtggcttaactccgttttgctgcctcttcttcataacgacctcaatcctacttttttacctgaatcaagctcgaagatactgggccttccactgatgcgccaggtgcgagcgaagagttccgagaagatgtgtttgccagcagaaaaatttgtccagaattcaatccgaagggagatacattgtcaccccaagtatggcatagaccccgaggacaccaaaaattactcagggttctggaatgaagtagataaacaggcgatcgatgagtcaactaacgggtttacttacaagcctcagggcacacagtggctctactacagttacggattactgcatacctacgggagtggtggttatgccctgtacttctttcccgaacagcagagatttaatagcacattgcggctcaaggaactgcaggagtccaattggcttgacgaaaaaacatgggcggtagtgctggagttgaccacatttaaccctgacattaacctcttctgtagcatctcagtgatctttgaagtttcacagcttggggtggtgaacaccagtatatccctccacagcttttctctggcagattttgacaggaaggcaagtgcagaaatctatctatatgtcgcgatactcatcttctttctggcatacgtggtggacgaggggtgtatcattatgcaagaaagagcctcttacgttcgttcagtttacaatctgttgaatttcgcgctgaagtgtattttcacagtcctgatcgttttgtttctgagaaagcactttctagccaccggcattatacgcttttacctgtcaaatccagaagacttcatcccgttccatgccgtgtcacaggtggaccacattatgcggattatactgggattcctcctgttcctcacaatactgaagacccttaggtactctaggttcttctatgatgtgagactggcacagcgggcgatccaggccgccctgcctggaatctgtcatatggccttcgttgtgtccgtctacttttttgtgtacatggctttcggctatttggtgtttgggcagcatgaatggaattatagcaacttgattcattcaacacaaaccgttttcagttactgtgtgagtgcctttcagaacaccgagttcagcaataacagaatcttaggcgtcctattcctgtcttctttcatgctggtgatgatttgcgtgctcattaacctattccaggcagtgattctcagcgcttacgaagagatgaagcaacctgtgtatgaggagcctagcgatgaagtggaggccatgacatacctgtgcagaaaattgcgcactatgtttagcttcctgacaagccaatcaaaagctaaggatgagcctgagttcttcatcgatatgctgtatggccagcctgaaaaaaactcccacaggtatcttggacttaaaacccgtaatattaacggtaagaaaatggtgtatttggtggtgtag

SEQ ID NO: 129193 - DNA, 12912 bp, Artificial Sequence
  Description of Artificial Sequence: Synthetic coding sequence
atgcctcctgcagcgcccgcacgcctcgctctggcactcggactaggactgtggctcggggccctagcaggagggcctggtagagggtgcggtccctgcgagccgccatgcctctgtgggccagcgccaggagcagcctgtagagtgaattgctcaggccggggtctgcgcacactcggtccagctctgcgtattcctgccgatgctacagccctggatgtttcacacaacctcctaagggcccttgacgtgggtttgctggcaaacctctcagcactggccgaactggatattagcaataataaaatctccaccctagaagaaggtattttcgcaaatctatttaacctgtccgaaattaaccttagcggcaatcccttcgaatgtgactgcggcctggcttggctgccccggtgggccgaagagcaacaggtgagagtggtgcagcccgaggccgccacatgtgctggacctgggagtctcgctggtcagcccctgctggggatccctctcttagacagtggttgtggtgaggaatatgtagcttgtttacccgataattcttcgggtactgtggccgctgtgtcttttagtgcagcacatgagggtcttctgcagcctgaggcctgctctgccttctgtttttctactggtcaggggctcgccgccctgagcgaacagggttggtgcctgtgcggcgccgctcagccaagctccgctagctttgcatgcctgagcttgtgctcagggcctccacccccgccggcgcctacttgccgagggcccacactgctccagcatgtctttcccgcctcacctggagccactcttgtgggcccccacgggccgttggcttccgggcagcttgccgcgttccatattgcagctccactgccagtgacagccacgcgatgggatttcggcgatggaagtgccgaagtggacgctgcagggcccgcagcctcgcatcggtacgtcttgcctgggcgttaccatgttacagcagtgctcgccttaggagctgggagtgctctgctaggcaccgatgtacaggtcgaggcagcccccgcggcccttgagcttgtttgtccaagctctgtgcaatctgatgagtcactggacctgtccattcaaaatcgtgggggatctggccttgaggccgcctatagcatcgtggctcttggagaggaacccgcgcgggcagtccatccactgtgtccctctgatacggaaatcttccccggcaatggtcattgctacaggctagtcgttgaaaaggctgcctggctgcaggcccaggagcagtgccaggcctgggccggtgctgccctcgcaatggtcgacagtccggccgtccagcggttcctcgtttctagagtgacccggtcgctggatgtgtggatcggcttctccacagtacagggcgtcgaagtcggccctgcccctcaaggagaagcattctctcttgaatcttgtcagaactggctgcctggcgaaccacatcctgctacagccgagcactgcgttagactgggtcctacaggatggtgcaacacagatctctgctccgccccgcactcttacgtttgtgaactgcagccaggcggccccgtgcaggacgctgagaatctcctggtgggagctccctctggagaccttcaaggaccactgacgcctctcgctcagcaggacggattgagtgccccacacgaacccgtggaggtgatggttttcccaggcctgagactctctcgggaggcattcctgacgactgccgagttcggcacacaggaactccggcgacctgcacagctgaggctacaggtttatcggctgctgtcaaccgctggtacaccggaaaacgggtctgagcctgagtccaggagccccgacaaccggactcagctggcacccgcctgcatgcctggcggccggtggtgtccgggagcgaatatttgtctgcccttggatgcgtcttgccaccctcaggcctgcgccaacggctgtacttctggtccaggtctgcctggcgcaccctatgccctgtggcgagaattcttgttttccgttcccgccggcccacccgcgcaatatagcgtgaccttacacggccaggacgtgctgatgctacccggtgacctggtcggtcttcagcacgatgccggtcccggggctctgcttcattgttccccagccccaggacatccaggtccccgggccccttatctgtcagcaaatgcaagctcctggctgccccatttgccagcccaactcgaaggtacttgggcttgcccggcatgcgctttgcgccttctggccgcaacagagcagctcaccgtcctcctggggcttcggcccaaccctgggctgagacttcccggccggtatgaggtcagggccgaggtgggcaatggtgtttcccgccacaacctatcctgttcattcgacgtggtgagtcccgtggccggcctgcgggtgatctatcccgcacccagggacggacggttgtacgtgcccacaaatgggtccgctcttgtgctgcaggtcgacagcggcgccaatgccacagccaccgctcgttggccaggcggttccgtgtccgctcgatttgagaacgtctgcccagcacttgtggcaacatttgtccccgggtgcccatgggaaactaatgataccctattcagtgtggttgccctgccctggttgtctgagggagaacatgtcgttgatgtcgtcgtagaaaattcagcctctagggctaatctctcactgagggtcaccgccgaggagccaatttgtggactgcgggcgaccccatctcccgaggccagagtgttgcagggcgtgctcgttagatattctcccgtggtagaagcaggatctgacatggtgttccgatggaccattaacgacaaacagtccttaacgtttcaaaatgtggtgttcaatgtgatttatcagagcgccgccgtctttaaattgtctctcactgccagcaaccatgtgtccaatgtgaccgtgaactacaatgttaccgtggagagaatgaatcggatgcagggactgcaggtgtctaccgtgcctgctgtattgtcgcccaacgcaacattggctctaacagccggagtgctggtggattcagccgtggaagtggccttcctgtggacctttggggatggagagcaggctctgcatcagtttcaaccgccgtataacgaatcattccctgtccccgacccgtcagttgcccaggttcttgtcgagcacaatgtgatgcatacttacgctgcccctggagaatatctcctgacagttctcgctagcaatgcttttgaaaatctcactcagcaggtacctgtgtctgtgcgagcaagcctcccctctgtcgcagttggcgtgtctgatggcgtgctcgtggctggacgccccgtgacgttctatcctcatcccctgcccagcccagggggcgtcctatacacctgggattttggggacggtagtcctgtgctgacccagagtcaacccgctgcaaaccatacatatgccagcagaggaacctaccatgtgcgactagaggtgaacaacaccgtgtctggcgccgcggcccaggccgatgtgcgcgtgtttgaagagctgcgcggtctatccgtcgatatgagcctggctgttgagcagggcgctcctgtggtggtaagtgccgccgtgcaaaccggggataatattacctggacattcgacatgggagacggtactgttctgagcgggccagaagccaccgtcgagcacgtttacctgcgggcacaaaactgtactgtgacggtcggggcggcatcccccgccggccatttggccaggagcctccacgtactggtgtttgtcctggaagtcctgagggtggaaccagctgcctgcatccccactcaacccgatgctcgtctcacagcctatgtcactggtaacccagcacactatctctttgattggacttttggcgatggatcctcgaatacgacagtaagaggatgtccaacagtcacgcataattttacacgatctggaaccttcccactggcactggtgctcagctctagggtgaaccgcgctcattacttcaccagtatctgcgtggaacccgaggtgggcaacgtcacactccagcctgagaggcagtttgtccagctgggggatgaagcatggctggtggcctgtgcttggcccccctttccataccgatacacctgggacttcgggacagaggaggccgcacccacacgcgcacgtggccccgaggttaccttcatttatagggaccctgggagctacctggtaacggtcaccgccagtaataatatctctgccgccaatgattctgccctagtcgaggttcaggaacctgtcctcgtcacttccatcaaggtgaatggctctttggggttggaacttcaacagccatatctgttttcagctgtcggacggggcaggcccgcatcttatctttgggatctgggagatggaggttggctcgaagggcctgaagtcacacacgcctataatagtactggagattttacagtcagggttgccggctggaacgaggtctctcgcagcgaagcctggctcaacgtgacagtaaaaagacgagtgcgcggcctggtggtaaacgccagcaggacagtggtcccactgaatgggagcgtttctttctcgacaagcctcgaggctggctctgacgtgcggtattcttgggttctttgcgaccgttgtacccctatcccaggtgggcccaccatttcctatacctttagatccgttgggacctttaacatcatagtgacagctgaaaacgaagtgggctcggcccaagattcgattttcgtttatgtgttacagctcatcgaaggcctacaggtggtggggggcgggcggtattttccgacgaaccacacagtgcagctgcaggccgtcgtaagagacgggacgaacgtttcttatagctggaccgcatggcgggatcgtggccccgcgttagccgggagtggcaaaggattctctctgacggtactggaggccgggacctaccatgtccagcttagggccacaaacatgttaggtagcgcttgggctgattgtaccatggactttgtcgagcccgtggggtggctgatggttgccgcgagtcccaacccagctgcagtaaatacatccgtcacgctctccgccgaactggccggaggctccggggtcgtttatacctggtctctggaggaaggcctctcttgggagacaagcgaaccgttcaccacgcactcctttccaacccccgggctccaccttgtcaccatgaccgccggcaatccccttggttccgccaacgctaccgtggaggtggatgtccaagtgcccgtgtccgggctgtccatcagagctagcgagcctgggggctcctttgtagccgcaggatcatctgtcccgttttggggacagctggccacgggtacaaatgtttcttggtgctgggcggttcccggcgggagcagcaaaagggggccccatgttacaatggtgttccccgacgccggtaccttcagcattcgtctgaacgccagcaacgcggttagctgggtgtccgcgacttataacctgactgctgaagaacccatcgtaggacttgtgctctgggcctcttccaaggtggttgcccctgggcagctggtccattttcagattctcttggccgccggctctgccgtgaccttccgcttacaggttggtggcgccaacccggaggtgcttccaggtccccggttcagccacagctttcctcgggtaggggatcacgtggtgagcgtgcgcgggaaaaaccatgttagttgggcccaggcccaggtgcgcatagtggtgcttgaggctgtgtctggtctccaagtgccaaattgttgtgaacctgggatcgcaaccgggaccgaaaggaatttcacagctagggtccagcgcggatcacgggtggcttacgcatggtacttttccctccaaaaagtccagggggatagcctggtaattctctccgggagagacgtgacatatacaccagtggcagctggattgcttgagattcaagtacgggccttcaacgcactgggatcagaaaatagaacgcttgttctggaggtacaggatgcagtgcagtatgtcgctttgcagtctggaccctgcttcacaaacagaagcgcccagttcgaagccgcaacatctccgtcaccgcgtagagtggcttaccactgggacttcggggatggttctcctgggcaggacacagatgaaccaagggcagaacatagctacttaaggccaggcgattaccgagtccaggttaacgcatcaaatcttgtgtccttttttgttgcccaggctactgtcacggtgcaggtgttggcttgtagggagcctgaggtagatgtcgtcctgcccctgcaggtgctaatgagacgtagccagcggaattatttagaggcccacgtggatctgcgcgactgtgttacttatcagacagagtatagatgggaagtatataggacggcgagctgtcagaggcctggacggcctgcccgggtggcactgcccggcgtcgacgtttcacgaccccgcctggttctacctcgactggcgttacctgttgggcactactgttttgtgtttgtggtcagctttggtgatacgcccctgacccaaagcatccaagctaatgtgaccgtggcaccagaaagactggtcccaataattgaggggggttcttacagggtctggagcgacacccgggatctagtccttgacgggtctgagtcttacgatccaaatctggaggacggcgaccaaacccctctctctttccactgggcttgtgtggctagcacccaacgggaggcagggggatgtgctttgaactttgggcctcgaggatcttccacagtcacaatcccccgcgagcgtctcgcggcaggagtcgagtacactttttctttaaccgtgtggaaggccggccgtaaggaagaggcgaccaatcaaacagttctgatccgttcagggcgggtgccaatcgtctcattggaatgtgtctcgtgtaaggcacaagctgtctacgaagtgagtcgaagcagttatgtgtatctggagggccgttgccttaattgctccagtgggagcaaacgcggtagatgggccgccaggacattttcgaacaagacactggtgctcgacgaaaccaccacttcaacagggtctgcaggaatgcgcttggttctgagaagaggggtcctgcgagatggcgaaggttacacctttacactgacagtgctggggcggtccggcgaagaggaggggtgcgcgagcatacgcctctcaccaaacagacctccactcggaggaagctgcagactgtttcccctgggcgccgtacatgcactgacgacaaaggttcactttgaatgcacagggtggcacgacgctgaagatgcaggtgcccccctggtctacgctctgcttctgcgccggtgccggcagggacattgtgaggagttttgtgtgtacaagggatctctgtccagttacggggccgttctaccacccgggttccgtccccattttgaggttggcctcgcagtggtcgtccaggaccagctcggtgctgcagtggtggcacttaaccgaagtctggccataaccctaccggaaccgaatggttccgccaccggattgacagtatggctccacggcctgacggccagcgtgctgcccggactgctgcgacaggcagatccccagcatgtcatcgagtactcgctcgccctcgtgaccgttctaaatgagtacgaaagagctctggatgtcgcagctgaacctaagcacgaaagacaacaccgcgcccagattagaaagaatataaccgagactctcgtcagccttagagttcatactgtcgatgatatccagcagatcgctgccgccttggcacagtgcatgggaccgagtcgggaactggtatgtcggagctgcctgaaacagaccctgcacaagctggaagccatgatgctgatactgcaagcggagacaaccgccgggacggtaactccaaccgccattggcgattcaatcttgaacataactggagatcttatccacctggcctcatccgacgtccgggctccacaaccttcagaactgggagcagagtccccatcacgcatggttgcatcccaagcttacaatctcactagtgctctcatgcggattctgatgagatcaagggtgctcaatgaggagccattaacccttgcgggagaggagatagtggcgcaggggaaacggagcgacccccgttcactgttgtgctacggtggtgccccaggacctggctgtcacttcagcataccggaggctttctccggcgccctagccaacctgtcagatgtggttcaactcatctttcttgtggattccaacccctttccatttggctacatttccaattataccgtatctaccaaagtggcctccatggctttccagacccaggcgggagcccagatccccattgagcgcctcgcttctgaaagggccattactgtgaaggtgcccaataactcggattgggcagctaggggccatcggtctagcgctaactctgcaaactcagtggtggtgcagcctcaggctagtgtaggagccgtggtgaccctggattcatcaaatccagcggccgggttacaccttcaactgaactatacactgctagacggccactatcttagcgaagaacccgaaccatacttggcagtttacctgcacagcgaacctaggccaaatgaacataactgctccgcctccaggcggatccggcccgagtcattgcaaggtgccgaccatcggccttataccttctttatatcgcctggctcaagagatcctgcaggatcctatcaccttaacctaagctctcattttagatggtccgctttgcaagtgtctgtggggctctacacctccctgtgccagtacttcagcgaggaggatatggtctggagaacagagggactcctgcctctagaggagacatctcctcgacaagccgtctgccttacaaggcatctaaccgccttcggcgctagtctgttcgtgcctccgtctcacgtcaggtttgtgtttccagagccgaccgccgacgttaactacattgttatgttgacgtgcgcagtgtgcttggtgacatacatggtcatggccgctatcttgcataagctcgaccagctggatgcatcacgcggccgggccatcccattttgtggacagcgaggacgctttaagtacgagattttggtaaaaaccgggtggggacggggttctgggaccaccgcccacgtcggcataatgttatatggcgttgattcacggtccggacacaggcatcttgatggcgaccgcgcattccatcggaacagcctggacatttttcgcatcgctaccccgcacagcctaggatctgtttggaagattagagtgtggcatgataataagggactcagccctgcatggttccttcagcatgttattgtgcgagaccttcagactgccagatccgctttcttcctcgttaatgactggctatcagtggagaccgaagcgaatggcgggttggttgagaaagaggtactcgccgcaagtgacgcagcacttctgagattccggcgattgctggtcgctgaacttcagcgtggtttctttgacaagcatatctggctcagtatctgggatcgtccgccaagatctagattcaccaggattcagcgcgcgacctgttgcgtgctgctgatatgtcttttcctgggtgctaacgcagtgtggtacggcgctgttggtgattctgcttacagtaccggacacgttagtcggctgtctccgctgtctgtggatacagttgctgtgggcctcgtgtcgagcgttgtggtgtatcccgtctatctggccatcctctttttgttcagaatgagcaggtcgaaagtcgccggatcgccaagtcctactcctgccgggcaacaagttttagacattgatagttgcctcgatagtagcgttcttgatagttctttcctgaccttttcgggcctacatgccgaacaggccttcgtgggtcagatgaagtcagaccttttcctggacgattccaaatctctcgtctgttggcccagcggcgaaggtaccctctcctggccagatctcctgtctgatccatcaattgttggaagcaaccttcggcagctggcccggggccaggctggtcacggactgggcccagaggaagatgggttcagtctcgcctccccctattcccctgctaagtccttttctgccagtgatgaggacttgatccagcaagttttggctgagggtgtatcaagccctgcccctacccaggacacgcatatggaaactgatcttctgtctagtttgagcagtacgcccggggagaaaacagaaaccctggccctgcagcggctcggggaactgggccctccaagcccaggccttaattgggaacagccccaggcagctaggctgtcgagaaccggcctagtggagggacttcggaaacgcctgttgcctgcttggtgcgcttctcttgcacatggcctgtcccttcttttagttgccgtggctgtggcagtcagcggctgggttggagctagcttcccacctggcgtgtcagtggcctggttgttgtctagttccgcttcatttctggcatctttccttggatgggaacctctgaaagtgctactggaagccctgtacttcagtctcgtcgctaagaggcttcatcccgatgaggatgatacactggtggagtcgcctgctgtcaccccagtctcggcacgagtccctcgtgtgaggcctccacacggattcgcattgttcctggccaaagaagaagcccgaaaggtcaagcgactgcatggcatgcttcgtagtctgctagtttacatgctgtttctgttagtgacactgttggccagctacggggacgcttcatgccacggccatgcctatcggttacaatccgccatcaagcaagaactgcattctagggcttttctggcgattacccgcagtgaagagttatggccgtggatggcccacgtgttacttccctatgtacacggaaaccagagctcccccgagcttgggcctcccagactgagacaagtccggcttcaggaggcactgtatcccgaccctcctggaccgagagtgcatacgtgcagcgccgcaggtggcttctcgacatctgattatgacgttggctgggagtcgccacataacgggagtggcacctgggcctactctgctccagacctgcttggggcgtggagctggggatcgtgtgccgtgtatgacagcggaggatatgtacaggaactgggtctgagcttggaggagtcacgcgatcgcttacgcttcctgcagctgcacaattggctcgataacaggagtagagcggtgtttctcgagctgacccggtattccccagctgtgggactgcatgctgcagtgacactccgccttgaattccccgcagccggccgggcgttagctgctttgtctgtgcgccccttcgcacttcggaggcttagcgccgggctgagtttacctctccttacatcagtatgcctgttactctttgccgtacactttgccgtcgccgaggcccggacatggcaccgggagggtcgatggcgagttctacgcttaggtgcttgggctcggtggctgttggtggctctcactgcagcaactgcgctggtgaggctggcgcagctgggcgccgccgatcgacagtggacccgctttgtcaggggtaggccccgtaggttcacctcttttgatcaggtggcacagctgtcctctgccgcacggggactggctgcttcacttttgttcctgctgctcgtgaaggctgctcaacaactgcggtttgtgcgacagtggagcgtgttcggtaaaacgctgtgcagggctttgccagagctactgggcgtgacgctgggactggttgtgctgggcgtggcctacgctcagctggccatcttgcttgtgagctcttgtgtagactctctgtggtcagtggcccaggcgctgctggttctctgccctggtactgggctatcaaccctatgcccagccgagagctggcatctctccccacttctctgcgtgggcctctgggccctgcgcctatggggggccctccgcctgggggcagtgatactgaggtggaggtaccacgccttgaggggagagctgtatcgtccagcatgggaacctcaagactacgagatggtggaactgtttctgagacggctgcggttgtggatggggctcagcaaggtaaaggaatttcgccataaagttagattcgaaggaatggagccactacccagtcgctccagtcgcggctctaaggtgagtcccgatgtcccgcctccttctgccggctcagatgcatctcatccgagcacttcttcatctcaactcgatggactgtccgtgtcccttggacggctaggaaccaggtgcgagccagagccttcacgcctacaagctgtttttgaggccctcctgacccagtttgacagactgaatcaggcaaccgaagacgtgtatcagttggagcaacagttacacagcctgcaggggcgaagaagttccagagccccggcaggaagctcaaggggccctagcccaggcctccgccccgctctgccatcccgactggccagagcctctcgcggtgtggacttagctacaggtcctagccgcacaccccttcgggccaaaaataaagtccatcctagtagcacatag

SEQ ID NO: 129194 - DNA, 10914 bp, Artificial Sequence
  Description of Artificial Sequence: Synthetic coding sequence
atgccccccgcagcccccgctcgactcgcccttgctctgggcctcggactgtggcttggggcactggccggcgggcccgggagaggctgcggaccttgcgagccgccgtgtctatgcgggccagctcccggcgccgcatgcagagtcaattgttccgggcgcggactccggaccctcggacccgccctcaggattcctgccgacgctaccgcactaactgcgatggctaaagccgatggggacgttaagaaatatggatccaaacggggcgctctcgccttaacccacggacactcacttcttagggatgtgagtcacaatctcttacgggccctggacgtgggacttttggctaatctgtcagccctggctgaactcgatatttcgaacaacaaaatcagtacgctggaggagggtatttttgccaatctcttcaacctctccgagatcaacctcagcggcaacccatttgagtgcgactgtgggttggcttggctgccacgatgggccgaggaacaacaggtccgggttgtccagcccgaagctgctacctgcgcaggccccggctccctcgctggccagccactcctgggcatacctctgttggattccggctgcggcgccaccctggtcggcccccacggtcctctagcgtccggacagctcgctgcattccatatcgcagcaccactccctgtcacagctacccgttgggatttcggtgacggtagtgccgaggtggacgcggctggccccgcggcctctcacaggtacgtacttccgggcaggtatcacgtgactgctgttctcgccctcggcgctggatctgctctgttaggcaccgacgtgcaggtggaggccgcaccagccgctttggagctggtgtgtccaagcagcgtccagagcgatgaatccctggatctgtcgatccaaaaccgcggagggtccggactggaagcagcttattctatcgtggctcttggcgaggaacctgcacgcgccgttcatcctctttgtccttcggacaccgagatttttccaggaaatggacattgctatcgccttgtagtcgagaaagcagcttggttgcaggcacaggagcaatgccaggcttgggcgggcgccgccctagctatggtggactccccggccgtgcagcgctttctggtgtcaagagtaaccagaagcctcgatgtatggataggtttttctacggttcaaggagtggaagtcgggcctgcccctcaaggtgaggccttctccctggaaagctgccagaattggttacccggagaacctcaccccgcaacggcagagcattgcgtgcgcctcggaccaactggatggtgcaatacggatctctgctcagctcctcactcctacgtatgtgaattacaaccaggcggacccgtgcaggatgccgagaaccttttagttggagcacccagcggtgacttgcaggggcccctgaccccactggcccagcaggacggcctgtccgccccacatgaaccagtcgaggcaggaatgggatccgtggaactccgccggcctcccgcacaccaggtgatggtgtttcctgggctgagactgagccgagaggcctttcttaccactgctgaatttggtacccaggagctgcgcaggccagcccaactcagacttcaggtctacagacttttgtccacagccggaactccagagaacgggagcgaaccggagagtaggtcaccggataaccgaactcagctggcccctgcctgtatgcccggtgggaggtggtgtcctggcgccaacatctgcctcccgcttgacgcctcttgccatcctcaggcttgtgccaacggctgcactgaaggagaacatgttgtggacgtggtagtggagaacagtgcatcaagggctaatctctccttgagggttactgccgaagagccaatttgtggtctccgggctactccctctcccgaagctcgagtcctccagggagtgctggtacgatacagtcccgtggttgaggccggttccgacatggtgttccggtggactataaatgacaaacagagtctgacctttcaaaatgtagtctttaatgtcatctatcagagcgctgccgtgttcaagctttcactaactgctagcaaccacgtcagcaatgttacagtcaactacaacgtaacagtggaaagaatgaaccgcatgcaaggactgcaggtttcaacggtgccagccgttctctctcctaacgccacactggccctgactgccggtgtactcgtcgactccgccgttgaagtcgctttcctttggaccttcggagatggtgagcaagctttacatcagttccagcccccatataacgaatcctttcctgtgcccgaccccagtgtggcccaggtcctcgtggaacacaacgttatgcacacgtatgctgccccgggcgaatatctgctgacagtgctagcaagcaatgcctttgagaatctgactcaacaagtacccgtgtccgtgagagcctccctaccaagcgtggcggttggcgtgtctgacggggtactctcccagccagccgcaaatcacacctacgcaagtcgagggacctaccatgtacggctggaagtgaacaatactgtgagcggcgccgccgcccaggcagacgtccgagtcttcgaggagctgcgggggctgagtgttgacatgtccctggcagttgagcaaggcgcacctgtcgtagtctctgcagcagtgcaaactggcgacaatataacttggacgtttgacatgggcgatggaaccgttttgtcaggccctgaagccacagtggaacacgtctacttacgtgcccagaactgcacagtcacagtgggcgcagcgtcacctgccgggcacctggcccgaagcctccatgtactcgtgtttgttcttgaggtgctgagagtggaacccgccgcgtgcattccaacacaaccggatgctcgcttaacagcctacgtgaccggtaacccagcgcactacctatttgattggacattcggtgacgggtcttcaaacacaaccgtgcggggctgtccaaccgttacacacaactttactaggtctgggaccttccccttagccttagtcctgtccagccgggtcaacagggcacattacttcacctccatctgcgttgaacctgaggtcgggaatgtcacactacaacctgaacggcagtttgtccagttgggggacgaggcgtggctggtcgcctgtgcgtggccccccttcccgtacaggtacacatgggacttcgggaccgaagaggctgcccctactcgggcgaggggccccgaagtgacatttatctatagagacccaggatcgtacctcgtgaccgtgacagcaagcaacaacatttctgctgcaaacgacagtgcgttagtggaagtacaggaacccgtgctcgtgacctctattaaagtcaatggaagtctcgggttggaactccagcagccctacttgttttctgctgtagggaggggccgccctgcctcgtacctgtgggacttaggcgacggcggatggctggaggggccggaggtcacacatgcatataatagcaccggagatttcacgggacccggcccgggtaggcaacggcaacgcttactcgcccaccgagaagccggcacttatcacgtgcaactccgagctacaaacatgctggggagcgcatgggcagactgtaccatggacttcgtggaaccagtcggttggctgatggttgccgcctcgcctaaccctgcagccgtcaataccagcgtgacactttcagctgagctggccggcggttccggggtcgtctacacctggtcactcgaggaaggactgtcttgggagacctctgagcccttcaccacccactcctttccaactcccgggctccatctggtgacaatgactgcagggaaccctctgggttccgcaaatgccaccgtggaagttgacgttcaagtcccggtgtctggacttagtataagggcttctgaaccaggggggagcttcgtcgcagcagggtcttccgtgcccttctggggccagctagctactgggacaaatgttagctggtgttgggccgtccccggtgggtcctctaagcgtggaccacacgtcacgatggtttttccagatgcgggaactttctctattcggctgaacgcctcaaatgcagtgtcctgggtcagtgcgacttacaatctcactgcagaggaacccatcgtggggctggtcctatgggccagcagcaaagtggtggcccccggacaacttgttcactttcaaattctgctggccgcaggcagcgccgttacatttagactgcaggataccgacgagccaagggccgagcattcttatttgcgcccaggcgattaccgagtccaggttaatgcctccaacttagtgagctttttcgtagcccaggccacggtgacagttcaggtgctagcctgtcgggagcccgaggttgatgtcgtgttacctctgcaggtacttatgagacgcagtcagagaaactatctggaggcccacgtagatcttcgcgactgtgtcacctaccaaactgagtacagatgggaagtctatcggacggcctcgtgtcagcggccagggcggcccgctcgcgtcgccttacctggagtggacgtgtcaagaccacgactggttctgccccgcctcgccctacccgtgggacactattgctttgtatttgttgtctcattcggtgacactcctttaacacagtcgattcaggcgaacgttactgtggccccagagcgattagtgccaattattgagggcggttcttaccgcgtgtggtccgacacccgtgacctcgtcctcgacggctctgaatcctatgatcctaacttggaggacggggaccagacacctttaagcttccactgggcatgtgttgcgtccacgcagcgcgaggccggcggctgtgccttaaatttcggaccacgtgggagcagcactgttacaatccctagggaacggctggctgctggagtggagtacacattctcacttacagtgtggaaagctggcaggaaagaggaagccacgaaccagacagtcttgattcgatctggacgagtgcccattgtgtcactcgaatgtgtgtcttgcaaggcgcaagccgtctacgaagtgagtagatcctcctatgtctatcttgagggcaggtgtttaaattgttcctcagggtcaaagcgcggacgctgggctgctcgaacattctctaataaaacattggtgttagacgaaaccaccacctcgaccggtagtgctgggatgcgtcttgtgttacggcgcggcgtgctgagggatggagaaggatacacttttacgctcacagtgctggggagaagtggtgaggaagagggatgcgccagtattcggttaagtcccaataggccgccactgggaggatcctgcagactgttcccattgggcgctgtgcatgccctcaccactaaagtgcactttgagtgtacagggtggcacgatgcagaggacgccggagctcctctcgtgtacgccctcctcttaaggcggtgcaggcagggtcactgcgaggagttctgtgtctacaaaggatctctgtcctcgtacggagctgtgctgccccccggattcagaccccattttgaggtggggctcgccgttgtcgtccaggaccagcttggggctgcggtggttgctttgaaccggtcgttagccatcactctccctgaaccaaatgggagtgctaccgggctgactgtgtggctgcacggattaacggccagtgtcctaccaggactcctccgacaagccgatccgcagcacgtcattgagtatagtttagctctggtaacagttctgaatgagcacagggcacaaattcgcaagaacatcacagagactttggtctctctcagggtacacaccgttgacgacatccagcagatcgccgccgctttggcacagtgcatgggtccatcccgggagctggtgtgtaggtcatgtttgaagcagactctgcataaactcgaggccatgatgttaattctccaagctgaaactactgctgggacagtgacccccacagcgataggggactccatcttaaacataaccggcgatctcatccacttagcttcctcagatgtgcgcgcccctcagcctagcgaattaggcgccgaaagcccatctaggatggtggcgagccaagcctacaacctcacctcagccctcatgcggatattgatgaggtcaagagtgctgaatgaggagccactgactctcgccggggaagaaatcgtggcacagggtaagcgatctgatcctcgttccctcctgtgctacggaggcgcaccaggacctggttgtcacttttcgatcccagaggcgttttccggcgctttggctaacctgtctgacgtcgtgcaactcatctttctggtggattcgaacccgtttccttttggctacatcagtaattacaccgtgtcaaccaaggtggctagtatggcgtttcagacgcaagcaggagcccagattccaattgaacgcctagctagcgaacgagcgatcacggtcaaagtgcctaacaacagtgactgggctgctaggggccaccgaagctcagctaatagtgccaatagcgtagtggtgcagccacaagcgtccgtaggtgcagtcgtgacccttgatagtagcaaccccgctgctggactgcacctgcagctaaattacacattgctggatgggcattacctgagtgaagaacccgagccatatctggccgtctatttacacagcgagccccgcccaaacgagcacaactgttcagcaagcaggcggatccgccccgagtcccttcagggcgccgatcatcggccttacacattttttatctcacccggatcacgggaccccgccgggtcctatcatttaaacttaagctcacactttcggtggagcgctctgcaggtgtctgtgggcctgtataccagtctgtgtcaatacttctccgaggaggacatggtatggcgcaccgaggggcttctgccactggaggagacaagccccaggcaggctgtgtgcctcacccgccatctcacagcatttggcgcatcacttttcgtgcctccaagccacgtccggtttgtattccctgaaccaactgccgacgtgaattacattgtcatgctcacttgtgcagtatgtctggtgacctatatggttatggccgcaatcctgcacaagttagaccagctagacgccagccgaggccgggccatccccttttgtggtcaacgtggccgctttaagtacgagatcctggtcaaaaccggatggggccgcggatctggcacgactgcacatgtagggatcatgctgtacggcgtggactctcggagcggccacaggcatctcgacggagatcgggcattccatcggaatagcttggacatcttcaggattgctactccacactctctggggtctgtctggaagatcagggtttggcatgacaacaagggcctgtctcccgcctggttcttgcaacacgtgatcgtgcgagatctgcagacggccagatcagctttttttttagtcaatgattggctcagcgtcgagacggaggcgaacggggggctcgtcgagaaggaggtcctcgcagccagcgatgctgctctcctgaggtttagacgcctacttgtggctgagctgcagcgcggattctttgataagcacatatggttgagtatctgggataggccaccaaggtcacgcttcactcggattcagagagctacctgttgcgtgcttttgatctgccttttccttggggctaacgccgtgtggtatggcgccgttggcgatagcgcctacagtactgggcacgtatccagactctccccgcttagcgtggacaccgtggccgtggggctggtgagtagcgtcgttgtttatcctgtttatctggccattctgtttctgtttaggatgtctcggtccaaggtggcgggcagtccctctcctacgccagccgggcagcaggtactggacattgattcttgtctggatagctcagtcctagattcctctttcttaacctttagcgggttgcacgctgaggccttcgtaggccagatgaagtctgatctgtttctggatgattccaaaagcctggtatgctggcctagcggagaaggcactctgagctggcctgatctcctctcagatccgagcatagtagggagtaacctccggcagcttgctaggggccaagctggacacggattgggaccagaggaagatggctttagtcttgcctcaccttatagcccagcaaaaagtttcagcgcgagcgatgaagacctgatccagcaggtgctggctgagggggtcagctcccctgcgccgacacaggatacccacatggagacagacctcctgtcgtcactaagtagcacgcctggcgagaagaccgagacccttgcgttgcaacgcttaggggagttgggccccccctctccaggactgaattgggagcaaccccaagctgcgcggctgagccgaacggggttggtagaaggactgcggaaacgtctgttaccagcttggtgcgccagccttgctcacggattgtctctgcttttggtggccgtggcggtcgcagtctctggctgggtgggcgcatctttccctcctggcgtgtctgtggcgtggcttctgagctcttcagcctcttttttggcctcattcctgggttgggagcctctaaaggtgctgttggaggccctatactttagtctggtcgctaaaagactccacccagacgaggatgataccctagtggaatcacccgcagtcacgccggttagcgcgcgggtgcctcgggtgcgtccccctcatggatttgcactcttcttggccaaggaagaagcgagaaaggtcaagcgactgcacggcatgttgagatccctgctcgtgtatatgctgttcctgctggtgactctccttgcatcatacggagatgctagttgccacggccacgcttacaggttacagtccgccatcaaacaagagctgcactctcgcgcttttttggccatcactagatccgaggagttgtggccctggatggctcacgtgctcctgccgtacgtgcatggtaaccagagcagtcctgagctaggtccaccccgcctgagacaggtgagattgcaagaagcactctatcctgaccctccaggcccccgcgtgcacacctgttcagctgcagggggctttagcacgagcgattacgatgtgggatgggagtctccccataacggctcaggcacttgggcctattctgctccagacctgcttggtgcttggagctggggctcttgtgccgtgtacgactcaggagggtacgtgcaggaattggggctaagtctggaggagtccagagaccggctaagatttctacagttgcataattggctcgacaataggtcaagggcggtatttctggaattgaccaggtacagtcctgctgtcggtctgcacgcagcagtgaccctgagactggaatttcctgcagcaggcagagctctagcggctctcagtgtccgcccattcgccctgcgccgcttgagcgcagggcttagcctgccactcttaacgagcgtgtgtttgttgttgttcgccgtgcattttgccgtcgcggaagcacggacatggcatcgggaagggagatggagagtgctacggctaggcgcatgggcaagatggcttctcgtcgccctgaccgccgcgactgccctggtccggctcgcccagttgggagcggcagacagacagtggacaaggttcgtccgaggccgaccaagacgcttcaccagctttgatcaagttgcacagttgtcttccgcagcccgcggccttgcagcatctttgctgttcctactcttagtaaaggcagcccagcaattgagattcgtgcgccagtggagtgtgttcggcaagactctgtgtagagctcttccagaattgctcggcgtgacgctaggactcgtggtccttggggtggcctatgctcagttggctattcttcttgtgtcttcctgcgtggatagcctttggagtgtggcccaggcattgctggtattatgccctggaactgggctttccaccctttgtccagccgaatcctggcacttgtcgccattgctttgcgtgggattatgggcccttagactgtggggcgccctgaggcttggcgctgttatcctgcgttggagataccacgcactccggggagagctctaccgccccgcctgggagccacaggactacgaaatggtagagctgtttctgagaaggctccgcctgtggatgggactatcgaaggtgaaagagttcaggcacaaggtgcggttcgagggaatggaaccactgccaagtcggagctctagaggaagtaaagtgagtcccgatgtgcctccgccttctgcagggagcgatgcttctcacccgtccacatccagtagccagctggatggcctgtctgtttctttgggtagattaggtacccggtgtgaaccggaaccttctcggcttcaggccgtgttcgaggcacttctgacacaattcgatcgcctcaatcaggcaactgaggatgtgtatcaactcgagcaacagctccattccctgcagggcaggcgctcgtctcgagcaccggcaggctccagtaggggaccttctcccggcctcagaccagcactgccttcccggttagcacgagcttctaggggcgtggacctggccactggtccatcacgcaccccccttagggcgaaaaataaggttcacccaagttccacttag

SEQ ID NO: 129195 - DNA, 3693 bp, Artificial Sequence
  Description of Artificial Sequence: Synthetic coding sequence
atggtggccgccagtccaaacccagcggccgtgaatacatccgtcaccctctctgcagagctcgcaggtggcagcggagtggtatatacttggtcactggaggaggggctgtcgtgggagaccagcgaaccatttacgactcactctttcccgacaccaggactgcatctggttactatgaccgccgggaacccgctggggagcgccaacgctacagttgaggtcgatgtacaggtgcccgtgtctgggttatccatccgcgctagcgagccaggcggtagctttgtggctgcaggatccagtgtgcctttctgggggcagctggctacaggcactaatgtgtcatggtgctgggcagtacctggcggatcatctaaacgggggcctcacgtaacgatggtttttcccgatgcgggaaccttcagcatcagattgaacgcctccaacgccgtttcgtgggtatccgcaacttacaatctcaccgcggaagaaccaatcgtaggcctggtcttatgggcctcgagcaaagtggttgcccctggccaactcgtgcactttcagatcctgctggctgcaggctccgctgtgacctttcggctgcaagtgggcggggctaatcctgaggtcctgcccggaccacggttcagccactcttttccacgggtgggggatcatgttgtgagtgtacggggcaaaaaccacgtgtcttgggcacaggctcaagtgcgaatcgtcgtcttggaggccgtgagcgggctgcaggtccccaactgttgcgaacccggaatcgcaacaggtactgagaggaatttcacagctcgtgttcagcgcggctcccgggttgcatatgcttggtatttttccctccaaaaggtgcagggggacagtctggttatcctgtccggtagagacgtcacgtacactccagtagctgccggactgctggagatccaagtgagagcattcaacgccttgggttcggagaatagaacccttgtgctcgaggtacaagacgccgtccagtatgtggcactgcaaagcggtccttgtttcacaaacagatccgcgcaattcgaagcagcaactagcccctccccgaggcgggtagcctatcattgggattttggtgacgggtccccaggtcaagacacagacgaacccagggctgaacactcttatcttagaccaggtgactacagagtacaggttaacgcatcgaatctggtttcattctttgtggctcaggccacagtaacagttcaagtgctagcctgccgagagccagaggttgacgtggtgctcccccttcaggttctgatgcggcgcagccagaggaactacttggaagcccacgtggatctgcgcgactgcgtgacctaccagacagagtaccggtgggaagtatatagaaccgcctcgtgtcagaggcccggccgccccgcccgggttgctctccccggagtggacgtcagccggccacgactggttctccctaggctggcacttcctgttgggcattactgtttcgtctttgtagtgtcttttggcgacacccccctcacccagtccatccaggcaaacgtgactgtggctcctgagagattagtgcccattattgaaggcggcagctaccgcgtgtggtcagatactcgcgacctcgtgttagacggcagcgaatcgtatgatccaaatctagaagatggcgaccagacgcctctgtcttttcactgggcttgtgtggctagcactcagcgcgaggctggcggctgtgccttaaacttcggcccacggggatcctccaccgtgaccatacccagggagagactggccgccggagtggagtatacgtttagcctgaccgtgtggaaagcagggcgtaaggaagaagccacaaatcaaacagtgctgatcaggagcggacgcgtgcctatcgtttctcttgaatgtgtttcctgcaaggcacaagcagtgtatgaggtaagtcggagctcatacgtgtatcttgagggacggtgtttaaattgttctagcggctcaaagcgcggcaggtgggccgctcgcacattctctaataaaaccctcgtgttagatgagaccaccacatccacaggctccgccggaatgcggctggttctgcggaggggtgtgttaagagatggagaggggtacacctttactctgacagtgctgggtcggtcaggagaggaggaagggtgtgccagtatccgtctgagtcctaacagaccaccacttggagggtcttgccgattgttccctctgggagctgtgcatgctctcacaactaaagtgcacttcgagtgcaccggctggcacgatgcagaggacgccggtgctccgcttgtctatgccctccttctgaggagatgcagacaaggccattgcgaggaattctgcgtgtacaaaggttcactgtcttcctacggcgccgtgctccctcccggtttccgcccccattttgaggttggcctggcagtcgtggtgcaggaccaactgggcgctgctgtagtcgccttaaataggtctctggctatcaccttgcccgaaccaaatggaagtgcaactggcctgactgtctggctgcatggactgaccgccagtgtgcttcctgggctactgagacaggctgacccacagcacgttatcgaatactctctggccctggttacagtcctgaacgagtatgagagggcactcgatgtggctgccgaaccgaaacacgagcgccagcaccgcgcccagatacgcaagaatatcaccgaaactctcgtttccctgcgtgtgcatacggtcgatgacatccagcagattgccgctgccctagcacagtgtatgggcccctctagagagctggtgtgtagatcgtgcctcaagcagacacttcacaagctcgaggccatgatgctgatactccaggctgagaccacggccggaacagttacacccacagctatcggagactccatcctcaacataactggggatctgatccacctggcatcatcagatgtcagggcaccccaacccagtgaattgggggcagagagccccagtcgaatggtagcttctcaagcttacaatctaacctctgctttaatgaggatcctgatgaggtctagagtgctaaatgaagagcctctgacgctggcaggcgaggaaattgttgctcagggaaagcggtccgaccccaggagtttgttgtgctacgggggggcacccggccctggctgccacttctctatcccagaggctttcagcggtgcgctcgcaaatctctcggacgtggtgcagctgatatttctggtggattcaaatccttttcctttcggctatattagtaactatacagtctctaccaaggctcccccaaccccccctactcctctatggtccagcccaagaccccccagtgtcctgtggtcaccatggacggctgccactctccggcccggctgtatctgctcctccacaatccgctgctggacggcaaccacttgtctccgtaacctgtcaccaacctggcaatctacctatacccgctctcctgggccaatgagtaccactgctcgcctggccggcggatcagcccaatcccactctcgtgtgctgactactggcccgacgccgagttcattcccacgcggagctgaaacccagaggggagtcaccatctag

SEQ ID NO: 129196 - DNA, 12909 bp, Artificial Sequence
  Description of Artificial Sequence: Synthetic coding sequence
atgccacccgccgcccccgctagacttgcactggcattaggtttagggctttggctgggagcccttgccggggggccggggagagggtgcgggccctgtgaacctccatgcctttgtggaccagctcccggagccgcgtgtcgcgtcaattgttctggcaggggcctgcgcactctgggtcccgcgttgcggattcccgccgacgccacagccttggatgtttcccataatctcttaagagcgctggacgtagggttgttagctaacttatcggcacttgcggagctcgatatttctaataataaaatcagcaccctcgaggagggaattttcgctaacctgttcaacctgagcgagatcaatttatctgggaatccttttgagtgtgattgtggattggcttggctgccccggtgggcagaggaacagcaggtcagagttgtccagccagaggcggctacttgcgccgggcctggaagtctcgccgggcagccactccttggcatcccactgctcgattcaggatgtggcgaagaatatgtagcttgcttgcccgataactccagtgggactgtggctgctgtttcattttcagcagcacatgaaggccttctgcagcctgaggcgtgtagtgctttttgtttctcgacaggccaaggactggcagcgctgagcgagcagggctggtgtttgtgcggcgcagcacagccaagttccgcctccttcgcgtgcctttccctatgcagtggacctccccccccaccagctccgacctgtcgaggccctactctacttcaacacgtctttcccgcgtcgccgggggccactctggtgggaccccacggccccctggcctctggacaattggccgcatttcatattgccgcccctctgcctgtaacggccacccgctgggattttggcgacgggtcagctgaggtcgatgcagcagggcctgctgcctcccacaggtacgtactccctggaaggtatcatgtcaccgccgtccttgccttgggcgctgggtcggccctcctgggtacagacgtccaggtggaggcagctcccgctgcacttgagttagtttgtccgagttctgtgcagtccgacgaatcattggacctgtctatccagaaccgtgggggtagtgggcttgaagcagcatacagtattgtcgcgctaggcgaagagcccgctcgcgccgtgcatcccttatgccccagtgatacggagattttccccgggaacgggcattgctaccgcttagtggtggagaaagccgcctggcttcaggcacaggaacaatgccaagcttgggcgggagccgctctcgccatggtggacagccctgccgtgcaaagatttctcgtttcacgtgtcactcgctccttggacgtctggattggcttctccacggtgcagggcgttgaagtagggccagcaccccagggcgaagcattttcacttgagtcctgccagaattggctgccaggagaacctcaccccgctacagctgaacactgtgtgcgactggggcccaccggctggtgtaatacagacctctgttctgcccctcacagctatgtctgcgaattacagcccggcggccccgttcaggacgcggagaacttgctggttggagcgccttccggtgacctccagggaccactgactccgctggcacagcaggatgggttgagcgctccccatgaacctgtagaagtgatggtgtttccaggcctacgcttgagccgcgaagcctttctgacgacggctgaattcggaacccaagagctgcgacgccctgcgcagctgcgcttacaggtgtacaggctcctgagcaccgctgggacccctgaaaatggatctgagcctgagtcccggtctcccgacaatcgaacccagctggcacctgcgtgcatgcccggaggaaggtggtgtcctggggcaaatatttgtctaccgctggacgcttcctgccacccacaggcgtgtgccaatggttgcacatcagggccaggcctccccggagctccctatgctctgtggcgtgagttcttgttctccgtgccagcgggccctcccgctcagtatagcgtgacactccatggccaagacgtgctgatgttgccaggcgaccttgttggactacagcacgacgccggacctggggcgctgctacactgttctccagcgcccggccatcccggaccccgcgccccatatctgtccgccaacgcatcatcatggctgccccatttaccggcccagctggaaggcacctgggcctgcccggcctgcgctcttaggttgcttgccgctactgagcagctgacagtgctgttggggttgcgccccaatcccggcttgaggctgccgggacggtatgaggtgagagccgaagtcggaaacggagtcagccgacataacttgtcctgttcgtttgacgtagtgtctccagtagcaggactccgcgtgatctatcctgccccacgggacggcagattgtacgttcctacaaatggtagtgctctggtgctccaggttgattcaggagctaacgccactgcaaccgccagatggccgggcggcagcgtctccgcaagatttgagaacgtgtgccctgcactggtggccacatttgtccctggatgtccgtgggaaaccaacgacacgctgttctccgtggtagctctgccctggctctctgagggagagcacgttgtcgacgtggtcgtagagaactcagcctcaagagcgaacctgagtcttagggtcaccgcagaagagccgatctgtggactcagggcaacaccttctcctgaagcacgggtcttgcaaggcgtcctcgtgcggtattccccggttgtggaggccgggtcagatatggtatttcggtggaccattaacgataaacagtccctgaccttccagaatgtggtgtttaatgtgatctatcagagcgctgcagttttcaagctgtctctgaccgctagcaaccacgtgtccaacgtgacagttaattataacgtgactgtggagcgaatgaaccgcatgcaaggcctgcaggtgtcaactgttccagctgtcctctccccaaacgcaaccctagctctaaccgcaggagtcctggttgattccgccgtggaggtggccttcctttggaccttcggcgacggtgagcaggccttgcaccagtttcaaccaccctacaacgaatcttttcctgtgcctgacccatccgtcgctcaggtcctggtggaacacaacgtgatgcatacttatgccgctccgggagaatacctgctcactgtgctggcctccaacgcttttgagaacctcactcagcaggttccggtctctgtaagggccagtctcccaagcgttgccgtgggagtatcggatggcgtgttagttgcgggtagaccagttaccttttaccctcaccctctgcccagcccgggcggtgtgttgtacacctgggattttggcgacggctcccccgtcttaacgcagtcgcaacctgcagccaaccacacatacgctagtcgcggcacctaccatgtgaggctggaggtgaacaacaccgtgtccggagctgccgctcaggccgacgtgcgagtgttcgaggagctccgggggctgtccgtcgatatgtcactggcagtggaacagggagctccagtcgtggtttccgccgccgtgcagacaggcgacaacattacttggaccttcgatatgggcgacggtacagtcttgagtgggcctgaggcaaccgtagagcatgtctatctaagggcccaaaattgcactgtgacggtgggtgctgcttccccggccggtcaccttgcccggtctcttcacgtgctggtatttgtgctcgaggtgctacgggtcgagccagccgcctgtattcctacccagccagacgcgaggctgactgcttacgtgactggcaaccccgcccactatctgtttgactggacgttcggcgatggtagttccaataccacagtaagagggtgtcccacagtgacgcacaactttacccgcagcggcacattccccttagctctggtgctgtcctcacgggtgaatagggcgcactacttcacctcgatttgcgtcgagcctgaggtcggaaacgtcacactccagccagaaaggcagttcgtccagctcggagacgaggcctggttggttgcttgcgcttggccacctttcccatatcgctacacttgggatttcggaacagaggaggccgctccaaccagagcacggggcccagaggtgacatttatctacagagatccagggtcttatctggtaaccgtgactgcgagtaacaacatctccgccgcgaacgatagcgcactggttgaggtgcaggagcctgtcttagtgacctccattaaggtgaatggaagtctgggacttgaactgcagcaaccctatctgtttagtgccgtgggaagaggaaggcctgccagctacctgtgggacttaggggacgggggttggctagaaggtcccgaagtgacccacgcgtacaactcaacaggggactttactgtccgagtggctggctggaatgaagtctctcggtcagaggcgtggctgaacgtcaccgtcaaaaggagggtgagaggtctggttgttaacgcctctcgtacagtagttcctctgaatggctcggtgtccttctcaaccagcctagaggccggcagcgatgtgcggtattcctgggtcctgtgtgataggtgtactccaattccaggcggcccaacaattagctatacctttagatccgtaggaactttcaacattattgtgactgccgagaatgaagtgggaagcgctcaggattcgattttcgtctacgtgctccaactgatagagggcctgcaggtggtgggtggcggtagatacttcccaactaaccatacagtacagctgcaggccgtggtgcgcgacggtactaatgtcagctacagttggacagcttggcgggacaggggccccgccctcgctggatctggtaaaggtttctctcttaccgttcttgaagcaggcacttatcacgtgcagcttagagccactaacatgctcggcagcgcctgggcagattgtacaatggatttcgtagagcccgtgggttggctgatggtcgcagcctcccctaaccctgcagcagtgaacacctcagtgaccctgtccgccgagctagcaggcggttcaggggtggtgtatacctggtccctggaggaagggttatcctgggagacgagtgaaccattcacaacccatagtttccctactccaggactgcatctggtcactatgactgccggaaaccctctgggttccgcgaatgcaaccgtagaagtagacgtgcaggtccccgttagcggtctgtcaattagggccagcgagccggggggcagcttcgttgccgctggctcttctgttcccttctgggggcagcttgcaaccggaactaatgtgagctggtgttgggctgtgcccggcggcagctcaaagcggggaccccacgtcacaatggttttcccagatgccggcacattcagcattcggctgaatgcgagcaacgcagtgtcgtgggtgtcagctacatacaaccttaccgcggaggaacccatcgtagggcttgttctgtgggcctctagtaaagtggtggcccctgggcagctggtgcattttcagatcttgctcgctgccggttccgcagtcacatttcggctgcaggtggggggtgcaaacccggaggtcctgccaggccctaggttctcccatagcttcccacgggtgggagatcacgtggttagcgtgaggggaaaaaaccatgtttcgtgggctcaggcgcaggtcaggatagtagtcctggaagccgtgtctggcctgcaggttccaaattgttgcgaaccaggcatcgccaccggtacagagcggaatttcacagccagggttcaaaggggttccagggtggcatatgcctggtatttctcattgcagaaagtgcagggcgactcactcgtcatcctatcggggcgggacgttacttacaccccggtcgcagccggcctattggagatccaggtgcgcgcctttaacgccctagggtcagagaatagaaccttggtgcttgaagtgcaggacgccgtgcaatatgtcgccctgcaaagcggcccttgtttcaccaataggagcgctcaatttgaagccgcaacctccccaagtccccggcgggtggcctaccattgggactttggggacggctcaccaggtcaggatactgacgagccaagggccgaacacagttatctgagacccggtgattacagagtccaggtcaacgctagcaacttagtcagcttttttgtggctcaggctaccgtgactgtccaggttctggcctgtcgagaaccagaagtggacgtcgtgctgccattgcaagttctgatgaggagatcccagagaaactatctggaggctcacgtagaccttcgcgactgcgtgacataccagacggagtacagatgggaagtctaccggaccgccagttgccaaagaccaggacggccagccagagtcgccctgccgggtgtggacgtctccagaccacgcctggtgctcccgaggctggcccttccggtgggacactattgcttcgtgtttgtggtgtccttcggcgacacaccgcttacacaatctattcaggcaaatgtaaccgtggcaccagagaggctggtcccgatcatcgagggtggttcctacagagtgtggtcagacacacgtgatctggttcttgacggatcagagagctacgatccaaacttggaagatggagatcaaaccccactgtcgttccattgggcctgtgtggcaagtacccaacgggaagctggggggtgtgccctcaacttcgggccccggggcagttctaccgtgacaatccctcgggagcggcttgccgcaggcgtcgagtacacattctcgcttaccgtgtggaaggccggccgtaaagaggaggctacaaaccagactgtgctcataagatccgggcgggtacccattgtgagcctggaatgcgtttcatgtaaggcccaagccgtgtacgaagtatccagatcatcttatgtatacctggaaggaagatgcctcaactgtagttccggcagcaagcgagggaggtgggctgccagaaccttctccaataaaaccctcgttctcgacgagacaactacctccacaggcagcgcaggtatgagattagtcctgaggaggggagtcctgcgtgatggcgagggctatacttttacattgacagtgctcggacggtctggcgaggaggaaggctgcgcttctattagactgagtcccaaccgcccacccttggggggcagctgcagactgtttccacttggcgccgtgcatgccttgacaacaaaggtgcactttgagtgcaccgggtggcacgatgccgaagacgctggcgcccccctggtgtatgcgctgctgttgcgccggtgtcggcagggacactgcgaggagttttgtgtgtacaagggctcactgtcctcctacggtgccgtgttgccaccaggcttccggccacacttcgaagtggggctggctgtggtggtgcaggaccagctcggagcagccgtggtggccctcaaccgctcattagcaattactttgccagagccgaatggttctgcaactggattaaccgtatggctgcacggcctgaccgcgagcgtgttgcccggcctactgagacaggcagatccacaacacgtgattgaatactctcttgctctcgtcacggtcctgaatgagtatgaaagagccctggacgtggcagccgaaccaaagcacgagagacagcatcgcgcacagatcaggaagaacatcaccgaaaccctcgtgtccttaagggtgcataccgtagatgacattcagcagattgccgcggccctggcccaatgtatgggcccatccagagaactcgtatgcaggagctgcctcaaacagaccctccacaaactggaggccatgatgttaattttgcaggctgaaaccacagccggcaccgtgacacccacagctatcggggacagtatcctgaatattaccggcgacctgatccacttagcctcaagtgatgttcgagctccccagccctccgaacttggggcagaatctccatcccgcatggtggcttctcaggcttacaacctcacgtcggctctgatgaggatcttgatgcgatcacgggtactgaacgaggagccgctgacgctggccggtgaggagatcgtggctcaggggaaaaggagcgaccctagaagtctgctgtgctacggaggcgcacccggcccgggctgccatttctctattcctgaggcattctctggggccctggcgaatctgtccgatgttgtccaactgatatttctcgttgattctaacccattcccctttggatacatttccaactacacagtgtcaacaaaggtcgcgtctatggctttccaaacccaggccggggcccagatccctattgaacggctggctagtgagcgggcaattacagtgaaagtgccaaataattcagattgggctgcccgtggccacagaagcagtgctaacagcgctaattccgtcgtcgtgcagccccaagcgagcgtcggggccgtggtcacactggactcgagcaaccccgcggcaggactccacctgcagcttaactacactctgctggacggacactacctctcggaggagcccgaaccttatctcgccgtctatctccacagcgaacctagaccaaacgaacataattgttcagctagccggcgcatccgacccgagtcactccagggcgcagaccatcgcccttacaccttttttatttcacccggcagcagagatcctgcgggctcctaccaccttaacctgagctcacattttagatggagcgcgctgcaggtgtcggtcggtctctatacctctctgtgtcagtacttctccgaagaagatatggtgtggaggacggagggacttctgcccctggaagaaacatcaccgcgacaggccgtgtgcctgacgcgccatctcactgcgttcggcgcgtcccttttcgtcccaccaagtcacgtccggtttgtctttccagaacccactgcagatgttaactatattgtgatgttgacttgcgctgtgtgtctcgtcacttacatggtgatggccgcgatcctgcacaagcttgatcagcttgatgctagtcgggggcgagccatccccttctgtgggcagcgcggacgctttaagtatgaaatactcgtgaagacaggctgggggaggggttccggtactaccgcacatgtgggcattatgctgtacggcgtggactcccggtccggacacagacacttagacggcgatagggcatttcacaggaatagcttggatatcttccgtatcgcaactccacactctctcggtagcgtctggaaaatccgagtctggcacgacaacaagggtctttctcccgcatggttcctccagcatgtaattgtgcgggacttgcagactgctcgatccgcttttttcctggtaaatgattggctttccgtcgaaacagaggccaacggggggttggtcgagaaggaagtgctcgcagcaagtgacgcagcactcttgaggttccgccgactcttggtggccgagctgcagagaggcttttttgacaagcatatctggttatccatttgggaccgaccaccccgaagtcggttcacaaggattcagagggcaacctgctgtgtcctcctaatttgcctctttcttggtgccaatgccgtgtggtacggagcggtgggcgactctgcttatagcaccggacatgtgagcagattgagccctctgagcgtcgatactgttgctgtgggcctcgtaagcagtgtcgtggtttatcctgtgtacctggccatcctgttcctgtttagaatgtcaaggtcaaaagtcgccggctctccatcccctactcccgccgggcaacaggtgcttgacatagactcatgcctcgactcaagcgtgctggatagctcattcctcacctttagcggtctgcatgcagaagcattcgtgggacagatgaaatctgatctttttttggatgattctaagtctctggtgtgttggcccagcggagaaggaaccctgagctggcccgatctgctatctgaccccagtattgtggggtctaacctgcggcaactggccaggggccaggctggtcatggcctgggccctgaggaggacgggttttcactcgcctcaccctattcgccggctaaatctttcagcgctagcgatgaggatttgattcagcaggtattggccgagggagtgtcatcccccgcacctacccaggatactcatatggaaacagacctgctcagctcacttagtagcaccccaggcgagaagaccgagaccctggcactgcagaggctaggtgaactcggcccccccagccccggcctgaattgggagcaacctcaagctgcccggctgagcagaaccggcctggtcgagggtctgcgcaaacggcttttgccggcctggtgcgcatccctggcccacggcctctccctgctcctggtcgccgtcgccgtggctgtgagtggctgggtgggggcctctttcccccccggggtgagcgtggcgtggctgctgtcatcctctgcctcctttcttgcgtcatttttgggttgggaaccactgaaggtgttacttgaggctctgtatttttcattagtggcaaaaaggctacatcctgacgaggatgataccctggtcgagagtcccgcagtgactccggtgagcgcccgtgtgcccagagtgaggcctcctcatggttttgctctgtttttagccaaagaggaagcccgcaaggtgaagcgcctccatggtatgttgcgatccctgctggtgtatatgctgttccttctcgttacattgctggcttcttacggggacgcttcttgtcacggccatgcgtatcgtttacaatctgcgatcaaacaagaactgcacagtagagcttttttggctatcacaaggtccgaggaactatggccttggatggcgcacgtcctgctcccgtatgtgcatggaaatcagagctctccagaattgggccctccaagattgcggcaggtgaggctccaggaagctctatatccggacccacccggccctagagtccacacgtgtagtgcagccggtggtttcagcaccagtgattatgatgttggatgggaatctccacacaacggttccggtacctgggcctactccgcccccgacctgctcggcgcatggagttggggcagctgcgccgtgtacgattccggtggatacgtgcaagaactcggactctccttagaagaaagccgcgataggctacgattcttgcaattgcacaattggctggacaaccggagccgagccgttttcctggaacttacgaggtattctcctgctgtcggcttgcacgcagctgtgaccctccgtctcgaatttccagccgctgggcgggccttggctgctctgtctgtgcgcccctttgcgctgaggaggctctccgccggcctcagcctgccattactgacttccgtctgtctgctcctgttcgccgtccacttcgccgtcgctgaggctcgcacctggcatcgcgagggaagatggcgcgtcctgaggttaggagcttgggctaggtggctgcttgtggccctgaccgctgccaccgcgttagtgcgccttgcccaacttggtgcagcagacagacaatggactcgcttcgttagaggccgtccacgacgctttacgagcttcgaccaggtagcccagctttcttcagcagcacgggggctcgccgccagcctgttgtttcttctgttggtcaaggcagcccagcagttacggttcgttaggcagtggagtgtttttggaaagacgctttgccgggccctgccagaactcttaggggtcacactcggcttggtggtactgggggtggcctacgctcaacttgccattctcctggtaagttcttgcgtggatagcctgtggtccgtcgcacaggctctgcttgttctgtgccctggcactggcctgtctaccctctgtcccgctgaaagctggcacctgagcccccttctctgtgtagggctttgggccctcaggctgtggggagctctaaggttgggggccgtaatcctgcgatggcgctatcacgcccttagaggcgagctctacaggcctgcctgggagccccaggactacgaaatggttgaactcttccttaggaggcttcgtctgtggatggggctctccaaagttaaagagttccgccataaagtgaggttcgagggcatggaacccttaccaagtagatcgtcacgtggatcaaaggttagtcccgatgtgccacctcccagcgccggctcagacgcaagccatccatctacttctagcagccagctcgatggcctgtcggtgtctctgggtaggcttggcaccaggtgcgagcccgagccctcccgcctgcaggcagtgtttgaggcccttctgacccagtttgaccggctcaatcaggctacagaagatgtatatcagcttgagcagcagctccacagtctgcagggccgacgctcaagtcgagcccccgctggctcctctcgaggacctagtcctggcttacgacctgcactcccaagtcgtctggccagagcgtctagaggagtggatctggccactggcccctcgcgcactcctctcagggcaaaaaacaaagtgcatccctctagtacttag

SEQ ID NO: 129197 - DNA, 8550 bp, Artificial Sequence
  Description of Artificial Sequence: Synthetic coding sequence
atggcagaggaggctgctcagaacataagtgacgatcaggaacggtgtctccaggctgcatgttgcctatcatttggaggcgaactcagcgtcagtacagataagtcttggggacttcacctatgttcttgtagtccaccaggaggtggattgtgggttgaggtgtacgccaaccacgtgctccttatgagtgacggaaagtgtggttgcccatggtgcgcgctgaatggcaaagctgaggatcgtgagtcgcagtctccctccagtagcgcgtctcgccaaaagaacatctggaaaacgaccagtgaggccgccttgtctgttgtgaacgaaaaaacccaggccgtggtgaacgaaaagacacaagctccgcttgactgtgataacagtgccgatcgcatcccacacaaacccttcatcattatagcccgcgcgtggagctctggcggccctcggtttcatcaccgacgcctgtgtgcaaccgggacagcggactcgactttctcagccttgttgcagctacagggaactacctccgccgccgccccatgctccttaaagatggaagcctcctgttgcgtgcttcgtctgctgtgttgcgcagaggatgtagccaccggcctccttccagggacagtaacaatggagactcctacgaaagtggctcgccctacccagacaagcagtcaacgggtgccactctggcccatctcccacttccccacatcaccgaggtcatcccatggactccctcctggcatacctcggaccccctcttttacggccagccagagcggctccgaaattctctaccctcccacacagcatcctccagtggcgattctggcacgtaacagtgataacttcatgaatcctgttcttaactgtagcctagaggtggaggccagggctccacctaaccttgggtttagagttcatatggctagtggggaagccttgtgcctgatgatggacttcggggatagtagcggagtggagatgaggttgcataatatgtcggaggccatggccgtgacggcttatcatcaatactctaaaggaatctttttccacctgttacattttcaattagacatgagcacctacaaggaggctgaaacacaaaacactaccctcaatgtctacctttgtcagtccgagaattcatgcctggaggactccgaccctagcaacctggggtatgaactgatctccgctttcgtcacgaagggcgtgtacatgttaaaagctgtgatttataacgagttccacggcaccgaggtcgaactcggaccttattatgtcgaaattgggcacgaggctgtgtctgctttcatgaattcatcctccgttcatgaagacgaggtgctggtgttcgctgacagccaagtcaatcagaagtccacagtagtgattcatcactttcccagcatccccagctataacgtgtcctttatctctcagacacaggtgggcgattcccaggcatggcacagcatgacagtgtggtacaaaatgcagagcgtgtccgtgtatactaacggtaccgtgttcgccaccgacactgacattacgttcacagctgtaactaaggagaccattccactggaatttgagtggtatttcggagaggatccaccagtccgcaccacctctcggtcgatcaagaaaagactttccattccccagtggtatcgcgtgatggtgaaagcttccaatcgcatgagctctgttgtgtcagaaccccacgtgatccgcgtgcagaagaagatagtggcgaatagactgacaagcccaagtagtgcgctagttaatgcttctgtggccttcgaatgctggattaatttcggcaccgacgttgcctatttatgggatttcggcgacgggacagtgtcactcggctcttctagctcatcccacgtgtactccagagagggagaattcactgtcgaggtgcttgcgtttaataatgtgtccgcctctaccctccgacagcagctgttcatagtctgcgaaccttgccagccgccgttggtgaagaatatgggccccggaaaggtgcagatctggcggagccagcccgtgaggttgggcgtgacctttgaagcggcagtcttttgtgatattagccagggtctctcatatacctggaatctgatggatagcgagggccttcctgtatccttaccagccgcagtggatacccatcgccagaccttgatacttccaagtcacaccctggaatacggcaactacactgcattagctaaagtacagattgaagggagcgtggtgtatagcaattactgtgttggcctggaagtccgggcgcaggctccggtgagtgttatctcagagggaacgcatctcttcttttccaggaccacaagcagccctattgtcttgaggggaacacaatcgttcgatccggacgaccccggagccacactccgctaccattgggaatgcgctacagcgggttcaccggcccacccgtgctttgattcaagcacagcgcaccaactggatgctgccgcccccacggtgtcctttgaagcccagtggttgagcgactcttatgaccagttcctggtaatgctgcgggtgtcctccgggggaaggaattcatccgaaaccagggtgtttttgtcaccgtaccccgactctgcattccgctttgtgcacatttcctgggtttccttcaaagatactttcgtcaactggaacgacgagctaagtctacaggctatgtgtgaggactgctctgaaattcctaatctaagctacagctgggacctgtttctcgttaatgctaccgagaagaacagaatcgaggtgcccttctgccgcgtggtgggactcctgggctctctcggcttgggcgcgatctcggagagctctcaattgaaccttcttcccactgagcccggcaccgccgaccccgacgctaccactactcccttttctcgggagccttcgcctgtcactcttgggcagcccgctacctccgcccctagaggtaccccgactgagccaatgaccggcgtgtattggattccccctgcaggggattccgccgtactgggcgaggcaccagaggagggatcacttgatctggagcccggacctcagtcaaagggtagcctgatgacagggaggtcggaacgcagtcagccaactcactcccccgacccacatctgtctgatttcgaggcttactactccgacatccaagaagcgattccatcaggcggcagacagccagccaaggacactagctttcctggatctggtccgtctttatccgccgaggagtcgcctggcgacggggacaacctagtagaccctagcttgtctgctggaagggctgaacccgtgcttatgatcgactggcccaaggccctgctaggacgcgctgtgttccagggatatagcagctccggcatcactgaacagacggtcaccattaagccttactcactctccagcggggagacatatgtactgcaggtcagcgtggcgtctaagcacggtcttctgggtaaagctcagctttatctgaccgtgaacccagccccccgagatatggcatgtcaggtgcagccccaccatggtctggaggcccacaccgtgtttagcgtcttttgtatgtctggtaagcctgatttccattacgagttcagctatcagattggaaatacatctaaacataccctgtaccatggtcgggatacccaatattatttcgtactgcctgctggggagcatttggacaattacaaagtaatggtgtctactgagattaccgatggcaaggggtcaaaggttcagccctgtacagtagtggtgactgttctgcctcgatatcacgggaatgattgtctcggggaagatctgtacaactcatctctaaagaacctctcgactttgcagctcatggggagctacactgaaataagaaattatatcaccgtgatcaccaggattttaagtagattgtccaaggaagacaaaactgcttcatgtaatcagtggtctcggatccaggacgctcttataagtagcgtctgtcgccttgcgttcgtggatcaagaagaaatgatcggcagcgtgctcatgctgcgcgaccttgtgagcttttcaaacaagctggggtttatgtctgcagtgcttatactgaagtacacaagggctctgctcgcacaggggcagtttagtggcccattcgtgattgataagggtgtccgcttagagctgatcggacttatctctagagtgtgggaggtatcagagcaggagaattcaaaggaggaggtttacagacacgaagagggtataaccgttatttctgacttactcttgggctgtctgtctctgaaccatgtctcaacgggacagatggaattcaggactctgcttcattataacttgcagagcagtgttcagagtctgggttcagttcaggttcacttgccgggcgacctggctggtcacagcccagccggagcggaaactcagtctccatgctacatctcgcagcttattctatttaagaaaaacccgtatccaggatctcaagctccagggcaaatcggtggcgtagtcggtcttaacctgtacacttgctcctcacgacgccctatcaataggcagtggctgaggaaaccggttatggttgaatttggcgaggaagatggtttggacaaccgccgcaacaagacaacctttgtgctcctcagagacaaagtgaatctccaccagttcaccgaactgtctgaaaacccgcaggagagtctccagatcgaaatcgagtttagcaagccggtcacgcgcgcgttcccagtgatgctgctggtgcggtttagcgagaagccgactcccagcgatttcctggtgaaacagatatacttctgggatgagagcatcgtgcagatctatattcccgcggcctcccaaaaggacgcatcagtcggctatctttcactgctggatgccgactacgatagaaagcctcctaaccgctacttggcaaaagccgtgaactacactgttcactttcagtggatcagatgcctgttttgggacaagcgggaatggaagtctgagagattctccccacagccggggaccagtcctgaaaaagtcaactgttcgtaccacagacttgccgcgtttgcactgttgcggcggaaattgaaagctagtttcgaggtctctgacatctccaaactgcagagccacccagagaatctgttgccttctatattcattatggggtccgtcattctttacggattcctggtcgcaaagtccagacaggtggaccatcacgaaaaaaaaaaggctgggtatatcttccttcaagaggccagcttgccaggacatcagctctatgctgtggttattgacactggattccgcgcccctgctaggctgacgtccaaggtgtatatcgtcctgtgcggtgataatggactgtccgaaactaaagaattgagttgtcccgagaaacccctgtttgagcgtaactcacgccacaccttcatcctctctgcccctgcccagctcggacttctacggaagattcggctgtggcatgacagcaggggtcctagcccaggctggtttatttctcatgtgatggtcaaagaactccataccggacaggggtggtttttcccggcccaatgctggctgtctgccggacgacatgatggacgagtcgaacgagagctgacatgcctgcagggaggactcggctttcgcaaactgttttactgtaagttcacagagtatctcgaggattttcatgtctggctctcagtatacagcaggccatcatcgagccgatacctgcacacccctagactcactgtcagcttttctctgctgtgcgtctatgcatgcttgacggctcttgtggctgccggtggccaggagcagcctcatttagacgtgagccccacccttggcagttttcgggtcgggcttctctgtaccctactcgcatcgcctggggcacagctgctaagcctgttgttccgacttagcaaggaggcccctggctctgcccgggtggagccgcactcccccctgcgcggcggcgcgcagacagaagcacctcatggtcctaactcttggggacggattcctgatgcacaggagccccgtaaacagcctgcgagcgctatcctgagcggatccggacgagcccagagaaaagccgcttcagataacgggaccgcctgtcctgcaccaaagctgcaggtgcacggagccgatcactccagaacctccctgatgggtaagtctcattgctgcccaccccacacacaggcaccatcatcaggactcgaaggacttatgccccaatggtcacgagctcttcaaccttggtggtcatccgccgtatgggcaatatgcggcaccgccagcctagcttgctctctgggcacgggctttcttgcctatagatttggtcaggagcagtgtgtccagtggcttcacttactcagcctctccgtcgtgtgctgtatcttcatcactcagccgcttatggtatgtctaatggccctgggcttcgcttggaagcggagagctgataaccattttttcacagagagtctttgcgaggcaacccgggacctggactctgaactggccgaaagatcatggaccagactgccattttctagcagttgctctattcccgattgcgccggagaagtggagaaggtgctggctgcacgacaacaggccagacatcttcgatgggctcacccaccctccaaggcccaactgagggggactagacagcgcatgaggcgtgaatcccggacacgggcagccctgcgcgacatttccatggatattctcatgctcctcctgttgctctgtgtaatttatggtcggttctcccaggacgagtatagccttaaccaggccattaggaaagaattcactcggaacgctcgaaactgcctcggaggccttagaaacatagctgattggtgggactggtctctgacaacgttacttgatggcctgtacccaggggggacaccatcagcccgcgttcccggagcacaaccaggggcattaggaggcaagtgttatctgattggttcaagtgtgatcaggcagctgaaagtgttccctaggcacctatgtaagcccccgaggccatttagtgctctgatagaggacagtatcccgacctgctcaccagaggtcggagggcccgagaacccatatctgatcgatcccgagaatcagaatgtgacattaaacgggccaggggggtgcggaacccgcgaagactgcgtcctttctcttgggagaactagaacagaagctcataccgctttgagtcgactgagagcatccatgtggatcgatcgaagcacacgcgctgtgagcgtgcactttaccttatacaatccccccacccaactgttcacctcagtgagtctgcgggtggagatcttgccgacgggttcactggtcccgagttccctcgtagagtcattcagcatcttcagatcggactcagcattgcagtaccatctcatgctgccccaactcgtgttcctagctctgagtctgatacatctatgcgtacagttatatcgcatgatggataaaggtgttctctcctattggcggaaaccacgtaactggctggaactatctgtcgtgggcgtgtcactgacctattacgccgtgagcggtcatctcgtgaccctggcaggagacgtgactaatcagttccataggggcctttgccgggcttttatggatctaactttgatggcttcatggaaccagagagccagatggctccgcggaatcctgctgtttctgtttaccctgaaatgtgtgtatctcccaggaatccaaaataccatggcatcatgcagctccatgatgagacactccctccctagcatattcgtggctggcctagtgggcgcgttgatgctggccgccctctcgcacctgcacaggttcctgctgtccatgtgggtgctaccaccgggaaccttcacagacgcctttccaggtctgctgttccattttccacggagaagtcagaaggattgtttactgggtctgtcaaagtcggaccagagggcaatggcgtgttacttcggcattttactaatcgtgtcggccactttatgctttgggatgctccgaggtttcttaatgacattgccacaaaaaagaaaaagctttcagtccaaaagtttcgttaggcttaaagacgtgactgcatacatgtgggaaaaggtcttaactttcttaaggctggagacccctaaattggaagaagcggagatggtggagaatcacaactactacctagacgagtttgcaaatttgctggatgagctattgatgaagatcaatgggctctcagattctcttcagttgcctctgctcgaaaaaacaagcaataacacaggtgaggcccgaactgaagagtctcccctggtagacatttcatcataccaggctgctgaacccgccgatatcaaggatttctag

SEQ ID NO: 129198 - DNA, 495 bp, Artificial Sequence
  Description of Artificial Sequence: Synthetic coding sequence
taggtcggcggacccgagaatccttatctcattgaccctgagaatcagaatgtaacattgaacggcccaggggggtgcggcacccgggaagactgcgtcctgtctcttggccgcaccaggaccgaggcacacaccgccctgtctcgtctgcgcgcctccatgtggatcgaccgtagcactcgggctgtctctgtccattttaccttatacaacccgccgacacagctctttacaagcgtatccctgcgggtcgaaattcttcctaccggatctttagtgccgtcgtctctcgtggaatctttctctatattcagaagcgatagcgctctgcagtaccatcttatgttgccccagcttgtgtttctagccttgagtctcatccatttatgcgtgcagttatatcgtatgatggacaaaggcgtattgtcatactggcgaaaacctcggaattggttggaggtggcgtccctggtttccttttcctttgagaaatag

SEQ ID NO: 129199 - DNA, 2907 bp, Artificial Sequence
  Description of Artificial Sequence: Synthetic coding sequence
atggtgaacagttctcgggtccaaccacagcagcctggcgatgcgaaacggcctcctgctcccagagctcccgatccaggaaggctgatggctgggtgcgccgctgtcggcgcatcactggctgcgcccgggggactctgcgaacaaagaggactggagattgaaatgcagcgcatccgccaggcagctgcccgagacccccccgctggcgcagcagccagtccttccccccccctctcaagctgtagtcgacaggcctggtccagggacaacccaggctttgaagctgaggaggaggaagaagaggttgaaggtgaagagggcgggatggttgtagaaatggatgtggaatggaggccaggttcgaggcggtccgcagcgagcagcgctgtgtctagcgtgggagcaagaagccgcggtttggggggataccatggggcgggacacccctctgggaggcgaaggaggagagaggatcagggccctccttgccctagtccagtgggcggtggcgatcctctgcatagacacttgcccctggagggccagcctccccgcgtcgcctgggctgaaagactggttcgcggcctcagggggttgtggggaacgaggctgatggaagaatcaagcactaacagggagaaataccttaaatctgtgctgagggaactcgtgacatacctactcttcctgatcgtcctgtgcattttaacttacgggatgatgtcatctaatgtttactactacacccggatgatgagccaactgttcctcgatacccctgtgtccaagacggagaagacaaacttcaaaaccctgtcttccatggaggacttctggaagtttacggagggttctttattagatggcctttactggaaaatgcaaccgagcaatcagacagaagccgacaatcggagctttattttctatgagaatcttttgttaggtgttcccaggattcgacagttacgcgtgcggaatggctcgtgcagcattcctcaagatctgagggatgaaatcaaagagtgttatgacgtctattcagtgtcttcagaggaccgagcaccgttcggaccgaggaatggcacagcttggatatacacgtcggagaaggatctcaacggatcgtcacattgggggattatcgcaacttattccggggctggttattatctggacctgtccaggaccagggaagagacagctgcccaggttgcatcgctgaagaagaacgtatggttagaccgcggcaccagggcgacattcatcgacttctctgtgtataatgccaacatcaacctgttctgtgtcgtgaggctgcttgtggagttccccgccacaggtggagttattccgagctggcagttccagcccctgaagctgattcgttatgtaaccacatttgacttcttcctcgccgcttgcgagatcattttttgtttctttattttttactatgtcgtggaagaaatccttgagatccgcatccacaagttgcactacttccggtccttttggaactgcttggacgtggtaattgtggtgctgtctgtggtcgctattggcataaatatctacagaacgagtaatgtggaggtgctgctacagttcctggaggaccagaatacttttccaaatttcgaacatctggcctattggcaaatacaattcaataatattgccgccgtgacagtattttttgtgtggatcaaactgttcaaattcattaatttcaaccgtactatgtctcagctgagtactacaatgagtaggtgtgcgaaggacttgtttggctttgccattatgtttttcataatcttcctggcctacgcccagctcgcatatctggtctttggcacccaggtggatgatttctccacattccaggagtgtatcttcactcaattccggattatattgggcgacataaacttcgctgaaatcgaagaggctaaccgggttttaggccctatctacttcacgacctttgtcttctttatgttttttattttgctgaatatgttcctggctattataaacgacacatactcagaggtgaaatcagacctggcacagcaaaaggcagaaatggaactgtctgacctgatccgtaaagggtaccacaaggctctcgtgaagctaaaactgaaaaagaacactgttgacgatatcagcgaatcactgcggcaaggaggggggaagctgaactttgacgagctgagacaggacttaaaaggaaagggccacaccgatgctgagatagaggccatcttcactaaatacgatcaagacggagaccaggagctcacagagcatgagcaccagcagatgcgagacgacctcgagaaggaacgagaggatctcgatttggaccacagctccctgcccaggcccatgtctagccgctcctttccaaggagtcttgatgatagtgaagaagatgatgatgaagactccggccatagttccaggcgccgcggaagcataagcagcggagtgagttatgaggaatttcaagtgctggtccgcagggtggatcgtatggaacattctatcgggagcatcgtgtcaaaaatagacgccgtaatcgtaaagctggaaatcatggaaagggcgaaattgaagaggcgtgaggtgctgggccgcttgctggatggtgtggccgaagacgagaggctcggccgcgactctgaaatccatcgggagcaaatggagcgactggtgcgggaagagttagaacgctgggaatcggatgacgctgcgtctcagatatcccatggacttgggacgcccgttggcctgaacggccagccacggccgcgctcctcgagaccttcttcatcgcaaagtacagaggggatggaaggagccgggggtaacggctccagcaacgtacacgtatag

SEQ ID NO: 129200 - DNA, 1161 bp, Artificial Sequence
  Description of Artificial Sequence: Synthetic coding sequence
atgagtcagctctctaccacgatgtcccgctgtgccaaagatctgtttggtttcgctattatgttcttcattatctttctcgcctatgcacagctcgcatatctcgtgttcggcactcaggtggatgatttttccactttccaggaatgcatcttcacgcagtttagaataatactcggcgatataaactttgccgagatagaggaagctaatcgggtcctgggcccgatctacttcacaacttttgtgttttttatgtttttcatcttactgaatatgtttctcgccatcattaatgacacttattccgaggtgaaaagcgacctggctcagcagaaagccgaaatggagctcagcgaccttattaggaagggctatcacaaagctctggtcaagctgaaactgaagaagaacacagttgacgacatttccgaaagcctgcgtcagggtggagggaaactgaattttgacgaattgcgtcaggacctcaaaggtaagggtcacaccgatgccgaaatcgaagccatattcaccaagtacgaccaggacggtgaccaagaactcaccgaacacgaacatcagcagatgcgggacgatctcgagaaggagcgtgaggaccttgatcttgaccacagttcgctgccgagacccatgtcatcccgatccttcccacggtccctggacgactctgaggaagacgatgacgaagactccgggcacagctcaaggaggagaggatccataagtagcggggtgtcatatgaggagtttcaagtgctcgttcgtcgtgtggaccgcatggagcacagtataggttctatagtgagtaaaattgacgccgtcatagtaaagctagaaatcatggaaagagcaaagctcaaacgacgagaggttctgggccgacttttagatggtgtggctgaggacgagcgcctaggtcgggatagcgagatccaccgcgaacagatggagcgactcgtgagggaagagcttgagagatgggagagtgatgatgcagcatcccagatatcccatggtctgggcaccccggtggggcttaatgggcaaccaaggcctcgaagttccagaccttcgagttctcaatccaccgagggcatggagggcgccggagggaatgggtcctcaaatgtacacgtctag

SEQ ID NO: 129201 - DNA, 1161 bp, Artificial Sequence
  Description of Artificial Sequence: Synthetic coding sequence
atgtctcagctgtcaactaccatgtctagatgtgccaaggacctgtttggctttgcaatcatgtttttcatcattttcttagcctacgcacagttggcttatttggtgttcggaactcaggtggatgattttagcactttccaagagtgtattttcacacagtttcggattattctgggggacatcaatttcgccgaaatagaagaggcaaatagggtgcttggtcctatttacttcacaacctttgtattttttatgttctttatacttctgaacatgttcctcgccatcatcaatgacacatattccgaggtgaaaagcgacctggcgcagcagaaggcggagatggagttatctgacttgatacggaagggttaccacaaggccctcgtgaaactgaaattgaagaaaaacaccgtcgacgatatctctgagtcactaagacagggtggagggaagctgaatttcgacgaattaagacaagacctaaagggtaagggacataccgatgcagagatagaggcaatcttcaccaagtatgatcaagacggcgatcaggagctgactgaacatgagcatcagcagatgcgggacgatctcgaaaaagagcgcgaggatctcgaccttgaccactcctcattgcctcgccctatgagctcgcgctccttcccccggagtctcgacgactctgaagaagatgatgacgaagactcgggccactcttctcgtcgtagagggtcaataagcagtggcgtttcctatgaggagtttcaggtcttggtccgccgtgtggaccgaatggaacatagcattgggagcattgtgtccaaaatcgacgccgtgatagtcaagctggagattatggagcgggccaagctgaaacgacgagaggtactaggcaggctactcgacggggtggcagaggatgagcgcctcggcagagattccgaaatacaccgcgagcagatggaacgtttggtgcgcgaggaactcgagaggtgggaaagtgatgacgccgcctctcagattagccacgggcttggcaccccggtggggctgaatggacaaccgagaccgaggagcagccgcccatcgagttcacaaagcaccgagggcatggagggcgctggcgggaatggatcatcgaacgtgcacgtgtag

SEQ ID NO: 129202 - DNA, 2418 bp, Artificial Sequence
  Description of Artificial Sequence: Synthetic coding sequence
atgaatgctgttggaagtccagagggtcaggagctccagaaactgggcagcggcgcatgggataacccggcatactcaggacctccttcaccacatggtaccctgcgcgtgtgtactatctctagtaccgggcccctccagccacagcctaagaagccagaagacgaacctcaggagactgcgtacagaacgcaggtgtccagttgctgccttcacatttgccaaggaattcgtgggttgtgggggaccacattgactgagaacacagcagagaacagagagctgtacatcaaaaccaccctgcgtgaactactggtttacatcgtatttttagtcgatatttgtctgctaacctacggtatgactagttcctccgcttactactacacgaaggttatgtctgagctttttctacatacacccagcgacacaggtgtctcattccaggccattagctcaatggctgacttttgggatttcgcacagggtccccttctcgactccctgtattggacgaagtggtacaataaccagtcattgggacatggctcccatagcttcatctattacgaaaatatgctgctaggcgtgccccgcctgcgtcagctgaaggtccggaacgactcctgcgttgtgcatgaggatttccgggaagatatcctctcctgttatgacgtatactctcccgataaagaggagcaactcccctttggacccttcaatggtacagcttggacttaccactcgcaggacgaactgggtgggttttcacactgggggcgactaacctcctactcaggaggcgggtattaccttgatctgccaggaagccgtcaaggttcagctgaagccttgcgagcactccaggaaggtttatggctagatagaggaacaagagtagtcttcatcgacttctcggtctacaatgctaatatcaatttgttttgtgtattaaggctggtcgttgagttcccagcaacaggcggtgctatcccctcctggcagattagaaccgtgaagttaatccgttacgtatccaactgggacttctttattgtcggctgtgaggtcatcttctgtgtgtttatcttttattacgttgtggaggagatcctcgaactccatatccacagacttcgctatttgagcagtatatggaacattcttgacttggttgtgatccttctgtccatcgttgccgttggctttcacatcttccgcactctcgaggtgaacaggctgatgggcaagctgctccagcaacccaatacctatgccgactttgaattcttggccttttggcagacccaatataacaacatgaatgctgttaatctgtttttcgcctggattaagatctttaagtatatttcctttaataagactatgacccagctctcttccactctggccaggtgtgccaaagacatactcggattcgccgttatgttttttatcgtcttcttcgcatatgcccagttaggctatcttctgttcggcacacaggtagaaaatttttcaaccttcataaagtgcatatttacccagtttcggattatcctgggagattttgattacaatgcaattgataatgctaatcgaatccttgggccggcttacttcgtgacctacgtgttttttgtgttctttgtgttgctgaacatgtttctagccatcatcaatgacacctactccgaggtgaaagaggaactggccggacaaaaggacgagcttcaactctccgacctgctgaagcaggggtacaataagacccttcttagactgagactgcggaaggaacgcgtgtctgacgtgcagaaagttctacagggcggtgaacaggaaatacaattcgaggattttacaaatacactcagggagttaggacacgctgaacatgaaatcaccgagctgaccgcaacatttactaagtttgacagagacgggaacaggattctggatgaaaaggagcaggagaaaatgcggcaagatctcgaagaggaaagggtagcactgaataccgaaatcgagaagctgggtcggagtatcgttagctccccacaggggaaatcgggcccagaagccgccagagccggaggctgggttagcggcgaggaattctacatgctgactcgccgagtgctccaactcgagacagtcctcgaaggcgtggtatctcagatcgatgccgtgggcagtaagttaaaaatgttggagagaaaaggctggctcgcaccttccccgggagtcaaagaacaggcaatctggaagcatcctcagcccgcccccgcagtcactccggatccatggggcgtacaggggggtcaggagtcagaagtgccatacaagagggaagaagaggctttggaagaacgcagactcagtcggggcgagatccccacactacagcgctcctag

SEQ ID NO: 129203 - DNA, 2193 bp, Artificial Sequence
  Description of Artificial Sequence: Synthetic coding sequence
atgaatgctgtgggatcccctgaaggacaagaattacaaaagctcgggagcggagcttgggataatccggcctattctgggccaccatctccacacgggactcttagagtgtgcaccatcagttcaaccggtcctttgcagccccagccaaaaaagcccgaagacgaaccacaggagaccgcatataggacgcaggttagttcctgctgcctgcacatttgccagggcattaggggcctctgggggactaccttgactgaaaacacggcggagaatcgagagctctacatcaaaaccacgcttcgagagcttttggtttacatcgtgtttctcgttgatatctgtttgttgacctatggcatgacttccagtagcgcctactactatactaaggttatgagcgagttgttcttgcacacacccagtgacaccggagtctcattccaggccatcagtagtatggcggacttttgggactttgcccagggtccgctgttggactcactgtattggacaaagtggtacaacaatcaatccctgggccacgggagccatagtttcatttattatgaaaacatgttacttggagtgccccgcctgcgccagctcaaagtgcgcaatgatagttgcgtagtacatgaggattttcgagaagatatcctgagctgttatgatgtgtactcacctgataaggaggagcagctgcctttcggcccattcaacgggactgcgttagtcgtcgagtttcccgcgaccggcggcgctattcccagctggcagatccggactgtgaagctcatccggtatgtgtctaattgggacttttttatcgtgggatgcgaagttatcttctgcgtgttcatcttttattacgtcgtggaggagattctggaactgcacattcacagattaaggtatttatcctcgatctggaacattctggatctggtagtgatcctactatcaatcgttgctgtgggtttccacattttcagaacgctggaggtaaacaggctgatggggaagctgctccagcagcccaacacatacgccgactttgaattcctggctttctggcagacccagtacaacaacatgaacgccgtcaacctctttttcgcatggattaaaattttcaagtacattagttttaacaagacaatgacccagctttcctcaacattggccagatgcgcaaaagatatccttggctttgcggtgatgttcttcatcgtattctttgcatacgctcagcttgggtatctactgtttggaacccaagtagaaaatttttccacattcattaaatgtatctttacccagttcaggatcattctgggggactttgattacaacgcaatcgataatgcgaatcgtattctgggcccggcctactttgtgacatatgtgtttttcgtgttttttgtgctgttgaacatgttcctggccataattaacgatacatactcagaagtcaaggaagaactggccgggcagaaagacgagctacagctctccgacctcctcaagcagggctacaacaaaaccctcctgcgccttcggctaaggaaagagagggtctctgatgtacaaaaggtgctacagggcggtgaacaggaaattcagttcgaagatttcaccaacactctgcgggagttaggccacgcagagcacgagatcacagaactgacagcaaccttcacgaaattcgaccgcgacggaaacagaatcctggacgaaaaagaacaggaaaagatgaggcaagatctagaggaagaacgcgtagctttgaatacggagatagaaaagctcggaagaagcattgtttcgtctccccaagggaaatcaggccctgaggccgcgagggccggtgggtgggtttccggcgaggagttttacatgctgacacgacgggtgctgcagttagagaccgtactcgagggagtcgtgagtcaaattgatgccgttggtagtaaactaaagatgttagagcgaaaaggttggctagcacctagcccaggcgtgaaggagcaggctatatggaagcacccccaacccgcccctgccgtcactcctgacccttggggcgttcagggcggtcaagaatccgaggtgccttataaaagggaggaggaggctctggaagagcggcggctttccagaggtgagattcctacactgcaaagatcatag

SEQ ID NO: 129204 - DNA, 2328 bp, Artificial Sequence
  Description of Artificial Sequence: Synthetic coding sequence
atgaatgcagtcggcagtcccgagggtcaagaactccaaaagctaggttctggagcatgggataatcctgcctactctggacctcctagtcctcacgggactcttagagtttgcacaatcagcagcaccggacccctgcagcctcagccgaaaaaacctgaggatgaaccacaggagactgcctacaggacacaggttagtagctgttgccttcatatatgtcaggggatacgcggtctctggggaacgactctgaccgaaaacactgccgagaaccgagagctgtacatcaagacgacacttcgcgaactcctggtctatatcgtctttctggtggacatctgcctgttgacatacgggatgacttctagttccgcatattattatactaaggttatgagcgaattatttcttcacacgccaagtgacacaggcgtgagctttcaggcaatatcgtcaatggcggacttctgggactttgctcagggtcctctcctcgattccctctattggacaaagtggtataataaccagtcactgggccacggctcccatagcttcatttattacgaaaacatgttattgggcgtgccacgactgcgtcaattaaaggtacggaacgattcatgtgtagtgcatgaggattttcgggaggacatcctcagctgctacgacgtctattcgcctgacaaagaggagcaactgccttttggccccttcaatgggactgcatggacctatcacagccaggatgagctgggcggcttctcacactgggggcgcttgacaagttattctggcggtggttactaccttgatctcccgggcagccggcagggctccgccgaggcactacgggcactgcaggaaggactgtggctcgatagagggactcgtgtggtattcatcgacttttctgtgtataatgccaatataaacctgttttgtgttctgcgtctggtcgttgagttcccggctcgcaggtgccaccctatcctggctaatccccatagccaggcagatccactgtgccaacaattattttttatcgttggttgtgaggttatattttgcgtctttatcttttattacgttgttgaagaaatcttagagcttcatatacataggcttcgctatttaagttcaatctggaatatccttgatctggtggtgatccttctttcaatagtggccgtcggatttcatatcttcaggacattagaagtcaatagactcatgggcaagcttctccagcaaccaaacacctatgccgactttgagttcctggcattttggcagacccagtacaataatatgaacgccgtgaatttgtttttcgcctggattaaaatcttcaagtacatcagcttcaacaaaaccatgacccaactgtcatcaacgctggcccggtgcgctaaagatatcctaggctttgccgttatgtttttcatcgttttcttcgcatatgcccaattaggttatctcttgttcggcacacaggtcgagaatttcagcacgtttatcaaatgcatcttcactcaatttaggatcatcctgggggatttcgactataacgcaattgacaacgcaaataggatcctgggccccgcgtattttgtcacttacgtcttctttgttttcttcgtgctgttgaacatgtttctggcgatcatcaatgacacatattccgaggtgaaagaggagctggctgggcagaaagatgagctgcaactgtcagatctactgaaacaggggtacaataagacactgctgaggctgagactcagaaaggagcgcgtgtccgacgtgcagaaagtgctgcaagggggtgaacaggagattcaattcgaggatttcacgaacacattgcgggagctgggccacgcagaacacgagattaccgagctcaccgctacctttacaaagttcgaccgcgatggcaacagaattctcgacgagaaggaacaagaaaagatgaggcaggacctagaggaagaacgggtagccctgaacacggaaatcgagaaacttggccgatccatagtgagcagtccccaagggaagagcggccccgaggcagcccgggcgggcggctgggtctccggagaagagttctatatgctgacccgccgggtgcttcagctggagacagtcctggagggtgtcgtttctcagatagacgcggtgggcagcaaacttaaaatgttagaacggaaaggatggctggcaccttctcctggcgtgaaggagcaggcaatttggaagcacccacaacctgcaccggcagtaacccccgatccctggggccctggctgggccggggagtag

SEQ ID NO: 129205 - DNA, 2283 bp, Artificial Sequence
  Description of Artificial Sequence: Synthetic coding sequence
atgaatgccgtgggatctcctgagggacaagagcttcagaaactaggctctggcgcctgggacaatcccgcttatagcgggccaccatctccgcacgggaccttgcgagtctgtaccatcagcagtacaggccccctgcaaccccagcctaagaagcctgaggatgagcctcaggagacagcttacagaacccaggtgtcttcctgctgcctccatatttgccaaggaattcgaggtctgtggggaactaccctgacagaaaacactgcagagaatagagagctgtatatcaagaccactctcagggaattgcttgtgtacattgtatttctggtcgatatctgcctgctgacgtacggcatgaccagttcatccgcatactattacactaaggtgatgtcagagttgtttctccacacacccagcgacactggagtgtcgttccaagcaattagcagcatggcagatttctgggattttgcccaggggcctctgctcgattcactctattggacaaagtggtacaacaatcagtctcttggccatggatcgcactcatttatttactacgaaaatatgctcttgggggtcccgcgcttgagacagttaaaagtgcgaaatgatagctgcgtcgtccacgaggacttccgggaggatatcctttcttgttacgatgtttatagcccagacaaagaagagcagttgccctttggcccgttcaatggtactgcctggacataccacagccaggatgaactgggaggtttcagtcactggggcagattgacctcttacagtggcggagggtactacctggatctgccaggatccaggcaggggagtgcggaggctcttagggctctacaggagggcctgtggctggataggggcacccgggtggtgtttattgatttcagtgtctataacgccaatatcaacctgttttgtgtgctgcgcctggtcgtggagtttcccgcaaccggcggcgcaattccttcttggcagatccgtacagtcaagcttatccgctatgtatcaaactgggattttttcattgtaggctgcgaagttatcttctgcgtgtttattttctattatgttgttgaggagatcttggagctccacattcacaggctgaggtacttatccagtatctggaatattctggatttggtggtgattttgctgtccatagtcgcagtgggattccatattttcagaacacttgaggtgaaccggctgatggggaaactgctgcaacagcccaacacatacgccgacttcgagttcttggccttctggcagactcagtacaacaacatgaatgccgttaacctttttttcgcctggatcaagatctttaagtacatctcattcaataagactatgacccagctgtcctccactctggctcgatgtgcaaaggatattctcgggttcgctgttatgtttttcatcgtcttctttgcttatgcccagctcggctacctgcttttcggcacgcaggtcgagaacttcagtacatttatcaaatgcatctttacccagttcaggattatcctcggggattttgactacaatgccatcgataacgcaaacagaatcctgggcccagcatatttcgtcacttacgttttctttgtttttttcgtcctgttgaatatgtttcttgccataatcaacgacacatattcagaagtgaaagaggagctggcagggcagaaagatgaactgcagctttctgaccttttaaaacagggctacaataaaaccctcctaagactccggttaaggaaagaaagggtgagtgatgtacagaaggtgctccagggcggagaacaagagatacagttcgaggacttcacaaatactttaagagaactcggacacgccgagcacgagattaccgagcttacagccaccttcacaaagtttgacagggatggaaatagaatcttggatgaaaaggagcaagaaaagatgaggcaggacttagaagaagagcgcgtcgccctgaacacagagatcgagaaactcgggaggtccattgtgtcttctccccagggcaagtctgggcccgaagccgcgcgtgccggcggctgggtgagcggtgaagagttctacatgttgactcggcgagtgcttcagctagagaccgtacttgagggtgtggtcagccaaatcgatgccgtgggcagcaaactgaagatgctcgagcgcaagggctggctcgccccttcgcctggagtgaggtttccaatcaaagagaagcgaaagccgtag

SEQ ID NO: 129206 - DNA, 1842 bp, Artificial Sequence
  Description of Artificial Sequence: Synthetic coding sequence
atggctgaggcaagtcgctggcatagagggggcgcctcaaagcacaaattgcattacaggaaggaggtggagatcaccactacacttcaggaactcctgctgtacttcattttcttaatcaatctgtgtatcctcacattcggaatggtgaatccccacatgtattatctgaacaaggtgatgagcagtctgttcctggacactagtgtgcctggtgaagagcggacaaatttcaagtcaattcgcagcataaccgatttctggaagtttatggaggggccgctgttggagggactctactgggattcatggtacaataaccagcagttgtataatctgaagaactcaagccgcatctactatgaaaacatcttgctcggagtgccgcgagtgcgccagttgaaagtccgcaataacacctgtaaggtttatagctcctttcagtccctcatgagcgagtgctacggaaaatatacatccgcgaatgaagacctctcgaacttcggcctacaaattaatacagagtggaggtacagtacgtccaatacaaactcgccatggcactggggttttctgggtgtctacagaaatggaggatacatttttacactctcaaagtctaaatctgaaacaaaaaataaatttatagatcttcggcttaactcctggattacccggggcacccgtgtgatcttcatagactttagcctgtataatgctaatgttaatctcttttgtatcatccgcctcgtggcagagtttcctgctaccggaggaatcctgactagctggcagttttactcagtgaagctcctcaggtatgtgtcatattacgactattttatcgcctcctgtgaaattacattttgcattttcctgttcgttttcacaacccaagaagtgaaaaaaataaaggagttcaaaagcgcctacttcaaatccatatggaactggcttgagctcctgttactgctcctttgtttcgtggcagtttcattcaacacctactacaatgtgcaaatattcttgcttcttgggcagcttcttaagtctaccgaaaaatacagtgatttttattttcttgcctgctggcatatatactataataatataatagccatcactattttctttgcatggattaaaatatttaaattcatatctttcaataaaactatgtctcagctatcgagcacactctcgcggtgcgtcaaggatatcgtcgggttcgccattatgttctttattatcttctttgcatacgcgcagttgggcttcctggtgttcggcagccaggtcgacgacttttcaacctttcaaaattcgatcttcgcacaatttcggatcgtcctcggagactttaactttgccgggatccagcaggccaaccctatcctcggcccaatttactttataacattcatcttctttgtgttcttcgtactactgaacatgttcctggctattattaatgacacttactccgaagttaaggccgattacagcattggaaggaggctcgacttcgaactaggcaaaatgatcaagcagtcgtacaagaacgtgttggaaaagttccggctgaaaaaagcccaaaaagatgaagataagaagacaaagggctccggcgatcttgccgagcaagcacgaagagagggatttgatgagaatgagatccagaacgcagagcagatgaaaaagtggaaggagcgcttggaaaagaagtattattcgatggaaattcaagacgactaccagccagtcacacaggaggagtttagggatgggaccactaccaaatataagatgagattctcagagtgcttaacaaagcggatttag

SEQ ID NO: 129207 - DNA, 1773 bp, Artificial Sequence
  Description of Artificial Sequence: Synthetic coding sequence
atggcagaggcaagccgttggcaccgtggggtgactttcgggatggtaaacccccatatgtattatttgaataaagtgatgtcaagcctgtttctggataccagcgtaccgggtgaggagagaactaacttcaagtccatacgatcaataacagacttttggaagtttatggaaggacctctcctggaaggcttgtactgggactcgtggtacaataatcaacagctctacaatttgaaaaattcatctcgcatctactatgagaacatccttctcggggtaccacgcgtccggcagctcaaagtgaggaacaatacttgcaaggtgtacagttccttccaaagcctgatgagtgagtgttatggcaagtatacatccgcaaatgaggatctgtcgaatttcggtctccagatcaacacagaatggcggtattctacgagtaataccaactccccttggcactggggcttcttaggcgtgtatcgaaatggaggttatatttttactctgagcaagtccaagtctgaaactaagaacaaattcatcgatctgagactcaattcctggattacacgcggcacccgcgtaatattcatagacttctcgttgtataacgccaatgtcaatttgttctgcatcatcaggctggttgccgaattcccagctaccggcggaattcttaccagctggcagttctatagcgtaaaactcctacgatatgtgtcctactatgattactttatagcatcttgcgaaatcaccttctgtatctttctgtttgtgtttacaacacaggaggtgaagaagattaaggagttcaagtccgcctattttaagtccatctggaattggctcgaactcttactgttgctactttgctttgtagcagtctcgttcaacacgtactataacgtccagatttttctattgctgggacaactgctgaagtctactgagaagtatagcgatttttacttcttagcatgttggcacatctactataataatatcatcgccatcactatcttcttcgcttggatcaagatatttaaatttatttcattcaacaaaactatgtctcagttgtctagcacactgtcgcgctgcgtcaaagacatagtgggcttcgctattatgttctttatcattttcttcgcctacgcccagttgggatttctggtgttcggaagccaggttgatgatttctcgacatttcaaaatagtatcttcgctcaattcagaatcgtgcttggggatttcaattttgccgggattcagcaggctaacccaatcttgggccccatttattttatcaccttcatcttcttcgtgtttttcgtcctactcaatatgttcttggccatcatcaatgatacctactccgaggtgaaagcagattatagcattggacggagactcgatttcgaactgggcaagatgataaaacaatcttacaagaacgtactggagaaattcaggctgaaaaaggcccagaaagacgaggacaaaaaaactaaagggagcggggaccttgcagaacaggcgagacgcgaagggtttgacgagaacgagatccagaatgctgagcaaatgaagaagtggaaagagcggctggaaaaaaaatattattccatggaaatccaggatgactaccagcccgtgacccaggaggaatttcgagagctcttcttatatgcagtagaactggaaaaggagctccattatatcaacctgaagctgaaccaggttgtgagaaaggtgagcgcactctag

SEQ ID NO: 129208 - DNA, 1875 bp, Artificial Sequence
  Description of Artificial Sequence: Synthetic coding sequence
atggctgaggcaagtagatggcatcggggtggtgctagtaagcataaactccactataggaaagaggtcgaaatcactaccacactccaggagttactgctgtacttcattttccttatcaacttatgtattttaacttttgggatggttaatcctcatatgtactacttgaacaaggtcatgagcagtctgtttctggataccagtgttcctggggaggagcgcactaatttcaaatcgattcgaagtatcaccgacttttggaaatttatggaaggcccactgctcgagggactttattgggactcctggtacaacaaccagcagttgtacaatctgaaaaattccagtaggatctattatgagaacatcctgctaggagttccgcgcgtgaggcaactgaaggttagaaacaatacctgtaaggtgtacagctcttttcaaagcctcatgtcagagtgctatgggaagtacacaagcgccaacgaagatctgtcaaacttcggcctccagatcaacaccgagtggagatactcgacaagcaacaccaacagcccttggcactggggctttctgggggtgtatagaaatggcggttatattttcacattgagtaaatctaagtcagagacaaagaacaaattcatcgacctccggctgaatagctggattaccagggggacccgcgtcattttcatcgacttctccctatacaacgccaatgttaacctgttctgcataataagactggtcgccgaatttccggccacgggcggtatattaacctcttggcagttctacagtgtgaaactgctgaggtatgtgtcttactacgactacttcattgcctcctgtgaaatcaccttttgcatttttctgtttgtgttcaccacccaggaagttaaaaagatcaaagagttcaagtccgcctatttcaagagcatttggaactggctagaactgctgcttctgctactgtgttttgttgccgtctcgtttaacacttactacaatgttcagatctttttactcttagggcaattgctgaagtcgaccgagaaatatagtgatttctactttttagcatgctggcacatttattataacaacataatcgccatcaccatattttttgcctggatcaagatttttaagtttattagctttaataagaccatgtcccagctgagtagtactttgagccgatgcgttaaagacattgtgggcttcgcgatcatgttctttattatattcttcgcttatgctcagttgggcttcctggtgttcggctcacaggtggacgatttctcaaccttccagaattccatctttgcacagtttcggatcgtcctgggcgacttcaacttcgccggcatacagcaggccaatcctattcttggtcccatctacttcatcaccttcatcttctttgtcttcttcgtactcctgaacatgttcctggctataatcaacgacacttatagcgaggtgaaggccgactattctattggaaggcggctggactttgagcttgggaagatgataaagcagtcctacaagaatgtcttggaaaaatttcgcttaaagaaggcacagaaagatgaagacaagaagactaagggaagcggtgaccttgccgagcaggctcgcagagagggctttgatgaaaatgagattcagaacgctgaacagatgaagaagtggaaagaaagactggagaaaaaatactactccatggagatccaggacgattatcagccggtcacacaggaagaatttagggagctgttcctgtacgcagtggaattggaaaaggaacttcattatatcaacctgaagttgaatcaggttgtacggaaagtgagcgcactgtag

SEQ ID NO: 129209 - DNA, 1809 bp, Artificial Sequence
  Description of Artificial Sequence: Synthetic coding sequence
atggccgaggcctctcgctggcatcggggtggggctagcaagcataagctgcattataggaaggaggtggaaatcacaacaaccctacaggagctgctactctattttatttttctgatcaatttgtgtattctgacgtttggcatggtcaacccacatatgtactacctcaacaaagtcatgtcatccctgtttctggacacctctgttcctggcgaagaaaggactaatttcaaatcaattcggtccattaccgatttctggaagttcatggaagggcccctgcttgaaggcctgtactgggattcctggtacaataaccagcagctgtacaatctcaaaaattcatcccgtatctattacgaaaacatcctgctgggtgtccctcgggtccgccagctaaaagtgcgcaataacacttgcaaggtgtattctagtttccagagcctgatgtctgagtgctatggaaagtatacaagcgcaaatgaggatctgtccaactttggactgcagatcaataccgagtggcgctactctacttcaaatactaacagtccttggcattggggttttctgggagtgtaccggaacgggggatacatctttacattatccaaaagcaaatcagaaactaaaaataaatttatcgatctacgcctcaacagttggatcacacgtgggacccgggtgatatttattgatttcagtctttacaacgccaacgtaaaccttttctgcattatccggttggtagccgagtttcctgctactggtggaattctcaccagctggcagttttatagcgtgaagctcttgagatacgtcagctattatgactactttatcgccagctgcgaaataaccttttgcatttttttgttcgtgttcaccacccaggaagtgaagaaaattaaggagttcaagagcgcctacttcaaaagcatctggaactggctggaattattactactgttgttgcttaaaagtacggaaaagtacagcgacttttatttcctggcttgctggcatatttattataataacattatcgccatcacgattttttttgcgtggatcaagatcttcaagtttattagcttcaataaaacaatgagccagctaagttctaccctgtcgcgatgtgtgaaggacatcgtggggtttgctatcatgttcttcatcattttttttgcctatgctcagctcgggttcctggtgtttgggagccaggtggacgacttctctaccttccagaactccatatttgcccagtttcgcatcgtgttaggggacttcaacttcgccgggatccaacaggcaaacccaatcctgggacccatctactttataacttttatctttttcgttttttttgtgctcctcaacatgttcctagcaataattaacgatacctactctgaggttaaggccgactactcaatcggccggcgcctggacttcgagctcggaaaaatgataaaacagagttacaagaacgtactggagaagtttagactcaagaaggcacaaaaggacgaagacaagaagaccaaaggcagcggggacctcgcagagcaagcgcgccgggaaggttttgatgagaatgaaattcagaacgcagaacagatgaagaagtggaaagagagactagagaaaaagtactactcaatggagattcaggatgactaccagccagtgacccaggaagaattcagagagctcttcctgtatgcagttgaattggaaaaggagctgcattacattaacctgaaactaaaccaggtcgtgagaaaggtgtctgctctatag

SEQ ID NO: 129210 - DNA, 1572 bp, Artificial Sequence
  Description of Artificial Sequence: Synthetic coding sequence
atggctgaagcatcgcgatggcaccggggaggagcatctaaacataaactacattatcgcaaggaagtagaaattactacaacattgcaggaactgctactgtacttcatcttcctgattaacctgtgcatactaacctttggcatggtgaacccccacatgtactacttaaacaaagtcatgagtagtctgttccttgacacctcagtccccggcgaggagcgcactaacttcaaaagtattcgctccataacggatttctggaaatttatggagggcccactattggagggcctctactgggacagttggtacaataaccagcagctctataatctgaaaaacagctccaggatttactatgagaacatcctcctaggtgtgcccagagtccgccagctcaaggtgaggaataatacctgcaaggtgtacagctcattccaatcacttatgtccgagtgttatggcaaatacacatctgccaacgaggatctttccaacttcggcctgcaaatcaatactgaatggcgctactcaacttccaataccaattccccatggcactggggctttctgggtgtgtatcgtaatggaggatacattttcacacttagcaaaagtaaaagtgagacaaagaacaaattcatagacctccgactgaattcttggattaccaggggaacgcgagttatttttatcgactttagcctatataatgcaaatgtgaatctgttttgcatcatccggcttgtggcggagttccccgccactggtggaattctaaccagctggcagttttactccgtgaaattgttgaggtatgtaagctattacgattactttattgcttcgtgcgaaattaccttttgcatctttctctttgtgttcactactcaagaggtcaagaagattaaggaatttaagagcgcctactttaagagcatctggaattggttggagctgttactgctgctcctttgctttgttgccgtgagttttaatacgtactacaacgtgcagattttcctccttctgggccagctcttgaaaagtaccgagaagtactctgacttttactttctggcctgttggcatatttactacaacaacatcattgccatcaccatattctttgcttggattaagaatatgttcctagccattattaacgatacgtatagtgaagttaaggctgattatagcatcggcagacgactcgactttgagctgggcaagatgataaagcagtcttacaagaatgtattggagaagttccgccttaagaaggcccagaaggacgaggataaaaagaccaaaggctcaggagacctcgctgaacaggcccgaagagaaggatttgatgagaacgagatccagaacgcagaacaaatgaagaaatggaaagagcgcttagaaaaaaaatactattctatggaaattcaagatgactaccagccggtaacccaggaggagttccgcgaactcttcctttacgctgtggagttagagaaggagttgcactacattaatttgaaactgaatcaggtggtgagaaaagtttcagctttgtag

SEQ ID NO: 129211 - DNA, 1836 bp, Artificial Sequence
  Description of Artificial Sequence: Synthetic coding sequence
atggaagaattagttgttgaggtgagaggcagtaacggcgccttttataaggcattcgttaaagatgttcatgaagacagtatcaccgtggcttttgagaataactggcaacccgaccgacagatccccttccacgatgtgcggttccctccacccgtgggctataacaaggacatcaacgaatccgatgaggtggaggtgtattcacgcgccaacgaaaaggagccgtgctgctggtggttagccaaggtgcgcatgatcaaaggcgagttctatgtcattgaatacgctgcgtgtgatgcaacttataatgaaatcgtaacgattgaacggctgaggagtgtgaaccccaataaaccagccacaaaggacaccttccataagatcaagctggatgtacccgaagacctccgccagatgtgcgccaaggaggcagcccacaaagactttaagaaggccgtcggagctttctcagtcacatacgatcctgagaactaccagttggttatcctgtcgatcaacgaggttacctccaaaagagcacacatgctgattgacatgcactttagatctttgaggacgaaactctcactgattatgagaaatgaagaggcctctaagcagcttgagtcgagccgccagctggcctcaagatttcacgagcagtttatagtgagggaagatctgatgggattggccatcggaacccatggggccaacattcaacaggcacggaaggtgcccggcgtgactgctatcgacctggacgaagacacgtgtactttccacatttatggcgaggaccaggatgccgttaagaaggccaggagcttcttagaattcgcagaagatgtgatccaagtgccacgcaacctggtgggaaaagtcatcggaaaaaatggaaagctaatccaggagatagtggataaatccggtgtcgtccgtgtcaggattgaggcagagaacgaaaagaacgtgccccaggaggaggaaatcatgcctccaaacagcctcccctctaataattcgcgggtcggacccaacgcccctgaagagaagaagcaccttgacatcaaggagaatagtactcattttagtcagccaaactctacaaaggtgcagaggggcatggtcccgtttgtgtttgtgggaaccaaggactccatcgccaatgccacggtgctccttgactaccacctcaactacttaaaggaggtggaccagctgcggctcgaacgcctccagatcgacgagcagctcaggcagattggggccagtagtcgccccccgcccaaccggaccgacaaagaaaagtcgtacgtcactgatgacggtcagggcatggggaggggctcacgaccttataggaatcgaggccacggccgccgaggcccaggctacacttcagggacaaacagcgaagcctctaatgcttccgaaacggaatccgaccaccgcgatgagttgtccgactggtccctggccccaacagaggaagagcgagagtcatttctgcgccgcggagacggtcggaggcgcggtggaggcggccgaggccagggggggagggggaggggcggaggatttaagggcaacgacgaccactcccggaccgataatcgccccagaaaccctcgagaggcaaaagggcgaacaactgatggctcacttcaaatacgggtagattgtaataatgagcgctctgtgcatactaagactctccagaataccagctctgagggctctcggctgcggacaggcaaagatcgtaatcagaaaaaggagaagcctgattcagtcgacggacagcagcccctagtcaacggagtcccatag

SEQ ID NO: 129212 - DNA, 513 bp, Artificial Sequence
  Description of Artificial Sequence: Synthetic coding sequence
atgcctctgccagtggccttgcaaacacgcctcgcaaagcgcgggatattaaagcacctagagcccgaaccagaggaagaaatcatcgcagaggactacgacgacgatcccgttgattatgaagcaacccgcctggaaggactgccccccagctggtacaaggtctttgatccctcatgtggcttgccttactattggaacgccgacactgatctcgtcagctggttaagtccccatgatccaaactccgtggttacgaagtccgccaaaaagctaagaagcagtaacgcggctgtctccaggaaggatgaggagctggaccccatggatcccagttcatacagtgacgccccccgggggacatggagtacaggacttccgaagcggaatgaagccaaaaccggggcagatactaccgcggcaggcccactgtttcagcagcggccctatccatctccgggcgccgtgctacgcgctaacgcagaagcttcacggaccaaacagcaagactag

SEQ ID NO: 129213 - DNA, 204 bp, Artificial Sequence
  Description of Artificial Sequence: Synthetic coding sequence
atgccactgcccgtcgctctgcagacgaggttagccaagagaggcatccttaagcacctggagcctgagccagaagaggaaatcattgctgaggactatgacgatgacccggtagattacgaggcaactcgcttagagggtttacccccctcatggtataaagttttcgatccatcctgcccgggttggtcagcaatggtgtag

SEQ ID NO: 129214 - DNA, 798 bp, Artificial Sequence
  Description of Artificial Sequence: Synthetic coding sequence
atgccccttccagttgcgctgcagactagactcgccaaaaggggtatattaaaacacctagaacctgagcctgaagaggaaattatcgccgaggactacgacgacgacccggtagactatgaagcgacccgactggaaggcctgcccccttcatggtacaaggtttttgatcctagctgtggcctcccctattactggaacgctgacactgacctggtgtcatggcttagccctcacgaccccaactcagtcgtaactaagtctgcgaagaagctgcgctcctctaatgcagacgccgaagaaaagctggatagaagtcatgacaaatctgatcgcggtcatgacaagtccgacagatcccacgagaagctcgaccgaggacacgacaagtcagaccggggtcatgacaaatctgaccgcgatcgggagaggggatatgacaaggtggaccgcgagcgcgagcgggatcgcgagcgcgacagggataggggatacgataaagccgaccgggaagagggcaaagagcggcgccatcatcgcagagaggagctggccccgtaccctaagtcaaaaaaggcagtttctagaaaagacgaggagttagaccccatggatccttcctcttattcagatgcacctaggggcacctggtccaccggtcttccaaaaaggaatgaagctaaaactggcgccgatactaccgctgctggccccttattccagcagcggccttatccatcacccggcgccgtgttgcgggccaacgcagaagcgagcagaacaaaacagcaggactag

SEQ ID NO: 129215 - DNA, 513 bp, Artificial Sequence
  Description of Artificial Sequence: Synthetic coding sequence
atgcccctgcctgttgcgctccagaccagactagcgaagcgcgggatactcaagcacctcgaacctgaaccagaagaagagataatcgccgaggactatgacgacgatccagtagattatgaagctactcgactggagggcctgcctccaagctggtataaagtgttcgaccccagctgcggccttccctactactggaatgccgacacggacctcgtgtcatggctctcccctcacgatcctaactcggttgtgactaagagtgccaaaaagttaaggagctccaacgcagcagtgtcccgcaaagatgaggaactcgacccgatggacccctctagttattcagacgctccccgaggtacttggagtactggcctccccaagcgtaatgaggccaagaccggggctgacaccaccgctgctggccccttgttccagcagcggccctacccctcccccggcgctgtgctgcgggctaatgcagaggcctcgagaacaaagcaacaggactag

SEQ ID NO: 129216 - DNA, 798 bp, Artificial Sequence
  Description of Artificial Sequence: Synthetic coding sequence
atgcctctgcccgtggccttacagactcggctcgcaaagcgcggcatcctcaaacacctggaaccagaaccagaggaggagataatcgctgaggattacgacgacgatccagttgattacgaggctacccgactcgagggcctgcctccaagttggtacaaggtgttcgatccttcttgcggcctgccctactactggaatgcggataccgatctggtgagttggttgtcaccccatgatcctaatagtgtggtgactaagtctgcaaagaagctcaggagctcgaatgccgacgccgaggagaagctggaccgatcacacgacaaatctgaccggggtcacgataagagcgataggagccatgagaagttggaccgtggccatgacaagtccgacagagggcatgataagagcgacagagatcgagagaggggctatgataaggtggaccgcgagcgcgagcgcgatcgcgagagggatagggacagaggctacgataaagcagatcgcgaggaaggcaaggaaagacggcaccatcgacgagaagagctggccccataccccaagtccaaaaaagcagtgagtcggaaggacgaggagcttgaccctatggatcctagttcctatagcgacgcacctcggggaacatggtcaaccggactgccgaaaaggaacgaggccaaaactggagccgacacaaccgcagcaggtcccctttttcagcagcggccctaccccagccctggagcggtcctcagggccaacgcagaagcttctaggacaaaacagcaggactag

SEQ ID NO: 129217 - DNA, 642 bp, Artificial Sequence
  Description of Artificial Sequence: Synthetic coding sequence
atgccccttcctgttgctctgcagaccaggctggcaaagcgcggaatcctaaagcatttggaacccgagcccgaggaggagatcatcgcggaagactatgatgacgacccagtcgactacgaggccactcggctagaaggattaccgcccagctggtacaaggtgttcgacccctcttgtggcttgccatattattggaacgctgatacggacctcgtctcatggctgtctccacacgacccgaatagcgttgtcacaaagagcgccaagaagcttaggtcatctaacgccgatgctgaagaaaagctggacaggtcccatgataagagcgaccgaggtcacgacaagtcggaccggagtcatgagaaactcgacagaggacacgacaagtccgacagaggccatgacaagtctgacagagatagagaaagagggtatgataaggtagaccgggagcgggagcgtgaccgggaacgggaccgggacaggggttatgataaggctgatagagaggaaggcaaggagcggcggcaccaccgccgcgaggagcttgccccttatcccaaatccaagaaagcagtgtcccgcaaagacgaagagttagacccaatggatcccagctcctactctgacgcaccatag

SEQ ID NO: 129218 - DNA, 798 bp, Artificial Sequence
  Description of Artificial Sequence: Synthetic coding sequence
atgccactcccagtcgccctacagacaaggttagcaaaacgtggcatcctgaaacatttggaacctgagccggaagaagagattatagccgaggattatgatgacgatcccgttgactatgaggctacacgcttggagggtctgccccctagctggtataaggtgttcgatccctcatgtggactcccatactactggaacgcagatacagatctcgtgagttggctgagcccccacgacccaaattccgtagtaaccaaatcagctaaaaaacttaggtcctccaacgcagacgccgaggaaaaactggataggtcacatgacaaatcagatagaggtcatgacaaatcagatcggagccacgaaaaactcgatcggggtcacgacaagagtgatcgcggccatgacaagtcagatcgcgatagggaaagggggtatgacaaggtcgatcgggagagggagcgagacagggaaagagatagagatcgcgggtatgacaaagccgacagagaggaaggaaaagagcgaaggcatcatagaagggaagagctggcaccatatcccaaatccaagaaggccgtgtctaggaaggacgaggagctcgaccccatggatccaagttcttactcagacgcacctaggggaacttggtcaaccggcctccccaagcggaacgaggccaagacgggcgctgacaccacggctgctgggccactatttcaacaacggccatacccatcgcccggggctgtgctgcgagccaatgctgaggcttctaggacaaaacagcaggattag

SEQ ID NO: 129219 - DNA, 453 bp, Artificial Sequence
  Description of Artificial Sequence: Synthetic coding sequence
tgaatcgctacctacctgctacacctactcgtccagcctgaagaagagatcatagccgaggattacgacgacgatccagtggactacgaagccacccgactcgaaggcctgccccccagctggtataaggtgttcgacccctcctgtgggcttccctactattggaatgccgatactgatttggtgagttggctctcaccccatgaccctaatagtgtggtcactaagtctgctaagaagttacgatcatctaacgcggccgtttcccgcaaagacgaagagctggatcctatggacccgtcatcttactcagacgctccaaggggaacctggagcacaggtctgcccaaaaggaatgaagccaagactggcgctgatacaaccgcggctgggccgctgttccagcagcgtccatacccaagccccggcgctgtgctccgcgccaacgcgtag

SEQ ID NO: 129220 - DNA, 699 bp, Artificial Sequence
  Description of Artificial Sequence: Synthetic coding sequence
atgggctccgtcctctctaccgactcaggcaaatcggccccagcgtccgctacagctcgagccctggagagacgccgtgacccggaattgcctgtcacatcattcgactgtgctgtgtgtcttgaggttctgcaccagcctgtgcgcacccgatgcggtcatgtattctgcagatcctgcattgcaacatctctgaagaataacaaatggacatgcccttactgtagggcttacctgccaagcgagggggtcccagccaccgatgtggcgaagaggatgaagtcagagtataagaattgtgctgagtgtgacacgctagtgtgtctatctgagatgcgagcccacataaggacatgccagaagtacatcgataagtatggaccacttcaggagctggaagaaaccgcagcacgatgcgtgtgtcccttctgccagcgggagctgtacgaagatagcctgctggaccactgtatcacccatcaccggagcgagcgaagaccggttttctgtcctctctgtcgcctgataccggatgaaaacccaagtagtttctcaggcagcctgatcaggcatcttcaggtctctcatacattattttacgatgactttatcgatttcaatatcatcgaagaagccttgatacgccgcgtgttagatcgctcattactggaatacgtgaaccacagtaacaccacgtag

SEQ ID NO: 129221 - DNA, 1986 bp, Artificial Sequence
  Description of Artificial Sequence: Synthetic coding sequence
atggagaaacttggcgtggagcccgaggaggaaggcggaggggacgacgacgaggaagacgccgaggcttgggctatggagcttgctgatgtgggggctgctgctagtagtcagggggtgcatgatcaggtccttccaacacccaatgcgtcttctcgggtgattgtgcacgtggacctggactgtttttatgcgcaggtggagatgattagcaacccagagctgaaagacaaaccgctgggagtacagcagaaatatttagtggtgacatgtaattacgaagcaagaaagctcggggtgaagaaattgatgaatgtcagagatgctaaggaaaagtgtcctcagctggtcctggtgaacggggaagatttgacaagataccgagagatgagctataaagtcacggaattgctggaagagttcagccccgtggtggagcggttgggtttcgacgagaattttgtggatctcacagagatggtggagaaaaggctgcaacagctgcaatcagacgagctgtcagcagtgaccgttagcggccacgtgtacaacaaccagtgcatcggctacaaaaccgccaaatgccttgaggccctcggaatcaatagcgttagagatttgcagacgttctcacctaagatcttagagaaggagttgggcatttctgtggctcaacgtattcaaaaactgtccttcggagaagacaactctcccgtgatattgtcaggtccaccccagagcttttcggaagaggattcatttaaaaagtgctccagcgaggtagaggctaagaataagattgaagagctgctggctagtttgttgaatagggtctgtcaagatggtcgcaaacctcatactgtacgactaatcattaggaggtattcctccgagaaacactatggaagagagagcaggcagtgcccaataccatcacatgtcatccaaaaactcgggacaggcaactacgacgtgatgaccccaatggtggatatcctgatgaagctgtttagaaatatggtgaacgttaagatgccatttcacctgacactgctatcagtgtgcttctgcaatctgaaggcgttgaatacggccaagaaaggattaattgactattatctgatgccttccctgtcaacaacctctagatctggtaaacactcatttaaaatgaaggacactcacatggaggactttccgaaagacaaggaaacgaaccgggactttctcccgtcaggaaggattgagagcacccgaacgcgcgagtctccccttgacaccacgaacttttccaaggaaaaggacattaacgaatttcctctgtgctccctacctgagggcgttgatcaggaagtgtttaagcaattgcctgtggacattcaagaagagatcttaagcggcaagtctagagaaaaattccagggtaaggggtctgtgtcttgtccactccacgcgtctcgaggtgttctgtccttcttttctaaaaagcagatgcaagacattccaatcaatcccagggatcacctctcctcctctaaacaggtgtcctccgttagtccatgcgagccggggacctcgggcttcaattccagcagcagtagttatatgagttcacagaaggattattcatactacttggacaacagacttaaagacgagcgaatttcacagggccccaaggaaccacaaggctttcacttcactaacagtaatcccgccgtttcagcatttcatagcttcccaaatttgcagtcagagcagttgtttagcaggaaccacaccacagacagccacaaacaaacagtggccactgacagccacgaggggctgacagagaatcgagagcctgatagtgtcgacgaaaaaataaccttcccgtctgatattgatccacaggtgttttacgaactacccgaggccgttcaaaaggagctcctcgccgagtggaagagggctggttccgattttcatatcggtcataagtag

SEQ ID NO: 129222 - DNA, 2223 bp, Artificial Sequence
  Description of Artificial Sequence: Synthetic coding sequence
atggagaagcttggcgtggagccagaagaggaaggcggcggggacgatgacgaagaagacgctgaggcttgggccatggaactggccgacgtaggcgccgcagcttcgtctcagggggtgcacgaccaggtccttccaacgccaaacgcatcctcacgggtgattgtgcacgtcgacctggactgcttttatgcccaagtggagatgatctccaatcccgagctgaaggacaagcctcttggagtccagcaaaaatacctcgtggtgacatgcaattacgaggctaggaaattaggcgtcaaaaagctgatgaacgtgagagatgcaaaagaaaagtgtcctcagctggtcttagtgaacggtgaggacttgacccgctaccgggagatgtcatacaaagtgactgagctccttgaggaattctccccagtggtcgagaggcttgggtttgacgaaaatttcgttgatctgaccgaaatggttgaaaagaggctccagcaattgcagagcgacgagctcagcgcagtgactgtttcgggccatgtgtataataatcagtcaatcaacctccttgatgtgctgcatatcagactgctggtcggatcccagatcgcagccgagatgcgtgaagccatgtataaccagctgggccttacgggttgtgctggagtcgcaagcaataaattactggccaaattggtttctggagtgtttaaaccaaatcagcagaccgtgctcctaccagagtcgtgccaacacttaatccactcactcaatcacatcaaagagattccaggcattggctacaagacggccaagtgtctagaagcactcgggattaactccgtccgggatctgcaaaccttctcaccaaagatcctggagaaggaacttggcatcagcgtggctcaacggattcagaagcttagtttcggtgaggataattcaccggtgatcctgagcggccccccccagtccttctcagaggaagactcttttaagaaatgtagttcggaggtcgaagccaaaaacaagatcgaagagctgctcgctagcctcctaaaccgagtatgccaggacgggaggaagcctcacacagtaaggttaatcattcgccgatacagcagcgaaaaacactacggccgcgaaagccgccagtgtcctatccctagtcatgtgatccagaaactcggcactggaaactacgacgtgatgacaccaatggtggatatcctgatgaaactcttccgtaatatggtgaacgtcaagatgcccttccaccttacgttgttatccgtctgtttttgtaacctcaaggctctcaacaccgcaaaaaaggggttaatcgattattacctaatgccgtcattgtccaccacctccaggtcgggtaaacattcatttaagatgaaggatacacatatggaagattttcccaaggacaaagagacaaacagggactttcttccctctgggcgcattgaatcaaccagaacgcgggagagcccgctggacacaacgaacttcagcaaagagaaggatattaacgaatttccgctgtgcagccttcccgagggcgtggatcaagaggttttcaagcagcttcccgtagatatccaggaggaaattctctcaggcaaaagtagggaaaaatttcagggaaagggttctgtgagttgtccactgcatgcttccaggggagtgctgtctttcttctctaaaaagcagatgcaggacattccgatcaacccccgcgaccacttaagctcctctaagcaggttagctctgtcagtccttgtgagcctggaacaagcggcttcaacagttcttccagttcgtatatgtcctcacagaaagactattcatattaccttgataaccgtttaaaagatgagagaatctcacagggcccaaaggagccacaaggcttccattttactaactcaaacccagctgttagtgcattccatagtttccctaacctgcaatcagaacaacttttttcccggaaccatacaaccgacagtcacaagcagactgtagccacggacagccacgaggggctgactgaaaatcgggaaccggactccgtcgacgaaaaaatcacgttcccatcagatattgatccacaggtattttatgagctgccagaggcagtgcagaaagagctgctggctgaatggaagagagcgggcagcgattttcacattggacacaagtag

SEQ ID NO: 129223 - DNA, 2613 bp, Artificial Sequence
  Description of Artificial Sequence: Synthetic coding sequence
atggacagcactaaagagaaatgcgattcctacaaagacgacttgttgcttagaatgggactgaatgacaacaaagccgggatggaagggctcgataaagaaaagatcaataagatcataatggaagcaaccaaggggtcaaggttctatggaaacgaacttaagaaagaaaaacaggtcaaccagcgaattgagaacatgatgcagcagaaagctcagataacaagtcagcagctcagaaaggctcaactccaggtggacagattcgcaatggagctcgagcagagcaggaacctgagcaatacaatcgttcatattgatatggacgcattctatgctgcggtcgaaatgagagataacccggagttgaaggacaaaccaatagcggttggttcgatgagtatgcttagcaccagcaattaccacgctagacgctttggtgttagagcggcgatgcccggcttcattgcgaagagattgtgccctcagcttataattgtcccgcctaatttcgacaaatacagagctgtcagcaaagaggtcaaagagatcttagcagactacgaccctaactttatggctatgagcctggatgaagcgtacctaaacatcaccaagcatttggaggagagacaaaactggccagaagacaaacgccgctattttatcaaaatgggaagctccgttgaaaatgataatccaggtaaagaggtcaataaactgtccgagcacgagcgttctattagccctctgctgttcgaagagagccccagtgacgtgcagccgccaggggatccgtttcaggtgaatttcgaagaacagaacaacccccaaatcctgcagaattccgtggtcttcggtactagtgcccaggaggtggtgaaagagatcagatttcggattgagcagaagaccacccttacagcttccgctggtatcgcacccaacaccatgctcgcaaaggtttgctcagacaagaacaagcctaatggtcagtatcaaattctcccaaacaggcaggcggtcatggatttcattaaagacctgcccatacgaaaggtgagtggcattggtaaggtgacagaaaagatgcttaaggcgctgggaattataacttgcaccgaactttatcagcagagggcattgctaagcctcttattctctgaaacatcatggcactactttctgcatattagcctgggcctgggctccactcatttgacccgagacggcgaacgaaaatcaatgtcggttgagcgaacgttctcagagatcaataaagcggaggagcaatactcgttgtgccaggaactctgtagtgagttggcccaggatctgcagaaagagcgcttgaagggtaggacagtaacaataaagttaaagaatgtcaacttcgaagtaaagaccagagccagtactgtaagctccgttgtcagcaccgccgaagagattttcgccatcgccaaagagctgctcaagactgaaatcgatgctgatttcccccacccactgcgcctgcgcctcatgggagtccggatctcgtctttccccaatgaggaagatcggaagcaccaacagcgctccatcatcggattcctccaggccggtaatcaagcccttagcgctaccgagtgtactctggagaaaaccgacaaagataagtttgttaagccgctggaaatgagccacaagaagtctttctttgataaaaagaggtccgagagaaaatggtctcaccaggatactttcaagtgtgaggcagtcaataagcagagtttccagacaagccagcccttccaggtcctgaagaagaagatgaatgaaaatcttgaaatcagtgaaaattctgatgattgtcagatcttgacttgcccagtatgcttccgcgcgcaagggtgcatttccctcgaagctctgaataaacatgttgatgagtgcctcgatgggccatctatatcagagaacttcaaaatgtttagctgcagtcatgtgagcgccacaaaggtcaataagaaggaaaatgtgcctgccagtagcttatgtgagaaacaggactacgaggctcaccctaagataaaagagatatcgtccgtagattgcattgctctggtagatacgatagataactccagcaaggcagagtcaattgatgccttgagcaataagcactcgaaggaggagtgtagctccctaccctccaagtcattcaatatcgaacattgccatcaaaactccagcagcaccgtaagtctggaaaacgaggatgtgggttcctttcgccaagagtacaggcaaccatatctttgcgaagttaagacaggtcaggcactcgtgtgtcccgtctgtaatgtggagcagaaaacttctgatctcactctcttcaatgtgcacgtggatgtgtgcctgaataaaagttttattcaggagctccggaaggacaagttcaatcctgtgaaccagcctaaagagtcatcccgcagcaccgggtcaagcagcggggtccagaaggctgtgacccggaccaaacgacccggactgatgacaaagtacagtactagtaagaagattaagcctaataatcctaagcacacactggatatttttttcaagtag

SEQ ID NO: 129224 - DNA, 2019 bp, Artificial Sequence
  Description of Artificial Sequence: Synthetic coding sequence
atggatagtacgaaagagaagtgcgattcgtacaaggatgacttactgctgaggatgggtctaaacgataataaggcaggcatggagggactggataaagagaagattaataagattattatggaggcaacgaaggggagtaggttttatggaaatgagctgaagaaagaaaagcaagttaaccagcggattgaaaacatgatgcagcaaaaggcgcagatcacaagtcagcagcttagaaaggctcagctccaagtggaccggttcgccatggagctggagcagagtcgcaatcttagcaatacgattgttcacatcgatatggacgccttctacgcagccgtggaaatgcgggataaccctgaacttaaggataagccaatagcagtgggcagcatgagtatgctctccacctctaactaccatgctagacggttcggcgtccgggcagccatgcccggtttcatcgcaaagcgtctgtgtccacagcttatcattgtcccccctaattttgacaaatatcgagcagtctcaaaggaagtgaaggagattttggctgattatgacccaaacttcatggcaatgtctcttgatgaggcttatttaaatataacaaaacatctcgaggaacgccagaactggccagaggataaaaggcgctatttcatcaagatgggtagctccgtcgagaacgataatcctgggaaagaagtgaataagctgtcagagcacgagcggtccattagccccctgctttttgaggagtctccttcggatgttcaaccgccaggtgaccccttccaggtcaactttgaggagcagaacaatcctcagattcttcaaaacagcgtggtgtttggcacgagtgcacaagaggtcgtgaaggagatacgcttccggattgagcagaagacaaccttgaccgcgtcggcaggtgtaagaatttccagctttccaaatgaggaggataggaaacatcagcagagatctatcattggattcttacaggcggggaatcaggccctgtctgcgaccgagtgcaccctggaaaaaactgataaggacaaattcgtcaagccactggaaatgtctcacaagaagagtttcttcgacaaaaagcgttctgaaaggaaatggagtcatcaggacacatttaagtgtgaggccgtgaacaaacagagctttcagacaagccagccatttcaagttctgaagaagaaaatgaatgaaaatctcgaaattagcgaaaacagtgacgattgccagatccttacctgtcctgtgtgcttcagagcccagggctgcatttctctcgaagccctcaacaaacacgtcgacgaatgtttggacggcccaagcatcagtgagaatttcaagatgttcagctgctcacatgtctcagcaactaaagtgaataaaaaagaaaacgttcctgcgagcagcctctgcgaaaagcaggattatgaggcacacccaaaaatcaaagaaatttcgtctgtagattgtattgcccttgtcgacacaatcgataacagtagtaaggcagagagcatcgacgccttgtcaaacaagcacagtaaagaggagtgttcaagccttccctctaagagcttcaatatcgagcattgccaccagaacagctcatcaacagtttccctggaaaatgaggacgtcggaagctttcggcaggagtaccgacaaccctacctttgtgaggtcaaaactggccaggctttagtgtgtcccgtgtgcaacgttgagcagaaaacttccgacctgaccttgtttaatgtgcacgtggatgtctgcctgaataaatcctttattcaggaactgagaaaggacaaattcaaccctgtgaatcagcctaaggagagctcaagaagcactggcagcagcagtggcgtccaaaaggctgtgactagaactaaacggcccgggctgatgactaagtatagcaccagcaaaaagattaagcccaacaaccccaaacacaccctggacattttcttcaagtag

SEQ ID NO: 129225 - DNA, 2343 bp, Artificial Sequence
  Description of Artificial Sequence: Synthetic coding sequence
atggagctcgagcagtcccggaatctgagtaatacgatcgtgcacattgacatggatgccttctatgcagcagtcgaaatgagagacaaccccgaattaaaggataagccaatcgccgtgggctctatgtcaatgctgagtacttctaattaccacgcgcgcaggtttggcgttcgggcagccatgcctggcttcatagcgaagcgtctgtgccctcaactgatcattgtgcctcccaatttcgataagtaccgcgctgtgagcaaggaggttaaagagatcttggccgactatgacccaaactttatggccatgtctctggatgaggcgtatctgaatatcacgaagcacctagaagaaagacaaaattggcctgaagacaaacgcaggtacttcattaagatggggtcttccgttgagaatgataatcccggcaaggaggttaacaaactctcggagcatgagcgcagcatttcccccttgttattcgaggagtccccctcagatgtgcagccccctggggaccccttccaggtgaacttcgaggagcagaacaacccccagatcctgcaaaatagcgttgtgtttggtaccagtgcccaggaggtggtcaaggagataagatttcgcattgagcagaagacaaccttaacggcctctgccggaatcgctcccaacaccatgctggcaaaagtatgctctgataaaaataagccgaacggtcaataccagattttgccgaacagacaggcagtgatggactttatcaaggacctgcctattcgaaaggtttctggcataggcaaggtcactgaaaaaatgctcaaagccctgggaataattacctgcacagagctgtaccagcaaagagcgctgctgtcactcttgttcagtgaaacttcttggcactatttcctccatatttctctgggacttggatccacacatctcacaagggatggcgaacggaagtccatgagcgttgaaaggacgttttccgagatcaataaggctgaggaacagtacagcctgtgccaggaactttgctccgagctcgcccaagatctccagaaggagagactgaagggacgtaccgttaccattaaattgaaaaacgttaacttcgaggtaaagactagggcatcaaccgtgagctctgtggtatctaccgccgaggagatttttgccatcgcaaaagagcttctcaagaccgaaattgacgccgactttccgcacccattacggctgagacttatgggagtgcgtatctccagcttcccaaacgaggaggatcggaagcaccagcagagatccattattggcttcttgcaggctggaaaccaggccctcagtgcaaccgagtgcacactggaaaaaactgacaaagacaaattcgtaaaacctctagaaatgtcccacaagaagtcctttttcgataaaaaacgctccgaaagaaagtggtcccatcaagatacattcaaatgcgaggccgtcaacaagcaaagctttcagacatcacagccattccaagtgctgaaaaaaaagatgaatgaaaatctagaaatatccgaaaattctgacgactgccagatccttacttgcccagtgtgtttccgtgcccaggggtgtatatcactggaagcattgaacaaacacgtcgacgagtgtctggacggaccttccatcagcgaaaacttcaaaatgttctcttgcagtcatgtttctgcaacaaaagtaaataaaaaagagaacgtgcccgctagcagtctgtgtgagaaacaggactatgaagctcaccctaagatcaaggagataagtagtgtggattgcatagcacttgtggatacgatcgacaactcatctaaagcagagtctatcgacgctctctccaataaacattccaaggaggagtgttccagcctgccatctaagagttttaacatcgagcattgtcaccagaattcatcttccaccgtctcactggaaaacgaagatgtcgggtctttccgccaggaataccgtcagccgtatctgtgtgaggttaagacaggacaggcgctggtctgtcccgtttgcaacgtggagcaaaaaacttctgacctgactctgttcaacgtgcacgttgacgtgtgccttaacaaatctttcatccaggagcttaggaaggataaattcaatcccgttaaccagcccaaggaatcatctagaagcacagggagttctagtggtgtccagaaggcggtgactagaacaaaacgccccgggctgatgacgaagtactccacatctaagaaaataaagcccaacaaccccaagcacaccctcgatatattctttaaatag

SEQ ID NO: 129226 - DNA, 1386 bp, Artificial Sequence
  Description of Artificial Sequence: Synthetic coding sequence
atggacagtaccaaggagaagtgtgactcatacaaggatgaccttctgcttcggatgggccttaacgacaacaaagccgggatggagggtcttgataaggagaagattaacaagatcatcatggaagctactaagggctctaggttctacggaaacgagctgaagaaggagaagcaggtgaatcagcgaattgagaatatgatgcagcagaaagcccagatcacttcacagcaattacggaaggcccagctgcaagtggatcgcttcgcaatggagcttgaacagtctcggaacctgtccaacacgatcgtgcatattgacatggatgctttctatgcggctgttgaaatgcgagataatcctgagctaaaagataaacccatcgccgtgggcagcatgtccatgctttctaccagcaactatcacgcaaggcgttttggggtcagggccgcaatgccgggatttatcgctaaaaggctgtgcccccagttgatcatcgttcctcccaacttcgataaatatcgtgcagtgagcaaggaggtgaaagagatccttgccgattatgaccctaatttcatggctatgagtttagatgaagcttacttgaatattactaagcatctagaggagcggcagaattggcccgaggataaacgccgctatttcatcaaaatgggaagctccgttgagaatgataacccaggtaaagaggttaacaaattaagtgagcatgagaggtctatttcgccactgctttttgaggagagcccttctgatgtccagccgcctggggacccatttcaggttaactttgaggagcagaataacccacaaatcctgcagaactccgttgttttcggtaccagcgcacaggaggtggtgaaggaaataaggttccgtatcgagcaaaaaaccacccttaccgccagtgcgggaatcgctcccaataccatgcttgcgaaagtctgtagcgacaaaaacaagcctaatgggcagtaccagatcctgccaaacagacaggcagtcatggacttcataaaggacctccccatcagaaaggtgtccgggattggtaaggtgaccgaaaagatgctgaaggcactcggaataattacctgcacggaactctaccagcagagagccctcttatctctgctgttctccgaaacctcatggcattactttctgcatatctcacttgggctcggctctacacatctgacccgcgacggggagcgcaagtctatgtccgttgagaggaccttctctgagataaataaggccgaagaacagtacagcctgtgccaggaactgtgctccgaactcgcccaagatctgcagaaggagcgcttgaaggttgcccaagttgagtacagacgactctag

SEQ ID NO: 129227 - DNA, 2019 bp, Artificial Sequence
  Description of Artificial Sequence: Synthetic coding sequence
atggattcgactaaagaaaaatgcgattcctataaagacgacttgttactgcgcatggggttgaatgacaacaaagcagggatggaggggctcgacaaggagaaaatcaacaagatcattatggaagcaacaaagggatctaggttttacggcaacgagctgaagaaggagaaacaggtgaaccagaggattgagaatatgatgcagcaaaaagcacagatcaccagtcagcagctgcgtaaggcccaattgcaggtggacagatttgctatggaactggagcagtcgcggaatctgtcaaacaccatcgtgcatatagacatggacgcattttatgctgcggttgagatgagggataatccagagttgaaggacaagcccatcgccgtgggtagtatgtccatgttgagcacgtctaattatcatgcccgtagatttggagtgagagccgctatgccagggtttattgctaagcgcctgtgtccgcagctgataatcgttcccccaaattttgacaagtaccgagcagtctccaaggaagtcaaggagatcctggccgactacgaccctaacttcatggcaatgagccttgacgaggcttatttgaatattaccaagcatctggaagagaggcagaactggcctgaagacaagaggcgttacttcatcaaaatgggatcaagcgtggagaatgataaccccggcaaagaagtcaacaagctttctgagcacgagaggtctatctcacctctgctctttgaggagtcaccctcagatgtgcaaccacctggagacccttttcaggtgaacttcgaggaacagaataatcctcagatcctgcagaattccgtggtgttcggtacatcagctcaggaagtggtcaaggagatcaggtttaggatcgaacaaaagactacactcacggcttctgccggggtacgtatttcgtcgtttccgaatgaagaagacagaaagcatcagcagcgatctataattggattcctgcaagctggtaatcaggccctatccgcaaccgagtgcacccttgagaagaccgacaaggacaaatttgtgaaacccctagaaatgtctcacaaaaagagttttttcgataagaaacgctccgaacgtaagtggagtcaccaggacacctttaaatgcgaggctgtgaataaacagtcattccagacctcacaaccatttcaggtgttgaagaaaaaaatgaacgaaaatctggagatctccgagaattctgacgattgtcagattctaacctgcccagtttgcttccgagcccagggctgcatctcacttgaggcacttaacaaacatgtcgatgaatgtctcgacggcccatctatctcagagaattttaaaatgtttagctgttcccatgtaagcgctactaaagttaataaaaaggagaacgtgccagcatcatctctgtgtgaaaagcaggattatgaagcccaccccaagatcaaggagatatcctctgttgattgtatcgctcttgtcgacactattgacaattctagcaaagccgaatccatcgacgcattatccaacaagcattcaaaagaagagtgttcatctctacctagcaaatccttcaacatagagcactgtcaccagaactctagcagtacagtaagtctcgagaatgaggacgtcggaagctttcggcaagagtatcggcaaccctacctctgcgaagtgaaaacaggccaggctctggtgtgtcctgtatgcaatgtcgagcagaaaacatccgatctcacgttatttaacgtacatgtggatgtatgcctaaataaatcttttatccaggagcttcgcaaagacaaatttaatcctgtaaatcaacctaaggagagctcaagatcaactgggtcttccagcggggtccagaaggccgtgacgcgcacaaaaaggcctggattaatgactaaatattccacatctaaaaaaattaaacctaacaacccaaagcacaccctggatatcttcttcaagtag

SEQ ID NO: 129228 - DNA, 1470 bp, Artificial Sequence
  Description of Artificial Sequence: Synthetic coding sequence
atggattccacgaaagaaaaatgtgatagttataaggacgatctactgctaaggatgggtctcaatgataataaagccggaatggagggcctcgataaggaaaagattaataaaatcatcatggaagccaccaagggatctcgattttacggcaatgagttaaagaaggaaaagcaggttaaccagagaatcgagaatatgatgcaacagaaagcccaaatcacgagtcagcagctgcgcaaggcacagctgcaggttgaccgtttcgcaatggagctcgaacagagtaggaacttgtcaaatactatcgtacacattgacatggatgcgttttacgcagctgttgagatgagagataatcccgagttaaaggacaagcccatcgctgtagggtcgatgtccatgcttagcacatcaaattatcacgcgcggcggttcggggtgagggccgctatgcctgggtttattgcgaagcgtctctgtcctcagttgattattgtgccgcccaattttgataagtatagagcagtaagcaaggaagtgaaggagatactggcggattatgacccaaattttatggccatgtcactggatgaggcatatctgaatatcactaagcatttagaagagaggcagaactggcccgaggataagagaagatacttcatcaaaatgggctcatcagttgagaacgataatcctgggaaagaggtgaacaagctttcagagcacgaacgatccattagtcctcttcttttcgaagagagcccttctgacgtgcaacctccaggcgacccgttccaggtcaattttgaggagcaaaacaatcctcagatcttgcagaactcggttgtttttggtaccagtgcccaagaagttgtcaaagagattcggttccggatcgaacaaaagactacactgactgcctctgcaggtatcgccccaaatacgatgctggccaaggtgtgctccgacaaaaataagcccaacggccagtatcagatcttgcccaacaggcaagccgtgatggacttcataaaagatcttcccataagaaaagtttcagggattggtaaagtgacagaaaagatgctgaaggccttaggaatcattacttgcaccgagttatatcagcaacgcgccctcctatccctgctcttcagcgaaaccagctggcactacttcctccacatctcactgggcctgggatctactcatctgacccgagatggtgagcggaagtccatgagcgtggaacgaacattcagtgagattaacaaggccgaagaacagtattctctgtgtcaggagctctgttcagaactggcgcaagacctgcagaaggagaggttaaaggtgtttggctacctggttttccccatgaagaggaccggaaatacaaataaaggggcgctcttggcgttctacagactggagacaaagccatgtcagcccctaagcgtgcactag

SEQ ID NO: 129229 - DNA, 426 bp, Artificial Sequence
  Description of Artificial Sequence: Synthetic coding sequence
atggacagtaccaaggagaaatgcgactcctacaaagacgatctgctgttacgtatgggacttaatgacaacaaggccggcatggaggggctagataaggaaaagatcaacaagattatcatggaagccaccaagggcagccggttctatgggaacgagctgaaaaaggaaaagcaggtgaaccagcgtattgagaatatgatgcaacagaaagctcagataaccagccagcagttgcgtaaggctcaactgcaggtggaccggtttgctatggaacttgaacaaagccgcaacctgtcaaacacaatcgtgcatatagatatggacgcattctacgccgccgtcgaaatgagggacaacccggaacttaaggacaagccgatagctgtgggatcaatgagtatgctgtcaacttctaactactag

SEQ ID NO: 129230 - DNA, 1419 bp, Artificial Sequence
  Description of Artificial Sequence: Synthetic coding sequence
atggattcgaccaaggagaaatgcgattcatacaaggatgacctcttactgaggatgggtctcaatgacaacaaggctggcatggagggtctagataaggagaaaataaacaaaattattatggaggcaaccaagggaagcaggttctatggtaatgagctgaagaaagagaagcaagtgaatcaacggatagaaaatatgatgcagcagaaggcccaaataacgtcacagcagttgcggaaagctcagctccaagtggataggttcgccatggaactggagcagtctaggaacttgagcaacaccattgtccatatcgacatggatgctttctacgccgccgtggagatgagagataaccctgagctgaaagataaaccaatcgctgtgggatccatgtccatgctgagcacaagtaattatcatgccaggagatttggagtgagagcagccatgccagggtttatcgctaagcgtctctgtcctcaactgattattgtacctcctaacttcgacaagtaccgcgctgtgtccaaagaggtcaaagagatacttgctgattatgatcctaattttatggctatgtcgcttgatgaagcgtacctcaacatcaccaaacacctggaggaacgccagaattggcccgaagataaacggaggtactttattaagatgggctccagtgtcgagaatgataacccaggcaaagaggttaacaagctgagcgagcacgagcggtcaatcagtccacttctatttgaggagtccccttcggacgtccagcctcccggagatcctttccaagtgaatttcgaggaacagaataatcctcagattcttcagaattccgtagtgttcggaacttccgcacaggaggtggtgaaagaaattaggttcaggatagagcagaagactacccttacagcgtctgccgggatcgccccaaatacgatgctagctaaagtgtgtagtgacaaaaacaaaccgaatggccaataccagatcctgcctaacaggcaagcagtcatggacttcataaaagatctgcccataaggaaggtttcggggatcggcaaggtcacagaaaagatgttaaaagcactggggattatcacatgtaccgaactctaccaacagcgtgcactgttaagtcttttattttccgagacaagctggcattactttttacacattagcctggggctcgggagcacacatctgactagagacggggaaaggaagtccatgtcagtcgagaggacatttagcgagattaacaaggcagaggaacaatactccctgtgtcaagagctgtgctctgaactcgctcaagatcttcagaaggaacgcttgaaagtcctgtatttcgacatggtctctcttgttttcaagttcttcaatagcaagatgctgccctag

SEQ ID NO: 129231 - DNA, 1911 bp, Artificial Sequence
  Description of Artificial Sequence: Synthetic coding sequence
atgaaatgtaagtgtcccgtcatttgttttaatgcaaaggactttgtgcggatcgttctgcaattcttcgggaacgacgggagctggaagcacgtcgctgatttcatagggttggacccccgaattgcagcatggctgatcgatccatccgacgccaccccatccttcgaggatcttgtggagaagtattgcgagaagtctataacagtgaaggtgaacagtacctatgggaatagctccagaaacatcgtgaaccagaatgtgcgggagaatctgaagactctgtaccggctgaccatggatctctgcagtaagctgaaggattacggcctgtggcagcttttccgaacgttagagctgcccctgattccaatcctcgcagtaatggagtcccacgctatccaagtgaacaaggaggaaatggaaaaaacttctgcattgctcggcgctcgcctgaaagagctagaacaagaggctcactttgtagccggagagaggtttctgatcaccagtaataaccaactgcgagagatcttgtttggtaaactgaagctgcatttgttaagccagagaaattccctgcccaggacgggcctgcagaaatacccttcaacctctgaggccgtgctgaatgcccttagagatttgcacccgctgccgaaaatcattcttgagtacaggcaagtccacaagataaagtcgacttttgtagatggcctactagcttgcatgaagaagggcagcatttcatccacttggaaccagaccggaaccgtcaccggaaggctgagcgccaagcaccctaacatccagggaatttctaaacaccctatccagattactacgcctaagaattttaagggtaaggaggataaaatcctaacaatctctcctcgggctatgtttgttagcagtaaaggccacacattcctcgcagctgatttctcacaaatcgaattgcgaatcctgactcacctgagtggtgacccggaacttctcaagttattccaggagtctgagcgggatgacgtgttttcgacccttacctcgcaatggaaagatgttccagtggagcaagtcactcatgcagaccgtgagcagaccaagaaggtcgtctacgctgtcgtgtacggagccgggaaggaaaggcttgcagcctgcctcggtgtaccaatacaggaagccgcacaattcttggagagctttttacagaagtataagaagatcaaggattttgctcgtgcggccattgcacagtgtcaccagacaggctgcgtggtcagtatcatgggcagacgccggccccttcctcgaatccacgctcacgatcagcaactcagggcccaggccgaaagacaggccgttaattttgtcgtgcagggatccgcggctgatctgtgtaaactggccatgatacatgtctttactgcggtagccgcctcccacaccctgactgcccggttggtcgcccagatccatgacgagctcctttttgaggtggaagatccacaaatccccgaatgcgccgctttggtcaggcgcacaatggagtccttggaacaggttccactgaaagtcagcttgtctgccgggcggagctgggggcacttagttcccttacaggaagcatggcttcgccaggctcatgttgcattaagcttgcccgcaaccgcgtggttgccactgggacctctccctgctccctctcctcatccatgcatctttcggctgcacttcgtttgcagtccacgacagcagtgggaagaacgcacaggattccagcaatcgatcgtctggccatctcccagatcccccgccttgtacgcgcctggacggatcaaccctttgggcctgggatggcccgccatcccctggtctaagtgcctgtgcaaagctctcttgattttatag

SEQ ID NO: 129232 - DNA, 936 bp, Artificial Sequence
  Description of Artificial Sequence: Synthetic coding sequence
atggccgtgggatctcaagactatggtctgtggcagttgttccggacactggaactgccgctaatcccaatactcgctgtgatggagtcgcatgccattcaagtgaacaaagaagagatggagaagacgtcggcgctgttaggcgccagactcaaagagctggaacaggaagctcattttgtcgctggcgagcgcttcctcatcacatctaataatcagctgcgcgagatactgtttggtaagttgaagctgcacctgctttcccagagaaacagcctgcctcggaccggcctgcagaaatatccctccacaagtgaagcagtgaatatacagggtatatctaagcatcctattcagatcaccactccgaaaaattttaaggggaaggaggacaaaattctgacaatcagtccccgtgcaatgttcgtttcatccaagggccatactttccttgcagctgatttctctcaaattgagcttagaatccttacccatctgagcggagacccggagctgctgaaactattccaggaaagtgaacgcgatgacgtgttctctacgcttacctctcagtggaaggacgtgcccgtcgagcaggttacccatgcagaccgggagcaaactaagaaagtcgtatatgcggtagtttatggcgccggcaaagagcgcttggctgcgtgcctgggggtccccatacaagaggctgcacagttcctggaaagcttcctccagaagtacaaaaaaatcaaggatttcgccagggcagctatcgcacagtgtcatcagaccgggtgcgtggtgtcgatcatggggcgaaggcgtcctctgccccgcattcacgcccatgaccagcagctccgtgcacaggcagaaaggcaagcggtcaacttcgtggtacaggcccagtctcagcatttgtgcgtggaggttccctag

SEQ ID NO: 129233 - DNA, 2703 bp, Artificial Sequence
  Description of Artificial Sequence: Synthetic coding sequence
atggagaactacgaggccctcgtcggattcgacttgtgcaacacacccctctccagcgtggcacagaagattatgtcggccatgcacagcggcgacttagtggatagtaagacctggggtaagagcaccgaaacaatggaagttattaataaaagtagtgtgaagtactctgtgcagctggaagacaggaaaactcagagtcctgagaagaaggacctgaagtcactacgctcacaaacaagtcgcggttctgccaaactgtctccccagtctttctccgtccggctgacagatcagctgtccgccgatcagaagcagaaaagtatttcctccctcaccttatcttcttgcctcattccccagtataaccaggaggcgtccgtcctgcagaaaaagggccataaaaggaagcatttcctgatggagaatataaacaacgagaacaaagggtctataaatttaaaacgaaagcacatcacctataataatctgtcagagaagacaagcaaacagatggccctggaagaagatacagatgacgctgaggggtacttaaatagcggcaattcgggggcacttaaaaaacatttttgtgacatcagacacttagatgattgggccaaaagccaactcatcgagatgctgaaacaagcagccgcccttgtgatcacggtaatgtatacagacggcagcacgcagctgggagctgaccagacccctgtcagcagtgtgagaggtattgtggtgcttgtaaaacgacaggctgagggtggccatggttgccccgacgcccctgcctgtggccctgtgcttgagggtttcgtgtccgacgacccgtgtatttacatccagatcgagcactccgcgatctgggaccaggagcaggaggcccaccagcagttcgcccgaaacgtcctgttccagacaatgaaatgtaaatgcccagtgatctgctttaatgcaaaagactttgtaaggattgtcctgcagttctttgggaatgacggctcctggaagcacgtggctgacttcatcggcctggatccaagaattgccgcctggctaattgacccgagtgatgccacccctagcttcgaagaccttgtagagaagtattgtgagaagtccataactgtcaaggtgaacagcacttacggaaattcttcccggaacattgttaatcagaatgtgagggaaaatttaaaaaccttgtaccgactgacaatggatctctgcagcaagctgaaggactacggcctgtggcaactgttccggactctggaattgcctttgatcccgatcctggcggtgatggaaagccacgccatccaggttaacaaagaagagatggaaaaaacttccgccctattaggggcacgcctcaaggagctggagcaggaggcacattttgtggccggtgagcgattcctgattacctccaataaccagctgagggagatcctgtttggaaagctgaaactccacctgctctcacagaggaacagcttgccacgaactggactccagaaatatcccagtaccagcgaagcagtcctgaatgctttaagggacctgcatcccctgccgaagatcatcctcgagtacaggcaggttcacaaaattaagtccaccttcgtcgacggactgctcgcctgcatgaaaaaggggtctatatcaagcacatggaaccagactggaacagtgaccggcagactgtctgctaagcatccaaatatccaggggatttccaaacatcccatccagatcacgacgccaaagaacttcaaaggcaaggaggacaagatactcactatctccccaagggcaatgttcgtttccagcaagggccatacctttctggccgcagattttagtcagattgagcttcgaattttgactcatctgtccggcgacccagagttgctgaagctttttcaggaaagcgaacgggatgacgtgttctccaccctcacctcgcaatggaaggacgtgcctgtcgaacaagtgacccacgccgaccgtgagcagacgaagaaggtggtttatgcagtggtctacggggccggcaaggagcgactcgcagcctgtctcggcgtgcctatccaggaagcagctcagttcctggagagctttctgcagaaatataagaaaattaaagattttgcgagggccgctattgcccagtgtcatcagacaggctgtgttgtgtcaattatggggcgacgaaggccacttcctcgaatacacgctcatgaccagcagctgagagcccaggccgagcggcaggcggtaaatttcgtcgtgcaaggttctgccgccgatctatgtaagttggccatgattcatgtgtttacagctgtggctgcaagccataccttgacggcccgcctggtggcacagatccacgatgaactcctgtttgaggttgaagatccgcaaattccagaatgcgccgccttagttcgtaggaccatggaaagtctggaacaggtgcaagcactggagttgcagttgcaagttcctctcaaagtcagtctctccgcgggccgttcatggggtcatctcgtaccactccaggaagcatggggcccaccgcctgggccgtgtagaactgagtcaccttctaattccctggccgctcctggttctccggcctccacccagccaccacctctacacttcagtccaagtttctgtctttag

SEQ ID NO: 129234 - DNA, 2703 bp, Artificial Sequence
  Description of Artificial Sequence: Synthetic coding sequence
atggagaactacgaagcgctggtgggatttgatctctgcaatacccctttaagcagcgtcgcccaaaagattatgtccgctatgcatagcggcgacctcgttgattccaagacttggggaaagtcaacagagactatggaggtgatcaataagtcgagcgtgaaatatagcgtgcagctggaggatcgcaaaacacagagccctgagaaaaaggacctcaaaagtctgcgttcccagacatcgagaggatcggctaagctctctccccagagtttttccgtcagacttaccgatcaactcagcgctgatcagaagcagaagagcataagctcccttacgttatcctcctgcctcatccctcagtataaccaggaagcgtctgtgctgcagaagaagggccataaacggaaacattttctgatggagaatattaataacgagaataagggttccattaaccttaagcggaaacatatcacttataacaacctcagcgaaaaaacttctaagcagatggccctcgaggaggataccgacgacgccgagggctatctgaactccgggaacagcggagcgctgaaaaaacatttttgcgacatccggcatttagatgactgggccaagtctcaactgattgaaatgctgaagcaagccgccgccctggtgatcaccgtgatgtacacggacgggagcacccaactcggcgccgatcaaacaccagtctcttcagtaagaggcattgtcgtcctggtcaagagacaggctgaaggcggacacgggtgccccgatgctcccgcctgtggtccagtcctggaaggattcgtgtcagacgacccctgtatttatattcagattgaacacagtgctatctgggaccaggaacaagaggcgcatcagcagtttgccaggaacgtgttgtttcagacgatgaaatgcaagtgccccgttatatgcttcaatgccaaagatttcgtgcgcatcgtcctgcaattttttggaaacgatggctcctggaagcatgtcgcggatttcatcggtctggaccctagaattgccgcctggctgatcgatcccagcgacgccacacccagctttgaagacctcgtggaaaaatattgcgaaaaaagtataaccgtgaaggtgaactcgacctacggcaactcatcacggaacatcgtgaaccagaacgtgagggagaacttgaagactctctaccgcttaactatggacctttgttccaagttgaaggactacggtctttggcagctgtttagaacattggagctgccactgatccctattctggcggttatggagagtcatgcgatacaggtaaacaaagaggaaatggaaaaaacttcagctctcctgggcgcgcggctcaaagaactcgagcaggaagctcacttcgtggccggcgaacgtttcctaataacctcaaataaccagttgcgtgagattctgttcggtaaactcaagctgcacctcttaagccaacgcaactcactgcccagaaccgggctgcagaagtacccttcgacttccgaggccgtgctcaacgccctcagggatcttcacccactccccaagatcattttagagtacaggcaggtgcacaagattaaatcaacatttgtggatggtttgcttgcttgcatgaagaaagggagcatatcaagtacttggaatcagaccggtaccgtgaccggtcgcctgtccgctaaacaccccaacatacagggaatctctaagcacccgattcagataactacaccgaagaactttaagggcaaagaagacaaaatactcaccatctcccctcgcgctatgtttgttagctctaaaggccacacttttctggccgccgactttagccagattgagcttcggatccttactcacttgtctggggacccagaactccttaagttatttcaagagtccgaaagggacgatgtcttttctacactcacttcacaatggaaggatgtccctgtggagcaggtgacccacgccgatagagagcagacaaagaaggtggtttatgctgttgtctacggcgccgggaaagaaagattagcagcttgcctcggtgtacctatccaggaggcggctcagtttttagaaagcttcttacagaagtacaagaagataaaggatttcgccagagctgcgatcgcccaatgccaccagacaggctgcgtggtttcgattatgggccgacgacggccactgccccgaattcatgctcacgaccaacagctacgcgcccaggccgagcgtcaggccgttaactttgtggtgcaaggtagcgccgcagacctttgtaagttagctatgatccacgtattcacagccgtggccgcctcccatacgttgactgcgaggctagtcgcgcagatccatgatgagctgctgttcgaagtggaagacccacagattcccgaatgtgctgccctggtgagacgaacaatggagtccctggagcaagtccaggccctggagttacaattgcaggtcccactgaaggtaagtctgagcgctggtcgttcttggggtcatctcgtgccactgcaggaagcatggggcccacctcctggaccttgcaggacagaatccccctctaattccctcgctgctccgggtagtcctgcctcaactcagcctccaccattacacttttcaccaagcttctgcttatag

SEQ ID NO: 129235 - DNA, 3033 bp, Artificial Sequence
  Description of Artificial Sequence: Synthetic coding sequence
cgcatggatggaaaacgcagacctggccccgggcccggggtccccccgaagcgcgcaaggggaggtctgtgggacgatgacgacgccccgagaccatctcaattcgaagaggatctggctctgatggaagagatggaggccgaacaccgcctgcaagagcaggaagaggaggagctccagagtgtgctcgagggagttgccgatgggcaagtaccacctagcgccatcgatcctcggtggctaaggcccaccccgcctgctctagatcctcagacagaacctctgattttccaacaattggagattgaccattatgtgggccccgcccagcccgtaccagggggacccccgccgtctcgcggtagcgtaccggttcttagggcctttggcgttactgacgagggattctccgtgtgctgtcacatccacggctttgccccttatttctatacccccgcccctccaggatttggaccagagcacatgggcgacctccagagggaactgaacctggctatttcacgcgactcccggggcgggagagagctcaccgggcccgctgtcctggcggtggaactgtgttcaagagaaagcatgttcggctaccacggccacgggccatcgccctttctacgcatcaccgtagcgctgccgagactcgtcgcgccagctagacgcttgctcgagcaggggatccgggtggctggacttgggacgccgagctttgctccctacgaggccaacgtggacttcgagatacgctttatggtagacactgatatagtaggatgtaactggctggagctgccagccggaaagtacgcactgcgccttaaagagaaagccactcagtgtcagctggaggcggacgtcctctggtctgatgttgtgtctcatcctcctgagggaccgtggcagcgcattgctccccttcgagttctctcattcgatatcgagtgcgctggtcggaagggaattttcccagagcccgaacgtgatcctgtaatccagatatgttcactaggcctgaggtggggagagccagagcccttccttagactggcactcactctgaggccttgcgcccccattctgggggcgaaagtacagagttatgaaaaagaggaagaccttcttcaggcctggtccacctttattcggatcatggatccagatgtgattactggttacaatattcaaaacttcgacttgccttacctgatcagcagggcccaaacgctgaaggtccagacattcccattcctgggacgtgtggccgggctctgttctaatattcgggactctagcttccagtctaagcagacaggtagacgggacactaaggtggtctccatggtgggaagagttcagatggacatgttgcaggtgttgttgagagaatataagctgcggagttataccctgaacgccgtatcattccacttcctcggggaacaaaaggaagatgtacagcattcgatcatcacagacctgcagaatggaaacgaccagaccagaaggaggctggcagtgtattgtctcaaggatgcgtacttaccgcttcgcctcttggagcggctgatggtgttggtcaacgctgtcgagatggcgagagtgacaggtgttccactctcctatctgctgtccagggggcagcaggttaaggtcgtatcgcagctcctgagacaggctatgcacgagggcctcctgatgcctgtggtgaagagcgaaggcggcgaagactatactggtgctaccgtcatcgagccactcaagggttattacgatgtccctattgctacactggacttcagttcattgtaccccagtatcatgatggcgcataatttgtgctatacaaccctgctacggccaggtactgcccagaaactagggctgacagaggatcagttcatcagaacacccacaggagacgaatttgtcaagacgtcggttcgaaaagggctactgcctcagatcctcgaaaatctcctcagcgcccgcaaaagagccaaggccgaactggctaaagaaaccgacccccttcgcaggcaggttctggacggcaggcagctagcactgaaagtctccgccaatagtgtctacgggttcacaggtgctcaggtgggaaaactgccctgcctagagattagccagagtgttaccggctttggccgccagatgattgaaaagacgaaacaactggtggagagcaagtacacagtcgaaaacggatactcaaccagcgccaaagtggtctatggtgataccgattctgtgatgtgcagattcggggtaagcagtgtggctgaggcaatggccctgggtagggaagcagccgactgggtgtccggccacttcccctctcctattaggttggagtttgagaaagtgtattttccatacctcctaatctctaagaagaggtatgctggtttactcttcagcagtcggcccgacgcgcacgatagaatggattgtaaggggctggaggctgtgcgacgggataactgccctctcgtcgctaatctggtcacggcttcattgcgccggctgctgatcgacagggaccctgagggggccgtcgcccacgcacaagacgtgatttccgatctcctgtgtaataggatcgacatcagccagctcgtgataacgaaagaactcaccagggctgccagcgactatgctggaaaacaggcacacgttgagttagccgagaggacgcgttgcagctgttggtccacggcatgccctctgacacgatctacgacttggagctcatcttggccctccccttcatgtgcctccagcagtccttcttgggcaagggcggtgccccgcctgtgctattgtggcgggacaaccagagctgcacggcggtgttcccgcgctcgctgggctgcttcttggccaagtccaaatgctgcaacagcggctctcgcagccgctcagtgcagtgctacacgtgaaccttgcgtatcctccgccagtcccggaagcctgtcttgtattaggagacgttacccaatttag

SEQ ID NO: 129236 - DNA, 3324 bp, Artificial Sequence
  Description of Artificial Sequence: Synthetic coding sequence
atggatggcaaacggagacctggcccagggccaggtgtgcctccaaaaagggctcgcggaggactctgggacgatgatgatgccccacgtcctagtcaatttgaggaagacctcgctctcatggaggagatggaggctgagcaccggctgcaggagcaggaagaagaagaactccagtcagtactggaaggagttgctgacggacaggtgccacctagtgccatcgacccaaggtggctccgtccgaccccacccgccctcgacccgcagacagaaccattgatatttcagcagctcgaaatcgaccactatgtaggaccagcccagcccgtgcccggcggaccaccccctagcaggggatccgtgcccgtgctcagagcattcggcgtgaccgacgaaggttttagcgtgtgctgccacatccacggcttcgctccctacttctacacccccgcaccccctggttttggcccagaacacatgggagacctgcagcgcgagctcaacctggcaatcagcagagactccaggggtggaagggaattaactgggccggcagtcctggctgtcgagctctgctccagagaatcgatgttcggctaccatgggcatggaccatctccatttctgaggatcactgtggctctacctagactggtggcaccagccaggaggctactggagcagggcatacgagtcgccggcctgggcacacctagcttcgccccttacgaagctaacgtggacttcgagataaggttcatggtggacacggacattgtcgggtgcaactggctggagttacccgctggaaaatacgcactacggctgaaagaaaaggccactcaatgtcaactcgaagccgatgtcctttggtccgatgtggtctcgcacccaccggagggcccctggcagcgtattgccccccttcgggtcctatcatttgatattgagtgcgctggacgaaagggaatcttccctgagcccgagagagatcccgtgatacagatttgctcacttgggctccgatggggagagccagaaccgtttttacgactcgcactcaccctgcgaccctgcgccccaatcctgggcgccaaagtgcagtcctatgaaaaggaggaagacctactgcaggcctggagcacttttatcaggatcatggaccccgatgtgataacagggtacaatatccaaaactttgatctaccatacctgatttctagagcccagactttgaaagtgcagacctttccattcctcggccgggtagccggactttgctcgaatatcagagattcttcgttccagagtaagcagacgggtcgcagggacaccaaagtggtgtcaatggtagggagagtacagatggacatgctgcaggtcctcctgcgagagtataagctcaggagctatacattgaacgcagtcagcttccatttcctcggtgagcagaaggaagacgtacagcactccatcataacagacctgcagaatgggaacgaccagacccgccgacggctcgccgtatattgcctaaaggacgcctatctacccctacgacttctggaaaggctgatggtccttgttaacgcagtagaaatggctagggtcactggagtgcctctatcttatctgctgtcacggggccagcaggtgaaggttgtgtcacagctgctcagacaggctatgcacgaaggcctgctcatgccagttgtcaagagtgagggaggtgaggactacaccggcgccactgtcatcgaaccattaaaagggtactatgatgtcccgattgctaccctagatttctcttctctgtaccctagtatcatgatggcccacaatctttgttataccacactgttgcggccaggtactgctcagaagttgggtctcaccgaggatcagttcatccgtacacccaccggggacgaatttgtgaagactagcgtgagaaaagggctccttccacagatccttgagaacctcctgagtgctcggaaaagggcaaaggccgagctggctaaagagaccgacccgctgcggagacaggtgctcgatggaaggcaacttgctctgaaagtatcagccaatagtgtctatgggttcactggggcgcaagttggcaagttgccatgtctggaaatcagccagagcgtgacgggtttcggtagacagatgatcgaaaagacaaagcagcttgttgagagcaaatacactgtggaaaacgggtacagcacgtccgcgaaggttgtttatggagatactgactccgtgatgtgccgattcggcgttagttcggtagccgaggcaatggccctcggacgagaagcagcagattgggtgagtggccattttccgtcccccataagactggagttcgaaaaagtctattttccatatcttttgatttcaaagaaacgctacgcaggactgctgttcagtagccgccctgatgcccacgaccgaatggactgcaaagggctggaagccgttaggcgtgataattgccccctggtggccaatctggttaccgcctccctaaggcggctgctgatcgatagggaccccgaaggagccgtggcacatgcccaggatgttatcagcgatctgttgtgcaataggattgatataagtcaactcgtaatcacaaaggagctcacccgcgcagcatcggattatgccggtaagcaggctcatgtggaactcgcggagaggatgagaaagagggacccaggtagcgctccaagtctgggcgatagggtcccttatgtcattatctcagccgctaaaggcgttgccgcctacatgaagagtgaggaccccctcttcgtgctcgagcactcgctccctatcgatactcagtattatcttgagcagcagctggctaaaccccttctaagaatattcgagccaatcttgggggagggtagggcagaggccgtcctgcttaggggcgaccacacacgatgcaagaccgtcctgacaggcaaggtgggcggcctgctggcatttgccaaaagacgtaattgctgcataggctgtcgcacagtgcttagccaccagggggcagtttgtgaattctgccagccacgggagagtgaactgtaccaaaaggaagtgtctcatcttaatgccttggaggaacgatttagtcgcctctggactcaatgtcagcgctgccagggaagcttacacgaagacgtgatttgcaccagccgggactgccccattttctacatgaggaagaaagttcggaaggaccttgaggatcaggaacaactgctgcggcgcttcggaccccctgggccggaagcgtggtag

SEQ ID NO: 129237 - DNA, 1410 bp, Artificial Sequence
  Description of Artificial Sequence: Synthetic coding sequence
atgtttagtgagcaggctgcccagagagcacacacgctgctttcccccccttctgctaataatgccacatttgctagggtgcctgtggcgacatacacaaactcttctcagccctttagactgggcgagcggtcattttctagacagtatgctcacatctatgccactcgcttaatccagatgaggcctttccttgagaaccgcgctcaacaacactgggggagtggcgtaggcgtgaagaagctatgcgagctgcagcctgaggagaagtgctgtgtggtggggactttatttaaggctatgccgcttcagccgtctatcttgcgggaagtgagcgaagaacacaacttactgccccagccaccgagaagcaaatacatccatcccgatgacgaactggtactcgaagatgaattgcagcggatcaagttaaaagggaccatagatgtaagtaaactagttacgggcacagttctggccgtgtttggctccgttcgggatgacggcaagtttcttgtcgaagactactgctttgccgaccttgccccgcagaaacccgcccccccacttgacaccgataggtttgtactcctggtgtcaggtctcggcctaggaggaggaggcggagaatccttgctgggaacacagctgttggtggacgtagtgacaggccagctaggggatgagggggagcaatgttctgcagcacacgtgagccgcgttatcctagctggcaatctgctgagccactccactcaaagccgtgattccataaataaggcgaagtacttgacaaagaaaacacaggctgcttccgtcgaggcagttaaaatgctcgatgaaatcttattacagttgtctgcctctgtgcctgtggatgtaatgccaggagaatttgaccccacaaactatacccttccgcagcagcccctgcatccatgcatgtttccgctggcgactgcttacagtacactgcagctggttaccaacccgtatcaggcaactattgatggcgtccggttcctgggcacgtcggggcaaaacgtgtcggatatcttcaggtattcctccatggaggaccacctggaaattttagagtggacgctccgagtacggcatataagtcccactgcccccgacactttagggtgttatcccttttacaagaccgacccctttatttttccagagtgcccccacgtgtatttctgcggcaacactccttctttcggctcaaagatcatcaggggtcccgaggaccagaccgtgctgctggttaccgttccagatttcagcgccacacagaccgcttgcctagtgaatctgaggtcccttgcctgtcagcctatttcattttccgggttcggcgctgaagatgacgatttgggtggcctgggattggggccctag

SEQ ID NO: 129238 - DNA, 447 bp, Artificial Sequence
  Description of Artificial Sequence: Synthetic coding sequence
atgttctcagaacaggctgcccagagagcccatactctcctcagtcctccatcggccaataatgcaacattcgctagagtgcccgtcgcaacttacaccaactctagtcagcccttcaggctgggtgagaggagcttttcccggcaatatgcccacatttacgcaactagactcatccaaatgcggcctttcctggaaaacagagcccagcaacattggggctcaggcgttggggtcaaaaagctttgcgagctgcagcctgaggagaaatgctgtgtagtggggacccttttcaaggccatgccactgcaaccatctatcctcagagaagtgtcagaggagcacaacctcttgccacagccacctaggagcaagtatatacatccggacgatgaactagtgctggaagacgagctgcagcggatcaaactcaaagggaccatttag

SEQ ID NO: 129239 - DNA, 663 bp, Artificial Sequence
  Description of Artificial Sequence: Synthetic coding sequence
atgtttagtgagcaggccgcccagagagctcacaccctgcttagccccccatcagcgaacaatgctacatttgctagagtgcccgtggccacttatacgaactcatcacagccatttaggctcggcgaacgctcattttcgcggcagtacgctcacatctacgccactcgtctgattcagatgaggccattcctggagaatcgcgcccagcagcattgggggtcaggggtcggagttaagaaattgtgcgagttgcagcctgaggagaaatgctgcgtggtcggaacgctattcaaagctatgcctctgcaaccaagcattctgcgtgaggtgtcggaagagcacaacctgctgcctcagccgccacgatctaaatatatccatccagatgacgaattagtgctcgaagatgagctacagcggattaagcttaaaggcacaatcgacgtgagcaaacttgtcacaggcaccgtcctggcagtattcggttctgtgagggatgatgggaagtttttggtggaggactactgtttcgccgaccttgcacctcaaaaaccagcccctccactggataccgatcgatttgtgctcctggtgagcggattagggctagggggcggaggcggagaaagcctccttgggacccagcttttggtggactag

SEQ ID NO: 129240 - DNA, 1410 bp, Artificial Sequence
  Description of Artificial Sequence: Synthetic coding sequence
atgttttctgaacaggctgctcaacgggcccatacccttctttctcctccgtccgctaataacgctaccttcgctcgagtgcctgtagcaacatacaccaactcctctcagccctttagactgggtgaaagaagcttttccagacaatatgctcatatctatgcaacccgcctgattcagatgcggccgtttcttgagaatcgagcacaacagcactgggggtctggcgttggggtgaagaagctgtgtgaactccaacctgaggagaagtgctgcgtggtgggaaccctgtttaaagccatgcccctccagccctcaatcttgagagaggtgtccgaggagcacaatctcctgccacagccgcctaggagcaagtacatccaccccgacgatgaattggtcttggaagacgagttacagaggattaagctgaaaggtacaattgatgtgtccaagctggtgaccggaaccgtcttggccgtcttcggctcggttcgcgacgacgggaagttcctggtcgaggactactgcttcgccgacttggccccacagaagcctgccccgccactggataccgataggttcgttctgctcgtgagcggactgggactaggcgggggcggcggggagtcactgttgggaacccagcttctggtcgacgtggtgaccggccagctaggggatgagggcgaacaatgtagcgcagcccatgtttctcgcgttatcctggcgggtaatctcctgagccactctacccagtcaagggactccataaacaaagcgaagtatctgacaaaaaaaactcaggccgcttcagtggaagccgttaaaatgctggatgaaatactcctgcagctgagcgctagtgtcccagtagatgtgatgccaggagaatttgatcccaccaactacacattgccccaacagcccctccacccttgcatgttcccactagcaacagcctattcaaccctacagctggtcactaatccataccaggcgacaatagacggcgttagatttctgggtacaagtggccagaacgtctcggacatctttcgatactcctcaatggaagatcacctggaaattctagagtggacccttcgcgtgagacacatctctccaaccgcccccgatacattagggtgctaccccttctataagacagatcctttcatatttccggagtgtccacatgtctacttttgcggcaacacccctagcttcggatctaagataattcgcggcccagaggatcagacagtcctgcttgtaaccgttccagatttttctgctacccaaactgcttgtctggtgaaccttagatcgttagcttgccagcctatcagtttcagcggcttcggcgctgaggatgatgacctgggcggcctgggactgggcccatag

SEQ ID NO: 129241 - DNA, 468 bp, Artificial Sequence
  Description of Artificial Sequence: Synthetic coding sequence
atgttctccgaacaagctgctcagagagcacatactttgttgtctccaccctcggcaaacaatgccacattcgccagagtcccagtggctacgtataccaactcttcccagcccttccgtctcggcgagcgctcatttagtaggcaatatgctcatatttatgccactaggcttatccaaatgcggccgttccttgagaatagagcacaacagcattggggatctggggttggagtaaaaaagctctgcgaactacagcccgaagaaaaatgttgcgtggtcggtaccctctttaaagccatgcctttgcagccttctatcctgcgcgaggtcagcgaagagcacaacctgttaccccaacctccacggtccaaatatatccaccccgatgacgaactggttctcgaagacgagctccagaggatcaagttaaaagggactattgatgtatccaaattagttacctag

SEQ ID NO: 129242 - DNA, 771 bp, Artificial Sequence
  Description of Artificial Sequence: Synthetic coding sequence
atgttccccgtgctgcctgggagtcatttgttgttgaataatcctgccctggaattcattaaatatgtctgtaaggtcctctccctcgacacaaatatcaccaaccaggtgaacaaactcaacagagatctgctgcgcctggtcgacgttggcgagtttagcgaagaggcccagtttcgcgacccctgcagaagttacgtcttgcctgaagtcatttgcaggtcatgcaacttttgtcgtgatctcgatctgtgcaaggactcatccttctcagaagatggtgcagttctaccacaatggctatgctctaattgtcaggcaccctatgattcctcggccatagaaatgacgctggtcgaggttctgcaaaaaaaactgatggcgtttaccctgcaggatctgaaagaggccgataccccgaaatgtgaagaaaaagagcgtcgcaaacgcgagctgcatagctccgccaccggcagaagctgtaggggggcctctgaacagagactgggggacgcaccctcctgccgagtggttgtgcacggggtgcaagcctgtaggatggaaggagtgtgcttgaagtgccgcggcgttaaggagacctctatgcccgtatattgcagttgcgctggagactttgccttgactatccacacacaggtttttatggagcagatagggatcttccgtaacattgcgcagcattacggaatgtcatacctcctggagacccttgagtggttactgcagaaaaatccccagctgggccactag

SEQ ID NO: 129243 - DNA, 6861 bp, Artificial Sequence
  Description of Artificial Sequence: Synthetic coding sequence
atgtcgttgaggtctggcggccggagacgggccgaccctggcgctgacggagaagcatctagggacgatggtgctaccagttcggtgagcgccttgaagcgcttggaacgatcccagtggaccgacaaaatggatcttaggttcggctttgaacgtcttaaggagcccggggagaagacaggatggttaatcaacatgcacccgaccgagatactggatgaagacaaacgactgggctccgccgtagactactactttatccaggatgatggcagcaggtttaaggtggcactcccttataagccctatttttatatagctaccaggaagggatgtgaacgggaggtctcgagtttcctgagcaagaaattccagggaaagatagcgaaagtggagacagtgccaaaagaggacctcgatttgccgaaccaccttgtcgggcttaagcggaattacattcgactgtctttccacactgtggaagacctcgtcaaagtccggaaggagatttcaccagccgtcaagaagaaccgcgagcaagaccacgcgtcagatgcgtatactgcactgctttcatccgtgctgcagaggggtggagtgattaccgacgaggaggagacttccaaaaaaatcgccgatcagctggataacatcgtggacatgcgggagtacgacgtgccttatcacattagactcagcatcgacctcaaaatacacgttgcacactggtataatgtcagatataggggaaatgcctttcctgtggaaattacccgccgtgacgatcttgtggagagacccgaccctgtggtcctcgcatttgatattgagaccaccaagctgcccctcaagttcccggatgcggagacggatcagattatgatgatcagttatatgatcgacgggcagggttatctgatcacaaatcgcgaaatcgtttccgaggacatcgaggacttcgaattcacccccaaacctgaatatgaagggccattctgcgtgtttaatgagcctgatgaggcacacctcattcagcggtggttcgagcacgttcaggagactaagcctacgattatggtgacgtacaacggtgactttttcgactggccatttgtggaggcccgggctgccgttcacgggctgtccatgcaacaagagatcggtttccaaaaggacagtcagggcgagtacaaggcgccacaatgtatacacatggactgcctgcgctgggtgaaaagggattcgtatctgccggttggctcccataacctgaaggcagccgctaaggcaaagctggggtacgatccggttgagctggatccagaggacatgtgtaggatggctacggagcaaccacagacacttgccacttacagcgtcagcgacgctgtcgcaacgtactacttatacatgaagtatgtgcatccatttatctttgcattatgtacaatcatacccatggaaccagacgaagtcctgcgaaagggcagtgggacactctgtgaggccctcctgatggtgcaggcatttcacgcaaacatcatcttcccaaacaaacaagaacaggaatttaacaagcttaccgatgatggccacgttctggactcagagacgtatgtcgggggccacgtcgaagcacttgagagtggagtgttccggtcagatatcccatgcaggttcaggatgaaccctgcggcgttcgactttctgcttcagagggtcgaaaagaccctgagacatgcactggaggaggaagagaaagtcccagtcgagcaggtaactaattttgaagaagtgtgcgacgaaatcaaatctaagctggcctcattaaaagatgttccttccagaatcgagtgccccctgatctatcacctagatgtcggcgccatgtacccgaatatcattcttacaaatagactacagccgtcagctatggttgacgaagccacttgtgctgcctgtgactttaacaagcccggagcaaattgccagagaaagatggcttggcagtggcgcggagagtttatgccagcatctagatctgaataccatcggattcaacaccagctggagtctgagaagtttcctccactcttcccagaagggccagctagggccttccacgagctgtcacgtgaagagcaggccaagtatgagaaacggagacttgcagattactgcagaaaagcctataagaagatccatatcaccaaagttgaggaaagactgacaactatctgtcagcgggagaactcgttctacgtcgataccgttcgtgcattccgggatcggagatatgagtttaaaggcctgcataaggtctggaaaaagaagctttcggctgccgttgaggtgggcgacgcggccgaggttaaaaggtgcaaaaatatggaagtcctgtacgactccctgcaattggcccataagtgtattttgaatagtttttatggttacgttatgcgtaagggcgcaaggtggtacagcatggaaatggctgggatcgtttgctttacaggagctaatattattacacaggcaagggagctcattgagcaaatcggccggccgctggagctcgacactgacggaatttggtgtgtcctccctaattccttcccagagaatttcgtgtttaaaacaaccaatgtcaaaaaaccaaaggtgactattagttaccccggggccatgcttaatattatggtcaaggagggctttaccaacgatcaataccaggaattagcagaaccatcatccctcacatacgtcactagaagcgagaactcaattttcttcgaggtggatggcccttatctcgccatgatcctccccgcatccaaagaagaaggaaagaagcttaagaagagatatgccgtgtttaatgaagacggttctctggcagagttaaaaggtttcgaggtgaagcgaaggggtgagctccagctgataaaaatctttcagagttccgtcttcgaggcatttctgaaagggagcacactcgaagaggtttatggtagtgtggctaaggtagcggactactggctggacgtgctgtacagcaaagccgctaacatgcctgatagcgagctttttgagctcataagcgagaaccgctccatgagccgcaagcttgaagattacggcgaacaaaaatcaacctccatttctactgctaaacgactcgccgagttcctgggcgaccagatggtgaaagatgctggcctgagctgtaggtacataattagccggaaacccgaaggaagcccagtgacagagagagctatcccacttgccatctttcaggccgaaccgacagtcagaaaacatttcttgcgaaagtggttgaagtcctcatccttgcaggactttgatataagggcaattctggactgggactactacatcgagcgcctaggttctgccatccagaagataattactatcccggccgcattacagcaggtgaagaaccctgtgccacgagttaagcatccagattggcttcacaaaaaattgttagaaaaaaatgacgtctacaaacaaaagaagatatcggagctcttcaccctggagggtcggcggcaagtgactatggccgaggcgtcagaggacagccccaggcccagcgcgcccgacatggaggactttggactcgtgaagcttccacatccagctgccccagtgactgtcaagaggaagcgtgtgctgtgggaaagtcaagaagaatcccaggacctcacgcctacggtgccttggcaggagatcctcgggcaaccaccagcactcggcacctcacaggaagaatggttagtctggctgagattccacaaaaagaagtggcagttacaggcccgtcagagattagctcgacgaaagcgccagagactagagtctgcagaaggggtattaagaccaggtgcgatccgggacggacctgccacgggcttgggttcttttctgcggcgcacagcaagatccatcttggatctaccatggcagatcgttcagatatccgaaactagccaggctggccttttcagactgtgggctctggtcggcagcgatcttcattgtatccgcctgtctatccctagagtgttttatgtgaatcagcgggtggccaaggccgaggagggtgcatcttatcgaaaagtgaaccgcgtgctcccacggtccaacatggtctacaacctgtacgaatacagtgtgccagaggacatgtatcaggagcatatcaatgaaatcaacgctgagctgagcgcccctgacatcgaaggagtgtacgagacccaagtgcccctattgttcagagctttggtacatctgggctgtgtctgcgtggtaaataagcaactggtgcgacacctttccggctgggaagccgaaacatttgcccttgaacatcttgaaatgaggagcctcgctcagttctcttatttggaacctggctcaattcgccacatatatctttaccaccacgctcaagcccacaaggcccttttcggtatcttcataccaagccagcggcgtgcttcagtgtttgtgctcgacaccgttagatccaatcagatgccatctttaggcgcactgtactccgcagagcatgggttgctgcttgagaaggtagggccggagctattgcccccacccaaacatacgttcgaggtccgtgccgagacagacctcaaaaccatttgcagagcaattcaaagattccttttggcctataaggaggaacgcaggggccccactttgattgcagtgcagtctagctgggaactcaagcggctggcctccgagatccctgtattggaagagttccccttagtacccatttgtgtggccgacaagatcaattatggggtactggactggcagcggcacggtgctcggagaatgattcgacattatctgaacttagatacgtgcttgtctcaggcatttgagatgtcccggtattttcacatacctatcggaaacctcccagaggacataagcactttcggaagcgatctctttttcgcccgccacttacaacgccacaatcacctcctttggctttcaccaaccgcacgaccagacttagggggtaaagaggccgacgacaactgcctcgtaatggagttcgacgaccaggccacagtcgaaattaatagttctggttgctactccacagtatgtgtggagctcgatctgcagaatctggctgtcaacactatccttcagtcccaccatgtgaatgacatggaaggcgcagattccatgggcattagtttcgatgtcatccagcaggctagtctcgaagacatgattactgggggccaggcagcttcagccccagcgtcatatgatgaaaccgctctgtgcagtaataccttcagaatcctgaagtcaatggttgtaggctgggtgaaggaaatcacccaatatcataacatctacgccgacaatcaggttatgcatttctacagatggctcaggagccccagcagcttacttcacgacccggccctgcacagaacccttcacaatatgatgaaaaagctgtttctccagttgatagctgagtttaagcgcctcggctcaagcgtgatttacgcaaatttcaatcgtatcatcctctgcacaaagaagagacgtgtcgaagacgctattgcctatgtggagtacatcaccagctctattcactcaaaagaaaccttccattctctgacgatttcctttagccggtgttgggagtttctgctgtggatggacccttcgaattatgggggaattaaggggaaggttagtagccggatccattgtggtcttcaggattctcagaaagcagggggagccgaggatgaacaggaaaacgaagatgacgaggaggagcgcgacggagaggaggaggaagaggccgaggagtctaacgtggaggacctcctcgaaaataactggaatattttacagttcctgccacaggccgcttcttgtcagaactatttcctcatgatcgtgtcagcctacatcgtagccgtataccactgcatgaaagacggactgaggcggtccgcccctggctccactccggtgagacgtcggggcgcatctcagctgtctcaagaggccgagggggcggtcggggccctgcctggaatgatcaccttctcccaggactacgttgccaacgaactgacccaatccttctttacaatcacgcagaagattcaaaagaaggttacaggatcaagaaactccaccgaactaagcgaaatgtttccagtgctccccggatctcatctgctactcaacaatcccgcactggaatttatcaagtacgtgtgcaaagtcctctctttggacaccaatatcaccaaccaggtaaacaagttgaacagggatctgctgaggctagtcgatgtgggcgagttttctgaggaggcgcaattccgcgacccatgccgctcgtacgttttgcccgaggtcatatgcagatcctgtaacttctgcagagatcttgatctctgtaaggactcttcctttagcgaggacggagcggtcctcccccagtggctgtgttccaactgccaggcgccatatgactctagtgctatcgagatgaccctggtggaagtactgcagaagaagttaatggcgttcacactccaggacctggtgtgcctgaagtgccggggcgtgaaggaaacatctatgccagtctattgttcatgcgctggagattttgctctgactatccatacacaagtgtttatggagcagattggcatcttccgcaatattgcccagcactacggaatgtcttatctgcttgaaaccttggaatggctgttacagaagaatccccagctcggccattag

SEQ ID NO: 129244 - DNA, 3330 bp, Artificial Sequence
  Description of Artificial Sequence: Synthetic coding sequence
atgcaccctaccgaaattctggacgaagataaacgtttggggagtgctgtggactactatttcatacaggacgacggttccagatttaaggtagccctaccttataaaccatatttctatattgcaactcggaaaggttgcgagcgggaggtctctagctttctcagtaaaaagtttcagggaaagatcgccaaggtagaaaccgtcccaaaggaagatctggacttaccaaaccatctggttggcttaaaacgcaattacatcaggctgtctttccacacagttgaagacctcgtaaaggtaaggaaagaaatcagtcccgctgtcaaaaaaaaccgcgaacaagatcatgcaagcgacgcctatacagctctgctgtcttctgtcctccagcgcggcggggtcattaccgacgaggaggagacctccaagaaaatcgcggaccagctggacaacattgtggacatgagagagtatgacgtaccctatcacatccggttatctatcgatcttaaaatccatgtggcccactggtacaatgtgagatacaggggaaacgcatttcctgtggagatcacgcgaagagatgacctggtggaaagacctgaccccgtcgtacttgcctttgacattgagactacaaagcttccgttaaagtttcccgatgcagagacagaccagatcatgatgatctcctatatgatcgacggccaaggataccttatcactaaccgggagatagtctctgaggacatagaagactttgagttcacgcccaaaccggagtacgagggccccttttgtgtctttaatgaaccggatgaggcccacttgatccagcgctggttcgaacatgtccaggagacgaagcctaccattatggtgacgtacaatggcgacttctttgactggccatttgtggaggcccgggcggccgtgcatgggctttcaatgcaacaagagattggctttcaaaaggattcgcagggcgaatataaggcaccccagtgtatccatatggactgcctgcggtgggtaaagcgcgattcatatctgccagtgggtagccacaacctcaaggcggccgcaaaggccaagctgggttatgaccccgtggaactcgaccctgaggacatgtgtcgtatggccacggaacagccacagactctggccacttatagtgtaagcgacgcggtggcgacgtactatctgtatatgaagtatgtgcaccctttcatctttgcattgtgtacaataattccgatggaaccggatgaggtcctgaggaaaggctctggaactctgtgtgaggccctgcttatggtccaggctttccacgccaatatcatttttccgaacaagcaagagcaagaattcaataaattaaccgacgatggacacgtgctggactccgaaacatacgtgggcggccacgttgaggctttggagtccggtgtgtttcgatctgacattccctgtaggtttaggatgaaccccgcagccttcgatttccttttgcaaagagttgaaaagacactgagacatgcattagaggaagaggaaaaagtgcccgtcgagcaagttaccaacttcgaagaggtatgcgacgaaattaagtcaaagttagcaagcctcaaggacgttccttcgcgcatcgaatgtccactcatttaccatctcgatgtaggcgctatgtaccccaatatcattttgaccaataggctgcagccaagtgctatggtggacgaggcgacttgcgcagcctgcgatttcaacaagccaggggccaactgccagcggaagatggcatggcagtggcgaggagagttcatgcccgcctccaggagtgaatatcaccggatccagcaccagctggaaagcgaaaagtttccccccttgttcccagagggtcccgctagggctttccacgagttaagcagagaagaacaagccaaatacgaaaagagaagactcgctgattactgccgcaaagcatacaagaagatccatattaccaaggttgaagaacgccttaccacaatttgccagagagaaaatagtttctatgtggacaccgtgcgtgcctttagagaccgtagatacgagtttaaggggttgcacaaggtgtggaagaaaaagttatccgcagcggtggaggtgggcgacgcggcagaagttaagcgatgcaaaaatatggaggtcttatacgacagcctgcaattagctcacaagtgtatactcaattccttttacggatatgtgatgcgaaaaggggccagatggtactctatggagatggcagggattgtgtgctttacaggagccaatatcatcactcaggcacgagaattgatagaacaaatcgggcgcccgctcgaactggacacagacggaatctggtgcgtcttgccaaactcatttcctgaaaacttcgtctttaaaaccaccaacgtgaagaagcccaaggtcaccattagttatccaggcgctatgcttaatatcatggtcaaagagggtttcacaaacgaccagtatcaggaactggcagagccttcatctctcacctacgtcactagatctgagaatagcatcttcttcgaagtcgatggcccttatctggcgatgatcctgccagcatcaaaggaagagggaaagaaactgaaaaagcgttatgcagtcttcaatgaggatggcagccttgcagaattaaaagggttcgaagtaaagcgtcggggagaactgcagctgattaagatctttcaaagctcagtgttcgaggccttcctgaaaggctctaccttggaggaagtatacggctccgtggcaaaggtggctgactactggttggacgttttgtatagcaaagctgcaaacatgcccgactcagaattgttcgaactgatctctgagaatagaagtatgtcgaggaaactggaggattatggggaacagaagagtactagcatatctaccgccaagcgcttggcagaatttctgggcgaccagatggtaaaggatgctggcttatcctgcaggtacatcatctcgcgaaagccagaggggagtcctgtgactgaacgggctattcctctggctatctttcaggccgagccaacagtacgaaagcacttccttaggaagtggctgaagagctctagcctgcaggacttcgacatccgagcgattctcgactgggactactacattgagaggctggggtcagctatccagaagataataacaattcccgcggccctccagcaagtgaagaatcccgtcccccgggtaaaacaccccgattggctgcataagactgccggcgaggaatag

SEQ ID NO: 129245 - DNA, 1491 bp, Artificial Sequence
  Description of Artificial Sequence: Synthetic coding sequence
atggagggcattctcaagagcatggtggtcggctgggtcaaagaaattacacaatatcataacatttacgccgacaatcaggtgatgcacttttacagatggctccgttcaccaagctctctgcttcacgatccagctctgcaccgaactttacacaatatgatgaagaaactgtttctgcagctgatcgccgagtttaagcggcttgggagctcagtaatctatgccaactttaatcggattatcctctgcaccaagaaacgaagagttgaagacgctatcgcttatgtggagtacattacttcaagtattcattccaaggagacattccacagcctcacaatttcttttagccgctgctgggaattcctgctttggatggaccccagcaattacggtggtattaagggtaaggtgtcgtcgcggatacactgtggacttcaggattctcaaaaagccggaggcgccgaagatgagcaggaaaatgaggatgacgaggaagagcgagacggggaggaagaggaggaagcagaagaatccaacgtagaggatctcctggaaaacaattggaacatcctgcagtttctgccccaggccgcctcctgtcagaattattttctgatgatcgtatctgcatacattgtggctgtctaccactgcatgaaggacggtctgaggcgaagcgctcccgggagcacgccagtgcgccgaaggggcgccagccaattgagtcaggaggcagagggggcagttggcgcactcccaggcatgatcactttttctcaggattacgtggccaatgagttgacacaaagttttttcactatcactcaaaagatccagaagaaggtgactggatctcggaactcaactgagctgagtgagatgttccctgtgctgcccggttctcatctgctgctaaacaatccagccttggaattcattaagtacgtgtgcaaagtgctttcactcgacaccaacatcactaatcaggtaaacaaactgaatcgtgacctgctccgtctggtcgacgttggtgagttctccgaagaggcccagttccgcgacccctgcaggtcgtatgttctgccagaggtgatatgcagatcttgtaatttctgcagggacttagacctctgcaaagatagctccttctctgaagatggcgcggtgctaccccagtggttatgttctaactgccaggctccctatgatagtagcgcaattgaaatgaccctggttgaagtcttacagaagaaactaatggccttcactctccaagacctggtgtgcctgaaatgccggggcgtgaaggagacctctatgcccgtgtactgctcgtgcgctggggacttcgcgttaactattcatacccaggtgtttatggagcagatcggaatctttaggaacatcgcccagcattacggtatgagttacttgttggagaccctggaatggctactccagaaaaatccacagttggggcactag

SEQ ID NO: 129246 - DNA, 6894 bp, Artificial Sequence
  Description of Artificial Sequence: Synthetic coding sequence
atgtcgagacctttggggttgaagtcctttccacgacacaagcaggccccgctgccgctgtctctgacattccacggctgcctcttactaaggagagatgatggtgccactagttcggtgagtgcactgaagagactggagaggagccagtggacagataagatggacttgcggttcggtttcgagagactgaaagagccaggagagaaaacaggctggctcatcaatatgcacccaacggagattctggatgaagataagcgtctcggtagtgcagtagattattactttatacaggatgatgggagcagatttaaagtggcattgccgtacaagccctatttttacatcgcgacccgcaaaggctgtgaacgagaggtgagctcgttcttgagcaagaagttccaagggaaaatcgcaaaagttgagactgtaccaaaggaggatctggatctgcctaatcatctggtcggtttgaaacgcaattatattagactgagcttccacacggtggaggacttggtcaaggtacgtaaggagataagccctgcagtgaagaagaatagagagcaggatcacgcttccgatgcttacactgccctgctttcatctgtgctacagagaggtggcgtcatcaccgacgaagaagaaacgagtaagaagatcgcggatcagctggacaatatcgttgacatgcgggagtatgatgtgccttaccacatcagattgtctattgatctcaaaattcatgtggctcattggtacaatgtgagatatcgggggaacgcctttccagtggagatcacgaggagagacgacctcgtggagaggccagatcctgtggtgctcgcgttcgacattgaaaccacgaaactgcctcttaagttccctgacgccgaaacagatcagatcatgatgatcagctatatgatcgatggccagggatatcttattactaacagagaaatcgtgtcagaggatatcgaagactttgagttcaccccaaaaccggaatacgagggacctttctgcgtgttcaacgagcccgacgaggctcatttaattcaacggtggttcgaacacgtccaagaaactaaaccaactattatggtgacttacaatggggattttttcgactggccattcgttgaagctagagcagctgtacacggtctctctatgcaacaggagatagggtttcaaaaggattcccagggcgagtacaaggcaccgcagtgcatccatatggactgcttacgctgggtcaaacgcgactcttacctgccagtcgggtctcacaacttgaaggctgccgctaaagccaagcttggctacgatcctgtggaattggacccagaagatatgtgtagaatggcaactgagcagccccagacattggcaacctacagtgtatctgatgctgtggcaacctactacctgtatatgaagtatgtgcatcccttcatcttcgcactgtgcacgattattcccatggaacccgacgaagtcctccggaaggggagcggtactctgtgcgaggcccttctgatggtccaagcgtttcacgctaacatcattttcccaaacaagcaggagcaggagttcaataaactgaccgatgatggccatgtgctggatagcgaaacctatgtgggtggtcatgtggaggcattggaatctggcgtgtttcggtccgacataccttgccgatttaggatgaatcctgccgctttcgacttcttgctgcagagggtggagaagacactgaggcatgccttggaggaggaagaaaaagtgcccgttgagcaggtgacaaattttgaggaggtgtgcgacgaaataaaaagtaagctcgccagtcttaaggacgtaccttcccgtatcgaatgtccattgatttatcacctagatgtgggcgcgatgtatccaaatatcatcctgacaaacagactgcagccatcagctatggttgacgaggcgacttgtgcggcttgcgattttaataagccaggcgctaactgccaaaggaagatggcctggcaatggcgaggggagtttatgcctgcctccaggtccgagtaccataggatccaacatcagcttgagagcgagaaattccccccactgttccctgaagggccagcaagggcctttcacgaactctcccgagaagagcaggccaagtatgaaaaacggaggcttgccgattactgccgaaaagcatacaagaagattcacatcaccaaagtggaggaaaggcttactactatatgtcagagagagaactccttttacgtggatacggtgcgagcatttcgtgataggcgctacgagttcaagggtttgcataaggtttggaaaaaaaaacttagcgcagccgtggaggtcggagatgcagcagaagtgaaaagatgtaaaaacatggaggtcctatacgacagtctgcagctggcccacaaatgtatactgaatagcttctacggctacgtcatgagaaaaggggcgcgctggtatagcatggaaatggccggcattgtgtgctttacaggggccaacattatcacccaggcccgggagctcatcgagcagatcggtagaccccttgagctggatacagacgggatctggtgtgttttgcctaattccttcccagaaaatttcgtatttaaaaccacaaatgtaaaaaaacccaaggtcaccatcagctatcctggggccatgctgaacatcatggtcaaggaaggattcaccaacgaccagtatcaggaactggcggagccttcaagtctgacctacgtcacacgctccgagaactctatcttcttcgaggtcgacgggccttacctcgctatgattctgcctgcaagcaaggaagaagggaagaagctcaagaaacgttacgcggtgttcaatgaggacggatccctcgcagaattgaagggctttgaggtgaagaggcgcggagaattacagctgatcaagatttttcagtccagtgtgttcgaagcgtttctcaaagggagtacgctggaagaggtctatggaagtgtggcaaaggtggctgactactggttggatgttctatactctaaggctgccaatatgcctgattcagagttgttcgaactgatttctgagaatcggtcaatgtcccgcaaacttgaggattacggcgagcagaaatctacatcgatctcaactgctaagcgcttagctgagtttctaggagaccagatggtgaaagacgctggactttcctgtaggtatattatcagtagaaaacctgaggggagcccagtgaccgagagagctatcccgctcgctatcttccaggctgaacctactgtgcggaagcacttcctccggaagtggctgaagtccagctcgttgcaggattttgacattagagctattctggactgggattattacattgaacgattaggatcggccattcaaaagattatcacgatcccagcggccctgcagcaggtgaagaatccagtcccccgggtaaagcatccggactggctccataaaaaactgctggagaaaaatgacgtttataagcaaaaaaaaatctccgaactgttcacccttgaggggcgcaggcaagtgaccatggctgaggcctcagaagacagtcctaggcccagcgcgccggacatggaagatttcggtctggtcaagctgccgcacccagcagcacctgtcacggtcaaacgcaagcgggttttgtgggaatcccaggaggaaagtcaggatctgactcctaccgtcccctggcaggagatccttgggcagcctcctgcattgggtacatctcaggaggagtggcttgtgtggctccgcttccacaagaagaaatggcagctgcaggccagacagcgcttagcgcgccgaaagagacagcgactcgaaagtgctgagggtgtacttcgccctggtgccatccgcgatggcccggcaaccggactcggatcctttctccgccgaaccgcccggtcaattctcgatttgccctggcagatagtgcagatctcagaaacgagtcaagctggtctgttccgcctctgggcactcgtggggtctgatttacattgcattagactatcgattccacgggtcttttacgtcaaccagcgggtggccaaggctgaggagggagcttcatatcgtaaagtgaaccgtgtattgcccaggagcaacatggtttacaatttgtatgaatacagcgtgcccgaggatatgtaccaggagcatatcaatgagatcaacgctgagctgtccgcacccgatatagagggagtatatgagacccaggtccccctgctgttcagggcactggtccacctgggctgcgtgtgcgtggtgaacaaacagcttgtcagacacctttctgggtgggaggccgagaccttcgccctggagcacctggagatgaggtccctcgcgcaattctcttatttagagccgggctctatcagacacatctacctgtaccaccacgcacaggcccacaaggctctattcggcattttcattccaagccaaagacgcgcctcagtcttcgtgttggatactgtccggagtaatcagatgccctcactcggagctctgtactccgctgaacacgggctgctcctggaaaaggtcggaccagaactactgccaccaccaaaacataccttcgaagttagggcagagaccgacttgaagaccatctgccgggctatacagaggtttttattagcttacaaggaagagaggcgcggccccaccttgatagccgtccagtcctcctgggaactgaagagactggcctcagagatccccgtcttagaggagttccccttggtgccgatctgcgtcgcggataagatcaattacggtgttctggactggcagagacatggtgccaggcgaatgattagacattatctcaacctggacacatgtttaagtcaggcattcgagatgtctcgctattttcacatccctatcggaaacctgccagaagacatctccacatttgggagcgacctcttttttgctagacatctgcagcggcataatcacctgttatggctctcaccaactgcccgcccggatctgggcgggaaggaagccgacgataactgcctggtcatggagtttgacgaccaggctacagttgaaattaattctagcggctgttacagtaccgtgtgcgtggagctggatctccagaatctagcggtgaacaccattctgcaatcccaccacgtcaacgacatggaaggcgccgactccatgggcatctctttcgacgtgatccagcaggcaagcttagaagacatgattaccggcggtcaggccgcatctgctcccgcttcatatgatgagactgccctctgctccaacactttccgcattctgaaaagcatggtcgtcggttgggtcaaagaaattacccagtatcacaacatttacgccgacaatcaggtgatgcatttctaccgctggcttcgcagccccagttcactgcttcacgatccggcactgcacaggaccctacataacatgatgaaaaaactgttcctccagctcatcgccgagtttaagcgcctgggatcgagtgtcatatacgccaattttaatcggatcatcctttgcacaaaaaaaagaagggtcgaggacgctatcgcttacgtagagtatatcacatccagtatacattccaaagagactttccactcacttacaatttctttcagtagatgttgggagttcctactgtggatggatccttccaactatggtgggatcaaggggaaggtatcatcacgcatccattgtggattgcaagattctcagaaagctggcggcgccgaggacgagcaggagaatgaggacgacgaggaggagcgtgatggggaggaagaagaggaagctgaagagtcaaatgtagaggatctactcgagaacaattggaacatactccagtttctcccccaagcagcaagctgccagaattacttcctcatgatcgtttccgcatacatcgtggctgtgtaccactgcatgaaggacggcctccgaaggtctgcccctgggtcaacccccgtgcgccgtcgcggcgccagccagctaagccaagaggccgagggtgccgtgggggccctccccgggatgatcacgttttctcaggactatgtcgccaatgagctgacccagagtttctttacaattactcagaaaatccagaagaaagttaccggttccagaaacagcactgagttgtctgagatgttcccagtcctcccggggagtcatctcctactgaacaatcctgctcttgagttcattaagtatgtctgtaaggtcttatccttggatactaacataactaatcaggtcaataaactgaatagagatttgctgagattggtcgatgtaggagaattcagtgaagaagcacagttcagggacccttgccggagctacgtccttccggaggtgatatgcaggtcttgtaatttctgcagggatctggatttatgcaaggactcaagcttctcagaggacggcgctgtactgccacaatggctctgctctaactgccaggctccatacgactccagcgcaatagaaatgaccctggtcgaggtgctccaaaagaagctgatggcattcactctgcaagatttggtctgcctcaagtgccgtggcgttaaggagacaagcatgcccgtctattgctcgtgtgcaggagactttgctctcacgatccatactcaggttttcatggaacaaatcggtattttcaggaacatagcgcagcattatggcatgtcctacttgcttgagactctggaatggctcctgcaaaagaatccccagctaggtcattag

SEQ ID NO: 129247 - DNA, 6780 bp, Artificial Sequence
  Description of Artificial Sequence: Synthetic coding sequence
atgagtctccgttcaggtggccggagacgggccgatccaggggccgacggcgaagcctccagggacgacggcgccacatcctccgtgtctgcactgaagcggcttgaacgttcccagtggaccgataaaatggatttgcgtttcggattcgaaagactgaaggagcccggcgaaaagactggatggttaataaacatgcaccctgtggccctcccatataagccctatttctacatcgcaacacgcaaaggctgtgaacgcgaagtatcatcatttcttagcaagaagtttcaaggtaaaatcgccaaagtcgagaccgtcccaaaagaagatttggacctgccgaaccacttggttggactcaagcgtaactacatcagattaagctttcacactgtggaagatttagtgaaagtgagaaaagaaatttctcctgccgtgaagaagaatcgggagcaagaccatgcctccgatgcttacaccgccttgctttccagcgtgcttcaacgcggcggagtgattacggacgaagaggaaactagcaagaaaattgcagatcagctggacaacatagtggatatgcgcgaatacgacgtgccttaccatattaggttatccatcgatctgaagattcatgtagcccattggtataacgtgaggtaccgcgggaacgccttccccgtggaaatcacacggcgcgatgatttggttgaacgcccagatccagtcgtactcgccttcgacatcgagaccacaaagctcccactgaaattccccgatgcagaaaccgaccagatcatgatgatttcctacatgatcgacggccaaggttatctgattactaatcgggaaattgtctctgaggatatcgaagacttcgaatttacacccaaacctgaatatgaaggtcccttttgcgttttcaatgaaccagacgaggcacacttaatccagagatggttcgaacacgtgcaagaaacaaagcccactattatggtcacttacaacggcgatttttttgattggccgtttgtcgaagcccgtgccgctgtgcacgggctgagtatgcagcaggagattgggtttcagaaggacagtcaaggtgagtacaaggctccacagtgtattcatatggactgtctccgctgggtcaagagggacagctacctgcccgtaggctctcataacttgaaggccgctgcaaaagccaaactgggatatgaccccgtcgagctggaccccgaggatatgtgcaggatggctaccgagcagcctcagaccctggcaacttatagcgtaagtgatgctgtggctacgtattatctgtatatgaagtacgtgcatccctttatatttgctctgtgcaccataattcctatggagccggatgaagtcttacgcaaaggatccgggacactttgtgaggccctgctgatggtgcaggcttttcacgctaatatcatcttcccaaacaagcaagaacaagaattcaacaaactgacagatgatggccacgtcctggacagtgaaacctatgtgggtggccatgttgaggccttggagagtggggtgtttcggtccgacattccatgccggttcaggatgaacccagctgcttttgacttcctgctacagagagtggagaagactcttaggcatgctcttgaggaagaggagaaggtacccgtagaacaagtgactaatttcgaggaagtgtgcgacgaaataaagtccaagcttgcatcgttaaaagatgtaccctcacgcatcgagtgccccctcatctaccatctcgatgtaggggctatgtatccaaacattatcttgacaaaccggctgcagccgtctgccatggtggacgaagccacctgcgctgcttgtgacttcaacaaaccgggggccaactgtcagaggaagatggcatggcagtggaggggtgagttcatgcctgctagcagatcggagtatcaccgcattcagcatcagcttgagtccgagaagttcccacccttattccccgaggggcccgcccgggcctttcatgagctatcccgagaggagcaggcgaagtacgagaagaggaggctggcggactactgccgcaaggcctacaagaagatccatatcaccaaggtcgaagagcggcttacaactatctgtcaaagggaaaactcattctatgttgacaccgtgagagcatttcgggaccggaggtacgaattcaagggactgcacaaggtttggaaaaaaaaactcagcgctgcggtagaagtgggcgatgcagctgaagtaaagcgctgtaaaaatatggaggttctgtatgactctctccagctggcacataagtgcatcctgaacagcttctacgggtatgtcatgcgtaagggagcccggtggtacagcatggaaatggccggaattgtctgttttaccggagctaatattataactcaggcccgcgaactcattgaacagatcggaagacccctcgagttagataccgatggtatctggtgtgttttgcctaactcattccccgagaacttcgtattcaagaccacaaacgtgaaaaagcccaaagttaccatatcctatcccggcgccatgctgaatattatggtcaaggagggattcaccaacgatcagtaccaggagctggcggagccatcctcactgacctacgtgacacgatccgaaaactccatcttttttgaggtggatggaccgtacctggcaatgattctaccggcctccaaagaggaagggaagaagctgaaaaagcgctatgccgtcttcaatgaagatggctctctggctgagctgaagggattcgaggtgaagcgccggggtgaacttcagctgatcaagatcttccagagttctgtcttcgaggctttcctgaaaggatctacactcgaagaggtgtatgggtctgtcgcgaaagtggccgattattggttagacgtgttgtattccaaggcagccaatatgcccgacagcgagctttttgaactgatcagcgaaaaccgctcaatgagtaggaagctggaggattacggcgagcagaagagtacttctatctccaccgccaaacgcctggccgagtttttgggcgaccagatggtgaaagacgccgggttaagttgcaggtacattatttctcgcaaacccgaaggatcgcctgtgactgagcgggcaatacccttagccatctttcaggcagagccgaccgtcagaaagcacttcctgcgcaagtggcttaagtcttcatctctccaagatttcgacattagggctatactcgactgggattattacattgagcgcctgggttccgcgattcagaagatcattacaatccctgcagcactgcagcaagttaagaatccagtccccagggtgaaacatcctgattggctccacaagaaactgctagaaaagaatgacgtgtataagcagaaaaaaatcagtgagctgtttacgttggaaggaaggagacaggtgaccatggccgaggcaagcgaggacagccctcgtccctcagccccagatatggaagactttggccttgtcaagcttccgcaccctgcggcacccgttaccgtcaaacggaagagagtgctttgggagtcgcaggaagagagtcaggatctgactccgactgttccgtggcaggaaatattgggtcagcctcctgctctaggcacctcccaggaggagtggctcgtctggcttaggtttcataagaaaaagtggcagttacaggccagacaaagacttgctaggaggaaaaggcaacgtttggagtcagcagagggagtgctcaggcctggcgccatcagggatggtccggccacaggtttagggtccttcctgcgaaggaccgctcgttcgattctggatctcccctggcagattgtgcagattagcgagacctctcaggcggggctgtttaggctctgggccctggtcggttcagacttacactgtataagactgagtattcctagggtattttacgtgaaccaacgcgtcgctaaagcggaagagggtgcatcctatagaaaggtgaatagggtgctgcccaggagtaatatggtctataacctgtacgaatacagtgtacctgaagacatgtaccaggaacacatcaatgagatcaatgcagagcttagtgctcctgacattgagggggtgtatgagacccaggttcccctgctgtttcgggccttagtccacttaggatgcgtgtgcgtggtaaacaagcagctggtcaggcatttgagtggctgggaggcagaaaccttcgctcttgagcatttagagatgcggtctcttgcccaattttcctatcttgagcccggtagtatccgacacatctatctttaccaccatgcccaggcacacaaggcgcttttcggtatcttcattccgagccaacgcagagcatctgtattcgtgcttgatacagtgcggtctaaccaaatgccgtctctcggagcactgtacagcgctgagcatggactgctgttagagaaagtaggacctgaattgctgccgccacccaagcataccttcgaagtccgggcggagactgacctgaaaacaatttgtcgtgccatccaacgatttctcttggcctataaggaggagcgaagggggcccactctgattgctgtgcagtctagttgggagttaaagaggctggcaagcgagatcccagtgctggaggagtttcccctggtaccgatttgtgttgctgacaaaatcaattatggcgtcctggattggcaacgccacggtgcgcgtcggatgatacggcattatctgaatctagacacatgcctgtcccaggcattcgagatgtccagatacttccacatacccatcggcaaccttcccgaggatatctctacgttcggctcggatctgttctttgccaggcatctgcaaagacataaccaccttttgtggctgagcccgacggcacggcctgacttgggaggaaaggaggcagacgacaattgtctcgtgatggaatttgacgatcaggctacagttgagattaatagcagcggctgctacagcacagtgtgcgttgagctagatcttcagaacctggccgtgaacaccatccttcagtctcaccacgtcaatgacatggagggagccgactctatgggtatcagctttgatgtcatccaacaggcctctctggaggacatgatcactggaggacaagccgcttccgcccctgcctcgtatgatgaaactgctttgtgcagcaacacctttagaatactgaaatctatggttgtgggatgggtgaaagagatcactcagtaccacaatatttacgccgacaaccaagtgatgcatttctatcggtggcttcgcagtccaagctccctgctgcatgatcccgccctgcatcgaactctacacaatatgatgaaaaagctgttcctgcagcttatcgctgagtttaagcgtttagggtccagtgtgatttacgctaattttaatcgaattatcttgtgtacgaagaagaggagagtggaagatgctattgcctatgtggagtatattacatcctcaattcattctaaggagacctttcacagcctgactatctcattcagccggtgttgggagttcttgctgtggatggatccgagtaactatgggggaatcaaaggaaaagttagctctcggatccactgcgggctacaagacagccaaaaggcagggggcgccgaagacgaacaagaaaatgaggacgacgaggaagaacgcgatggagaagaagaagaggaggctgaagagagcaatgtcgaagatcttttggaaaacaactggaacatcctgcagtttcttccccaggccgcttcctgtcaaaactacttcctgatgatagtatccgcttacattgtggccgtctaccattgtatgaaagacggattgagaagaagcgcgccagggagtactccagtgcgcaggcgcggagcatctcagctatcccaggaagctgagggcgccgtgggcgctctgccgggaatgattacattctcccaagactatgtggctaacgagcttacgcaatcattttttaccatcacacagaaaattcaaaaaaaggttaccggatcgcgtaattcgacagagctgtcagagatgtttcctgtcttgccaggcagccacctgctacttaacaaccctgcgctagagttcatcaagtacgtctgcaaagtgttgtcactggatactaacatcacaaaccaggtaaacaagttgaaccgggatctgcttaggctggttgatgttggagaattcagtgaagaagcccaatttcgcgatccatgccggagctatgtgctgccagaggttatttgccgcagctgtaacttctgccgcgatctggatttgtgcaaagactcaagctttagtgaagacggggctgtgctgcctcaatggctgtgttcaaactgtcaggcgccatacgatagttcggcaattgagatgactctggtggaggtgctccagaaaaaactgatggcttttactctgcaggatctcgtgtgtctgaagtgcagaggtgttaaggaaactagcatgcctgtttactgctcctgtgccggagatttcgcactgaccatccatacacaggtctttatggagcagatcggcatctttagaaacattgcccagcactacggtatgtcctacctgcttgagaccctggagtggctgctgcagaaaaacccccagcttggacattag

SEQ ID NO: 129248 - DNA, 480 bp, Artificial Sequence
  Description of Artificial Sequence: Synthetic coding sequence
atgattaaatttttcttaatggtgaataaacagggccagactcgtctcagcaagtactatgagcatgtggatattaataaaaggactctgctggaaactgaagtgatcaaaagctgcctcagtcgctccaatgaacagtgtagtttcatcgagtataaggattttaagctcatttatcgtcagtacgccgctctgtttattgtagtcggcgtgaatgatacagaaaatgaaatggccatctacgaattcatccacaactttgtagaggtgctggacgaatacttcagcagggtgagtgaactggacgtctctttcttcaataccgtgttccactccacctggcagatgcattcaggaccgtatcaggagcctatagacgaactcccaaaaatctgctctgctctcgagccacagcaaacatgtttctcacctgacagttcctcttttaaaggtgcagcatctacaacccccatctattag

SEQ ID NO: 129249 - DNA, 1506 bp, Artificial Sequence
  Description of Artificial Sequence: Synthetic coding sequence
atggccccagagcgccttcgttctagggccctttccgccttcaagcttaggggactgctgcttaggggtgaagctattaagtatctaaccgaagcgctccagagcatcagcgagctggagcttgaggacaaactcgagaaaatcatcaatgccgtggagaagcaaccattgtcatcgaacatgattgaaaggtcagttgtcgaggccgccgtccaggagtgctcccagtccgtggacgagactattctgcttatgacaaaccacccagcccccaatctctttggtaccccacgggataaagccgaaatgttcagagagcgctatacaattctgcatcagcgaacccaccgccatgagcttttcaccccacctgtgattgggagccacccagatgagagcgggtctaagttccagctgaaaacgatcgaaactctgctgggatcaaccacaaagattggggacgccatcgtgctcggtatgatcacccaactgaaagagggcaagttcttcctggaggaccctactggaacagtacagctggatctcagcaaagcgcagtttcactccggcctctacaccgaggcctgttttgttctcgccgaaggctggttcgaggaccaggtgttccatgtgaacgccttcggttttcctcctaccgagccatcctccacaacaagagcatattatgggaacatcaatttctttggagggccgtctaacacgtcagtcaagaccagtgccaagctgaaacagctcgaggaggaaaataaggacgctatgttcgtattcctctctgacgtttggctcgaccaggtcgaggtccttgagaagttgcgtattatgttcgctgggtacagccccgcaccacccacgtgcttcatcctgtgcggcaatttttcctccgccccttacggaaagaatcaggtgcaggccctaaaagacagcctcaagacactggccgacatcatctgcgaataccccgacatacatcaatcgtcaagattcgtgtttgtgccgggaccagaggatcccggattcgggagcatccttccaaggcctccactggccgaaagtattaccaacgagtttcgtcagcgcgtcccgttcagcgttttcaccacgaatccctgcaggatccagtactgcacccaggagatcacagtgtttcgagaagacttagtcaataagatgtgtcgcaattgtgtgcgctttcccagcagcaatctcgcaatccctaatcattttgttaaaacaattctgtctcagggccacctgacccctctgcccttgtatgtctgtcccgtctattgggcctatgactatgcccttcgtgtgtaccctgtgccagacttgctggtgatcgcggataagtacgacccgttcaccacgaccaataccgaatgtctctgcatcaatcccggctctttcccacgttcaggattctcctttaaggtattttatccctccaataagacggtggaggactccaaactgcaggggttctag

SEQ ID NO: 129250 - DNA, 1509 bp, Artificial Sequence
  Description of Artificial Sequence: Synthetic coding sequence
atggcccctgagcggctgcggtcccgggctctgagcgccttcaaactgcgtggtctgctgctgagaggagaggcaattaagtacctgaccgaagccctgcagagtatcagtgagctggaactggaggataagctagagaagattatcaacgccgtggagaagcagcctttgagctcgaacatgatcgaaaggtcagtggttgaggctgcagtgcaagagtgctcccagtccgttgacgaaaccattgagcatgtgtttaatattatcggagctttcgacatcccccgtttcgtttacaattccgaaaggaagaagtttctgccactgttgatgaccaaccatcctgcccctaacctgttcggcacacctagagacaaggccgagatgttcagagaacgatatacgatcctccaccagcgcactcatcgccacgaattattcaccccccctgtaatcggcagccaccccgacgaatccggtagcaagttccagctcaaaactattgagacactgctggggagcacaacgaaaataggggatgctattgtgctgggcatgattactcaacttaaggaaggcaagttctttctggaagatcccacaggaacagtgcagctggatctctctaaggctcagttccacagcggtctgtacaccgaagcctgcttcgttctggcggaaggatggttcgaggatcaggtattccacgtgaacgcatttggcttcccccccacagagccctcatctaccacccgtgcatactacggcaacataaatttcttcggcggaccttcgaatacatccgtaaagacttctgccaagctgaagcagttggaagaggagaacaaagacgccatgtttgtgttcctctccgacgtctggctggaccaggttgaagtccttgagaagttgagaatcatgtttgctggttacagtcccgcccctccaacatgttttatcctttgtggcaacttcagctcagcaccctacggaaaaaatcaggtacaagcactgaaggactctttgaagacgcttgccgacatcatctgtgaatacccagacatacaccagtccagccggtttgtgttcgttcccggccccgaggatcccggcttcggttcaatccttcctcggcctcccctggcagaatccatcacgaacgaattccgccagcgcgtgcccttctcagtctttaccactaacccatgcaggatccagtattgtacacaagagattaccgtctttagagaagaccttgttaataaaatgtgcaggaactgtgttcggtttcctagctccaatttagccattccaaaccacttcgtgaaaacaattctgagtcaaggccacctgacccccttgccgctatacgtttgtcccgtgtactgggcatatgattacgccctgagagtttatcctgtgcccgatctgctggtgatcgccgataagtacgatccatttacgaccactaataccgagtgcctctgtataaaccctgttcggatgtag

SEQ ID NO: 129251 - DNA, 444 bp, Artificial Sequence
  Description of Artificial Sequence: Synthetic coding sequence
atggcagagaggccagaggatctgaacctccccaatgccgttatcacccgcattataaaagaagcccttcccgacggggtcaatataagcaaggaagctcggtctgccatatctagggccgcttcagtctttgtgttgtatgctacctcatgcgcaaataactttgcgatgaaagggaagcggaagacattgaacgccagcgatgttctttctgcgatggaggagatggagttccaaaggttcgtgacgcctctcaaggaggcactggaagcctacagacgggagcagaagggtaagaaggaagctagcgagcagaagaaaaaggataaggacaaaaaaacagatagtgaagaacaggacaagagccgggacgaggataatgacgaagatgaggaacgcttggaggaagaggagcagaacgaagaagaagaagtcgataactag

SEQ ID NO: 129252 - DNA, 444 bp, Artificial Sequence
  Description of Artificial Sequence: Synthetic coding sequence
atggcagagagaccagaggacttaaacctgcccaatgccgtgattacccgtatcataaaagaagccctcccagacggggttaacatatctaaggaggctaggagcgctatctctagggcagcgagtgtcttcgtgctctacgccacgtcttgcgcgaataatttcgccatgaaaggaaagagaaaaacactgaatgcttctgacgtacttagcgccatggaggagatggagttccagcggtttgtcactccactcaaagaagccctagaggcgtatagacgggaacagaaggggaagaaagaagcgtcagagcagaagaaaaaggacaaagataagaagaccgattcggaggagcaggacaaatcgagggacgaagataacgatgaagacgaggaacgactggaagaagaagagcagaacgaggaagaagaggtagacaactag

SEQ ID NO: 129253 - DNA, 1245 bp, Artificial Sequence
  Description of Artificial Sequence: Synthetic coding sequence
atggccactggccaggaccgcgtcgtggctcttgtagacatggactgcttcttcgtccaggtcgagcaaaggcagaaccctcatctgcggaacaagccatgcgctgtggtccagtacaaaagctggaaaggcgggggcatcatcgcggtcagttatgaagctcgggcgttcggggttacaaggtccatgtgggcagatgacgccaagaagttatgcccagacctgctcttggcccaagtgcgcgagtcccgtggaaaggcaaaccttaccaaataccgagaggcaagcgtggaagtgatggagatcatgagccgctttgcggtaatcgagcgcgcctctatcgatgaagcatacgtggacctgacatccgcggttcaagagaggttacaaaaactccagggccaaccaataagcgctgatctgctccctagcacatatattgaaggactgccgcaagggcctacaactgctgaagaaactgtccagaaggaaggaatgagaaagcaggggctgttccagtggctcgacagtttacagatcgacaacctaacctcccccgacctccaactgaccgtcggagccgtcatcgtggaggaaatgagagctgctattgaacgagaaactgggtttcagtgcagtgctggcatcagtcataataaggtgctggcgaagttggcctgcggtctgaataagccaaatagacaaaccctcgtttcccatggatcagttccacaactcttcagccaaatgccaattcgcaagatccggagtttaggaggaaagttgggcgccagcgtgatcgagatcctgggtatcgagtatatgggggaattgacacagtttaccgaaagccaactacagtcccactttggcgaaaaaaacggctcttggctgtacgcaatgtgccgtggcatcgagcacgacccggttaagcctcgacagctacctaagactatcggatgctctaagaacttccctgggaagacagctctggccactcgggagcaggtgcaatggtggttgttgcagttagcacaggaacttgaggagcggctcacgaaggaccgcaatgataatgacagggtggccactcagttggtggtctcgataagagtgcagggtgataagcgactgagttcactcaggagatgctgcgctctgactcgctacgatgctcataagatgtctcacgatgctttcaccgtgatcaagaactgtaacacatctggcattcagacagagtag

SEQ ID NO: 129254 - DNA, 2142 bp, Artificial Sequence
  Description of Artificial Sequence: Synthetic coding sequence
atggccacaggccaggacagggtggtcgcgctcgtggatatggattgtttttttgttcaggtagagcagaggcagaatccgcacctgagaaacaagccctgtgccgtggtgcagtacaaaagctggaaaggtgggggcatcatcgcggtgagttatgaggcccgcgcctttggagtcacccggtcgatgtgggctgatgacgcaaagaagttatgccccgatctcctgctagcacaggtgcgggaaagtcgagggaaagccaacctgacaaaatatcgcgaagcctctgttgaggttatggagattatgtctcgctttgccgtcatcgagagagcttcaatagacgaggcgtacgtggacctgacctcagcagttcaggaaaggctccaaaaactacagggccagcctatctccgcagatctgttgccatcgacctacattgaggggctccctcaaggtcccaccaccgcagaagaaactgtgcagaaagagggcatgagaaaacaaggcctatttcagtggctggactccctgcagatcgacaaccttacgtcaccagatttgcagctcactgttggcgcggtgattgtggaggagatgcgggccgcaattgaaagggagacgggctttcaatgctccgcagggatttcgcataacaaagtgctcgccaaacttgcatgtggattaaacaaaccaaaccgacagaccctggtgtcacatggcagcgtacctcagcttttttcccaaatgccaattcgtaagatccggtccctggggggaaagctaggcgcctctgtaatcgagattttgggaattgaatacatgggtgagttaactcagtttaccgaatctcagcttcagtctcacttcggagagaagaatggcagttggttgtatgccatgtgcagaggcatcgaacacgatcccgtgaagcctagacaactgcctaaaaccattggctgttcaaagaacttccctggcaaaaccgccctggcgactagggagcaagtccagtggtggttactccagctcgcccaagagctcgaggaaagactgacaaaggatcgtaatgacaatgatcgcgtagctacccagctggttgtcagtatccgagttcagggagataagcgattaagctcactgcgcaggtgttgtgcgctgacaagatacgatgcgcacaaaatgagccacgacgcatttacagtaatcaagaactgcaacaccagcggtatccagacagaatggtcgccacctctaactatgctgttcctatgcgctactaaattctccgccagtgctccttcttcctctacggacataacttccttcctttcctccgatccttctagccttcccaaagttcctgttacatcgtcagaggctaagactcaggggtcaggtcccgcagtgaccgctactaagaaggcgaccacctccctggagagtttcttccaaaaagccgccgagagacagaaggtaaaagaagcctccctgagtagcctcacagcccccacccaagctccaatgagtaattctcctagtaagccatctctcccattccagacctcccagagcacgggcacagagccgtttttcaagcagaaaagcctcctgctgaaacagaagcagcttaataacagcagcgtttcatcgcctcaacagaatccttggagcaactgtaaggccttacctaatagcctccctacagagtatccagggtgcgtaccagtttgcgagggagttagcaagctggaagaatcttcaaaagccacccccgccgaaatggatctagcccacaattcccagtccatgcacgcctcttcagcgtcaaaatcagtactcgaggtgactcagaaggccacgcccaatccctcccttttggctgccgaagaccaagttccttgtgaaaagtgtgggtccttggtaccggtgtgggatatgcccgagcatatggactatcatttcgctcttgagcttcagaaatccttcctccagccgcattctagtaacccacaggttgtgtctgcagtgagtcaccagggcaagcggaacccgaagtccccgctggcctgcactaacaaacgcccgcggccagagggaatgcagacactggaaagcttctttaagcctctcacccactag

SEQ ID NO: 129255 - DNA, 219 bp, Artificial Sequence
  Description of Artificial Sequence: Synthetic coding sequence
atgtgggcagatgacgcaaaaaagctgtgcccagatttgcttctagctcaggtaagagaatccaggggtaaagcaaaccttacaaagtacagggaagcaagcgtggaggttatggagattatgtccagatttgccgtcatagagagagccagtattgacgaggcctatgtggacctgacttcggctgtgcaggaacgactccagaagttgcaggggtag

SEQ ID NO: 129256 - DNA, 1956 bp, Artificial Sequence
  Description of Artificial Sequence: Synthetic coding sequence
atgtgggctgacgatgcgaagaagttatgccctgacctgctcttggcccaggtacgggagagcagggggaaagcaaatctgactaagtatcgtgaagccagtgtagaagtcatggaaatcatgtcacgttttgctgtgattgagagagcatcaatcgatgaagcttacgtcgatcttacaagcgcagtgcaggagcggcttcagaaactccaggggcaacccatctccgcagatctcctgcctagcacatatatcgaaggattgcctcagggccctaccaccgccgaggagacagtgcagaaagaaggcatgcgcaagcaaggtctttttcaatggctggattccttgcagattgacaatctgacctcgccggatctacagctcaccgtgggcgcagtgatcgttgaggagatgagggccgcaattgaacgcgagacaggcttccaatgttccgccggcatttcacataacaaagtcctcgcaaagctggcgtgtgggctaaacaaacccaaccgccagaccctggtgtcccatggatcagtgccacagctgttttcacaaatgcctatcaggaaaattagatccttagggggcaagcttggcgcatctgtcatcgaaatactcggaattgaatatatgggggaactgacacagtttaccgaatcccagctacagtcacatttcggcgagaagaatggctcttggctatatgcaatgtgcagaggcatcgagcacgacccagttaagccaagacaactcccgaagacaattggctgctctaagaactttcctggcaagaccgccctggctactagggagcaggtgcagtggtggctcttgcagctcgcgcaggaattggaggagagactgaccaaagaccgtaacgacaacgacagggttgctactcaactggtggttagtatccgcgttcagggagacaaacgacttagttcactcagaagatgctgtgccctgacccgatacgacgctcacaagatgtctcatgacgcgttcacagttattaaaaattgtaatactagcggcattcagaccgaatggagcccacctctgacgatgttgtttctgtgtgccaccaagttttctgcatcagccccttcttcttcaactgatatcacgtcatttctctcctcagacccctctagtctgcccaaggtcccggtcacaagcagtgaagcaaagacccaggggtctggacccgcggttactgcaaccaagaaagcgaccaccagtctggaatctttcttccaaaaagccgccgagagacagaaagttaaggaggcctccctgtcatctttgacagctccaactcaagcccctatgagcaactcccccagtaagccgagtctgcctttccaaacatcccaatccacgggtaccgagcctttctttaaacagaagagtcttctcttgaagcagaagcagttaaacaattctagcgtctcaagtcctcagcagaacccctggtctaattgcaaggccctccccaattcccttcctactgagtaccctggatgcgtgccggtgtgtgaaggagtgtcaaagctggaggaaagctccaaggcaactcccgctgaaatggaccttgcccataactcccaaagcatgcatgcctccagcgccagtaaatctgtcctggaggttacacaaaaagccacaccaaacccatcactgctcgccgcggaagaccaggttccttgtgagaaatgtgggagtctggttccggtgtgggacatgcccgagcacatggattaccattttgccctggagcttcagaaaagtttcctccagccacactctagcaatcctcaggtggtgtctgcagtgtcccaccaggggaagcggaatccaaaatcccctctagcctgtacaaataaaaggccccgccctgaggggatgcagactctggagtctttctttaaaccactgacccactag

SEQ ID NO: 129257 - DNA, 3720 bp, Artificial Sequence
  Description of Artificial Sequence: Synthetic coding sequence
atgtcacgtctgctctggcgtaaggtagcgggggcaactgtgggacccggccccgttcccgcacccggccgttgggtctcctcctcagtgccggcctctgacccctcagatggccagcggagaaggcaacagcagcagcagcaacagcagcagcagcagcagcagccacagcagccacaggtcctgagcagcgaaggaggccagctgcgacacaacccgttagacatacaaatgctttcgagaggcctccacgaacagattttcggtcagggcggagaaatgcctggcgaggctgccgtaaggcgcagcgtggagcacctacagaaacatggcctttggggacagccagccgtccccctgcccgatgtcgagcttcgccttccccccttatacggcgataatctcgaccagcacttccggctgctggcccagaagcagtcattgccttacctggaagcagcaaatttgcttttgcaggcccaactgccacccaaacccccagcttgggcatgggctgagggatggacgagatatgggcccgagggtgaggccgtgcccgtggctatcccagaggagagagcgctggtttttgacgtagaggtgtgtctggccgagggtacctgtccgacattagcggtggctatatctccgtctgcttggtacagctggtgttctcagcggctggtggaggagaggtattcctggacatctcaactctctcccgccgacctgatccccctggaggtgccaaccggggcctcatcccccactcagcgggattggcaggagcaactggttgtggggcataatgtttccttcgaccgtgctcacatacgggagcagtacctcattcagggaagcaggatgcggttcttagacacaatgtccatgcatatggcgatatctggattgtcttcctttcagcggagcctgtggattgctgccaagcagggaaagcacaaggtgcagcctcctaccaagcagggccagaaatcacagcgcaaagctagaagggggcccgctattagtagctgggattggctggacatttctagcgtgaacagccttgcagaagtccaccgattgtacgtgggcggccctccactcgaaaaagagccacgcgaactgttcgtgaaaggaaccatgaaagatatcagagagaattttcaggatctcatgcagtattgcgctcaggacgtttgggcaactcatgaagttttccagcaacaactcccactgttcctggagagatgccctcacccagtaaccctggctggtatgctagaaatgggagtcagctatctgcccgtgaatcagaattgggagcgctatttggctgaggcccaggggacgtacgaagagctgcagcgcgagatgaagaaatccctgatggatcttgcaaatgacgcatgtcagttactcagtggcgagagatacaaagaggatccgtggctgtgggatttagaatgggatctccaggagttcaaacaaaagaaggctaagaaggtgaagaaagagcccgctaccgccagcaagctccctattgagggcgccggcgctccaggggatccgatggatcaagaagatctgggaccgtgttccgaggaagaggaatttcagcaggatgtcatggcccgagcctgcttacaaaaattgaaaggaacaaccgagctgttacccaagcgaccccaacacctccccggccaccctggatggtatcggaagctgtgccctaggctagatgatcccgcgtggacgcctggaccatctctgctttctctgcaaatgagagtaacccccaagcttatggccctgacctgggacggtttccccctgcactattctgaaagacacggttggggctacttggtgcctggcaggagagacaatttggctaaattgccaactgggaccacccttgagtctgcaggggtcgtttgtccttatcgagccatcgagagcctgtacagaaagcactgtctggagcaggggaagcagcaactgatgccgcaggaagccgggctggccgaagagttcctgctgacagacaatagcgcaatttggcaaaccgtggaagaactggattatctcgaggtggaagccgaggcaaaaatggagaatcttcgtgcagccgttccaggacagcccctcgccctgacggcccggggcggtcccaaagacacccagccaagttaccaccacggaaatgggccctataacgacgtggatattcccggttgctggttctttaagttaccccacaaggacgggaacagctgcaatgttggttcgccttttgccaaggacttcctaccaaagatggaagatgggacattgcaagcggggcccgggggggccagcggaccccgtgcactggaaatcaacaagatgatctctttttggcggaatgcgcataagcgaatatcctctcaaatggtcgtgtggcttccccggagcgcactccctcgggcagtaatacgacaccccgactacgatgaggaagggctgtatggagccatactgccccaagttgtgaccgcaggcaccatcacaagacgagctgttgaacctacttggttgacagcctctaatgccaggccagacagagtcggctctgaactgaaagcaatggttcaggcacccccgggctacaccctggtgggggcagacgttgatagccaggagctctggatcgctgctgttttgggcgacgcgcacttcgcgggcatgcacgggtgtactgccttcgggtggatgactttacagggaaggaaaagccgagggactgatttacacagcaaaactgccacaaccgtgggtatcagccgtgagcatgctaagatcttcaattatggtcggatctacggggcgggtcagccctttgccgagcgtcttttgatgcagtttaatcatcgactgacgcagcaggaggcggccgagaaagctcagcaaatgtacgccgcaacaaagggcctcaggtggtacaggttatctgatgaaggggagtggttagtgcgcgagttaaatctgccggttgatcgcactgaagggggatggatctccctgcaggatctgcgtaaggttcaacgcgagacggcccgaaagagtcagtggaagaagtgggaggtggtcgccgagagggcgtggaaaggtggcaccgagagcgaaatgtttaataagctggagagtatcgcaaccagtgacatcccacgaacaccggtccttggctgctgcattagtcgcgcgctagaaccaagcgctgtgcaggaagagttcatgacaagccgggtgaattgggtagtacaaagcagtgctgtagactatctgcacctgatgctggtagcgatgaaatggctattcgaagagtttgctatcgacggaagattttgcatctccatccacgatgaggtgaggtacctcgtgagagaagaggacagatatagggcagccctggctttacagataaccaatttgctgactcgctgcatgtttgcatataagttgggtttgaacgacctcccccagtctgtggcgtttttctcagccgtcgatatagaccggtgtcttaggaaggaggtgaccatggattgcaagaccccctcaaatcccacaggcatggagaggaggtacgggatcccgcagggtgaagccctcgatatctaccaaattatcgagctgacaaagggttcactcgagaaacggtcccaacctggcccctag

SEQ ID NO: 129258 - DNA, 3720 bp, Artificial Sequence
  Description of Artificial Sequence: Synthetic coding sequence
atgtccaggcttctctggcgtaaggtggccggcgccaccgtggggcccggtcccgtcccggctcctggcaggtgggtttcatcatcagtgcctgccagtgatccatccgacggccaaagaagacgccagcagcagcagcaacaacaacagcagcagcagcagcaaccacaacagccccaggttttatcttccgaaggggggcagcttcggcacaaccctctggacattcagatgctcagccgcggattgcatgaacaaatctttggccaaggaggggaaatgccaggggaagcagctgttagacggtcagtcgaacaccttcagaaacatggcctgtggggccagcctgctgttccccttcccgacgtggaactgaggcttcctcccctttacggcgacaatctggatcagcacttccgactgttggcacagaaacagagccttccatacctggaagccgctaaccttcttttgcaggcacagctgccacccaaaccaccggcctgggcgtgggccgagggatggacaaggtacggccccgagggggaggccgttcccgtcgctatcccagaagagagagcactggtgttcgatgtggaggtgtgtttggccgaaggcacctgcccaacgcttgctgtggcaataagcccgtcagcctggtatagctggtgtagtcagaggctggtagaggagcggtacagctggacctctcaactaagtcctgctgatctaataccactcgaggtccctacaggggcaagcagcccaacccaacgggattggcaggaacagcttgtggtgggacacaatgtgtcttttgacagggcccacatcagagagcagtacctcattcagggatcccggatgaggttcctggataccatgtccatgcacatggccatctctggcttatcttctttccaacgcagcctgtggatagccgcgaagcaggggaaacacaaagtgcaaccccccactaagcagggacagaagtcccagcggaaggctcgccgcggaccggcgatctccagctgggactggctggacatctcatccgtcaactcactggctgaagtgcatcgcctgtatgtgggcggtcctcctctcgaaaaggaaccccgagagttgtttgtcaagggtaccatgaaagatattagagagaacttccaggacctcatgcagtactgtgcacaagatgtttgggccactcatgaggttttccagcagcagctccccctgttccttgagaggtgtccacatccggtgacactagcgggaatgctcgagatgggtgtctcatacttgcctgtaaatcagaactgggagcggtacctggctgaagcccaggggacatacgaagagctccagcgggagatgaaaaaatccttgatggatctcgccaacgatgcatgccagctgctgtccggagaacgttacaaggaggatccttggctgtgggatctggaatgggatctgcaagagttcaagcagaaaaaagccaaaaaagtcaagaaagagcctgcaaccgcatccaagcttcccattgaaggcgccggcgccccgggcgacccaatggaccaagaggatttaggcccctgcagtgaggaggaagaattccagcaggacgtcatggcgcgggcttgcttacagaagctgaaaggcacaaccgagttattgcctaagcggccccagcaccttcccggacatccagggtggtaccgcaagctctgcccccgtcttgatgatcccgcctggaccccagggccctcactgttatctctgcagatgcgggttaccccaaaacttatggccttgacctgggacgggttccccctccactacagtgagaggcatggatgggggtatctcgtgccagggcgtagggacaatctagcgaaacttcctaccggtaccacactggaaagtgccggagttgtttgtccttaccgggccatcgagagcctatacaggaaacattgtttggaacagggcaaacagcagttaatgccccaggaagccggtctcgctgaagagttcctactcactgataattcggctatttggcaaactgtagaggagcttgattacttagaagtggaggcagaagcaaaaatggaaaatctgcgggccgccgtgcccggacaacccctggctttaacagccaggggtggaccaaaagatacacagccctcttatcatcatggcaacggtccctataatgacgtcgacatccctggatgttggtttttcaaattgccccataaggacggcaactcctgtaatgtgggctccccattcgccaaggactttctgccaaagatggaggacgggacactgcaggccggacccggtggggccagtggtcccagagctctggagataaataagatgattagtttctggaggaacgcccacaagcggattagctctcagatggtggtttggctcccaagaagcgccctcccgagagccgtcatcagacacccggattacgacgaggagggactatatggcgctattctgccacaagttgtaacagccggaacgatcactagacgagctgtggaacccacctggctgacagcctccaacgcgcgccccgatcgggtagggagtgaacttaaggcaatggtgcaggcacctcccggctacactctagttggggcagacgtggattcacaggagctgtggattgcggctgtgctgggtgacgctcacttcgcaggaatgcatggctgtactgcttttggatggatgactctgcaaggtcggaagagtcgcggaaccgatctgcattctaaaactgccactaccgtggggattagccgcgagcacgcaaagattttcaattacggtcgaatatacggagccggtcagcctttcgcagaacgcctccttatgcaattcaatcatcgccttacacaacaagaggccgccgaaaaggcccaacaaatgtacgctgccacaaaggggctgcgctggtaccgactgagcgacgagggggagtggctagtccgggagctaaacttgccagtggaccgaacagagggaggctggatttccttgcaagatttaagaaaggtgcagcgcgaaactgctagaaagagccagtggaagaagtgggaggttgtcgctgagcgggcttggaagggaggcaccgaaagcgaaatgttcaacaaactagagagcattgctacctctgatatccctcgaacacccgtgctaggctgttgtatctcaagagccttagaaccaagcgcagtgcaggaggagtttatgacaagccgggtgaattgggttgttcagtcctctgcagtggattatctgcacctgatgcttgtagctatgaagtggctctttgaggagtttgctatagatggccgtttttgtatttccatccatgatgaggtccgctatttagtacgggaggaggaccgctatagggccgcgctcgcattacagataaccaacttgctgacccgttgtatgttcgcctataagttggggctcaatgacctgccacagtccgtcgcattttttagcgcagtggacatcgatcggtgccttcgcaaggaggtaacgatggactgcaagacaccttctaaccctaccggtatggagcggagatacggcatcccacagggcgaagctttagacatctatcaaatcattgagctgactaaaggttccttggagaagcggtcccaacccggaccttag

SEQ ID NO: 129259 - DNA, 1458 bp, Artificial Sequence
  Description of Artificial Sequence: Synthetic coding sequence
atgcggagtagggttgcagtaagagcctgtcataaggtctgtaggtgcctcctttcagggttcggcggccgcgtggatgcaggtcagccagagctgctgacagagcggtcttcccccaagggtgggcacgtgaagtcccatgccgaactcgaaggtaacggagagcacccagaagccccagggagcggtgagggatctgaggcacttttggagatctgtcagcgtcgccacttcctgtccgggtcaaaacaacagctcagcagagattcactgctgtcaggatgtcatccaggcttcgggccccttggcgtggagctgcgcaagaaccttgccgccgaatggtggaccagtgtcgtggtttttcgcgaacaggtgttccctgtcgacgcccttcaccataagccaggaccactacttcccggagactccgccttccgactcgtcagcgcagagacactgagggagattctgcaggataaagagttatccaaggagcagctggtagcattcctggagaacgtactcaaaaccagcggtaagctccgcgaaaatctgttacacggagccttagagcactacgtgaattgccttgatttggttaacaagcgtctcccctatgggctggctcagatcggcgtgtgttttcaccccgtgttcgacacaaagcagataaggaatggcgtcaagtcaattggggaaaagaccgaagcgagcttagtatggttcacaccaccacgaacgtccaatcaatggctggatttctggcttcggcacaggttgcagtggtggagaaaattcgctatgtcacccagtaatttcagtagttctgattgccaggacgaggaggggcggaagggtaataagctgtattacaactttccttggggcaaggaactgatcgaaacactgtggaacctcggcgaccacgaactgctacacatgtaccccggaaacgtgtccaaactccacggtagagatggtcggaaaaatgtcgtcccttgcgtgctctctgtcaatggagacctggaccgaggcatgctggcttacctgtatgactctttccagttaacagagaattcctttactaggaaaaaaaatctacatcggaaagttttgaagctccacccctgtctggctccaataaaggtggcgctggacgtgggccgtggtccaactttggagctgaggcaagtgtgtcagggtctatttaatgagttgctggagaacgggatttctgtgtggcctgggtatctcgagacgatgcagtcgagtctcgaacaattgtacagcaaatatgatgaaatgtccatactgttcacggtgttggtgaccgaaaccacactagagaacggactcattcacctgcgtagccgtgacactaccatgaaagagatgatgcatatcagcaagctgaaagactttctcataaagtatatctctagcgctaagaacgtctag

SEQ ID NO: 129260 - DNA, 7773 bp, Artificial Sequence
  Description of Artificial Sequence: Synthetic coding sequence
atgaacctcctccggcggtccggaaagagaaggcggagcgaaagcggatcggactcattcagcggaagcgggggcgactcttccgcttctccccagttcctgtccggaagtgtgctgtctcctcccccaggactcggccgttgtctgaaagctgctgccgctggagaatgtaagccaactgtgcctgactatgagcgcgataagctcctgttggccaattggggtctccctaaggcggtccttgaaaagtatcatagctttggtgtgaaaaagatgtttgagtggcaagcagaatgcctgctgctgggccaggtcctcgaagggaagaacttggtgtactctgcacccacttctgcgggtaaaactttagtggcagaattgctgatactgaaacgtgtgctagaaatgcggaagaaagccttgttcatcctcccgtttgtgtctgtggcgaaagaaaaaaaatactacctccagtcgctcttccaggaagtcgggataaaagttgacggctatatggggtcaaccagcccctctcgtcacttctcctcgttggacattgccgtgtgcaccattgagcgcgcgaatggtttgatcaacaggctaattgaggagaacaagatggatcttctgggcatggtcgtggtcgacgagctacacatgctgggtgactcccaccgaggctatctcctggagctcctactcacaaagatctgttacatcacaagaaaaagcgcaagttgtcaagcagatctggcaagcagcctgtccaacgctgttcagatcgttggcatgtccgccacattacctaacttggagctggttgcttcgtggctgaatgctgaactttaccacaccgattttaggcccgtaccactcttagaaagcgtaaaagttggcaattcaatctacgacagcagcatgaagcttgtccgcgaattcgaacccatgcttcaggttaaaggcgatgaggaccatgtcgtctcactctgttacgagacgatctgcgacaaccactcagtgttactattctgcccctcaaagaaatggtgtgagaagctggctgacatcatcgcgcgagaattctacaacctgcatcaccaggctgagggactggtcaagccgagcgaatgccctccagtgatcttggagcagaaagagttgttagaggtaatggatcagctgcggcgcttgccaagcgggcttgactctgtgttgcagaaaaccgtcccgtggggcgttgcctttcatcacgccgggctcacttttgaggagagggacatcattgagggagcttttcggcagggcctaatccgggttctagctgccacaagtaccctcagttcaggcgtcaacctgcctgccaggagggttatcatccgcactcccatcttcggcggacgtccattggatatcctcacctacaagcagatggtcggaagggctggtaggaaaggagttgacaccgttggtgagagtatcctgatttgcaagaattccgagaaatctaagggcattgcactgttgcagggcagtctgaaaccggttcgctcgtgtctgcagagacgagaaggggaggaggtgaccggatctatgatcagggccattttggagataattgtgggcggggttgccagtaccagccaggacatgcacacttacgctgcctgcacgttcctcgcagcctctatgaaagagggaaaacagggtatccaacggaatcaagaatcagtacaactcggcgccattgaagcatgtgtgatgtggctcctcgagaacgaattcattcagagcactgaggcaagtgatggcaccgaaggtaaggtttaccaccctactcacctggggagcgccaccctgtcatcgagtctgtcaccggccgacacccttgatatcttcgccgatttgcagagggccatgaagggtttcgttctggagaacgaccttcatatactgtacctcgtgacccctatgttcgaggattggaccacgatcgactggtatcgttttttctgcctgtgggagaagctgccgacctcgatgaaaagagtggctgagttggtaggggtggaggaggggttcctggcccggtgtgtaaagggtaaggtggtggcaagaacagagcggcagcatcgccaaatggctatccataagaggttcttcacatctctggtgttgctggatctgattagcgaagtcccacttcgcgagattaatcagaaatatgggtgcaaccgggggcaaattcagagtcttcagcagagtgccgcagtgtacgctggaatgattaccgtcttttcaaacagactgggatggcataacatggagctcctgctgtcacagtttcagaagcgattgacttttggcatccagagggaactgtgtgatcttgtgcgcgtctcccttcttaatgcccagcgggcccgggtcctttatgcctccggtttccacactgtcgcggatctggccagggctaacatcgttgaagtcgaagttatcttgaagaatgccgtgccatttaaaagcgctaggaaagcggtggacgaagaggaagaggctgttgaggagagacggaacatgaggactatttgggtgaccgggagaaaaggtctcactgaaagagaggccgcagctctgattgtggaggaagctagaatgatcttgcagcaggacctggtagaaatgggggtgcaatggaacccatgcgctctcttgcactccagcacatgtagcttgactcattctgaaagcgaggtgaaagagcatactttcattagccagacaaagagcagctataagaagttgacctcaaagaataaatccaacaccatcttttctgacagctatatcaagcactctccaaacattgtgcaggatttgaataagagtcgggagcacacaagctctttcaattgcaattttcaaaatggtaaccaggagcatcagacttgctcaatctttagggcgcgaaagagggcctctctggacatcaataaagaaaagcccggcgcatctcagaacgagggaaagacaagcgacaagaaggtggtgcaaacgttcagccagaaaactaagaaggcaccgttaaactttaattctgagaaaatgtcgaggtcctttagaagttggaagaggagaaaacatctgaagagatcacgcgattcatcacctctgaaagattcaggcgcttgcagaatccacttacagggacaaacactgagcaatccatcgctgtgcgaggacccgttcacccttgatgaaaagaaaacggaatttcgcaactcgggtccattcgcgaagaacgtaagcttatctggtaaggagaaagataacaaaacaagttttccactccagataaaacagaattgctcgtggaacattaccctcaccaacgacaacttcgtggagcacattgtgaccgggtctcagtctaaaaatgtgacatgtcaggccacctccgttgtgagtgagaaaggacgcggagtcgcagttgaagcagaaaagattaacgaggtattgattcagaatgggtctaaaaaccagaacgtgtatatgaagcaccacgacatccatcccatcaatcagtacctgagaaaacaatcccacgaacagaccagtacaatcacaaagcagaaaaatatcattgaaaggcaaatgccatgcgaagcggtctctagctacatcaaccgcgacagcaacgtgactattaactgcgagagaatcaaattgaacaccgaagaaaataagccttcacattttcaagctctgggtgacgatatatctaggaccgtgatcccttccgaagtgctccccagcgccggcgctttctccaagtcagagggccaacacgagaattttcttaatatttcgcgattacaggagaagacgggcacttacaccactaataaaacgaagaacaaccacgttagcgatctcgggctcgttctttgtgattttgaggattcattttatttggacacccagtccgaaaaaatcatccagcaaatggctacagagaacgccaaactcggagctaaagataccaatttggcagctggtatcatgcagaaatcactcgttcaacagaactcaatgaatagtttccaaaaagagtgtcacatcccttttcccgccgaacaacacccattgggagccacaaagattgaccatctagatctcaagacagtgggcaccatgaagcagagctctgattcccacggtgtcgacatcctcacccctgaatctcctatcttccacagtccaattctgctggaggaaaacgggcttttcctgaaaaaaaatgaggtgagcgtgacggactcccagctgaactccttcctccagggatatcaaactcaagaaaccgtgaagccagtcattcttctgattccccaaaaaagaaccccaacaggagtcgaaggggaatgcctccctgtgcctgagacaagcctgaatatgtccgactcattgttgtttgacagctttagtgatgattatttagtgaaagagcaactgcccgatatgcagatgaaggagcccctccctagcgaggtcacctccaaccatttttccgactccctgtgcctccaagaagatctcattaaaaagtcaaacgtcaatgaaaaccaggatacccatcagcaattaacttgttccaatgacgagagtattattttctccgagatggactctgtccagatggtggaagccctggacaatgtggatatctttccagtgcaggagaaaaaccacacagtcgtgagcccacgagccttagaactgtctgatcccgtccttgacgaacaccaccagggagaccaggacgggggggatcaagacgagcgtgccgagaagtccaagttgacaggaacccgccaaaatcacagctttatctggtccggcgccagtttcgatttaagccctggcctgcagcgcatactcgataaggtatcatctcctcttgaaaatgagaagttgaaaagcatgactattaatttctccagccttaaccggaaaaatacggaactgaacgaggagcaggaagtgatctccaatttggaaaccaagcaggtccagggtatttccttttcaagcaacaatgaagtcaaatccaaaatcgagatgttggagaacaatgccaatcacgatgaaactagctctctgctgccccggaaagaatccaacattgtggacgacaacggtcttatcccacccacccctatccccacatcagcctcaaaattaacctttcctggcattctggagactccagttaatccatggaagaccaataatgtgttgcagccgggcgagagctatttgttcgggagccccagtgacatcaagaaccatgatttatcaccggggtcaaggaatggctttaaggacaactccccaatctctgatacaagcttctcactccagttgagccaagatggactacaattaactcccgccagcagctcatcggaaagcctcagtatcattgacgtagcgagcgaccaaaacctgtttcagaccttcatcaaagagtggcgctgtaagaagcggtttagcatcagtttagcatgcgaaaagattcgaagcctaacgagtagcaaaacggcgactatagggtccagatttaagcaggcctcctctccacaggagataccaatacgtgacgacggctttcccattaagggatgcgatgacaccttagtcgttggtttagcagtctgttgggggggccgcgacgcctactacttttctctacagaaggaacagaagcactccgaaatcagtgcttccctggttcctccatccttagatccgtccctgaccttgaaagacaggatgtggtatctgcaaagctgccttagaaaggagagtgataaagagtgctctgtggtgatttacgacttcattcagagctacaagatactactcctctcttgcgggatctccctcgagcagagctatgaagatccgaaagtggcctgttggttgctagatcctgattctcaggaaccaacactccactctatcgtcacctcattccttccgcatgagctgcccctattggaaggcatggagacctcacagggcatccagagcttgggcctcaacgcaggatctgagcactccggtcgctacagagccagtgtagagagcattctgatcttcaacagtatgaaccaattaaattctctgctccagaaagagaatctgcaggatgtttttcgcaaggtggaaatgccttctcagtattgcttggcgctgcttgagctgaatggcatcgggttctctactgcggaatgtgaaagccaaaagcatataatgcaggccaagttggatgcaatcgagacccaggcctatcagctggctggccacagctttagctttacatcttcagatgacatcgcggaagtgctcttcctcgagcttaagctgccacctaaccgggaaatgaagaaccaaggtagtaagaagaccttggggagtacgcggcggggaatcgataacggcaggaaactgcgccttggaaggcagttttccacctccaaagacgtgcttaacaagttgaaggccctgcaccctctgccaggcctcattctggaatggaggaggatcactaatgcaataacgaaggtggtcttccctctgcaaagagagaaatgcttgaacccgtttctcggcatggagcggatctatcccgtctctcagagtcatacagcaacaggtcggattacgttcacagagcctaatattcagaacgtgccacgtgacttcgagataaaaatgcccaccctcgtgggagagagcccaccgtctcaggctgtgggtaagggactgctccccatgggcagaggcaagtacaaaaaaggatttagcgtcaatcccaggtgccaggctcagatggaagagcgggccgccgacaggggaatgcctttctcgattagcatgagacacgcatttgtgccttttccggggggctcgatactcgcagcggactactcccagctcgaactccgcatactcgcccacctgagtcatgaccgccggctcatccaagtgttgaacacaggtgcggacgtttttcggtcaatcgcagctgaatggaagatgatcgagccggaatcagttggcgatgacctgcgacagcaggctaagcaaatctgctatggcattatttacgggatgggggccaaatcattgggcgaacagatgggaatcaaggaaaatgacgcggcttgctatatcgacagcttcaaatccaggtataccgggattaatcagtttatgactgagacggtaaaaaactgcaaacgcgacggatttgtgcagactatcctcgggcgcagacggtacttgcccggcatcaaggacaacaacccgtatcggaaagcccatgccgagcggcaagcgatcaacaccatagtccaaggaagcgctgcagatatagtgaaaattgctacagtgaatattcaaaaacagttggagacctttcatagtactttcaagagtcacgggcacagggagggcatgctgcaatcagaccagactggcctgagcaggaagcgcaagctgcagggaatgttctgtccaatacgaggaggattcttcattcttcagttgcacgacgagctgctgtacgaggtggcggaggaagatgtggtgcaggtggcgcagatcgtgaagaatgagatggagtccgctgtgaagctgtctgtcaagctcaaagtgaaggtgaaaattggggcaagttggggcgagctcaaggactttgatgtttag

SEQ ID NO: 129261 - DNA, 8181 bp, Artificial Sequence
  Description of Artificial Sequence: Synthetic coding sequence
atgaatggccaccgttttacatttagaacccggagcctgctgcctttgcagaaaggacagcaccgctgtatcaccaaattgttggctcacaacgatccctggggaatctttcgggccccgagcagcagaagatcttacagtgtctccggagtgtgccagcctgccatccccaacagctctcttcacatccctcataacgcttgctggctgaagtggaaactgtgctcagaaatagccctgccttaccaccacatcctgggagagcgccgtaaactgtgcagcattaggaggttcgagttcgaagattggagagaggacgtccggagctgttgccaggctagggtgctaccccgcggacgaacactgggcctgtggttagccctgattgggcgagaggagttcgcaatgaatttgctgaggaggtctggtaagcgcagacgctccgagtctggaagtgactctttctccggcagcggtggcgactcaagtgccagcccgcagttcctaagcggtagcgtcttaagcccaccaccgggactcggccgatgcttgaaggccgccgcagcgggtgagtgcaagcccacagtgcccgattatgaaagagacaagctgttactggccaactggggcctgccaaaagcagttcttgaaaaataccactcctttggagtgaaaaaaatgtttgaatggcaggctgagtgtctcctgctcggtcaggtgctggaaggcaagaatcttgtttactcagccccaacaagcgccgggaaaaccttggttgccgagctgctcatcttgaagagggtcctcgagatgcgcaagaaagcccttttcatccttccctttgtttccgtggccaaagaaaaaaaatattacctgcaatcccttttccaggaggtggggatcaaggtggacgggtacatggggtctacctctcctagtaggcatttctccagtctcgacatcgccgtttgtacgattgaacgcgcaaacgggctcattaatcggcttattgaagagaataagatggacctccttggcatggtagtcgtcgatgaactccacatgctgggcgattcccacagaggttacctgctagagttactcctcactaagatctgctacataactagaaagagtgcctcctgccaggcagatctggccagctcactgagcaatgccgttcagattgtgggtatgagcgcaactctgcctaatctggaacttgtggcctcttggctgaatgctgagttgtatcacacggactttaggcccgtcccccttctcgagtcagttaaggtgggcaatagcatttatgactcttcaatgaaactcgtgcgtgagtttgaaccaatgctgcaagtgaagggcgacgaagaccatgtcgtgtcactttgttacgagactatctgcgataatcattctgtcttactattttgtcctagtaaaaagtggtgtgaaaaactggccgacataatcgcacgtgaattctacaatctacaccaccaggccgaaggcgagggcctcgttaagccttcggagtgtcccccggtgattctcgagcagaaagagcttctggaggtcatggaccagttaaggaggctcccttctgggttagactctgtgctccagaaaaccgtgccttggggggtggccttccaccatgcaggacttacctttgaagagcgggatataattgagggcgcgtttcggcaggggctcattagggtcctggcagccacctccaccctgtccagtggagtgaacctgccagcaaggagagtgatcattcggacacccatctttggaggccgccccctggacattttgacatataaacagatggtgggccgggctggcagaaagggggtggacacagtagagtctattctcatttgtaagaattccgaaaaaagtaagggcatcgcccttttgcagggaagccttaagcctgtaaggtcttgcctccagagacgcgagggcgaagaagtaaccggatcgatgattagggctattctcgagattattgtaggaggcgtagcaagcacctcgcaggatatgcacacctacgctgcctgtacctttttggcggcctcgatgaaagaaggaaagcaggggattcagcgaaatcaggaaagcgttcagctcggggccattgaggcttgcgtgatgtggctgctggaaaacgagttcatccagtcaaccgaggcctccgacggaactgaggggaaagtataccatcctactcatctgggctccgctaccctgagttccagtctgagcccagcagatactttagacattttcgcagacctccagagggccatgaaaggctttgtgctcgaaaatgaccttcacattttgtaccttgtcactccaatgtttgaagactggaccactattgactggtaccggtttttctgtctctgggagaagctgcctacctccatgaagagagttgctgagttggttggggtcgaggaaggatttctcgctcggtgcgtgaagggaaaggttgtcgcgcgcaccgagagacagcaccgccagatggccattcataagcggttctttactagtttggtcctgttggaccttattagtgaagtcccccttcgtgaaatcaatcagaaatacggctgcaaccgtggacagatacaatcccttcagcagagcgcggccgtgtatgcgggaatgattactgtctttagtaatcggttaggctggcataacatggaactcctgctgtcccagtttcaaaaaagacttacgtttggaattcagcgcgagctttgcgaccttgtgagagtcagcctgttgaatgcccagcgtgcccgcgtcctgtacgcctccggctttcacaccgtggctgacctggcccgggcgaatatagtggaagtggaagtgattcttaaaaacgctgttcctttcaaaagtgctaggaaggctgtcgacgaggaagaggaagcagttgaagagcggcgcaacatgagaacaatctgggttacaggaaggaagggactgactgagcgcgaggctgctgccctgatcgtggaggaggcgagaatgatcttgcagcaagatctagtggagatgggagtccagtggaatccatgcgcactacttcactcaagtacctgttcccttacccattctgagtcagaggttaaggaacatacattcattagccagactaagtcttcctacaaaaaactgactagtaagaacaagagcaacactatcttttctgatagttacatcaaacacagccctaatattgtgcaggacctgaataaaagccgagagcacacatcttctttcaattgcaactttcagaatggtaaccaggagcatcagacatgctcgatcttcagggctcggaagagggctagcttggacattaataaggaaaagcctggcgcctctcagaatgagggaaaaaccagcgataagaaggttgttcaaacgtttagccagaagactaagaaggctccgctgaacttcaactccgagaagatgtccaggagttttcgttcatggaagcggcgtaaacacctaaagcgctcgcgcgacagcagtcccttgaaggacagtggggcgtgcagaattcacttacagggacagaccctcagtaacccttctctttgcgaagaccctttcaccctggacgagaagaagacagagtttaggaacagcggtccattcgctaagaacgtgtcactgtccggcaaagaaaaagacaacaaaacttcgttccctttacagattaagcagaattgttcgtggaacatcaccctaacaaacgataatttcgttgaacacattgtgactggatctcagagtaaaaatgtcacttgtcaggccacatccgtcgtcagtgaaaaggggagaggcgtcgcagtggaggccgagaagatcaatgaagtgctaatccagaatgggtcaaagaaccagaacgtatacatgaagcaccacgatatacaccccatcaaccagtatctgcgcaagcagtctcatgaacagacaagcacaatcaccaagcagaaaaacatcatagagagacagatgccgtgcgaagctgtcagctcctatatcaatagagattctaatgtaacaatcaactgtgaacgtatcaaactgaatacagaagagaacaagccgtcccactttcaagccttgggagacgacatctctcgaactgtgatcccctctgaggtcttaccgtcagcaggagccttctcaaaatcagagggacaacacgagaactttctgaatatcagtcgtttacaggagaaaactggaacatacacaactaataagaccaagaataaccacgtttcagaccttggactcgtcctgtgtgacttcgaggacagcttctacttagatactcaatctgaaaaaatcatacagcagatggcaactgaaaatgccaaacttggcgcaaaagacacaaatctagccgcagggatcatgcagaagagtctggtccaacagaattccatgaactcattccagaaggaatgccatattccattcccggcagagcagcatcctctcggagcaactaaaattgaccacctggacctaaagactgtcggtaccatgaaacaatcctcagactctcatggagttgacatcctgactccagagagccccatcttccacagtcctatacttctggaggaaaacggactgttcctcaagaagaatgaggtgtctgtgactgatagtcagctcaattcgtttctccaggggtaccagacccaggagacggtgaagcctgtgatactcctgatccctcagaagagaacacccaccggcgtggagggagaatgtctgccggtgcccgagaccagcctcaatatgagtgatagcttactgtttgattcattttccgacgactatctggtcaaggaacaacttcctgacatgcaaatgaaagaacccctgcccagcgaagtcacaagtaaccatttctccgactccctgtgtctccaggaggatctgatcaaaaaatctaacgtcaacgaaaatcaggacactcaccaacagctgacttgctccaatgatgagagcataatcttctctgaaatggatagtgtgcaaatggtggaagccttggacaatgttgatatatttccagtccaagaaaaaaaccacaccgttgtcagtcctagggctttagagctcagcgatccagtgctggacgagcaccatcaaggcgaccaagacggcggagaccaggatgaacgtgccgagaaaagtaagctgaccggcacccgtcagaaccacagctttatctggtcaggagcgagttttgatctcagccccggactacagaggatcttagataaagtcagctcacctctggagaacgagaaactgaagtcgatgacaataaattttagttcactgaaccggaaaaataccgaactcaatgaggaacaggaagttatctctaacttggaaaccaaacaggtccaggggatttcattttctagcaataatgaagtaaaatcgaagattgaaatgcttgaaaacaacgccaatcatgatgagacatcttctctgcttcctagaaaggagagcaatatagttgatgacaacgggctgatcccccccacaccaattcctacttccgcgagcaagctgacatttcccggaatcttggaaacccccgtcaacccgtggaagacaaacaatgtgctgcagccaggcgaaagctacctctttggcagcccctcagatattaagaaccacgacctgtcccccggcagcaggaatgggttcaaagacaattcgcctatttcagacaccagcttctcattgcagctctcccaggacggtctgcagttgacccctgctagcagcagcagtgagtccctgagcatcattgacgtagcctcagaccaaaatctgttccagacctttattaaagagtggagatgcaagaagcggtttagcattagtttggcgtgtgaaaagatacgctccttaaccagcagcaagactgccaccattgggagtcgatttaagcaggcatctagcccccaagaaatccctattagagatgatggctttcccataaaaggctgcgatgacactcttgtagttggactggccgtgtgctggggaggccgcgatgcctattacttttcactgcagaaggaacagaagcatagcgagatttcagcgagcctggttcctccttctctcgacccctctttgacgctaaaggataggatgtggtatctgcaatcttgcctccgtaaggagtctgacaaggaatgcagcgttgtgatctatgactttatccagtcctacaaaatcctcctgctgagttgtgggatttctttagagcagtcctacgaggacccaaaggtggcctgctggcttctggatccagattcccaagagcccaccttgcatagcattgtcactagtttcctgccacatgaactgccactgcttgaagggatggagaccagccagggaattcagtccctgggcctcaacgccggatctgaacatagcggaaggtacagggcctccgtggagagtatactgatctttaactctatgaaccagctgaactccctgctccagaaggagaatctgcaggacgtatttcgaaaggttgaaatgcctagccaatattgtctcgcactcttggagttgaacggcatcgggttcagcaccgccgaatgcgaatcacagaaacacatcatgcaggccaagctggacgcaattgagactcaggcctaccaactcgcaggtcactctttcagttttacatcctctgatgatatcgcagaagtgctgttccttgaactcaagctcccacctaaccgggagatgaaaaaccaggggagcaagaagacgctgggctcaaccagacgcggtatcgacaacggtaggaagctgagactgggaagacagttcagcacatcaaaggatgtgctcaataagctgaaagcacttcatcccttgcctgggttgattttggagtggcgccgcattaccaacgcgataaccaaagtcgtgttccctctccagcgggagaagtgtctgaatccattcttgggaatggagaggatttacccagtgtcccaatcacacacagccactgggagaatcacatttaccgagccaaatatccagaacgtgcctcgcgactttgaaattaagatgcccaccctcgtcggtgagtcgcccccaagccaggcagtgggaaaggggttgctgccaatggggcgcggcaaatacaaaaaaggtttttcagttaatcccaggtgtcaggcacagatggaggaacgtgctgcagaccgtggaatgcctttcagcatttcgatgaggcatgccttcgtcccatttcctggcggcagtattttagcagccgattattctcagttggaactacggatccttgcacacctatcccacgatcgacggctgatacaagtacttaacacaggagcagacgtgttccggtctatagccgccgaatggaagatgattgaacctgagtctgtcggcgacgaccttagacagcaggccaagcagatctgctacggaattatctatggcatgggagctaagtcactgggagaacagatgggcataaaagagaatgacgcggcctgctatattgatagctttaagagtcgatacaccggaattaatcagttcatgactgaaaccgtcaagaactgcaagcgcgacgggtttgttcagacaatcctcggaaggcgccgctacttgccaggcattaaggataacaatccttaccgcaaggcccacgccgagagacaggcgatcaacactatcgtccaggggtccgcagccgatattgtcaaaatcgccaccgtgaatattcagaagcaacttgagaccttccactcgacgtttaagtctcatggacaccgcgaggggatgttacagtccgatcaaaccgggttgagtcgcaaacgaaagttacagggcatgttctgtcctatccgtggcgggttctttatcttgcagttgcacgatgagcttctctacgaggtagcagaagaggacgtggttcaggtggcacagatcgttaaaaacgagatggaaagcgcggtaaaactaagcgtcaagctaaaggtgaaggtgaaaattggggcgtcatggggggagctcaaggattttgatgtatag

SEQ ID NO: 129262 - DNA, 6642 bp, Artificial Sequence
  Description of Artificial Sequence: Synthetic coding sequence
atgcccacaagtaattcccagaaagagcttcttgaggtgatggaccagctgagacggttgccatccggactcgattcagtgctgcaaaagaccgttccgtggggcgttgcttttcaccatgccggactgacattcgaagaaagggatatcattgagggagccttccgccaaggactgattagagtcctggccgccacatctaccctaagcagcggggttaacttgcctgcccgacgcgtcataattaggacccccattttcgggggcaggcccttggatatcctcacctataagcaaatggttggtagagcagggaggaagggtgtggataccgtgggagagtctattctgatatgtaagaacagtgagaaatctaagggcattgctctcctgcaggggtcgctcaaacctgtccggtcatgcctgcagcgacgcgagggggaagaagtaactgggtccatgattagagccattctggaaatcatcgtgggtggtgtcgctagtaccagtcaggatatgcacacatacgccgcgtgtacattcctggcagcctctatgaaagaaggcaaacaaggtatccagaggaaccaagaaagcgtgcagcttggggcgattgaagcctgcgtgatgtggctgctagaaaatgaatttatccaatctacggaagcctcagacggtacagaaggcaaagtttaccatcctacccatcttggttcggcgaccctatcttcttcgctgagtcccgcagacacattagacatatttgcagatctgcaacgggctatgaaaggattcgtgttggaaaacgatttgcatatactctacctagtgactccgatgtttgaggactggaccacaatcgattggtacaggtttttttgcttgtgggaaaaacttcccacatccatgaagagagtcgccgaactggtcggtgtggaggagggattcctggctcggtgtgttaagggcaaggtggtcgcgaggacagaaaggcagcatcggcagatggccatccataaacgctttttcacttcactggtgctcttggatttaattagtgaagtccccctgagagagataaatcagaagtacggatgcaataggggacagattcagagcttgcaacaaagcgccgctgtgtacgcgggcatgatcaccgtgttcagcaacagactggggtggcacaacatggagctgctgctcagccaatttcagaagcgtctgaccttcgggatccagagggagttatgcgatttggttcgagtgtcacttctgaacgcacaacgtgcgagggttttgtatgcctctggattccacaccgtggccgatttagctcgggcaaacatcgtggaggtcgaggtgatcttgaaaaatgcagtgccttttaagtctgcacgcaaggcggtggacgaggaggaggaggctgtggaagagaggaggaacatgaggacaatttgggtcaccggccggaagggactcacggaacgagaagccgcggctctgatagttgaggaggccagaatgatcttgcagcaggacctagtcgaaatgggggtacaatggaatccatgcgcactgcttcactcgtctacctgttccttaacacacagtgaaagcgaagtgaaggagcacaccttcatttcccagaccaagtcatcatataagaagctgacatccaaaaacaagtccaacacgatcttctccgactcatacattaagcatagccctaatatcgtgcaggatttgaacaagtccagggagcacacctccagtttcaattgcaattttcaaaacggaaatcaggaacatcagacctgtagtatcttcagggcccgcaagagggcaagcctggacattaataaagaaaagcctggggcaagtcagaatgaggggaaaacctctgacaaaaaggtcgtccagacgttttcacagaagacaaaaaaggcaccgctgaactttaattcggagaaaatgagtcggagcttccggtcctggaagagaaggaaacacctgaagcgatcacgggatagttccccgctcaaggattctggtgcatgcaggattcacctgcagggacaaaccctgagcaatccaagcctgtgcgaagatcctttcacactggatgaaaagaaaaccgaattccgaaactcaggcccatttgctaaaaatgtttcgctttctggtaaagaaaaggataataaaaccagtttccctctgcagattaaacagaactgctcatggaacattacactcaccaacgacaacttcgtggagcacatcgtgaccggctctcaatcaaagaatgtaacatgccaggctaccagcgtggtgagcgagaagggccgcggggtagccgtggaggctgagaaaattaacgaagtcctgatccagaacggatccaagaaccagaacgtttatatgaaacaccatgatattcaccctatcaaccaatatctccgcaaacagagtcatgagcagacaagtacgatcacaaaacagaaaaatattatcgagagacagatgccatgtgaggccgtcagcagctacattaatagagactctaatgtcaccatcaactgcgagaggattaagctgaataccgaagagaataaaccaagtcatttccaggcattgggagacgacatttctcggaccgtgataccaagcgaggtccttccgagtgccggtgcattcagtaaatccgagggccagcatgagaatttcctgaacatttcaaggctccaggagaaaacaggaacctatacaacaaacaagacgaagaataatcacgtgagcgatctaggcctggtgctgtgtgactttgaggattctttctatctggatacgcagtccgaaaagatcatccaacagatggcaacagagaatgcaaaactcggagccaaagatacaaaccttgccgccggtatcatgcagaagtcccttgttcagcaaaacagcatgaattcatttcagaaagagtgtcacattccgtttcctgctgagcagcatcctctgggcgcaactaagatagaccacctcgatctgaagactgtgggtaccatgaaacagtcaagcgacagtcacggcgtggatattctcacgcccgagtctcccatttttcatagccctatccttctcgaagagaatggtctcttcctgaaaaagaatgaagtttcagtcacagatagccaactcaatagcttcttgcagggctatcaaactcaggaaacagtgaaacccgtgatactgttaatccctcagaaacggacaccgacaggggtggagggagaatgtcttcccgtaccagagaccagcttgaacatgtcagacagcttactgttcgactccttctcggacgattatttagtaaaggaacagctgcccgatatgcagatgaaggagccgctgcctagcgaagtcactagcaatcacttcagcgattccctgtgcctccaggaggatctcatcaaaaagagcaacgtgaatgagaatcaggatacccaccagcagttaacttgctccaacgacgagtcaatcatcttctccgagatggacagcgtgcagatggtggaggccttggacaatgtcgatatcttcccggtgcaggagaagaatcacacagtggtctccccaagagcgctagagctctctgacccggtgctggatgagcatcaccaaggcgaccaggacgggggcgaccaagatgaacgggccgagaaatctaagctcaccggcacaagacagaaccattcattcatctggagtggggcttcttttgacctatctcccggtctccagcgaatactcgacaaagtatccagcccattggagaacgaaaaattgaagagcatgaccatcaacttctcttcactcaaccgcaagaacacggagctgaatgaggagcaggaggttatctcaaacctcgaaacaaaacaggtgcaaggcatttcattctcctctaataatgaagtgaagagtaagatagagatgttggaaaataacgcaaatcacgacgagacctcttcactgctccccagaaaggagtccaacattgtggatgataacggcttaatcccgccgacgccgattccaacgtcggcgagcaagctaacctttcccggcatcctcgaaactcccgttaatccatggaaaactaacaacgtactgcagccgggcgagtcgtacctatttggatccccgagtgatatcaaaaatcacgatctgtcaccagggtccaggaacgggttcaaagacaatagccctatttccgatacgagcttctcgcttcagctgagccaggatgggctgcagttgacccctgcttcttcttctagcgagagtctgagcataatcgacgtagccagtgaccaaaacttatttcaaacattcattaaggagtggcgatgtaagaagagattctctatatccttagcatgcgagaagattcgctccctcaccagcagcaaaaccgctaccattggatctcgctttaagcaggcctcttccccacaggagatacctattcgggatgatggattcccaattaaaggctgcgacgacactctcgttgtggggctcgccgtgtgttggggcgggcgagacgcttactactttagtcttcagaaagagcagaaacatagcgagatttctgcatccctggtccctccatccttggacccgtcattgacacttaaagatcgtatgtggtacctccagagttgtcttcgaaaagaatcagataaagagtgtagtgtcgtgatctatgacttcattcaatcctataagatcctcctgctttcctgcggaattagcttggagcaatcctacgaggaccctaaagtagcatgttggctcttagatccagattctcaggaacccaccctgcactctatcgtcacatctttcctccctcacgaactgccactcctggagggaatggaaaccagccagggaatccaatcattgggccttaacgctggatcggagcattctggcaggtaccgtgcttcagtagagtcaatcttgatattcaactcgatgaatcaactcaactctcttctgcaaaaggaaaacctgcaggacgtatttcgtaaagtcgaaatgccctcccagtactgtttggccctcctggagttgaacggcattggtttcagtacagccgagtgcgaaagccagaaacatatcatgcaggccaagctcgacgccattgagacccaggcttatcagttggctggacattcatttagcttcacaagctcggacgacatcgcagaggtgctcttccttgaactgaagctacctccaaatcgcgagatgaagaaccaggggtcaaaaaaaacattgggcagcacccgccgtggtatcgataacggtcggaagctaagacttggccgccagttcagtacatcaaaggacgtgctcaacaaactcaaggccctacaccctcttcccgggctgatactagaatggagacgaatcaccaacgcgattaccaaagtcgtgttcccattgcagcgagagaagtgccttaatccgtttttggggatggagcgcatctaccccgtttctcaatcccacaccgccactggtagaatcacttttactgagcctaacatccagaacgtccctagggacttcgagattaagatgcccacacttgtgggcgagagcccaccttcccaggccgtcggcaaaggattgttgccgatgggaagaggcaagtacaaaaagggattcagtgtaaaccccaggtgccaggctcagatggaagaacgcgccgctgaccgaggaatgcccttctcgatcagtatgaggcacgccttcgtccctttcccgggcggcagtatacttgctgcggactattctcagctggagttacgcattctagctcacctctcacatgataggaggttgatacaggtactcaatactggcgctgatgtgtttcgaagtatcgctgcggagtggaaaatgattgaacccgagtctgttggggatgatctgagacaacaggctaaacagatctgttacgggataatctatgggatgggcgccaaaagcctcggtgaacagatgggcataaaagagaacgatgctgcatgttacatagactcgttcaaaagccggtatactggaatcaaccagtttatgactgaaaccgtcaagaactgtaagagagatggattcgtacagaccattttgggtcggcgcaggtatctgcctgggatcaaagataataacccctacagaaaagcccacgccgagagacaagcaataaacactattgttcaaggttccgccgcagatatcgtcaaaattgctaccgttaacatacagaaacagcttgaaacatttcactcaaccttcaaaagccatggccatagagagggaatgctccagtctgaccagaccggcttgtccaggaagaggaagcttcagggcatgttctgcccaattagaggaggcttcttcatcttgcagttgcacgatgagctcctctatgaggttgctgaggaggacgtggtccaggtagctcagatcgtgaagaatgagatggagagtgctgtgaagctgtctgttaaactcaaggtgaaagtgaagatcggagcttcatggggggagttgaaagactttgacgtgtag

SEQ ID NO: 129263 - DNA, 240 bp, Artificial Sequence
  Description of Artificial Sequence: Synthetic coding sequence
atgggtcgtaagaggttaattaccgactcataccccgttgtgaagcgccgagagggacctgccggccatagtaaaggggaacttgcccccgagttgggggaagaaccccagcccagggacgaggaggaggctgagcttgaattgctcaggcagttcgacttggcatggcagtatggaccctgcactgtgtccggcataagcattccgtacgaggcacctcgcaaaacctcttgcccctag

SEQ ID NO: 129264 - DNA, 324 bp, Artificial Sequence
  Description of Artificial Sequence: Synthetic coding sequence
atgggtcggaagcgattgataacggattcatacccagtggtcaaacgaagagaaggaccagcaggccacagcaaaggcgagttagcccccgaactcggggaggagccacagcctcgggatgaggaggaagcagaactggaactgttgaggcagttcgatctggcatggcaatatggcccttgtacgggcattactcgactgcagcggtggtgccgcgcaaagcagatggggcttgagcctcctcccgaagtgtggcaggtcctgaagacacatccaggggacccccgctttcaatgttcactctggcatttgtatccactgtag

SEQ ID NO: 129265 - DNA, 105 bp, Artificial Sequence
  Description of Artificial Sequence: Synthetic coding sequence
atgggaagaaagcgcctcataacagattcttaccccgtagtgaagcgacgagagggccctgctgggcactccaagggcgagctggccccagaattgggactttag

SEQ ID NO: 129266 - DNA, 1266 bp, Artificial Sequence
  Description of Artificial Sequence: Synthetic coding sequence
atggcggacatctctctcgacgaactcatccgcaagcgaggcgcggccgcaaaggggcgtctgaacgcccgcccaggcgttggaggggtgaggtctcgtgtgggcattcaacaaggtcttctgtctcagtctacacgcaccgcaacctttcagcagagattcgacgcgaggcagaagatcgggctgtccgacgcccgcttaaaactgggagtgaaagacgcaagggaaaaactcctgcagaaggacgctaggtttcgtatcaaaggcaaagtgcaggacgcccgcgagatgctgaactcaaggaaacagcagacaaccgtcccacagaaaccacgccaggttgccgatgctagagagaaaatctcactgaaacgctcatcacctgcggctttcatcaatccacctattggaacggtgacccctgctctgaagctgaccaagaccatccaggtgccccaacaaaaagccatggcaccccttcaccctcaccccgctgggatgcggataaacgtggtaaataaccaccaggcgaaacagaacctctatgacctcgacgaagacgatgacggaatcgcctcagtgcctaccaaacagatgaagttcgcagcttctggaggattcctacaccatatggctggcctctcctcctcaaagctctctatgtcaaaagctctcccactaacgaaggtggtgcaaaatgatgcctacaccgcccctgcactgccctcgagcattcgcaccaaggctttaaccaatatgtctagaaccctcgtgaacaaagaggaacctcctaaggaattgcccgcagccgaaccagtactctcacctctagagggaacgaagatgacagtcaacaatctgcatccccgagttactgaagaggatattgtggagctgttttgtgtgtgcggtgcactgaagagggctcgactggtgcacccgggggtggctgaggtggtatttgtgaagaaagacgacgcaattacggcctacaagaaatacaataaccgttgcctggacggccaaccaatgaaatgcaacttacatatgaacggtaatgtgatcaccagcgaccagccaatcctcctgcgcctgagtgattccccttcaatgaagaaggagtcagagcttcctaggagggtgaacagtgcctcttcaagtaaccccccagcagaagtggatcccgacaccatattgaaggcgctattcaaaagcagcggagcctctgtcacaacgcagcctacagagttcaagataaaattgtag

SEQ ID NO: 129267 - DNA, 558 bp, Artificial Sequence
  Description of Artificial Sequence: Synthetic coding sequence
atggctgatattagtttagatgaactgattcgcaagcgtggtgctgccgctaaaggccgccttaatgcccgccccggcgtagggggcgtccgatcccgagtcggtatccagcaggggctgctctcacagagcaccagaaccgccacatttcaacagcgcttcgacgccaggcaaaaaatcggcttatccgatgcaaggctgaaattgggcgttaaagacgcccgagaaaaactcctgcagaaggacgcaagatttaggataaagggtaaggttcaggatgcaagggagatgctgaatagcagaaagcagcagaccaccgtgccccagaaacctaggcaggtagctgacgcacgggaaaaaatttctctgaagagaagttcaccagctgcctttatcaaccctcccatcggcacagtgacacccgcactgaagcttacaaagacgatacaggtgggcctacgagccgtacctttgctctgtctggtctccggtggggcttgggtgggctcacgtagtcaagcttcatgtcctctaccaagtgggtctcggccgcattag

SEQ ID NO: 129268 - DNA, 1179 bp, Artificial Sequence
  Description of Artificial Sequence: Synthetic coding sequence
atggcagacatcagcctggacgaattgatcaggaagaggggggccgcagcaaagggacgccttaatgctaggccaggagtgggcggggttagaagtcgcgtgggcatccagcaggggctgttaagccagtctacgcgtactgctaccttccagcagcgctttgacgctcgacagaaaatcggcctaagtgatgctcggctgaagcttggggttaaggatgcgcgcgaaaaacttttacagaaggacgcacgatttcgaattaaagggaaagtgcaagatgctcgggagatgctaaattctagaaagcaacagactacagtgcctcagaagccacgtcaggtcgccgacgcccgggagaagatttccctgaaacgttcttctcctgcagcgtttataaacccgcccatcggaaccgtcactcccgccctgaagctcaccaaaacaatccagaacctgtacgacctagatgaggacgacgacggaatcgcctctgtgcctaccaaacagatgaaattcgccgccagcggggggtttctccaccacatggcaggattgagcagttccaagctgtctatgtcaaaagccctaccattaaccaaggtggttcagaatgatgcctacactgccccggccctaccaagcagcatcagaacaaaggcgctcaccaatatgagccgtaccctcgtgaacaaagaggagccccccaaggaattgccggccgcagaaccagttctctcgcctctggagggtaccaagatgacggtgaacaatttacaccctcgcgtaaccgaagaggatatcgtagagcttttctgcgtgtgcggagcactaaaacgcgcccgcctggtccaccccggcgtggcggaagtggtgttcgttaagaaagacgatgccatcacagcttacaagaaatacaacaacagatgccttgatggtcagccaatgaagtgtaatttacatatgaacgggaacgtgatcacgagcgatcagccgatactgctgcggctgtcggacagtcctagtatgaaaaaagagagtgaactacctcgtagggttaactcagcgtcctcctccaacccacccgcagaggtcgaccctgatactatcctgaaggccctgtttaaaagctccggagccagcgtgaccacacagcctacagaatttaaaattaaattatag

SEQ ID NO: 129269 - DNA, 690 bp, Artificial Sequence
  Description of Artificial Sequence: Synthetic coding sequence
atggctgacatctctctcgatgagttgatcaggaagcgaggcgccgccgccaagggtagactcaacgcaagaccgggggttggaggggtccgcagcagggttggcatccagcaggggttgctgagccagagtacacgaacagctaccttccaacagcgatttgacgctcggcagaagatcggcctgtctgacgcccggctcaaattaggggtgaaagatgcgagagagaaactgctgcagaaggacgcccgctttagaataaaagggaaggttcaggacgcacgggagatgcttaattcccggaagcagcaaaccacagttcctcaaaaaccaaggcaggttgccgacgctagagagaaaatctccttgaagcggtcttctcctgctgcattcatcaacccaccgatcggcacagtgacaccagctctgaagctcacgaaaacaatccagaacctgtatgatctggatgaagatgacgacggaatcgcctcagtccccactaagcagatgaagtttgcggcctctgggggattcctgcatcacatggcgggtctgtcatcgtcaaagttatctatgtccaaagcattgcctctgacgaaggtagtgcagaatgatgcttacacagcccctgcactcccctcaagtatcaggacaaaagccctgcccgtactgacttccccaggcacttag

SEQ ID NO: 129270 - DNA, 561 bp, Artificial Sequence
  Description of Artificial Sequence: Synthetic coding sequence
atggctcctcttcaccctcatcccgccggcatgaggatcaatgtcgtgaacaatcatcaggcaaagcaaaacctctatgatcttgatgaagacgacgacgggatcgccagcgttccaaccaaacagatgaagtttgcagcatcaggtggatttctccaccatatggctggattgtcatctagtaaactgtctatgtcaaaggcactgcctctgacaaaggtggtgcaaaatgatgcctataccgccccagcccttccttcatccatacgtacgaaggctttaactaatatgtcccggaccctggtcaataaggaagagccgccaaaggaacttcccgccgccgagccagtgctgtcacccctcgagggcaccaagatgacagtgaataatctacacccacgggtcacggaggaagatatcgttgagctcttttgcgtgtgcggcgctcttaaaagagcacgactagtgcaccctggtgtcgccgaggttgtttttgtcaagaaagacgacgcaattaccgcctataagaaatataataacagatgcctagatggtggatag

SEQ ID NO: 129271 - DNA, 555 bp, Artificial Sequence
  Description of Artificial Sequence: Synthetic coding sequence
atggctgatatctctttggacgaacttataagaaagcggggcgccgcagcaaaagggcgattaaacgcacgccccggagtcggcggggtgcggtctagagtgggcatccagcaaggtctgctaagccagtctactcgaacagcaaccttccagcaacggttcgatgctagacagaagattggactgagcgatgcccgactgaagttgggggtgaaggacgcccgggagaaactcctgcaaaaggatgcacggttccgcatcaaaggcaaggtgcaggacgctagggagatgctcaatagccgaaagcagcaaactactgttccccagaaaccccggcaggtagccgatgcccgagagaagatatcgttgaaaagatctagtccagccgcttttataaatccccccatcggtaccgtcacgcctgcgttaaagctgactaaaacaatccaggttccctcctttccatgccctagaccatctctgagccctaagtggttccggatgatgcacactcagctcctacttagcctgccattgttcgagcaaaagccatag

SEQ ID NO: 129272 - DNA, 354 bp, Artificial Sequence
  Description of Artificial Sequence: Synthetic coding sequence
atggcagctgccgctgcagcaggcagcggcacaccccgcgaggaggaaggacctgctggagaagccgcggcaagccagccccaagccccaacgtctgttcctggagcaaggctgagtcgcttaccattagctagggtgaaagccttagttaaggccgatccagacgtgaccctggccgggcaggaagctatcttcatccttgcccgtgcagcagaactgtttgtggaaaccattgctaaagacgcttactgctgcgctcagcagggtaaaagaaagacactgcagcgacgtgacctggataacgcaatcgaagccgttgatgagtttgccttcttggaaggcacacttgattag

SEQ ID NO: 129273 - DNA, 1029 bp, Artificial Sequence
  Description of Artificial Sequence: Synthetic coding sequence
atggcagctagtcaggcggtagaggagatgcgatcaagagtggtcctgggcgagtttggtgtgaggaatgtccatacaaccgactttccagggaactacagcgggtacgatgatgcttgggaccaggatcgcttcgagaaaaattttcgggtggacgttgtacatatggatgagaattccttagagtttgacatggtgggaatcgacgcagctatagccaatgcttttagaagaatcctgctcgcggaggtcccaactatggccgttgagaaggtgctggtgtataataacaccagcattgtgcaggacgagatccttgcccatcgcctgggcctaattcctattcatgccgatcccaggttgttcgagtacagaaatcagggggatgaggagggaacagagattgacacactgcagttcagattgcaggtcagatgcacccgaaatcctcacgccgcaaaagattcttctgatcccaatgagctctatgtgaatcataaggtctacaccaggcacatgacgtggatcccgctcggcaatcaggccgacctctttccggagggtactattcggcccgttcatgacgacatcctcattgcccagctgagaccaggacaagagatcgaccttctcatgcattgcgtcaaagggattggcaaagaccacgcgaaattctcaccggtggcaacagcttcctatagactgcttcctgatataaccctccttgaacccgtggagggggaagctgccgaagagttgagcagatgcttcagccctggcgtgatagaagtgcaggaggttcaggggaagaaagtagcaagagttgcgaaccccagactagatacattctcaagggaaatttttagaaatgagaaactgaagaaggttgtgcggctggccagagtgagggaccactacatttgtaagaaggacctgctggctgccgtcgcgcacacttgcaatccaagcacattgggcggacaaggggaatggataaccggatctcgggagcgggaccatccagggtag

SEQ ID NO: 129274 - DNA, 633 bp, Artificial Sequence
  Description of Artificial Sequence: Synthetic coding sequence
atggcggtcgagaaggtgttagtctacaacaatacatcaatcgtccaggatgagattctggcgcaccgcctgggtttgattcctattcacgccgaccctcgcctgttcgaatacagaaaccaaggagacgaggaaggtactgagatcgatacactgcagtttagactgcaggtgagatgcacccggaatccgcacgctgctaaagacagttctgatcctaatgaactttacgttaatcataaagtctatacgagacatatgacctggattcccttgggtaaccaggccgatctcttccctgaaggcacaattcgacctgtgcacgacgacattctcattgcccaattacggcccggccaagagatcgacctgctcatgcactgcgttaaaggaattggaaaaaaagtggctagggtggcgaacccaaggctagatacattctctagggagattttccgaaatgaaaagctcaaaaaagttgtcaggctcgcccgggttagagatcattacatcttctcagttgagtcaacgggtgttctgccgcccgatgtgctggtgagtgaggccatcaaagttctgatggggaagtgccgcagattcctggacgaactcgacgcagttcagatggactag

SEQ ID NO: 129275 - DNA, 1041 bp, Artificial Sequence
  Description of Artificial Sequence: Synthetic coding sequence
atggccgcctcccaggccgtcgaggagatgaggagcagagtggtgctgggggagttcggagtccggaacgtacataccacagattttcccggaaactattctgggtatgacgacgcttgggaccaagatagattcgaaaagaatttccgagtggacgtggtgcacatggatgagaactccctggagttcgatatggtgggcatcgatgccgccatcgccaacgcctttcgcaggatattgctagccgaagtacccactatggctgttgagaaagtcctcgtgtacaataatactagcattgtccaggatgagattctggcccatcgtctgggcttaatccctatccacgctgacccccgtcttttcgagtaccgtaaccagggtgacgaggaagggacggagatagatacactgcagtttcgactacaggtccggtgcacacgcaatccacacgccgccaaagattcaagcgaccctaatgagttgtatgtgaaccacaaggtatacactcggcacatgacctggatcccactgggtaatcaggcagacttgttccccgaggggactattaggccagtgcatgatgacatcctcatcgctcagctccgccccggtcaggagatagatctgctaatgcactgcgttaaggggatcggcaaagatcacgccaaattttcacccgtggctactgcatcttacaggctactgcccgatataaccctccttgaacccgtcgagggagaggcggctgaagagttgtcccggtgtttttctccaggagttattgaggtgcaagaagtccagggcaaaaaagtcgctagggtggccaatccaaggttggacacctttagcagggagatttttcgaaatgagaaactaaagaaggttgtgagactcgctagggtcagagaccattacatcttcagtgttgagagtaccggcgtgctgccgcccgacgtcctggtttccgaggccattaaagtcttgatgggaaagtgtagacgtttcctggacgagctcgatgccgtacaaatggattag

SEQ ID NO: 129276 - DNA, 369 bp, Artificial Sequence
  Description of Artificial Sequence: Synthetic coding sequence
atggaagaggatcaagagttggagaggaaagcaatcgaagagcttctgaaagaggctaaacgggggaaaactagagctgagacaatgggtccaatgggctggatgaagtgtccgctcgcttcaaccaacaaacgtttcctaattaacactatcaaaaatacactcccctcccacaaggaacaagatcacgaacaaaaagagggcgataaggaacccgcaaagtctcaggctcaaaaggaagaaaatccaaagaagcatcgatcgcacccctataaacacagtttccgcgcacgggggagtgccagctattcacccccaaggaagaggtcttcccaagataagtacgagaagcggtctaacagaaggtag

SEQ ID NO: 129277 - DNA, 402 bp, Artificial Sequence
  Description of Artificial Sequence: Synthetic coding sequence
atggaggaggatcaggagctggaacgaaaaatctccgggttaaagacctctatggcagaaggtgaaagaaagaccgccttggagatggtgcaggccgcagggacagataggcactgcgtgaccttcgttctgcacgaagaggaccacaccctggggaactcactgaggtatatgataatgaaaaacccagaagttgagttctgcggctatactaccactcacccaagtgaatcaaagataaacttaagaatacaaacacgcggaacgctccctgccgtggaacccttccagcggggacttaatgagctgatgaatgtgtgtcagcacgtactggataaatttgaggcttccataaaagactacaaggaccagaaggcaagccgtaatgaatctaccttttag

SEQ ID NO: 129278 - DNA, 402 bp, Artificial Sequence
  Description of Artificial Sequence: Synthetic coding sequence
atggaggaggatcaagagctggagcggaaaatctctgggcttaaaaccagcatggctgagggcgagcgtaagacggctcttgaaatggtgcaggcggccgggacagacaggcactgcgtgactttcgtgctccacgaagaggatcatactctgggaaattctttacggtatatgatcatgaaaaacccagaagtcgagttttgtgggtacacaacgacccacccttccgagtccaagatcaacctgaggatccagacgagaggaacattacccgctgtagaaccgtttcaacggggcctcaatgagctgatgaacgtgtgtcagcatgtgctggacaaatttgaagccagtatcaaggattataaggaccagaaagcatcacgcaacgagagtaccttctag

SEQ ID NO: 129279 - DNA, 5913 bp, Artificial Sequence
  Description of Artificial Sequence: Synthetic coding sequence
atgcacggagggggccccccttcaggcgattccgcttgtcccctacgtaccatcaagcgcgttcagttcggtgtgttgtctcctgatgaattaaaacggatgagtgtcactgagggagggatcaagtaccctgaaacaactgaggggggccggccaaaattgggtggtctcatggaccccagacagggagttatagagcgaaccgggaggtgtcagacttgcgctggaaacatgaccgagtgccccggtcactttggacatatcgaattagcaaagccggtctttcatgtaggctttttggtgaaaactatgaaggtgctccgctgcgtgtgctttttttgcagtaagctgcttgtggacagcaataacccgaaaatcaaggacatactggcaaagtccaagggacagccgaagaagcggttgactcacgtatatgacctttgcaaggggaaaaatatctgcgaagggggcgaagagatggacaataagttcggtgtcgagcaacccgaaggggatgaggatctaacaaaagaaaagggacatgggggatgtggcagataccaaccccgaatcaggcgctcaggcttggagctttacgccgaatggaaacacgtgaacgaggacagccaggaaaagaaaatcctcctttctccagagcgggtgcacgagatcttcaaacggatctccgacgaggaatgctttgtcctcgggatggaaccacgctacgcacgccccgaatggatgatcgtgacggtgctaccagtcccacccctatccgtgcgccctgctgttgtgatgcaaggatccgctagaaatcaggacgacttaacccataagctggcagatattgtgaagataaacaatcagctgagacgcaacgaacagaacggagcagccgcccacgtgatcgcagaagacgtaaaattgcttcagttccacgtcgccacgatggtggacaatgagctcccaggcctgccaagagcgatgcagaagtccggtagacctttgaaatctctgaagcagcggctcaaaggtaaagaaggacgggttagaggcaatttgatgggaaagcgtgtggacttttctgcaagaaccgtgataactcctgatcccaacctctccatcgatcaggtaggggtgccaaggagcattgccgccaacatgacgtttgccgagatcgtgacacctttcaatatcgatcgcctgcaggaactggtgcggcgcgggaatagccaatatcccggagcgaagtacataatacgggacaacggagacagaatcgatctgcgtttccaccccaaaccttcagatctgcacttgcagactggttataaggttgagcggcatatgtgcgacggagacatcgtaatcttcaaccgccaacctacgttacataagatgtctatgatgggccatagagtacggattctgccatggagcaccttcagactaaacctgagtgtcaccacaccctataatgctgatttcgatggggatgagatgaacttgcatctaccccaaagcttggaaactcgcgcagagatccaggaactggcaatggtacccaggatgattgtgacaccccagtctaacagacccgtaatggggatcgtccaggacaccctcacggccgtcagaaagtttaccaagcgtgacgtgttccttgagcggggtgaggtcatgaatctgctcatgttcctctctacatgggatggtaaagttccacaacctgctatcctgaagccaaggcccctctggaccggaaaacagatttttagtcttatcatccctggccacataaactgtatacggacccattctacccatcccgatgacgaggactctggtccgtataagcatattagccccggcgataccaaggtcgtcgtggaaaacggagaactcatcatgggcattctgtgtaaaaagtccctgggaactagcgctggatcccttgtgcatatatcctacctggaaatggggcacgacatcacccggttgttctactcgaacatccaaaccgtgatcaataactggttgctcatcgagggacacaccatcggtatcggcgactccatagccgatagcaagacatatcaggacattcagaacactataaagaaggctaagcaagatgtgatagaggtgattgagaaggcccacaataacgagcttgagcctactccaggcaacacattacggcaaacgtttgagaaccaggtaaaccggatcctgaacgacgccagagacaaaaccggctctagtgcgcaaaagtcccttagcgaatacaacaatttcaagtcgatggttgttagtggagctaaaggttctaagataaatattagtcaggtaattgccgttgtgggccagcagaacgtcgagggtaagagaattccttttggattcaagcaccgaactctgcctcattttattaaggatgactacggaccggaatctagagggttcgtcgagaactcttacctggcagggctcaccccgactgaatttttcttccacgctatggggggccgagaaggcttgatcgacacagccgtgaaaactgctgaaacagggtacattcaacgacgcttaatcaaatcaatggaatcagtgatggtcaagtatgatgcgaccgtccggaactccattaaccaagtggtgcagttgaggtacggggaggacggactggctggtgaaagcgtggaattccagaatctcgccacactcaagcctagcaacaaagccttcgaaaaaaagttccggtttgattacacaaacgaacgggctttaaggagaaccctgcaggaggacctggtgaaggatgtcctgagcaacgcccatatacagaatgagctcgaaagggaatttgagcgcatgcgcgaagatagagaggtgttgagagtcatattcccaaccggcgactctaaggtggtacttccttgcaacctgctgagaatgatatggaacgctcagaaaatatttcatataaatcccaggctgccttccgatcttcatcctatcaaggtagtggagggggtgaaagaattgtcaaagaagctggtgatcgtgaacggagacgaccccttatctagacaagcccaggagaacgccacactcctgttcaatatccacctaaggtcgaccctgtgttcccgcagaatggccgaagagtttcggctgtctggcgaagcattcgattggctgctgggcgagatcgaatcaaagttcaaccaagctattgcccatcctggcgaaatggttggggctttagccgcccagtctttgggagagccggcaacccagatgaccctcaataccttccactacgccggcgtttcagcgaagaacgttactctgggggttcccaggcttaaagaactgattaacatttctaaaaagccaaaaaccccctctcttactgtttttctgctgggacaatcagccagagacgcagagagagccaaggacattctatgccgcctcgaacatacaacactcaggaaagtgacggccaataccgccatctactatgaccccaatccccaatctactgtcgttgcagaagatcaggagtgggttaatgtgtattatgagatgcctgatttcgatgtagccaggatctccccatggctgctgcgcgtggagctggatcgcaaacatatgaccgaccggaaacttaccatggaacagatagccgaaaaaataaatgctggcttcggggacgaccttaactgcatctttaacgatgacaacgctgaaaaactggttctgcgcattagaataatgaacagcgacgagaataaaatgcaggaagaagaggaggtggtggacaaaatggatgatgatgtattcttgaggtgcatcgagtcaaatatgttaaccgatatgactctccagggcatcgaacaaatctcaaaagtctatatgcatcttcctcagaccgataataaaaaaaagattattatcaccgaggatggggaatttaaggctctgcaggagtggatcctggagactgacggcgtcagcctgatgcgcgtgttgtctgaaaaagacgtggatccagtgcggaccactagcaatgatattgttgaaatatttactgtgctgggcattgaggccgtgcgtaaagcactggagagagagctgtaccacgtaatttcattcgacggatcctacgtgaattataggcacctggctctgctctgcgatactatgacctgccgggggcacctgatggcgatcacacgccatggcgtaaaccgacaagacaccggcccccttatgaagtgcagtttcgaagaaaccgtagacgtcctaatggaggccgccgcgcatggtgagagcgaccccatgaaaggtgtgagcgagaacattatgttgggccaacttgctcctgccgggacaggctgcttcgacttacttctggacgcagagaagtgtaagtatggcatggagatccctacaaacatccccggactcggcgccgcaggtcccaccgggatgttttttggctctgctccaagccccatgggagggatttccccagcgatgactccatggaaccagggagctactccggcgtacggagcctggagtccatccgtcggctcaggaatgacacccggggcagccggctttagtccgtcggcagcgagtgatgcctccgggttctcaccgggttattcccccgcctggtcccccacaccagggtctcccggaagtccaggtcctagctccccatacatcccctctccagggggggcaatgtccccttcatacagccccacaagtcctgcttacgaacctcggtcccccggcggatacacaccccagagccccagttattctcccacaagtccctcatactctcccaccagcccgagctatagccccacctccccgaactactcccctacctcaccctcctacagtcctaccagcccgtcgtattcccctacctccccctcatactcccctacgagccccagttatagtcccacctctccttcttacagccccactagccccagctactcacccacttcaccaagctactcccccacaagccctagttacagcccaacatcccctagttactcccccacttccccgagctactcaccgacatctccttcgtactcgcccaccagcccttcctacagtcccacttcaccgtcctacagccctaccagcccaagctatagcccaacgtctccctcatactcacctacgtcgcctaattacagccccacttctccgaactacacccccacatccccctcttacagccccacaagtccctcctactctcctacttcaccaaactacaccccgacctccccgaactactctccaaccagcccttcttacagccccacaagtcccagttactcgccgacatctcctagctatagcccctcaagcccccgttacaccccccaaagtccaacttatacccccagctctccgagctatagcccttctagccccagctattctcctgcctctccgaaatatacccccactagcccctcctactcacctagcagtccagagtatactccaacttctcctaagtactccccaaccagtccaaagtacagtcctacttctcctaagtacagtcccacctcaccaacttacagccccaccaccccgaagtactcaccgacttcccctacatattccccaacgtccccagtttatacgcctaccagcccaaaatacagtcccacttccccaacatattcgccgacctcacccaagtatagccccacaagtcccacatacagtcccacctcgcctaaaggcagcacctacagccctacctctcctgggtactctcctacctcccctacctactcgctcactagtcccgccatatccccagacgattccgacgaggagaactag

SEQ ID NO: 129280 - DNA, 1626 bp, Artificial Sequence
  Description of Artificial Sequence: Synthetic coding sequence
atgcccggtcggtgtcaatctgacgccgctatgcgagtgaacgggcctgcttctagagcaccagcgggatggacttcaggctccctgcacacaggccctagagctggcaggcctcgagctcaggcaaggggcgtgcgtggacgtggcctccttctgagacctcggcctgcaaaggagctgcccctgcctcgtaagggtggagcctgggcccctgccggaaaccctggaccccttcaccctctgggagtcgccgtcggcatggcagggtcgggaagactagtcttgcggccttggattcgcgaactcatcctgggttccgagacacccagttctcctagggctggacagctcctcgaggatgcagaagccgcagtggcagggcccagccacgcaccggacacaagtgacgtgggagcaacactgctagtgtctgatggcacccacagtgtccgttgcctggtgaccagggaagcactcgatactagcgactgggaagaaaaagaatttggctttcgaggaacagaaggacgactgttactcctgcaggattgcggtgtccacgtgcaagtcgccgaggggggcgctccagcggaattttatttacaggtcgataggttctccctgctgcccacggagcagccccggttaagggtacctggatgcaatcaggacttggatgtgcagaaaaagttgtacgactgcctcgaagagcatttgagtgaatccacgagtagtaacgcaggactgtctctctcacagcttctggacgagatgcgagaagaccaagagcaccagggcgcgctggtttgccttgccgagtcatgccttactttggaggggccatgtacagccccaccagtgacacactgggccgcaagccggtgcaaggccaccggcgaagcggtgtatacagttccatcttctatgctgtgtatcagcgaaaacgaccagttgatcctgagctcactgggtccttgtcagcggactcaggggcccgaacttcccccccctgatccagccttgcaggacttgtcccttaccttgatagcttcaccgccctcttcaccgtcctcctctggcacaccagcactgcccggacacatgtcttccgaggagtccgggacaagcatcagcctcctgcctgctcttagcctggcagcacctgatccaggtcagcgctcaagctctcagcccagccccgccatctgctctgcacctgccacattaacccctcggagcccccacgcttcaaggactcctagctcacccctccagtcctgtaccccatccctgtcaccaaggagccatgtgccatccccccatcaagcactcgtcacccggcctcaaaaacctagtctagagtttaaggagtttgtcggcttgccctgtaaaaaccgccctccatttccacgcacaggcgcaacgcgtggcgcacaagagccctgcagtgtttgggaaccaccgaagagacatcgtgatggcagtgcctttcagtacgagtacgagccaccctgtacgtcattgtgcgccagggtgcaggcggtgagactgcccccgcagctcatggcttgggccctgcacttcctgatggatgcccagccaggttctgagcctacccccatgtag

SEQ ID NO: 129281 - DNA, 2040 bp, Artificial Sequence
  Description of Artificial Sequence: Synthetic coding sequence
atggaccgcgtgaccagataccctatcttgggtattcctcaggcccaccgcgggaccggactggtgctggacggcgacacatcctatacttatcacctggtgtgcatgggcccagaggcctctggatgggggcaggatgaacctcagacttggcctactgaccacagggcacaacagggagttcagagacagggcgttagttatagcgtacatgcttacactggtcagccatcacctaggggcctgcacagcgaaaaccgcgaagatgagggatggcaggtgtatcgtctgggcgcccgcgacgcccaccagggacgcccaacatgggcccttagacctgaggacggggaggacaaagaaatgaaaacttatcgattagacgccggcgatgcagacccgagacgcctgtgtgatttggagcgagagagatgggcggttatccagggccaggccgtgagaaaatcctccaccgtggccaccctgcagggcacccccgaccacggcgatccccggaccccgggccccccaagatccacaccactggaagaaaatgtggtggatcgcgaacagatcgatttcttggccgctcgacagcagtttctttccttggaacaggccaataagggggccccacattcaagccctgctcgggggactcccgcaggaaccacaccgggggccagtcaggcccctaaagcatttaataaacctcacctggctaatggccacgtggtccccattaaacctcaggtgaagggagtggtccgcgaagagaataaggtacgggcagtaccaacctgggcatccgtccaggtcgtagatgacccaggttccctcgcgagcgtcgagtcacctgggactccaaaggagacgcccattgagcgggaaattagactcgcacaggagagggaggcagacttgagagagcagcgaggtctgcgtcaggctacagaccatcaggagctcgttgagatccctactcggcccttacttaccaaattgtctctgataactgccccccggagagaacggggaaggccctcactatacgtgcagcgcgatatagtgcaggaaactcagagggaggaagaccacaggagagaggggctgcacgtggggagagcttcgacccccgattgggtctcggagggcccacagcctggactgcgccgagctctgtccagtgattcaatcctttctcccgcacccgacgcaagagctgccgaccccgctccagaagtgcgcaaagtcaaccggatccctcccgatgcatatcagccatatctgtcccccggcacgccccagctggagttttcagcattcggggctttcggcaagccctctagcctgtcgacggccgaggcaaaggctgcaacctcacctaaggcaaccatgtccccgcgacatttgagcgagtcgtcaggcaaacccctcagtacaaaacaggaggccagtaagcctccgcgcgggtgtcctcaggctaatagaggagtggtgaggtgggagtacttcagattgagacctctacgtttccgggcccctgacgagcctcagcaggcacaggtgccccacgtttggggctgggaggtggccggtgccccagcgctccggctgcagaagtctcagagtagtgatctactggaacgtgagagggaatcagtactacgacgggagcaggaagtcgctgaggagaggaggaacgctctattcccagaggtcttctctccaaccccggacgagaactctgaccagaattcccggagtagctcccaggcatctggaatcaccggatcttatagcgtcagtgaatctcccttcttctccccaatacatctacactcgaatgtcgcatggactgtggaggatccagtcgacagcgcacctccgggccagcgcaagaaagagcaatggtatgccgggatcaatccatctgatggcattaactctgaagtgttggaagcaatccgcgttacaagacataagaacgctatggctgaacggtgggagtcccgcatctacgcctcagaagaggacgattag

SEQ ID NO: 129282 - DNA, 381 bp, Artificial Sequence
  Description of Artificial Sequence: Synthetic coding sequence
atgagtgacaacgaggataacttcgacggtgatgactttgacgatgtggaggaggatgagggccttgacgacctggagaatgcggaagaggaagggcaagaaaacgttgaaatacttcctagcggcgagaggcctcaagccaatcagaagcgcatcactaccccttatatgacaaagtatgaacgggctagagtcctgggcacaagagccctacagatcgccatgtgcgctcctgtgatggttgagctcgaaggggagaccgatcccctgctgatcgccatgaaggagctcaagctcctgtggggccttgagtacaccgtgctgcggccctcctatgccctcgcccattcactgggcagcttcagcatttcatctcggtag

SEQ ID NO: 129283 - DNA, 477 bp, Artificial Sequence
  Description of Artificial Sequence: Synthetic coding sequence
atgtctgataatgaggacaatttcgacggcgatgatttcgatgacgtggaggaggatgagggcttagacgatctcgaaaacgcggaagaagaggggcaggaaaacgtggaaattcttccctccggggaacgacctcaggccaaccagaaacgtatcacaacaccatatatgacaaagtatgagagggctagggtattgggcactagagcactccagatcgcaatgtgcgcaccagtgatggttgaacttgagggagagaccgatcccctcctgatcgctatgaaagagttgaacgcacggtccgctagtgagccgccaggtgaggaaccaccatggatggacagggggaccagggacgagcatttgccgagctgccctggttgtcctgcggtcgcatctaacactcgctgctgtccaccggccgcgtgtctgccaggaatctctctttcccgcaggcgccggttgagagaggaatag

SEQ ID NO: 129284 - DNA, 384 bp, Artificial Sequence
  Description of Artificial Sequence: Synthetic coding sequence
atgagtgacaatgaggataatttcgatggagacgatttcgatgatgttgaggaagacgagggccttgacgatcttgagaacgcagaagaagagggacaggagaacgtggagattcttcccagtggggagagaccccaagccaatcagaagcggattacaactccctacatgaccaagtacgaacgggccagggtactgggaacccgggctctacagattgcaatgtgtgcccccgtgatggttgaactagaaggcgaaaccgatccactgctgatagctatgaaggagctgaaggcgcggaaaatcccaataatcattcggcggtacctcccagatggcagctacgaggattggggagtagatgaactcataattaccgactag

SEQ ID NO: 129285 - DNA, 519 bp, Artificial Sequence
  Description of Artificial Sequence: Synthetic coding sequence
atgttctaccacatttctctggaacatgaaatcctcttgcatccccgatactttggcccaaacttgctcaacaccgtcaaacagaagctcttcacagaggtggaaggaacatgcacgggcaagtacggtttcgttattgctgtcaccactattgataacatcggggccggcgtgattcagcctggacggggtttcgtgctgtatccagtgaagtataaagccatcgtttttcgcccttttaagggggaagtcgtcgacgcggtagtaacacaggtcaataaagtcggcctctttaccgaaatcgggccaatgagttgttttattagccgccactccattccctcggaaatggaattcgaccccaactctaatccaccttgctacaagacaatggatgaagacattgtcatacaacaagatgatgagattcgcttaaagattgttggcaccagggtggacaagaatgatattttcgcaattgggtccctgatggatgactatttaggccttgtgagctag

SEQ ID NO: 129286 - DNA, 453 bp, Artificial Sequence
  Description of Artificial Sequence: Synthetic coding sequence
atggccggtattttatttgaggatatcttcgacgtcaaggacatagatccggaggggaaaaagtttgacagagtcagccgcctgcattgcgagagtgaatctttcaaaatggacctgatcttggacgttaatattcagatttacccagttgacttaggcgacaagttcaggctggtgatcgcctctacactgtacgaggacggcacactggacgacggggaatataatcccacagatgatagaccttcgcgagccgatcagtttgagtatgttatgtatggaaaggtttacagaatagaaggtgatgaaacatccaccgaggcggctactcgattgtccgcgtacgtgagctacggtggactgctgatgaggctgcagggggacgccaataacctgcacggtttcgaagtggattctcgggtgtatctgttgatgaaaaaactagccttttag

SEQ ID NO: 129287 - DNA, 39 bp, Artificial Sequence
  Description of Artificial Sequence: Synthetic coding sequence
atggctggtattcttttcgaggatatcttcgacgtgtag

SEQ ID NO: 129288 - DNA, 450 bp, Artificial Sequence
  Description of Artificial Sequence: Synthetic coding sequence
atggcaggtatcctgtttgaggacattttcgatgtcaaagatatcgaccccgagggcaaaaaattcgacagagtatcacgtctacactgcgaatctgagtcttttaaaatggatctgatcctcgatgtcaatatccagatctatccggtggatctgggagataagtttcgcctagttatagcctccactttgtacgaggatggaactctagacgacggcgagtacaaccccactgacgatcgcccttcaagagctgaccagttcgaatacgtgatgtacgggaaagtttataggatagaaggagacgagactagtaccgaagccgcgaccaggctgagcgcctacgtaagctatggcggtctgttgatgcgtctgcagggcgatgcgaacaatttgcacgggttcgaggttgattcgagggtttatctgctcatgaagaagcttgcctag

SEQ ID NO: 129289 - DNA, 453 bp, Artificial Sequence
  Description of Artificial Sequence: Synthetic coding sequence
atggccggcatcctgtttgaggacatctttgacgtgaaagacatcgatcccgaaggcaaaaagttcgaccgcgtatctcggttgcattgcgaatccgaatcttttaaaatggacctcattctggatgtgaatattcaaatttaccccgttgatttgggagacaagtttaggctggtgattgccagcacattgtatgaggacgggacccttgacgacggagaatacaacccgacggacgacagaccatccagagctgaccaattcgagtacgtaatgtatgggaaggtgtaccgcatagagggcgacgagaccagcaccgaggctgctactagactgagcgcgtacgtatcttatgggggccttctcatgcggctgcagggggatgccaacaaccttcatgggttcgaggtagactcgagggtatatctcctgatgaaaaaactggccttttag

SEQ ID NO: 129290 - DNA, 1491 bp, Artificial Sequence
  Description of Artificial Sequence: Synthetic coding sequence
atggaggaacagcgtgaggcccttaggaaaattataaaaacactggcagttaagaatgaagagatccaaagtttcatctatagcctgaagcagatgctgcttaacgtcgaagctaacagcgcaaaggtgcaagaggatctcgaggccgaatttcaaagtctcttctccttgctcgaagagctgaaggaaggaatgcttatgaagattaagcaggaccgggcttctcggacttacgagctccagaatcagttggctgcatgtacgcgagccctggaatcatccgaggagctactggagacggccaatcaaaccctccaggcgatggattctgaagattttccacaggcggccaaacagatcaaagatggcgtaaccatggcaccagccttcaggctgtcgcttaaggccaaggtgagtgacaacatgagtcacctgatggtcgacttcgcccaagagcgacaaatgctccaggccttgaaatttctgccggtgccaagcgcccctgtgatcgacctggctgagagcctggtggcagacaactgcgtcaccctggtatggcggatgcctgacgaggattctaaaatcgaccactacgttctagagtaccgcagaacaaactttgaaggaccccctaggctcaaggaggatcaaccctggatggttatcgagggcatacgacaaactgagtatacactcaccggacttaaatttgacatgaagtacatgaattttagagtgaaggcttgcaacaaagctgtcgcgggcgaattcagcgagcccgtgaccctcgaaacccccgccttcatgttcagactagacgcctctacttcccaccagaacctgagggttgacgatctgagcgtggaatgggacgccatggggggaaaggtccaggacatcaaggcgcgcgagaaagacgggaaggggagaactgccagccccattaattccccagctcgaggcacaccctctccaaaaagaatgccatccggccgggggggcagagatcgctttaccgctgaatcgtatactgtgctgggcgacacactgatcgatggcggtgagcactactgggaggtaaggtacgagcccgactccaaggctttcggggtgggcgttgcctataggtccttaggccggtttgagcagttgggaaagacggccgcctcttggtgtttacatgtcaacaactggctccaagtgtcattcactgcaaagcatgccaataaagttaaggtcttggacgccccggtgcccgattgcttaggagttcactgcgacttccatcaagggttgctgtctttttacaatgcccgtacgaagcaggtcctccacacttttaaaaccagattcacccagcctctgttgcccgcttttaccgtctggtgtggaagtttccaggtgaccacaggtctccaggtaccttctgccgttagatgcctgcagaagcgggggtccgcaacatcttccagtaatacaagccttacatag

SEQ ID NO: 129291 - DNA, 354 bp, Artificial Sequence
  Description of Artificial Sequence: Synthetic coding sequence
atgaacgccccaccagcattcgaatcattccttcttttcgagggtgaaaagaaaatcacaataaataaggatacaaaggtacctaatgcgtgtttgttcaccattaataaggaggaccatacgcttggaaatattatcaagagccagcttctaaaagatccccaagtgctgttcgcgggctacaaagttcctcatccactggaacataagatcattatccgagtccaaacgactcccgactattcgcctcaggaggcatttacaaacgcaatcactgacctcatatcggagcttagtctgctggaggagaggtttagagtcgcaatcaaggataaacaggagggtatcgaatag

SEQ ID NO: 129292 - DNA, 384 bp, Artificial Sequence
  Description of Artificial Sequence: Synthetic coding sequence
atgaacgcaccacctgcattcgaaagcttcctgctgttcgagggtgagaagaaaatcacaattaacaaagatactaaagttcctaatgcatgtttgtttaccatcaacaaggaagaccatacactcggaaatataatcaagtctcagctgctcaaggaccctcaggtcttgtttgctggatacaaggtcccccaccccttggaacacaagattatcatacgcgtgcagactactcctgattacagccctcaggaggcttttacaaacgcaattactgatctgattagcgaactctccctcctggaagagaggttcagagtcagagcaggtcccgggggagccgatggggtcgctatcaaagacaagcaggagggtatagaatag

SEQ ID NO: 129293 - DNA, 351 bp, Artificial Sequence
  Description of Artificial Sequence: Synthetic coding sequence
atgaacgctcccccggcattcgagagtttccttcttttcgagggagagaagatcacaattaataaggataccaaagtccccaaggcttgtttgttcacgatcaataaggaagaccatacacttggtaatatcattaaaagccgcgcttgctttccctttgccttttgccgcgattgtcagtttccagaggcatcacccgcaaccctccccgtgcagcccgcagaattgtgcccaagagctcaccagctctgtgctcccgccctgaaacgacatctggggggtgaagctcatccggtgcacttacacgctggcgccgcatctcgcccagttcagcaaccccaacacctgtag

SEQ ID NO: 129294 - DNA, 348 bp, Artificial Sequence
  Description of Artificial Sequence: Synthetic coding sequence
atgaacgcccctcccgcctttgaatcctttctgctcttcgaaggcgagaaaatcaccatcaataaagacactaaggtgcctaaagcttgcctgttcacgattaataaggaagaccacacactgggcaatatcatcaagtcacagttgctcaaggatccccaggttctgttcgcaggctacaaagtcccccacccacttgaacacaagataatcattcgcgttcagaccaccccggattattcccctcaggaggccttcacaaatgccattacagatttgataagtgagctctcccttttagaagagcgcttccgaacatgcttgctgcctctgcgactgctgccgtag

SEQ ID NO: 129295 - DNA, 177 bp, Artificial Sequence
  Description of Artificial Sequence: Synthetic coding sequence
atggacacccagaaagacgtgcagcctccaaagcagcaacctatgatatatatttgtggcgagtgccacacagaaaatgaaattaagagccgagaccctatccgctgccgggaatgtgggtataggattatgtacaagaagagaacgaagaggctcgtcgttttcgatgctaggtag

SEQ ID NO: 129296 - DNA, 204 bp, Artificial Sequence
  Description of Artificial Sequence: Synthetic coding sequence
atgatcatccccgtaagatgttttacttgcggaaaaatagtcggaaataagtgggaggcgtatctaggcctgctacaggccgagtacacagaaggcgatgctctggacgcgctgggattgaaacgatattgttgccggagaatgcttctcgcccacgtagacctcatagagaaactgctgaactatgccccactagaaaagtag

SEQ ID NO: 129297 - DNA, 204 bp, Artificial Sequence
  Description of Artificial Sequence: Synthetic coding sequence
atgattattcccgtcaggtgtttcacatgcggaaaaatagtgggcaataagtgggaagcgtatctggggctgctgcaggctgaatacaccgagggcgacgccctggatgccctcggactgaaacgttattgctgccggcgtatgctgctggcacatgtggacctcatcgaaaagctacttaactacgctcccctggaaaagtag

SEQ ID NO: 129298 - DNA, 4173 bp, Artificial Sequence
  Description of Artificial Sequence: Synthetic coding sequence
atggtgaaggaacagtttcgggagactgacgtcgctaaaaaaataagccatatctgctttggaatgaagtcaccggaggagatgcgccaacaagcccacattcaagtagtttcaaagaacctgtactcccaggataaccagcatgcgccccttttatatggggttctcgaccatcgcatgggaacatccgagaaggacaggccatgcgaaacttgcggaaaaaacttggcagattgcttaggtcactacgggtatattgacctcgaactgccctgcttccatgtcggctacttccgcgcagtgatcggcatccttcagatgatctgtaagacctgctgtcacatcatgctctcccaagaagagaaaaagcagtttttagactatctcaaacgccccgggctcacttacctccaaaaaagaggtcttaaaaaaaaaatctctgacaagtgccgcaaaaagaacatctgtcaccattgcggggcctttaacggcacagtgaagaagtgcggcctgctgaaaattatccacgagaaatacaagaccaacaaaaaggtcgtcgatcccattgtaagtaactttctgcagagttttgaaaccgccatcgaacacaataaagaagtcgagcctctgcttggacgagcccaagaaaacctgaacccgcttgtcgtgttgaatttgtttaagcggattcccgccgaagatgtgccactcttattgatgaaccccgaggccggcaagcctagcgacctgatcctcactagactgctcgtgccaccactctgtatccggccgtctgttgtttccgatcttaagtctgggacaaacgaggacgacttgactatgaaattgacggagattatctttctcaacgatgtaattaagaagcatcgcatttctggcgccaaaacccaaatgattatggaggactgggacttccttcagttgcagtgcgctttgtatatcaactccgagctgtcagggattccactcaatatggcaccaaaaaagtggacccgtggattcgtccagaggctaaaggggaagcagggtcgcttccgggggaatctgtcggggaagagagtggatttctccggaagaactgtcataagtccggaccctaatcttcggatcgacgaagtggccgtgccggttcacgtggctaagatcctgacgttcccagagaaggtcaataaggccaacatcaactttctacggaagctggtccaaaacggcccagaagtacatcccggcgctaacttcatccagcagaggcatacacagatgaaacgctttctgaagtatggcaatcgggaaaagatggctcaggagttaaaatatggggacattgtggagagacacttaattgacggtgatgtcgtgcttttcaatcgtcagccttcactccacaagctttcaataatggcccatctggccagagttaagccccatcggaccttccggttcaatgaatgtgtctgcactccgtataatgcagactttgacggagatgaaatgaacctacacctgccccagaccgaggaggccaaagcggaagctctggtcctaatgggtacaaaggctaatctcgtcactcctaggaacggcgaacccctgatcgcagctattcaggacttcttgactggcgcatacttacttacactcaaggacactttttttgacagggccaaggcgtgccaaattatcgcctcaatcctcgtcggcaaggatgagaagataaaagttcgcctgccgccgcctacgatactgaagcccgtgacgttatggaccggtaagcagatcttttcagtgatcttgaggccaagcgatgataacccggtcagggccaatttacggaccaagggaaaacagtactgtggcaagggcgaggacctgtgcgccaatgactcctacgtgaccatacagaactccgagctgatgagcggctccatggacaaaggcaccctgggatccggctccaagaataacatcttctatatactgctccgggattgggggcagaatgaagcagcggatgccatgtcccggttagcaagactcgcccccgtgtatttatccaatagggggttctcaatcggaataggcgacgtgacccccggacagggactgctgaaggctaaatacgagctcctgaatgccggatacaaaaagtgtgatgagtatattgaagccctcaatacaggtaagctacagcagcagcctggctgcacggctgaggaaactcttgaagcacttatcctgaaagaactctctgtgattcgcgaccatgcaggaagcgcttgtctccgcgagttagacaagtccaattcaccccttacaatggctctttgtggcagcaagggttctttcattaatatctcccagatgatagcatgtgttggccagcaggccatcagcgggtctcgcgtacccgacggttttgagaacagatccttgcctcacttcgaaaaacactccaagctgccagccgcaaagggtttcgtggctaatagcttctactccggcctcactccaaccgagttcttcttccacactatggccggtcgagaaggtctagttgacacggcagttaagacagcagagacagggtatatgcagcgccggcttgtaaagtccctggaggacctatgttcacagtatgacctgacggttcggtctagtaccggcgatataatccagtttatctatggcggggacggtctggatccggcggccatggaaggcaaggatgaaccactggagttcaagcgagtcctcgataatataaaagctgttttcccctgcccttccgagccggctcttagcaaaaacgagctcattcttaccacagagagcattatgaagaagagcgagttcctttgctgtcaggactccttcttacaggagatcaaaaagttcattaagggagtgtcagaaaagataaaaaagaccagagataagtacggaattaacgataatggcaccactgaaccacgagtactataccagctcgatcggattacacccacacaagtggagaagttcctggagacttgccgtgacaaatacatgagagctcaaatggagccaggaagcgccgtgggagctctgtgtgcccagagtattggtgaaccaggcactcagatgacactgaagacctttcacttcgccggagtggcaagcatgaacattacccttggggttcctagaataaaagaaatcatcaacgctagcaaagcaataagcacccccattattacagcgcagttagataaagacgacgacgctgactacgccagattggtgaaaggccggatagagaaaacgctgctcggcgagatctctgagtacattgaggaagttttcctgccagatgattgctttattctggtgaaattgtcactggagagaattcggttgctcagattggaggtgaatgctgagacagtacgttactctatatgcacctctaagctgcgggtaaaaccaggagatgtggccgtccatggcgaggcggtggtgtgcgtgaccccgcgtgagaacagcaagtcatcaatgtattacgtgttgcagttcctgaaggaggacctgccaaaagtcgtcgttcagggcattccagaagtgagccgcgccgtaatacacattgacgagcaaagtggaaaagaaaagtataaactacttgtggaaggcgacaacctgcgggccgtgatggccacgcacggagttaaggggaccagaacaacttctaataatacctacgaagtggaaaagaccctaggcattgaagctgccagaacgaccatcatcaatgagatacaatacactatggtcaatcatgggatgtcgatcgatagacggcacgtgatgcttctttccgatttgatgacatacaaaggggaggttctgggtatcacccggtttggccttgccaaaatgaaagagtccgtgttgatgttagcaagcttcgagaagacagcagatcaccttttcgatgctgcttattttgggcagaaagacagcgtttgcggcgttagtgaatgtatcattatgggaatcccgatgaacattgggactgggctcttcaaactgcttcataaggctgaccgagaccctaacccacccaagcggccactgattttcgacaccaatgaattccatatacccctcgtgacctag

SEQ ID NO: 129299 - DNA, 489 bp, Artificial Sequence
  Description of Artificial Sequence: Synthetic coding sequence
atgtattacgtgctacaatttcttaaagaagacctgcccaaggttgtggtgcagggcatacctgaggttagccgcgcggtaatacacattgacgaacagagtgggaaagagaagtataaattgcttgtggagggggataatctgagagcggtgatggcgacgcacggcgtgaaggggacaagaaccacttccaataatacctacgaggttgaaaagacactgggcattgaagccgcacgcaccacgatcataaatgagatacagtatacaatggtaaaccatgggatgtccatcgataggcggcacgtgatgttactgagcgatttgatgacttacaagggcgaggtgctgggtatcacaagatttggacttgcaaaaatgaaagaaagcgttctgatgctggcttcctttgagaagaccgcagaccatttattcgacgccgcctactttggacagaaggatagcgtctgcgcttggccgcagccctag

SEQ ID NO: 129300 - DNA, 4110 bp, Artificial Sequence
  Description of Artificial Sequence: Synthetic coding sequence
atggtgaaagagcagtttcgggagaccgatgtagcaaaaaagatatcacatatctgctttgggatgaagagtcccgaagaaatgagacagcaggcccacattcaggtcgttagcaagaatctttactcacaggacaatcagcatgccccactcctgtatggagtgttggaccatcggatgggaacctcagagaaggacagaccttgtgaaacttgcgggaaaaatctcgccgattgtctgggtcactacggatatatagatctcgagctgccatgtttccacgtggggtatttccgggcagttatagggatccttcaaatgatctgtaaaacatgctgtcacataatgctctctcaagaggagaaaaagcagtttctagattatcttaaaaggcccggactgacctatctgcagaaaagaggccttaaaaaaaaaatctctgataagtgcaggaaaaaaaacatctgccaccactgcggtgcgtttaacgggactgtgaagaagtgtgggctgttaaagataatccacgaaaagtacaaaacaaataagaaggttgtcgatccaatcgtgtcaaacttcctgcagagttttgaaacagcaatcgagcataacaaagaagtggagcctctgcttggcagagcacaggagaacctgaaccctttagtggtgttgaacctcttcaagcgaatacccgcagaggacgtgcctctactccttatgaatcctgaagctgggaagcccagtgatctgatcctgactaggttgctggtccccccactgtgtatcagaccatcggtcgtgtctgatctgaagtcaggcaccaacgaagatgatcttaccatgaaattgaccgaaatcatttttctaaatgatgtgatcaagaaacacaggatatcaggtgcaaaaacacagatgataatggaagactgggatttcttgcagttgcagtgcgctctgtatatcaattctgaactgtccggaatcccgttaaacatggcaccaaagaagtggactcgcggcttcgtgcagcgactcaaaggaaagcagggtcgcttcaggggtaacctcagcggaaagcgggtggatttcagtggcagaactgtgatctctccagacccgaatctaagaatcgacgaagtcgccgtgcctgtgcacgtcgctaaaatactgactttcccggagaaggtgaataaggccaacatcaactttttgcgaaaacttgtgcaaaacgggcccgaagtgcatccgggcgccaacttcattcagcagaggcacactcaaatgaagcggttccttaagtatgggaatagggaaaaaatggcccaagagttgaagtatggcgatatagtcgagcgtcatctaatcgatggagacgttgtgctgtttaaccgccagccctctctgcataaactttctatcatggctcatctagcacgtgtcaagccacacagaactttccggttcaatgagtgtgtctgcacgccttataatgctgatttcgacggagacgagatgaacctccacctgccacagaccgaggaggcaaaggcagaagccctggtcctcatgggaactaaggccaatcttgtaacccccaggaacggcgagccactgatagccgctatccaggattttctcactggtgcatacctgcttacactcaaggacaccttcttcgatcgtgccaaggcctgccagataattgcctcaatactcgtgggaaaggacgagaaaattaaagtcaggctgccccctccgacaattctgaagcccgtgaccctgtggaccgggaagcagatcttcagcgtgattctgcgaccaagtgacgacaatcccgtgcgcgccaacctcagaacaaaggggaaacagtactgtgggaagggggaggacctttgcgcgaacgactcatacgtaacaattcaaaactccgagctgatgtccggaagtatggacaaaggaactctaggtagcggaagtaaaaataatatattctacatactgctaagagattgggggcagaacgaagccgccgatgcaatgagtaggctggctcgcctggccccagtttaccttagtaatcggggatttagcatcgggattggcgacgtgaccccgggccagggcctgctgaaggcaaagtatgaattacttaatgcaggatacaagaagtgtgacgagtatattgaggctttaaacactggtaagctccagcagcagcccgggtgcacagccgaagagactctggaggccctaattctgaaagagctgagtgtcattagggaccacgctggaagcgcctgcctgcgggagctcgataagtctaacagtcccctcactatggccctctgtgggtctaaggggagcttcatcaatatctcccagatgattgcctgtgtgggacagcaggccatttcgggctcacgggtccccgacgggtttgaaaacaggagcttaccccacttcgagaagcactcaaaactacctgccgcgaaaggtttcgtggctaactccttctactcgggattaacccccactgagttcttttttcacactatggcaggacgcgagggactcgtcgatactgctgttaagacagcagagacagggtatatgcaaaggcgcctcgtaaagagccttgaggacctttgttctcaatatgatctaaccgttagaagttccacgggggatattatccagtttatttacgggggcgatgggttagatcccgcggctatggagggcaaagacgagccacttgagttcaagagggtgcttgacaacatcaaggccgtgtttccttgccccagcgagccagctctgtctaaaaatgaactaatcctgactacagagtccataatgaaaaaaagcgaattcctgtgctgtcaggacagttttctccaggagattaaaaaattcattaaaggagttagtgaaaagataaagaagacccgtgataagtatggcatcaacgataatggcaccacggaacctcgggttctgtaccagctggacagaattacaccgacacaagtggaaaagttcttagagacttgtcgtgacaagtatatgcgggcccagatggaaccaggctcagctgtcggtgctctctgcgctcagcgaaatatcacactcggcgtacctagaattaaagaaatcattaacgctagcaaggcgatctctacaccaattattacagctcagctggataaggacgatgacgctgactacgctcgtctcgtgaaagggcgtattgaaaaaactttgttgggagaaatttcagagtacatcgaggaggtcttccttccagacgattgctttattcttgtgaagctctctttggaacggatccggctcctccggctggaagtgaacgctgagaccgtacggtattccatatgcacatccaagctgagagtcaaacctggagatgtcgccgtgcacggggaagctgtggtttgcgttacaccacgagaaaattccaagagctccatgtattacgtgttgcagtttttgaaggaggatttgccaaaggtggtggttcagggcatccctgaagtctccagggctgtcatacacatcgatgagcagagcggcaaagaaaagtataaattgctggtggaaggtgataacctccgagctgtcatggctactcacggcgtcaagggaacccggactacaagcaacaatacctatgaggtggagaaaacattggggattgaagctgcgaggacgaccattatcaacgagattcagtatacgatggtcaatcacggcatgtcaatcgacagacggcacgtgatgctgctgtctgatcttatgacttacaaaggcgaggtgctgggaataacccgattcgggctggccaaaatgaaggaatcagtcctcatgctggcttcattcgagaagacggccgaccatctttttgatgcagcctatttcggacagaaggattccgtgtgcggcgtgtctgaatgtattattatggggatccccatgaacattggcacaggattatttaagctgttacataaggctgaccgcgaccccaatcctcctaagagacccctcatcttcgatactaatgagttccatatcccactagtgacatag

SEQ ID NO: 129301 - DNA, 753 bp, Artificial Sequence
  Description of Artificial Sequence: Synthetic coding sequence
atgaaagccacaatcatccttttgctgcttgcccaggtgagttgggccggcccgtttcagcaacgtggcctgtttgacttcatgctggaagatgaggccagcggaatcgggccagaagtgcctgatgatcgcgacttcgagccatccctgggtccagtttgtccgtttagatgtcaatgtcatctaagggtcgtgcagtgttcagaccttgaactgggcactaatcctctcaagtccagtggcatagagaacggagcctttcaggggatgaaaaagctaagctatatccgaatagcagatactaatataactagcattccccaggggctcccaccttctctcactgaactccacctggatggtaacaagatctctcgcgtcgatgccgcctctctgaaagggttaaataatttggccaagcttggcttaagtttcaatagcatcagcgccgtggacaacggcagcttggctaacacccctcaccttcgagaacttcatcttgacaacaacaagctgacacgggtgccagggggactagctgaacacaaatacatacaagtggtttacctgcacaataacaacatctccgtagttggatcttccgacttctgcccccccggccacaacacaaagaaggcctcttattccggggtgagtctgttcagtaacccagttcagtattgggagattcagccctctacttttcgttgtgtctacgttcgaagcgcaattcagctcgggaactacaagtag

SEQ ID NO: 129302 - DNA, 3228 bp, Artificial Sequence
  Description of Artificial Sequence: Synthetic coding sequence
atgaaagcgaacgaaaaggtcacgtccgacgcagatccaatgtggtacctgaaatacctgaatatctacgtcggtctgcctgatgtggaggaaagctttaacgtcaccaggcctgtgagcccgcatgaatgtaggctgagagatatgacatactccgcccctattactgtcgatatcgagtatacaagagggagccaaaggattatccggaatgcacttcccatcggccgcatgcccataatgctgaggtcttcaaattgcgttcttacagggaagacccctgctgaattcgcaaagctcaacgagtgcccactcgacccgggcggctacttcattgtgaaaggcgtggagaaagttattctgattcaagaacaattgagtaaaaacaggattatcgttgaagccgacagaaaaggggctgtcggagccagtgtcacatcctcaacccatgagaagaaatcgcgcacaaatatggcagttaagcaaggcaggttttatctcagacataatactctctcagaggatattcctatcgtgataatcttcaaggcaatgggggtagagagtgaccaggaaattgtgcagatgataggaacagaagagcacgtgatggccgcttttgggccctctctcgaggagtgccagaaagcacagattttcactcaaatgcaggccctcaaatatatcggaaataaggttaggcgtcagaggatgtggggtggagggcctaagaagaccaaaattgaagaagctagggagctgcttgcctcaacaatattgacccacgtgcccgtaaaagaattcaatttccgagctaaatgcatctacactgcggtgatggtgcgacgggtgattctggcccagggcgacaacaaggtggatgatcgtgattactatggcaacaagaggttagaattggcggggcagctgctgtctcttttgttcgaggacctgtttaagaagttcaactctgagatgaaaaagatcgctgatcaagttatccctaaacagcgtgccgcacagttcgatgttgtcaaacacatgagacaggatcagatcacaaacgggatggtgaatgccatcagcacaggaaactggtctttgaaaagattcaagatggatcgccagggggtgacacaggtgctctcgcggctctcctatatttctgcgttaggaatgatgacccgcatcagctcacagttcgagaagactagaaaagtctctggcccaaggtcgttgcagccctcccagtgggggatgctgtgcccttcggacactcctgagggagaggcctgtggcctggtgaaaaacctagctttaatgacccacattacaaccgatatggaggacggtcctatagtgaaactggctagcaatttgggggtcgaggacgtcaacctactttgcggggaggagctgtcctatcccaacgtgtttttggtgtttttgaacggtaacattcttggagtgatcagagaccacaaaaaactggtgaatacttttcgcctgatgaggagggcaggctacatcaatgagttcgtgagtatctctaccaatttgactgacaggtgcgtctatattagcagtgatggcggccgcttgtgccggccttatataatagtgaagaagcaaaagcccgctgtcacaaacaagcacatggaagagctcgcacagggctacaggaactttgaagattttttgcacgagtcgttggtagagtacctcgatgtaaacgaggaaaacgattgtaatatagccctttacgagcacactatcaataaggacaccacgcacctcgagatagagcctttcacactgcttggagtgtgcgccggtctgattccctacccgcatcataatcagtctccccgcaatacgtaccagtgtgcgatggggaagcaggccatggggacgatagggtataaccagaggaacagaatcgataccttgatgtatttgctagcctacccccagaaacctatggtgaagacaaaaactatcgagctgatcgaatttgagaaactgcccgcgggacagaatgcaactgtcgccgtgatgagctacagcgggtatgatattgaagatgctctcgtcctgaataaggccagtttagatcgtggattcggtcggtgtctcgtgtataaaaacgcaaaatgtactctgaagcgctatacgaaccagaccttcgacaaagttatgggtccgatgctggacgccgctaccagaaagccgatttggcgccacgagatcttagacgccgatggaatttgtagccctggagagaaggtcgagaataagcaggtgctggtgaataaaagcatgccaaccgtcactcagatccctctcgaaggttctaacgtgcctcagcagcctcagtataaggatgtgcctatcacctacaagggcgctacagactcttacattgagaaagtcatgatctcctcaaacgccgaagacgcatttctaataaaaatgttgctgcgacaaactagacggcccgaaataggggacaagttctcctccaggcacgggcaaaaaggagtctgtgggctgattgtacctcaggaggatatgcctttttgcgacagcgggatctgccctgacattatcatgaacccacatgggttcccatcacgtatgaccgtgggaaaactgatcgagctgctggcagggaaggccggagtgcttgacggaagattccactacggcacagcattcggcggatctaaggtgaaggatgtctgcgaagacctcgtacgacacggttacaactaccttggcaaggactacgtgaccagcggaattaccggcgagccacttgaagcttacatctacttcgggccagtatactatcagaaattgaagcacatggtgctcgacaagatgcatgccagggcacgcggccctcgcgcggtattgacgcgccagcccaccgaaggccgctcccgggatgggggcctccgtctcggcgaaatggaaagagactgcctgatcgggtatggtgccagcatgcttttgctagagagactgatgattagcagcgatgcatttgaggttgatgtgtgtggtcagtgcggccttctcgggtacagtggatggtgccactactgtaaatcaagttgtcatgtgtccagcctccggataccatacgcctgcaagcttctgttccaggagctccagtccatgaatatcattccacgcctgaagctctccaaatacaacgaatag

SEQ ID NO: 129303 - DNA, 633 bp, Artificial Sequence
  Description of Artificial Sequence: Synthetic coding sequence
atggacgacgaggaggagacctacaggctctggaaaatccgcaagactatcatgcagctatgccacgatcgtggctatctggtgactcaggacgagctcgatcaaacactagaagaatttaaagcccagagtggcgacaagccaagtgagggcagaccccgcagaactgatcttactgtcttggtcgctcacaacgatgacccaaccgatcaaatgtttgtatttttcccagaggaacctaaagttgggattaagactattaaggtctactgtcagcgcatgcaggaagagaatataactagggcacttatcgtggtgcaacaggggatgaccccatctgctaagcaatccctagttgacatggccccaaagtatatcttagaacaatttcttcagcaggagctactaatcaatattaccgaacacgaacttgttcctgaacatgtcgttatgacaaaagaagaggttactgaactgctggcacggtacaagctccgcgaaaatcagttgccgaggattcaggctggggacccagttgctcgttacttcggcattaagagaggccaggtggtgaagatcattcgaccaagcgagacagccggtcggtatatcacctatagactggtgcagtag

SEQ ID NO: 129304 - DNA, 1173 bp, Artificial Sequence
  Description of Artificial Sequence: Synthetic coding sequence
atggaggacccgacgctgtatattgtggagcggccccttcccgggtatccagacgcagaagccccagaaccatctagcgccggggctcaggccgccgaagaaccgtcaggtgcaggatccgaggagctaatcaagtcagaccaggtcaacggagtgctagtcctgagcctgctggataagattatcggagctgtggaccagattcagctgacgcaggcacagttagaagaacgccaggccgagatggagggtgccgttcagtccattcagggagagttgtctaaattaggaaaagcgcatgccacaacatcaaacactgttagtaaactcctcgaaaaagtgcgaaaggtaagcgtcaatgtgaaaacagtgcgagggtctctggagcgccaagccggtcagataaagaagctcgaggtgaacgaagcggagctgctgagaaggcgcaatttcaaagttatgatctatcaggacgaggtgaaactccctgccaagctgtccatttccaagagcctgaaggagtcggaggcgctacccgagaaggagggcgaggaattaggagagggcgaacggcccgaggaggacgcggcagctttagaattgagcagcgacgaagctgtcgaggttgaggaggtcattgaagaatcacgcgccgagcgcatcaaacgcagcgggctgagaagagttgatgatttcaagaaggcctttagtaaagaaaaaatggaaaaaactaaagtccggaccagggagaacctggaaaagaccaggctcaaaaccaaagagaacctggagaaaaccagacataccttagaaaagaggatgaataaactaggcacacgtctggttcccgcagaacgcagagagaagctgaaaacttcaagggataagttacggaagtcctttactcccgatcacgtagtgtacgcgaggagcaagactgcggtgtataaggtccctccattcactttccatgtgaagaagattcgcgagggacaggtcgaagtgctgaaagctacagagatggtggaggtcggagccgatgatgatgagggaggcgcagagaggggagaggccggcgacttgcggcgaggttcatcacctgacgtgcatgccctgctggaaatcacagaagagtcagatgcggtgctggtcgataaatccgattccgattag

SEQ ID NO: 129305 - DNA, 1038 bp, Artificial Sequence
  Description of Artificial Sequence: Synthetic coding sequence
atggaggatcccactttgtacattgtagaacgtcctctgccaggataccctgacgccgttgatcagatccaattgactcaagcacaactggaagagcgtcaggccgaaatggaaggggcagtccagagcatccagggagagctgtccaagctgggtaaagcacatgcaacgaccagcaatacagtctccaaattacttgaaaaagtccggaaagtgtcagtgaatgtgaagacagtaaggggaagtcttgagcgccaggctggacagatcaaaaaactggaggttaatgaagcagagctgttgcggcgtcgaaacttcaaggttatgatttaccaggacgaagtgaaattgccagcaaaactgtcgatatcaaagtcattaaaggaatcagaagccctaccggagaaggaaggtgaggagctgggcgagggagaaagaccagaggaagacgcggccgccttagaacttagctccgatgaggccgtggaggtcgaggaggtgatagaagagtcccgagccgaacggattaaaaggtccggcctacggcgagtcgacgattttaagaaagccttttctaaggagaagatggaaaaaaccaaagtgcggacaagagaaaacctggagaaaacacgcctcaaaacaaaggaaaatctcgagaaaacgaggcacacccttgagaagaggatgaataaactgggcactcggttggtaccggccgagaggagagagaagttgaaaacaagcagagataagctccggaagtcttttaccccggaccacgttgtttatgctcgttccaaaaccgcggtctacaaggtgccaccttttacatttcatgtgaaaaaaatacgcgaagggcaggtggaggttctgaaagccaccgaaatggtggaagtgggcgcagatgacgatgagggaggagccgagaggggcgaggccggagaccttagacggggtagctcacctgacgtgcacgcattgctcgagataaccgaagagtctgatgctgtcttagttgataaatctgactcggactag

SEQ ID NO: 129306 - DNA, 2295 bp, Artificial Sequence
  Description of Artificial Sequence: Synthetic coding sequence
atgctgctgttcgtgctaacctgtctgctagctgtattccctgcaatctcgactaagtcccccatcttcggcccagaggaagtgaactctgtggagggcaacagcgtttccattacctgctactaccctcctacatctgttaaccggcacacccgtaaatactggtgccggcagggcgctagaggcggctgcatcacacttatttcaagcgaaggctacgtgtcatccaaatacgccggtagagccaacctaaccaatttccctgagaacggcaccttcgtggtgaatatcgctcagctttcccaagacgacagtggaaggtacaagtgtggcctggggattaacagccgtgggctgtcctttgatgtcagtttagaagtttcccaggggcctggactgctcaatgacacaaaagtctatactgttgaccttggacgtactgttactataaactgcccttttaaaacagagaatgctcagaagaggaaaagcttatataagcaaatcgggttgtatcctgtcctggtcatagattcctcaggctacgtcaaccctaactatactgggaggatacggctagatatccagggtacaggccagctgctttttagtgtcgtcataaaccaactgcgactttcagatgccgggcagtacctatgtcaggctggcgacgactctaacagtaataaaaaaaatgccgacctccaagtcctaaagccagaacccgagctggtgtatgaggacctccgcggttcagttaccttccactgcgctctcggccccgaagtcgcgaatgtggccaaattcctctgccgccaatcctcaggcgaaaactgcgacgtagtagttaataccctgggcaaaagagctccggctttcgaaggtcggatcttactcaacccacaggataaggatggctcattcagcgttgtgataacaggactgcggaaggaggatgccggcaggtatctatgtggggcgcactccgatgggcagctgcaggagggcagcccaatccaggcctggcagttgttcgttaatgaggagtcgaccatcccccggtcaccgactgtcgtgaaaggagttgcaggcggaagcgttgcagtgctctgcccctataacaggaaagaatcaaagagcatcaaatactggtgtctgtgggagggtgcccagaacgggcggtgtccactgcttgtggatagcgaaggctgggtcaaggcgcaatacgagggacgtctctccttgcttgaggagcctggaaacggcaccttcactgtgattctaaatcagcttacttcccgcgatgccggtttctactggtgtctaactaacggcgacacactttggcggaccaccgtagagattaagattatagagggggagccaaatctcaaagtgcccggtaacgtcacagccgtgctgggtgaaacgctgaaggtgccctgtcatttcccatgcaagttcagtagttatgaaaaatattggtgtaaatggaacaatacagggtgccaagcacttccctcacaagacgaggggccatcaaaagcctttgtgaattgtgacgagaactcccgactggtgtctctgactttgaatctggtcacacgggcggacgagggatggtactggtgtggtgttaagcaggggcatttctatggagagaccgccgcagtgtatgttgcggttgaagaaaggaaggctgccggctcaagggatgttagcctggccaaagcagatgcagcccccgacgagaaggtgctcgacagtggattccgagagatcgagaacaaggccatccaggacccccgactatttgcagaggaaaaagctgtcgctgacacaagagaccaggcagacggctctcgcgcgtcagtggattctggatctagcgaggagcagggtgggtccagccgagcgcttgtgagtactctggtgccgctgggcctggtgctcgcagtgggcgcagtcgcagtcggggttgcaagggcccgccaccgaaaaaacgtagatcgtgtgagcatccgatcgtatagaacggatattagcatgagcgactttgagaattcacgagagttcggtgcgaacgacaacatgggggcgagctccataactcaggagacctccctcggtggtaaggaggagtttgtggcaacaaccgagagtaccacagagacaaaggaacctaaaaaggcaaagagaagttctaaagaggaagctgaaatggcatataaagactttctgctacagtcatccactgtagccgctgaagcccaggatggtccccaggaggcttag

SEQ ID NO: 129307 - DNA, 1596 bp, Artificial Sequence
  Description of Artificial Sequence: Synthetic coding sequence
atggacgggatagtccccgacattgcggtggggacaaaacgcggaagtgatgagctgttcagcacttgcgtaactaatggtccattcattatgtctagcaatagcgcgtcagcggctaatggcaacgactcaaaaaaatttaagggtgattctcgatcagccggtgtcccctcaagagtcatccacatccggaaattaccaatagatgttactgaaggcgaggtgattagcctgggtctgccattcgggaaggtcacaaatctgctcatgctcaagggtaaaaaccaggcatttattgagatgaacacagaagaggccgctaacaccatggtgaactattacactagtgtaacgccagtgttgcgcgggcagcctatttacatccagttctctaaccacaaagaactgaagaccgatagcagccctaatcaggcccgagcacaagccgcactgcaagccgtgaactccgtgcaaagtggcaatctggcgctggccgccagcgcagctgcagtcgacgctgggatggcaatggcaggtcaaagtcccgtgctaaggatcatagtcgaaaacttgttctatccggttacgttagatgttttgcatcagatcttcagcaagttcgggaccgtgctgaaaataataaccttcaccaagaataaccagttccaggccctgctccagtacgcagacccagtgtctgctcagcatgcaaagctgagcctggacgggcaaaatatttataatgcatgctgcacactgcgcatcgacttttctaagttgacttctctgaacgtgaagtataacaatgacaaatcaagagactacacccgcccggatctgccttctggagacagccagcccagtctggatcagaccatggccgctgctttcgggttaagtgtgccaaacgtgcatggcgctctggcgcctttggcgatcccgtctgccgcagccgcggctgctgctgcaggcagaattgcaatccccgggttggctggtgcgggaaactctgtcctactcgtgtctaacctaaatcctgaacgggttacgccacagagcctgttcattctctttggagtgtatggagatgtccaacgggtgaaaatccttttcaataaaaaggaaaatgcactcgtgcagatggccgacggcaatcaggcccaattagccatgagccatcttaacggtcataaactccatggaaaacctatcagaatcactctgagcaaacaccagaatgtgcagcttcctagggagggtcaagaagaccagggcttaacaaaagattatgggaactctccattacacaggtttaagaagccagggtcaaagaattttcagaatatctttcctccgtccgctaccctgcatttatcaaacatcccaccttccgtttccgaggaagatttgaaggtgttgttcagttcgaacggaggagtggtgaagggtttcaagttttttcagaaggatagaaagatggccctcatacagatgggctctgttgaggaggctgtacaggcactcattgaccttcataaccacgacctgggtgaaaatcaccacttgcgagttagcttttccaaatctaccatctag

SEQ ID NO: 129308 - DNA, 594 bp, Artificial Sequence
  Description of Artificial Sequence: Synthetic coding sequence
atggacggaatagtacctgatattgccgtgggcacgaagagggttacaccacagtcattgttcatcctttttggggtgtacggggatgtgcagcgcgtcaaaatcctattcaataagaaagaaaacgctctcgttcaaatggccgacgggaatcaagcccagctcgccatgtctcacctcaatggtcacaagctgcacggtaaacctattagaatcacattatcaaagcatcagaatgtacagctgccaagagagggccaagaggatcagggtctcacgaaagactatgggaatagcccactccatagatttaaaaaaccgggctctaagaattttcagaacatcttccccccctctgctacccttcatctgtccaacattcccccgagtgtgtcagaggaggacctgaaagtcctcttttctagcaatggcggcgtggtcaagggttttaaattcttccagaaggatcgcaaaatggccctgattcagatggggagcgttgaagaagctgttcaggctctgatcgacttgcataaccacgacttgggcgagaatcaccacctgagagtgtcctttagtaaaagcacgatttag

SEQ ID NO: 129309 - DNA, 1674 bp, Artificial Sequence
  Description of Artificial Sequence: Synthetic coding sequence
atggacggaatcgttccagacattgctgttggcacgaagagaggcagcgacgaactgttctccacttgtgtgaccaatgggcccttcattatgtccagtaactccgcctcggctgccaatggaaatgatagtaaaaagttcaagggggatagccgcagcgccggcgttccatctcgtgtgatccatatcagaaagcttcccatcgatgtgactgaaggtgaagtgatctctcttggcctgcccttcggaaaggtgactaatttgctcatgctgaagggtaagaaccaggccttcatagaaatgaataccgaagaggccgccaacacaatggttaattattataccagtgtgactcccgtgctgcgggggcagccaatttatatccagttttctaaccataaagaactgaaaacagatagttctcccaaccaagcacgggcgcaggccgcactgcaggccgtgaactccgttcagtcagggaatctggcgttagcagcttcagccgccgcggtagacgctggcatggccatggccggccagagccccgtcttacggataattgttgaaaatctgttttaccccgtgactctcgacgtgctgcaccagatcttctccaaatttgggacggtccttaagattattacttttactaaaaataatcagtttcaggcattactgcagtacgctgaccctgtatccgcacaacatgcaaaactgtcactcgacggccagaatatttataatgcttgttgcacgctccgtattgacttctctaaactgaccagcctcaacgtgaagtataacaatgataagtcccgcgactatacacggcccgatttgccaagtggagattcacagcccagcctggatcagacgatggcagcagccttcggagcccccggcattattagtgccagcccttacgctggggctggtttccccccaacatttgccattcctcaagctgctgggttgtctgtgccaaacgttcatggggcccttgcccccttggccatcccctccgccgccgccgctgcagccgccgctgggcgcattgccatcccaggactggccggagccggtaattccgtgctgctcgtctccaacctgaatcccgaaagagtaacaccgcaatccctgttcatcctttttggggtatacggcgacgtccagcgagttaaaatcctctttaacaaaaaagagaatgccctggtgcagatggccgatggtaatcaggcccagctcgcaatgtctcacctgaatggacacaaactgcacggcaaaccaatcaggatcaccctgagcaaacaccagaatgtgcagttgccaagggaggggcaggaggaccagggccttaccaaggactatggtaattcaccactccaccggtttaagaagccggggtctaagaactttcaaaacattttccctccttccgctacattgcatctctcgaacattccacccagcgtgtccgaggaggacttaaaagttttgttcagctctaacggaggagtggtgaagggattcaagttctttcaaaaagataggaaaatggcactgatccaaatgggtagcgtggaggaagctgtacaagcgctgatcgacctgcacaaccacgacctgggtgaaaaccaccatctaagggtttctttcagcaagtctacaatctag

SEQ ID NO: 129310 - DNA, 1653 bp, Artificial Sequence
  Description of Artificial Sequence: Synthetic coding sequence
atggacggcatcgtgcccgacatcgcagttgggaccaagagaggttccgacgagttgtttagcacctgcgtcaccaacgggccattcattatgtctagcaatagcgcttccgcagccaatggcaatgacagtaagaagttcaaaggagactctcggagcgccggcgtaccttcgcgcgtcattcatattaggaagctcccaattgatgtcaccgaaggagaagtgatctcattgggcctgccgttcggtaaagtcacgaatctcctaatgctcaagggcaagaaccaggcgtttattgagatgaacacagaagaggcagcgaacactatggtgaactactatacgtctgtaactccagtactgcggggccagccaatctacattcagttttctaaccacaaggagctgaagactgactcgagtcctaaccaagcccgggcccaagccgcactccaagcagttaacagcgtacagtctggcaacctggctctcgccgccagtgccgctgcagttgacgccgggatggctatggcaggacagtcccccgtattacggattattgtagaaaacctcttttacccagttactttagatgtgctgcaccagatatttagtaaatttggcactgtgctgaagattataacttttacaaagaataatcaatttcaggccctgctgcagtatgctgaccccgtttcagcccagcacgcaaaactgtcgctcgacggacaaaatatctacaacgcatgctgtactctgagaattgacttcagtaaactgacctcactcaatgtcaaatataataacgacaaatctcgtgattatacccgaccagacctgccaagcggagacagccagccaagcctagaccagaccatggcagccgctttcgcctcgccttatgccggcgcaggattcccaccaaccttcgcaatccctcaggccgccggcctgtcagtgcccaacgtgcatggagcactggctcccctggccatcccctctgcagccgccgcagccgccgcggccggacgaattgccatcccaggattagctggggccgggaactccgtcctactggtttctaacctgaatcccgagagggtaaccccccagtccctcttcattttgttcggagtgtatggcgatgtccagcgggtgaaaatcttgttcaacaagaaagagaatgcccttgtgcagatggctgacggcaatcaagcacaactcgcaatgtcccacctcaacggacacaagttacacggtaaacccattcgcattacattgagcaagcatcaaaatgtccagctgccacgcgaagggcaggaggaccaggggctgacaaaggactacgggaatagccctctgcacaggtttaaaaaacccggatctaagaacttccagaatatcttccccccaagcgcaaccttgcaccttagcaacatccctcctagtgtgtctgaggaagatcttaaagtgctattctcctcaaacggcggagtggtgaaagggttcaaattttttcagaaggacagaaaaatggcactgattcagatggggagcgtcgaagaggcagtccaggctctgatcgacctgcataaccacgaccttggtgagaaccaccacttgagggtgagcttttcaaaaagtacaatctag

SEQ ID NO: 129311 - DNA, 1599 bp, Artificial Sequence
  Description of Artificial Sequence: Synthetic coding sequence
atggatggaatcgtgacagaggtggctgtcggagtgaaaagagggtccgacgagcttctcagtgggagcgtgctgagtagccctaattccaatatgtcttccatggtggtgacggccaatggcaatgacagcaagaagtttaagggggaggacaagatggacggcgccccatcaagggtgctgcacatccggaaactgcccggtgaagtgactgagactgaagtcatagccctggggctccccttcggaaaggtgacaaacatattgatgttaaagggcaagaaccaggccttcctcgagctggctaccgaagaagctgccatcactatggtgaactactactctgccgtgactccccatctgcgaaatcagcccatatatattcaatactctaatcacaaggagcttaagacagacaataccctcaaccagagggctcaggctgtgttgcaggccgttaccgctgtgcagactgcaaacacacccttgtcaggtacaaccgtgtcggaatcagccgttactcccgcacagagtcctgtgctgagaatcattattgacaacatgtattatccggtcacactggatgtgctacatcagattttctctaagtttggggctgtgctgaaaattatcacttttacaaagaataaccaattccaggcactgctccaatacggtgatccggtaaatgcacaacaggccaaacttgctctggacggtcagaacatttacaacgcttgttgcacgctcagaatagacttttcaaagctggtgaatcttaatgtgaaatacaacaacgacaaaagccgggactacacacgtcctgacctgccctctggggacggccagccagctctagacccagccatcgcagccgcttttgcaaaggagacgagcctgctggctgttccaggtgcactgtcccctttagccatcccaaacgccgccgcagcggctgctgcggcagccgcgggcagggtaggtatgcccggggtctccgcaggtggaaataccgtcttgttagtctccaacttgaacgaggaaatggtgaccccacaatctctgttcactctgttcggcgtgtacggcgatgtgcaacgggtaaagattctctataataagaaggatagcgctctcatccagatggcagacggcaaccagagccagctcgccatgaatcacctcaatgggcagaagatgtatggcaagattattcgagtcactctgagcaagcaccagactgtgcagttacctagagaggggctggatgaccagggactgacgaaggacttcggtaattctcctttacatcggttcaagaagcccggaagtaagaatttccagaatatcttcccacccagtgccaccctgcacctgagtaacattcctccatccgttgctgaggaagacctgcgcacactattcgccaacaccggggggactgttaaagcctttaagttttttcagagagaccataaaatggccttgctgcagatggcaaccgttgaggaagctattcaagccctgatagacctgcacaactacaacctaggcgaaaaccaccacctgagagtcagctttagcaagagtaccatctag

SEQ ID NO: 129312 - DNA, 1614 bp, Artificial Sequence
  Description of Artificial Sequence: Synthetic coding sequence
atggatggtatcgtgacggaggttgctgtcggtgtgaagcggggaagcgatgaactgttaagcgggagtgtcttgtccagtccgaactcaaacatgtcatctatggtggtaacagcaaatgggaacgacagcaaaaagtttaaaggagaagataagatggatggagccccatccagagtcctgcacatcagaaaactgccaggggaagttactgagaccgaagtcattgcactcggactgcctttcggcaaggtgacaaatatacttatgctcaaaggcaagaatcaggcattcctcgaattagcgacggaagaagctgccatcacaatggttaactattacagcgccgtgactcctcatcttcggaatcagccaatctatattcagtactccaatcacaaagagctgaaaaccgacaacacgctcaaccagcgtgcacaggctgtgctgcaggcagtgaccgcggtacagaccgcaaatacccccttgtccggcacgaccgttagtgagtctgccgtcacaccagcacagtccccggtcctgcgaattataattgacaacatgtattatcccgttactttggacgtcctccatcagatattctctaaattcggtgccgtcttgaagatcatcaccttcacgaagaacaaccagtttcaggcactgctgcagtacggagatcctgtcaacgcgcaacaggcaaagctggccctggacggccagaatatatacaatgcctgctgcacattgagaatcgacttctccaagctggtgaacctcaatgtcaagtataataatgataagtctcgcgattacacacgcccagacttgccctctggcgacggccagcccgcactcgaccccgctatcgcagctgcgtttgccaaagagacaagcctgctggggctacccgttgcagccgtgccaggtgcactgagtccattggcaattccaaatgcagcagccgcggcggccgcagctgccgccggaagggtgggcatgccaggcgtcagcgctggtggcaacacggtattactggtgtccaatctgaatgaggaaatggtcacacctcagagtctgtttacactgttcggagtttacggcgacgtccagagagttaagatactttataacaaaaaagactcggccttaatccaaatggctgatgggaaccaatcccaactggcaatgaaccatctgaacggccagaagatgtatgggaagatcattagagtcaccctgtccaaacatcagaccgtccagctccctagggaagggcttgacgaccagggactcaccaaagattttgggaattctcccttacatcgtttcaaaaagcctggctctaaaaacttccaaaatatcttcccaccttccgccactctgcacctgtccaatatccccccttctgtggctgaggaggacctgagaaccttgttcgccaacacaggtggaaccgtcaaggccttcaagttcttccagagggaccataagatggccctcctccagatggctactgttgaagaggcaatacaggctttgattgacttacataattataacctgggtgaaaatcaccatctccgggtgtcattttccaaaagcaccatatag

SEQ ID NO: 129313 - DNA, 1611 bp, Artificial Sequence
  Description of Artificial Sequence: Synthetic coding sequence
atggatggaattgtgactgaagtggcggtgggtgtgaaacgggggtctgacgaattgctaagtggcagtgtgctatcctcacctaactccaacatgtcctctatggtcgttacagctaatggtaatgactcaaagaagtttaagggggaagacaagatggacggagccccttcccgagtcctccatatacggaagctgccaggcgaggtgaccgaaacggaggtcattgcccttggccttccctttggcaaggtgacaaacattcttatgctgaaaggcaaaaaccaggcgttcctggaactggccaccgaggaggccgctattaccatggtgaattactattctgctgtgactccacacctgagaaaccagccaatctatattcagtactccaaccacaaggagctgaagaccgacaataccctcaatcagcgggcccaggccgtgcttcaggcagtgactgcggtccaaactgctaatacgcctttgtcaggaacaaccgtcagcgaaagtgctgtgacacccgcacaaagccctgtccttcgtattatcattgacaacatgtactaccctgtgaccctagatgtgctccatcagatattctctaaatttggcgcagtattaaagatcatcacttttactaagaataaccagtttcaagccttgctgcagtatggtgatcctgttaatgcccagcaggccaagcttgccctcgatggccaaaacatttacaacgcgtgttgtacgttgaggatcgacttctccaagctggtcaatctgaacgttaaatacaacaacgacaaatcccgcgattatactaggccagacctgcccagtggtgatggacagcctgctctggacccggctatcgccgcggcgtttgctaaggaaacgagcctcctaggcctgccagtggccgcagttccaggggcactctcccctctggcgatacccaacgccgccgccgcagccgctgctgcagcggctggcagagttggaatgcccggcgtgagtgcaggaggcaacactgtgttactggtcagcaacctaaacgaagagatggtgacaccacagtcactgtttacactattcggcgtgtatggagatgttcagcgggtaaagatcttgtacaacaaaaaggactcagccctcattcagatggccgacggcaatcaatcacagttagccatgaaccacctcaatggacaaaaaatgtatggaaaaataatccgcgtcacattgagtaaacaccaaaccgttcagttgccgcgtgaaggtctggacgatcagggcctcaccaaggattttgggaattctccactgcaccggtttaaaaaacccggcagtaagaattttcagaacatctttcctccatcagccaccttgcatttgagcaatatcccgccatctgtggccgaggaggacttgaggacgctgtttgcaaatacgggcggaaccgtgaaagcattcaaattctttcaggatcacaagatggcactattgcagatggccaccgtggaggaagctatccaggcccttattgacctgcacaattacaatctgggggagaatcaccaccttagagtgtcctttagcaagagtacaatttag

SEQ ID NO: 129314 - DNA, 1056 bp, Artificial Sequence
  Description of Artificial Sequence: Synthetic coding sequence
gggatgaagcgcggctcggatgaattactttctggttcggtgttgagctcgcccaatagcaatatgtcttctatggtagtgaccgccaacgggaatgactccaagaaattcaagggcgaggacaagatggacggcgcccccagtagggtactccatatcagaaagcttccaggtgaggtgactgaaaccgaagtgattgcactgggactacctttcggcaaggtgacaaacatcctgatgttaaaggggaaaaaccaagcgttcctggaactggctacagaagaggcagccatcaccatggtaaattactactccgccgtgacacctcacctgcgaaatcagccaatctacattcagtacagcaaccacaaggaactcaagaccgataacacgttaaaccagagggcccaagccgtgctccaggccgttacagcagtacagacagccaacacccctctctctggaacaacagtgtcggagagcgcagtaacgcccgcccagtcacccgtgctgcgcattatcatagataatatgtattaccccgtgaccctggacgtcctgcaccagatttttagtaaatttggagctgtcttgaaaataatcacattcacaaaaaacaaccaatttcaggcactcctccaatacggagatccagtgaatgctcagcaagcaaagctcgccctggacggacagaacatctataacgcctgctgtacccttcggattgactttagcaaactggtcaatctcaacgtaaagtacaacaatgacaaatccagggattatacacgacctgacctaccatctggagatggacagccagctcttgatcctgccatcgctgccgcttttgcaaaggaaactagccttttaggcctgccagtcgcagcagtgccaggggccctttcccccctcgccatcccaaacgccgcagctgccgccgctgcagcagccgctggacgcgtggggatgccaggggtgagtgcagggggaaatacggtgctattggtgagcaacctcaacgaagaggttttcatggagatgtgttctgtctag

SEQ ID NO: 129315 - DNA, 1647 bp, Artificial Sequence
  Description of Artificial Sequence: Synthetic coding sequence
atgtggtccaatctcacatttagcttctttggcctgcggacgaaagctaaaaagtatgtcactgtgaataacagggggagcgatgaactgttgagcggctcagttttgagttcccctaatagcaatatgtcctctatggtcgttaccgcgaatgggaacgatagcaagaagtttaagggggaggacaaaatggatggcgcaccttcacgcgtgctccacattcgcaagctacccggcgaggtcacagaaacagaagtgattgcattaggtttgcccttcggcaaggtgaccaacatcctgatgctaaaaggaaagaaccaagcctttctcgaactggctaccgaggaagcagccataacaatggtgaattactattccgccgtgacgcctcacctccggaatcagccgatttatattcagtactccaaccacaaagagctgaagaccgacaataccttgaatcaacgtgctcaggctgtcctccaggccgtgaccgcggtgcagaccgccaatacaccactgagcgggactacagtgtcggaatcggccgtgaccccagcccagagcccagtcctgcgcatcattattgacaatatgtactatcccgtcactctggacgtccttcatcagatctttagcaagtttggtgctgtgcttaagatcattacgttcaccaagaataatcagttccaagccttgttacagtacggggatcccgtgaatgcacagcaagccaagctggctcttgatgggcagaatatctataatgcctgctgcactttgaggatagatttttctaagctcgtgaatctgaatgtgaaatacaataacgataaaagcagggactacaccaggcctgacctccctagcggtgacggacagcctgccctggatcccgcgatagccgcagcttttgctaaagagacaagcctgctcggtctcccggtcgctgccgtgcccggagcactgtctcccctggcaatacccaatgcagccgctgcggcggccgcagccgcggcaggtcgtgtcggcatgccgggagtgagcgcggggggaaatacagtgctgctcgtgtccaacctcaacgaggagatggttacgccacagtctcttttcacacttttcggcgtctatggtgacgtccaaagggtgaagattttgtacaataagaaagactccgccctgatccagatggctgatgggaaccagtcccagctcgccatgaaccacctaaacggacaaaaaatgtacggaaaaataatccgggtcaccctgtccaaacatcagacagtccagctccctcgcgaggggctcgacgaccagggtctgaccaaggattttgggaattcccccctgcatcggttcaaaaaaccggggtccaaaaacttccaaaatatctttccgccgagcgcaacacttcacctgtccaatatccccccctctgtcgcagaggaagacctcagaacactttttgctaataccggtggaaccgtgaaagcgttcaaatttttccaacgggatcacaagatggccctcctgcagatggcaaccgtggaggaagctatacaggcgctgatcgacctccacaactataatttgggggagaatcaccacctgcgcgtgagtttctccaaaagtactatctag

SEQ ID NO: 129316 - DNA, 1596 bp, Artificial Sequence
  Description of Artificial Sequence: Synthetic coding sequence
atggatggaatagtgaccgaggttgcggttggcgttaagcgggggtctgatgaactgttatccgggagtgtgctgagtagcccgaacagtaacatgtcctctatggtagtcacggctaacggcaatgacagtaagaaattcaagggagaggacaagatggacggcgcgccctctagggtcttacacatccggaaactccctggagaagttacagagacagaggtcatcgccctgggactgcccttcgggaaggtcaccaacattctcatgctgaaggggaagaatcaggcatttcttgaactcgccaccgaggaagctgccatcaccatggtgaattactattcggccgtgacgcctcacctgaggaaccagccgatctacatccagtacagtaatcataaggaattaaagacagataacaccctgaaccagagggcacaagctgtcctgcaggccgtaaccgccgttcagactgccaacactcccctgtccggaaccacagttagcgaaagtgctgtcacaccagcccagtcccccgtgttacgcatcataatcgataacatgtattaccccgttaccctggatgtccttcaccaaatatttagcaagttcggggcagtgctgaagattatcactttcaccaagaacaatcaattccaagcacttctccaatatggcgaccccgtgaacgcacagcaggcaaaactggctctggatggacagaacatttataatgcatgctgcaccctaagaatagacttctcaaaactcgtgaacctcaatgttaaatacaataacgacaagtccagagactacacgcggccagacctcccttctggcgatggacagccagcactcgaccccgctatagctgccgcttttgccaaggagacatctctccttgcagtgcctggcgccctgtccccactggcgatccctaatgcggccgctgctgcggccgccgctgctgccggtagagtcggtatgcctggcgttagcgcaggaggtaatacggtcctgctggtgagcaatctgaacgaggaaatggtgactccacagtcactgtttacccttttcggagtgtatggagacgtccagagggtgaaaattctttataacaaaaaagacagcgctctcattcaaatggccgacggtaatcagtcccagctagccatgaatcatctaaacgggcagaagatgtatggcaagatcattagggtgacactaagtaaacatcagacagtgcagctgcctagggaaggcctcgacgaccaggggctgaccaaggatttcggaaatagtccgctacaccgttttaagaagcccggctccaagaatttccagaacatcttcccgccaagtgcaaccctccatctctcaaacatacccccttccgtcgccgaagaggacctgagaaccctgtttgccaacacaggcgggaccgtaaaggctttcaagttctttcaggatcataaaatggctctgcttcagatggccaccgtggaagaagcaattcaggccctgatcgatttgcacaactacaacctgggagaaaaccaccacttaagggtctccttcagcaagtctaccatttag

SEQ ID NO: 129317 - DNA, 978 bp, Artificial Sequence
  Description of Artificial Sequence: Synthetic coding sequence
atgagctcaatggtcgtgaccgccaacggcaatgattccaaaaaatttaaaggggaggacaagatggatggcgctccttcccgagtgctgcacattagaaagcttccgggcgaggtaacagagactgaagtgatcgccctcggcctcccgttcggtaaagtgaccaacatccttatgctgaagggcaagaaccaggcattccttgagctagccactgaggaggccgccattaccatggtgaactactattctgccgtgactcctcacttgaggaatcaacccatttatatacaatattctaaccataaggagctcaagactgacaatactctaaaccagcgagcccaagccgtcctccaagccgttacggccgtccagaccgcaaacactccattgtctggtacaaccgtgtccgagagcgctgttacaccagcgcagtctccagttctgcgaattataatcgataatatgtactaccccgtcactctcgacgtcctgcaccagatattctccaagtttggcgccgttttaaagatcatcactttcaccaaaaacaaccagtttcaggcattgctccagtacggcgacccggtaaatgcacagcaggctaagcttgctctggacggccaaaacatctataatgcttgctgcacccttcggattgattttagtaaactggtcaatctcaacgtcaagtataataatgataagagcagggactacactagacctgatctgccctctggggatggacagccggcactggacccagcaatcgctgctgcttttgcaaaagaaactagccttctcgcagtacccggtgctctctctccactcgccatcccaaacgccgcagcagccgctgctgccgctgctgccgggcgcgtgggtatgcctggagtctcagccggcggaaatactgtccttctggtctctaacctgaacgaggaggtttttatggaaatgtgctctgtgtag

SEQ ID NO: 129318 - DNA, 615 bp, Artificial Sequence
  Description of Artificial Sequence: Synthetic coding sequence
atgcctggggtttccgccggcggaaacaccgtcctccttgtatcaaatctcaatgaagaaatggtgactccccagtctttattcacgctttttggcgtctatggggacgtgcagcgcgtgaaaatcttgtacaataagaaggactcagctttgattcagatggctgacggcaatcagtcccagcttgcaatgaatcacctcaacggtcaaaagatgtacggcaaaattatcagggttactctgagcaagcaccaaaccgttcagctgccgcgtgaggggttggatgatcagggtctaaccaaggactttggcaattccccgctccatcgtttcaagaaacccggttctaaaaacttccagaacatttttccccccagcgcaactctgcatctgagtaatattcccccttccgtggcagaagaagacctccggacactgtttgcgaacacaggcgggactgttaaggcatttaaattcttccagcgcgatcacaagatggcgctattacaaatggcgaccgtcgaagaggccatccaggcgttgatcgacctgcacaactacaatctgggtgagaatcaccaccttagggtcagcttcagcaagagtaccatctag

SEQ ID NO: 129319 - DNA, 348 bp, Artificial Sequence
  Description of Artificial Sequence: Synthetic coding sequence
atggtttgcagccccgtgactctgagaatcgccccccccgataggcggttctctaggtctgctatcccagagcaaatcatttcctccaccttgtcgtcgccatcttctaacgctcccgatccttgcgccaaggaaacagtgttgagtgctcttaaggagaagaagaaaaagaggaccgtggaggaagaagaccaaatattcttggatggccaagagaataagcggtcctgcctagtggacggccttacagatgcttcatctgcctttaaagtgccgagacccggacctgacaccttgcagtttactgtggatgtcttccactttgctaacgactcccggaacatgtag

SEQ ID NO: 129320 - DNA, 564 bp, Artificial Sequence
  Description of Artificial Sequence: Synthetic coding sequence
atggtttgctcgcccgtcaccctgcgtatagcaccaccagaccggcggttcagtcgcagtgctattccagagcagataatttcaagcacgctctcaagccctagtagcaatgccccagatccatgcgctaaggagacagtgttaagcgcactgaaggagaagaagaaaaagagaacagtagaagaggaggaccaaatttttctagatggccaggaaaacaagagaagctgcctggtcgatggacttaccgacgcgagctccgccttcaaagtcccccgtccaggccctgataccctacagtttaccgtggacgtttttcacttcgccaatgacagccggaacatgatttacattacctgccatctgaaagtcactctagccgagcaggatcctgatgaactgaacaaggcttgtagttttagtaaacctagcaattcctggttccctgtagaaggccttgcagacatttgtcagtgttgtaacaaaggggactgcggcaccccctcacacagccggaggcagcccagggtagtcagtcagtggtcgacttctgccagcctttag

SEQ ID NO: 129321 - DNA, 1095 bp, Artificial Sequence
  Description of Artificial Sequence: Synthetic coding sequence
atgtctgctaattcatccagagtggggcaactgctgctgcagggctccgcttgtatcagatggaaacaggacgttgagggggctgtgtatcatctcgctaattgtctgctactgctaggatttatgggaggaagcggagtgtacggatgtttctacttgtttggcttcctcagtgccggatatctttgttgcgtcctttgggggtggttttcagcatgtggactggacattgttctttggtccttcctgctcgcagtcgtatgtctccttcaattagcccacctggtgtatagactgagagaggatacgttgcctgaagagtttgatctgctttataagaccctgtgtcttcccttgcaggtcccactccagacctataaggagattgtgcattgctgtgaggaacaggtcctgactctggctaccgaacagacatacgctgttgagggagaaactcctatcaatcgacttagtctgctcctgagtggccgcgtaagggtctctcaagacggccagtttcttcattacatcttcccttatcaattcatggattcgcctgagtgggaaagcttacagccttcagaagagggtgtgttccaggtgactttaaccgccgaaacctcatgctcctacatctcttggccgcgtaaatccctgcatctcctgctgaccaaggaacgctatatttcctgcctcttttcagccctcctcggctacgatatcagcgagaaactttatactctgaatgataagcttttcgccaaatttggcctgcggttcgacatcagactgccttcactttatcacgttcttgggccaaccgccgcggacgctggtcctgagtctgaaaaaggcgatgaggaggtctgtgagccagctgtttcacctcctcaggcaaccccgacctccctgcaacagaccccgccatgcagtacccctcccgccaccaccaattttcctgctccccccactcgcgcccgcctctcacgccccgattctggcatactggccagccgaatccctctacagtcgtacagccaggtcatctcaagaggacaagcgccactcgcgcctactcataccccggagttatag

SEQ ID NO: 129322 - DNA, 1083 bp, Artificial Sequence
  Description of Artificial Sequence: Synthetic coding sequence
atgagtgctaactcttcaagggtgggccagctgttgctgcagggcagcgcgtgcatacggtggaagcaggacgttgagggcgccgtctatcacttggctaattgccttcttctgctcggctttatgggcgggagcggggtctatggatgcttttatcttttcgggttcctgtctgccggatacctctgctgcgtgctatgggggtggttcagtgcctgtggactggacattgtgttatggagcttcctattggccgtcgtctgcctgctccagttggctcatcttgtctaccgcctccgggaggatactcttccagaggagtttgacctgctgtataaaactctgtgcctccctttgcaagtcccccttcagacctacaaagaaatcgtgcattgctgtgaggaacaggtacttactttggccactgaacaaacctacgccgtggagggtgaaacccccatcaatcggctgagcttactgctgtcgggtcgcgttcgtgtgtcccaggatggacagtttttgcactacattttcccttatcagttcatggattctccagaatgggaatccctacagccatcagaggagggcgtatttcaagtaaccttgacagcagaaacctcctgctcctacatttcctggccgcggaagagcctgcacctgttactcactaaagaacgatatattagttgtctattctctgccttgctgggctatgatattagcgagaaactgtacaccttaaatgataaactgttcgcaaaattcggtctgcggtttgacatccgtctgccatctctgtaccatgttcttggtcctacagcggccgatgcaggacccgaaagcgagaagggcgacgaagaagtttgcgaacccgctgttagccccccccaagctacccctacatcgctccagcagacacctccttgtagtactcctccggcaaccaccaatttccccgctccccccaccagggccaggctgtcaaggccggacagcggcatcctggagattgacgacttcccgagttactttcatcagtttgggtttagcggtaaagtggctgccggaagaataccttag

SEQ ID NO: 129323 - DNA, 1083 bp, Artificial Sequence
  Description of Artificial Sequence: Synthetic coding sequence
atgagcgctaactccagtagggtgggacagctgctgttgcaggggtctgcatgtatcagatggaagcaggatgtggagggggcagtctaccaccttgccaactgcctgctgctcctcggctttatgggggggtcaggcgtgtatggatgtttttacctttttggcttcctgagcgctggctatttgtgctgtgtcctgtgggggtggttcagtgcatgtggactggatatcgttctctggagcttccttcttgcagttgtatgcctactgcagctggcgcacctcgtctacagactgcgcgaagataccttgcctgaagaattcgacctcctgtataaaacactctgcctgcccctgcaagtgccccttcaaacctataaagagatcgtacactgctgcgaggaacaagtcttaacactggcaactgagcagacctatgcagtggaaggcgaaacaccaattaaccgccttagtcttctcttgagtggacgcgtcagggtttcccaagacgggcagtttctacattatatttttccttatcagttcatggacagcccggaatgggaaagtctgcaaccgtctgaggaaggggttttccaggtaaccctgactgccgagaccagctgtagttacatttcctggccaaggaagagcttgcatctgctgctgacgaaagagagatacatcagttgcctgttcagtgccctgctgggatatgacattagcgaaaagctgtacactctaaacgataagctgtttgccaagttcggattgcggttcgatattcgcctgccttccctgtaccatgtgctaggcccgacggccgccgacgccggccccgagtcagagaagggcgacgaggaagtgtgcgagccagcggtgagtcctcctcaagctacgccaacctcgctacagcagaccccaccttgctctactccacccgcgactactaacttcccagcgcctcctacccgggcaaggctgtcccgacctgactccggaatcctagaaatcgatgatttcccttcctactttcatcagtttggctttagcgggaaggtggcagccggcaggattccatag

SEQ ID NO: 129324 - DNA, 876 bp, Artificial Sequence
  Description of Artificial Sequence: Synthetic coding sequence
atggagagaaactccagcttgtggaagaatctgattgacgaacaccctgtgtgtactacttggaaacaggaagcagagggtgcgatttaccacctggccagcattctgttcgttgtaggctttatgggtggctccggcttttttggccttttatacgtcttcagcctgctcggcctcggattcctgtgctctgcggtctgggcttgggtcgacgtatgcgcggctgacatcttcagctggaatttcgtgctttttgttatatgcttcatgcagttcgtgcatattgcgtatcaggtgagatccattacttttgcgcgggagtttcaggtgttatacagctccctgtttcagccgttaggtatctccttgccagtgttccgcaccatagctctgagttctgaggtggtgaccctggaaaaggagcattgctacgccatgcagggcaagacctcgatcgataagctgtcactcctcgtatccgggcggatacgggtaacagtagatggggaattcctgcactatatctttccgttgcagtttctcgactctccagagtgggacagtctgagaccaacagaggagggcatttttcaggtgactctgaccgccgaaaccgattgcagatacgtgtcatggcgaagaaagaagctgtatttactgtttgctcagcacaggtacatctctcgccttttctccgtgttgatcggaagcgatatagcagataagctgtacgccttgaacgaccgggtgtacatagggaaaaggtaccattacgacatccgtctccctaacttctatcaaatgtcgacgcctgagattagaaggagcccattgactcagcactttcagaatagtcggcgatattgtgacaagtag

SEQ ID NO: 129325 - DNA, 306 bp, Artificial Sequence
  Description of Artificial Sequence: Synthetic coding sequence
atgctcttcctatgctttgataggatccgggtaactgtagacggcgaatttctgcactatatttttcctctccagttcttggattcccctgagtgggatagcctgcgtccaactgaggaagggatttttcaggtgactctcactgcagagaccgattgccgttatgtgtcgtggagacgaaagaaactgtatctcctgtttgctcaacatcggtacattagcagactattcagcgttcttatcggatctgatatagcggataagctctatgccctgaacgaccgagtgtacatcggtaaacggtag

SEQ ID NO: 129326 - DNA, 1386 bp, Artificial Sequence
  Description of Artificial Sequence: Synthetic coding sequence
atggccaccttttccagacaggagtttttccagcagctcctgcagggctgtctgctgccaactgcgcaacaggggctggaccagatctggttgctgctggccatctgccttgcttgccggttgctatggaggttaggcctgccttcctacctgaagcatgctagcacggtcgccggaggttttttctccctgtatcacttctttcagctccacatggtatgggtcgtgctcctctctctcctgtgttacctggtgttgttcctctgccgccactcctcacaccgcggcgtcttcctttccgtcaccattttaatctatttgttaatgggcgagatgcacatggtggacaccgtgacctggcataaaatgcgtggcgcgcaaatgatagtcgcaatgaaggctgtgtccctgggctttgacctggatcggggtgaagtcggcacagtcccttccccggtggagttcatggggtacctgtacttcgtgggtactattgtgtttggaccatggatttccttccactcatacttgcaagcggtccagggaagacctttatcttgccgttggctgcagaaagtcgctcgaagcctcgccctagctcttctatgcctggtactgtctacttgtgtcggcccttatctcttcccctacttcattccgctgaatggcgatcggttgctccgcaacaagaaacgcaaagccagggggaccatggtccggtggctacgcgcctatgagtcggctgtgagcttccatttcagcaattactttgtgggctttctttctgaagctacagcgaccctcgccggagccggattcactgaagagaaggaccaccttgaatgggatcttacagtgagcaagcctctaaatgtggaactgcctcgttcaatggtggaggttgtcacatcttggaatctgccaatgagctactggttaaacaactacgtcttcaaaaacgccttacgtcttggtactttttccgcagtactggttacgtacgctgcctctgctctgctccatggctttagtttccatctggccgcagtgcttctgtccctggcatttattacatatgtggagcacgtcttacggaagcggctagccaggatattatcagcctgcgtcctctcaaagagatgcccgccagactgtagccatcaacaccggttaggtctgggggtgagggcgctgaatctgctgttcggagcacttgccatcttccatctcgcgtatttaggctcgcttttcgatgtggacgtggacgataccaccgaggagcaaggctatggtatggcctacaccgtccacaagtggtccgagttatcttgggctagtcactgggtgaccttcggctgctggattttctatcgcctaatcgggtag

SEQ ID NO: 129327 - DNA, 1368 bp, Artificial Sequence
  Description of Artificial Sequence: Synthetic coding sequence
atggctacattttctcggcaggagttcttccagcagctgctgcaggggtgcttgctgcctacagcccagcaggggctggaccagatctggcttttgctggccatctgtctggcctgccgccttctgtggagattaggcttgccctcttatctgaaacacgcatcgacagtggcaggcgggtttttttccctatatcacttcttccagcttcatatggtctgggtcgtcctgctgagcctgctttgctacttggtgctttttctgtgtagacatagttctcatcggggggtgtttttatcagtgactattctcatctatctgctgatgggagagatgcacatggtagacaccgttacttggcataaaatgcggggcgcccagatgatcgtggccatgaaagccgtatctctcggcttcgatctcgatcgcggcgaggtgggtacagtgccttcaccggtggagtttatgggctatctgtattttgtgggaacaatcgtattcggcccttggatctcattccacagctacctgcaggctgtgcaaggaaggcctctgtcgtgtaggtggctgcaaaaagttgcccgttcattggccctcgctttgctctgcctagtgctctcaacctgcgtcggaccttacttgttcccttacttcatccctctgaatggagatcgattgctgcggaagggcacaatggtgcggtggttgcgagcctatgaaagtgctgtcagctttcatttcagtaactacttcgtgggattcctgtccgaagcaacagccaccctcgctggggccggttttaccgaggagaaagaccacctggaatgggacctcacagtcagcaagcctcttaacgttgagctcccccgcagcatggttgaagtcgtgacatcctggaatttgcccatgtcatattggctgaacaattacgtctttaaaaatgcactacgcctcggaacgttctcagccgtgttggtaacatacgcagccagtgccctccttcacggtttttccttccacctggcggcagtcctgctaagcttggcctttattacctacgtagagcatgtcctcaggaagaggctcgccaggatcctgtccgcatgcgtcctttcaaagcggtgtccccctgactgctcccatcaacatcgtcttgggctgggagtgcgagccctaaatctgttgtttggcgccctagctatcttccatctggcctacctgggaagcctgtttgacgtggacgtcgacgataccacagaggaacagggatacggcatggcctacactgtacacaaatggtccgagctaagttgggcttcacattgggtcaccttcggctgctggatcttttacaggctgattggatag

SEQ ID NO: 129328 - DNA, 1371 bp, Artificial Sequence
  Description of Artificial Sequence: Synthetic coding sequence
atggctacatttagccgccaggaatttttccagcaactgctgcagggctgtctactgcccactgctcagcaaggactggatcagatctggcttcttctggccatctgtcttgcttgtaggttgctttggcggctgggacttcctagctatctgaagcacgcctcgacggtggccggtggtttttttagcctttaccacttttttcaactgcacatggtgtgggtcgttctgctgtcgctgctgtgctatttggttctgtttttatgtagacatagctcccataggggcgtctttctctcagtgactatactcatctatctcttgatgggcgagatgcatatggtcgataccgttacatggcacaaaatgcggggtgcgcagatgatcgtagccatgaaggccgtgagtctcggcttcgatctggaccgcggcgaggtgggcactgtgccgtcgccagtggaatttatgggttacttgtattttgtgggcactatcgtattcggcccctggatctctttccatagttatttacaggcggtacagggacggccactgagttgtaggtggctgcagaaggtggcgaggtctctggcactcgctttactgtgtctcgtgctcagcacatgcgtcgggccttatctcttcccgtattttattccgctcaatggggacaggctactgcgcaataagaaacgcaaggcgcgctggctgagggcctacgaaagcgcagtttcgtttcacttttcaaactactttgtgggatttttatctgaggcgacagcaaccctcgccggagcaggattcaccgaagaaaaagaccacctggagtgggatctgacggtgtcaaaacccttgaacgtcgagctcccacggagtatggtcgaggtggtgaccagttggaatctgcctatgtcgtattggttgaataactacgtgtttaaaaatgctctgcgattaggcactttctctgctgtattagttacttacgctgcatcggccctattgcacggtttcagctttcatttggctgcggtgttgctcagcttagcattcatcacctacgttgaacacgtgctcaggaagcggctagcccgtatcctgtctgcatgtgtgctttcgaaaaggtgccctccagactgctcccaccagcatcggttgggtctaggggtgcgtgccctgaatttgctcttcggtgctttagctatcttccacttggcctacctaggcagtctatttgacgtagacgttgacgatactacagaggagcagggctacggcatggcgtacacagtccacaaatggagtgagctctcttgggctagtcactgggttacttttggatgctggatattctaccgactgataggttag

SEQ ID NO: 129329 - DNA, 1368 bp, Artificial Sequence
  Description of Artificial Sequence: Synthetic coding sequence
atggccacctttagtcgccaagagtttttccagcagctcctgcaaggttgcttgctccctaccgcccagcagggactggatcagatatggttactgctcgcaatttgcctggcatgcaggctgctctggagattaggactgccaagctacctcaagcacgcatccaccgttgctggggggtttttttccttgtaccacttcttccagctccatatggtgtgggtggtgcttctgagcctgctttgttatctggtgcttttcttatgtcgtcattcatcgcatagaggagtgtttctgagtgtcaccattctaatttacctgttgatgggagaaatgcacatggtggataccgtcacctggcacaaaatgcgtggtgcccagatgatagttgcaatgaaagctgtgagcctcggcttcgatttggataggggcgaagtgggcaccgtgcctagtccagtggaattcatgggatacttgtatttcgtgggcaccatcgttttcggcccctggatctctttccattcctatctgcaggctgtgcaaggccgaccactatcctgtcggtggttgcaaaaggtggcccgctctctggccctcgctcttctgtgcctggtactctccacctgcgttggaccttacctgttcccatacttcattccactcaacggtgataggttactcaggaagggaaccatggtgcggtggttaagagcctatgaatctgctgttagcttccacttttccaactattttgtcggctttcttagtgaagcaacagccactctggctggggccgggtttaccgaagaaaaggaccaccttgagtgggatttaacggtctcaaagcccctcaacgtggaattgccgcggtctatggtagaagttgtcacttcgtggaacctcccaatgagttattggcttaataactatgtgttcaaaaacgccttaaggctcggaaccttcagcgccgtgctggtgacttacgcggcatctgccctgctgcatggattttcttttcacctcgccgcggtgctgctcagcctggcctttatcacatatgtggagcatgtgctgcgaaaacggcttgcccgcattctctcagcttgtgtgttatccaaaagatgtcctcccgattgctcccatcagcacaggctgggtctgggggttcgcgctctcaatttgctttttggggcactcgccatctttcacctggcttacctgggcagccttttcgatgtggatgtggatgatactaccgaagaacaggggtatggaatggcctacacagtgcataaatggtccgagctgagttgggcatcccattgggttacgttcggttgctggattttctatcgattgatcggctag

SEQ ID NO: 129330 - DNA, 1353 bp, Artificial Sequence
  Description of Artificial Sequence: Synthetic coding sequence
atggcaaccttttctcggcaagagtttttccaacagttgttacagggttgcctcctgccaaccgcacagcagggactagaccagatctggttacttttggctatttgcctcgcctgccgcctcctttggcgactgggcctgccctcatatcttaaacacgctagcaccgtggccggcggcttcttttcactttatcacttttttcagctgcacatggtgtgggtggtgctgctgagtctgctatgctatctggtgctgtttctgtgcaggcattccagtcaccgcggggtgttcctgagcgttacaattctgatctacctcctcatgggggagatgcatatggttgatacagtaacctggcataaaatgcgcggagcgcaaatgatcgtcgccatgaaagcagtttctcttgggtttgatttggatcgcggcgaggtgggaacagtgccaagccccgtggagttcatgggctacctgtattttgtgggaacaattgtgttcggaccttggatctcctttcattcttatctgcaggccgtgcagggccgccccctctcatgtcggtggttacagaaagtggcccggagcctggctctggccctactctgcctggtgcttagtacctgcgtgggtccatacttattcccatattttattccgctgaacggagaccgcctactacgcaaatggttgagggcctacgaaagcgctgtcagttttcactttagcaattactttgtggggttcctctctgaagctacagccacactcgctggggctgggttcacagaggagaaggaccacttagaatgggacttgaccgtctccaagcctttaaatgttgagctgcctcgctctatggttgaggtcgtgacctcttggaatctgcccatgagctattggcttaacaactatgtgtttaaaaatgcccttcgcttaggcacttttagcgctgttctggtgacatatgcagcgagcgcactcctccatggcttcagttttcacttagctgctgttctgctctctctggcatttattacgtatgttgaacatgttttaagaaagcgactggctagaatcctctctgcgtgcgtgctgtctaaacggtgccctccggactgcagtcaccagcaccgactaggccttggggtgagggcgctgaatctcttatttggcgcccttgccatcttccacctcgcatacctgggctccctatttgacgtcgatgtggatgatacaaccgaagaacaggggtacggcatggcctatacagtccacaagtggtcggagctgtcctgggcctcccattgggtgacgttcggctgctggatcttttatcgactgattgggtag

SEQ ID NO: 129331 - DNA, 1140 bp, Artificial Sequence
  Description of Artificial Sequence: Synthetic coding sequence
atggtgtgggtagtgcttctctctttactatgttatctggtgctctttctgtgtaggcactcttctcatcgaggcgtctttctgagcgttactattcttatctaccttctgatgggtgagatgcacatggtggacaccgtgacttggcataagatgagaggggcccaaatgattgtggccatgaaagcagtttctctaggatttgacttagacaggggagaggtcggcactgtgccctctcctgtcgagttcatggggtacctgtacttcgtggggaccattgtgttcggaccatggatctccttccactcttatctacaagctgtgcagggccgccccttgtcgtgccggtggctccaaaaggtcgcacgatccctcgcacttgccttgttatgtctggtgttatctacctgcgtgggcccatacctgttcccctacttcattcccctcaacggcgaccggttgctgcggaaatggcttcgcgcttacgagtcagctgtgtcattccatttcagcaactattttgttgggttccttagcgaggccactgctacactagccggggctggtttcacagaagaaaaagaccatctcgagtgggacctgaccgtctcgaagcctttgaatgtggaactgcctaggtctatggtagaggtcgtcacgagctggaatctccctatgtcttactggcttaacaactacgtgttcaaaaatgcattgagactgggaacgttttccgcagtgctcgtcacatatgctgccagtgcactgctccacgggtttagttttcacttggctgcagtcctcctgtctcttgcttttataacctatgtagagcacgtcttacgcaagaggctggccagaattctttccgcctgtgtcctctcaaagagatgccccccagattgtagccaccagcatagattaggcctgggtgtcagggccctgaacctcctgttcggagcactcgccattttccatctggcctacctggggtctctcttcgatgtggatgtggacgacacaacagaggaacagggctatggtatggcttatacagtgcacaaatggagcgagctcagctgggcctcccattgggttacttttggctgttggattttctaccgactgattgggtag

SEQ ID NO: 129332 - DNA, 294 bp, Artificial Sequence
  Description of Artificial Sequence: Synthetic coding sequence
atggcaaccttttcccggcaggaattctttcagcaattgctccaagggtgccttctgccaaccgcacagcaagggctcgaccaaatttggctcttactcgccatctgcctagcctgccggctgctgtggagattaggtttgcctagttaccttaaacatgcctcaactgtcgccggaggatttttttcactatatcacttttttcagctgcacatggtgtgggtcgtcctgctgagcttactgtgctacctggtgctctttctgtgtaggcattcgagtcaccgaggggtgtag

SEQ ID NO: 129333 - DNA, 1386 bp, Artificial Sequence
  Description of Artificial Sequence: Synthetic coding sequence
atggctacattcagccggcaggaattctttcagcaacttctgcagggctgcttgcttcccacggctcaacagggtttagaccagatttggttgctgctggcaatctgcctcgcatgcaggctgctctggcggctgggactaccatcttacctgaagcatgcctctaccgttgccggaggctttttttcactttaccacttcttccagctgcacatggtgtgggtcgtactgctgtccctgctgtgttacctcgtcttgtttttgtgccgccattcttcccaccgaggggtattcctgagcgtgacaatattgatctacctgctgatgggcgagatgcatatggtcgatacagtgacatggcacaagatgcggggggcccaaatgatcgtcgcaatgaaggccgtctcactgggatttgatctcgatcgtggggaggtgggtactgtgccctcacccgtggagttcatgggctacctttactttgtcggaacaatcgtgttcggcccgtggatctcgtttcacagctacctgcaggccgtgcaggggcgacctctgtcgtgccggtggctccaaaaggtcgccaggagcctggctctggccctactgtgtctggtactgtccacatgtgtcgggccgtacctgttcccctactttattccactaaacggagaccgcttgctcagaaataaaaaaaggaaagcgcgcggtacaatggtccggtggttgcgcgcatacgaatccgccgtatctttccactttagcaattacttcgtcggatttctgtctgaggcaactgcaacactggcaggagccggcttcacagaagagaaggatcacctggaatgggatctgaccgtgtcaaagccactgaacgtcgagcttcccaggagtatggttgaagtcgtgacttcatggaatctaccaatgtcttactggctgaataattacgtctttaaaaatgccctgcggctgggcacattctctgccgtgctcgtaacctacgctgcttctgctttgctgcacggcttttctttccacctcgccgcagtcctgctctctctggcattcataacttacgtggaacatgtcctccggaagcggctagctcggatcctatccgcatgcgtcctgtcgaagcggtgtccgcctgactgcagtcatcaacaccgcctcggcctcggggttcgggcgcttaatctgctgtttggggcccttgcaatttttcacttggcctacctgggttctctgtttgatgtggatgtcgatgatactaccgaggagcagggatatggcatggcttacactgttcataaatggagcgagttgagttgggcctcacactgggttacttttggctgctggatcttttatcggttaattggatag

SEQ ID NO: 129334 - DNA, 2769 bp, Artificial Sequence
  Description of Artificial Sequence: Synthetic coding sequence
atgttcttgcactctgtgaatctgtggaacttagccttctatgtgtttatggttttcctagccacactgggactatgggacgtcttttttggtttcgaagagaacaaatgttctatgagctatatgttcgagtaccctgaataccagaagatcgagttacccaaaaagctggccaagcgctatcccgcatacgagctctacctatacggcgagggatcgtatgccgaggagcacaaaatactgcccctgaccggcatccctgtgctcttcctaccaggaaatgcggggtcttataagcaggttcgcagcatcggttctattgctcttagaaaggccgaggacatcgacttcaaataccacttcgacttcttcagtgtaaactttaacgaggaattagtcgccctttatggcggctcactgcagaagcagactaagttcgtgcatgaatgcatcaagaccatcctcaaactctataaggggcaggagtttgccccaaagagtgtcgccattattgggcactccatgggagggctggtagcacgggcactcctgactcttaagaattttaagcacgatctgatcaacttactcattacacaagctactccgcacgtggccccagtcatgcccctggatcggtttattacagacttttacactaccgtgaataattactggatcttgaatgctcgccatataaacctcacaaccctgtccgttgccgggggttttagggactatcaagtaaggtctggcctgacatttcttccaaaactaagtcaccacacttctgctctgagcgtcgttagttctgccgtccccaagacctgggtttccaccgaccacctctctatagtgtggtgtaagcaactgcagttgaccacagtgagagcttttttcgatctgatcgatgcagataccaagcaaattacacagaatagtaagaagaagctgtctgtcctatatcatcatttcatcagacatccgtccaaacacttcgaagagaacccggcaattattagtgatttgaccggtacctccatgtgggtgctggtcaaagtcagcaaatggacatacgttgcctataacgaaagtgaaaaaatttacttcacttttcccctggagaaccatcggaagatctacacacacgtatactgtcagtccaccatgctggatacaaattcatggatattcgcatgcatcaactccacatcaatgtgccttcagggcgtcgacctgagttggaaagcagagctgttgcctacaatcaagtacctgaccctcagactgcaggactacccctcactaagccacctggtcgtctatgtcccttccgtgaggggctcaaagtttgtcgtggattgcgagttcttcaagaaagagaagagatacatacagctccccgtgacccacctgttctccttcggtctctcttcaaggaaagtggtcctgaataccaatgggctttactacaacttggagctactaaatttcgggcaaatctaccaggccttcaaaatcaatgtcgtttctaaatgctctgccgtcaaggaagaaatcacaagcatctacagactccacattccctggagctacgaggatagtctaaccatcgcccaggcacccagctctacagagatatcattgaagcttcatatcgcacagccagaaaataatactcacgttgcactgtttaagatgtacacctcaagtgactgtcgatacgaagttacagtaaagacttcgttctcccaaatcctgggtcaagtggtgcggtttcatgggggcgcccttcccgcttatgtggtgtcgaatatcttactagcctacagaggtcagctatactccctcttctctaccgggtgttgtttggaatatgccaccatgttggacaaagaggccaagccctataaagtggacccctttgtgattatcatcaaattcttattaggttacaagtggttcaaggagctttgggacgtgctcctcctccctgagctggacgcggtgattctgacgtgtcagtcgatgtgttttccgctcatctctctgattctgttcctgttcggaacttgcacagcttattggagcggactgcttagttccgcctctgtgagattgcttagcagtctatggctggccctcaaaaggccctctgagttacctaaagacatcaagatgatcagtcctgacctgcccttcctgacaatcgtgcttattattgttagctggacaacctgtggggctctggcaatcctactaagttatttgtactacgtgtttaaagtggtgcacctccaggccagtcttaccacattcaagaactctcagcccgtcaaccccaagcattccagacgcagtgagaagaagagtaaccatcacaaagacagctctatccaccatcttcgactgagcgctaacgacgccgaggacagcttaaggatgcatagtacagtcatcaatttgttaacatggattgtgttgctgagcatgccgtcgttgatctattggcttaaaaatctgagatactatttcaaacttaaccccgatccttgcaagccattagcattcatattgatcccaaccatggccatcctggggaacacgtacactgttagcatcaaaagcagcaagctgttgaagactacctcacagttcccattgccccttgcagttggcgtgatcgcttttggaagtgcccacctgtatcggctgccttgcttcgtcttcattccactgttgcttcacgccctctgtaactttatgtag

SEQ ID NO: 129335 - DNA, 915 bp, Artificial Sequence
  Description of Artificial Sequence: Synthetic coding sequence
atggaagtactcgagtcaaagaagattgagcttcccaagaagctggctaagcggtacccggcctatgagttatacctctatggggaaggctcatacgccgaggaacacaaaattcttcctctcaccggtatccccgtcctcttccttccaggcaacgccggcagctacaaacaggtgcggtcaatcgggtctatcgcactccgaaaggccgaggacatagacttcaagtatcattttgacttcttctcagtgaattttaacgaggaattggtcgcactatacggtggttccctccagaaacagacaaagtttgtgcatgagtgcattaagaccattctgaaattatacaaggggcaggagttcgctccaaagagtgttgctatcatcggccactcaatgggcggcctggttgctcgcgccttgcttaccttaaagaacttcaaacacgatctgatcaacttattaatcacccaagctacaccccacgtggcgcccgtgatgcctttggaccgattcatcaccgatttctacaccactgttaacaactactggatcctgaacgccagacatattaatctcacaactctgagcgtcgcagggggcttccgcgactaccaggtgcggtccggcctcaccttcctcccaaaactgtcacaccatacatctgctttaagtgtcgtgtctagcgccgtgcctaaaacatgggtctccactgaccacctttccatagtgtggtgcaagcagctgcaactgacaacggtgagagccttctttgatttgattgacgctgacactaagcaaatcactcaaaattccaagaagaaactatctgtgctataccaccatttcatccgtcaccccagcaagcacttcgaagagaaccctgctattatctccgatttgaccggcatctag

SEQ ID NO: 129336 - DNA, 1779 bp, Artificial Sequence
  Description of Artificial Sequence: Synthetic coding sequence
atgtttcttcacagtgtcaatttatggaacttggcgttctacgtgtttatggttttcctcgcaacactcggcctgtgggatgtattctttgggtttgaggagaacaagtgttccatgtcttacatgttcgagtatccagagtaccaaaagatcgaacttcccaagaaactggctaaacggtacccagcatatgaactgtacctctacggtgaaggttcatatgccgaggaacataagatcctcccactcacaggcatcccagttctctttctgccaggaaatgcagggagctacaagcaggtcaggagtatcgggtctatcgccctgaggaaagcggaagacatcgactttaaataccatttcgactttttctccgtgaacttcaacgaagaacttgtggccttgtacgggggatccctccagaaacagaccaagttcgtccacgaatgcattaagaccatactgaagctttacaaaggccaggagtttgctcccaaaagtgtggccatcattggccattctatgggcgggctcgtagcccgcgctttgttaaccctcaagaactttaagcatgacttgattaacctactcataacacaggccaccccgcacgtcgctcctgttatgccgctggaccggtttatcactgacttctataccacagtgaataattattggattctgaatgcccgacacatcaacttgactactcttagcgtagccggcgggtttagagactatcaggtgagatcagggttaacattccttcccaaattatcacatcacactagcgcactgtcggtggtgagctccgcggtcccaaaaacatgggtgagtactgaccacctttccattgtttggtgtaagcagctccagctcaccaccgtgcgcgctttcttcgacctgatagatgctgataccaaacagattactcagaactcgaaaaaaaagcttagcgtgttgtaccatcatttcatacgccatccatccaagcatttcgaggagaacccagccataattagcgaccttactggtactagcatgtgggttcttgttaaagtgtcaaaatggacctacgtagcctacaatgagagtgagaaaatctatttcaccttcccactggagaaccatagaaaaatctacacgcacgtgtactgtcaatccactatgctagacaccaacagttggattttcgcttgtattaattcgacaagtatgtgtctgcagggggtcgatctgagttggaaagcggagttgctgcccaccattaaatatcttactctgaggctgcaggattatccaagcctttcccatctggttgtttatgttcctagtgtgaggggaagcaaattcgtggtggattgcgagttttttaagaaggagaagcggtacatccagctgcccgtaacccacttgttctcctttgggctttcatccaggaaggtggtgctgaacaccaacgggctgtactacaatctggagctgctgaacttcggacagatttaccaggcattcaagatcaacgttgtttcaaagtgttcagcagtaaaggaagaaattaccagtatttatcggctccacatcccttggtcttatgaagatagcttaactatcgcccaggctccgtcatcaaccgagattagcctgaagctgcacattgcgcagccagagaacaatacccatgtggccctttttaaaatgtatacctcgtctgattgtcggtacgaagtgactgtcaagacgagtttctcccagattctcggacaggtcgtcgcatag

SEQ ID NO: 129337 - DNA, 1293 bp, Artificial Sequence
  Description of Artificial Sequence: Synthetic coding sequence
atgttcctccattccgtgaacctgtggaacctggctttttacgtgtttatggtgtttctggccactcttggcttatgggacgtgttcttcggtttcgaagagaacaaatgttctatgtcctacatgttcgagtatcctgagtaccagtcctcggccgttcctaaaacatgggtctcaaccgatcacttgtctatcgtgtggtgcaaacagctgcaactcactaccgtccgcgcattttttgacctgatcgacgcggacactaagcagatcacgcaaaacagtaaaaagaaactgtcggtgctctaccatcatttcatcagacatcccagcaagcatttcgaggagaatccggcgataatttcagatctgacaggcacctctatgtgggtactcgtgaaagtgagtaagtggacgtacgtggcttacaatgagagcgagaaaatttacttcacgttcccacttgaaaaccatagaaaaatttacactcatgtgtattgtcaatcaacgatgctggacacaaatagttggatttttgcctgtatcaactccacctcaatgtgtctgcagggagtggacctgtcctggaaagcagagctcctacctactatcaagtatttaactctccgtctgcaggactaccccagcctgagtcatcttgtcgtctacgttccatctgtgcgggggagcaaattcgtggtggattgtgagttctttaaaaaggagaagaggtatatccagctgcccgtgacccaccttttctcttttgggctttctagccgcaaggtggttctgaacaccaatggcctgtactataacctggaacttctcaactttggacagatatatcaggctttcaagatcaacgtggtgtcaaaatgttcagccgtaaaggaagaaataacaagcatctaccgtctacatataccatggtcatatgaagattcattgaccatagcccaagcaccatcatcaacagaaataagtctcaaactgcatatcgcacagcccgagaacaacacacatgtcgcactcttcaaaatgtacacttcctccgactgccgctatgaagtgacggttaagacctccttcagccagatattaggacaagttgtgcgcttccatggcggtgccctgccagcctatgttgtgtctaatattctcctggcttatcggggccagctttattccctctttagcaccggatgttgtttagagtacgctacaatgcttgataaggaggctaaaccttataaagtggatccgttcgtcatcattataaaattcttactgtag

SEQ ID NO: 129338 - DNA, 774 bp, Artificial Sequence
  Description of Artificial Sequence: Synthetic coding sequence
atgtcacgcccactaattacccgatccccagcctcacccctcaacaatcaggggatacctacccccgctcagctcactaagtccaacgcaccagtgcacatcgatgtagggggccacatgtatacatccagtctcgcgacactgacaaagtatccagagtcacggatcggccgcctctttgacggaaccgaaccgatcgtactggactccctcaaacagcactattttatcgacagggatggtcagatgttccgctatattctcaatttcctgaggacctcgaagcttctaattccggatgactttaaggactatacacttctgtacgaggaagctaaatacttccagctccaacctatgctgctggagatggagaggtggaaacaggaccgtgagaccggccgcttttctcggccctgcgaatgtcttgtggtgagagtcgcgcccgacctgggggaacgtattaccctgagcggtgataagtctctgattgaggaagtgttcccagaaatcggggacgtgatgtgcaatagtgtgaatgccggttggaatcacgactcaacccacgtgattcgtttccccctcaatggctattgtcaccttaactctgtccaggtcctggagagactgcagcagcgcggtttcgaaatagtcggaagctgcggcggtggagttgattcctcacaattttctgaatatgtgcttcggagggagctgagaaggacccctcgggtcccctctgttatccggatcaaacaagaaccgctcgactag

SEQ ID NO: 129339 - DNA, 774 bp, Artificial Sequence
  Description of Artificial Sequence: Synthetic coding sequence
atgtcgaggcccctgatcacaagaagcccagcgtcaccacttaataaccaaggtatccccacccccgcccaactgactaagtcaaacgccccggttcatatagatgtggggggacacatgtacacctccagtcttgccaccttgaccaagtaccccgaatcaaggattgggaggctgtttgatgggacagaaccaatcgtgctcgacagtctgaagcagcactatttcattgatcgcgatggccagatgttccggtatattttgaatttcctgcggacttcaaagctgttgattcctgacgactttaaggattatacactgctttacgaagaagccaagtacttccagctgcagccaatgcttctggagatggagcggtggaaacaagaccgggagactggccgtttctctcggccttgcgagtgtctggtagtccgtgtggcaccggacctcggcgagcggataacactgtcaggagataagagccttatagaagaggtatttcccgagatcggcgacgttatgtgcaattcagtcaatgctgggtggaatcatgattccactcacgttattaggttcccacttaacggatactgtcacctaaacagcgtgcaggttctggaacgccttcaacaacggggattcgaaatcgtgggtagctgtgggggcggggtcgacagttcccagttctcagagtacgtgttgcggcgggaactgagaagaacgcctcgtgtgccgtctgtgattcgtatcaaacaagaacccttggattag

SEQ ID NO: 129340 - DNA, 2598 bp, Artificial Sequence
  Description of Artificial Sequence: Synthetic coding sequence
atggcacggatgcccggcagtggcgactgcaacacttctgcaggaggttcggcctctgctgcagcagctgccgcggaaaacaacggagagcggggagagggggagagaggcgccggcgggcgcggcaggaggcatagtcgaccacactattgcagcgcaggcgaggaagaagaagaagaagaggaagaggacgagatccaggaagtccagatcacaggagatgaggaagaggaggaggacggaggaggcggcttggaagaagatgaggaagaagaagaagaagaagagatgggcctggactgggatgagccattggagccagaggacagcgcaggggaagagctggaaccggagcctgtgcatatgatcaatatggaccaatccgcagcgctggagccagaagcaccgccacggctactggcgcctcgcgctcggggcgggccacccggagatgggagcgagctggaccctgacgtgcttcagcgacctgagcgcgcccgcctttctgagaatactaggttggctaccagatatgctgtgcgaattttcagagagtatctaagtgagaaggctcaaagtcctgattttgaaaccatggacaaaggtgccttgtgtcgcgtcctcaggtcattctacgcggaagcaagatctaaatcaggccagctatattctaagtcctccctgatctcaattaggagcagtctgaacagatacctgaacgagcctccttattgtcgcacgttggacctaactaaggacccggaattacgtagcgctaatctcacactggccgctgtaattcggaaactggaggagcagggggctggtccggtcgtgcagaaacaagctatcacaagagctgatctcagaaagctctacacctcatccgtatttagcaccaatacccccttcggactactcaataaggtttggttcgaaacatgtatgtatttctgtacaagaggccgggaaaatcagagggagttggaggaagactccttcggcctggcaatggatgaggatggaagaaagtttgtgtattttaagtctctgggtccgtatcataaaagccggagtagttcttggtccaagaagagagctgagtcatcggatgaagagaacttaccccggatgtacgaaactggcacagagttctgcccctatgctagctttgtcaagtatttgtccaagcggaacccactatgcaaagctttttttcagcgaccccgcgatcactgctctgaaggagatgtgacatggtacgaaaacaaggcgataggtaaaaacctgctgggcactcgcatgcagatgctgtccaaggcagcaaagttgtctaagacctataccaatcattgtatcggggccgtgagcatcgcaacactcaatagtatagccggtattggaaccaaacttggctcgcctgccccccagggctgctatgctgaggctttgaatggggcggcccgacatcacagccatcatcctcctacccatccatctcaccatcaccggccccagcccccctcgctcggaaatacctacattctcccaaaagactcccaggtggggccagatgtgaaatccgaggccgctcccaaacgggccctgtatgagtccgtttttgggtccggagagatctgtgggcccactagcccaaagagactgtgcatccgaccctcagagcctgtggatgcggtggtggtggtctctgtgaagcacgatcctctgccccttctgcctgaagctaacggccatcgcagcaccaacagccctactatcgtgtctcccgccattgtgtctcctacccaggacagccgccctaacatgagccggcctctaattaccaggtcccctgcttcacctctgaataaccagggcatacccacccccgcccagcttacgaaaagtaatgcgcccgtgcacatcgatgtgggcggacacatgtacacgagctctctcgcgaccttaaccaagtaccctgagtcacgtataggccgcctgtttgatggaactgaacctattgtgttggattcattgaagcagcactatttcatcgatcgtgatgggcagatgtttagatatatcttaaactttcttagaacatctaaactattgatacctgacgatttcaaagattataccttgctttatgaagaagctaaatacttccagctgcagccgatgcttctggaaatggagagatggaagcaggatcgcgagactggccggttttcgcgcccttgtgagtgtttagtcgtgcgtgtggccccagacctgggagagcgcataacacttagcggtgataagagcttaatcgaagaagtgtttccggagatcggtgatgtaatgtgtaacagtgtgaatgccgggtggaaccatgattccacccatgtgattcggtttccactgaacggctattgccacctgaatagtgtccaggtgttagagcggctgcagcagaggggatttgagattgtgggatcctgtggtggcggagtggatagctcacagtttagcgagtacgtccttaggcgcgaactgagacgcacccctagggtgcccagcgtgatacggatcaaacaagaacctctcgactag

SEQ ID NO: 129341 - DNA, 774 bp, Artificial Sequence
  Description of Artificial Sequence: Synthetic coding sequence
atgagccggccccttattacaagaagtccagcatctcctcttaacaaccaagggattcccactcccgctcagctgactaagtcaaatgctcccgttcacatcgatgtggggggtcacatgtatacaagcagcctggccacgcttacaaagtaccctgagtctcggattggccggctgtttgacggcaccgagcctatcgtcttggactccctgaagcagcattattttattgacagagacggtcagatgtttcggtacattcttaactttttgcggactagcaaactgctgattcccgacgactttaaggattatacgctcctgtatgaagaagcgaagtatttccagttgcagcccatgctgctggaaatggagcgctggaaacaggaccgggaaactggacgcttcagccgcccctgtgagtgtttggtggtgcgcgtggccccagacctgggtgagcgaatcactctgtccggggacaagtctttaatcgaagaggtgttccccgagataggagatgtgatgtgtaactcagtcaatgcgggatggaatcacgacagcacgcacgtgatccggttcccactcaatgggtattgtcatctgaatagcgttcaagtgcttgaacgactgcagcagcggggatttgaaattgtcggcagttgcggcggtggagtcgactcctctcaattttccgaatatgtgctgcgcagagagctgaggagaacccccagagtgccttctgtcattcgcattaaacaggaaccactggactag

SEQ ID NO: 129342 - DNA, 1044 bp, Artificial Sequence
  Description of Artificial Sequence: Synthetic coding sequence
atgagagtcgtggtgataggagctggagtgatcggactgagtaccgctctgtgcatccacgaaagataccactctgtactgcagccgctggatattaaggtctacgccgaccgttttactcctctgacaacgactgacgtggccgcagggctgtggcaaccctatttaagtgatcccaacaacccacaagaggccgactggagtcaacagacgtttgactacctactctcgcacgtgcactctccaaatgccgagaacctgggactgtttctgatctcggggtataacctattccatgaagccattcccgatcctagttggaaggacaccgtacttgggtttcgcaagctcacaccaagagagctcgacatgttcccagattatggatatggatggtttcacacttccttaatactggagggtaagaactatcttcagtggctgaccgaacgtctcaccgagaggggggtgaaatttttccagagaaaggtcgagtcattcgaagaagtggcgagggaaggtgctgatgtgatcgtgaattgtaccggcgtgtgggccggcgcactacaaagagatccgctccttcaacctgggcgaggacaaattatgaaggtggacgccccttggatgaaacacttcattttgacccatgacccggaaagaggtatttacaattccccgtacataatacctgggacgcagactgttacacttggcggcatcttccagttgggtaattggagcgagctgaataatatacaggaccacaacacgatctgggagggatgttgccgattggagccaaccctcaaaaacgcgcgtatcatcggcgaacgcaccggttttcgtccagtaagaccgcaaatccgcctggaacgggaacaattgagaacagggccatctaacaccgaggtgattcacaattacggacacggagggtacggccttactattcactggggatgtgccttggaagcggccaaactttttggccgtatccttgaggagaagaagctttcccggatgccaccttctcacctttag

SEQ ID NO: 129343 - DNA, 399 bp, Artificial Sequence
  Description of Artificial Sequence: Synthetic coding sequence
atgctgaagaatatcgagcttttcgataagctctctcttcgcttcaatgggcgggttctctttatcaaggacgttattggcgacgagatttgctgctggagcttttacggccagggcaggaagattgccgaggtttgctgcacttccattgtgtacgcgactgagaaaaagcagacaaaggtcgagttccccgaggcacggatttacgaggagactctaaatattctcctctacgaggcccaggacggaaggggccctgacaatgccttgcttgaagcgaccggcggggctgcagggcgttcacaccacttggacgaagatgaggagcgtgaaaggatcgagcgtgtgcgtcgcattcatattaaacgccccgatgatagggctcatctgcaccagtag

SEQ ID NO: 129344 - DNA, 840 bp, Artificial Sequence
  Description of Artificial Sequence: Synthetic coding sequence
tgaaggtactgtcgcagcccattttggagcggctatggaaacttctactcgctccagaaaagtggttttctgccaacgttgggcacagtacagccttttaattactgcaaaagcggctggattctgattgatcgatgtgggaagcactttggaaccattctgaattaccttagagacggagcggtccctttaccggagtctcggagggagattgaagagcttttggctgaggctaaatattatcttgttcagggtctagtggaagagtgccaagctgccttacagaataaagacacgtacgagcctttttgcaaggtccctgtgatcacttccagtaaggaagagcaaaagctgatcgctacatcaaacaagcccgccgttaagctcctttacaaccgctccaacaacaagtactcatatacttcaaactcagatgacaacatgcttaagaacatagaactcttcgataagctcagtctgaggttcaacgggcgggtacttttcatcaaggatgtcatcggcgacgaaatttgctgctggtcattttacggccagggtaggaaaatcgccgaggtgtgttgcacttctattgtgtatgctacagaaaagaagcagactaaggtggagttccccgaggcaaggatttatgaggagaccctcaacattctgctgtatgaggcccaggacggaagaggccccgacaatgcccttctggaagccacagggggtgccgctggcaggagtcatcacctggacgaggatgaggaaagagagaggatcgagagggtccggaggattcacattaagagaccggatgatagggctcacttacaccagtag

SEQ ID NO: 129345 - DNA, 864 bp, Artificial Sequence
  Description of Artificial Sequence: Synthetic coding sequence
atgtcaggtgagtctgttgtttcctccgcggtccccgccgctgcaacaaggactacgtcattcaaggggacatcaccatccagcaagtacgtcaaactcaatgttggaggcgccctgtactacacaactatgcagacactgaccaagcaggacacaatgctaaaagccatgttctctggccgcatggaggttttgacagattccgaaggatggattctgatcgaccgctgtggcaagcactttggaaccatcctgaattaccttagggatggcgcagtgccactgcctgaatccaggcgggagatcgaggaactgcttgccgaagcaaagtattacctcgttcagggcctcgttgaggaatgtcaggctgctttacaaaacaaggacacctacgaacccttctgcaaagtgcctgtcatcacatcatctaaggaggaacagaagcttatcgcaaccagcaacaaaccggccgtcaaactgctgtacaacaggagcaacaataaatattcatatacgcgcgttctgttcattaaggatgtcattggcgatgagatttgttgctggtccttttacggccaggggcgcaagatcgccgaagtctgctgcacaagcatcgtgtacgccacagagaaaaaacagacaaaagtagaattccctgaagccaggatatacgaggagaccctaaacatcctgctgtatgaggcacaagatgggcgcgggccggataacgccctgttagaggcgaccgggggcgcagcgggccggtctcaccacctggatgaagacgaggagcgggagcgaattgaaagagtgaggagaatccacatcaaacggccagacgatcgtgcgcacctgcaccagtag

SEQ ID NO: 129346 - DNA, 468 bp, Artificial Sequence
  Description of Artificial Sequence: Synthetic coding sequence
atgatggctgtgttcacctccctctggagtccctaccagatgttattctgcagcaacagcgatgacaacatgttgaaaaatatcgagctattcgataagcttagcctgaggtttaatggtcgtgtgctcttcattaaggacgtaatcggcgacgaaatttgctgttggtctttctatggccagggccggaagattgccgaagtttgctgcacctccattgtgtacgccactgagaagaaacagacaaaggtagagttccctgaggctagaatctatgaagagacactgaatatcctgttatatgaggcgcaggatgggagagggccggataacgcgctgctcgaagctactggaggcgccgctgggcggtctcaccacctggacgaagatgaggaacgagagagaatcgaacgcgtcagacgtatacacatcaagagacctgatgatcgcgctcatttgcaccagtag

SEQ ID NO: 129347 - DNA, 990 bp, Artificial Sequence
  Description of Artificial Sequence: Synthetic coding sequence
atgtccgctgaggcttctggaccagccgctgccgcagcccccagcttagaggccccgaaaccctcgggtttggagcccggccctgctgcatacggactcaagccactgacccccaacagcaaatacgtgaaattgaatgtgggcgggtccctccactataccaccctgaggacgttgactggacaggatacaatgctgaaagccatgtttagtggaagagttgaagtgctcaccgacgctggaggttgggttcttattgaccgtagtggccggcatttcggtacaattctgaactacttgcgggacggatctgtccccctacctgagtccacacgcgagttaggtgaactgcttggcgaggcaagatactacctggtgcagggcctgatcgaagactgccagttagcacttcagcagaaacgggagactctctcccccctttgtctcattcccatggtaacctcccctagagaggagcagcagctgctagcctctacatccaaacctgttgtgaagctgctccacaaccgctcaaataacaagtactcgtacacttctacctctgatgataacctgcttaagaatatcgaactattcgacaaacttgcactccggttccatgggagattactctttcttaaagatgttttaggtgatgagatctgttgttggtccttctacggacaggggcggaagattgcagaagtgtgctgcacaagtatcgtgtacgctaccgagaagaagcagacaaaagttgagttccctgaggccaggatcttcgaggagaccctgaatatactgatttacgaaacaccacggggcccagatcctgcgttgctcgaggctaccggcggcgcagccggcgccggaggggccggcaggggtgaggacgaggagaatagagaacatcgggtgcgacgcatccacgtgcggaggcatataactcatgacgaaaggcctcatggccagcaaatcgtatttaaagactag

SEQ ID NO: 129348 - DNA, 990 bp, Artificial Sequence
  Description of Artificial Sequence: Synthetic coding sequence
atgagcgccgaggccagcggcccagcggctgctgctgccccaagcctcgaagcccccaagcctagcggcttggagcccggccccgcagcttacggacttaaacccctgactcccaatagcaagtatgtgaagctgaacgtaggcgggtctttgcactatactaccctgaggacattgaccggccaggacactatgctgaaggcaatgttttccggcagagtggaggttcttacggacgccggggggtgggtcctgattgatcgctccggcaggcacttcggcaccattctcaactacctccgcgatggaagcgtgccactgcccgaatcgactcgcgaactgggggagttgctaggagaggcccggtattatctcgttcaaggtctgatcgaggactgccaattggcacttcagcagaaacgggaaactctttctcctctgtgtctgattcctatggtgacctcaccccgggaagaacagcaacttctagccagcacatcaaagccagtggtcaagctgctgcataatagatcaaacaacaaatactcttacacctcaacttccgatgacaacctactcaagaacatcgaacttttcgacaagcttgccttgcgatttcatggccggctcctttttctcaaagatgtgttaggcgacgagatatgctgctggtccttctacgggcagggtcgcaagatcgcagaggtttgttgtacatccatcgtgtacgctacagagaagaagcaaacgaaagtagaatttccggaagcaagaatttttgaggaaaccctgaacatcctgatttacgagacaccacggggtcctgaccctgccttactggaggcaactgggggcgccgccggagctgggggggccggtaggggcgaagatgaagagaaccgggaacatcgggtgagaagaatacacgtcagacggcacatcacccatgacgaaaggcctcacggacagcaaattgtcttcaaggactag

SEQ ID NO: 129349 - DNA, 1287 bp, Artificial Sequence
  Description of Artificial Sequence: Synthetic coding sequence
atggccttatcggggaactgttcacgttactacccacgggagcagggctctgccgttccaaatagtttccccgaagtggtagaactgaatgttggcggccaggtctacttcactagacacagcacattaatctcaatccctcattcactcctgtggaaaatgttctccccgaagagagacaccgctaatgatttagccaaagactcaaaaggtaggttttttatagatcgtgatggcttccttttccgctatatcctcgattatttacgagaccgacaggtcgtgctgccggatcattttcccgagaaaggtcgcttgaagcgagaggctgagtacttccagcttccagacctggtcaagctgctgactcctgatgagataaaacagtcccccgatgagttttgccatagcgacttcgaggacgcatctcagggatcagataccaggatctgccctccatcttcactgttgccagccgatcggaaatggggattcattaccgtgggatacaggggctcttgcaccctagggagggagggacaggccgacgcaaaattcagacgcgtaccgcggatcctggtatgtggccgaatttctctggctaaagaagtgtttggcgagacactcaacgaatctagagacccagaccgcgctcccgagaggtatacctctcggttctacctgaagtttaaacaccttgaaagagcctttgatatgctgtccgagtgcggctttcatatggtggcatgcaacagtagtgtcactgcttcatttataaatcaatacactgacgataagatctggtcgtcttatacagaatacgttttctaccgggagcctagcaggtggtccccttctcactgcgactgctgttgtaaaaacggtaaaggggacaaagagggggaatcaggcaccagctgcaatgacctctccacttcttcatgtgactcccagtctgaggcctccagcccccaagagacagtgatttgcggacccgttaccaggcagactaacatccagacgctggatcgcccgatcaagaaaggcccggttcagttgattcaacagagtgagatgagacgaaagtcggacctcctgcgaacactgaccagcgggagccgggagtctaacatgagcagtaaaaagaaagccgtcaaggaaaaacttagcattgaagaggaactggagaaatgcattcaggactttctgaagatcaagattcctgatcgattccccgagaggaaacatccctggcaatcagagctgctccgaaaatatcatctgtag

SEQ ID NO: 129350 - DNA, 1287 bp, Artificial Sequence
  Description of Artificial Sequence: Synthetic coding sequence
atggcactcagtggaaactgctcaagatattatcccagagaacaggggtcagcagtgcccaacagcttcccggaggtagtcgagctaaacgttggagggcaagtctacttcactcgacactcgacccttatttccattcctcacagcttgctttggaagatgttttcgcccaagcgggatacagccaatgatttagccaaagacagtaagggccggttcttcattgatagagatggctttctgttccggtatatcctggattatctgcgcgaccgccaagtcgtactgcctgatcacttccccgagaaagggcgccttaagcgggaggctgagtattttcagctcccggatctggtaaagctcctgacgcccgacgaaattaaacagagcccggacgaattttgtcacagcgacttcgaagacgcctcccagggctctgatacaaggatctgtccaccctcttctcttctgcctgcagaccgtaagtgggggttcatcactgtgggctacaggggctcttgcaccctggggcgcgagggccaagctgatgcaaaattcagaagagttccacgcatcctggtctgcgggcgcatatcgttggccaaggaggtattcggagaaactctgaacgagtcccgtgaccctgaccgtgcccctgagagatatacaagcaggttttacttaaaattcaaacaccttgaacgcgcctttgatatgctatcagaatgcggcttccacatggtggcgtgtaattctagcgtgaccgcttcattcatcaaccaatacactgatgataagatctggtcaagctacactgaatatgtattctaccgtgaaccctcccggtggagcccatctcattgtgattgttgctgcaagaacggcaaaggcgacaaagagggcgaatctgggacctcatgcaatgatctgtccacgagctcctgcgatagtcagtctgaggcttccagtccccaggagacagtgatctgcggccccgtcacccgtcagaccaatattcagaccttggaccggccaattaagaagggccctgtacagcttattcagcagtccgagatgcgaaggaagtcagatctgttgcgtaccctcacatcaggctccagggagtcgaacatgagctccaaaaagaaagcagtgaaagagaaactgtctattgaggaagaacttgagaagtgtatacaggacttccttaagattaaaatacccgacagattccccgaacgcaaacacccatggcagagcgagctgcttcgcaagtaccatctgtag

SEQ ID NO: 129351 - DNA, 792 bp, Artificial Sequence
  Description of Artificial Sequence: Synthetic coding sequence
atggccgaactacagctggacccagccatggccggactcggaggaggaggggggagcggcgtgggggacggagggggccctgtgcgaggcccacctagccctaggcctgccggccccactccacgaggccatggccgtcctgccgcagccgtggcccagcccctcgagcccggcccagggccacccgaaagggccggagggggtggtgcggcgcgctgggttagactgaacgtcggcgggacatattttgtaactactcgccagacactggggcgggaacccaaatcgttcctgtgccgcctctgctgccaggaggacccggagctggactctgataaggatgaaacgggagcctacctgatcgatcgcgacccaacatattttgggccaatcctgaactacctcagacacggaaagctcatcattacaaaggagctcgcggaagagggggtcctcgaagaggccgaattttataatatcgcatctctcgtgaggctcgtgaaggaaagaattagagacaatgaaaaccggacatctcaaggcccagtcaagcatgtgtatagggtcctgcaatgtcaggaggaagagctcactcagatggttagcactatgagcgatggatggaaatttgaacagctcatttccataggcagttcctataactacggtaatgaagaccaggccgaattcctgtgcgtggtgtcaagggagcttaataattccactaacggaattgtgattgaaccaagcgagaaagctaagatcctgcaggagcgcgggtctaggatgtag

SEQ ID NO: 129352 - DNA, 738 bp, Artificial Sequence
  Description of Artificial Sequence: Synthetic coding sequence
agcttgccacgtaatgggcctgctaggttgcgagctggctcatcaggcggtggcggcgggcctagatggcggaactgcagctggacaaggaggtggcgagggtgggaaggcgctccaggtcccggccctccagagcgcgccgggggaggaggcgctgccaggtgggtgcgcctcaatgttggtggcacctacttcgtcacaacacgtcagaccctaggtcgggagcccaagtcatttctgtgcaggctctgttgtcaggaagaccctgaattggatagcgacaaggacgagacaggcgcatatctcatcgacagagaccctacgtatttcggaccaatcctcaactaccttagacacggaaagctgatcatcactaaggagctggcagaggagggcgttctagaggaggccgagttctacaacatcgcttcattggtacgcctggtcaaagaacgaatcagggataacgaaaaccgaacatctcagggacctgtcaaacatgtatacagggtgctgcagtgtcaggaggaggaactcacacaaatggtgtcgacaatgtccgacggatggaaatttgagcagctgatttcaataggatcatcttacaactacgggaacgaagatcaggctgaattcctgtgtgtggtgtcaagagaactcaacaactcaactaatggtatcgtaatcgagccttccgagaaagcaaagatcttacaggaacgaggtagtaggatgtag

SEQ ID NO: 129353 - DNA, 2448 bp, Artificial Sequence
  Description of Artificial Sequence: Synthetic coding sequence
atggccggcggacactgcggatcctttcccgcagccgcagctggaagcggcgaaatagtgcagctgaacgtgggtggtactcgtttctctaccagccgtcagactcttatgtggatccctgattcgtttttctcctcacttctgtctggtaggatctcaaccttgagggacgaaactggtgccatttttatcgatcgggatcccgccgcattcgcccccatactcaactttctgcgaacaaaagagttagatctgcggggcgtctctataaacgtgctgaggcatgaggcagagttttatggcattactcccctggtccggcgtctgcttctatgcgaagagctcgaacgaagttcatgcggttccgttctttttcacgggtacctccctccccccggcattccgtcacgcaaaatcaacaataccgtgcgatccgccgattctaggaacggtcttaacagcactgaaggagaggccagggggaacggcacacaacctgtgctgtccggcaccggtgaagagactgtgagactgggcttccccgttgaccccaggaaggtcttgatcgtagccgggcatcacaactggatcgtggccgcctatgcccattttgccgtgtgttatcgcatcaaagagagcagcgggtggcagcaggtgttcacctcgccttaccttgactggacaatcgagagggtcgccctcaacgccaaggtggtgggcggacctcacggtgataaagataaaatggttgccgtggccagcgagagcagcataatactctggtcggtacaggacgggggatctgggtctgagatcggggtgttctccctgggagtgccagtggatgctctgttctttatcggtaaccagcttgtggctacaagtcatacggggaaagtcggagtttggaacgccgtcactcagcactggcaggtgcaagacgtcgtgccgattacatcctacgacaccgccggatccttcctgcttcttgggtgtaacaacggtagcatttattacattgacatgcagaagtttcctcttcgcatgaaagataacgatcttctggtgacggagctgtatcatgatcctagcaacgatgccattacagccctgtccgtgtacctgacccccaagacatccgtcagcggaaattggattgaaatagcatatggaacctcatccggcgcagtccgggtgatagtgcagcaccccgaaaccgtcggttccggcccccagcttttccagactttcactgtccaccgttcccctgtaaccaagatcatgctgtctgagaagcatctggtgagcgtttgcgccgacaataatcacgttagaacctggaccgtgaccaggtttagagggatgattagcactcaacccggatccacccccctagcctcgtttaagatactctccctagaggagactgagtcacatggctcatattcatctggcaacgacattggtccttttggggagagggacgatcagcaggtattcatccagaaagttgtgcctataacgaacaagctctttgtgcggctcagttcaaccggcaagagaatctgtgaaatccaagccgtagattgcactaccatatcatccttcactgtacgggagtgcgaaggctctagcagaatggggtcccggccccggcgttacctcttcacagggcacactaacggctccatacagatgtgggatctcacaaccgccatggacatggtgaacaaaagcgaggacaaggacgttggagggcctaccgaggaggagctactgaaactccttgaccagtgcgatctaagcacatctcgctgcgccacgccgaatatctcaccagccaccagtgtggtccagcactcacacctccgggaatctaatagttccctgcagctacagcaccatgatacaacacacgaggctgccacctacggaagcatgaggccctaccgagagagtcctttattagcacgcgcaagaagaacagagtcgttccactcctaccgcgacttccaaacaatcaatctaaaccggaatgtagaacgggccgtgcccgagaatgggaacctgggcccgatccaggccgaagttaaaggagctacaggggaatgtaacatttctgaaagaaagtcgccgggggtggaaattaagagcttgcgggagttagattctggcctggaggtccataaaattgccgaaggattctccgagtctaagaagcggagtagtgaagacgaaaacgaaaataagatcgaattcaggaaaaagggagggtttgaagggggcggtttcctcggtaggaaaaaggttccttatctcgccagcagcccaagcacctcagacggtggcacagactcccccggcaccgccagtccatcacccaccaagacaaccccatctccaagacataaaaaaagtgactcgtctggtcaggagtattccctgtag

SEQ ID NO: 129354 - DNA, 723 bp, Artificial Sequence
  Description of Artificial Sequence: Synthetic coding sequence
atggcgggcggtcactgtggaagttttccggccgcagcggcagggtccggggaaatcgtacaactcaatgtaggaggaacccgcttctctacatcgcgtcagaccttaatgtggattcctgactcattcttcagttccctgctgtccggtcgaatcagcactctgcgggacgagacgggggccatatttatcgaccgggatcccgccgcttttgcccccatcttgaatttcctcagaaccaaggagctggaccttagaggggtttcgatcaatgtgttgcgacacgaagctgaattctacggcattacccccctggtcaggcgactactactgtgtgaggaactggagcgaagctcttgtggatcagtgttgttccacggttatctgcccccccccggaatccctagtcggaagatcaataacactgtccgttctgccgactctcgcaatggtctgaattccacagaaggcgaagctagaggaaacggcacacaaccagtgctgtccgggaccggggaggaaaccgtgagactggggttcccggtggaccctagaaaggttcttatcgtcgcaggccatcacaattggattgttgctgcctatgctcacttcgctgtgtgttacagagtgttttggttgggaaccgttgggcatgcctgcaatcccagtacattgggtggaagggatggttggtcatcaaggtcagctcgccctacttggtag

SEQ ID NO: 129355 - DNA, 567 bp, Artificial Sequence
  Description of Artificial Sequence: Synthetic coding sequence
atgaaagacaacgacttacttgtgaccgaattgtaccatgaccccagtaacgatgcaattacagccctctcagtatatctgaccccaaagacctccgtcagtggcaactggatcgaaattgcttatggcacctcaagcggcgcggtcagggttattgtgcagcatcctgaaaccgtggggtctggacctcaacttttccagacatttacagtccaccggtctcccgtgacaaagattatgctgtccgagaaacatctagtgtctgtctgcgccgacaacaaccatgtgcgcacatggacagtcacccgttttcggggtatgatttccactcagccagggtctaccccacttgcatctttcaagatcctttcattggaggagacggaatcccacggatcatatagcagcggcaacgatattgggccatttggggagagagacgatcagcaggtctttatccaaaaggtggttcctatcacaaacaaattgttcgtccgcctgagttctactggaaaatccctttgcggcgtgagtctggtcagtcggtctagtcaggaacctacttag

SEQ ID NO: 129356 - DNA, 642 bp, Artificial Sequence
  Description of Artificial Sequence: Synthetic coding sequence
tgattttccacatcacgccagacacttatgtggattccagacagcttcttctcgtccctcctgtccggacggatctctaccctgcgggatgaaaccggggctatattcatcgacagggaccccgccgcatttgcaccgatattgaattttcttcgcacaaaggaactggacctccggggcgtctcgataaacgtgctacggcatgaggcggagttttacggaattacgccattggtccgacgtcttctgctgtgcgaggaactggaaagatccagttgtggctccgttctgtttcacgggtacttgccaccaccgggcataccaagtcgtaagatcaataacacggttcgatcagccgattcacggaacgggcttaactctacagaaggggaggcccgcgggaacggcactcagcctgtccttagtggcaccggtgaggaaactgtgcgcttgggctttccagtcgacccgaggaaggtgctcattgtagctgggcatcacaattggattgtcgctgcctatgcacatttcgcagtatgttatagagtattttggctcggtactgtaggccatgcatgcaatccgagtactctggggggaagggatgggtggtccagcaggagcgcccgccctacctggtag

SEQ ID NO: 129357 - DNA, 507 bp, Artificial Sequence
  Description of Artificial Sequence: Synthetic coding sequence
taagctctttccgtgtatctgactccaaagacctcagtgtccggaaattggatcgagatcgcctatgggacctccagcggtgcagtaagagtgattgtgcagcatccagaaaccgttggctccgggccccagctcttccagacatttactgttcacaggtctcctgtcaccaagattatgcttagcgagaagcaccttgtgtccgtgtgtgctgataataatcatgtacgtacttggaccgttaccagatttagggggatgatctcaacgcaaccaggaagtacgccgctcgcgtctttcaagatcctgtccctggaggaaacagaatcccacggtagctacagctcgggcaacgacattggaccctttggcgaacgcgacgaccagcaggtgttcattcaaaaagtggtgccaatcacaaataagttgttcgtgcggctgtcctccaccggaaagagcttgtgtggtgtttctctggtatctagatcttcccaggaaccgacttag

SEQ ID NO: 129358 - DNA, 870 bp, Artificial Sequence
  Description of Artificial Sequence: Synthetic coding sequence
atggtcgtcgttactggtcgtgaaccagactcaagaagacaggatggggctatgtcctcctcagatgccgaggacgatttcctggagccagccacaccaacagccacccaggcaggtcacgcactacccctgcttccccaggaatttccggaggtcgttccactgaacattggaggtgcacacttcacaacccgcttgtcaaccctccgctgttatgaagacaccatgttggctgctatgttctccgggcgacattacatacccacagatagcgaggggaggtattttattgatagggacggaacccatttcggagatgtgctgaatttcctgcggtcaggcgatcttccaccccgggagcgcgtgcgcgccgtctataaggaagcccaatactacgctattggtccactgttggaacagctggaaaacatgcagcctctgaagggcgaaaaagtgcgccaggcgtttttgggtttaatgccttattacaaggatcacctggaaaggatagtggagattgctcgcttacgtgcagtgcaacgtaaagccagatttgccaagttgaaggtatgtgtgtttaaggaagaaatgccaatcaccccctacgagtgcccccttcttaacagtctccgctttgagcgcagcgagtccgatggccaactgtttgagcaccactgcgaggttgacgtgtcctttgggccttgggaggcagtagccgatgtttacgatctgctgcactgcttagtgaccgatctgagcgcccaggggctcacggtggaccaccagtgtatcggcgtgtgcgacaaacatctggtgaaccattactactgtaaaaggcccatctacgagtttaagatcacttggtggtag

SEQ ID NO: 129359 - DNA, 1728 bp, Artificial Sequence
  Description of Artificial Sequence: Synthetic coding sequence
gtgtcccgaaagaagatgagtctgaaatctgagagaaggggcatacacgttgatcagagtgatctgctatgcaagaagggttgtgggtactacgggaaccctgcatggcagggattctgctccaagtgttggcgcgaggagtaccacaaagctagacagaaacagatccaggaagactgggagctggccgaacgagtgttactctgttacccgggttggtcagccatggtacagttccagctcaccgccacttctgcatcatgggcgcaggtcatactgctcctgcagccacccaacgtgttgggtctgcaggctctacagagagaggaagaggaggctttcgcctctagtcaaagtagccaaggagcccagagcttgacgttttcaaagttcgaggagaagaagacaaatgagaaaacccggaaagtcacaaccgtgaagaagttcttcagtgccagtagccgggtggggtctaagaaagagattcaggaggctaaagccccaagtcccagtataaatcgtcagactagcattgaaacagacagggtatctaaagagtttatagagtttctgaaaacatttcataaaactggacaagagatatataaacagaccaaactgtttttggagggaatgcactacaaacgcgatctgagtatcgaggagcagtccgagtgtgcccaggatttttaccataatgtggctgagcgaatgcagacacgtggtaaagagcgaaggttccaccacgtggggcaggctggtttggaactcttaacttccggcgatccacccgcctccgcctctcaatccgccgggaacactggagtcgaaccgcctcaccctgctgtccctccagagagagtggagaagataatggaccagattgagaaatatataatgactaggctgtataagtatgtgttttgtccagagaccacagatgatgaaaaaaaagacctggcaattcaaaagagaatccgggctctgcggtgggttactccccagatgctttgcgtgccagtcaacgaggatattcctgaggtgagtgacatggtagttaaggccatcaccgacatcattgaaatggattccaagagagtcccccgcgataagctcgcttgcatcacaaagtgctctaagcatatcttcaacgccatcaaaattaccaagaacgagccagcgtcagctgatgactttcttcctactctgatctatatcgttctgaaaggcaaccccccaaggcttcagagtaacattcagtacatcactagattctgcaatccaagcaggctgatgactggagaagacggttactactttaccaatctgtgctgtgccgttgcctttatcgaaaaactggacgcccagagcttaaatctctcacaggaggactttgatcgctacatgtccggacagacaagtccacgcaagcaggaggcagagtcttggtcaccagatgcatgtcttggagtgaagcaaatgtacaagaatctagatttgctgtcccaactaaacgagaggcaagagaggatcatgaacgaagctaagaaactggaaaaggacttaatcgattggaccgacggaatcgcacgggaggtgcaagacattgtggaaaaataccctttggaaatcaaaccaccaaatcagccactggcggccattgactctgagaatgttgaaaatgacaagttgccgcctcctctacagccgcaggtatatgcaggatag

SEQ ID NO: 129360 - DNA, 1596 bp, Artificial Sequence
  Description of Artificial Sequence: Synthetic coding sequence
atgagcttgaagtctgagagacggggcattcacgtggaccagtcggacctgctctgcaaaaaaggctgtgggtattacggcaatcctgcgtggcaagggttctgcagcaaatgttggcgagaggaataccacaaggctcggcaaaaacaaatccaggaagattgggagctggccgaaagagtactcctgtgctacccaggatggtcagcaatggtccaatttcagctgaccgcgactagcgctagctgggctcaggttatcttactccttcagccacccaacgtacttggcctccaagctctccagcgggaggaggaagaagcctttgctagttcgcagtcgtcccagggagcccagtctctgacattctcaaagttcgaggagaaaaagactaatgaaaagaccaggaaggtcacaaccgtcaagaaattctttagcgcgtcttctagagtgggtagcaaaaaagaaattcaggaagcgaaggctccaagcccaagcattaacaggcagacctcaattgagactgatcgggtgtccaaggagttcattgagttcttgaaaaccttccacaaaacagggcaggagatttacaagcaaacgaagttgttcctcgaaggaatgcattataagcgcgacctgtctatcgaggaacagtcagagtgcgcccaggatttctaccacaatgtggctgagaggatgcagactaggggcaaagtgccccccgagcgggtagaaaaaataatggaccagattgagaagtacatcatgacacgactgtacaagtatgtcttctgccccgaaaccactgatgatgagaagaaggatttagccattcagaagagaatcagggcactaagatgggtgactcctcagatgctctgtgtgcctgtgaatgaagacattcctgaggtatcagatatggtggtgaaagcaatcaccgacataattgagatggatagcaagagagtgccccgtgacaaattagcttgcatcaccaaatgtagcaagcatatcttcaatgccattaaaattacaaagaatgaacctgcatctgccgacgatttcctacctacgcttatctacatcgttctgaaagggaacccccctagactgcaaagcaacatacaatatattacaaggttttgtaacccatcacggctgatgacaggagaggatgggtattacttcactaatctgtgctgtgccgtggctttcatcgaaaagctagatgctcaatccctaaacctcagccaggaagacttcgacagatacatgagcggccagacctccccccgtaaacaagaggccgagtcatggtcccctgacgcatgtcttggcgtaaagcaaatgtataagaatcttgatctattgagccaattaaacgaacgtcaggaaaggatcatgaacgaagccaagaagctcgagaaagatttaatagattggaccgatggtatcgctagagaagtgcaagacatcgtggagaaatacccactggagatcaagcctcccaaccaacccttggcagctatcgacagcgagaatgtggaaaatgacaagctacctcctcccctgcaacctcaggtctatgcgggatag

SEQ ID NO: 129361 - DNA, 1476 bp, Artificial Sequence
  Description of Artificial Sequence: Synthetic coding sequence
atgtctctgaaaagtgagcgacgcggcatccacgttgatcagtctgacctgctgtgcaagaagggctgtggatattacgggaatccagcatggcagggattttgttccaagtgctggcgagaagagtaccacaaagccagacagaagcagatccaagaagattgggagttagcagagcgactgcagcgtgaagaggaggaggccttcgcctcaagccagagcagtcagggtgcacagtcactaaccttttccaaatttgaggaaaaaaagaccaatgaaaaaacacggaaggtcaccaccgtcaagaagttcttctctgcctcttccagggtaggatctaaaaaggaaattcaggaagcaaaagccccttcaccatcaatcaaccggcagaccagcatcgaaaccgacagagtgagtaaagagttcatagaatttctcaagacatttcacaagactggacaggagatctacaaacagacgaaattgtttctcgaaggtatgcattataagcgggacttgtcaatcgaggagcaatccgaatgcgcccaggacttttatcacaatgtggctgagcgtatgcagacccggggcaaggtcccccccgaaagagtcgagaagataatggatcagattgagaaatatatcatgacacgtttgtataaatacgtgttctgtcccgagacgaccgacgatgaaaagaaggatctggctatccagaagaggattcgcgcgctcaggtgggtgacgccacagatgctgtgtgtgcccgtgaacgaggatataccagaggtgtctgatatggtggtaaaagctataaccgatatcattgaaatggactccaagagggtgccacgtgacaaacttgcgtgcatcacaaaatgcagcaaacacatctttaatgccatcaagatcacaaaaaacgagccagcttccgctgacgattttctgcctacgctgatctatatcgtgctcaaaggaaatccccctcgccttcagagcaatatacagtatatcacacgcttctgtaatccctctagacttatgacaggagaggatgggtattattttactaatttgtgttgcgcggtcgctttcatcgagaaactggacgcccagtccctgaacctctcccaagaggactttgacaggtatatgagtggccagacttccccgaggaaacaggaggcagagagctggagtcccgatgcatgccttggggtcaaacagatgtacaaaaatctggacctgctgtcacagctgaatgagagacaagagaggattatgaacgaagctaaaaaactggagaaagatctcatagactggactgatggtatcgcccgcgaggtgcaggacatcgtggagaaataccctctggagatcaagcccccaaatcaaccacttgctgctattgacagcgaaaatgttgagaatgataagcttcccccccctctccagcctcaggtctacgctggatag

SEQ ID NO: 129362 - DNA, 1476 bp, Artificial Sequence
  Description of Artificial Sequence: Synthetic coding sequence
atgagtctaaaatcagagcgccgcggcattcacgttgaccagtctgatctgctctgtaagaaggggtgtggctattacgggaacccggcttggcagggcttctgttcaaagtgttggcgagaagagtaccataaggcaaggcagaagcagattcaggaagactgggaacttgcagagaggctacagcgcgaggaagaggaagccttcgcatccagtcagtcaagccagggggcacagtctcttacattctccaaatttgaagagaagaagacgaacgagaaaactcggaaagtcacgactgttaaaaaattcttcagcgcctctagtcgagtgggcagcaagaaagaaatccaagaagcaaaagccccttcacctagcattaacagacagacctctatcgaaaccgacagggtaagtaaggagtttattgaatttctgaaaactttccataagaccggccaagaaatctataaacaaaccaaactctttctggaaggcatgcactacaagagagacttgtccatagaggagcagtccgagtgcgcccaggacttttatcataacgttgccgagcggatgcaaacacggggaaaggtcccaccagagagagtcgagaaaataatggatcagatcgagaagtatattatgactcgactctacaagtatgttttctgtccagagacaacggatgatgagaaaaaggacctcgccatacagaagcgaatcagagctctgcgatgggtgaccccccagatgctgtgtgtgcccgttaacgaagacatacccgaggtctctgacatggtggttaaggctataaccgatatcatcgagatggactcaaaaagggtgcctagggacaaattggcttgtataactaaatgctccaagcacattttcaatgcaattaaaatcaccaaaaacgaacctgccagtgccgacgacttcctgcccactctgatatatattgtcctcaaaggaaatcctccgcgtcttcagagtaacattcagtacattactaggttttgcaacccatcccgattaatgacaggggaagatggctactacttcacaaacctttgttgcgccgtggccttcattgagaagctggacgcccagtctctaaatctgagccaagaggatttcgatagatatatgtccgggcagacatcccccagaaagcaggaggccgagtcctggagccctgatgcttgtttaggtgtgaagcaaatgtataagaatcttgaccttttaagtcagttaaatgagcgccaagaaagaatcatgaatgaggctaagaagctggaaaaagacctgattgactggacagatggtattgccagggaggtgcaggacatcgtggaaaaatacccacttgagattaagccacccaatcagccactagcagccatcgattctgagaacgtggagaacgacaaactgcctcccccgttgcaacctcaggtatatgcaggatag

SEQ ID NO: 129363 - DNA, 1224 bp, Artificial Sequence
  Description of Artificial Sequence: Synthetic coding sequence
atgtcgctaaaatcggaacggagggggatacacgttgaccagtctgacctcctctgtaagaaagggtgtggttactatggaaaccctgcttggcagggattttgcagtaaatgctggagagaggagtatcataaagctcgccagaaacagatccaggaagattgggaattggccgaaaggctgcagagagaagaagaagaggcgttcgcttccagtcagtcaagccagggtgcgcagtctctgacattctccaaatttgaggagaaaaagactaatgagaagacaagaaaggtgacaacggtgaaaaaatttttctccgcatccagtagagtaggctcaaagaagcctccggagagggttgaaaaaattatggaccagatcgagaagtacattatgactcgactatacaaatacgtgttttgtcctgaaaccactgacgacgaaaagaaagacctggccatacagaagcgcatccgggctcttagatgggtcacgccacagatgctttgcgtgccagtcaacgaagatatccccgaggtcagtgatatggtggtgaaggccattaccgacattattgagatggattccaaacgggtacctagagacaagttagcgtgtatcacaaagtgcagcaagcacatcttcaacgctatcaagataacaaagaacgagcctgccagcgcagatgattttctcccgaccttgatctatatcgtattgaagggaaacccccccaggcttcaaagtaacattcagtatatcacgagattttgcaacccatctcgtctaatgacgggtgaggatggttactacttcaccaatttatgctgtgccgtggcttttatcgagaaactagacgcccaatctctgaatctaagccaggaagattttgaccgctatatgagcgggcagacgagccctcgcaaacaggaggcagagtcctggtctcctgatgcctgtcttggcgtgaaacagatgtacaagaatttggatctgctcagccagctcaatgaaagacaggagaggatcatgaacgaggctaaaaagctcgaaaaggacctgattgattggaccgatggcatcgccagggaggtccaggacattgtggagaagtaccctttggagattaagccgccaaaccaacccctagccgcgattgattctgagaatgtcgagaacgacaagctgccccctccccttcaaccacaagtgtacgcagggtag

SEQ ID NO: 129364 - DNA, 867 bp, Artificial Sequence
  Description of Artificial Sequence: Synthetic coding sequence
atggtcgtggttaccgggcgcgaacctgactctaggcgccaagacggcgcgatgtcatcctctgatgctgaagacgattttctggagcccgccactccaacagcgactcaggccggacacgccctgccccttctgccccaggagtttcctgaggtggtccctttaaatatcggcggggcccacttcaccacgaggctttccacgttgaggtgttacgaagatacaatgctggccgccatgtttagtggtaggcactacattcctactgactctgaaggacggtacttcatagatcgcgacggaactcacttcggcgatgtgctgaatttcctccggtctggtgacctgcccccccgagagagggtgagagcggtgtataaagaggctcagtactacgccattggacctctgctggagcagctcgagaacatgcagcctttaaagggggagaaggtgcggcaggcattcctgggtctcatgccctactacaaggatcacctggagagaatagttgaaattgcacgtctgcgggccgttcagcgtaaagctagattcgcaaagctcaaggtgtgcgtgtttaaagaagaaatgcccatcacaccctacgaatgtcctctgctaaactcccttcggtttgaacgttcagaaagcgacggacagctttttgagcaccattgtgaagtggacgttagttttgggccatgggaggctgtggctgatgtgtatgacctcctgcattgcctagtaacggacctgagcgctcagggtctgaccgtggatcatcagtgtataggcgtgtgcgataaacacttagtgaatcattattactgtaagcgacctatctatgagttcaagatcacctggtag

SEQ ID NO: 129365 - DNA, 663 bp, Artificial Sequence
  Description of Artificial Sequence: Synthetic coding sequence
atgaaaggctacggtcatacagtgcctctctcagatggcgggaaagctttttgtattatctactccgttatcggcatcccattcacacttctgttcttgactgctgtggtccaacggatcaccgtccatgtgacgaggcggcctgtactgtatttccacattcgctggggattttcaaagcaagtcgtcgctatagtgcatgccgtcttgctgggctttgttaccgtctcatgcttctttttcatccccgcggccgtcttctccgtgttagaagatgactggaactttctggagagtttctacttttgtttcatttctttatctaccattggcttgggtgactacgtccctggtgaaggttataatcagaagtttcgggaactgtacaaaatcgggatcacctgttacctgctcctgggattgatcgcaatgcttgtggttttggaaaccttttgcgagctgcacgagctgaaaaaatttcgcaagatgttctatgtcaaaaaggacaaggatgaagaccaggtccacataatagagcacgaccagttgtccttttctagcatcactgaccaagcagcgggtatgaaggaggatcagaagcagaatgagccatttgtggccactcaaagctctgcctgcgtagacgggccagccaaccactag

SEQ ID NO: 129366 - DNA, 1011 bp, Artificial Sequence
  Description of Artificial Sequence: Synthetic coding sequence
atgctccaatcactggctggctcctcttgcgtcaggctggttgagcggcatagaagcgcgtggtgttttggtttcttggtgcttgggtacctgctatacctcgtgttcggcgcagtggtgttctccagtgtggaactcccctatgaagacctgttgcgtcaagagttacgcaaacttaagaggcggtttctcgaagagcacgagtgtctttccgaacagcagctcgagcagtttctggggagggtgcttgaagcatctaactacggagtctccgtcctgagcaatgcctccggaaactggaattgggatttcacatctgccttgttcttcgccagcaccgtgctgtcaactaccggatatggacatacagtccccctaagcgatgggggtaaggctttttgcattatttactcggtgatcggcatcccgttcaccctgctgttcttgacagccgtcgttcaaaggataaccgtgcacgtcactaggagacccgtcttgtacttccacatcaggtggggatttagcaagcaggtagtcgcgatcgttcacgctgtactcttgggctttgtcactgtgagctgcttttttttcatccccgccgccgtgttcagtgtcttggaagatgattggaactttctggaaagcttttatttctgcttcatcagcctttcaaccatcggtttgggtgattatgtacccggcgaggggtacaatcagaaattccgcgaactatacaagatagggataacctgctaccttctgctcggcctgatagctatgctcgtagtattggagacgttctgcgagctgcacgaattgaaaaaattcagaaagatgttttatgtcaagaaggacaaggacgaggaccaggtgcatataattgaacatgaccaactcagcttctctagcataacagaccaagcggctggaatgaaggaagaccagaagcagaatgagccgttcgtggccacccagtctagtgcctgcgtggacggtccagcaaaccactag

SEQ ID NO: 129367 - DNA, 729 bp, Artificial Sequence
  Description of Artificial Sequence: Synthetic coding sequence
gtgctgagagtgttaagtcctgacctggtgagacgccttctcaaccttgcggtcagagccttccaagtccccaagggcgagagtcttaattttcctgaaagcactccaggctacggccacactgtgcctttgagtgacggaggaaaggctttttgtatcatctactccgtgattggaattccttttacactgttatttctcacagctgtcgtccaaagaatcaccgtccatgtcaccagaaggcctgtgttatactttcatatcagatggggcttcagtaagcaggttgtggcaatcgtccacgcagtcctgctaggatttgtgaccgtttcatgtttcttttttattccagccgcagtattctccgtgctcgaagatgactggaacttcctggagtccttctacttctgcttcattagtctttctacaatcgggctgggcgactatgttcctggtgaagggtataaccagaaatttagggaattgtataaaattgggattacttgttacctgcttctaggattgatagccatgctggtggttctcgagacgttctgcgagctgcacgaactgaaaaagtttcggaagatgttctacgtcaaaaaagacaaagacgaggatcaagtgcacataatcgagcacgatcagctgtctttctcgtcaatcacggaccaagccgccggaatgaaggaggaccagaagcagaatgagccttttgttgcaacgtag

SEQ ID NO: 129368 - DNA, 1632 bp, Artificial Sequence
  Description of Artificial Sequence: Synthetic coding sequence
atggaggatggctttaagggcgaccgaactgaaggctgccgtagcgattctgtggccgtgccagccgctgctcccgtctgtcaacctaaaagcgccacaaacggacagcctcctgccccagcgcccaccccgactccacgacttagcattagttcgcgggctaccgtagtggctcgtatggagggtacatcacagggggggctccagaccgtgatgaaatggaaaacagtggtggctatcttcgtcgttgttgtggtctacttagtgactggcggcttagtttttagagccctagagcagcccttcgaatcttctcagaagaatacaattgccttagaaaaagcagaatttctcagagaccatgtgtgcgtaagcccacaggagctggaaaccttgattcagcacgccctagacgccgacaacgccggcgtttcacctattggcaactctagcaacaattcttcccactgggacctgggcagcgctttcttttttgctggaactgttatcaccaccatcggttacggcaatatcgccccgtcaacagaaggtggaaaaattttctgtattctctatgccatcttcggcatccctcttttcggatttctcctcgctggcataggggatcaactcggaactatttttgggaagtctattgcccgcgttgagaaggtgttccgcaagaagcaggtatcgcagacgaaaattagggtcataagcaccatattattcatcttggccggatgtatcgtattcgttaccattccagccgtcatcttcaagtacatcgaagggtggacagcattggagtctatttacttcgtggtggtgacactgaccaccgtggggttcggtgacttcgtggccgggggtaacgcaggtatcaattacagagagtggtataagccactggtgtggttctggattttggtcgggcttgcctactttgccgccgtgctcagtatgatcggcgactggttgagggttctgagtaagaaaactaaggaggaggtcggagagataaaagcccacgcagcagagtggaaggccaacgtaacggcagaatttagagaaacaaggcgcagactcagcgtagagattcacgataaattgcagagagcagctacaattcggtccatggagcggcggcgcctcggactggaccagcgagcccatagcttagacatgctttcgcctgagaagagatcagtgtttgccgctctcgacacgggtagatttaaagcaagctcacaggaatctattaataacagaccaaataacctgagactgaagggcccggagcaacttaacaagcatggacaaggagcaagcgaagataatataatcaacaagtttggcagcacttctagacttactaaaaggaaaaataaagacctcaagaagaccctgccagaggatgtgcagaagatctataaaacgttcaggaattacagccttgacgaggagaaaaaagaggaggagacagaaaaaatgtgcaattccgacaactctagcacagcaatgctcactgattgcattcagcagcacgccgagcttgagaatgggatgatcccaacggatacaaaggacagggagccagaaaataactccttgttggaggaccggaattag

SEQ ID NO: 129369 - DNA, 1632 bp, Artificial Sequence
  Description of Artificial Sequence: Synthetic coding sequence
atgaagtttcctatcgagacaccccgaaaacaggtaaactgggatcccaaggttgctgtccccgcagccgcacctgtgtgccagccaaagagcgcaactaacggacagcctcctgccccggctcccacaccaacccctagactatctatctcctctcgggccactgtcgtagcaagaatggagggcactagtcagggcggcttacagaccgtcatgaagtggaagaccgtggtggcaatttttgtagttgtcgttgtgtacttggtaaccgggggtttggtctttcgagctttagagcaaccgtttgagtcttcccaaaagaataccatcgcattggagaaggccgaattccttagagatcatgtgtgcgttagtccccaggagctggagactctgatccagcacgcattagatgccgacaatgcaggcgttagcccaatcgggaattctagcaacaatagttcccattgggatctgggctctgccttcttcttcgccgggactgtcataacaactatcgggtacggcaatatcgcaccaagtacagagggcggcaagattttttgtatcttatacgccatattcgggatcccactgtttggatttctgctagctggtattggcgatcaactgggcactatatttgggaaaagcatcgctagggtcgaaaaggtgttcaggaaaaagcaggtaagccagaccaagatccgagtgattagcactatactgttcatcttagccggttgcattgtcttcgtcactatccccgccgtgatcttcaagtatattgagggctggaccgctctggagtccatctatttcgtggtggtgactcttacaacagtgggatttggtgactttgtggccggtggcaacgcgggaatcaattacagggagtggtataaacctctggtttggttctggatcctcgtgggactggcctattttgctgccgtcttatctatgataggggattggctccgggtgctgagtaagaagactaaggaggaggttggggagattaaggcccacgcagcggaatggaaggccaacgtaacagccgagttcagagagacacgccgtcggctgtccgttgaaatccatgataaacttcagcgagccgccactatccggagtatggaacgtcggcgcctaggccttgaccagcgggctcactccctggatatgctctctcccgaaaaaaggtcggttttcgccgcgctggataccggaagattcaaggcgtcgtcccaggagtccatcaataaccgccctaataatctgcgcctgaaaggccccgagcagctcaacaaacatggacagggtgcctcagaggacaatattattaacaaatttgggtcaacgtccagactgactaagcgtaaaaacaaggacctgaaaaagacgctccccgaagacgtccagaaaatctacaagacgtttcgcaactattcacttgacgaagagaaaaaagaagaagagacagaaaaaatgtgcaattctgacaattcttcaaccgctatgttgactgactgtattcagcagcacgctgaactggaaaatggcatgataccaactgataccaaggacagagagccagaaaataacagcctactcgaggatagaaattag

SEQ ID NO: 129370 - DNA, 1617 bp, Artificial Sequence
  Description of Artificial Sequence: Synthetic coding sequence
atgtttttcctgtatactgatttttttttgtcccttgtggccgttcctgcagcagccccggtatgccagccaaaatcagccactaatgggcagcctcccgctcccgcccctaccccaaccccccgcttgtctatttctagcagggcgacggtggttgccagaatggaaggaaccagccaagggggtctgcagactgtgatgaagtggaagactgtggtagccatttttgtggtcgtggtggtgtatctggtcacgggaggccttgtgttccgtgccctcgaacagccgttcgaatcctcccaaaaaaacaccatagctctagagaaggcagaattcctgagagatcatgtctgtgtttccccacaggaattggagacactgattcagcacgcactggacgccgataatgctggggtcagtcccattggcaacagttccaacaatagttcacactgggacctggggtccgccttcttctttgcggggacagtgatcacaaccatcggttatggaaatatcgccccgtctaccgagggaggcaagattttctgtattctatacgccatatttggtattcccctgtttgggttcctcctggcgggcattggggatcagctaggcacgatcttcggcaagtctatcgcacgagttgagaaggtgtttagaaaaaagcaggtgagccagaccaagattcgcgtgatctccaccattctgtttatcctggcaggctgcatcgtattcgtgactattcccgccgtgatctttaaatatattgaaggctggacagcgctcgagtcaatctacttcgtcgttgtgaccctaaccaccgtgggctttggggacttcgtagcggggggcaatgcaggcatcaattatagggagtggtacaaaccactcgtttggttttggattctagtagggctggcatacttcgcagccgtactatctatgatcggcgactggttgagagtcctgtccaaaaaaacaaaggaggaagttggtgagataaaggcccacgccgccgaatggaaagctaatgttactgctgagtttagagagacacggaggcgcctctcagtcgaaatccacgacaaactgcagcgcgctgccacaatcaggtcaatggaacgcagaaggctggggcttgatcagcgggctcactcgctggacatgttgtctccggagaagcggtcagttttcgcagctctggacaccgggaggttcaaagcttccagtcaagagtcgataaacaataggccgaataacctgcgcctgaagggtccagaacagctgaataaacacggccagggggcatctgaggataatatcataaataaatttgggagcacgagtcgcctcacgaaacggaagaacaaggatttgaagaagacactgcccgaggacgtgcagaagatttacaagaccttccggaattactctctcgatgaagaaaagaaggaagaggagacagagaaaatgtgtaactccgataacagttccaccgccatgttgaccgactgcatccagcagcatgctgagcttgaaaatggcatgatcccaactgatactaaggaccgtgaacccgagaataattcactgctggaggataggaactag

SEQ ID NO: 129371 - DNA, 1293 bp, Artificial Sequence
  Description of Artificial Sequence: Synthetic coding sequence
atgtcttcgaggtccccaagacctccccctagacgctccaggaggaggctgccacggccgagttgctgctgttgctgttgtcgccgcagccacctaaacgaagatacagggcgttttgtgctgctggccgccttgatcggcctgtatctggtcgccggagctacagtattttcagctctcgaatctcccggcgaagccgaggccagagcacgctggggagcaaccctcagaaatttcagcgccgcgcacggcgttgccgaacccgagttgcgcgcattcctccgtcattacgaggccgctctcgctgccggcgtgcgtgcagatgccctgaggccccggtgggattttcctggtgccttttacttcgtcggcacggttgtctcaaccatagggtttggtatgacaactcccgcaaccgtcggtggaaaggctttcctcatcgcctacggtctatttggctgcgccggcaccatcctttttttcaacctgtttttggaacgcataatatccctactcgcatttattatgagggcttgtagagagcggcagctcaggaggtcaggcctattgcctgcaaccttccgccggggcagcgcgctgtccgaggcagactccctggcgggctggaagccctccgtttaccatgtgctcctcattcttggtttatttgcggtgctgctttcttgctgcgcctcagctatgtatacaagcgtagagggctgggattatgtggactctttatatttttgcttcgtgactttctccaccatcggcttcggggatcttgtctcttcccagcacgccgcatacagaaaccaggggttatatcggctgggcaactttctattcattctgctgggggtttgctgcatttattccctgtttaacgttatctcaatacttataaagcaggtgctgaactggatgctccggaaattaagttgtcgctgctgcgcgcgatgctgtccagcgcccggggcccctctcgccagaaggaatgccattacacctggctcacgtctccggcgtaggctcgcagcactgggcgctgatccagctgccagagattccgacgccgaagggcggcgactgtctggagagttaattagtatgagggacctgactgcgtccaacaaagttagcctcgcactgctgcagaaacagctgtccgagacggccaatggctacccaagatccgtatgcgtgaacacacgtcaaaacggttttagcggcggtgtcggagctctgggaatcatgaacaataggctagctgagacaagcgccagtagatag

SEQ ID NO: 129372 - DNA, 1227 bp, Artificial Sequence
  Description of Artificial Sequence: Synthetic coding sequence
atggccgggcgaggcttctcatgggggccaggacatttgaatgaagataatgcacgcttcctgctgctcgcggcactgatagtcctgtatcttcttggaggcgccgcggtgttttcagccctcgaactagcgcacgaaagacaggcaaagcaaaggtgggaggagcggctcgccaatttcagtcgaggacataatctcagccgggatgagcttaggggcttcctgaggcactacgaggaggctacaagagcaggtatccgcgtagacaatgtgcgaccccggtgggactttacaggggctttttactttgtgggtacagtggtttccacaataggctttggcatgactacgccagctacggtgggtgggaagatctttctaatcttttacggacttgtgggttgcagctcaactattctgttttttaatctgtttctagaaaggctgatcacaattatcgcctacattatgaagagttgtcaccagagacagctccgtcgtagaggagccctccctcaggaatccctaaaagacgctggtcagtgcgaagtggactcactcgcgggctggaagccttcagtgtactacgtgatgctcatactatgcacagcatctatattaattagttgctgtgcctcagcaatgtatacccctatagaaggttggagttactttgactcgttatacttttgtttcgttgcttttagtactattgggtttggagacctagtgtcttctcagaatgcgcactacgaaagccaagggctatacaggttcgccaacttcgtgttcatcctgatgggcgtgtgctgtatctattccctatttaacgtaatttccattctcattaagcaatcattaaattggattctgaggaaaatggattctggatgctgtcctcagtgtcagaggggtttgctgaggagcagacggaacgtggtgatgccaggcagcgtgcgtaacagatgcaacatctccatcgaaaccgatggtgtcgctgagagtgacacagatggccggcggctgtcaggcgaaatgatcagtatgaaagacctactggctgcgaataaagcatcattagccatactgcagaaacaattgtccgaaatggccaacggctgccctcaccagacttccaccctggcccgtgacaatgaatttagtggaggcgttggtgccttcgcaatcatgaacaatcgactggcggaaaccagcggcgacaggtag

SEQ ID NO: 129373 - DNA, 993 bp, Artificial Sequence
  Description of Artificial Sequence: Synthetic coding sequence
atgcgacggccctcggttcgcgccgccggcctggtactttgcacactgtgttacctgctggtgggagctgcagtctttgacgctctcgagtccgaggcggaatccgggcggcagcgccttctcgtgcagaagcgaggcgctttgaggcggaaattcggattttccgccgaagattaccgcgagctggaacgtctggccctgcaggccgaaccgcatagggcagggaggcaatggaagtttcctggcagcttttactttgcaatcactgtcattaccacaatcgagtacggacatgcagcccccggtacagacagtggcaaggtattctgtatgttctatgcgctgctgggcatccctttgactcttgtgacttttcagtctctaggggagagactcaacgcagtggttcgccgtctgcttcttgccgcaaagtgttgtcttgggctacgatggacatgcgtttccacagaaaatcttgtcgtggcagggcttctcgcctgtgcggccaccctagccctcggggcagtggctttctcccattttgaagggtggaccttttttcatgcatactactactgcttcattacgctcaccaccatcggctttggagactttgtggctctacagagcggggaagcattgcaacggaaactaccatacgtggcattctccttcctgtatatcctcctgggcctgaccgttatcggcgctttcctgaatctggtggtgctgcgttttttggtggctagcgcagattggcctgagagagcagcacgcacacctagccctaggcctcccggagccccagagtcaaggggcttgtggctgccccgtaggccagctcgcagcgtcggctcggcaagtgtattctgccacgttcataaattggaaagatgcgccagggacaacctgggtttttcccctccaagtagcccaggggtcgtacgcggcggacaggccccccggttaggggctcgatggaagagcatatag

SEQ ID NO: 129374 - DNA, 789 bp, Artificial Sequence
  Description of Artificial Sequence: Synthetic coding sequence
atgccatcggccggactgtgcagttgttggggcgggcgtgttctccccctcctgctggcctacgtctgttacctcctcctgggtgcaactatcttccagctcttagagcgccaggccgaggcccagagccgcgaccagtttcaattggaaaaactacggttcctggagaactacacttgtttagaccagtgggcgatggaacagtttgtacaggtaattatggaggcctgggtgaagggggtcaatccaaaagggaattctactaatccctcgaactgggattttggttcaagtttcttttttgcaggtaccgtggtaaccacaatcgggtacggtaacctggctccctctactgaagccggccaggttttttgtgtgttctacgcacttcttggaatacccctgaatgtcatattcctcaatcacctcggaacaggactccgggcccacctagcggcaattgaacgatgggaggaccggccacgtaggagtcaggtcctccaggtgctgggcctggcccttttcctgaccttaggtaccctggttatcttgatcttcccaccaatggtcttttcacatgttgaagggtggtcattcagcgagggattctattttgccttcattactttgagcacaatcggcttcggagactacgtggtgggtctgaggcaggggtgcggcgccaaagccgcccctggccgtcggccacgcaggggcagcactgcagcacgaggggtccaggtcaccccccaggactttcccatctcgaagaagggtctgggatcatag

SEQ ID NO: 129375 - DNA, 930 bp, Artificial Sequence
  Description of Artificial Sequence: Synthetic coding sequence
atgcctagcgccggattatgtagctgttggggcggcagggtacttcccctgctccttgcttacgtatgttacctgctgttgggcgccaccatctttcagctgctcgaacgccaggccgaggcccagtctcgagatcagtttcagctagagaaactgaggttcctggagaattacacatgcctggaccagtgggctatggagcagttcgtacaagttatcatggaagcttgggtaaaaggggttaatccaaaaggcaacagtaccaacccatctaattgggatttcggatccagtttcttcttcgccggaacagtggtcactactattggttacggaaacttagcacccagcaccgaggcaggacaggtgttttgcgtgttctatgccctactagggatacccctgaacgtcatttttctgaatcatttgggtacaggtcttcgggcacatctggccgcaatcgagagatgggaagatagaccccgtcggtctcaggtcctccaagtgctgggactggctctttttcttacactcggcacgttagtgatcctgatttttccaccaatggtattctcccatgtggaggggtggtcttttagcgagggcttttacttcgctttcattacgctgtccactattggcttcggtgactacgtggttgggacggatccgtccaagcactacatcagcgtgtaccgttcactcgccgccatatggattctgttgggcctggcatggctggctttgatcttgccactcggccctctgctccttcatcggtgctgtcagctttggctgctttctctgaggcagggatgtggggctaaggcagcacctggacggaggccacgaagggggagtacagccgccaggggggtgcaggtgacaccacaagactttccaatctcgaaaaagggtctggggagctag

SEQ ID NO: 129376 - DNA, 969 bp, Artificial Sequence
  Description of Artificial Sequence: Synthetic coding sequence
atgccctccgctggcttatgctcatgctgggggggcagggtgctaccactcctcctagcttacgtatgctaccttctccttggtgcaaccatatttcaactcctggagcgacaggctgaggcacaatcacgcgatcagtttcagctggagaaattacggttcttggagaactatacctgtttggaccaatgggctatggagcaattcgtgcaggttatcatggaagcctgggtcaaaggggtgaaccccaaggggaactccacaaacccatcaaactgggactttggaagctcctttttctttgcgggtactgtcgtgactactatcggctacggaaacttggcccccagcacggaggctggacaggtattctgtgtattttacgccttgctgggaattcctctgaacgtcatattcctgaatcacctgggtaccgggttacgagcccacctcgctgctatcgagcgttgggaggatcggcctaggaggagtcaggtcctacaggtgctgggcctcgccctgttccttacccttggaacactagttatactaatcttcccacccatggtttttagccacgtagaaggttggagtttctcagagggtttctattttgcttttatcaccctgagtacgattggatttggcgactacgttgtgggacaccctctgaactttattactccaagcggcctcctgccctcacaggagccgtttcagacacctcacggaaagcctgaatcccaacagattcccggtagcttccagaaggttagctcgatgaacgtttggcctctgtccggcatgcatagtcctggcctcgcgttcccattgccggactgtaacatcccagatcaggagaggttccgccccctccatcccggtgcatggaagttttggccgctgccacttccaagctcaaattcaaagtgggctcctatgtggctcgggtcatccgcccaggtctag

SEQ ID NO: 129377 - DNA, 885 bp, Artificial Sequence
  Description of Artificial Sequence: Synthetic coding sequence
atgccttcagccggtctttgctcctgctggggaggccgggtcttgcctctgctgctggcttacgtgtgttacttgttgttgggtgcaacgattttccagctgctggagcgacaggccgaagcacagtcccgggatcagtttcaactggagaagctccggtttttggaaaactatacttgcctcgaccagtgggcaatggagcagtttgtgcaagtaataatggaggcctgggtgaagggagtgaatccaaaaggaaattctaccaacccaagcaattgggattttggaagctcctttttctttgccggaactgttgtgacgactatcggttatggaaatttagcaccatcaactgaggcaggccaggttttctgtgttttttatgccctgctggggataccactgaacgtcatattcttaaaccatttaggcacaggcctgcgcgcccacctggctgccatcgaacgctgggaagatcgccccagaaggtcacaggtacttcaagtcctcgggctggcgctctttctcaccctggggaccctcgtaattctcatctttccccctatggtgttctcacacgtggaggggtggagtttctctgaggggttctactttgctttcattaccctcagcactatcgggtttggggattacgtggtgggcactgaccctagtaaacactatatttcggtgtacaggtctctagcagctatttggatcttattgggattggcatggttggcgttaatcctccccctgggccctttactcctgcaccggtgctgccagctgtggctcctctcgagaggccttggagttaaggatggcgcggcttcagacccgagcggcctgccccggccacagaaaattcccatctccgcatag

SEQ ID NO: 129378 - DNA, 594 bp, Artificial Sequence
  Description of Artificial Sequence: Synthetic coding sequence
atggaacagttcgttcaagtgattatggaggcctgggttaagggggtaaacccaaagggaaacagtacaaatccttccaactgggattttggcagctccttttttttcgctggtacagtcgtgactaccatcggctatggcaacttagcgccctcaactgaggccggccaggtgttttgcgtgttttacgcactgctgggcataccactcaatgttattttcctgaaccacctagggactggcctgcgggcacaccttgccgccatcgaacgttgggaggacagaccgagacgctcacaggtcctgcaggtcctcggcctggcactgtttctgactttgggcactctggttattctcattttcccccccatggtgttcagccacgtggagggctggtcctttagcgagggcttctatttcgccttcatcacgctgtccacaatcggattcggagattacgtggtgggtctgagacagggctgtggtgccaaggccgcccctgggcgcagacccagaaggggatccactgccgctcgcggggtgcaggtgacccctcaagattttcctatctccaagaaagggttgggatcctag

SEQ ID NO: 129379 - DNA, 999 bp, Artificial Sequence
  Description of Artificial Sequence: Synthetic coding sequence
atgtaccgccctcgagccagagctgccccggagggcagggtgcgtggctgtgctgtgccgtccacggtcctgttgctgctcgcgtacctggcctatttagccctggggacaggagttttctggaccctcgaagggagagccgcccaggatagtagccgatcttttcagagagacaagtgggagttgctacaaaatttcacctgcctcgaccgtccagcgctggattccttgatacgggacgtggtccaagcttacaaaaacggagcttccctactatccaataccacaagcatggggcgctgggaactagtgggaagtttcttcttttccgtaagtacaatcactaccatcgggtatggcaaccttagccccaacaccatggccgctcgtctcttttgtatttttttcgctctggtgggaattccccttaatctggtggtgttaaacagactcggccacctcatgcagcagggggtgaaccattgggcttctaggctgggtggcacctggcaggatcccgataaggctcgatggttggccggctccggggccctgctcagcggattgttgttgttcctcctccttcctcccctactcttttcccacatggagggctggtcctatactgagggtttttattttgcattcatcaccctcagcacggtcggattcggcgattatgttatcgggatgaatccgagccaacgatacccgctgtggtataagaacatggtctccctgtggattctctttggcatggcctggttagcactaatcattaaattaatcctgagccaactggagacgcctggtcgcgtgtgttcttgctgtcatcacagctctaaggaggattttaaatcccagagctggagacagggccccgatcgagaaccagagtcccactcccctcaacaggggtgttaccctgaagggccaatggggatcattcagcaccttgagccctccgcccatgctgctggctgcgggaaagacagttag

SEQ ID NO: 129380 - DNA, 816 bp, Artificial Sequence
  Description of Artificial Sequence: Synthetic coding sequence
atgtaccgccctagggcgcgggcagccccagaaggccgggtacggggctgcgccgtgccctccactgttttgctgctgctggcataccttgcttatcttgccctgggcaccggagtgttctggaccttggaaggcagagccgcccaagactcttccaggagctttcagcgggacaagtgggaactcttgcagaacttcacgtgtctggatagacccgctttagacagcttgatccgcgacgtggtgcaggcctacaaaaatggtgcgagcctgctatctaacaccacatcaatgggtcgttgggagctggtgggttcgttcttcttctcagtatctacgatcaccactatcggatacggaaacctctccccaaatactatggcagccaggctgttctgcatttttttcgcccttgttggcatccccctcaatttggtggtccttaatcgcctcggccatctgatgcagcagggcgttaaccactgggcctcaaggctgggcggcacttggcaggaccctgataaagctcggtggctcgcaggctccggagcccttctgtccggccttctcctgttcttgctgctgcctcctctgttgtttagccatatggaggggtggagctacactgaaggcttttactttgcattcatcaccctgtcgaccgtggggttcggagattatgtcattgcctcatgtctgattagtgacactagaaagccaaaccgcgattggcagacactagaaagaacatctaaatctagcggcggattgctgaagtatagatttttggctggtcatggtggctctcacctgtag

SEQ ID NO: 129381 - DNA, 1155 bp, Artificial Sequence
  Description of Artificial Sequence: Synthetic coding sequence
atggaggtcagtggacacccacaagcccgcaggtgttgcccggaagccctcggcaagttatttccaggactctgtttcctgtgctttctcgtcacttatgcactggtcggcgcagttgtcttttccgccatagaagatggccaggttctcgttgctgcagacgacggagagtttgagaagttcctggaggaactgtgccggatcctcaattgttctgagactgtcgtcgaggatagaaagcaggatctccaggggcacctccagaaggtgaaaccacagtggtttaatcggacgactcactggtccttccttagcagcctgtttttctgttgcaccgtgttttctaccgtggggtatgggtatatataccctgtgaccaggctgggaaaatacctgtgcatgctgtatgctctttttggaattcctctcatgtttttagtgttgacggacactggagacatcctggccacgatcctctccacttcctacaaccggtttcggaaatttcccttttttacacgccccctcctgtcaaagtggtgtccaaaatccctttttaaaaagaagcctgatccaaagccagctgatgaagccgttcctcagatcatcatttccgccgaagaactccctggaccaaagttgggaacttgcccctcccggccaagctgttccatggagctgtttgagcggagtcatgctttagagaagcagaatacactgcagctgcctccgcaagctatggaacgctcaaacagttgcccagagctggttctgggacgcttgtcttatagcatcattagtaacctcgacgaagtgggccagcaagtggaaagattggatatcccgctgccaattattgcacttatcgtgttcgcctacatctcctgcgccgcagccattctgcctttctgggaaacgcaactcgattttgaaaacgctttttatttctgcttcgtaaccttaactacaattggctttggggacactgtgttggaacatccaaatttcttcttgttcttttccatctacatcattgtggggatggagatcgtctttatcgccttcaagctggtccagaacaggcttattgacatttataagaacgtgatgctattcttcgcaaaggggaagttctaccacctcgtcaaaaagtag

SEQ ID NO: 129382 - DNA, 459 bp, Artificial Sequence
  Description of Artificial Sequence: Synthetic coding sequence
atgatgaacccccgggcaaaacgtgacttttacctggcagcccccgacctgctcgatcctaaaagcgccgctcaaaatagcaaacctcggctcagcttctctacaaagcctaccgtgttggcctcaagagtggagtccgataccacaattaatgtgatgaagtggaagactgtaagtacaatcttcttagtagtagttctgtatcttattattggagcgaccgtgtttaaggctctggagcagccgcacgaaatttcgcagagaacaactatagtaatccaaaagcagacattcattagtcaacattcatgtgttaatagcacagagctggacgaactaatccaggacctcgagacgagtcaccacgcacagaaagcagctaaatactcagtgtcctcaatgccctactgggaatttccttctctggttttcagttggttggaactcgagatcagttag

SEQ ID NO: 129383 - DNA, 1236 bp, Artificial Sequence
  Description of Artificial Sequence: Synthetic coding sequence
atggcagcgcctgatcttctagatccaaaatctgccgcccagaatagcaagcctaggctctcatttagcacaaagcctaccgtgctggcgtccagagtggagagtgacaccactattaacgtcatgaagtggaaaacagtgtctacaatattcctggtggtggtgttgtacctaattatcggcgcaacagtcttcaaggccctcgagcaacctcatgagataagccagagaaccacgatagtaatacagaagcagacctttatctctcaacacagctgtgtcaacagtacggagctcgatgagttaattcagcagatagtggctgctattaatgctggaatcatcccgctaggcaacacctctaatcagatatcccattgggatttaggcagctcattctttttcgccggcaccgtcataactactattggtttcggtaatatcagccctagaaccgagggcgggaaaatattctgcattatctacgcactgctcggaatacccctgtttggcttcctcctcgcgggggttggagaccagttggggacgatctttggaaaaggcattgccaaggttgaggacacctttatcaagtggaacgtgtctcagactaaaatcagaatcatttcaactattatctttatcctgttcggctgtgtcttgtttgtggcgctccctgccatcatctttaagcacattgagggatggtcagcactcgacgcaatttacttcgtggtgattacactgacaacgataggctttggggactacgtcgcaggtgggtccgacatcgaatatttggacttctataagcccgtggtctggttttggatactggtgggtctcgcctatttcgccgccgttctgtccatgattggcgattggctgcgtgttatttctaagaagacaaaagaggaggtaggggagtttcgggcacatgcagcagagtggacggcgaacgtgactgctgagttcaaggaaacaaggcgccggctttctgtggaaatttacgacaagttccaacgagctacctctataaaaaggaagctgtccgccgagctggctggaaatcacaatcaggagctgacaccgtgcagaaggactttgtcagttaatcacttaacatctgaacgggacgttctccctcctttgctgaagacagagagcatttatctgaatgggctgaccccacactgcgccggcgaggagatagcagtcatagagaatatcaaatag

SEQ ID NO: 129384 - DNA, 1269 bp, Artificial Sequence
  Description of Artificial Sequence: Synthetic coding sequence
atgatgaatcccagagccaaacgggacttctatctggccgcgccagacctcctggatcccaagagtgccgctcagaatagtaaacccaggctgtccttcagcacaaaaccgacagtcctggcctcaagagttgagtccgatacaaccattaacgtgatgaagtggaaaaccgtgagcacaatattcttggtggtggtgctgtacttgatcataggggctacagtcttcaaggccctcgaacaacctcacgagatctcgcagaggacaaccatcgtgatccagaagcaaaccttcataagtcagcatagttgcgttaattccacagaactcgacgaacttattcaacagattgtcgctgcgataaacgccggcataattccgttgggcaataccagcaatcagatctcacattgggacctgggcagttcattcttctttgctggaacagtgataacaacaattggcttcggaaatatatctccccggaccgaaggagggaaaatattttgcattatctatgctctgctgggaattcccctatttggattcctgcttgccggagttggagatcagctcggaactatatttggtaaggggatcgccaaggttgaggatacgttcataaagtggaatgtgagccagaccaagatcaggatcatatcgacaatcattttcattttgttcggttgtgtgttgtttgttgccctccccgccattatatttaagcatattgagggatggagtgctctggatgccatctattttgtggtgattacccttacaactattggctttggcgactatgtagccgggggctccgatatcgaatatttggacttctataagccagtggtatggttctggattttggtcggactagcctactttgctgctgtgctgagcatgatcggcgattggcttagagttatcagcaagaaaacaaaggaagaggtaggtgagtttagagcacacgctgctgagtggaccgccaatgtgaccgcggagttcaaggaaacccgtaggagactgtctgtcgaaatctatgataagttccagagggccacttcaattaaacggaaactaagtgctgagctagccggcaatcacaaccaggagcttaccccctgccgaagaacgctgtcagtgaaccatctcaccagtgagagagacgttctgccacccctcctaaagacagagtccatttacttgaatggattgactccccactgcgcgggagaggagatcgcagtgatcgagaacatcaaatag

SEQ ID NO: 129385 - DNA, 1281 bp, Artificial Sequence
  Description of Artificial Sequence: Synthetic coding sequence
atgcttccatccgccagtagagagcggcctggctatcgagcgggcgtggcggctcccgacctgctagaccctaagtccgcagctcaaaatagcaagccccggctctcattttccactaaaccaactgtgctggcgagtagagtggaatcagataccaccatcaacgtgatgaaatggaagacggtctccacaatatttctcgtggtggtgttatatctaatcataggggccacagtgttcaaagctctggagcaaccacatgaaataagccagagaactactattgtgatacagaaacagactttcatatcacagcacagttgtgtgaatagtacagagctggacgaactgatccagcaaattgttgcagctattaacgccggcattatcccactcgggaatacttctaatcaaatctcccattgggatttaggttcttcatttttttttgcgggcactgttataaccacaatcggatttggcaatattagccctaggactgaaggtgggaaaatcttctgtatcatttacgctttacttgggataccactattcggcttcctcctggcaggtgtgggggaccaattgggtaccatcttcggaaaaggcattgccaaggtggaagatactttcattaaatggaacgtgtctcagaccaaaatccggattatcagtacaattatatttatcctgttcggctgcgtgctgttcgtagcgctgcctgctattatcttcaagcatatcgagggctggtctgctctcgatgcaatctacttcgtggtgatcaccctgacgaccattgggttcggtgattacgtggccggtggcagcgatatagaatatctagatttctacaaaccggtggtttggttctggattctcgtggggctggcgtattttgctgccgtgctgagcatgattggcgattggctcagggtaatcagcaagaagacgaaagaggaggtcggtgaatttcgcgctcatgccgccgaatggacggccaatgttaccgctgagtttaaggaaactagacgccggttgtcagtcgagatctacgacaagttccagcgggccacttcaatcaaacggaagttatcggcagaacttgcaggaaaccataaccaggaattaactccttgcaggaggacactgtccgttaaccatctgacaagtgagagagacgttctgccacctctactcaagaccgagtctatttatctgaacgggctgacccctcactgtgccggggaggaaatcgccgtgatcgaaaacataaagtag

SEQ ID NO: 129386 - DNA, 687 bp, Artificial Sequence
  Description of Artificial Sequence: Synthetic coding sequence
atgatgaacccaagggcaaagagagacttttatctggccgcacctgacctgctggatccaaaaagcgcagcacaaaatagcaagccgagattaagcttctccacaaagcccacagtcctggccagcagagttgagagtgatacaaccataaacgttatgaaatggaaaacagtttccacgattttcctggtcgtggttctctatttaattataggtgctaccgtctttaaagccctggagcagccccatgaaatttcccagagaacgactattgtgatacaaaaacagacatttatctctcaacactcctgtgtcaatagcaccgaactggacgaactgatccagcaaatcgtggcagcgatcaatgccggtatcataccccttggtaatacctctaaccagattagtcactgggatctgggtagcagctttttcttcgccggaaccgtcatcactactattggcttcggaaatatttcgccgaggacagagggcggaaaaattttttgtatcatttatgctctgctgggaataccgctctttggcttcctgttagctggcgtgggtgaccagctggggacgatattcgggaaaggtattgcaaaggtggaggacactttcattgtggaccccatcctcaatatctggacatccatatctctatcctgcggatcaggctcactctag

SEQ ID NO: 129387 - DNA, 471 bp, Artificial Sequence
  Description of Artificial Sequence: Synthetic coding sequence
atgctgccatcagcctcccgcgaacggcctggttaccgagccggagtggctgctcctgatctcctcgacccaaagtctgctgcacagaattccaagcctcgcctcagcttcagtaccaagcccacggttctggcatcaagagtcgaatccgatacgacaataaacgtgatgaagtggaagaccgtgtcgacaatcttcttggtcgtggtcctataccttatcattggggcaacagtttttaaggccttagaacagccccacgaaatcagccagcggaccaccattgtgatccagaaacagacgtttatctctcagcattcgtgcgtgaactctaccgagctggacgaactgatacaggacctggagacgtcccatcacgcgcaaaaggccgctaagtattccgtctccagtatgccctattgggagttcccttcgctggtgttctcatggctcgagctagaaatctcctag

SEQ ID NO: 129388 - DNA, 459 bp, Artificial Sequence
  Description of Artificial Sequence: Synthetic coding sequence
atgatgaacccccgggctaagagggacttctatctcgccgctccagacttgttggacccgaagagcgcggctcagaatagtaaaccaaggctgtcattcagcaccaaaccgactgttttggcatcgagggtggagtcggacacaacaatcaacgtgatgaagtggaagactgtgtccacaatcttcctggtggtcgtgctctatcttattatcggagctactgtttttaaggccctggaacagccccacgaaatatctcagagaactacaatcgtcatccaaaaacagactttcatttcccagcactcctgtgtgaattctaccgagctcgatgagcttatccaggatctggagaccagccaccacgcccagaaggctgcaaaatatagcgtctctagtatgccctactgggaattcccttcactcgttttcagctggctggagctggagataagctag

SEQ ID NO: 129389 - DNA, 1185 bp, Artificial Sequence
  Description of Artificial Sequence: Synthetic coding sequence
atgaaaagacagaacgttaggaccctggctctcatcgtgtgcacctttacctatctgttggtcggggctgcagtgttcgatgctctggagtcagagcctgagctgatcgaaaggcagcggctggagctcaggcagcaagagttgagggctcggtataatctgagtcagggcgggtacgaagagttggagagagtggtcctccgattgaagccccataaagccggcgttcagtggcgattcgccgggtccttctacttcgccatcactgtcatcactactatcgggtatggacacgcagctccctcaaccgacggaggtaaggtgttttgcatgttttatgccttgctggggatccccctcacccttgtcatgttccagtcccttggtgagcgcatcaacaccctcgttaggtatctgcttcatagggctaagaagggtcttgggatgcgaagggcagatgttagtatggctaacatggttctgattggcttcttttcatgcattagtaccctgtgcatcggcgccgccgctttttcacactacgaacactggacattcttccaagcgtactactattgctttattactctgacgaccattggatttggtgattacgtggccttgcagaaggatcaggccctccagacacagcctcagtacgtggcgttttcatttgtctacattctgacaggccttaccgtcattggagcgttccttaacctagttgtgcttcgctttatgacaatgaacgcagaggatgagaaaagagacgccgagcatagagcgctcctgaccagaaatggccaggctggcggcggtggcggagggggcagtgcccatactacagacaccgccagcagtactgctgccgcaggtggcgggggattcagaaacgtctacgccgaggtattgcattttcagtcgatgtgttcctgcctgtggtataagtcaagggaaaagctacagtattccatcccaatgataatcccaagagacctttccacttctgatacttgcgtggagcagagccactctagcccaggcggcggaggccggtacagcgatacaccctccaggaggtgtctgtgctcgggcgccccaagaagcgcgattagttcggtgagtactggactccacagcctttcaacctttcggggactgatgaaacggaggtcttcagtctag

SEQ ID NO: 129390 - DNA, 816 bp, Artificial Sequence
  Description of Artificial Sequence: Synthetic coding sequence
atgttccaatccctgggcgagcgtataaacactctcgtgaggtatcttctgcacagagctaagaagggcctagggatgcgccgggcagatgtctccatggctaatatggtgttgatcgggttcttttcttgcatttcaactctgtgcatcggcgcggcagcattcagccattatgaacactggacctttttccaggcctattattattgctttatcaccctgactaccataggcttcggtgattacgtggcacttcagaaggatcaggccctgcaaacccagcctcaatatgtagcattcagttttgtttacatactgacaggactaacagtcatcggggccttcctcaacttagtcgttctgagattcatgactatgaatgccgaggatgaaaagcgtgatgccgagcacagagccctcttaaccaggaacggacaggccggcggtggcggcggtggtgggagtgcccacacaaccgatacggcttcatccaccgccgcggctgggggtggtggatttcgaaatgtttacgctgaggtcttgcatttccagtcaatgtgttcatgtctctggtataaaagtagggaaaaactccagtactctatccctatgataatcccaagggacctctccacttcggacacttgtgtggaacagagtcatagctcacccgggggggggggcagatacagtgacaccccctcgaggcgatgcttgtgctcgggcgcgcccagatccgcaatttcatcagtgtcaaccgggctccactctctgtcaaccttcagagggttgatgaagcgacgttcaagcgtctag

SEQ ID NO: 129391 - DNA, 1182 bp, Artificial Sequence
  Description of Artificial Sequence: Synthetic coding sequence
atgagatctaccacccttctggccttgctggctttagtactactgtatctggtgtccggcgccctcgtttttcgggccctggaacagccccatgagcagcaggcgcaacgggagctcggcgaggtgcgggaaaagtttctcagagcgcacccttgtgtctctgaccaagaactgggactgcttattaaggaggttgcagatgccctcgggggcggcgctgaccccgagactaactccacctccaatagctcccattcggcctgggatctgggctctgctttctttttttccggaacgataattacaaccattggttacggtaatgtagcgttaaggaccgatgctggaaggctgttctgcatcttctatgccctagtcgggattcccctgtttggcatacttctggcaggtgtgggcgaccgacttggatcgtccctgcgccacgggattggccacattgaggccatcttcctcaaatggcacgtgccccccgagctcgtcagagttttgagcgctatgctgttcctgctgatcggatgcctgttatttgtcctcacccctacttttgtgttttgctacatggaggactggtctaagctcgaggcaatttactttgtgattgtgactctcaccaccgtagggtttggagactacgtggctggcgccgaccctcgacaggatagtcccgcctaccagccactggtctggttctggattctgctgggcctggcctactttgccagtgtgctaacaacgatagggaactggctgagagtcgtctctcggagaactagggctgaaatgggcggccttacagcgcaggccgcctcatggactgggacagtgactgctcgagttacccagagggccggtccggccgctccccctcccgagaaggagcaacccttattgcccccacctccgtgccccgcccaaccactgggaagaccacgctccccttcacctccagagaaggctcagcctccttcgcctcccaccgcatccgccctcgactacccttccgagaatcttgctttcattgatgagtccagcgacactcagtctgaaagaggctgtccccttcctcgagcgcctagaggcaggcgcaggcctaacccccctagaaaacccgtccggccacgggggccaggccgtccaagagacaagggcgtgcctgtctag

SEQ ID NO: 129392 - DNA, 1182 bp, Artificial Sequence
  Description of Artificial Sequence: Synthetic coding sequence
atgagatccaccacgttgctggcgcttctcgctctggtgctcctgtatctggttagtggggctttggtttttagggcgttagagcaaccccacgagcaacaggcacagcgtgaactcggcgaggtgcgcgagaagtttttgcgcgcccatccatgcgtcagcgatcaggagctaggattactcataaaggaggttgctgatgcactgggagggggcgctgatcccgagacaaatagtacctctaattcaagccactcagcgtgggatctaggctccgccttctttttttctggaaccatcattacaaccatcggctatggtaacgttgccctgcggacggacgctggccggctgttttgcattttctacgcattggtgggaattcccctgttcggcattttgctcgctggcgttggagaccggctagggagctcactacggcacggcatcgggcacattgaggcaatcttcttgaagtggcatgtgcctcctgaactggtccgcgtgctttccgcgatgctgtttttactgatcggctgtctgctctttgtccttaccccaacatttgtgttctgttatatggaggattggagtaaactcgaggcaatttatttcgtcattgtgaccctgactactgtcgggtttggtgactatgtagccggcgctgaccctcgacaggacagtccggcttatcagcccctcgtatggttctggatcctgctgggtttggcgtatttcgcatcagtactcacgactattgggaactggcttagagtggtgtctcggcgcactcgcgctgagatgggggggcttaccgcccaggccgcttcttggaccgggaccgttaccgcccgcgtcacccaaagggctgggccggcagcacccccgcctgaaaaggagcagccgctgctcccacccccgccgtgtcccgcgcaaccactgggccgtcccaggtctcctagcccacctgagaaagctcaacccccatcacctccgactgcctctgccctcgactacccgagcgaaaacctcgcttttatcgatgagagctcagacacacagtccgagcgtggttgcccccttccccgcgcaccaaggggacgaaggcgccctaatccccctaggaagcccgtgaggcccagaggccctggtagacctcgcgataagggagtgccagtgtag

SEQ ID NO: 129393 - DNA, 1182 bp, Artificial Sequence
  Description of Artificial Sequence: Synthetic coding sequence
atgagaagtacaaccctgcttgcgctcctggcattagtgctgctgtatttagtcagtggtgcccttgtcttccgagccctggagcagccgcatgaacagcaggcccagagggagctgggtgaggtgcgcgaaaaatttctacgagctcatccatgtgtgagcgaccaggagctcggtctgctgatcaaggaagtcgccgacgccctaggcggaggtgccgatcccgaaacaaactcaacctccaatagttcacactctgcctgggaccttggttcggccttcttttttagcgggaccattattacgacaattggatacggcaatgtcgccctcaggacagatgccgggcggctgttctgcattttctatgccttggtaggaatcccactatttgggatccttttggctggggttggcgatcgcttgggttcttctctgagacatggcatcggccacattgaggcaattttcctcaagtggcacgtgccacctgaactggtcagagttctttccgcaatgctgttcttactgataggatgcctcctgtttgtgctaacacccacatttgtgttctgttatatggaagattggtcaaagcttgaagccatttactttgtgatcgtgacgcttactacagtcggatttggcgactacgttgcaggggcagatcccagacaggattcccccgcgtaccagccactggtctggttctggatcctgcttggcctcgcgtattttgctagtgtgctaactacaattggtaactggttgagggtggtctcccgtagaactcgggcagagatgggcggactaacggcacaagccgcctcctggactggaacagtcaccgcacgcgtgactcagagagccggacccgccgcacccccccctgagaaagaacaacccctcctcccacccccaccttgcccggcccagccactaggccgcccacgtagcccctctccacccgaaaaagcacagcccccgtccccaccgaccgcctctgccttagattacccgagtgaaaaccttgcattcatagacgagagctctgacactcagagtgagaggggctgtccccttccacgggctccacgtggaagacgaaggcccaaccccccgcgaaagcctgtgcgccctagaggccctgggcgtccccgggataagggcgtccccgtgtag

SEQ ID NO: 129394 - DNA, 1257 bp, Artificial Sequence
  Description of Artificial Sequence: Synthetic coding sequence
accacggctccccaggaacctccagccagacccctgcaagcgggctccggcgccggaccagccccgggcagagccatgagatccacaactctgctcgccctgctcgccctggtcctgctgtatctcgtctcaggggcactcgtgttcagagctcttgaacagccacatgagcagcaagcccagcgggagttgggcgaagttagagaaaagtttctgcgggcgcacccttgtgtgtctgaccaggagctggggctgctcataaaagaagtggcagacgctttaggaggcggcgctgatcctgagaccaatagtacaagcaactcttcacacagcgcctgggacctgggtagtgcttttttctttagcggcaccataatcacaacaatcgggtatggaaatgttgcgctaaggacggacgccggtcgcctgttctgtatcttttacgccctggttggcatccctttgttcggcatccttttagccggtgtgggtgatcggttaggctcatcgctacgacatggaatcggccatatcgaggccatctttctgaagtggcatgttccccccgaattagtgagggtactgtctgcaatgctttttctactcatcggctgtctgctgttcgtgctgactcctacctttgtgttttgttatatggaggactggagtaagctggaggctatctacttcgtgatagtgacacttactaccgtggggtttggagactatgtcgcgggggccgatccaagacaggacagcccagcgtaccagccgctcgtttggttctggatccttctgggcctggcctattttgcatcagtgcttaccaccatcggcaactggttaagggtggtcagccggaggacacgtgccgagatggggggcttaactgctcaggcagcctcctggaccggaaccgtgaccgctcgcgttactcaaagagctgggcccgccgcccctcctccagagaaagaacagccactcctgccccctccaccctgcccagcacagccattaggacgtccaaggtctccatctcctcctgagaaggctcagccaccatcaccacccaccgcgtccgctctggactacccctctgaaaatcttgcatttatcgatgaatcctctgacacccagtcagagcggggatgccctctgcctcgggcaccccgcggtcgccgaagacctaatcccccccgcaagcctgtgagacctagaggaccaggcagaccccgcgacaaaggggtccccgtgtag

SEQ ID NO: 129395 - DNA, 1368 bp, Artificial Sequence
  Description of Artificial Sequence: Synthetic coding sequence
gtgcatgcttcagtgcacacccgagtccggggcctttgggtcccttggcggggtcgtcatgcccatggtgggaggggttgtagaggagtatgcggggagtgccggtgggtgacgaccgcccctcaggaaccaccagcgcgacctctgcaggctggatcgggagccggtcccgcaccagggcgggccatgaggtctactacattactcgccctattagccttggtgctattgtacctggtgagcggcgcactagtattcagagcccttgagcaacctcatgagcaacaggcacagagggagctgggagaggtcagggagaagtttctgcgggcacacccttgcgtgtccgatcaggaattaggcttgttaataaaagaagttgcagacgctttaggcggaggagcggaccctgagaccaactccacatctaactcaagccattctgcctgggatctgggaagcgccttttttttttccggcactatcatcaccacaattgggtacgggaatgtggcactcaggacagatgctgggcggctattctgcatcttctatgctctagttgggatccccctgtttggcattcttttggctggcgtgggggacaggctgggtagctccttaagacacgggatcggccatattgaggcgatctttctgaagtggcacgtgccaccagaactggtacgagtgctctctgcaatgctgttcctgctaatcggatgcctgctctttgtactcactccaactttcgtgttttgttatatggaggactggagtaaacttgaggccatctactttgttatcgtgacactaaccacggtgggctttggagattatgttgcaggcgccgacccaaggcaggatagcccggcatatcagcccttagtgtggttttggattctgctgggcctcgcatactttgcctccgtgctgaccactatagggaattggttgagggtggtctcacggaggacgcgggccgagatggggggattaacggcccaggctgccagttggaccgggactgtgacggctagggtcacccagagagccgggcctgcggcccctcctccagaaaaggaacagccactcctgccaccgccgccttgtccagcccagcctctcggccgaccccgctccccttctccgcctgaaaaagcccaaccaccatctcctcccacagcatccgccctggactatcccagcgaaaacctggcttttatagatgagagctcagatacccagtcggagaggggatgcccgttaccgcgggcaccccgagggcgcaggcgtcctaatccaccgcgcaagccagtgaggcccaggggcccaggccgccctcgtgataagggggtgcctgtgtag

SEQ ID NO: 129396 - DNA, 1500 bp, Artificial Sequence
  Description of Artificial Sequence: Synthetic coding sequence
atggtggatagaggtcccctgctgacctctgcaatcattttctacctggccattggagccgctattttcgaggtgcttgaggaacctcactggaaagaagccaaaaagaattactatactcagaagctgcatctactgaaggagtttccttgtctcggacaggaggggttggataaaatcttagaagtagtgtctgacgccgccgggcaaggtgttgctattacaggtaatcagacttttaataactggaattggcctaacgcgatgatattcgccgcaaccgtcattactactattgggtatggcaacgtggcacccaagaccccggccggacggctcttctgcgtcttctacggtcttttcggggttcccttatgcctcacttggatttctgctctgggaaaattctttggggggcgagcaaaaagactaggccagttcctcacaaagcgaggcgttagtctcaggaaagcacagattacatgcacagtaatttttatagtgtggggggttcttgtgcacttagtgatcccaccattcgtgtttatggttactgagggatggaattacatcgaagggctttattacagcttcattacaatctctaccatcggatttggcgactttgtggctggcgtgaacccatccgcgaattaccatgcactttaccgctattttgtggagctctggatatatttaggactggcgtggctgagtcttttcgtgaactggaaggtgagcatgttcgtggaggtgcataaggctatcaagaagcggcgcaggcgacgtaaagagagtttcgagtcttcgcctcacagcaggaaagcactgcaggtcaaaggctcgacagccagtaaggacgtgaacatcttttcgttcctgtctaaaaaggaggaaacgtacaacgacctgattaagcaaatcggtaagaaggccatgaagactagcggcggcggcgagactggacctggccctggactgggaccacagggaggcggcttgccagcactccctccatcgctggtgccacttgtagtatactccaaaaaccgggttcctactcttgaagaggtctcacagacactccgttcaaagggacatgttagcaggagcccagatgaggaggccgttgctcgcgctcccgaggattcctcacccgctcctgaagtttttatgaaccagcttgatcggataagcgaggaatgcgagccgtgggatgcacaggactaccacccgctcatatttcaggatgctagtataacttttgtaaacactgaagctggtctttctgatgaggagacttcaaagtcaagtcttgaggataacctggcaggcgaagaatcccctcagcagggcgccgaggctaaagcacccctgaatatgggcgagttccctagctcctccgagagcacgttcacaagcactgaaagcgaactgagcgtcccttatgaacagctgatgaacgagtataacaaggcaaacagccctaagggaacctag

SEQ ID NO: 129397 - DNA, 942 bp, Artificial Sequence
  Description of Artificial Sequence: Synthetic coding sequence
atgagacggggcgcgctgttggcaggtgccctagcagcctacgccgcctacttggtgctcggagctctgttagtggccaggctggaggggccccatgaggcaaggctgcgcgccgaattagagaccctgcgagcccaacttctccaaagatccccttgtgtcgccgcaccggccctcgatgcttttgtcgagagggtgctggctgccggccgcctgggtcgcgtagtcctggcgaatgctagcggatctgcaaacgccagcgaccctgcttgggactttgcttctgctctgtttttcgcctccaccctgattaccacagtagggtatgggtacaccactccactgaccgatgcaggaaaggccttctcaattgcattcgcattgcttggagtccctactactatgttgctgctgactgccagtgcacagagactgagtctcctgctgacgcatgtgcctctgtcctggctcagcatgaggtggggttgggatccaaggagagcggcctgctggcatctggtggcgcttttaggcgtggtcgtgactgtgtgtttcctggtgcctgccgtgattttcgcacatctggaagaggcatggtcttttttagacgcattttacttttgtttcatttccctgagcacaatcggcctgggcgattatgtgcctggcgaagccccaggccagccttaccgcgctctttataaggtactcgttaccgtgtatctatttcttgggttagtcgcaatggtgttggtcctgcagaccttcagacatgtgagcgatctgcacggccttacagagttgatattactccctcctccatgccccgcgtcctttaacgccgatgaagacgatcgtgtcgacattctgggtcctcaacctgagtcacaccagcaactctctgccagcagccacactgattacgctagcataccgcgttag

SEQ ID NO: 129398 - DNA, 924 bp, Artificial Sequence
  Description of Artificial Sequence: Synthetic coding sequence
atgggagggttgaggccctggtctcgttacggcctcctggtggtggcccatttgttggcactgggactcggtgctgtcgtctttcaagcccttgaggggccccccgcatgccggctgcaggcagaactccgggccgaactggcagccttccaggcggagcatagggcgtgtctacctccaggggccctcgaggagcttctgggcacagctcttgcaacccaagcccacggagtttcaacactgggcaactcgagcgaggggcggacgtgggacttgccttctgccttactcttcgcagctagcatcctgaccaccactgggtatggccatatggccccactcagtcctggcgggaaagccttttgtatggtgtacgccgctctcgggctgcccgcttcactcgcattggtggccacgcttcgtcactgtctgttacctgtcttatcacgaccacgggcgtgggtcgcagtccactggcagctctcccctgcacgagcagccctattgcaggccgtggcactgggcttgctagtagcttctagctttgtcctgctaccggcacttgtgttgtgggggctccagggcgactgttccctgttaggagccgtgtatttttgcttctccagtctttccactattggtctggaggatctgctgcctgggcggggcagatcccttcacccagtgatttatcacctggggcagttggctctcctggggtacctgctgctgggactgctcgccatgcttctcgcagtggaaacgttttccgagctcccgcaggtgagagccatgggtaagttctttcgaccatcaggcccagtgaccgcagaggatcaaggcgggattcttggtcaggatgagctcgctctgtccaccctgccacctgctgctccagcgtcagggcaggctcctgcctgctag

SEQ ID NO: 129399 - DNA, 759 bp, Artificial Sequence
  Description of Artificial Sequence: Synthetic coding sequence
atgggggggctgaggccctggtctcgttacggcctgctggtggtcgcccatctgctggcactgggtcttggcgctgtggtttttcaggccctggagggaccacctgcttgcagactgcaggccgagttgcgcgccgagctcgccgctttccaggcggaacacagagcctgtcttccaccaggggcactcgaagaactactcggtaccgcccttgccactcaagcccatggggtttctactctgggcaattcaagcgaagggaggacctgggacctcccctctgcactgttatttgcggcctcgatcctcacgaccactggctacggtcacatggcccccttaagccctggggggaaggccttctgtatggtttacgccgctctgggtttgccagcatctttagcactggtggcaaccctgcgccactgcctattgcccgtcttgagccgcccacgagcctgggtcgccgtccactggcagctcagccccgctcgcgctgccctgcttcaggccgtggccctaggcttgctcgtggcttcatcgttcgttcttttgccagccttggtgctctggggcctacagggagactgttcactgctgggcgcagtttatttttgtttctcatccctctccacaatcggactcgaggatctcttacctgggcgggggcggtcactgcaccctgtgatttatcatctcggtcagctggcattactgggcgggggtacgagcttgcaaggtaccgcctgggagggttag

SEQ ID NO: 129400 - DNA, 774 bp, Artificial Sequence
  Description of Artificial Sequence: Synthetic coding sequence
atggggggactgcgcccctggagccgatacggtcttctcgtcgtcgcccatttgctcgcactggggctgggcgccgtggtgtttcaggctcttgagggaccccctgcttgtagactgcaggctgaactgcgcgccgaactggcggcatttcaagcggagcatagggcttgcctgccccccggagccctggaagaattgctgggtaccgcactcgcaacgcaggcccatggcgtaagcacattgggtaactcctcagaggggcggacatgggacttgccgtcagctctactgtttgctgctagcattttgacaactacaggctatggccacatggcgccactgagcccaggcggcaaggcattctgcatggtctacgctgctctcggactcccagcatccctggctttagtcgcaacactacgccattgtctgctgcccgtcctttcccgccctagagcctgggtggccgtgcactggcaactatcccccgcacgggcggcccttcttcaggcggtggcactgggactgctggtggccagcagttttgtcttgttaccagctctggttttatggggtttacagggcgattgctcgcttctgggcgcagtctatttctgctttagttccctgagcactatcgggctggaagatctcctgcccggccgcggccgctccctgcatcctgtgatctaccatctgggacagcttgccctgttgggtaagagttcacatctcacagcgtgcggtggacgcgggaagcggagcctggactag

SEQ ID NO: 129401 - DNA, 759 bp, Artificial Sequence
  Description of Artificial Sequence: Synthetic coding sequence
atgggtggcctgcgaccttggagtaggtacgggctgctcgttgtggctcatctgctggcactgggactcggcgcagtggtattccaggccctcgagggaccgcctgcctgtaggctgcaggcagagctgcgggctgagttggctgccttccaggctgagcacagggcttgcctcccaccaggggcactcgaagaactgctgggaacggcccttgccacccaggcccacggggtttccacccttgggaactcaagcgaggggcggacgtgggacttgcctagcgcactcctcttcgccgcctccatactgactacaaccggctacggacacatggccccccttagtcccggtggcaaggccttttgtatggtttatgcagccctgggcctgccagcgagtttggcgctggtcgcaaccttgcgccattgtctcctacccgtgcttagcagaccaagggcatgggtggccgtgcactggcagctgtcaccagcaagggcggctttattgcaggccgtggccctgggcttgttggtggcatcctcctttgttctgctccctgctcttgtgctctgggggttgcagggggactgttctttgctgggggctgtctacttttgcttcagttctttgagtacaataggccttgaggacctccttccgggacgcggccggagcctccatcctgtgatctatcatctgggtcaattggctctgctgggtggagggactagcctgcagggaaccgcctgggagggatag

SEQ ID NO: 129402 - DNA, 87 bp, Artificial Sequence
  Description of Artificial Sequence: Synthetic coding sequence
tgactacacccggtaatctatcacctgggccaactggccttgttgggcggaggcacgagcctgcagggcaccgcttgggaggggtag

SEQ ID NO: 129403 - DNA, 1125 bp, Artificial Sequence
  Description of Artificial Sequence: Synthetic coding sequence
atgaaacgacagaatgtgcgcactcttagcctgatagtgtgtacctttacttacctgctggtgggcgcggcagtctttgatgcgctcgagagtgaccacgaaatgagggaagaagaaaaacttaaagccgaggagattcgaatcaagggcaagtacaatatatcaagtgaggactatcgccagctggagctggtaattctgcagtctgaaccccatcgagccggagttcaatggaagtttgccggctcattctacttcgctatcaccgtgatcacaactataggctacgggcacgccgctcctggtactgatgccgggaaagcattttgcatgttctacgcagtgcttggaattcctctgaccctggtgatgttccagtccctcggggagcggatgaacacgtttgtgcgatatctgctcaagcgaataaagaagtgttgcggaatgcggaacaccgatgtttcaatggagaacatggtgaccgtcgggttcttttcatgcatgggtacgctgtgtataggcgccgccgcattcagccagtgcgaggagtggtcttttttccatgcctattattactgtttcatcacacttacaacaatcggctttggggattacgttgctctgcaaactaaaggtgctctccagaagaagccactgtacgtggctttttccttcatgtatatcctggtgggcctgacagtgattggcgcattcttgaacctcgttgtgctgcgctttctcactatgaactcggaggacgagagacgcgatgccgaggagcgagctagtctcgctggcaacaggaatagtatggtgattcacatcccagaggagcctaggccttcccggccacgctacaaggccgacgtgccagatctgcaatctgtgtgctcttgcacatgctatcgctcacaggactatggcgggcgaagcgtcgcgccacaaaactctttcagcgccaaactggctcctcattattttcattctattagctacaaaatagaggagatttctccctctacactgaagaacagcctctttccaagccccatcagctctatctcacctggactgcacagtttcacagaccatcagagactgatgaagcgacgaaaatcggtctag

SEQ ID NO: 129404 - DNA, 1125 bp, Artificial Sequence
  Description of Artificial Sequence: Synthetic coding sequence
atgaaaaggcagaacgttcgcacgttatcattaattgtgtgcaccttcacttacctgcttgttggggccgccgtgtttgatgcactcgaaagtgaccatgaaatgcgggaggaggagaaactcaaggcagaagagatcagaataaagggaaaatataatattagctccgaggattaccgacagctcgagctggtaattctacaatctgaaccccaccgggccggtgttcagtggaagttcgccgggagtttctactttgccatcacggttatcactacaatcggttatggtcacgccgcacccgggacagacgccggcaaagctttttgtatgttttatgctgttctcggaattcctctgaccctcgtgatgttccaaagcctgggcgagcgcatgaacacttttgttaggtatctactcaagcgcatcaagaaatgttgtggcatgagaaacacagacgttagcatggagaatatggtgacagtcggctttttttcatgtatgggcacgctctgtatcggggcggctgccttctcacagtgtgaagagtggagcttcttccacgcctactattattgctttatcaccctgactaccattgggtttggcgactatgtagcgctgcaaaccaaaggagccctccagaagaaaccattgtacgtcgctttttcgtttatgtacatactggtagggctcaccgtcataggggctttccttaatttggtggtcctgaggttcctcaccatgaacagcgaggatgagagaagagacgctgaggaacgcgctagtcttgccgggaaccggaatagcatggtaattcacatcccagaggagccgaggccatcacgccccaggtacaaagcagacgtgccagacttacagtctgtctgtagttgtacttgttacaggtcacaagactacgggggcaggtccgtcgcccctcagaactccttcagtgctaaactggctcctcactactttcactcaatctcctataaaatcgaggagatttccccgtccacccttaaaaacagtctcttcccgtctcccatctcaagtatcagcccgggattgcattcctttaccgatcaccagcgactcatgaagcggcgaaagtctgtgtag

SEQ ID NO: 129405 - DNA, 1125 bp, Artificial Sequence
  Description of Artificial Sequence: Synthetic coding sequence
atgaagcgccagaacgtcagaaccctatctctcattgtttgcaccttcacatacctacttgtcggggcggctgtttttgacgccctcgagtccgaccacgaaatgcgggaggaggagaaattgaaggccgaagaaatccgtattaagggaaaatataacattagttctgaagactaccggcagttggaactggtgatactccagtccgagcctcacagggccggcgtgcagtggaaattcgctgggtccttttactttgctatcacagtaatcaccactattgggtacgggcatgcagccccaggaacagacgcgggcaaagccttttgtatgttctacgccgttctgggaatacccctgacactcgtcatgttccagagcctgggcgagaggatgaacaccttcgttagatacctgttgaagagaatcaagaaatgttgtggaatgcgtaacactgatgtaagcatggaaaacatggtgactgttggatttttctcttgcatgggaacgctctgtatcggcgcagccgccttttcacagtgtgaagagtggtcctttttccacgcctattattattgcttcataacccttaccactattggtttcggcgattacgttgctctgcaaactaagggagctctacaaaaaaaacccctgtacgtggctttttcgtttatgtacattctggtgggactcactgtcatcggcgcatttctgaacttggtagtgttaaggttcctaacgatgaacagcgaagacgagaggagggatgcagaggagcgtgcctcccttgcgggcaatcggaatagcatggtcatccacatccccgaggagcccaggccttcccggccaaggtacaaagccgacgtacctgatctccagagtgtgtgcagttgcacttgttatagaagtcaagattacggagggaggagcgtagcgccacagaattcatttagtgctaaactggcaccccactatttccatagtattagctataagatcgaggagatctctccttccacactcaaaaactccctcttccctagccccatatcatccatttctccgggcttgcactcttttacagaccaccagagactaatgaagaggcgcaagtcagtctag

SEQ ID NO: 129406 - DNA, 3693 bp, Artificial Sequence
  Description of Artificial Sequence: Synthetic coding sequence
atggcgagagcaaagctgcccagatcccctagcgagggcaaagccgggccgggaggagctccagccggcgctgcagcccctgaggaacctcatggtctgagtcctctccttcccgctcgtgggggagggtccgtagggtctgatgtcgggcagcgactccccgtggaggacttttcccttgactccagcctcagccaggtacaggtggaattctatgtgaacgagaatacattcaaggaacggctgaagcttttcttcataaaaaatcagcgaagctccctgcgcatcaggcttttcaatttttcgctcaaacttttaacctgtcttctgtacatcgtacgagtgctcctggatgatccagctttgggtatagggtgctggggctgtccaaagcaaaattactcctttaacgattctagctctgaaattaattgggctccaatcctatgggtagaacgaaaaatgactttgtgggccattcaagtgatcgttgctatcatttcatttttagagacaatgctcctgatctacctctcctacaaggggaatatttgggaacagatctttcgagtgagcttcgtcctcgagatgattaacaccctgccattcatcataacgatcttctggccacccctgcgaaacctgttcatccctgtattcctgaactgttggctggccaaacacgctctggagaacatgataaacgacttccacagggccatcttgcggacacaatcagccatgttcaatcaggtactaattctgttttgtaccctcctttgtctcgtgtttaccgggacttgtggaattcagcatctggagagggccggcgagaacctgtcccttctaacatctttttacttctgtattgtgactttcagcactgtgggatatggcgacgttacaccaaagatttggccttcccagcttctggttgtgattatgatttgcgtggccttagttgtgcttcctctgcaatttgaagagttagtatatctctggatggaaagacaaaagtcaggaggaaactactcccgacacagagcacagacagagaaacatgtagtgctctgcgtgtcgagtctgaaaatagatctgctaatggattttctgaacgaattttatgcgcaccccaggctgcaggactactacgttgtgatattatgccccactgagatggacgttcaggtgcgacgagtgctccaaatccccctgtggtcccaacgtgtgatctatctgcagggtagtgccctcaaagatcaggatttaatgcgagccaagatggacaatggagaggcatgctttattctgagttcccggaatgaggttgatcgtaccgcggcggatcatcagacaatcctgagggcctgggccgttaaggatttcgcccccaattgccctttatacgtacagatcctgaagccggagaacaagtttcacgtgaaatttgcagatcacgttgtgtgtgaggaagagtgcaaatacgcgatgttagcactgaactgtatatgcccagctaccagcacattgatcaccctcctagttcatacatcacgcggtcaggaaggtcaggaatcgccggagcagtggcagcgcatgtacggaagatgctccgggaatgaagtgtaccatatacgaatgggtgacagcaagtttttcagagagtatgaagggaagtcttttacatatgcggctttccatgcccataaaaaatacggagtttgcctgatcgggctcaagagggaggataataaatctatccttctcaaccccgggcctcgccacattttggccgcctcagacacatgcttttacattaatatcaccaaggaggagaactctgcttttatttttaaacaggaggagaaaaggaagaaacgggccttttcaggccaaggcctgcatgagggacctgcccggttaccggttcactcgattattgctagtatggggactgtggcaatggatttgcaagggaccgaacacaggccaacgcagtccggtggtggcgggggaggcagtaaacttgctctgccaacagagaatgggtccgggtcacgccggccctccatcgcacccgttcttgagctagccgacagcagtgcactcctgccatgtgatcttctaagtgatcagtccgaagacgaggtaaccccttccgatgacgagggactgtctgtcgtggagtatgtcaagggctacccccccaacagtccgtatattgggtccagcccgacactctgccacctgctgcctgtcaaagcccccttctgttgcttaaggttggataaaggctgcaagcataacagctacgaagatgccaaagcttacggtttcaagaacaaactcattattgtttcagctgagacagccggcaacggtctttataactttatcgtgcccctgagggcctactacagatctcgtaaggagctgaatcctatagtgttgctgctcgataataagccagatcatcatttccttgaggccatctgctgcttcccaatggtgtactatatggaagggagcgtggacaacttagattctctgctccagtgcggcatcatctacgctgataatctcgtggttgtagataaagaatctacaatgtccgctgaggaggattacatggccgatgctaaaacaattgttaatgtgcaaacaatgtttagactctttccatcactgtccataaccactgagctgactcatcccagcaacatgcgtttcatgcagtttcgggctaaagactcatacagcttggccctttccaagttggaaaaacgggaaagagaaaacggctccaacctggcctttatgttcaggctgccctttgccgccggacgggtcttttccatatcgatgttagacaccctgctctaccaatccttcgtgaaagactacatgataacaatcacaaggctactgctcgggctcgacacaacccctgggtccggctacttgtgtgcgatgaagattacagagggcgatctgtggattcggacttatggtcgcctgtttcagaaactgtgctcctcatccgcagaaattcccatcgggatctacagaaccgagtctcacgtattctcgacctcagaatctcagatctcagtcaatgtcgaagactgcgaagacactagagaagtcaagggaccctggggctcgcgggccggaacaggcggatcctcacaaggcaggcacaccgggggcggggacccggccgaacatccgctgctgcgaagaaagagcctgcagtgggctagaagactaagcaggaaagcccccaagcaagctggcagggcggccgctgctgaatggataagccagcagcgcctttccttgtatcgcagatccgaacgccaggagctttctgaactggtcaagaaccgtatgaaacatctgggcctcccgaccaccggttatgaggatgtcgccaaccttactgcatctgatgtgatgaaccgcgttaatctaggatacctgcaggacgagatgaacgaccaccagaataccctaagctacgtcctgattaaccccccacctgacactcgtctggagcccagcgacatcgtgtaccttatacgctccgatcccttggcccacgtggcctcttcaagccaatctcgaaaaagctcctgctctcacaaactcagctcgtgtaacccggagacccgtgacgagacccaactctag

SEQ ID NO: 129407 - DNA, 3771 bp, Artificial Sequence
  Description of Artificial Sequence: Synthetic coding sequence
atgcccttacctgacggcgctcgaacacccggaggtgtgtgcagggaggctcgcgggggaggatatacaaataggacctttgagtttgacgatggacaatgcgccccccgccggccgtgtgcaggggacggagctctcctggacaccgccggtttcaagatgtcagacctggatagcgaagtcctccctctgccacctaggtatcgattccgggatcttttgctgggagaccccagctttcaaaatgacgatcgagtacaagtagaattctatgttaacgaaaacacattcaaggagaggttgaagctgttcttcattaaaaatcagagatccagcctgcgcataaggctgttcaacttcagtctcaagctgttgacttgcctcctgtacatcgtgagggtcctgctggatgaccctgcccttgggattgggtgctggggatgtcccaagcagaactattcattcaacgatagcagtagcgagatcaactgggcccctatcttgtgggtggagcgcaaaatgactctttgggccatacaagtgatagtcgccataattagtttcctggagaccatgttgctaatctacctgtcctataaggggaacatttgggagcagattttccgagtgagtttcgtgctggagatgatcaatacccttcccttcatcatcacaattttttggccacccctgaggaacctgttcatcccggtgttcctcaactgctggttggccaaacacgccctagagaatatgatcaacgatttccaccgggcaattttgcgcacccagtctgctatgttcaatcaggtgctgatcctcttttgtacgctcctgtgtttggtgtttactggcacctgcggcattcagcatcttgaaagagctggcgagaatctctcactactgacctccttttacttctgcatcgtgaccttctcaaccgtggggtacggggacgtcacccctaaaatctggccttcccagctgcttgtggtgattatgatatgtgtggcccttgtagtgctcccacttcagttcgaggaattggtttatctctggatggagagacagaagtccggcggaaactattctcgccatagggcccagacagagaagcatgtagtactctgcgtttctagcctgaaaatcgacctgctgatggactttctcaacgaattttatgcccatccccggttacaggactattacgtggtcattctttgcccaactgaaatggatgtgcaggttagaagggttctgcaaatcccgctgtggtcgcagcgagtgatctatctgcagggtagcgctctcaaggaccaggacttgatgcgcgccaaaatggacaacggggaggcctgttttatactcagttctagaaatgaggtggaccggactgccgcagatcatcagactatcctgagggcttgggcggtcaaagatttcgcccctaactgcccactctacgtccagatcctgaagcccgaaaacaagtttcatgtgaaatttgccgaccatgttgtctgtgaggaggaatgtaaatatgcaatgttggctctgaattgtatttgccccgcaaccagcactctcattactctgctcgtgcatacatccaggggccaggagggccaggaaagtcctgaacagtggcagaggatgtatggccgttgtagcggcaatgaagtgtatcacatcaggatgggggacagcaaattcttccgcgaatacgagggaaagagcttcacctacgctgcatttcacgcacataagaaatacggggtttgcctcatcggtttaaaaagggaggataataaatctatcctactgaaccctggcccccgacatattttagctgcttcagacacatgcttttatatcaatatcacaaaagaggaaaactccgcattcatctttaagcaagaggagaagagaaagaagagggcatttagtggtcaagggttgcacgaggggcccgcaagactgcccgtccattccattatagccagtatgggaactgtggccatggacctacagggcacagaacaccggccgactcagtctggaggcggtggggggggctcaaaacttgctctcccaacagaaaatggctctggctctcgccgtccctccatcgcaccagtgctagaactggccgactccagtgccttgctgccgtgtgacttgctttcagaccagtctgaggatgaagtgacgccgtctgatgatgagggactgagcgtggtggagtatgtgaaaggctacccccccaattctccctacattggcagcagccctaccctctgccacctacttcctgttaaggctcccttttgttgcttacgccttgataaaggttgtaagcataattcttatgaggacgcaaaagcatacgggttcaaaaataaactcatcatagtgagcgcggaaactgctggaaatgggctgtataattttatcgtcccactgagggcatactacaggtcgagaaaagagctgaacccaattgttctgttgctggacaacaaacccgatcatcattttcttgaagccatttgttgtttcccaatggtctactacatggaggggtctgtcgacaacttggattctcttctccagtgtggaatcatctacgccgataatcttgtggtggtggataaggagagcacaatgagtgctgaggaagactacatggccgatgcaaaaactattgtgaacgtgcagactatgttccgtctgttcccctctctctccatcaccacagagctgacccaccccagcaatatgcgcttcatgcagtttcgcgccaaagatagttacagtctggctttaagcaaacttgagaagcgcgaaagggagaacggatctaacctcgctttcatgttcaggctacccttcgccgctggtagagttttttcaatctcaatgctggacacgctgttataccagtctttcgtgaaggactacatgattaccatcactcgactgcttctgggcctggacacaacccctgggagcggttacctctgtgcgatgaagatcacggagggagatttgtggattcgaacatatggtcgtctttttcagaagctttgtagttctagcgccgagatccccatcggcatctacaggacagagagtcatgtattctctacttctgagccccacgatctgagagcgcagtctcaaatctctgttaacgtggaggactgcgaagatacccgggaagtcaaaggaccatggggaagcagggcagggaccggcggcagcagccaagggaggcataccggaggcggagatcctgcagagcacccgctcttacgcagaaaatcattacagtgggcaaggcgcctgagcaggaaagcacccaaacaggctgggcgcgctgcagccgcggaatggatctcccagcagcgattgtccttgtacaggcgcagcgagcggcaggagctcagtgagctcgtgaagaacagaatgaagcatctgggtcttccaaccacaggatatgaagacgtggccaacctcacagcatccgacgtgatgaaccgggttaacctcggatatttgcaggacgagatgaacgaccaccagaacacactgagctacgtgcttattaaccctccgcctgatacacgacttgagcctagcgacatcgtatacctaattagaagtgaccctcttgcacacgtagcttctagcagtcagtcccgcaagagttcgtgctcacacaagctttcctcgtgcaatcctgaaactcgggacgaaacacagctctag

SEQ ID NO: 129408 - DNA, 3708 bp, Artificial Sequence
  Description of Artificial Sequence: Synthetic coding sequence
atgcctctccccgacggcgcccgcacccccggcggcgtgtgtcgagaggcgcgaggaggaggctacacaaatcgaactttcgagttcgatgacggacagtgtgctccccgccgcccgtgcgcaggggacggggcccttctcgacactgcaggatttaagatgtctgacttagattctgaggttctaccactcccgccacgctacaggttcagggatctgctgctgggtgatcctagtttccaaaatgatgatagggtgcaggtggagttttacgtgaatgagaatacattcaaagaaaggctcaagctgttctttattaagaaccagcggtccagtcttcgaatcagattattcaacttctcccttaagcttcttacttgtctgctgtacattgtgcgagttctcttggacgaccctgctctcgggattggttgctgggggtgccccaagcaaaattattccttcaatgacagctcctctgagatcaactgggcccctattttatgggtggaaagaaagatgactctttgggccatccaagttattgttgctattatcagctttttggagactatgctgttgatctacctgagctacaaaggcaacatctgggagcagatctttagggtgagtttcgtgctggagatgatcaatacactgccatttatcatcacaattttctggcccccgctacgaaacttgtttatccccgtgttcttgaactgttggctggctaagcacgctctggagaatatgatcaatgattttcaccgagctattctgcgcacccagtccgccatgttcaatcaggttttaatcctcttctgcactttgctctgtctggtgtttacaggcacatgcgggatacaacacctcgaacgcgcgggagagaatttatcactacttacaagtttctatttctgcattgtcaccttcagcaccgtgggttacggcgatgtgacacctaaaatctggccttctcagttgctcgtggtgatcatgatctgcgttgccctggttgttctgccacttcagtttgaggaacttgtttacctgtggatggagagacaaaagagtggaggtaactactctaggcacagggcgcagactgagaagcacgtcgttctgtgcgtctcatctttaaaaattgaccttctgatggacttcttgaatgagttctatgcccatcctcgcctccaggattattacgtagtcattctgtgtccgactgaaatggacgtacaggtgaggagagtcctacagattcccctctggtcacagagggttatttacctccagggctctgcactgaaagaccaggatttgatgcgcgcaaaaatggataacggagaagcttgcttcatcctgtcaagtcggaatgaagtggataggaccgccgcagaccatcaaactatcctccgcgcttgggccgtgaaagacttcgcacccaactgcccactttacgtgcaaattctaaaacccgagaacaagttccacgttaaatttgccgaccacgttgtatgtgaggaggagtgtaaatacgctatgctcgcgctcaactgcatctgtccagctacgagcactttaatcacactcctggttcatacctcccgcgggcaggagggacaagaatccccagaacaatggcagcgtatgtatggacggtgctctgggaatgaggtgtaccacataaggatgggggactcgaagttctttcgagagtatgaaggcaagagctttacttacgcagctttccacgctcacaaaaagtatggggtatgcctaataggtctgaagagggaggacaacaagtccatcctgctgaatcccggaccaaggcatatcctcgctgctagcgacacctgcttctacattaatattactaaagaggagaatagcgcgttcattttcaaacaagaggaaaaacgcaagaagcgagccttttctggacagggtcttcacgaaggtcccgcgcggcttcccgtacattcaatcatagcaagcatgggaaccgttgcaatggatctacaaggtaccgaacaccgcccaacacagtctggcggcggaggtggaggttctaagctggccttgccgactgagaatgggtcaggctcaagacggccaagcatcgcgcctgttctagaattggcagactccagtgctctgctcccttgtgacctgcttagtgatcagagcgaagatgaggtgactccgagcgatgacgagggcctctctgtggtggagtatgtcaagggatatcccccaaattcaccctatatcggatccagtccaaccctctgccacttgctccccgtgaaggcccccttctgctgccttcggctcgacaagggttgcaagcataactcttatgaagatgcgaaggcgtacggcttcaagaacaagctcattatcgtgtctgctgaaaccgcaggtaatggtctctataacttcatcgtgcctctgagggcctactacaggtctagaaaagaactcaatcctatcgtgttgctgcttgacaacaaaccagaccaccactttctagaggctatctgctgctttccaatggtatactacatggagggtagcgtcgataatctcgactctctgttacagtgcggcattatttacgcagataacctggtcgttgttgataaggagagcactatgtctgccgaggaagactatatggccgatgccaagacaatcgttaacgtccagacaatgttcagactattcccatcgctgtccatcacaactgaacttactcaccctagtaatatgagatttatgcaattcagggccaaggacagctattctctcgcgctgtctaaactggagaagagggagcgggagaacggatcaaatcttgcctttatgttcaggctgccattcgcggctggcagggttttcagtattagcatgctggatacacttctgtatcagtctttcgttaaggactatatgatcactattacacggctgcttctcggtctcgataccacgcctggaagtggatacttgtgcgcaatgaaaattacggagggcgatttatggatcagaacctacggccgactttttcaaaagctatgcagctcttccgccgaaatcccaattggcatctatagaacggaaagccacgtgttcagcacctctgagccccacgacctgagggcccagtctcagatttctgttaatgttgaagactgcgaggacaccagggaggtgaaaggaccctggggatccagagcaggcacaggagggagctcacagggaagacatacaggaggcggagacccagccgagcatcccctactgagaaggaagagcctgcagtgggccagacgcctcagcaggaaagctcctaaacaggccggaagagcagctgctgctgagtggataagccaacaacgtctgtctctgtatcgaagatcggaacggcaggaattgagcgaattagtgaaaaatagaatgaaacatttgggcctccccacgaccggatatgatgaaatgaacgaccatcagaacacactaagttacgttctcattaatccccccccagataccagactggaaccttctgacatcgtttatttgatacgttcagatcctctggcccacgttgcctcaagttcacaatctcgcaaatcctcctgttcccacaagctgtccagctgcaaccccgaaacacgtgacgaaacccaactgtag

SEQ ID NO: 129409 - DNA, 3408 bp, Artificial Sequence
  Description of Artificial Sequence: Synthetic coding sequence
atggtggacctggaaagcgaggttccccctctgccacctaggtaccggtttcgagacctccttttgggggaccagggatggcagaacgacgaccgcgttcaggtggagttctacatgaacgaaaatacttttaaagagcggctgaaattgttcttcatcaagaaccaacgcagtagcctccggatcaggctattcaacttcagtctaaaactcctcagctgtctgctctacataatcagggttctgctggagaatccctcccagggcaacgagtggtcccatattttttgggttaaccgctctctacctctgtggggtcttcaggtcagtgtggcgctgatatctctattcgagacgatactcctcggatatctctcatacaaggggaacatctgggaacagattctgcggatcccattcatcctggaaattatcaatgccgtgcctttcattataagtattttttggcccagtctccggaatctcttcgtgccagtgttcctcaactgttggctggcaaagcatgctttagagaatatgatcaatgatctgcatcgggccatccagcgaacgcagtctgctatgtttaaccaggtgctaatactgatctcaaccctgctgtgcctgattttcacctgtatatgtgggatccagcacctggaaagaattggcaagaagctgaatctttttgactctctctatttttgcattgtgaccttctctactgtgggcttcggtgatgtgacccctgaaacctggtcgtcaaaattattcgttgtggccatgatctgcgtagctttggtagtgttgcctattcaattcgagcagctggcctatctgtggatggagagacaaaagtccggaggtaactattctagacacagggcgcagaccgagaaacacgtcgtactgtgtgtatccagcttaaagatagacctactcatggactttctgaatgaattctacgcacaccctaggctccaggactactacgtcgtaatcctgtgtcctacggaaatggacgttcaggtacggagagtcctgcagattccaatgtggtctcagagagtgatatatctccagggatccgcactgaaggaccaagatctgctgcgagcgaaaatggatgatgccgaggcttgttttatcttaagttccagatgcgaagtagatagaactagcagcgaccaccagacgattttaagggcctgggccgtgaaggattttgccccaaactgcccgctgtatgttcagatcctgaaaccagagaacaagttccacataaagttcgctgaccacgttgtgtgcgaagaggagttcaagtacgccatgctcgctctgaattgtatctgtccggccacctccactctgatcacacttctggtccatacatcccgcggccaggaggggcagcagtcccccgagcagtggcagaaaatgtatggcaggtgttctggaaatgaggtttatcacatcgtcttggaggagagtaccttcttcgctgaatatgagggcaaatcattcacttatgcgtcttttcatgcccataagaaatttggcgtttgtctgatcggagtccggcgggaggataacaagaacatcctcttgaacccgggccccagatatatcatgaactccaccgacatatgtttttacatcaacatcacaaaagaagaaaacagcgcttttaagaatcaggaccagcagcgaaagtccaatgttagcagatcgttctaccacgggccatctcggcttcctgttcattcaatcatcgcctccatgggtacagttgcgatcgatctccaggacacatcttgtagaagcgcaagtggccctacactcagccttcctaccgaaggatcaaaagagatcagaagaccctccatcgcgccagttcttgaggtcgctgatacttcaagcatccagacatgcgaccttctctcggatcagagcgaagacgaaacaacacccgacgaggagatgagctctaacctagaatacgcaaaggggtaccccccgtattctccgtatataggtagcagccctactttctgccacctgcttcacgagaaggttcctttttgttgcctccgtctggacaaaagctgtcagcacaattactacgaagatgcaaaagcctatggcttcaaaaacaaacttattatcgttgccgctgaaaccgcaggtaatggtctttacaattttatcgtgcctcttagggcctactaccggccaaaaaaagagcttaatccaatagtgctcctattggataaccccccagatatgcacttcctcgatgccatatgttggttcccgatggtgtactatatggtcggtagtattgacaacctagatgacttattacgatgtggcgtgaccttcgcagcgaacatggttgtggtcgataaagaatcaacaatgtccgcggaggaggactatatggccgacgccaagaccattgtgaacgtccagactctgtttcgcctcttttcatcactgtccatcataaccgaactgactcaccctgccaacatgaggttcatgcagttcagggcgaaggactgctattcccttgcactgtccaagctggagaagaaggaacgggagaggggtagcaatctggcatttatgtttagactcccattcgcagctggaagggtgttttccattagtatgctcgatactttgctgtaccagtctttcgtgaaagattatatgatatcaattaccagacttctactagggttggacacgactccagggtccggcttcttgtgctccatgaaaatcaccgccgacgacctgtggatcagaacctatgccagactttatcaaaagctatgctcttccactggagatgtccctatcggcatatacagaactgaaagtcagaagctgactacctccgagtcgcaaatcagtatcagcgtggaagagtgggaggacaccaaagatagcaaagagcagggtcatcataggtccaaccatcgtaatagtacatcgtccgaccaaagcgaccacccacttctgcgcaggaaaagcatgcagtgggctagacgtttgagtcggaagggacccaagcactctggcaagacagcagagaagataacccagcagcggctgaatctgtataggcggtccgaaagacaggaactggcggagctggtgaagaaccgcatgaaacacctggggctgtccacagtggggtatgacgaaatgaacgatcatcaatccacactctcttatattcttatcaatccctcccctgatacccggatagaactgaatgatgtggtgtatctcattagacccgaccccctcgcgtatctccctaattccgaaccatcccggcgcaattcaatttgtaatgtcactggccaggattcccgagaggagacacaactttag

SEQ ID NO: 129410 - DNA, 3210 bp, Artificial Sequence
  Description of Artificial Sequence: Synthetic coding sequence
atggtagatttagagtccgaagtgccaccattgcccccacggtacagatttcgagatctccttctgggcgatcagggatggcagaatgatgatcgggttcaggttgagttctatatgaatgagaatacctttaaggagcgcctcaagctgttcttcattaaaaaccaaaggagttcactcagaatcagactgttcaacttctctttgaagctgctgtcctgccttctgtatatcatccgtgtcttactggagaacccatcacagggcaatgagtggtcccacatcttttgggtaaatcgcagcctgccgctgtggggcctgcaggtgagcgtggcactgatctcgctgttcgagaccatcctgctgggctatctgtcctataagggaaacatctgggagcagatcctccggatcccctttatcctggagatcatcaatgccgtaccttttataatttccattttctggccatctttgagaaacctgtttgttcctgtgttcttgaattgttggctcgccaagcacgcactggagaatatgataaatgacctgcatagggctatccagcgaacgcagtccgccatgtttaaccaggtgctaatcttgattagtaccttgttgtgtctgatcttcacctgtatttgcgggatccagcatctggagcgaatagggaaaaagttgaatttattcgattctctttatttctgtattgtcactttctcgacggtggggttcggggatgttacccccgagacgtggagttccaagctttttgtggtcgcaatgatctgcgtggctctcgttgtgttgcccattcaatttgagcagctcgcttatttgtggatggagaggcagaaaagtgggggaaactatagccgacatagagcacagacagaaaaacatgtggtgctgtgtgtcagttccctcaaaatcgacctgctcatggactttttaaatgagttttacgcgcacccccggttgcaggattattacgtagtgatattgtgccccacggaaatggatgtgcaggtgcggcgcgtgttacagattcccatgtggtcgcagagagtgatctacctacaggggagcgctttaaaggatcaggatttgctccgggccaaaatggatgacgccgaagcttgtttcatcttaagcagccgctgcgaggtggacagaaccagctccgaccaccaaaccattcttcgcgcctgggcggttaaggatttcgcaccaaattgtcctctctatgttcagattctgaaacccgagaacaagtttcacataaagttcgccgatcatgtggtttgtgaggaggaattcaagtacgccatgcttgccttaaattgtatctgccccgccacatccaccctcattaccctactggtgcacacgagcagaggacagttcggcgtctgccttattggggtccgcagggaagataataaaaacatcctactgaaccccgggccacggtacattatgaatagtacagatatttgtttctacataaatattaccaaagaagagaacagtgcattcaagaatcaggaccagcagcggaagagcaacgtgtctagatccttctaccacggtccatccaggctgcccgttcactctatcattgcctctatggggacagtcgcaatcgatctgcaagatacaagctgtaggagcgccagcgggccaacactttctttgcctactgagggcagtaaagaaatcagaagaccatcaatcgcccccgtgttggaggtcgcagatacctcaagcatacagacttgtgatctgctgtctgaccagtccgaagatgagaccacccctgacgaagaaatgtcaagcaaccttgagtatgctaaggggtacccaccctattcaccatatatcggaagttctcccaccttttgccatcttctacacgagaaggttcccttctgttgtctgaggctagataagtcttgtcagcataactactacgaggacgccaaagcttatggttttaaaaacaaactgattatagtcgcagccgaaaccgctggtaatggtctgtataatttcattgtgccactgcgagcttactaccgccctaagaaggagttgaaccctattgtactcctgctggacaatcccctggatgatctactgcgatgcggagtgacctttgcggctaatatggttgtggtggataaggagtctaccatgtcagctgaggaggactacatggctgacgcgaaaaccatcgttaacgtccagacactgtttcggttattttcctctttgagcatcattaccgagttgacgcatcccgctaacatgaggtttatgcagttcagagcaaaagactgctatagcctcgctctgagcaaacttgagaagaaggagcgggaacggggatccaatttagccttcatgttccgtttacctttcgcggccgggcgtgtgttctccatttctatgctcgacactctgttgtatcagagcttcgtcaaggactacatgatctctatcacccgactgctcttgggactggataccacccctggttctgggttcctgtgctcaatgaaaatcaccgcagacgatctgtggataaggacatatgctcgactgtatcagaaactgtgctctagtactggggacgtgcccatagggatatatcgtactgagagtcagaaactgacaacaagcgaggagacctacatacttatttttctgtctcagatttctatctctgtggaagaatgggaagacacaaaagatagtaaagagcagggccatcatagatctaatcatagaaactctacttccagcgatcagagcgatcacccgctgctgcgaagaaagtcaatgcagtgggcccgccgattatcaaggaaggggccaaagcactccggtaagacagcggagaagataacacaacagcggttgaatttgtaccggcgttctgaacgccaggagctcgccgagctggtcaaaaataggatgaaacaccttggcctgagcaccgtgggatatgatgaaatgaatgatcatcagtccactttgtcctacatcttgattaacccttcccctgacacaaggatcgagctgaacgacgttgtctacctgatcaggcctgatcctcttgcataccttccgaacagtgagccaagcagacgcaatagtatttgcaacgtgactggacaagacagcagggaagaaacacagctgtag

SEQ ID NO: 129411 - DNA, 3336 bp, Artificial Sequence
  Description of Artificial Sequence: Synthetic coding sequence
atggtggatcttgagtctgaggtgcctcctctccccccacgctatcggtttagggatctgctgcttggggaccagggttggcagaatgatgatagagtgcaggtcgagttttatatgaatgagaacacattcaaagaacgactgaagttgttctttattaagaaccaaaggtctagcctgcggatccgcttattcaactttagcctcaagctgttgtcctgtttgctgtatattatcagagtactcctggaaaatccatcccagggaaacgagtggtcgcacatcttttgggtaaacaggagcctccccctctgggggttgcaagtatctgtggcgcttatcagcctattcgagacaatccttctcgggtacctgtcgtataagggaaacatctgggagcagatcctgagaatcccatttatcctggagatcattaatgctgtccccttcataatatctatattctggccttctttacgaaatctgttcgtcccagtgtttctgaactgctggttagctaaacatgcgctggagaacatgattaatgacttgcatagagcaattcagcgcactcagagcgccatgtttaatcaagttctgattctgatcagcaccctgctgtgccttattttcacctgtatatgtggaatccagcacctcgaaagaatcggcaaaaagctcaatctatttgacagcctgtacttttgcattgttactttctctacagtaggattcggagatgtgacaccagagacctggtcgagtaagcttttcgtggtggctatgatttgcgtggcacttgttgtgctaccaatccagttcgaacaactggcatacctgtggatggagagacaaaaaagcgggggtaattacagccggcatcgagcccagactgagaagcacgtggtcctgtgtgtgtcaagtctgaaaatcgatctacttatggatttcctgaatgaattctatgcccaccccaggctgcaagattactacgtcgtcatactctgcccaactgagatggatgtgcaggtgagacgggttctccagatccccatgtggtcacagagggtgatttaccttcagggcagcgccctgaaagatcaggacctgttacgtgctaaaatggatgatgccgaagcctgctttattcttagcagcaggtgcgaagttgacaggacaagttccgatcaccagactatactccgagcctgggctgtgaaagacttcgctccaaactgcccgttgtacgtgcagattctcaaacccgagaataagtttcatatcaagtttgccgatcacgtggtttgcgaggaggaatttaagtatgctatgctggctttgaattgtatctgtcccgctacaagtactctcataaccctgttagtgcatacatcacgcggacaagagggccaacagtcacctgagcagtggcagaagatgtacgggcgctgctcaggtaatgaagtgtatcatatcgttctggaggaaagtacgtttttcgcagaatacgaggggaaaagtttcacatatgcctcctttcacgcccataaaaagttcggtgtgtgtctgataggtgttaggcgggaagacaacaagaatatactgctgaaccctggtcctcgctatattatgaactcaacggacatttgtttctacattaacattacgaaagaagagaacagcgcctttaaaaaccaagaccagcagaggaagtcaaacgtaagccgcagtttctaccacggccccagcaggctgccagtccattctatcatagccagcatgggcacagtggctatcgatctccaggatactagctgtcgaagcgcctcggggcccaccctctctcttcccacagaggggagtaaggagatcagacgccccagtatcgcacctgtgttggaagtggcagacacctctagcatccagacttgtgacttgctgtccgatcagagtgaggatgagacaaccccagacgaagagatgtcttctaatttggaatatgcaaagggatacccaccctattctccgtatatcgggtcctcgcccacattttgccacctgctccacgaaaaagtcccgttttgctgcctcaggttggataagtcctgccaacataactattacgaagatgccaaggcttacgggtttaagaacaaactgattatcgtagccgccgagaccgccggaaacggcctctataactttatcgtgccacttcgggcttattatcgcccaaagaaggaattgaatccgatcgtccttctcctcgacaatcccttagacgatcttctgcgctgcggggttacattcgcagccaatatggtcgtcgtggacaaggaatccacaatgtccgctgaggaggattacatggccgatgccaaaaccatcgtgaacgtgcagacactatttcgactattttcgagcttgtctatcatcaccgagctgacgcacccagcaaatatgaggttcatgcagttcagggccaaagattgctatagcctggctcttagcaaactcgaaaagaaggagagagaacggggctcgaacctcgccttcatgtttaggctcccatttgccgccggccgtgtgtttagtatcagtatgttagataccctcctgtatcaatcttttgtcaaggattacatgatcagcataacgcggcttctgctggggttagacacaacccctggttcggggtttctgtgttccatgaagatcaccgcagacgacctttggattaggacttacgctcggctttatcagaagctgtgctcatcaaccggcgatgtgccaatcgggatttatcgaactgagtctcagaaactgactacgtccgagtcacagatctccatcagcgtggaagagtgggaggacacaaaggacagcaaggaacaaggacaccaccgcagcaaccataggaatagtacgtccagtgatcagagtgatcatccgctccttcgacggaagtccatgcagtgggctaggcggttgagcaggaaaggccccaaacatagcggtaagaccgctgagaagatcacacaacagcgacttaatctgtatagaagatccgagcgccaggagctggcagagctcgtgaagaatagaatgaaacaccttgggctatctactgtaggctacgatgaaatgaatgatcatcagtcaaccctctcatacatcttgataaacccttccccagacacacgaatcgagctcaacgatgtagtgtatctcattcgacctgatcctctagcgtacctcccaaacagcgaaccctcccgccgaaatagcatttgtaacgttaccggacaggatagcagagaggagacacagctttag

SEQ ID NO: 129412 - DNA, 1113 bp, Artificial Sequence
  Description of Artificial Sequence: Synthetic coding sequence
atgccatatcttcacttagatcaccagacgatcctgagggcctgggccgtcaaagattttgcgcccaattgtccattgtacgtccagattcttaagccagaaaacaagttccacatcaagttcgctgaccacgtcgtgtgcgaggaggagtttaagtacgcaatgctagcgcttaattgcatatgcccagccacgtctacccttattaccctgctagtccacacgagccgcggccaggagggacagcaatcacctgaacaatggcagaagatgtatggccggtgttccggcaatgaggtgtaccacatagtcctggaggagtccaccttttttgctgagtacgaaggaaagagttttacatacgccagctttcatgctcacaagaagttcggggtctgcctgatcggcgtcaggagggaggataataagaacattttgttaaatcctggccccaggtatatcatgaatagtacggacatttgcttctatattaacataactaaggaagaaaatagcgccttcaagaatcaagaccagcaaagaaagagcaatgtgagtaggtcattttaccatggcccctcacgcctcccggtgcattcaattatcgctagcatggggaccgtggctatcgacctgcaagatacgagctgtcgaagcgccagtggacccacgcttagcctgcccacagaaggctcaaaggagattcgcaggccgtcaattgcccctgtactggaggtagctgacacctcctcgatccagacctgtgatctgctgtctgaccagtccgaggatgagaccacccctgacgaagagatgagctcaaacttggagtacgccaaaggctacccaccctattcaccctatatagggtcctctcctaccttttgccacctgcttcatgagaaagtgcctttttgctgcttgaggcttgacaagagttgtcaacacaattattacgaagacgccaaggcatacggcttcaagaacaagctcattattgttgcagcagaaactgctgggaatggcctttataacttcatagttccactacgagcctattacaggcctaagaaagagttgaatcccatcgtgttgctgcttgataatccatag

SEQ ID NO: 129413 - DNA, 1572 bp, Artificial Sequence
  Description of Artificial Sequence: Synthetic coding sequence
attattaatgacctccaccgggcaatccagcggacacagagtgctatgtttaaccaagtgctgattcttatctctacgcttttgtgtctcattttcacctgtatctgcggtattcagcatttggagcgaatcggcaagaagctcaacctgttcgactccctctacttttgtattgtgaccttttccacagttggtttcggggacgtgactccggagacctggagttctaaactcttcgtggtagctatgatttgcgtagccctcgttgtccttccgattcagttcgaacagctggcatacctgtggatggagaggcagaaaagtggggggaactattcgcgacaccgggcacagactgagaagcatgtcgtcctgtgtgttagttctttaaaaatcgaccttctcatggattttctcaacgaattttacgcacacccacggctgcaagactattacgtggtgattctgtgccccaccgaaatggatgtgcaggtgcggcgtgtactacagatcccaatgtggagccagagggtgatctatctgcagggatctgccctgaaggatcaagacctcctcagggctaagatggatgatgccgaagcgtgctttatactcagctcaaggtgcgaagtggatcggacctccagcgaccatcagacgattctacgagcttgggcagtaaaagacttcgcacctaactgccccttatacgtccagatcctaaaaccagaaaataaattccacatcaaatttgcggaccacgtggtctgtgaggaggaattcaagtatgctatgctcgccctgaattgcatctgccccgctacgtctactctgatcacactgctggtgcatacttctagaggccaggaagggcaacagtcccctgaacaatggcagaaaatgtatggaagatgtagcggcaatgaggtatatcatattgttctggaggagtcaaccttcttcgctgagtatgagggcaaatccttcacctatgcctcttttcacgcacataaaaaatttggggtgtgtctcatcggagtacgtcgcgaggataataagaacatattgcttaacccggggccacgatatataatgaatagtactgacatttgtttctatattaacattacaaaagaggaaaatagtgcttttaagaaccaagaccagcagaggaagtcaaatgtctcccggagcttttatcatggtccatctaggctgccagtgcacagcattatcgctagtatgggaacggtagcaatcgatctccaggacacgtcctgccgctcggcttctggtcccaccctaagtctgccaaccgaaggcagtaaggaaatccgtagacctagtatagctcctgtgctcgaggtcgccgatacttcttcaatccagacctgcgacctgctttctgaccagtcggaggacgagaccacaccagacgaagaaatgagctccaatcttgaatatgcgaaagggtacccgccatacagcccctatatcggatccagccctaccttttgtcacctgctgcacgaaaaagtgccattctgctgtctgcgcctggacaaattttag

SEQ ID NO: 129414 - DNA, 1503 bp, Artificial Sequence
  Description of Artificial Sequence: Synthetic coding sequence
atgccctcttccgggagagccctactggactcaccccttgattccggaagtctgactagcctggattcatccgtcttttgttctgaaggcgagggggagccccttgccctgggagactgtttcaccgtgaacgtggggggctcccgttttgtgctgtcccaacaggctttgagttgttttccccatacccgtctgggtaagcttgccgtggtggtggcaagttaccgcagacctggcgcgctggctgcggtgccttctcccctggaattatgtgacgatgccaacccggtcgacaatgaatatttcttcgatcgcagctcacaggctttcagatatgtactgcactactatcggactgggagacttcatgtaatggagcagctgtgcgccctcagtttcctacaggagatccagtactgggggattgatgagctgtccattgactcctgctgtagggacagatacttccggaggaaagagctctccgaaacgctcgacttcaagaaagataccgaggatcaggaaagtcaacacgagtcagagcaggatttttctcagggtccgtgccccacagtccgacaaaagctatggaacatcctagagaaacccggatcatccaccgccgcccgcatttttggcgtgatctctataatttttgtggtagtgtcaataatcaatatggcccttatgagtgccgagctgtcatggctcgatttacagctcttggagattttggaatacgtctgtatttcctggttcactggagaatttgtgctgcgattcctctgcgtcagagaccggtgccgcttcctcagaaaagtccccaatatcattgacttgctagccatcctgcctttttacattactcttctggtggagtccttatctgggagccagaccactcaggagttagaaaacgtggggagaattgtgcaggtacttcggctgcttagggcgcttcgcatgctgaagcttggccggcattcaaccgggctgcgctctctaggaatgacaatcacccagtgttatgaggaagtggggctcctgctgcttttcctcagtgtgggcattagtatcttttccacagttgaatacttcgctgagcagtctatacccgacacgacatttacaagtgtgccttgcgcctggtggtgggcaactacatcaatgacaacggtcgggtatggggacatccgtccagatactaccactggtaagattgttgcctttatgtgcatcctgagcggcattctggtcctggccctgcctatcgcgatcatcaatgatagattttccgcatgttattttaccttaaaactgaaagaagccgctgtgcgacaacgcgaagcactcaagaagctcactaagaatatcgctaccgacagctacatcagtgttaatctccgcgacgtgtacgcaaggtcaatcatggagatgctccgcctgaagggaagggagagggcttccacccggtcttctgggggtgatgatttctggttctag

SEQ ID NO: 129415 - DNA, 1503 bp, Artificial Sequence
  Description of Artificial Sequence: Synthetic coding sequence
atgccctcgtccggaagagcgttgctggacagtccgcttgattccggctcactcactagcctggatagctcagttttctgttcagagggcgagggagagcctctggccctaggcgactgctttacagttaatgtgggcggctcacgatttgtactgtcccagcaggccctgtcatgtttcccacacacaaggcttggaaagctcgcagtcgttgtggcttcttatagacgacctggcgccctggctgccgtcccttcaccactcgaattgtgtgacgacgccaaccctgtggacaatgagtactttttcgacagatcttcacaggctttccgctatgtgctgcattactaccgcaccgggagattgcacgtgatggagcaactctgcgcactttcgtttttgcaggaaatacagtattggggcattgacgagttgagcattgacagctgctgtcgcgatcggtactttcgacggaaggaactctcggagacactggactttaagaaggacactgaagatcaggagagccagcacgagtcagagcaggatttctcacagggaccatgtcctacagtcaggcaaaagctgtggaacatcttagaaaagccaggttcaagtacagcagccagaatcttcggagttatctctatcatcttcgtcgtggtgagtatcatcaacatggcccttatgagcgccgagctctcatggctagacctgcaactgctggagatccttgaatacgtctgcatctcttggtttacgggtgagttcgtactcaggtttctttgcgttcgcgatcgctgccgctttttgcgtaaagtgcccaatataatcgacctgctggccatactgccgttttatataaccctcctcgttgagagcctgagcggctctcaaacaactcaagaacttgaaaatgtcggtaggatagttcaggttcttcgcctgttgcgcgctctgcggatgctaaagctcggcagacactctacaggcctgagaagtctcggcatgactattactcagtgttatgaagaagtggggctccttctgctttttttatctgtagggatcagcatttttagcaccgtggagtatttcgccgagcagtctatcccagatacgacattcactagcgttccctgtgcctggtggtgggcaactacatctatgacaacagttggctatggtgatatccgacctgacaccacgacagggaagatcgtggcattcatgtgcatcttaagcggaatcctcgtcttggctctgccaattgctatcataaacgataggttttctgcctgttactttacgctgaaactcaaggaggcagctgtgaggcagcgggaggccctgaagaaattgactaaaaacatcgccaccgactcttacatcagcgtgaacctgcgcgatgtctatgccaggtccatcatggagatgctccgcctaaagggacgagagagagccagcacaagatcatcgggcggtgatgacttctggttctag

SEQ ID NO: 129416 - DNA, 1131 bp, Artificial Sequence
  Description of Artificial Sequence: Synthetic coding sequence
atggaacagctatgcgctctcagtttccttcaggagattcaatattggggcatcgatgaacttagcatcgacagctgctgcagagaccggtacttccgcagaaaggaactgtcagaaacccttgatttcaagaaggacacagaagaccaggagagtcagcatgagagcgaacaggacttctcccagggtccatgtccgacagtccgacaaaaattatggaatatcctggagaagcctggatcatctaccgcggcacgtatcttcggcgttatctctataatattcgtggtggtgtctataattaacatggcgctgatgtcagccgaactttcctggcttgatcttcagctcttggagatcctcgagtacgtctgtatatcttggtttacaggggaatttgtgctgcggtttctatgcgtgagggatcgatgtcggttcctgagaaaggtacctaatattattgacctactggccatcctgcctttctatatcaccctgctggtggagtccctgagcggcagccaaacgacccaggagctggagaatgtcggcaggatcgttcaggtgctgagacttctgagggccctgcgaatgctgaaactgggccgccattctaccggcctccggtctctggggatgaccattactcagtgctatgaggaggttggtcttctcctgctgttccttagcgttgggatctctattttctcaacagtggaatattttgcggaacaaagcatccccgacacgaccttcacctcggtgccttgtgcttggtggtgggctaccacgtcaatgaccaccgtgggctatggggacatacggccagatacaacaacaggcaagatcgtcgcctttatgtgcatactatctgggattctggttcttgctctgccaattgcgatcattaacgatagattcagtgcatgttactttactttaaaacttaaagaggcggccgtccgccagagggaagcgttgaagaaactcactaagaacatcgcgacggattcatatatcagcgtgaacctccgggacgtgtacgcaaggtccatcatggaaatgctgcggctgaagggtagagagagggcctctactcgtagcagcgggggcgatgacttctggttttag

SEQ ID NO: 129417 - DNA, 1638 bp, Artificial Sequence
  Description of Artificial Sequence: Synthetic coding sequence
atgctgaaacagtccgagcgccggagatcatggtcatatcggccctggaacaccacagagaatgaagggtcgcagcatcggaggtcaatctgttccctaggagctcgtagtggaagccaggcctccatccacggctggacagaaggaaactacaattactacattgaggaagacgaggacggcgaagaagaagaccagtggaaggatgatctagctgaggaggaccagcaggcaggcgaagtcacaacggctaagcccgaagggcctagtgacccacctgctttgctcagcaccttgaatgtaaacgtggggggccattcctaccagctggactactgtgagttggccggctttcctaagacgagactcggtaggctggcaacctcgactagtcgaagtcggcagctaagcttatgtgatgattatgaggagcagacggacgagtacttttttgatagagaccccgccgtttttcaacttgtgtacaatttctatctgagcggcgtcctcttagttctggacggtctttgtcccaggcgcttcctggaggagctgggttattggggtgtacgactgaagtacacacctaggtgctgccggatatgcttcgaggaaagaagggacgagctgtctgaaagacttaaaatccagcatgagctgagggcacaagcccaggtggaagaggctgaggagctgttccgtgacatgcgattttatggccctcagcggcgaagactgtggaatctcatggaaaaaccctttagcagcgtcgcagccaaggccatcggcgtggctagttccacattcgtcctcgtgagcgtcgttgcgcttgctttgaacacagtcgaagaaatgcaacagcactccggacagggcgaaggcggccctgacctgcgcccgatcctcgaacatgtcgagatgctgtgtatgggattcttcaccctggaatacctcctccgtctcgcttctaccccagacttacgcaggtttgcccgctccgcacttaatcttgttgacctggtagccatcctgccgctatatctccagctgctgctggagtgttttactggggaaggtcaccaacggggccagacagtgggaagtgtgggaaaagtaggccaagtccttagagttatgaggctgatgcgaattttccgcatcctcaagctcgcacgccattccaccggactgcgggctttcggatttacccttaggcagtgttaccagcaggttgggtgccttttattgtttatcgctatgggaatttttactttttccgcagccgtctatagtgtggagcacgatgtcccctctaccaacttcacaaccattccacacagctggtggtgggcagccgtgtctattagtaccgtcggatatggcgatatgtaccccgagacccacctgggaaggttttttgcctttctgtgtatcgcctttgggatcatccttaatgggatgccaattagtatcctgtataacaaattcagcgattactattccaagctcaaggcatacgagtataccacaattcgacgagagcgaggggaggttaattttatgcagcgggccaggaagaagatagccgagtgcctcctgggttcaaacccccaactgaccccccgccaggaaaattag

SEQ ID NO: 129418 - DNA, 963 bp, Artificial Sequence
  Description of Artificial Sequence: Synthetic coding sequence
atgcttaagcagtccgagcgacggcgcagttggtcttatagaccctggaatacaacagagaatgagggctcccagcaccggcggagtatctgctcactgggggccaggtcaggcagtcaggcttccatccatggttggactgaaggcaattataactactacatagaagaagacgaggacggggaggaggaagatcagtggaaggatgaccttgccgaggaggatcagcaagcgggagaggtgactaccgctaaaccggaagggccctccgatccacctgcactactctctaccttaaatgtgaatgtgggcggccactcctaccaactggattactgcgagttagccggtttccctaaaacccgtctgggtcgactcgccaccagtacttcccggagcaggcagttaagcctctgtgatgactacgaggagcagactgacgaatactttttcgaccgcgaccctgcagtctttcaattggtttataatttttatttgtctggggtcctcctcgtcctcgatgggctgtgtcctcggcgatttctggaggagctcggatattggggggtcaggctgaagtataccccaagatgctgccgcatctgttttgaagaacggagagatgagctgtccgaacgtctgaagattcagcatctgagagccagattgaggggcggggcaggggcccagcatagagggggcgacgcagctgcacttggtgccgggagaggtagacccagacccgcagcgcatccaggagcgagaggggacgctgtgcacggactgctccacgcaagagtacccgctgcccccagcctccatgcaagacccgaggcccttcgcgcccagcgtccgcagcccggcggaccaggtggacaccccgccgccttgccatccgcagcagcaagggtcctccatggccggggaccacccaccaggcccgatggggggcagagaggttag

SEQ ID NO: 129419 - DNA, 1740 bp, Artificial Sequence
  Description of Artificial Sequence: Synthetic coding sequence
atgtcctcgtgtcgttacaatggcggggtaatgagaccactgtctaacctctcagcaagccggaggaacctccacgaaatggattccgaggcacagccccttcagccaccagcttctgtaggcggtggcggtggagcttcctccccctcggccgcagcagcagccgccgctgctgtgtcatccagtgcacccgaaattgtcgtgtctaagccggagcacaacaattctaacaatcttgcactctacggtaccggaggaggcggtagcactggcggaggggggggagggggaggtagtgggcacgggtcctcctccggaactaaaagttctaaaaagaagaaccagaatattgggtataagctcggccacagaagagccctcttcgaaaaacggaagagactgtcggattacgccctcatctttggaatgttcgggatcgtggtgatggtgattgaaacagagctgtcttggggcgcctatgataaggcttccctctatagcctagcccttaaatgcttaatctctttgtccacaattatcctgcttgggttgattattgtgtatcacgctagagagatccagctgtttatggtggacaatggtgccgatgactggcggatcgctatgacttacgaacgcatcttttttatttgcctggaaatcttggtgtgtgcaatacaccctattcccggtaattacacattcacctggacagctcggctggctttttcctatgcaccctccactacaactgctgacgtggatatcattctgagtatcccaatgtttctgaggctgtacctgattgcacgagtgatgctgctgcatagcaagctatttactgatgcttcctctagatctattggagctctgaataagatcaatttcaatacccggttcgtaatgaaaaccctgatgaccatctgtcccggaaccgtccttctcgtcttcagtatctccctgtggataatagcggcctggacagtgcgggcttgcgagcgttatcacgatcagcaggatgtgacttcaaacttcctgggcgccatgtggctcatatccatcactttcctgagtattggatacggggatatggtgcccaatacatattgcggaaagggagtctgtctgttaactggtatcatgggcgcaggttgtaccgctctcgtggtggcagttgttgctcgcaaacttgagctcaccaaagcagaaaaacacgtgcataatttcatgatggatacccagctgactaagcgagtgaaaaatgctgcagcaaatgtgctgcgtgaaacttggctgatctacaaaaataccaagctagttaagaaaattgatcacgccaaagtgcgcaaacaccaaagaaaatttttgcaagcgatacaccagttgagatcagtcaagatggagcagagaaaactcaatgaccaagctaacaccctggttgatttggcgaagacgcagaatataatgtacgacatgatcagtgatcttaatgagagatccgaggactttgagaagagaatagtcaccttagaaactaagctagagacgctgatcgggtccattcacgctctgcccgggcttatctcccaaaccattaggcagcagcagcgcgacttcatagaagcccagatggagtcctacgataaacacgtcacatacaacgcagagcgctccaggagtagcagcagaaggaggcgctctagcagtaccgcccctccaaccagctccgaaagctcctag

SEQ ID NO: 129420 - DNA, 696 bp, Artificial Sequence
  Description of Artificial Sequence: Synthetic coding sequence
atgtggctaatctccattacctttctgtctatcgggtacggggacatggtgcctaatacttactgcgggaaaggggtctgtcttctgacaggcataatgggagcggggtgtaccgcgctggtcgtagccgtggttgcaaggaagctagagctgacaaaggccgagaagcatgtgcacaacttcatgatggacacgcagctgaccaagcgagtcaaaaatgctgccgctaatgtgttgcgggagacatggctgatctacaaaaacactaagctagttaaaaaaatcgatcatgccaaggtccgcaaacatcaacggaagtttctccaggctattcatcagctgcggtccgtaaaaatggaacagcgcaagctgaatgatcaggctaacaccctggtggacctggccaagacccagaacattatgtatgacatgatctcagacttaaatgagaggagtgaagacttcgagaaacgcattgtgaccctggagactaagctcgagacgctgatcgggagtattcacgcgcttcctggccttatcagccagaccataaggcaacagcagcgcgacttcatcgaggctcagatggagtcctacgataaacacgtcacttacaacgctgagcggtcacgtagttcctctcgccgacggaggtcgagctccacagcacccccaacttcctcagagagttcttag

SEQ ID NO: 129421 - DNA, 1326 bp, Artificial Sequence
  Description of Artificial Sequence: Synthetic coding sequence
atgtcctcctgtagatacaatggtggagtaatgagacccctgagcaatcttagcgcctctcgccgcaatctgcacgagatggactcagaggcccagccgttgcaaccacccgcgtcagtgggaggcggggggggagctagctccccctccgccgcagctgctgccgccgcggcagtgagctcctctgcgcctgaaattgttgtgagcaaaccagaacacaacaattccaataatctggcgctgtatgggaccggcggaggtggaagcaccggcggtggcggtggggggggcggaagtggacacggctcttcgtccggtacgaagagtagcaaaaaaaagaaccaaaatatcggctacaaactgggacacagacgcgctttattcgaaaagaggaaaagactgtcggactatgctctgatatttggtatgttcggaattgtggtcatggtgatcgaaactgagttatcctggggggcttacgacaaggcatctctgtattccctcgcacttaaatgcctgataagcttaagcacgatcatattgttaggattgataatcgtgtaccacgcaagagaaatccagcttttcatggtggacaatggagccgacgactggcgaattgcaatgacttacgagcgcatcttcttcatatgtctcgagatactggtgtgtgccatccaccccatcccggggaactacacctttacttggaccgccagactcgcattctcatatgcacctagtacaacgaccgcagacgtggatatcatcctctcaatcccaatgttcttgcggctttacttgatcgcaagagtgatgttattgcattccaaactgttcacagatgccagcagtagatctattggcgccttaaataaaatcaacttcaataccagattcgtaatgaagaccttgatgaccatctgccccggaacggtgctgctggtgtttagtatatcactgtggatcatcgcagcctggaccgtaagggcctgcgaacgatatcatgatcagcaggacgtgacttcaaattttttgggggccatgtggttgattagtattacttttctgagcatcgggtatggtgatatggtgccaaatacatactgcgggaagggagtctgccttttaactggcatcatgggggccggctgtactgccctggtggtggccgtggttgctaggaagttggagctgacaaaagcagaaaagcacgttcacaacttcatgatggatactcagctcactaaacgggtctcatactatccctacatcttcaaagagaatatcatagtcattttcagtgtgttgggcaatatggcttag

SEQ ID NO: 129422 - DNA, 2196 bp, Artificial Sequence
  Description of Artificial Sequence: Synthetic coding sequence
atggacacatccggccattttcacgactccggcgtgggtgatcttgacgaggatcccaagtgcccatgccccagctccggagatgaacaacagcagcagcagcagcagcaacaacaacagcagcccccaccgccggcaccaccagccgcgcctcagcaacctctgggccctagtctgcaacctcagcctccgcaacttcagcagcaacaacagcagcagcagcagcagcagcaacaacagccaccacatccactgagccagttagcccagctgcaatcacagccagtccaccccgggctgctgcatagcagtcctaccgcattcagggctcctccctcgagcaatagcacagcgatactgcacccgtcctcaaggcaggggtcacagctgaatctcaacgatcatctcctgggtcactctccaagctcaaccgccacctctggaccaggaggggggtcaagacacaggcaagcatcccctctcgtgcatcgcagagacagcaacccattcaccgagattgccatgagtagctgcaagtactcaggcggcgtgatgaagccactttctcgattgtcagctagccgtaggaaccttatcgaagccgagaccgaaggccagcccttgcagctcttttccccgtctaacccaccagaaatcgttataagttccagggaagataaccatgcccatcagactctcctccaccatcccaatgccacacacaatcaccagcatgccggcaccaccgcatcctcaacgacattcccaaaggcaaataaacgcaagaaccagaacattggatacaagctcggccatcgccgcgcgctgttcgaaaaacgtaagcgccttagtgactatgccctgatctttgggatgttcggcatagtcgtgatggttatcgagacagaattatcatggggcctatattccaaggattctatgttctcactcgctctgaaatgcctgatctcattaagtacaataatcctcctgggtctcatcattgcctatcacacgcgagaggttcaacttttcgtcatcgataacggggccgatgactggcgcatagctatgacatacgagcgcatcctttacatctccctagagatgctggtgtgcgcgattcaccccatcccaggggaatacaagttcttttggacagcacgtctagcgttttcctacactccaagccgggctgaagctgacgtagatatcatcctgagtatcccgatgtttctgaggctgtatcttatcgcccgagtcatgctactgcacagcaaattatttactgacgcatccagccgcagcatcggcgctctgaataagatcaattttaacactcgatttgtgatgaagacactcatgactatctgccccggcacagtgctcctggtattctcgatctccctgtggatcattgcagcctggaccgtcagggtctgcgagcgctaccacgaccagcaggatgtgaccagtaactttctgggcgcgatgtggctgatttccataacctttctgagtatcgggtacggggacatggttccccatacatactgcgggaaaggagtgtgcctcttgacaggaatcatgggggctggatgcaccgcgctcgtggtcgccgtggtagcccgcaaacttgagttgaccaaagccgagaagcacgttcacaatttcatgatggacacacagttgacaaaacggataaagaacgccgcagccaatgttctcagagagacctggttgatttataagcacactaagttactcaaaaagattgatcacgccaaggtcaggaaacaccaacgcaagttcctacaagctatccaccagcttcggtctgtgaaaatggaacagagaaagcttagcgatcaggctaacacactcgttgacctgagcaaaatgcagaatgtcatgtacgacttgatcaccgaattaaatgacagatctgaggatctggaaaaacagatcggctcactggagtccaaactggaacatctcaccgcttcattcaatagcctccctctccttattgccgataccttaaggcagcagcagcagcagctgttgtctgctatcattgaggccagaggcgtgagcgtagcagttggaaccacccacactcctattagcgacagccccataggggtgtcctctaccagcttccctacaccctacacaagctcaagctcgtgctag

SEQ ID NO: 129423 - DNA, 1257 bp, Artificial Sequence
  Description of Artificial Sequence: Synthetic coding sequence
atgttctcactggctttgaagtgtctcatttctctgagcacaataattctgctcggactgattattgcttaccacactagagaagtacagctgttcgtcattgataatggcgcggacgattggcggattgctatgacgtacgagagaattctttatatctccctggagatgctcgtgtgtgccatacacccgatcccgggggagtacaagtttttttggaccgcccgacttgccttcagctatactccatcccgggcagaggcagatgtggatattatcctcagtatccctatgtttctgcggctctacctcatcgcccgagtcatgctgctgcatagcaagctctttaccgatgcttcatccaggtctataggcgcccttaataagataaatttcaacacaagattcgttatgaagaccctcatgactatatgtcctggcacagtgcttttggtcttctcgatctccctttggattattgctgcatggaccgtgcgggtctgcgagcgatatcacgatcaacaggatgtgacctccaactttctgggtgccatgtggcttatatcaatcacctttctgtcgattggctacggagacatggtgcctcacacatattgtggcaagggcgtatgtttgctgaccggcataatgggcgccggctgtacagcactggtcgtggctgtggtggcaaggaaactcgagctgacgaaagcagagaaacacgttcacaactttatgatggacacacaactgacaaagaggataaagaatgcagctgcgaatgttctgagggagacttggcttatctataaacacacaaagctgttaaagaaaatagatcacgccaaagttcgaaaacaccagaggaagtttctgcaagccattcaccagctgcggtccgtaaaaatggagcagcgcaagttaagtgatcaggccaacactctagtggaccttagcaaaatgcagaatgtcatgtatgatctcattacagagctgaatgatagatctgaagacctggaaaaacagatcggctctctggagtctaagctcgagcaccttacggcctcttttaacagtctgccattgctgattgctgatactctgagacagcagcagcagcagctcttgagcgcgatcatagaagcccggggagtcagtgttgctgtcggtacaactcatactccaataagcgacagccccattggggtctcttccacctctttcccgacaccatatacaagttcttcatcctgttag

SEQ ID NO: 129424 - DNA, 1281 bp, Artificial Sequence
  Description of Artificial Sequence: Synthetic coding sequence
atggagcgcccaatcaaggacagcatgttctccctcgccctaaaatgtctaatttcgctttcaacaattatacttctgggtttaatcatcgcgtaccataccagagaagtccaactgtttgtgattgacaacggcgctgacgactggcggatcgcaatgacatacgagaggatcctgtatatctcattagagatgctcgtttgcgccatacatcctatcccgggcgaatacaaatttttctggacagctcggctggctttcagctatacacccagcagggcagaggccgatgttgatataatcttatccatcccaatgtttcttcgactgtacctcattgccagagtaatgttgttgcactcaaagctgttcaccgatgcatcaagtcgatcgattggtgccctcaataagatcaatttcaacacgcgtttcgttatgaaaaccctcatgaccatttgcccgggcacagttctcttggtgtttagtatatcattgtggatcattgctgcctggaccgtaagggtttgcgagagatatcatgatcaacaggacgttacaagcaacttcttgggagctatgtggctaatctcaatcactttcctgtccatcggctacggtgacatggtcccccatacatactgcgggaaaggcgtctgtttgctgaccgggatcatgggggccggttgtaccgccctggtagtggctgttgttgcacgcaaactggagctgaccaaagccgagaagcacgtgcataactttatgatggacacccagctaacaaaacgaatcaagaatgcagcagcgaacgttttaagagaaacctggctgatttacaagcacaccaagctcctgaaaaaaattgatcatgcgaaggtccgaaaacatcaacggaagtttctgcaagcgatacaccaacttagaagcgtgaaaatggaacagcggaagctgtcggaccaggccaacaccctggtcgacctttccaaaatgcagaatgtcatgtacgacctgattacagagcttaacgatcggagcgaagacctggaaaagcagattggatccctggagagtaaactggagcacttgaccgcctcattcaatagtttgccactgctgattgcggatacactcaggcagcagcagcagcagttgcttagcgccatcattgaggctcgcggggtgagcgtggcagttggaacaacacatactccgatctctgattcacccattggggtgtctagcaccagctttcctactccctacacctcctctagctcttgttag

SEQ ID NO: 129425 - DNA, 684 bp, Artificial Sequence
  Description of Artificial Sequence: Synthetic coding sequence
ccgcacaccctgcttgaggatcatctcctccgggaattcttccaccccctgtttttcctacaagctcccctcctcctgtcattgcccgcgcaatacaacgcttttttatccggttccgtctggacccctggtagccccagagaaccaaagcaggcgaaagaaagaaccggagcgaaaattctagtcggagagattgggtgcctcgcattttttgaggacatcttcggcgcacgagttgctttgggatggggacttgtgctgcagggcatccagcccggacctaaaatggacacgtcaggacatttccatgattccggggtgggggatctggatgaggatcctaaatgtccgtgtccctcgagtggagacgaacagcagcagcagcagcagcagcaacagcagcagcagcctcctcctcccgccccaccagccgccccccagcagccactcgggccaagcctgcaaccacagcccccgcagctccagcagcagcaacagcagcagcagcagcaacaacaacagcaaccgccacaccccctgtcacaactggcccagcttcagagtcagcctgtgcaccccggacttctccacagttcccccacagccttcagaccaccattcgttcaattacatcgtcaccctcctcccttcttacaggcccggcaaccggcacagtcacagtag

SEQ ID NO: 129426 - DNA, 1284 bp, Artificial Sequence
  Description of Artificial Sequence: Synthetic coding sequence
atgggcggcgatcttgtgcttggactgggcgcactgaggcgccggaaacgactactggaacaagaaaagtctctggcaggatgggcgctggtgctagctggaaccggcattggactcatggttctccacgccgaaatgctttggttcggtggttgtagctgggccctgtatttattcctggtgaagtgcaccatctccatctcgacctttctacttttgtgcctgatcgtggcttttcacgccaaggaggttcagctttttatgaccgataatgggcttagagattggcgtgtggccctaacaggccgacaggccgcccagattgtcctagagctagtggtgtgcgggcttcatcctgcacccgttcgggggcccccttgtgtgcaggatctcggggctcctctgacttctccccagccttggccgggttttttagggcagggcgaagccctgctttcactagcaatgctcttgcggttgtacctcgttcccagggccgttctcctccggagcggggtcctgctgaatgcctcttaccgctccatcggtgccctgaatcaagttagatttagacattggttcgtggcaaagctgtatatgaatacccaccctggccgcttgctcctaggtcttactctggggctttggctgacaacagcatgggtactgagcgtggccgaacggcaagctgtgaatgccaccggacatctgtcagatactctctggctgattcctattaccttcctcaccatcgggtacggggacgttgtcccgggcactatgtggggaaaaatcgtttgcctctgcaccggcgtcatgggcgtttgttgcaccgccttgcttgtcgcagtggtcgcaagaaagctggaatttaataaggcagaaaagcacgtgcacaactttatgatggatattcagtataccaaggagatgaaggaatcagcagcccgtgtccttcaagaagcgtggatgttctacaagcatacccggcgtaaggagtcgcacgccgcccgccgacatcagagaaagctgttggcggccatcaacgcattccggcaggtcagacttaagcatcggaagctccgggagcaagtgaactctatggtggatatttctaagatgcatatgattctctacgatctgcagcagaacctctcctcatcccatagagccctggagaaacagatcgacaccttagctgggaagctggatgccctgactgagctgctttctaccgcactgggtccccgacagctgccagagccttcacaacaaagcaaatag

SEQ ID NO: 129427 - DNA, 888 bp, Artificial Sequence
  Description of Artificial Sequence: Synthetic coding sequence
atgcatgaccagcattttcatctcttaaccccgttgccccatagagggttatcctgccagcgcggacctgctgtccatgaccggcaaagggccgccgggctggcccgcggcgccgatagggctgctgggaacgcttcatacaggtcgataggagccctgaaccaggttagattccggcattggttcgttgcaaagctgtacatgaacacacatcccggaagattactgctgggcctgacgctcggcctgtggcttactaccgcttgggtgctcagcgtggccgaacgtcaggcggtgaatgcaacggggcatttgtctgataccttatggcttattccaataacatttctgaccatcggttacggcgacgtggtgcctggcactatgtggggcaagattgtatgtctctgcactggagtgatgggggtttgttgcaccgccctgctggttgccgtcgtcgccaggaagctggaattcaataaagcagaaaagcacgttcataactttatgatggacatccaatacacaaaagagatgaaggagtcggccgcgagagtactgcaggaagcgtggatgttttacaaacatacacgcaggaaagaatctcatgcagcacgtcgacatcagcgtaagcttctcgcagcgatcaacgctttccggcaggtgcgtttgaagcatcgcaaactgcgtgaacaggtcaactctatggtggacatctccaaaatgcacatgattctgtacgacctgcagcagaatctctcatcgagtcaccgggccctggagaagcagatcgacaccctggcagggaaactggacgccctgacagagctgctgtccactgcgctcgggccgaggcagctgcccgaaccgtcccagcagtcaaaatag

SEQ ID NO: 129428 - DNA, 1119 bp, Artificial Sequence
  Description of Artificial Sequence: Synthetic coding sequence
atgttcaagcacctgcggaagtgggtagtgacaagattctttgggcactctcgccagagggctcgcttagtgtccaaggatgggagatgcaatattgaattcgggaatgtggaggcccagtccaggttcatattctttgtggatatctggaccacggtgctggaccttaaatggcgttataagatgacgatctttattactgcttttctcggctcttggttcttctttggtctcctctggtacgccgtcgcctacatccataaagatttaccagagtttcacccttctgctaaccacaccccatgcgttgagaacatcaatgggctcacctccgcctttcttttctcgctcgagacccaagtgacgataggttacgggttcaggtgcgttaccgagcagtgcgcaacagccatttttctccttatatttcagtcgatcctgggcgttatcataaacagttttatgtgcggagcgatcctggctaagatctctcggcccaaaaagagagccaaaactatcactttcagtaagaacgccgtcattagcaagagagggggtaagttgtgtcttctgatcagagtggccaatctgaggaagagtctgttgataggatcacatatatacggcaaactcttgaagacaaccgtcacgcccgaaggggagaccattatcctggaccagataaatatcaacttcgtagtagacgccggtaacgaaaatttgttttttatttccccactaactatttaccacgtaatcgatcacaattcacccttttttcacatggcggcggaaaccctccttcagcaagattttgagctcgtcgtgtttttagatggcacagtggaaagtacgtctgctacgtgtcaggtgcgcacaagctatgtaccagaagaggtgctgtggggctaccggttcgcacctattgtaagtaaaactaaagaaggtaagtaccgcgtcgatttccacaatttctctaaaacagttgaggttgagacccctcattgcgcaatgtgcctatataacgagaaggatgtgcgagctcggatgaagcggggttatgataacccaaactttatcttaagcgaggtgaacgagaccgatgacacgaaaatgtag

SEQ ID NO: 129429 - DNA, 1119 bp, Artificial Sequence
  Description of Artificial Sequence: Synthetic coding sequence
atgtttaaacatctacggaaatgggtcgtgactcggtttttcggacattcacgtcaacgggcccgactcgtgagcaaggatggtagatgtaatattgaatttggaaatgtcgaggcacaatcccgcttcattttcttcgtcgacatttggacaactgtccttgacttaaagtggcgatacaaaatgacaatcttcattactgcattccttggttcatggttttttttcgggctactatggtatgcagtcgcttatattcataaggacctgcctgagttccatccatccgcgaaccatactccttgcgtggaaaatatcaacggcctgacatcagcattcttgttcagtttagaaactcaggtaactatcggatatggcttccgttgcgttaccgaacagtgtgccactgctatctttcttctgatctttcagtctatccttggtgtgatcatcaacagctttatgtgtggagctatcctggctaaaatatctagaccaaagaaacgagcgaaaactatcacctttagcaagaatgctgtgatctctaagcggggaggaaagctgtgcctgctgataagagttgcgaacctgcggaagtccctgctgatcggctctcatatatatggcaaactgttgaagaccactgtcacacccgaaggggagactatcatactcgatcagatcaacataaatttcgtggttgatgctggcaatgaaaatttgttttttatcagcccactaaccatatatcacgtaatagaccataattcgcctttcttccacatggccgctgagaccctgctccaacaggactttgaactcgtggtctttctggatggcaccgtcgaatctacctctgccacatgccaagtgcggacttcttacgttcccgaggaggtgctgtggggctacagatttgcacctatcgtgtcaaagaccaaagaaggcaagtatagggtggacttccataacttcagcaagaccgtggaggtggaaacccctcactgtgctatgtgtctgtacaacgagaaagacgtcagagctagaatgaaacgcggctatgacaacccaaattttattctgtccgaagtcaacgaaacagacgacaccaaaatgtag

SEQ ID NO: 129430 - DNA, 912 bp, Artificial Sequence
  Description of Artificial Sequence: Synthetic coding sequence
atggcctggtggctgatcgcctttgcacacggggacctggcgcccagtgaaggtaccgccgagccatgcgtgactagtatacactccttctccagcgccttcctgtttagcatcgaggttcaagttaccattggttttggcggaagaatggtgacagaggaatgtccacttgcgattttgatcttgattgtgcagaacatcgttggtctcatgatcaacgccattatgttgggttgtattttcatgaaaacggctcaagcacataggagggcagagaccctaatcttctcaaagcacgccgtcattgcactcagacatggacgactgtgcttcatgctccgtgtcggcgacctgcggaaatccatgataattagcgcaaccattcatatgcaggtggtgagaaagaccacaagtccagaaggtgaggtcgtccccctacatcaggtggatatacccatggagaatggcgtgggtggcaacagcatctttctcgtcgcaccacttatcatctaccatgtgatcgatgccaacagcccgttatacgacttggcaccttcagacctgcaccatcaccaggatctggagataatcgtgattctggagggtgttgttgaaactaccggaatcacaacacaagctagaacctcatatctggccgacgagattttgtggggccagagatttgtgcccattgtggcagaggaagatggtcgttactctgtcgactacagcaaattcggcaatactgtcaaggtccccaccccactctgcacagccaggcagctcgacgaagaccattctctgctggaggctctgaccttggcttccgcaagaggtccattacggaagcggtctgtacccatggcaaaggcaaagcctaaattctctatcagcccggattctctcagctag

SEQ ID NO: 129431 - DNA, 1302 bp, Artificial Sequence
  Description of Artificial Sequence: Synthetic coding sequence
atgacagccgcatcgcgagcgaatccatattcaatagtgagtagcgaggaagatgggcttcatctcgtaaccatgtccggggcaaatggctttggtaatggcaaagtgcatacccgtcggcgttgccgtaataggttcgtgaaaaaaaacgggcagtgcaatatcgaatttgcaaatatggacgagaagtctcaaagatacctagctgacatgttcacaacctgtgtggatatccgttggagatatatgctgctgattttctccctcgcatttttggccagttggctgctctttggcatcatcttttgggtcattgcagtagctcacggcgatttggagcctgcagagggacggggaagaaccccatgcgtgatgcaggtgcatggatttatggcagctttcctgttcagcattgagacccagacaaccataggctatgggctccgctgcgtgaccgaagaatgtccagtggccgtgtttatggtagtggcccaatccatcgtgggctgcatcatcgacagctttatgatcggcgcgattatggccaagatggcaaggccgaaaaaacgggcacagacccttcttttctcgcacaatgctgtggtcgcacttcgagacggtaaactgtgcttaatgtggcgagtcggcaatctgcgtaagtcgcatattgttgaagctcatgtacgcgctcagcttattaaaccacgcgtgacagaagaaggtgagtacatcccacttgaccagatcgacatcgatgtggggttcgacaaggggctcgaccggatcttcctcgtgagcccaatcactatactccacgagatagatgaagcttcccctctttttgggataagtcgccaggatctcgaaacagacgacttcgaaatcgtggttatcctggagggcatggtggaagctaccgcaatgacaacccaagctcgaagcagttacttggccaatgagattctgtggggccatcgatttgaaccggtgctgtttgaggagaagaaccagtacaaaatcgattattcacactttcacaagacctacgaggtaccttccacaccaaggtgttctgctaaggatctcgttgaaaacaaatttctgctgccatccgcaaactccttctgttacgagaacgaactggcattcttgagccgtgatgaagaagacgaagccgacggcgatcaggatggccgctctcgggatggactgagcccacaagctcgccatgattttgatcggcttcaggccgggggaggggttctcgagcagagaccctatcgccgggaatcagagatttag

SEQ ID NO: 129432 - DNA, 1257 bp, Artificial Sequence
  Description of Artificial Sequence: Synthetic coding sequence
atgtcctattacgggtctagctatcatatcatcaatgctgatgctaagtatccaggctacccacccgagcatatcattgcagagaaaaggagagcccgacgcaggcttttgcacaaggacggatcctgtaacgtgtatttcaagcatatttttggagagtggggtagctatgtagtggatatttttaccaccctcgtcgatacaaagtggagacatatgttcgtgatcttttctctgagctatatcctgtcttggctcatctttggatcggtgttctggctaatcgcattccatcatggagacctgctgaacgacccagacattacgccctgtgttgacaacgtccattccttcactggagcattcctgttttccctggagactcagaccactataggctatggctacaggtgcgtaaccgaagagtgcagtgtggccgtccttatggttattcttcaatctatcctgtcgtgtataattaacaccttcatcattggagcggcccttgccaagatggctaccgctcgcaaacgggctcaaaccatccgcttcagttactttgcgctgattggcatgagggatggcaaactgtgtctcatgtggcgcattggagatttcagacctaaccatgtggtggaaggtaccgtccgagcccagttattaagatataccgaggactccgaggggagaatgacaatggcttttaaggatttgaaactggtaaacgaccagattattcttgtgacccccgtcactatcgtccatgaaatcgaccacgagagccctctgtatgctctggatagaaaagctgtggccaaggacaacttcgagattttagtgacatttatatataccggcgactcaactggcacatcacatcagagccgctcaagttatgtcccaagggaaatcctatgggggcacagatttaacgatgtgcttgaagtgaagagaaaatactacaaagtcaactgcctacagtttgagggttcagttgaagtctatgcacctttttgttccgccaagcagttagactggaaggatcagcagttgcacattgaaaaagctccgccagtgcgtgaatcttgtaccagtgacaccaaggcccggagacgaagcttctctgcagtcgctatcgtatcttcatgcgaaaatccagaggagactaccactagcgccacacatgagtaccgggagaccccttaccagaaggcattactgaccctgaatagaattagcgtcgagagccagatgtag

SEQ ID NO: 129433 - DNA, 1119 bp, Artificial Sequence
  Description of Artificial Sequence: Synthetic coding sequence
atgttcaagcacctgagaaagtgggtcgtcacacgattcttcggtcactctcggcaacgcgctcgccttgtgagtaaagacggcagatgcaacatcgaatttggcaacgtggaagcgcagtctaggttcatctttttcgttgacatttggaccacagttctcgatctcaaatggcggtataaaatgacaatcttcatcaccgccttcctgggatcctggttcttctttggcctgttgtggtacgccgtcgcctatatccacaaagacttgccagagtttcacccctcggctaatcacacaccttgcgttgaaaacattaatgggctgacaagcgcatttctgtttagtttagagacacaagtcacgatcgggtatgggttcagatgcgtgacagaacagtgtgcaacagccatatttctcctgatcttccagtctattctcggagtgatcattaacagctttatgtgtggagccattcttgccaagatcagcagaccaaagaagcgtgcgaaaacaatcacgttttctaagaatgccgtcatcagtaaacgcggaggaaagctatgcctcctcatacgagtagccaatctgagaaagtcccttctgattggatcccacatatatggcaagctccttaagacaaccgtgacacccgaaggtgagactatcattctcgaccaaattaacatcaacttcgtggtagatgctggcaatgaaaatttgttcttcatctcccccttgacaatctatcacgttatagatcataattcgccttttttccatatggctgccgaaaccctgctgcagcaggacttcgaactcgtagtttttctggacgggacagtagaatccacctccgccacctgtcaagtaagaacaagttacgtccctgaagaagtcttatgggggtatcggttcgccccaattgtgtctaagaccaaggagggcaagtaccgggtggacttccacaatttttcaaagaccgttgaggtggaaaccccgcactgcgccatgtgtctttacaacgaaaaggacgtgagagctagaatgaagaggggatatgataacccgaactttatactgtccgaagttaatgagactgacgataccaagatgtag

SEQ ID NO: 129434 - DNA, 1176 bp, Artificial Sequence
  Description of Artificial Sequence: Synthetic coding sequence
atgaatgcgagctctagaaatgtgttcgacactctgattcgtgttttaacagagagcatgtttaaacatctgagaaaatgggtagtcacccggttcttcggccattcacgccaacgagccagattagtctcgaaggacggacgctgcaacatagagtttggtaacgtggaggctcaatctcggtttatcttctttgtggatatttggaccacagtcttggacctaaaatggcggtacaaaatgaccattttcattacggcatttctgggctcctggtttttctttggattgctgtggtacgcagtcgcttacattcataaggacctacccgagttccatccttccgctaatcatacaccttgtgtagagaacattaatggccttaccagcgctttcctgttctctctcgagacacaggtgaccatcgggtacggatttcggtgtgtgactgagcagtgcgcgactgccatatttttgcttatttttcagagcattctgggcgtaataatcaattcattcatgtgcggtgctattcttgcaaagatcagccgcccgaagaaacgtgccaaaacaattaccttttccaaaaacgccgtcatcagcaagagaggtggaaagctatgtctgcttatccgcgtggccaacctgcgaaagtctctgctcatcggtagtcacatatatggcaaactcctcaaaaccacggtcacccccgaaggcgaaacgataatccttgaccaaattaatataaatttcgtggtagatgcgggaaatgaaaacttgttctttattagtcctctgaccatttaccacgtgatcgatcataattcacctttttttcacatggccgcagaaacactgctgcagcaggactttgagttggtggttttcctcgatgggactgtggagagtacctccgcaacatgccaggttagaacttcctatgtgcccgaggaggtactgtggggctaccgcttcgcccctatcgtgtcgaagactaaggagggcaagtatcgcgtcgactttcacaatttcagcaagacagtggaggtcgagaccccccactgtgccatgtgtctttacaacgagaaggatgtccgcgcccgcatgaaacggggctatgacaatcccaactttatcctgtctgaagttaacgaaactgacgatactaagatgtag

SEQ ID NO: 129435 - DNA, 1119 bp, Artificial Sequence
  Description of Artificial Sequence: Synthetic coding sequence
atgttcaagcatctcagaaagtgggtcgtgacacgttttttcgggcacagccgacagagggcccggctggtctctaaagacgggcgctgtaacatcgagtttggcaacgtggaggcacaatctagattcatctttttcgtcgacatctggacaactgtgctggatttgaaatggcggtacaagatgacgatctttattaccgcttttctgggatcatggtttttctttggtttactgtggtacgctgttgcctacatacataaggaccttcctgaatttcatccctctgctaaccatacaccgtgcgtggaaaacattaacgggctcacatccgctttccttttttccctggagactcaagttactatcggctatggattcaggtgcgttactgaacagtgtgcgaccgcaatttttttgttgatatttcagagcatactgggagtcatcatcaactcttttatgtgtggggccatcctggcgaagattagcagacctaagaaacgggcaaaaacgatcactttcagcaagaacgccgttataagtaaacgtggagggaagctgtgtcttcttattcgcgtcgccaaccttcgcaaatccctgctgataggctcccacatatatggtaagttactcaagaccacggttacaccggagggggagaccataatcttggatcagataaacatcaactttgtggttgatgcaggtaatgagaaccttttttttatatccccgttgaccatttaccatgtcatcgatcataattccccgtttttccatatggccgcggagactctgctgcagcaggatttcgagctagtagtgtttttagacggaaccgtggagtctacctcagcaacctgccaggtgcggacctcctacgtgcctgaggaggtgttgtggggctatcggttcgcaccgatcgtgtccaagaccaaggaagggaaatacagggtggactttcacaatttctcaaagacagtggaagttgagaccccgcactgcgctatgtgtttatataatgagaaagacgtacgagcccggatgaagaggggatatgacaacccaaattttattctgagcgaggtaaacgaaactgacgacacgaagatgtag

SEQ ID NO: 129436 - DNA, 1140 bp, Artificial Sequence
  Description of Artificial Sequence: Synthetic coding sequence
atgacctcagttgcaaaggtgtattattcacagactacccagaccgagtctcgtcccttaatgggcccagggatccgcagacgcagggtcttaactaaagatgggaggtccaatgtcaggatggaacacatcgctgacaagcggttcctttatctaaaagacctctggactacctttatcgatatgcaatggcgctacaaactccttctgttctcagcaacgtttgccggaacatggttcctcttcggcgtggtgtggtatctcgtcgcggtggcgcacggcgaccttctggagctggaccctcctgccaatcacacgccctgtgtggtgcaggtccacaccctcaccggagccttccttttctccttggagagtcagacgactataggctatggttttaggtacatcagcgaagagtgccccctggccattgtcttgttgatagcgcagttggtcctgacgaccattctcgagatattcattacaggaaccttccttgccaaaatcgcaaggcccaagaagcgggccgagaccattaggttttcccaacacgccgtcgtagcctcacacaatggcaagccatgtctcatgattagggtcgccaacatgcggaagtcactgttaattggctgccaggtgacagggaaactgcttcagacacatcagacaaaggagggggagaacatccgcctgaatcaggttaacgtaacatttcaggtggacactgcatctgactcacccttcctgattctcccactcacattctaccacgttgtcgatgagacctcaccactcaaagacctgcccttgcgctccggggagggtgattttgaacttgttctgattttgagtggcacagttgagtctacaagtgccacatgccaagtccggacatcgtatttgcctgaagagattctgtggggctacgagtttacacccgccatttccctgtccgcctcaggcaagtacatcgccgacttcagtttgttcgaccaggttgtgaaggtagcgagcccaagcgggttgcgggacagcactgtgcgttacggtgaccccgaaaagctgaagttggaagaaagtctgagagagcaggctgagaaagagggatcagccctcagcgtccgaatctctaacgtctag

SEQ ID NO: 129437 - DNA, 1173 bp, Artificial Sequence
  Description of Artificial Sequence: Synthetic coding sequence
atgctgtcccggaaggggataatcccggaggagtatgtgctcacgcgtctcgccgaggacccagccaaacccaggtaccgagccaggcaacgccgggcccgctttgtttccaagaagggcaactgtaacgtggcccataagaatatccgggagcagggaaggtttctccaggatgtgtttacaaccctagtggacctgaaatggccacacactcttttgatattcacaatgtctttcctgtgcagctggcttctgtttgccatggcctggtggctgattgctttcgctcatggagacctggccccttccgaaggtaccgcagagccctgtgtcacgtcgatccattctttcagttctgcatttttgtttagcattgaggtgcaggtcacgatcggctttgggggccgaatggtgacagaggagtgtcctttggctattctcatcttgatcgtccaaaatatagtcggactcatgatcaatgcaataatgctgggttgcattttcatgaagacagctcaggctcatcgtcgagctgagacccttattttcagtaagcatgccgtgatcgccctgcggcacggccggctgtgttttatgctccgggtcggcgatctgagaaagtcaatgatcatcagcgctacaatacacatgcaggttgtgcgcaaaactacctccccagaaggcgaagttgtacctctgcaccaggtggatattcctatggagaatggcgtcggtggcaactccatcttcctggtcgcaccactgataatctaccacgttatagacgcaaacagccctctgtacgacctggctcctagcgatcttcatcatcaccaggatctggaaatcatcgtgattctagaaggggtcgtagaaactactggcattaccacacaggcccggacatcttacctcgctgatgagatcctgtggggacagaggttcgtacccatagttgccgaagaggatggccgttactctgtggactattccaagttcggtaacactgtgaaggttccaacgcccctctgcacagcacgccagctggatgaagaccatagcctgttggaggccctcactttggcatctgcccgtgggcctttgagaaagcgctccgtcccgatggccaaggccaagccaaagttttctatctctcctgacagcctgtcctag

SEQ ID NO: 129438 - DNA, 1302 bp, Artificial Sequence
  Description of Artificial Sequence: Synthetic coding sequence
atgaccgccgccagcagagccaacccctacagcattgtgtcatcagaagaggacggactccatctggtaacaatgtctggagcaaacggatttgggaacggaaaagtgcacacacggaggcggtgcaggaataggttcgttaaaaagaacgggcagtgcaatatcgagtttgccaacatggacgagaagagtcagagatatctggctgacatgttcacaacatgcgtcgacattcggtggcgatatatgttactgattttcagcctagctttcctggcctcatggcttctgtttggtatcatcttctgggtcatcgccgttgcccacggggaccttgaaccggccgagggtaggggccgtacaccctgtgtcatgcaggttcatggatttatggctgctttcctgttctctatcgagacacaaaccactattggatatggactcaggtgcgtcacggaggagtgtcccgtggccgttttcatggtggtggctcagagcattgtgggctgtataatcgactcctttatgatcggtgcgatcatggccaagatggctaggcctaagaagcgcgctcagaccctgttgttcagccacaacgccgtggtcgccctgcgcgatgggaagttatgcctgatgtggagggttggaaaccttagaaaatcccatatcgtggaggctcatgtgcgggcccaattgattaagcccagggttaccgaggaaggagagtacatccctctggaccagatcgacatcgatgtaggtttcgataagggcctcgaccgtatcttcctggtctctccaatcacaatccttcatgagatagacgaggcctcccctctgtttggcatcagccgccaggacctggagactgatgatttcgagattgtagtaatcctcgaggggatggtggaggcaacggccatgactacacaggctagaagctcatatctagctaacgagatcctctggggccatagattcgaacccgtcctcttcgaggaaaaaaaccagtataaaattgactacagtcatttccacaagacatatgaagtcccttccacccccagatgtagtgctaaagacctggtggaaaataaatttctactgccctctgctaattccttctgctacgaaaatgagctggcattccttagtcgagatgaggaggatgaagctgacggcgaccaggatggccgcagccgggatggtctgagcccccaggccaggcatgactttgaccgcttacaagccggggggggggtgctggagcagaggccttatcgccgcgaaagtgaaatatag

SEQ ID NO: 129439 - DNA, 819 bp, Artificial Sequence
  Description of Artificial Sequence: Synthetic coding sequence
atggtcttgttgaccgcagtcctcctgttgctcgcagcttacgccggcccagctcaatcactgggctcattcgtgcattgcgagccgtgtgacgaaaaagccctgagtatgtgccccccatccccactgggatgtgagttggtcaaagaacctggatgtggttgttgcatgacctgtgcactggccgagggccagtcctgcggcgtgtacaccgagagatgcgcccaggggctgcgctgcctccccagacaagacgaagaaaagccactgcacgctcttctccacggaaggggtgtatgccttaatgagaaatcctatcgggagcaagtgaaaattgaaagagatagccgtgagcacgaggagcccacaacatccgagatggccgaggagacgtactctcccaagatttttcgacccaagcacaccaggatctccgaactcaaggccgaggccgtgaagaaggacagaagaaagaagctaacacaatcaaagttcgtcggtggcgccgaaaacactgcgcaccctaggatcattagcgccccagagatgcgtcaagagtctgaacagggaccctgccgtagacatatggaggcctctctgcaggaactgaaggcaagccctcgcatggtaccgcgcgctgtttatttgcctaattgcgatcggaagggcttctacaaacgcaagcagtgcaagccgtctcggggaagaaaacgcggcatctgctggtgtgtagacaagtatggtatgaagctccctgggatggagtacgtggacggtgatttccagtgtcatacgttcgatagtagtaacgttgaatag

SEQ ID NO: 129440 - DNA, 285 bp, Artificial Sequence
  Description of Artificial Sequence: Synthetic coding sequence
atggacagcagcaactgtaaggtgatagcaccgttactgtctcagcgttaccgccggatggtaacgaaagatggtcactcaactctacaaatggatggcgcgcaacggggcctcgcttacctgcgtgatgcgtggggaatcctgatggacatgcggtggcggtggatgatgctggttttcagcgccagctttgtggtccattggctggtgtttgctgtcctatggtgtttttgtggggaggattgtccagcgaaaaagtcgagcttttttaacagtctttactag

SEQ ID NO: 129441 - DNA, 1083 bp, Artificial Sequence
  Description of Artificial Sequence: Synthetic coding sequence
atggattctagtaattgcaaagttattgccccacttcttagtcagcggtatcggaggatggtgacaaaggatggtcactcaacgctgcagatggacggggcccaacgcggtcttgcgtatttgcgcgacgcctggggtatcttgatggacatgcgatggagatggatgatgctggtgttcagcgcttcatttgtcgtgcattggctggtgtttgcagtcttgtggtatgtgctggccgagatgaatggtgatctggaactggaccatgacgctccacctgagaaccatacaatctgtgtcaaatacattacttccttcaccgctgccttttccttttccctcgaaactcaactcacaatagggtacggtacaatgttcccaagtggggactgccccagcgcaatcgctttactcgccatccagatgctgcttggtctgatgttagaggcttttattacgggagccttcgtcgcgaaaatagctagacctaagaaccgggcattttccatccgattcaccgatacagccgtcgttgcacatatggacggcaagcctaacctcatcttccaggtcgcaaatacacgaccctcaccactgacatccgtgagggttagcgccgtgttataccaggagcgcgagaacgggaagctgtaccagacttccgtggattttcatctagatggaatttccagtgatgagtgccctttctttatttttcccttaacctattaccactcaataaccccatctagcccgctggctacgcttttgcagcatgagaatccctcccacttcgagctcgttgtattcctgtcagcgatgcaggaaggtactggagagatctgccaaaggagaacatcatacctgcctagcgagattatgcttcaccattgcttcgcctctcttctgaccaggggttctaagggcgagtaccagatcaaaatggagaattttgacaagactgttccggaatttccaacaccactggtgtcaaaatcccctaacagaacagatttagacatccatattaacggccagtctatcgataatttccagatatccgaaacagggcttacagagtag

SEQ ID NO: 129442 - DNA, 1128 bp, Artificial Sequence
  Description of Artificial Sequence: Synthetic coding sequence
atggatgccattcatattgggatgtcctcaaccccgctggtcaaacatacggccggcgcggggctgaaggccaaccgaccacgcgtgatgagtaagtctggccatagtaacgtacggatagacaaggtggatggtatatacctgctctacttgcaggatctctggaccacagtgattgacatgaagtggcgatataagcttacgttattcgccgccactttcgtcatgacgtggttcttgtttggagtgatctattacgctattgccttcattcatggcgacctagaacccggagaaccgatctctaatcacacaccctgtattatgaaggtggatagcttgacaggggcattcctgttttcactggaaagccaaacaacaatcggatacggcgtgcgctcaattactgaagagtgccctcacgctatattcctcctagttgcccagctggtgatcacgacactgattgagatatttataacagggaccttcctcgccaaaatcgctcgcccgaaaaaaagagctgaaacaattaagttctctcattgcgcggtcattacaaagcaaaacggaaaactctgcttggtgatccaagttgccaatatgcgcaagtcactcctgattcagtgtcagctctctggcaaacttttgcagacgcacgtgactaaggaaggcgagaggatcttattaaaccaggccactgtgaagtttcacgtggatagttcaagtgaatcaccttttcttatactgccgatgaccttctatcacgtgcttgacgagacctcacccttgagagatctgacccctcagaatctgaaagaaaaggagttcgagctcgtggtgctgctcaacgccactgtggagagtacgagcgctgtatgtcagtcccgcaccagctacattcctgaagaaatctactggggtttcgaattcgtcccagtagttagcttgtcaaaaaatggcaaatacgtagcggattttagccaattcgagcaaatccgcaagagtccagactgcaccttctactgcgccgatagcgagaaacagcagctagaggagaaataccgccaggaggaccagcgcgagagggaactgcggactctgttgttgcaacaaagtaatgtctag

SEQ ID NO: 129443 - DNA, 186 bp, Artificial Sequence
  Description of Artificial Sequence: Synthetic coding sequence
atggatgctatacatatcggcatgagctcaacccccctagtcaaacacactgccggggccggcctgaaagccaacaggccaagggttatgagcaaatcaggccattcgaacgtcaggatcgataaggtggatggtatttatctcctctatcttcaggatctgtggacgaccgtgattgacatgtag

SEQ ID NO: 129444 - DNA, 471 bp, Artificial Sequence
  Description of Artificial Sequence: Synthetic coding sequence
atggatgcgattcacatcggcatgtcctcaacccccctggtgaagcacacagccggtgcagggctgaaggctaatcgcccaagagtgatgtcaaagagcgggcactcaaacgtgagaatcgataaagttgatggtatctatctcctgtacctgcaggatctgtggaccacagtgattgatatgaaatggagatacaagctgacgctttttgccgcaaccttcgtgatgacgtggttcctattcggggttatctactatgccatcgcctttatacacggagacctcgaaccaggcgaacccatttctaaccacactccttgcatcatgaaagttgattccttgaccggtgccttcctgttttcactggagtcccagacaaccatagggtatggggttagaagcattacagaggagtgccctcatgctatttttctgctggttgcacagttagtcattactactcttatatag

SEQ ID NO: 129445 - DNA, 471 bp, Artificial Sequence
  Description of Artificial Sequence: Synthetic coding sequence
atggacgccattcacatcggtatgtcgagtactccattggttaagcacacagctggcgcaggcctcaaggccaacagacctagggtcatgagtaagagtggccacagcaatgtgcgaatagacaaggtagacggaatctatctcttgtacctacaagacctttggactaccgttatagatatgaagtggcggtataagctcactctgttcgcagccacgttcgtcatgacatggtttctgtttggagtgatctactatgctatagcattcatccacggcgacctggaaccaggggagcccataagcaaccacactccttgtataatgaaagtcgattccttaactggtgccttcctcttttccttggaaagtcaaaccactattggctacggagtacgcagcatcacagaggagtgcccacacgccatttttttacttgttgctcagctcgtcatcactacgttaatctag

SEQ ID NO: 129446 - DNA, 1128 bp, Artificial Sequence
  Description of Artificial Sequence: Synthetic coding sequence
atggatgccatccacatcggcatgtcaagcactccacttgtcaagcacactgccggagctggcttaaaagctaatcgacctcgggtcatgtcaaaatcgggacacagtaatgtccgaatcgacaaagtcgatggtatctatctcttgtatctccaggacctttggacaaccgtgattgacatgaagtggagatacaagttgactctgttcgctgccacattcgtgatgacttggtttttattcggtgtgatttactatgccattgcgttcatccacggggacctggaaccaggtgagccaatctcaaatcacacgccatgtattatgaaggtggacagtttgacaggggccttcttgttctccctagagagccagactacgattgggtacggagtgcggtcaattaccgaagaatgtccacacgcaatatttctcctcgtggcccaactggtaattacgactctgatcgagatctttatcacgggtactttcctggccaaaattgcaaggcccaaaaaacgcgcggaaactatcaaattttcacattgtgctgtaattacaaaacagaacggcaagctttgtctggtgattcaggtagctaatatgcgcaagagtctacttattcagtgccaactgtccgggaagctcctgcagactcatgtgacgaaggaaggtgaacgcatcctactcaatcaggctaccgtgaaattccacgttgacagcagtagtgagagcccttttctcattctgcctatgactttctatcacgttctcgatgaaacctcgccattgcgtgacctgactcctcagaacctcaaagaaaaagagttcgaactggttgtgctgctgaacgctaccgtagagtccacaagtgctgtctgccaaagtcggaccagttatatccccgaagaaatttattggggcttcgaattcgtgccagtggtgtccctctccaagaacgggaagtacgttgccgatttcagccaatttgagcaaattcggaagagcccggactgtaccttctactgcgccgatagcgaaaagcagcagcttgaggaaaagtacaggcaggaagatcagagggagagagagctgagaaccttattgctacagcagtcaaatgtgtag

SEQ ID NO: 129447 - DNA, 1128 bp, Artificial Sequence
  Description of Artificial Sequence: Synthetic coding sequence
atggatgccatccacattggcatgagtagtactccccttgtgaagcatacagcaggagcaggcttgaaggccaaccgacctcgcgtcatgagcaagtccgggcactcaaacgtcagaattgataaggtcgacgggatttatttactctacctccaagatttgtggactaccgtaatcgatatgaagtggagatacaaactgaccctcttcgcagcaacatttgtcatgacctggtttctctttggcgtcatctactacgctatagcgttcattcacggggacctggagcctggcgaacctattagcaatcacaccccatgcataatgaaggtggattccttgactggagcatttttatttagtttggagagccagaccacaataggatacggggtaaggagtatcaccgaagaatgccctcatgctatttttctactcgtggcgcagctggttatcacaaccctaatcgagatcttcatcaccgggacttttttggctaaaattgcaaggcccaaaaaacgcgccgaaaccattaagttttcccattgtgctgtaattaccaaacagaatggtaagctttgtctcgttatccaggtcgcaaacatgcggaagtctttactgattcaatgtcagctaagcggaaaactcctgcaaactcatgtgactaaggagggcgagcgtattctgctcaaccaggccacagttaaatttcacgtagacagctcaagcgagtccccctttctcatcctgcccatgactttttaccacgtgctcgacgagacctctccccttagggacctaactcctcagaatttgaaggagaaagagttcgaattggttgtgctgctgaacgctacagtggagagtaccagcgcagtgtgccaatcgagaaccagttatatccccgaagaaatctactgggggtttgaatttgtccctgtagtgagcctgagtaagaatggcaagtacgtggccgacttttcccaatttgaacagatcaggaagagcccagattgtacgttttactgtgctgactctgaaaagcaacagctggaagagaagtaccgccaagaagatcaaagagagcgggaattgcgcaccctcctgctgcaacaatcaaatgtgtag

SEQ ID NO: 129448 - DNA, 1128 bp, Artificial Sequence
  Description of Artificial Sequence: Synthetic coding sequence
atggacgccatccacatagggatgtcatctacacccctcgttaagcatacagccggcgctggccttaaggccaaccggccccgagtgatgtccaaaagcggccactccaatgtgagaattgacaaagtggacggaatctatttactttatctacaggatctctggacaacagtcattgacatgaaatggaggtataaacttaccttgttcgctgcgacgttcgtgatgacctggttcctcttcggagtgatatactatgctatcgctttcattcacggggacttggagcccggagagccaatatctaaccatacgccctgcattatgaaggtcgactccctgactggcgcttttttattctcactcgagtcccagaccacgatcggctatggagtgcggtccatcacagaggagtgcccacatgccatttttctcctggtggctcaactggtgattaccacactgattgagatatttatcacggggactttcttagctaagatcgctaggcctaaaaagcgcgctgaaacaattaagttttcacattgcgccgtcatcactaaacagaatggcaaattgtgtctggttatccaggtcgccaatatgcggaagagtctgttaatccaatgccagctgtccgggaaactgctgcagactcacgtgacgaaggagggcgaaagaatactgttaaaccaggcaaccgtgaagttccatgtagatagctcaagcgagagtccattcctcattttgccgatgaccttttaccacgtgctcgacgagacatctccactgcgagatctcactccccaaaacttgaaagagaaagaattcgagctggtggtgttactgaacgcaaccgtagaaagcacctccgccgtgtgccagagccgcacctcttacatacctgaagaaatctactggggttttgagtttgtaccagtggtctctctctctaaaaacgggaaatacgtggccgatttttcacagtttgaacagatccggaagtcacccgactgtaccttctattgcgctgactctgaaaagcagcagctcgaggaaaaatacagacaggaggaccagcgggaacgtgaattaaggaccctgctgttgcagcagtccaatgtgtag

SEQ ID NO: 129449 - DNA, 1128 bp, Artificial Sequence
  Description of Artificial Sequence: Synthetic coding sequence
atggatgccattcatatcgggatgtcttctaccccactggtgaagcacaccgccggcgcgggccttaaagcaaatcgccctcgggtgatgtccaagtcaggtcactctaacgtacgaatcgacaaggtcgacggtatctatctcctgtacttacaagacctgtggacaaccgtgattgacatgaaatggcggtacaaactaacccttttcgctgcaacctttgttatgacatggtttttatttggtgtgatctactacgctattgccttcattcatggggacctagaaccaggcgagcccatttccaaccacacaccctgcattatgaaagtcgattcattgaccggcgcctttctctttagcctggagtcacaaaccacaattggctatggagtcaggtcgatcactgaggagtgcccacacgcgatttttctgttggtggctcagctggtgattactacactaatcgaaatctttattacggggacattcctggctaaaatcgctcggccgaaaaagcgggcagagaccattaagttctcccattgtgcagtgatcacgaaacagaacgggaagctgtgtctagtgatccaggtggcaaatatgcgcaagtccttgctgatccagtgccagctttccggcaaacttctgcaaacccatgtaaccaaagagggggagcgcattctgctgaatcaggcgacggttaagttccatgtggactcatccagcgaatcaccattcctgatcctgcctatgacattttaccacgtgctggatgaaacttctcccctccgagacctgactccacagaatctgaaggagaaagaattcgagctagttgtcctccttaacgcgactgtagagtcgacgagtgccgtgtgtcagtccaggacctcctacatccctgaagagatttactggggctttgagttcgtgcctgtagtgagcctgtctaagaacggcaagtatgtagcagacttctctcagtttgaacagatcagaaagagtccggactgtaccttttactgcgccgacagtgaaaaacaacagctggaagaaaagtaccggcaagaggatcaaagagaacgagaactgcggacactcttgctccaacaaagtaacgtgtag

SEQ ID NO: 129450 - DNA, 60 bp, Artificial Sequence
  Description of Artificial Sequence: Synthetic coding sequence
atggacgccatacacattggaatgtccagcacacccctggtcaagcataccgcaggttag

SEQ ID NO: 129451 - DNA, 420 bp, Artificial Sequence
  Description of Artificial Sequence: Synthetic coding sequence
atggacgccatacatataggaatgtcttccactcctctcgtgaagcacactgcaggcgctggccttaaagccaacagacctcgcgttatgtccaagtccggacattccaacgtccgcatcgataaggtcgacggtatctatctgctttatctgcaggacttatggaccactgtgatagacatgaagtggaggtacaaactgacactattcgccgctacctttgtgatgacctggttcctgtttggggtcatctactacgcgatcgcctttattcatggagatctcgagccaggcgagccgatatccaaccacactccctgcatcatgaaggtggattcactgactggagcctttttgtttagtttagagagccagacgactattggttacggagtcaggtcaatcacagaagagtgttag

SEQ ID NO: 129452 - DNA, 738 bp, Artificial Sequence
  Description of Artificial Sequence: Synthetic coding sequence
atggacgctattcacattgggatgagtagtacccccctggtgaagcacaccgctggggctggtcttaaagccaaccggccacgggtgatgtcaaaatctggccattcaaacgtgcgaatagataaggtagacgggatctaccttttatacttacaggacttgtggacgaccgttattgatatgaagtggcgatacaagttaaccctctttgccgctaccttcgtcatgacttggttcctgtttggcgttatctattacgccatagcctttatccatggggatttggagcctggcgagcccatcagtaatcatacaccttgtatcatgaaggtggacagcttgactggtgcttttctcttcagccttgaatcccagaccacgatcggctacggggtacgatcgatcactgaagagtgtcctcatgctattttcctcctggttgctcaactcgtcatcactacgctgattgagatctttattactggaactttcctggccaagatagcccggccaaagaagagagccgaaaccatcaagttcagccattgcgccgtcattaccaagcagaacgggaagctctgcctggtcatccaggtagcaaatatgaggaaatcattgctcatccagtgtcaactgagtggcaagctccttcaaacccatgtcaccaaagagggagagaggattctgttaaatcaggctactgtgaaattccacgttgattcaagctccgaatcctag

SEQ ID NO: 129453 - DNA, 120 bp, Artificial Sequence
  Description of Artificial Sequence: Synthetic coding sequence
atggatgctattcacataggaatgagctctacgccactggtgaagcacaccgccggcgccggcctgaaagcaaaccggccaagagtcatgagcaagagcggacacagcaatgttcgttag

SEQ ID NO: 129454 - DNA, 147 bp, Artificial Sequence
  Description of Artificial Sequence: Synthetic coding sequence
atggacgccattcacataggcatgtctagtacccccctcgtgaaacacactgcaggcgcaggtctcaaagcaaacaggccacgggttatgtctaagagcggtcacagtaacgtgaggattgacaaagtcgacggaatctacctgtag

SEQ ID NO: 129455 - DNA, 147 bp, Artificial Sequence
  Description of Artificial Sequence: Synthetic coding sequence
atggacgcaatccacattggcatgagctcaacccctcttgtcaagcatacagcaggtgctggcttgaaggccaatcgacctagagttatgtcaaagagcggacacagtaatgtgcgcatcgacaaagtggacggtatttacttatag

SEQ ID NO: 129456 - DNA, 147 bp, Artificial Sequence
  Description of Artificial Sequence: Synthetic coding sequence
atggatgccatccacatcggaatgtcctcaacccctcttgtgaagcataccgcgggagccgggctgaaagccaatcggccccgggtcatgtcaaagagtgggcacagcaacgtgagaattgacaaggtggacggaatctacctctag

SEQ ID NO: 129457 - DNA, 78 bp, Artificial Sequence
  Description of Artificial Sequence: Synthetic coding sequence
atggacgcaattcatataggcatgtcctctacccccctggtcaagcatactgcaggagccggcctgaaggccaactag

SEQ ID NO: 129458 - DNA, 147 bp, Artificial Sequence
  Description of Artificial Sequence: Synthetic coding sequence
atggatgcgattcacattgggatgtcttccacccctctggtgaaacataccgccggagcaggactgaaagcaaatcgacctcgcgttatgtcgaaatctggccattccaatgtgcgaattgacaaagtagatggaatctatctgtag

SEQ ID NO: 129459 - DNA, 147 bp, Artificial Sequence
  Description of Artificial Sequence: Synthetic coding sequence
atggacgccattcacattgggatgtcctcgaccccactggttaagcacactgccggagccggcctaaaggctaaccggccaagagtcatgagtaagagtgggcattccaatgtgagaattgataaagtcgacgggatatacctctag

SEQ ID NO: 129460 - DNA, 147 bp, Artificial Sequence
  Description of Artificial Sequence: Synthetic coding sequence
atggacgccatccacatcggaatgtctagtactccactggtgaagcatactgccggcgcgggtcttaaggcgaatcgccccagagtaatgtccaagtccggacatagcaacgtgagaatcgacaaggtggacggcatctacctgtag

SEQ ID NO: 129461 - DNA, 1257 bp, Artificial Sequence
  Description of Artificial Sequence: Synthetic coding sequence
atgagctactatggcagcagttaccacatcatcaatgcagacgctaagtatcctgggtaccccccggaacacattattgccgaaaagagacgggccaggcgccgcttgctacataaagatggttcttgcaacgtgtactttaagcatatctttggcgaatgggggagttacgtagtggatattttcaccactcttgtggacacgaaatggcggcatatgttcgtgatcttttctctatcctatatcctttcatggctcatatttgggtcggtgttttggctaatcgccttccatcacggcgaccttttgaacgatcccgacattaccccatgtgtggataacgttcattcatttaccggcgccttcctgttttcgctggaaacacagacgactatcgggtacggatatagatgtgttactgaggagtgcagtgtggctgtactcatggtaattcttcagtctatcctgtcctgcattatcaacacttttatcatcggagccgcattggcaaagatggctactgcaagaaagagagcccagactattcggtttagctatttcgcactcatcggaatgcgcgacggtaagttgtgcctgatgtggaggattggggacttcaggccaaatcacgtggtggagggcactgtgcgagctcaattgctcaggtacacggaagattctgaaggcaggatgacaatggctttcaaagatttaaagctggtaaacgatcagattattttggtgaccccggtaactattgtccatgagatagatcatgaaagtccgctgtacgctcttgaccgcaaagctgtggcaaaggataatttcgaaattctcgtcaccttcatttacactggcgactcaacaggcacgtcacaccagtctcggtcttcttacgtacctagagaaatcctgtggggacatcggtttaatgacgtcttggaggtaaagcggaagtactacaaggtgaattgcctacagtttgaggggtccgtcgaggtgtatgcgccattttgctctgctaaacagcttgattggaaggaccagcagctacacatcgagaaagccccacctgtgcgcgagagctgtacaagcgatactaaagctcgcagaaggtccttctccgctgtcgcaattgtgtcctcatgcgaaaatccagaagaaactaccacctcggccactcatgagtaccgggagactccttaccaaaaggcgttgctcacgctcaataggattagtgtggagtctcagatgtag

SEQ ID NO: 129462 - DNA, 1257 bp, Artificial Sequence
  Description of Artificial Sequence: Synthetic coding sequence
atgtcatactacggctcttcttaccacataatcaacgctgatgcaaaatatcccggctacccccccgaacatatcatcgcggagaaacgccgcgccagacggaggttattgcataaagacgggtcctgcaacgtgtattttaagcatatctttggcgagtggggctcttacgtcgtcgacatcttcaccacacttgtcgacacaaagtggcgacacatgtttgtcattttcagcctgtcctacatcctctcctggctgatcttcggctccgtattttggctgatcgcctttcaccatggcgaccttctcaacgaccccgatataacaccttgcgttgacaacgtgcactcctttactggagcattcctattctctctggagactcagactactattggctatggatatagatgcgtgacagaagaatgctctgtcgcagtgttgatggtgattttgcagtcaattctgagctgcatcatcaatacattcataatcggagccgccctcgctaagatggccactgctcgcaaacgggcccaaacaatccgcttttcatatttcgctctcattggcatgcgtgacgggaagctttgcctcatgtggcggattggtgatttcagaccaaaccacgtcgtagaagggacagtcagagcccagctgctgcggtataccgaggacagcgagggtaggatgacaatggcgttcaaggaccttaaattggttaatgaccaaattattctcgttacacccgtgacaattgtccacgagattgaccacgagtcaccactgtatgccctggatagaaaggccgtggccaaagacaacttcgagatccttgtgaccttcatttacaccggggattcgacggggacatctcaccagagcagatcttcctatgtgccacgagagatattgtggggacacagattcaatgatgtgcttgaagttaaaagaaaatactataaggtcaactgtcttcagttcgaaggcagtgtggaagtatacgctccattttgctccgccaagcagctggattggaaggatcaacagctccatatcgagaaggctcctcctgtccgagagagttgtacttcggatacaaaggcgagacgcagatcgttctccgccgtagctatcgtgtctagctgtgagaatcctgaggaaaccacaactagtgcaacacatgagtatagggaaactccttaccaaaaggcgctcctgacactgaataggatatcagttgagagtcaaatgtag

SEQ ID NO: 129463 - DNA, 1257 bp, Artificial Sequence
  Description of Artificial Sequence: Synthetic coding sequence
atgtcttattacggttcctcttatcatatcatcaacgccgacgccaagtatcccggctatccaccggaacatattatcgcagagaagcgcagggcgcggcgccgcttgctgcacaaagacggtagctgcaatgtgtatttcaagcatatctttggcgagtggggcagttacgtggtggatatcttcaccacactcgtggacacaaagtggcggcacatgtttgtgatcttcagtctgagctacattttgtcctggctaatcttcggcagtgtcttctggctgatagctttccatcacggcgacctcctcaacgaccctgatatcacaccatgcgtggacaacgtgcattcgttcacaggcgcttttctgttcagcctagagacccaaacaaccataggctacgggtaccgctgtgtgactgaagaatgcagcgtggcagtcctcatggtgatccttcagtctatattaagctgtattattaacacctttatcattggcgccgccctagcaaagatggccaccgcccgcaagagggcccagacaattcggttttcttatttcgctttgattggcatgcgagatgggaagctttgtctgatgtggcgcataggcgatttccgtccaaaccacgtggttgaaggcacggttcgagcccagcttctccggtacactgaggactctgaaggcagaatgaccatggccttcaaggacctaaagctggtcaatgatcaaattatcctcgtgactcctgtgacgattgttcatgaaatcgatcacgagtccccactgtacgccctggatcggaaggcagtcgctaaagataatttcgagatcctggtgacctttatctacaccggtgactccaccggcactagtcatcaatcaaggtcttcttatgtgcccagggagattctgtggggacatcgcttcaatgatgtcctggaggtgaaacgcaaatactataaagtgaactgcctgcaatttgaaggatctgtcgaggtgtacgcacccttttgtagcgcgaagcagctagattggaaagatcagcagctccacatcgaaaaagcgcctccagttcgagaaagttgcacctctgatacaaaggctagacggcgctctttctcagccgtcgctatagttagtagctgcgagaaccccgaagaaactacaacttcagcgacacatgaatatcgcgagacaccctaccaaaaagcacttctgacactgaatcggataagtgtcgagagccaaatgtag

SEQ ID NO: 129464 - DNA, 1284 bp, Artificial Sequence
  Description of Artificial Sequence: Synthetic coding sequence
atgggtagtgtcaggaccaacaggtacagcatcgtttcaagtgaggaggacggaatgaagcttgctactatggctgttgccaacgggttcggcaacgggaagagtaaggtacacacacggcagcaatgcagaagcagatttgttaagaaggacgggcactgcaacgtgcagttcatcaatgtgggagagaaggggcagcgataccttgcggacatttttactacttgcgtggatatccgatggaggtggatgctggtgatattttgcctcgcatttgtcctctcttggctgtttttcggatgcgtgttttggctgattgcattgctgcacggcgacctggatgcatcaaaagagggaaaagcctgcgtttccgaggtaaattcattcaccgccgccttcctctttagcatagagacacagacgactattggatacggctttagatgtgtgacggacgagtgtccgatagccgtgttcatggtggtgttccaaagtatcgtgggttgtattatcgacgctttcatcatcggagccgtgatggcgaaaatggcaaaaccgaagaaaaggaacgagactctcgtgttcagccacaatgcagtgattgctatgagggatggaaagttatgcctgatgtggcgcgtgggaaatctacgcaaatctcacttggtggaggcccacgtcagagcccagttattaaaatcgcgcataacgagcgagggcgagtacatccctcttgatcagattgacatcaatgtcggattcgactccggtatcgatcgaatattcttagtgtcacccatcacgattgtgcacgaaattgacgaggatagccctctttatgacctcagcaaacaggacattgacaacgctgactttgaaatagttgtcatcctggaggggatggtggaggccaccgccatgaccacccagtgtaggtcttcctacctggctaatgaaatactctggggacacagatatgagcctgtgctgtttgaagaaaagcactattacaaagtggactattctcggtttcataaaacctatgaggtccccaacactcccctgtgcagtgcaagagatttggccgaaaaaaagtacattctgtcaaatgctaacagcttctgttatgagaacgaggtcgcattgacatcaaaagaggaagacgattcagaaaatggggtgcctgagtccaccagcactgatacccctcctgatatagacttgcacaaccaggcttccgtgcctctggagcctagacctctaaggagagaaagcgagatttag

SEQ ID NO: 129465 - DNA, 1284 bp, Artificial Sequence
  Description of Artificial Sequence: Synthetic coding sequence
atgggatcagtgagaaccaaccggtactccatcgtgtcatccgaggaggacggcatgaagctggctacgatggcagtagccaacggtttcggaaacggcaaatccaaagtgcatacacggcaacaatgccgatctcggtttgtgaagaaagatggtcattgtaatgtgcagttcataaatgtcggcgaaaaaggacaaaggtacctggcggatatttttacaacgtgcgtggacatccgatggcgttggatgctggtgatcttctgtttagccttcgtgctctcttggctcttcttcggttgtgtattttggttaatcgccctgctgcacggcgatttggacgctagcaaagaagggaaggcctgtgtgagtgaggtgaacagtttcaccgcggcctttcttttctcaatcgaaacgcagaccacaatcgggtatggtttccgttgtgtgaccgatgagtgtcctatcgccgtcttcatggtggtattccagtcaatcgtcggctgcatcatcgacgcctttatcatcggagcggtgatggccaagatggctaaaccaaaaaaacgaaatgagacgctcgtgttttcccacaatgccgtcattgcaatgcgcgacggcaaactttgcctgatgtggcgggtgggcaacttgagaaaatcgcatctggtggaggcccacgtacgggctcagctgctaaagagtagaattacctcagaaggcgagtacatccctcttgatcagatagacatcaatgtgggctttgatagcggcattgacaggatatttcttgtatctccgatcactattgtccacgaaatcgacgaggactcccctctgtacgacctcagtaaacaggacattgacaatgcagactttgaaatagtagtcattctggaaggaatggtcgaggccacagccatgactacccagtgccgctctagctacctagcgaacgaaattctgtggggacatcggtacgagccagtcctcttcgaggaaaaacattactacaaggtggactactcaagattccataaaacctacgaggttccaaatacacctctgtgcagcgcccgcgacctagctgagaagaaatatatactcagtaacgccaactccttttgctacgagaacgaagtggcactgacctccaaagaagaagatgacagcgagaatggcgttccagaaagcacctctactgatacaccacctgacattgatcttcacaaccaggctagcgtcccactggagccccgccctttgagacgagaaagcgagatatag

SEQ ID NO: 129466 - DNA, 1506 bp, Artificial Sequence
  Description of Artificial Sequence: Synthetic coding sequence
atgagtgcccttagacgcaagttcggcgatgattatcaggtggtaactacttcaagctctggaagtgggcttcagcctcaaggtccgggccaggatcctcagcaacaattggttccgaagaaaaagagacagagattcgtggacaagaacggccgatgcaacgtgcagcatggaaatttgggcagcgagactagccgctatttgagtgacctgttcaccacgttagtagatctcaaatggcgctggaatctatttattttcatacttacttacactgtagcctggctatttatggcaagcatgtggtgggtcattgcgtatactcgaggagacttgaacaaagctcatgtaggaaattacaccccctgcgtcgccaacgtgtataacttcccttcagcctttctgttctttatcgagactgaagccacaatcggctacgggtatagatacatcactgacaagtgcccggaaggtattatcctgtttctgtttcagtcaatcttggggtccattgtggacgctttcctcatcgggtgcatgtttatcaaaatgtcacagcctaagaaaagggctgagacgctgatgttctcagaacacgccgtgatctcaatgagggacgggaagttaactttaatgtttcgagtcgggaacctgagaaactctcacatggtgtccgcccaaattcggtgcaagttgttgaagtcgcgccagacgcctgagggcgaattcctgccattagatcagttggaacttgacgtaggcttctctacgggagctgatcaattatttctcgtttcccctctgacaatctgccacgtgattgatgccaagtcgcctttctacgatctctctcagagatctatgcaaacggagcagtttgaaatcgtcgttatattggagggcattgtggagacaacgggaatgacatgccaagctaggacctcatacaccgaggatgaagtcctgtgggggcatagattcttcccagttatttcactggaggagggattctttaaagtggattattcccagttccacgcaaccttcgaagtcccaacaccaccttatagtgttaaagaacaggaggagatgttgcttatgagcagcccgctgatagctcctgccatcaccaacagcaaagagcggcacaattcagtggagtgcctggacgggctggacgatatcaccacaaagttacccagtaaactgcagaagattaccgggagggaggacttccctaagaaactgcttcgtatgtcatcaacaactagcgaaaaggcatacagtctcggtgacctgcccatgaagttacaacgtatttcgtctgtgcctggcaatagtgaggagaaactcgtgagtaaaacaactaaaatgctgtctgacccaatgtctcagtccgtagcggaccttcctcccaaacttcagaagatggccggaggcgcagctcgaatggagggaaacctgcccgctaagctcaggaaaatgaattcagaccgttttacctag

SEQ ID NO: 129467 - DNA, 708 bp, Artificial Sequence
  Description of Artificial Sequence: Synthetic coding sequence
atgagcgcattgcggagaaaatttggtgatgactaccaggtggtaacaacctcatcatccgggtccggcctccaaccgcaagggcccggccaagatcctcagcaacagttggtacccaagaagaaaagacagcggtttgtggataagaatggaaggtgtaatgtgcagcacgggaacctggggtctgaaacaagtagatacctgtccgatctctttaccactctggttgatctcaagtggcgctggaatttgtttattttcattttgacgtacaccgtggcctggcttttcatggcttccatgtggtgggttattgcatatacccgcggcgatctcaataaagcgcacgtgggaaactatactccctgtgtcgctaatgtttataattttccttccgcgtttctgttttttatagagactgaggctactatcggctatggttaccggtacattaccgataagtgtcctgaaggtattatacttttcctgttccaaagcattttgggatcaatcgtcgacgccttcctgatcggatgcatgttcataaaaatgtctcaacccaaaaagcgtgctgagacattaatgttcagtgagcacgccgtgatcagcatgagagatggcaagttgacactgatgttccgtgtaggaaatttacggaattctcacatggtttccgctcagatcaggtgcaaactgctcaagggttag

SEQ ID NO: 129468 - DNA, 1338 bp, Artificial Sequence
  Description of Artificial Sequence: Synthetic coding sequence
atgcacggacactcgcgaaacggccaggcccatgtaccacgtagaaaacgccgaaaccggtttgtgaaaaagaatggacaatgcaacgtgtacttcgctaatctgtccaataagagccaaagatacatggccgacatcttcaccacctgtgtggataccaggtggcggtacatgttgatgattttcagtgccgcttttctggtttcttggctgttcttcggcctgctcttctggtgtatcgcgttcttccatggtgacttagaggcctctcctggagtgcccgcggcagggggtcccgcggcaggtggcggcggggcagcacctgtggctcccaagccctgcattatgcatgttaacggattcctgggcgcctttctgtttagcgtcgagacccaaactaccattggttatggatttaggtgcgtgacagaggaatgccctctggcagtcattgccgttgtcgttcagagtatcgtggggtgcgttattgacagcttcatgatcgggaccattatggcaaaaatggcacgccctaaaaagcgggcccaaactttgctcttctctcatcacgccgtgatttccgtgagagacggtaaattatgcttaatgtggcgggtggggaacctgcgaaaatcacacattgtcgaggcccacgtgagagctcagctgattaagccctacatgacccaagaaggtgaatacctccccctggaccaacgagatttgaacgtgggctacgatattggtctggacaggatttttctggtctcccctatcattatcgtgcacgagatcgacgaagacagccccctgtatggaatgggaaaagaagagctggagagcgaagacttcgaaatcgtcgtgatactggaggggatggtggaggccactgcaatgactacccaggctcggagctcgtacctggcctcagaaatcctctggggacacaggttcgaacctgtggttttcgaggaaaagagccactataaggtcgattacagtaggtttcacaaaacttacgaagttgccggcaccccgtgctgctctgcaagagagctgcaagaatccaagataaccgtgcttcccgcccccccacccccgccaagtgcattctgttacgagaatgaattggcacttatgtctcaagaggaggaggagatggaggaggaagccgccgccgccgccgcggtggctgctggtctaggactggaggctggaagcaaagaagaggccgggataattcgcatgttggagtttgggagtcacttggatctggagcggatgcaggcgtccctccccctggacaatatctcttataggcgtgagtcagcaatctag

SEQ ID NO: 129469 - DNA, 1260 bp, Artificial Sequence
  Description of Artificial Sequence: Synthetic coding sequence
atggcgggcgatagccggaacgctatgaatcaggacatggaaattggcgtgacaccttgggatcccaaaaaaattcccaagcaggctcgagattacgtacctatcgccactgatagaacaagactgcttgccgaaggcaagaagccacgccagcgttacatggagaaatcaggaaagtgcaatgtccaccatgggaatgtccaggagacataccggtacctgagcgatttgttcactaccctcgtcgacctgaagtggcgcttcaatttacttgtatttacaatggtgtacaccgtcacttggctcttcttcggattcatttggtggctgatcgcatatatcaggggagacctcgaccacgtgggggaccaagagtggattccttgcgtggagaacctaagtggattcgtgagcgctttcttgttcagtattgaaaccgaaacaacaattggatacggcttcagggtgattacggagaaatgtcccgagggcattattctgctactggtgcaggccattctaggatcaatcgtcaatgcctttatggttggatgtatgttcgtgaaaattagccagcctaaaaagcgggccgaaaccctcatgttctccaataatgccgtgataagtatgcgggatgaaaaactgtgcctgatgttccgtgtgggcgacctgaggaatagtcatatcgtggaagcttctatacgggccaagctcatcaagtcccgccagacgaaggagggcgagttcattccgcttaatcaaacggatattaacgtgggttttgatacaggcgacgaccggctatttcttgtctccccccttatcatttcccacgagatcaatcagaagagccccttctgggaaatgtcccaagcgcagctgcatcaggaagaatttgaggtcgttgtgattttggaaggtatggtcgaagccaccggaatgacttgtcaggcaaggtcctcatacatggacacagaagtgctgtgggggcatagattcacaccggtgctcactcttgagaaaggtttttacgaagtcgactataacacattccatgatacctatgaaactaacaccccaagctgttgcgccaaagaactcgccgaaatgaagcgcgaaggaaggttgcttcagtatctgcccagcccgcccctgctaggaggctgtgctgaggccgggctcgacgctgaagccgagcagaatgaagaggatgaaccaaaggggctgggagggagcagagaggccagagggtccgtgtag

SEQ ID NO: 129470 - DNA, 1260 bp, Artificial Sequence
  Description of Artificial Sequence: Synthetic coding sequence
atggctggcgatagtcggaacgctatgaaccaggacatggaaatcggcgtgaccccttgggatcctaagaaaattccaaagcaggcaagagattacgtgccaatcgccacggatcggacacgcctcttggccgaaggtaaaaaacccagacaacggtatatggaaaagagtggcaagtgtaacgtgcaccacgggaatgtgcaggagacgtaccgatatctctcagatctctttaccaccctggtagacttaaaatggcggttcaatctgctagtgtttacgatggtttataccgtaacctggctgttcttcggatttatctggtggctaatcgcgtacattagaggggacctagatcatgtgggtgatcaggaatggattccttgcgtagaaaatctatcaggctttgtgtcagcgtttctcttcagtatcgagaccgagactacaattggatatgggtttcgggtcattactgaaaagtgcccagaaggaattatccttctccttgtccaggctatattgggcagtattgtgaacgcctttatggttgggtgcatgttcgtgaagatatctcagccgaaaaaaagggccgagacactcatgttctcaaacaatgccgtgatcagtatgcgtgacgagaaattatgtctaatgttccgggtgggcgacctgaggaactcccatattgtcgaggccagcattcgggctaagctgattaaaagtaggcagacaaaagagggggagtttatcccactcaatcagactgacataaatgtgggtttcgacacaggggatgacaggctgtttttggtgagtccgctgatcatttcccatgagatcaaccagaagtctccattctgggaaatgtctcaggcgcagctacaccaggaggagttcgaagtcgtcgtgatcttggaagggatggtggaggccacagggatgacttgtcaagcgcgaagctcatacatggatacagaagtcctctggggccataggtttaccccagtccttaccctggagaaaggcttctacgaggtcgattacaacactttccacgatacttacgaaaccaatacaccttcttgttgtgccaaagaattagccgagatgaaacgtgaaggacgcctgctacagtaccttccatcccccccacttctgggcggatgcgccgaagcaggtctggacgctgaggctgagcagaacgaagaggacgaacctaaagggctgggtggctcgagggaagctaggggatcagtgtag

SEQ ID NO: 129471 - DNA, 1260 bp, Artificial Sequence
  Description of Artificial Sequence: Synthetic coding sequence
atggcgggcgactcgaggaacgccatgaatcaggacatggagattggagtcacaccctgggaccccaaaaaaattcccaaacaggcccgggactacgttcctattgcaacagaccgcactcggctgctcgctgagggcaagaaaccccggcagaggtatatggaaaagagtgggaaatgcaatgtgcaccatggcaacgtgcaggagacgtatagatatttgtcggacctgttcacaacgctcgtggatcttaaatggcggttcaatctgttagtctttactatggtgtacacagtgacatggctcttcttcggcttcatttggtggctcattgcctatatccggggggacttagatcacgtgggagatcaggagtggatcccttgtgtggaaaatctgtctggattcgtttccgcttttctgttttcaatagaaaccgagaccaccattggttacggttttcgtgtcattactgagaaatgccccgagggaataatattattattggtccaggcaatcctcggttctatcgtgaatgcttttatggtgggttgtatgtttgtgaaaatcagtcagcctaaaaagagggcagagaccctcatgttctccaacaatgctgtgatatccatgcgggatgagaagctctgtctaatgtttagagtgggggatctgcggaatagtcacatcgtggaagcttcgatcagagctaagctgattaagagtcgccaaaccaaggaaggagagttcattcccctgaatcagactgacatcaatgtaggtttcgacaccggagatgaccgcctgttcctggtgtcaccactgattatcagccacgagattaatcagaagtcacctttttgggagatgagccaagctcagctgcatcaggaggaatttgaagtggtggtaattctcgagggaatggttgaagctaccggcatgacctgccaggctaggagttcctatatggatacagaagtcctctggggacaccgcttcacacccgttctaaccctcgagaaaggattctatgaggttgattataatactttccacgacacttacgagacaaacacgccctcctgctgtgcgaaggagctcgcggagatgaaacgcgaaggacgacttttgcagtatcttcctagccctccattacttggcggatgcgccgaagcaggactcgatgccgaggccgaacaaaacgaagaggacgagcctaaggggctcggcggatctcgagaggctagagggagcgtatag

SEQ ID NO: 129472 - DNA, 1272 bp, Artificial Sequence
  Description of Artificial Sequence: Synthetic coding sequence
atggccaaactgaccgaatccatgaccaatgtgctcgagggcgactcaatggaccaagacgtcgaatccccagtagcaatacatcagccaaaactgcccaagcaggcgagggacgatctgcccagacatatctcccgggaccgaacaaagaggaagattcagcgctatgtgcgtaaggatggcaaatgtaacgtccatcacggtaacgtccgcgaaacctataggtacctgaccgacattttcaccaccttggtcgatctcaaatggcgctttaatctgctgattttcgtgatggtgtatacagtgacctggctgttctttggcatgatttggtggctgatcgcctatatcaggggcgacatggaccatattgaggatcccagttggaccccatgtgtcaccaacctgaatggctttgtttctgcctttctgttttcaatagagacggaaacgaccattggatacggttaccgcgtgataaccgacaaatgcccagaagggataattttattgctcattcaaagcgtccttggctctatcgtaaatgcgttcatggttgggtgcatgttcgttaagatttcgcagcctaaaaaaagagcagaaacgctggtattttcaacacatgccgtaatttctatgcgcgatggcaaactgtgcctgatgtttagagtgggggatctcaggaacagccacatcgtggaagcgagcatcagagccaaactcattaagtcaaagcaaacttctgaaggagagtttattcccttgaatcagaccgatatcaatgtcggctactacaccggtgacgatcgcctgtttctcgtgtcaccattaattatttcccatgagatcaaccaacagtctccattctgggaaatttctaaagcccaactccccaaagaggaattggagatagttgttattcttgagggcatggttgaggctaccgggatgacctgtcaggcacggagttcctatatcacctctgagatcctgtgggggtataggtttactcctgtgttaaccctggaggatggtttctatgaagtcgattacaactcttttcatgaaacttatgagacctccaccccttcattgtcggccaaggagctggctgaacttgcctccagagctgaactgccactgtcttggtccgtttctagtaaactcaaccaacatgccgagttggagactgaggaagaggagaagaacctcgaggaacagaccgaaaggaatggtgacgtggccaatttagagaatgagtccaaggtgtag

SEQ ID NO: 129473 - DNA, 1272 bp, Artificial Sequence
  Description of Artificial Sequence: Synthetic coding sequence
atggcgaaattaaccgaatctatgacaaatgtgctcgaaggagatagtatggaccaggatgtagagtcccccgtggccattcatcaacctaagctgcccaagcaagctagggacgacttgccgcgtcatatttcccgggacaggacaaagaggaaaatccagaggtacgttagaaaagatgggaagtgcaatgtccatcacggcaatgtgcgcgagacgtaccggtatcttactgatatcttcacaactctcgtcgacctgaagtggcgctttaacttgctcatatttgttatggtgtataccgtgacttggctttttttcggtatgatctggtggttgatcgcatatatacgcggagatatggaccacattgaggatccctcttggacaccctgtgtcacaaatttaaacggcttcgtgagtgcgtttcttttttccatagaaacggagactaccatcggttacggctatcgtgttattaccgacaagtgcccagaaggaataatcctgcttttgatccagtccgtactcggaagcatcgtgaacgcctttatggtgggctgcatgtttgtaaagattagccagccgaagaagagggctgagacactggtgtttagcacccacgcagtgatatccatgagggacggcaaactgtgtctcatgtttcgggtgggagatctgcggaacagccatattgtggaagcctctattagagcaaagctgatcaagagcaaacagaccagcgagggggagttcatccccttaaaccagactgacatcaacgtgggctactataccggtgatgaccgactgtttctggttagcccattgatcattagccatgaaattaaccagcaatcaccattttgggaaatttcgaaggcccagctccccaaggaagagctagaaattgtggttatcttagaaggtatggttgaagccacaggcatgacatgtcaggcccgatctagttacatcacatcagagatcctgtggggttaccgctttactcccgtgctcacactggaagatggcttctatgaagtcgattataatagctttcatgagacatacgagacttctactcccagcctgtctgctaaggagctggccgagctcgcgtcacgtgccgagctgcctctgtcttggagtgtgtcatcgaaactcaatcagcacgctgaactggagacggaggaggaagaaaagaaccttgaggagcagacagagcgtaacggggatgttgcaaatctcgaaaatgagagcaaggtgtag

SEQ ID NO: 129474 - DNA, 1275 bp, Artificial Sequence
  Description of Artificial Sequence: Synthetic coding sequence
atgcttgcccgcaaatccattataccggaggaatatgtgcttgcccgcattgcagcggagaaccttcgcaagccgagaatccgtgatcgactgcccaaagcccgctttattgctaaatctggggcatgcaacctggcccacaagaacatacgggaacaaggacgctttcttcaagacatctttacaacattggtggatttaaaatggaggcacacacttgtgatcttcaccatgagtttcctatgcagttggctactgtttgccataatgtggtggctcgtggcctttgcacacggcgatatctacgcctatatggaaaaatctgggatggagaagagcggcttggagtcaacagtgtgtgtgaccaacgtcagatctttcacctcagctttcctgttcagtatcgaagtgcaggtcacgattggcttcggcgggaggatgatgacggaggaatgtccgttggctatcactgtactaattctgcagaacatagtggggctgataattaacgctgtcatgttgggctgtatatttatgaagactgcccaggctcatagacgagcagaaacactcattttctccagacacgccgtcatcgccgttcgaaatggcaagttatgtttcatgttcagagttggcgacttgcgtaaatcaatgatcatcagtgcgagcgtcagaatacaggtcgtgaaaaagaccacaacaccagaaggagaggttgtgcctatccaccagcttgacatacccgtggacaatcccatcgagagtaacaacatctttttagtggctcctctgatcatatgtcacgtgatagataaacggagtccactctacgatatctccgccacagatttggccaaccaagacctggaagtgatcgtgattctcgaaggagtggtcgagacgaccggcatcaccacccaagccaggacttcgtatatcgccgaggagattcagtggggccaccgattcgtgagtatcgtaacagaggaagagggtgtgtattccgttgattattctaagttcggaaatacagtgaaggtagccgcaccccgctgttctgcccgagagctcgatgagaagccatcaatcctcattcaaactctgcagaagagcgagctgtcccaccagaatagcctgaggaaacggaatagcatgagacgaaataattctatgcgacgcaataactccatccgtagaaacaactcctccctgatggtgccgaaggtgcagtttatgacccccgaaggtaaccagaacacgtccgagtcttag

SEQ ID NO: 129475 - DNA, 345 bp, Artificial Sequence
  Description of Artificial Sequence: Synthetic coding sequence
atgctggctcggaagtccattattcccgaggagtacgttctagcccggatcgccgcagaaaatctcagaaagccccggattcgggacagactccccaaagcgcgctttattgccaagtctggggcatgcaacttggcacataagaatatccgcgagcaggggcgattcctgcaggacatttttactacactggtggatctgaaatggaggcacactttggtgattttcacaatgtcctttttatgttcatggctgctgttcgccataatgtggtggctcgttgctttcgcgcacggagacatttatgcctatatggagaagagcgggatggaaaaatcaggttag

SEQ ID NO: 129476 - DNA, 1275 bp, Artificial Sequence
  Description of Artificial Sequence: Synthetic coding sequence
atgctcgccagaaaaagcatcatccccgaggagtacgtgcttgcaaggattgctgccgaaaaccttcggaaaccacgcattcgggaccgactccctaaagcccgcttcattgctaagagtggggcctgcaatctcgcccacaaaaatatccgggagcaagggcgattcctgcaggacatcttcaccacactggttgacttgaagtggagacacaccctggtgatttttactatgagtttcctgtgttcttggctgctgtttgccatcatgtggtggctcgtcgcctttgctcacggagacatttatgcctatatggagaagtcgggaatggagaagtccgggctcgaatctaccgtctgtgtgaccaatgtacgaagtttcactagcgcatttctgttcagcatcgaagttcaagtcaccatcggcttcggaggcagaatgatgactgaggagtgtcctctcgccattacggtgctgatcctgcagaatatcgtgggcctcattataaacgcagtgatgctcggatgtatttttatgaaaacggcacaggcccacagaagggctgagacgttaatcttttccagacatgccgttattgctgtgcggaatggcaagctgtgttttatgttcagagttggcgatctgcgtaagagcatgatcatctctgcctcagtgagaatccaagtcgtaaaaaaaactaccacgccagaaggtgaagtggtgcctattcaccagctggatataccggtagacaaccctattgagagcaataacatttttctggtggcacccttaatcatctgccacgtgatcgataaaaggtcacctctgtatgacatttccgccaccgatttagcaaatcaagatctcgaggtaatcgtcatccttgaaggagtcgttgagacgactggcataactacacaggctcgcacttcttacatcgccgaggagatacagtgggggcatcgattcgtgtcaatcgtgaccgaagaagagggagtgtactccgtggactattctaagtttggaaacaccgtcaaagtcgctgctccacggtgcagtgctagggagctggatgaaaagcccagcattctgatccaaaccttacagaaatccgagctgagccaccagaatagcctgagaaaaaggaactctatgcgaagaaacaattcaatgaggcgtaacaacagtatccgaagaaataattcaagcctgatggtgccaaaagttcagttcatgactccggaaggcaaccagaatacttctgaatcttag

SEQ ID NO: 129477 - DNA, 774 bp, Artificial Sequence
  Description of Artificial Sequence: Synthetic coding sequence
atgaccgcctttcctgccagcggaaaaaagcgggagactgattattccgacggagacccactggacgttcataagaggcttccttctagcgccggcgaggatcgggctgtgatgctgggattcgctatgatgggattctctgtgcttatgttttttctgctgggcacaacaattttgaagcccttcatgctctccattcagagggaggagtccacatgcactgcgattcacaccgatattatggatgactggctggattgtgcgtttacatgtggggtccactgtcatggccaaggaaaatacccatgtctccaggtttttgtgaaccttagccaccctggccaaaaggcactgctccactacaatgaggaagctgtccaaatcaatcctaagtgtttttacacaccaaagtgtcaccaggataggaacgatctgctcaacagtgccctggacatcaaagagttttttgaccacaagaatggcaccccatttagctgtttttattcgccagcctcccaatcagaagatgttattttgattaagaaatatgaccagatggccatctttcactgtctcttctggccctcgctgaccctactgggaggcgcgctgatcgtggggatggtccgcctgacacagcacctctctttactgtgtgagaagtattccactgtagtcagagatgaagtaggcgggaaggtgccttacattgaacagcatcagttcaagctatgcattatgcgccgaagcaaaggccgggccgagaaatcctag

SEQ ID NO: 129478 - DNA, 522 bp, Artificial Sequence
  Description of Artificial Sequence: Synthetic coding sequence
atgcagccgttttcgatccctgtgcagatcactctccagggcagccgacggcggcaaggccggactgcattcccagcctcagggaaaaagagagaaacagactatagcgatggagacccactcgatgtccataagagactcccatccagtgctggggaggatcgcgccgtcatgctaggcttcgccatgatgggttttagcgttcttatgttcttcctcctcggaacaaccattttgaagccgttcatgttatcaatacaaagagaggaaagcacctgcacagcaatacacacagacataatggacgattggctagattgcgcctttacctgtggagtgcactgtcatggacagggaaagtacccctgcctgcaggtgttcgtgaatttgagccaccctggacagaaggcattgttacattacaatgaagaagcagtgcagattaaccccaagcgagacgtcacggattgtagagtgaaagagaagcagacattaaccgtttctgacgaacataaacagtag

SEQ ID NO: 129479 - DNA, 840 bp, Artificial Sequence
  Description of Artificial Sequence: Synthetic coding sequence
atggacttcagcccatccagtgaactcggcttccacttcgtggctttcatattgctcacccggcaccgcaccgcctttccagccagtgggaagaagcgcgaaactgattactcagatggcgacccacttgatgtgcacaaacggcttcctagctccgcaggtgaggatagagccgtcatgctggggttcgctatgatgggattttcggttctgatgttttttcttctcggcactaccatattgaagccattcatgctctcaattcagagagaagaatcaacctgcactgctattcatacagatataatggacgattggcttgactgcgcattcacctgcggcgttcactgccatgggcagggtaagtatccttgtctgcaagtattcgttaaccttagtcatcctggacagaaagctctgctgcattacaatgaagaggccgtgcagattaaccccaagtgtttctatacccccaagtgccatcaggatcgaaacgacctgcttaactccgccctagacataaaggagtttttcgaccacaaaaacggaacaccgttctcttgcttctattctcccgcctcacagtccgaagatgtgattctcatcaagaagtacgatcagatggcaatctttcattgcctcttctggccatccctgacgctgctcgggggtgccctgattgtggggatggtgaggctcacccaacacttgtccctcctttgtgagaagtatagtacagtcgtacgagatgaagttggtggaaaagttccatatatagaacagcatcagtttaaactttgcataatgcggcgaagcaaaggcagagctgagaaatcctag

SEQ ID NO: 129480 - DNA, 834 bp, Artificial Sequence
  Description of Artificial Sequence: Synthetic coding sequence
atgcaacctttttctattcctgtccaaattacgcttcagggatccagacggcgtcagggcagaacagcttttccagcctccggcaagaaacgggagaccgactattcagacggagacccactggatgtgcataagcggcttccctcctctgccggcgaagatcgagccgtcatgctgggctttgccatgatgggattctctgtgctgatgttcttcctgcttggaactactatcctgaaacctttcatgctctccatccagagagaagagagtacatgtaccgccattcacacggatattatggatgactggctggattgcgcgttcacgtgcggcgttcactgccacggccagggcaagtacccatgtctgcaggtttttgtgaacctgtcccacccgggccaaaaggctctcctccactacaatgaggaagccgttcagatcaatcccaagtgcttttatactcctaagtgtcaccaggatcgaaatgacctgttgaacagcgcgcttgatatcaaggaattctttgaccataaaaacgggactccctttagttgcttttactctccagcttctcagtccgaagatgtgattctcattaagaagtacgatcagatggccattttccactgcctattttggccttcattaaccttgctgggcggtgccctgatcgttggcatggtgaggttgactcagcatctctcgcttctgtgcgagaaatatagcaccgttgtcagagacgaggtcggaggaaaggtgccatatattgagcaacatcaatttaaactttgtatcatgcgccgaagcaagggcagggccgaaaaatcctag

SEQ ID NO: 129481 - DNA, 828 bp, Artificial Sequence
  Description of Artificial Sequence: Synthetic coding sequence
atgtttcccctgttatacgagctgaccgccgtatctcctagcccctttcctcagagaacagccttccctgcctcaggtaaaaagcgagaaacggactactcagacggggatcccctggatgtccacaaacgattgccctcctccgccggggaggacagagcagtgatgctggggttcgccatgatgggatttagtgtgctcatgttctttcttctgggcacaaccatacttaaaccttttatgctatcgatccagagggaagagtccacatgtaccgccatccacacggacattatggacgactggcttgattgcgctttcacttgtggggtgcactgtcacggtcaaggaaagtacccttgccttcaagtgttcgtgaatctgagtcacccagggcaaaaggccctgttacactataacgaggaagccgtgcagatcaaccctaaatgcttctacacacccaagtgccaccaagacagaaatgatcttctgaattcggcccttgatatcaaagaattcttcgatcacaagaacggtacccccttttcttgtttttacagtcccgccagccaatctgaagacgtgatcctgattaagaaatacgaccagatggctatcttccattgcctcttttggccgtcattgaccttactgggaggtgctctcattgtcgggatggtgcgactaacccagcacctctccttactctgcgaaaaatattccaccgtagtccgtgatgaagtgggcggaaaggttccgtatattgagcagcaccagtttaagttgtgcattatgagacgtagtaagggtagggccgaaaaaagttag

SEQ ID NO: 129482 - DNA, 774 bp, Artificial Sequence
  Description of Artificial Sequence: Synthetic coding sequence
atgaccgcctttcccgctagcgggaagaagagagagactgattattccgacggggatccacttgatgttcacaagagactaccctccagtgccggagaggaccgggcagtcatgctcggatttgccatgatggggttctctgtgttaatgttttttttgctgggcaccaccatcctgaaaccttttatgctcagtatccagcgagaggaaagtacgtgtaccgctattcacactgacatcatggatgactggctagattgcgcctttacatgcggcgttcactgtcatgggcagggcaagtacccctgtcttcaggtttttgtgaacttgtcccatcctgggcagaaagcgttactccattataacgaagaggccgtccagatcaatcccaaatgcttctacacacctaagtgtcaccaagacaggaatgatctcctgaatagcgcactagatatcaaggaatttttcgatcacaaaaacgggaccccatttagctgcttttacagcccagcctcacagtccgaggatgttatcctcatcaaaaaatatgaccagatggccattttccactgcctattctggccatcccttactttactgggaggcgcactcatcgtggggatggtgcgtctgacacagcatctttctctgctgtgcgaaaaatatagtaccgttgtgcgcgacgaggttggcgggaaagtaccttatattgagcagcatcagttcaagctgtgtatcatgaggagatcgaaaggcagggccgaaaagtcatag

SEQ ID NO: 129483 - DNA, 3537 bp, Artificial Sequence
  Description of Artificial Sequence: Synthetic coding sequence
atggccaatggtggaggcgggggaggagggtcttctgggggcggtggcggtggcggggggtcatcactgcgaatgagtagcaatattcacgccaaccatctgagcctggatgctagtagttcttcgagcagtagcagctcttcatcttctagtagctcatcttctagctcctcttcctccgtccacgaaccaaagatggacgcccttatcattccagtgacaatggaggtaccttgtgactcgaggggccaacgcatgtggtgggccttcctcgccagttctatggtcaccttcttcggaggtttattcatcatccttttatggaggaccctcaaatacctgtggactgtgtgttgccattgcggcgggaagacaaaggaggcacagaagatcaacaatggctcttcccaagcagacgggaccctcaagccagtcgacgagaaggaggaagctgtagctgctgaagttggctggatgactagcgtgaaagactgggctggggtgatgatttccgctcagactcttacaggtcgcgttctggtcgttctggtatttgcactatccatcggtgctctcgtgatttacttcatcgatagttctaatcctatcgaatcatgccagaatttctataaggatttcaccttgcagatcgatatggcctttaacgtttttttcctgctttattttggcctgaggtttatagccgccaatgataagctgtggttctggttggaggtaaattctgtcgtcgacttcttcacggttccccccgtgtttgtcagtgtctatcttaacagaagctggctgggtctcagattcctgcgggccttgcgcctcatacagtttagcgaaatactccagtttctgaacatcctgaagacttctaacagcataaagctggtgaatttgttgtctatatttatctccacatggctgacggcagcgggattcatacatctggtcgagaattccggcgacccatgggaaaactttcagaataaccaagccctaacctattgggaatgcgtgtacttgttaatggtaaccatgtctaccgtcgggtacggtgacgtctatgctaaaacaacccttgggcggctgtttatggtcttcttcatactcggaggtctcgcgatgtttgccagttatgtccccgaaatcatagagctgataggaaaccgaaagaagtacggtggttcatattcagccgtgtccgggagaaagcatattgtggtgtgcggtcacatcactctggagagcgtcagcaatttcctcaaagatttcctacacaaggaccgtgacgacgtgaacgtcgaaatagtgtttctgcataacattagccccaacctggagcttgaggccttgtttaaacggcattttacccaggtggaattttaccagggatctgtccttaacccccacgatttagccagggtcaaaatagagtcagccgacgcgtgtttgatattggctaataagtactgcgccgaccccgatgccgaagatgcctctaacattatgagggtgatatcaatcaagaactaccatcctaaaatacgcattattacccaaatgctacagtaccataacaaggctcacctgctgaacataccatcatggaactggaaagagggagacgacgcgatctgcctggcagagctgaaactgggatttatcgcccaaagttgtctagcccagggtctctccactatgttagccaatctcttcagtatgagatcctttatcaagattgaggaggatacctggcagaaatactacttagagggggtgtctaatgagatgtatacggagtatctttcttcagcatttgtcggtctaagcttcccgactgtctgcgaactttgtttcgtgaagctgaaattgcttatgatcgccattgagtacaagagtgctaatcgggaatcacgaatactcatcaacccaggaaaccatctgaagattcaggaaggcactttagggttctttattgctagtgacgcaaaggaggtaaagagagcttttttttattgcaaagcatgtcatgatgatataactgaccccaagaggattaagaagtgcggctgtaagaggctcgaagatgagcaaccctctacactgtcccccaagaaaaagcaaagaaatggaggcatgcgtaatagtccaaacactagtcccaagcttatgaggcacgacccccttctaattcctggaaatgaccagatcgataatatggactcgaacgtgaagaagtatgattctaccggaatgtttcattggtgtgcccccaaagagatcgaaaaagtgatcctcacaaggtctgaggcggctatgacggtgttgagtggtcacgtcgttgtttgcattttcggagacgtatcctctgctctaatcggtttgaggaatttagttatgcctctgagagcctctaattttcactatcacgaattgaaacacattgtgttcgtcggaagtatcgagtacttgaagagagaatgggaaacactccataatttccctaaggtctccatcctacctggcacaccactgtcacgagcagatctacgagctgtgaatattaatctttgtgacatgtgcgtcatccttagcgccaaccaaaacaatatagatgacacgagtctacaggacaaagaatgcatcttagcctcccttaacataaagagcatgcagttcgacgatagtatcggcgttttacaagctaactcgcaggggtttacccctcccggaatggatcgaagcagccccgacaacagtcccgtccacggcatgctgcgccagcccagcatcaccactggggtgaacatcccaatcattacggagttggtaaatgacacaaatgtccagttccttgaccaggatgatgatgacgatcccgatacggaactataccttacccagccatttgcatgtggaacggcatttgccgtctccgtgctggactccttaatgtctgctacctacttcaacgataacatcctgaccctcatccgtactctcgtcaccggtggtgccacacctgaattggaagcgcttatcgctgaggagaacgcattaaggggagggtactctactccccagacactggcaaatagagacaggtgtagagtagctcaactggctttactggatggacctttcgcggatctgggggatggcgggtgctacggcgacctcttctgcaaggccctcaaaacatataacatgctgtgtttcgggatctaccggctccgagacgcacacctgtcaacaccttctcagtgcaccaagagatatgttatcaccaacccaccctatgaattcgaattggtgcctaccgatcttatcttctgtctcatgcagtttgaccacaacgctgggcagtctcgggccagcctctcacactccagtcactctagccaaagttcaagcaaaaaatcttccagtgttcacagcattcctagtactgctaaccgccaaaatcggccgaagtctcgggagagcagagacaagcagaagtatgtgcaggaagaacgtctgtag

SEQ ID NO: 129484 - DNA, 3633 bp, Artificial Sequence
  Description of Artificial Sequence: Synthetic coding sequence
tcaaatattcatgcgaaccacctgagtctcgatgcctccagctcttccagtagttccagtagttctagttcgtcctcatcctcatcttccagctcatcatctgtccacgagcctaagatggatgcgctgatcattcctgtgacgatggaggtgccatgcgatagcagaggtcagaggatgtggtgggctttcctggctagtagtatggtgacattcttcgggggactctttattattctgttatggaggactctcaaatacctttggactgtatgctgtcactgtggcgggaagacaaaggaggcccagaaaattaataatgggtccagccaggcggatggcactttgaagcccgttgatgaaaaggaagaggccgtcgctgccgaagtcggctggatgacttcggtgaaagattgggccggcgtgatgatatccgcacagactcttactgggcgcgtgctggtcgtactggtattcgccttgtctataggggcactagtgatatatttcattgactccagcaatccgatcgagagctgtcagaatttctataaggactttacgctgcagattgacatggcctttaacgtgttttttctcctatattttggattgcggttcatcgcagctaacgataaattatggttttggctcgaggtcaactccgtggtggacttcttcaccgtaccgcccgtcttcgtgagcgtctacttgaatagaagttggttggggctccgtttcctacgcgccctccggttgatccagttcagcgagatcttgcagttcctgaatattcttaaaaccagtaattcaatcaaacttgtgaatctactgtcaattttcatctctacatggttgactgcagctggcttcatccaccttgtggagaactctggcgatccgtgggagaatttccaaaataatcaggccttgacctactgggagtgcgtttacttactgatggtgacaatgtcgacagtaggatacggagacgtctacgcgaaaacaacactggggagactgtttatggttttctttatcctcgggggcctcgccatgtttgccagttacgttcctgaaatcatagagttgatcggtaacagaaaaaaatacggagggtcttattctgccgttagtgggagaaaacacattgttgtgtgtgggcacattaccctcgagtccgtgtccaatttcctgaaagatttcctgcacaaggatagagacgatgtgaatgttgagattgtgttcctacataacatttccccaaatcttgagttggaagctctgttcaagagacattttacacaagtggagttttatcagggatccgtgcttaacccccacgatctcgctcgcgtgaaaatcgaatcagctgacgcttgtctgatcctggcaaataagtactgtgcagatccagatgctgaagatgcttcaaatattatgcgggtgatctcgatcaaaaactatcatcccaagattcgcatcatcacgcaaatgttgcagtatcataacaaagcacatctcctcaatatcccctcttggaactggaaggagggtgacgatgctatctgtttagctgaactgaaacttggcttcatcgcccagtcttgtctcgcccagggtttaagtactatgctcgccaacctcttcagcatgaggtcgttcatcaagattgaggaggacacctggcagaagtattacctcgaaggagtgtcaaacgaaatgtacacagagtatctatcgagtgctttcgttggcttatcattcccaactgtgtgtgagctgtgcttcgtaaagctgaagctgctcatgatagctatcgaatacaagagcgccaatagggaaagtagaatcctcatcaatcctggaaaccatcttaagattcaggaaggaacactgggtttcttcatagcctcagacgccaaggaagtgaaacgagcatttttttactgcaaggcatgccatgacgatataaccgatcccaaacgaataaaaaagtgcggctgcaagaggcccaagatgtctatttataaacgcatgcggcgcgcatgttgttttgattgtggtagatctgaacgtgactgcagctgtatgtcgggacgcgtgagaggcaacgtcgacacgctagagagggccttccctctgtcctctgtcagcgtcaatgattgttctacctcttttagagccttcgaggacgaacagccaagtacactttccccaaagaaaaaacaacgaaacggaggtatgagaaattcccccaatacgagtcctaagttaatgcggcatgacccactgctgattcccggaaacgaccagatcgacaatatggactctaatgtgaagaagtatgatagtaccggcatgtttcactggtgtgccccaaaggaaatcgaaaaagtgatcctgacaaggtccgaagccgccatgaccgttctgagtggccatgtagtggtctgtatcttcggtgatgtgtcgagtgcactcattggcttgcggaatctggtaatgcccctgagagcgtctaatttccattatcatgagttgaagcatatcgtgtttgtggggtcaattgagtatctgaagcgagagtgggagacacttcataacttcccgaaagtctctatactgcccggcactccactgtcccgtgcggacctccgtgccgtcaatatcaacctgtgtgacatgtgtgtgatcctcagtgcaaatcaaaacaacatagatgatactagtctgcaagataaggagtgcatccttgcttccctgaacataaaatccatgcagtttgatgacagcattggggtgctgcaggcaaattctcaaggtttcaccccacctggcatggaccggagctcccctgataatagccccgtccacgggatgttgcgacaaccgtctatcaccactggtgttaacatccccataatcactgagctagtgaacgatacaaatgtgcagttcctcgaccaagacgatgatgatgatcctgatacagaattatacctcactcagccgttcgcatgcggcacggcatttgcagtatccgtgctcgactcactgatgagcgccacctacttcaatgacaatattctgacactgatccggaccctggtgacgggtggagcaactcctgaactggaagcgctaatagccgaagaaaatgcactccgtgggggctatagtactccccagacgctagctaatagagacaggtgcagagttgcacaattggccctcttagatgggccttttgcagacttgggtgacgggggctgttacggagacctattttgtaaagccctgaagacctacaacatgctatgctttggcatttatagattgcgtgacgcgcacttgagcacaccatcccaatgcacgaaacgctacgtgatcaccaaccccccttacgagttcgaactggtgcccaccgatctgattttctgccttatgcagtttgatcacaacgctggtcaatccagagcctccctttctcactcatcgcactccagccagtccagcagcaaaaagtcgagctctgttcactccatcccttcaacggcaaatcgtcagaatagacctaagtccagagagtccagagacaaacaaaagtacgtgcaggaggaacgcttatag

SEQ ID NO: 129485 - DNA, 3720 bp, Artificial Sequence
  Description of Artificial Sequence: Synthetic coding sequence
atggcaaacggtggtggaggtggggggggcagttcaggcggtggcgggggcggaggcgggagttcactgcgcatgtcctcaaacattcacgcgaaccatctgagtctcgacgcaagcagctcctctagcagttcctcaagcagcagcagctcctcgagctcgagttcctccagttcttcggttcacgagccgaaaatggacgcactgataattcctgttacaatggaggtgccctgcgactcaagaggacagaggatgtggtgggcttttctagcctcatccatggtgacattctttggtgggctgtttataatcctgctgtggcgtactctgaaatacctctggaccgtctgttgtcactgtgggggcaaaacaaaagaggcacagaagataaacaacgggagttcccaggcggacggcacactcaagccagttgacgagaaggaagaagcggtggccgccgaagttggctggatgactagtgtcaaagactgggcgggcgtgatgatctcagctcagacgctaactggccgggtgctagttgtgcttgtctttgccctctcaatcggagcactggtgatttactttattgattctagcaacccgatcgaaagctgtcagaacttctataaggattttacacttcagatcgacatggccttcaacgtgttcttcctactgtattttggcctccgtttcattgctgctaatgacaagctctggttctggctggaggtcaactccgtcgtagatttctttaccgttcctccagtgtttgtctcagtatatctgaaccgctcctggcttggccttcgctttctacgcgccttgcggctgatccagttctctgagatactccagtttcttaatatcttgaagacttcgaatagtatcaagttggtcaatctcctttctatctttatttcaacttggctgacagcagcaggtttcattcaccttgtcgaaaacagtggagatccttgggagaactttcagaataatcaagccctgacgtattgggaatgcgtttacctgctgatggtcacaatgagtacggtgggctatggcgatgtgtacgccaagacgacactgggccgcctcttcatggtgttttttattctgggcggactggcaatgtttgcctcctacgttcccgagataatcgaactcatcggtaatcgtaaaaaatacgggggcagttactccgcggtgtctggacgaaagcatattgttgtgtgcggccacatcacattagagagcgtcagcaattttctgaaagatttcctgcacaaggacagagatgatgtcaacgtggaaatcgtgttcctgcataacatttctcccaacctggagcttgaagccttgtttaaacgccacttcactcaggttgagttttatcaaggatcggtcttaaatccccatgacctcgcaagggttaaaattgaatctgcagatgcatgcctgattctcgcgaacaagtattgcgccgatcctgatgccgaggacgccagcaacatcatgcgcgtgattagcattaagaattaccaccccaagatccggatcatcacacagatgctgcagtatcacaacaaggcccatctcctgaacatccctagttggaactggaaagaaggggacgacgccatctgcctcgcggagcttaagctaggcttcatcgctcagtcctgtctcgcccagggcctgagcacaatgttggcaaacttgttcagcatgcggtccttcatcaagatagaggaggatacatggcaaaagtattacttggagggagtgtctaacgaaatgtacacggagtacctgtcctctgcttttgtgggccttagctttcctaccgtgtgcgagttgtgttttgtgaagctaaaattactcatgatagctattgaatacaaatccgccaatagggagtctcggatcttaatcaatccagggaaccacctgaagatccaggagggaaccctgggcttttttattgcatctgatgctaaggaggtgaagcgagccttcttttactgcaaggcctgtcatgacgacattaccgatcccaaaagaatcaagaaatgcggatgcaagcgcagatgggaggagcattgttccctgtggagactcgaaagtaagggcaacgtgcgaagactgaattactgccggggccagcagactttctcagtgaaggtgaaggtggcagcacgcagcaggtacagtaaggacccattcgagttcaagaaggagactccaaacagtcgccttgtcactgagcctgtggaggatgagcagccaagcaccctgagccctaaaaaaaaacagcgcaatggaggtatgcgtaactccccaaatacatccccaaagctcatgcggcatgacccactcctcatccccggcaacgaccagattgataacatggacagtaatgtcaaaaaatatgacagcacagggatgttccattggtgcgccccaaaggagatagagaaagtgatcctgacaagatctgaggccgctatgaccgtcctgtcaggccatgtggtggtctgcatctttggagacgtcagtagcgctctgatcggccttcggaatctggttatgccacttagagctagcaactttcactatcacgagctgaaacatattgtgttcgtgggttctattgaatatctgaagagggagtgggagactctgcacaactttcccaaagtgtccattctacccgggacaccacttagcagggctgatctcagagctgttaacattaacctgtgcgatatgtgcgttattctgtccgcgaatcagaacaacattgatgacacctcccttcaggataaagaatgtattctggcctccttgaacatcaaaagcatgcaattcgacgactctataggggtgctgcaggccaacagtcagggttttaccccgccaggtatggatcgctcatcccctgataattctccagtgcacgggatgctgcgtcagccatctatcaccacaggcgtgaacattccaatcatcacagagcttgtgaatgacactaatgtccaatttctggaccaggacgacgacgatgaccccgacacggaactgtacctgactcagccatttgcctgcgggacggccttcgcagtcagtgttttggatagcctgatgagtgcgacctatttcaacgataacatcctgactctgataagaacactggtgacgggtggggccaccccagaacttgaagcccttatagccgaggaaaacgccctcaggggcgggtatagcacgccacaaacgctggccaacagagatcgttgccgggtggcgcaactggctctgcttgatggaccattcgctgacttgggcgacggaggatgttacggggatcttttttgtaaggcattaaaaacatataacatgttgtgttttggcatctaccgtctccgggacgctcacctgtctacaccgagccagtgcacaaagcggtacgtgatcacaaaccccccttacgagttcgagttggttcctacagatctcattttttgcctgatgcaatttgaccacaatgctgggcagtcccgagcctcactctctcactcctctcactcctcgcagtcctctagtaaaaagtctagcagcgtccactcaattccatcaaccgcgaaccggcaaaacagaccaaaatcgcgcgagagtagagataagcaaaagtatgtgcaggaagaacgactttag

SEQ ID NO: 129486 - DNA, 3549 bp, Artificial Sequence
  Description of Artificial Sequence: Synthetic coding sequence
tgaagtagctcctcttcatcaagttcctcctccgtccacgaacccaagatggatgctctcattatccctgtgacaatggaagtgccatgcgacagccgcggacaacggatgtggtgggctttcctcgctagctccatggtgacgttcttcggcggactgtttatcatcctgctatggcgaacattgaagtacttgtggaccgtttgctgtcactgtgggggaaaaacaaaggaagcccagaagatcaataatggcagttcacaagctgatggtacacttaaaccagtggacgaaaaagaagaagccgtggcagcagaagtgggatggatgacatcggtcaaggattgggccggcgtcatgatcagtgcgcagaccctgaccggccgcgtgctggtggtgctggttttcgccttgagcattggggcgctggtgatttatttcattgatagctccaaccctattgaatcctgccagaatttttacaaagactttaccctgcagattgatatggcattcaacgttttttttcttctctatttcgggctccgctttattgctgcaaacgacaaactgtggttctggttggaggtgaattcagtcgtcgatttcttcacagtgccaccagttttcgtgtccgtttacctgaatcggtcttggctcggcctgcgctttctgcgggcactgcggctgattcagttttctgagatcctgcagttcctaaacatccttaagaccagcaacagcatcaagctagtgaatctgctttctatttttatcagcacctggctgacagccgccgggttcatccatctggtggaaaactccggagacccatgggagaacttccagaataaccaggcactgacttactgggagtgcgtgtatctgctgatggtgaccatgagcaccgtgggctacggtgatgtgtacgccaagacaacccttgggcggctatttatggtctttttcatactgggcggcctggctatgtttgcatcatatgtccccgagatcatcgagctgatcggtaacaggaagaaatatggcgggtcctattcagctgtgtctggacggaaacacatcgtcgtttgcgggcatatcactctggaatccgtgtctaatttcctcaaagatttcctccacaaagatcgggatgatgtgaacgtggagatcgtgtttctgcacaacatcagtcctaacctcgaactggaggccctgttcaaacgacacttcacccaagtggaattctaccaaggcagcgtcctgaatcctcacgaccttgcccgggtgaagattgagtccgctgatgcttgtttgattttggcaaataagtactgtgcagacccagatgcggaagacgccagcaatatcatgcgggtcatctctatcaaaaactatcatcccaagattaggattatcacacaaatgctgcagtatcataacaaagctcacctgctgaatataccctcctggaattggaaagagggggatgatgccatttgccttgcagagctgaaacttggtttcatcgcacagtcttgcctggcccaaggccttagtaccatgctcgctaatctgtttagtatgagaagtttcatcaaaatcgaagaggatacatggcaaaagtattacctagaaggagtgtccaatgagatgtacacagaatatctatcgagcgcatttgtagggctctcctttcccacagtctgtgagctgtgtttcgtgaaactgaagctgctgatgatcgccattgagtacaagtccgccaatcgtgagtcacgaatactgattaatcccgggaatcacttaaagatccaggaaggcacgttgggcttctttatcgccagcgacgccaaagaggtgaaaagagcctttttttactgcaaagcctgccatgatgacatcacagacccaaaacgcatcaagaaatgtgggtgtaagcgtctcgaagatgagcaaccttctacactcagccccaaaaagaaacagagaaatgggggcatgcgcaacagtccgaatacctcccccaaactgatgcggcacgaccctctgttgattcccggtaacgatcaaatcgataatatggattctaatgtaaagaaatacgacagtaccgggatgtttcactggtgtgctccaaaagaaattgaaaaagtcatcctcactcgttcggaggccgctatgaccgtgctgagtggacacgtggttgtgtgtatcttcggagacgtgtcaagcgcactgattggcttacgtaacctggtcatgccactgcgcgcaagcaacttccactatcacgagctgaaacatatcgtgttcgtcgggtccatagaatatttgaaaagggaatgggagaccttgcataatttccccaaagtgagcatcctaccaggcacacccctaagcagggcagacctcagggcagtcaacattaacctgtgtgacatgtgcgtaattctctccgctaaccagaataatatcgatgacacgtcactgcaggacaaggagtgcatcctggcttctctgaatatcaagtcaatgcaatttgatgacagcatcggagtgctgcaggctaactcccagggcttcacacctcctgggatggatcgatccagtccagacaactcacctgtgcacggcatgctgcgccagccttcaataacaacgggcgttaatatccctatcatcaccgagctagttaacgacaccaacgtacaatttcttgaccaagacgatgacgacgaccctgacacagaactatatctgacacagccattcgcatgcgggactgccttcgccgtttccgtgctagactccctcatgtctgccacgtacttcaacgacaacatactcaccctcatccgaaccctggtcactgggggggctactccagagctcgaagcactgattgctgaagagaatgctctgcgcggaggttactccacacctcagactctcgcgaatagggaccggtgtcgcgtggcccagctggccctgctggacgggcctttcgctgatcttggggacggtggatgttacggggacctgttttgcaaggctctgaagacctataatatgctctgcttcgggatctaccggctgcgtgatgcacatttgtccactccaagccagtgtacaaaacggtatgtcatcacaaaccccccctatgagtttgaattggtacccactgatctcatcttctgtctgatgcagttcgaccataatgcaggtcaaagtagggcctcactgtctcatagctcacatagttctcaaagctccagcaagaagagctcctctgttcattcaataccttccaccgctaatcggcagaatcgccctaagagccgtgagagccgagacaaacagaacgcaacgcggatgaaccggatggggcaggccgaaaaaaagtggttcactgacgagcccgacaacgcatacccgaggaacatccagatcaaaccaatgtcgactcatatggcaaatcagatcaaccagtataagtctacatcatctcttatcccacctatcagagaagtggaagatgagtgctag

SEQ ID NO: 129487 - DNA, 3504 bp, Artificial Sequence
  Description of Artificial Sequence: Synthetic coding sequence
cctaaaatggatgcgctgattattcccgtcactatggaggtgccttgcgatagtcggggccagcgcatgtggtgggcttttctggcaagcagtatggttacctttttcggaggcctgtttattatcctgctgtggaggactctgaaatacctgtggacagtgtgctgccactgtgggggcaaaactaaagaagctcagaagattaataacggctcttcccaagccgacggtaccctcaagcccgtggacgaaaaagaggaggccgttgccgcggaggttggctggatgacctctgtgaaggattgggccggggtgatgattagcgcccagacactgacaggccgcgtcttggtcgttctcgtgttcgccctttctattggggccctggtcatttacttcatcgattcctctaatcccatcgagtcttgccagaatttctacaaggattttactcttcagattgacatggctttcaatgtgttcttcttactgtactttggcctgcggttcatagccgctaacgataagctctggttttggttggaggtcaactctgtagtggacttcttcacagtgccacccgtttttgttagcgtgtatctcaataggtcatggctgggcctgaggtttctgcgcgcactgagactgattcagttttcagaaattttacaatttctgaacatcttgaagactagtaattccataaaactggtcaacctgttgagcatattcataagcacctggctgaccgccgcaggttttatccatttagtggagaactccggtgacccatgggaaaactttcagaacaatcaagcccttacttactgggagtgtgtgtacctcctaatggtgaccatgtctacagtgggctatggggatgtgtatgctaagactacgttaggccgactgtttatggttttctttatcttaggaggcttagccatgttcgcatcgtacgtgcctgaaattatagaactcataggcaatcgtaaaaagtacggtgggtcttactctgccgtgagcggacgaaaacatatcgttgtgtgcggacacatcactctggagagcgtttctaacttcctcaaggacttcctgcacaaagacagagatgatgtgaatgtggagatcgtgtttctacacaacattagtcccaacctcgaactagaagccctgttcaagagacatttcactcaggttgagttttatcaaggctctgttctcaatcctcacgaccttgcaagagtgaagatcgagagcgccgatgcatgcttaatattagctaacaagtactgcgccgaccctgatgcagaggatgcctctaatattatgagggtgatttcaattaagaactatcatcccaaaattcgtattatcacgcaaatgcttcagtaccataacaaagcgcatctcctgaatataccaagttggaattggaaagagggcgatgacgcaatatgcctggcagagctgaaattaggcttcattgctcaatcatgcctggcccaggggctgagcacaatgttggcaaatttatttagtatgagatcattcatcaaaatagaggaggatacctggcagaaatattatctggagggggtctccaatgaaatgtatactgaatacctgagctctgcttttgtgggcctgtccttccccacggtttgcgagctgtgttttgtgaaactgaagctcctgatgatcgctatcgagtacaagtctgccaatagggaatctagaattctcatcaaccctggaaatcacttgaagatacaagaaggaacacttgggttcttcatagcttccgacgcgaaggaggttaaacgtgcattcttttattgcaaagcctgccacgatgatatcactgaccctaaaagaatcaagaaatgtgggtgtaagagacttgaggatgaacagccctcaaccttaagtccgaaaaaaaagcaaaggaatggcgggatgaggaatagcccgaatacaagccccaaacttatgcgccacgacccactgttgattccaggcaacgaccagattgataacatggacagtaacgtgaaaaagtacgactctactggtatgttccattggtgtgcgcctaaggaaatcgagaaggtgattctgaccaggtcagaggccgccatgacagtcctatcaggccacgtggtggtgtgtatcttcggcgatgtttcctcggctctcatcggtcttaggaacctcgtcatgccactccgcgccagcaacttccactatcacgagttgaaacacatcgtttttgtaggctctatcgagtatctgaagcgtgaatgggagacactgcataattttcctaaggtctcgatcttgcccgggacaccattaagtcgagccgacttgagggctgtcaacatcaacctatgcgacatgtgtgtgatattgagcgcgaatcagaacaatatagacgatacatccctgcaagacaaggaatgcattttggcctcactcaacatcaaaagtatgcaattcgatgactcgattggcgtgttgcaggcaaattcccagggctttaccccacccggtatggacaggtccagcccggacaattccccagtccacggcatgctgcggcaaccttcaatcactacaggcgtcaacatcccaatcatcacagagctagttaacgacactaacgtgcagttcttggaccaagacgacgacgatgacccggacaccgaactctacctaacacagccattcgcttgcggaactgccttcgccgtgagtgtccttgattcactgatgagtgctacctatttcaacgataacattctcacactgattaggacgttggttacgggaggggctacccctgagttggaagcccttattgccgaggaaaacgccctgagagggggatatagcacaccccagactcttgctaatcgggaccggtgcagagtagcccagctcgccctgctagatgggcctttcgcggatctcggagatggtggctgctacggggacctgttctgcaaagcgctgaagacttataacatgctctgcttcggaatttacaggctgcgcgacgcccacctctcaactccctctcagtgcactaaaagatacgtgattactaaccccccctacgagttcgagctggttccgacagacctcattttctgcctgatgcagttcgaccacaacgcaggacagagtcgtgcatccctgtcccattctagtcattcctcacagagctcttcaaagaagagctctagcgtacactccattccctctactgccaatcgccagaacagacccaagtccagagagtcccgcgacaaacagaatgcaaccaggatgaaccgaatggggcaagaaaaaaagtggttcacagacgaaccagacaatgcataccccagaaacatccagatcaagcccatgtcaacacatatggcaaatcagattaaccagtacaagagcacatcgtctctgatccctccaatccgggaggtcgaggatgagtgctag

SEQ ID NO: 129488 - DNA, 3504 bp, Artificial Sequence
  Description of Artificial Sequence: Synthetic coding sequence
tagggtggcggaggcggcggcgggggaagctctctgcgcatgtcttcaaatattcacgctaatcacctctccctggacgccagtagctcttcctctagctcctcaagttcttcatcctcatcctcttccagctcttcgtcctcatctgtgcacgaacccaaaatggacgctctgatcattccagtaaccatggaagtgccctgcgacagcagggggcagagaatgtggtgggcgtttctggcctcgagtatggtaacatttttcggagggctcttcataatcttactttggagaactttgaaatatctgtggaccgtatgttgtcattgtggcggcaagaccaaggaagcacagaagattaacaatggcagctcccaggcagacggcaccttaaagccagtggacgagaaagaagaggccgtggcagcagaggtggggtggatgacctctgtgaaagactgggccggtgttatgatttctgcacagactttgacagggagagttctggtggtcctggtgtttgctctgtcgatcggcgcattggtcatatacttcatagactcctcaaatcccatcgagtcttgtcagaacttttacaaagacttcactttgcagatagacatggcattcaacgtgttttttttactctactttggccttaggtttatcgctgcaaatgataaactatggttctggttagaggtgaactccgtagtagattttttcaccgtgcccccggtgtttgtgagtgtgtacttgaaccgatcatggttggggctgaggttcttgcgagccctccggctcatccagttctccgagattctgcagttcctcaacatcttgaaaacctccaactctatcaagcttgttaacctcttgtcaatcttcataagtacctggctgactgccgcaggtttcatccacctcgtggagaacagcggagacccatgggaaaactttcaaaataatcaggctcttacatattgggagtgtgtttatctgctcatggtaaccatgtctaccgtgggctacggagacgtctacgcgaagacaacgctgggcaggctgttcatggtgttcttcatactcggcggacttgcaatgttcgcgagttacgtgccagaaatcatcgagctgattgggaaccggaaaaagtatgggggctcttacagcgctgtgagtggaagaaagcatatcgtggtatgtggacatatcacactcgaaagcgtgtcgaacttccttaaggactttttgcacaaagaccgcgacgacgtaaacgttgaaattgtttttctgcacaacatctccccgaatctcgagttagaggctctctttaaacgccattttacccaggtcgagttttatcaggggtctgtgctgaaccctcatgacctggctcgggttaaaatcgagagtgccgacgcatgccttatcctggccaataaatattgtgccgaccctgatgccgaggatgccagcaatatcatgagggtgatcagtattaagaattaccaccctaagatccggatcattacacagatgctgcaataccataacaaggcacatctgctgaatattccaagctggaattggaaagaaggagacgacgccatatgtcttgccgagctgaagttgggatttatcgcccagagttgcttggcccaaggtctttcgactatgctggctaacctgttttctatgcggagctttattaagatcgaggaggacacctggcaaaagtactacttagagggggtgtcaaacgaaatgtatacagagtatcttagttccgccttcgtgggactgtcctttcctaccgtgtgcgagctgtgtttcgtgaaactgaagttgttgatgatagcaatcgagtacaagtctgctaaccgcgaatcccggatcctgattaatcccggaaaccatctgaaaatccaggaagggacactggggttcttcatcgcatctgatgctaaggaggtgaaacgggccttcttctattgcaaggcttgccacgacgacattaccgatcccaagcgtatcaagaaatgtgggtgcaaaaggcttgaggatgagcagcctagcactctgtcgcccaaaaaaaaacagagaaatggagggatgcgtaacagccctaataccagtccgaagctcatgcgacatgatcctttactaataccaggcaatgaccagatcgataatatggattcaaacgtgaaaaagtatgacagcacaggaatgttccactggtgtgcccctaaggagattgagaaagtcattctgacccgatctgaggccgccatgaccgtgctgtcagggcatgtagtagtctgcatcttcggggacgttagctcggccctgatcggcttaaggaatctggtcatgccgctacgtgcaagcaacttccactatcatgaattaaaacatattgtttttgttgggtcgatagaatacctaaagagagaatgggagactctgcacaatttccctaaagtcagcatcttgcctggaactccgctctcacgagccgatttacgcgctgtaaacattaacctgtgcgacatgtgtgtgattctgtccgccaatcaaaacaacattgacgacacctccctccaggataaggagtgtatactagcgagtctcaacattaagagcatgcaatttgatgactccattggtgttctacaggccaacagccaggggttcaccccacccggaatggatagaagctcccctgataacagcccagtgcacggaatgttgcggcaaccaagtatcacgactggagtgaacatcccaatcatcacggaattagtcaacgacacgaacgtgcaatttcttgaccaagacgatgatgacgatccagacaccgaattatatttgacgcagcctttcgcatgcgggactgctttcgcagtttctgtgttggattctctaatgagtgctacctatttcaatgataatatactcaccttaatacgtaccctcgtcacgggaggagccacacccgagttggaggccctgatcgccgaggaaaatgccctgcgcgggggttattcaactccacagacactggctaatagagatcgatgtagagttgcccagctagccctccttgacgggccattcgcggatctaggtgacggcggttgctatggagatctgttttgcaaggctctgaaaacctacaatatgttatgctttgggatatatcggctgcgtgacgcccatctgtccacccccagtcagtgtactaagcgctatgtcattactaatcccccttacgaatttgagctggtccctactgatcttattttttgcctgatgcagttcgaccacaatgctggtcagtctagggcctccctctctcattcaagtcactcaagtcaatcaagctctaaaaaaagcagcagtgtccactccatacctagcactgcaaatcgacagaaccgcccaaaaagtagagaaagcagagacaagcagaatcgcaaagaaatggtgtacagatag

SEQ ID NO: 129489 - DNA, 3516 bp, Artificial Sequence
  Description of Artificial Sequence: Synthetic coding sequence
atggacgccctgatcatacccgttaccatggaggtgccttgcgactctagagggcaacgaatgtggtgggccttcctcgcttcctcgatggtgacatttttcgggggattgttcataatcctgctgtggaggacccttaaatacctgtggacggtttgttgtcactgcggcgggaagaccaaggaggctcaaaagatcaataacggaagtagccaggccgacgggaccctcaaacccgtagacgaaaaagaggaagctgtggctgccgaggttggctggatgacctccgtaaaagactgggccggagtgatgatctctgctcagactctgaccggccgggtacttgtggttttggtcttcgccctcagcattggcgccctggtaatatatttcatagattctagtaatcccatcgagagctgccagaacttttacaaagattttacattacaaatcgatatggctttcaatgtcttctttctgctatacttcgggctgaggtttatagcagccaacgataaattgtggttttggctcgaagtcaactcagtggtagatttctttactgtgccaccagtgtttgtctctgtgtatttgaaccgatcatggttaggcctccgctttttgcgtgctctgagattaatacagttttctgagattctccagttccttaatattcttaaaacctctaacagcattaaattggtgaatctgttgtcgatctttataagcacttggcttaccgccgccgggtttatacatcttgttgagaacagtggggacccctgggaaaatttccagaataatcaggctcttacatactgggagtgtgtctacttgttgatggtcaccatgtccaccgtgggatatggagatgtgtacgcgaagactacgctcggacgcctgtttatggttttcttcatcttgggcggcctcgccatgtttgcttcttacgtgccggaaatcatcgaattgatcggaaatcgcaaaaagtatggaggctcgtatagcgctgtgtccggacgtaaacacattgtagtgtgcggtcatataacgctggagagtgtgtctaattttttaaaagacttcctgcacaaggacagagatgacgtcaacgtggagattgtgtttctgcataatataagtccgaacctcgaactggaggcccttttcaagaggcactttacccaggtcgagttttaccaaggcagcgttctcaaccctcatgacttggctcgggtaaaaatcgagtctgctgatgcctgtctgatcctcgccaataaatactgtgccgaccctgatgccgaagatgcttctaatatcatgagagtgataagtatcaaaaactatcaccctaaaatcagaataataacgcagatgctgcagtaccataacaaggcccacctgcttaatatcccaagctggaattggaaagagggggatgacgcaatctgtcttgccgagctaaagctgggtttcattgcccagtcttgtctcgcccaagggttaagcaccatgttggccaatttgttctccatgcgtagctttattaagatcgaagaggatacctggcagaaatactacctggaaggcgtctcaaatgaaatgtatacagagtatctgagctcagccttcgtcggactgagcttccctacggtatgcgagttatgcttcgttaaattaaagctgctcatgattgctattgagtataagtcagctaacagggagtcccggatcttgatcaatccgggtaatcatttgaagatccaggaaggcactctcgggttcttcattgcaagcgatgccaaagaggtcaaacgtgcctttttctactgtaaggcatgccacgatgatataacagatccaaagagaatcaagaagtgcggctgtaaacgcccgaagatgtctatttacaagaggatgaggagggcctgttgtttcgactgcgggagatctgagagggattgtagctgtatgtcgggcagagtccgcggtaacgtcgatacgttggagagagccttccctctgagttccgtgtccgtcaatgactgttctactagttttagggctttcgaggatgaacagcctagcaccctttctccaaaaaagaagcagaggaatggtgggatgcggaatagccccaatacaagtcctaagctaatgcgacacgatccattactcatcccgggcaatgaccagatcgataacatggactcgaatgtcaaaaagtacgattcaacgggcatgtttcactggtgcgccccgaaggagatcgaaaaggttattcttactaggtcggaggccgccatgaccgtgctcagcggccacgtcgtagtgtgtatctttggcgatgtaagcagcgcactgatcggcctgcggaacttggtgatgccgttgcgcgcctccaattttcactatcatgagttaaaacacatcgtgtttgtgggaagtatcgaatacctcaaaagggagtgggagaccttacacaattttccaaaagtctccattttgcctggcacccccctgtcccgggctgacctcagggctgtaaatattaatctttgtgatatgtgtgtgatcctctccgccaatcaaaataatattgacgacacaagcctccaggataaagaatgcattctggcctcgctcaatatcaaatcaatgcagtttgatgacagtataggcgtcctacaggccaatagtcaaggcttcactccaccaggaatggacagaagctccccagacaactcaccagtgcatgggatgctacggcagcccagcatcaccacaggagtcaatattccaatcataacggagcttgtcaatgacactaatgtgcagtttctcgatcaagatgacgacgacgatccagataccgagctataccttacacaaccctttgcctgtgggaccgcattcgccgtctcggtgctcgacagcctcatgtctgccacttattttaatgacaatatcctgacgctcattaggacgcttgttaccggaggggccacccctgagttagaggccttaatcgccgaagagaacgcattaagaggcggctactcgaccccccaaacacttgcgaacagggacaggtgccgcgtggctcagctggccctgctggacggcccctttgctgacctgggcgatggaggttgctatggagatttgttctgtaaagcactcaagacttacaacatgctgtgtttcggaatctacaggctcagagatgcgcatttatcaacaccctctcaatgtactaaacgctatgtaatcacaaaccccccatacgagtttgagctcgtgcccaccgacctgatcttttgtctgatgcagttcgatcacaacgccggacagagtcgcgcatccctgtctcactcctcccactcgtcgcagtcgtctagtaaaaaatcttcttcagtgcactctatcccttcaacggctaatcggcaaaatagacccaagtcaagggagtcccgggataaacagaaccgcaaggaaatggtgtacaggtag

SEQ ID NO: 129490 - DNA, 3534 bp, Artificial Sequence
  Description of Artificial Sequence: Synthetic coding sequence
atggctaatgggggcgggggtggcggagggtctagtggcgggggtggtggcgggggtgggtctagtctcagaatgtcctccaacattcacgccaaccatctgagcctcgacgcttcttccagctcttcatcaagcagcagctcctcctcctctagttcctctagcagcagctcctctagcgtacatgagccaaagatggacgcactcattattcccgtgaccatggaggttccatgcgactctcgaggtcagcgaatgtggtgggccttcctcgcctctagcatggtgacttttttcggcgggctattcattattctactgtggcgaacccttaagtatctctggacagtgtgctgtcactgtggaggaaagacaaaagaagcccagaaaattaacaatggatcatcacaggcagatggcacactcaaacctgtcgatgagaaggaagaggctgtggccgccgaagtgggttggatgaccagtgtcaaagattgggcaggcgtgatgatctccgcgcagaccctgacgggtcgcgtcctggtggtcctcgtttttgctttgtcgattggcgcgctggtgatctatttcatcgattcatcaaaccctatcgagtcatgccagaacttttataaagacttcaccctgcagatcgatatggcctttaatgtgttttttctcctatacttcggcctgcgttttatagccgccaacgataaattgtggttctggctggaggttaatagtgtggtcgatttctttactgtccccccggtttttgtcagcgtctatttaaacaggtcttggttggggctgcggtttctgcgcgcccttaggctcattcagttctctgagattttgcagttcctgaatattcttaagacgtctaattctatcaaacttgtgaacctgctcagtattttcatctcaacctggctgaccgctgccggattcattcaccttgttgagaactccggagatccctgggagaattttcagaacaaccaagcgctcacttattgggaatgtgtgtatctcctcatggtaaccatgagtaccgtcgggtatggtgacgtgtatgctaaaacaactcttggccggctgttcatggttttcttcattttaggcggcctggccatgtttgccagctacgtgccggagatcatagagctcataggtaatagaaagaagtacggtggatcttactcagcagtgtcgggccgcaagcacattgtggtctgtggccacataactttggagagcgttagtaatttcttgaaggatttcctccacaaagatcgggatgacgtgaatgtagaaatcgtttttctccacaatatatcaccgaatctcgaacttgaagccttgtttaaacggcacttcacacaggtggaattttaccagggttcagtcctgaatcctcacgatcttgctagagtaaagatcgagtcggcagacgcctgtctgatcctagcgaacaaatattgtgcagatccggatgcagaggatgcttccaacatcatgcgcgtcataagtattaaaaactaccatccgaagatacgcataatcacccaaatgctccagtatcacaacaaggcacacctgttgaacatcccctcatggaattggaaagagggggacgatgcgatctgtctggccgaactcaagctgggcttcattgcgcagagttgtctcgcccaaggactgtctaccatgcttgcgaatctgttttctatgagaagctttattaagattgaggaggatacctggcagaagtattatctggagggagtgagtaacgagatgtacaccgaatacctgagttccgcctttgtgggattgagcttccccacagtttgtgagctgtgtttcgtgaagctcaagcttctgatgattgccattgaatacaagtccgctaatcgggagtctagaattctcattaaccctggcaatcatctgaaaattcaagaggggacactgggattcttcatagccagcgacgccaaggaggtcaagcgggcattcttctactgtaaagcctgccacgacgacattactgacccaaaacgaatcaagaagtgcggctgcaagcgcctagaggacgaacaaccttcaaccctaagccccaaaaaaaaacagcggaatggcggaatgagaaacagcccaaatacatctcctaagctcatgaggcacgatcccttactaattcccggaaacgatcaaattgacaatatggacagcaacgtgaaaaagtacgattctactggaatgttccattggtgcgcacctaaggagatcgagaaagttatactgacccgcagcgaggcagcaatgacagtgctgtctggccatgtcgtggtgtgcatctttggcgatgtgtctagtgctctgatcggacttagaaacctggtgatgccactccgggcctccaactttcattatcatgaactgaaacatattgtgtttgtcggctccatagagtatctgaagcgagagtgggaaacactgcacaacttcccaaaagtcagcatcctccctggcacgccgctgagtagggcagacttgagggctgtgaatattaacctatgtgacatgtgcgtgatactgagtgctaatcagaacaatatagacgacacttccctacaggataaagaatgtatcctagcctcactaaacatcaaatctatgcagttcgacgactctatcggggtccttcaggcaaatagtcagggattcaccccacccggtatggatcgttcctccccagacaactcacctgtgcacggtatgttgaggcagccttccatcacaactggagtcaacattcccataatcacagagctcgtgaatgacaccaatgttcaattcctcgaccaggatgacgacgacgacccagacaccgagctttatctcactcagccattcgcatgtggcaccgccttcgccgtctccgtgcttgacagtttaatgtccgctacctactttaacgataatattctcactctcatcagaactctggtgacaggtggcgcaactccggagcttgaggctctcatcgctgaagagaacgccctgcgagggggttattccactccccagaccctcgccaacagggatcggtgtcgcgtggcacagcttgctctcctggacggcccatttgcagacttgggagatggaggctgctatggcgatctattctgtaaagccctcaagacctacaacatgctgtgctttggcatctaccgtctcagagacgcccatctctctacgccatcacaatgtaccaagcgctatgtcatcaccaacccaccgtacgagttcgagctcgtgccgacagatctgatcttctgcttgatgcagtttgaccacaacgctggccagagccgagcttctttgtctcattcatcacattcgtcacagagtagtagcaagaagagcagcagcgttcattctataccctccacagcgaaccgccagaatcgccctaaatcccgtgaaagcagggataaacaaaagaaagaaatggtgtacagatag

SEQ ID NO: 129491 - DNA, 3618 bp, Artificial Sequence
  Description of Artificial Sequence: Synthetic coding sequence
atggcaaacggtggggggggaggcggtggatcttctggtggtgggggcggtggggggggctcctccctccgcatgagctcaaacatccacgccaaccatttgtcgttagacgcctctagtagcagcagttcaagctcatctagtagtagctcttcatcatccagctcctcgtcatcttcggtccacgaaccaaaaatggacgcattaataattcctgtaaccatggaagtgccctgcgattcgaggggtcaaagaatgtggtgggcatttctcgcttccagtatggttacgttttttggcggactgttcatcatcctgctgtggcggacactgaagtacctctggacagtgtgctgtcattgtggcggaaaaaccaaagaagcccagaaaataaataacggctcaagccaagcagacggtaccttgaaacctgtggacgagaaagaagaggccgtggccgccgaggtaggatggatgacatctgtcaaggattgggccggagtgatgattagtgcgcagacattgacagggagggtcctcgtggtactagtgttcgccctctccatcggggccctcgtaatttatttcattgacagctccaacccaatcgaatcatgtcaaaatttttacaaagatttcacgctgcagatcgacatggcgtttaacgtgttttttctgctgtatttcggcctgcgattcatcgccgcaaatgacaagttatggttttggttggaggttaatagcgtcgttgacttcttcactgtccctccagtgtttgttagtgtatatctcaacaggagctggttgggactgagattcctgcgagctttgaggcttattcagttttccgagattctgcagttcctcaacattctgaagacgtccaactccattaaactggttaatctcctcagtatctttatcagcacctggcttaccgccgcagggtttatccacctggtggaaaactctggagatccttgggagaatttccagaataatcaggcacttacgtactgggagtgcgtatacctgctcatggtgactatgtcgaccgtgggctacggtgatgtatatgccaagaccacgctgggtcggctgttcatggttttttttatccttggcggcctggctatgttcgcctcttacgttccagaaattatagaacttatagggaaccgaaagaagtacggcggctcctactcagcagtgagcggtagaaagcacatcgtggtttgcgggcatattacactcgagtccgtgtcgaactttctgaaagactttcttcataaggatagggatgacgtcaatgtggagatcgtgttcttacacaatatctcccctaatctggaacttgaggcactctttaagcgtcatttcacccaggtcgaattctaccagggctcggtgctgaatcctcatgatttggcccgcgtgaaaattgagagcgccgatgcatgcctgatcctcgcaaataagtactgtgcggacccggatgcagaagatgcaagcaacatcatgagagttattagcatcaaaaactatcatccaaaaatcagaatcatcacgcaaatgttgcagtatcacaacaaagcacacttactgaacatccccagctggaattggaaggagggcgacgacgcaatttgcctcgccgaactgaagcttggttttattgcacaatcttgtctggcgcaggggctgagcacaatgctggcaaatctgttctcaatgaggtcattcattaaaatcgaggaggatacctggcagaagtactacctggagggggtttctaacgaaatgtataccgagtacttgagttcagcctttgtagggcttagctttcctacagtttgtgagctttgttttgtcaaactgaaactcctaatgattgccatcgagtataagtctgctaatcgcgagagccgtattctcatcaacccaggaaatcatcttaagatacaggagggcacactcggcttttttatagctagtgacgctaaggaagtgaagagggcattcttttattgcaaggcctgtcatgacgacattaccgatccgaaacggatcaagaagtgtgggtgtaagcgacttgaggacgaacagccttctacactctcacctaagaaaaaacaacggaatggcggaatgcgtaacagccctaatacgtcacccaaactaatgagacacgacccactcctaattcccggtaacgaccagatcgataacatggatagcaatgttaagaaatatgactcaaccgggatgtttcactggtgtgctcccaaggagattgaaaaagttatcttgacacggtccgaagccgcgatgactgtgttaagcggacatgtcgtggtttgcatctttggcgacgtgtctagtgctctaatcgggcttcgaaatctggtgatgcctctgcgggcctccaacttccactatcatgagttaaagcatatagtcttcgtgggatcaatcgagtacctgaagagagaatgggagacacttcacaacttccctaaggtctcaattctgcctgggacccctttgtcacgggcagatctgcgcgcagttaatattaatttgtgtgatatgtgtgtcatactgtccgctaaccagaataatatcgatgacacttcgctgcaggacaaagaatgtattctcgcctctcttaacattaagagcatgcagtttgatgacagtatcggagtactccaggcaaatagtcagggatttacccctcctggcatggaccgctccagtcccgataactcccctgtccacgggatgctgcgtcagcctagcattaccaccggcgtcaatattccaattatcacagagctggccaagcctggcaaactcccactcgtaagcgtcaaccaggagaagaattccgggacgcatatccttatgatcaccgagctggtgaacgacacgaacgtgcaattccttgaccaggacgatgacgacgatccagacacagagctgtacctgacgcagccatttgcgtgtggtacggcatttgccgtgtccgtcctagattcactaatgtctgccacctacttcaatgacaacattctgactttaatcaggactctggtcaccggtggggccacaccggaactggaagcactgatcgcagaagaaaatgcacttcggggaggatattcaaccccgcagactttagctaatagagaccgatgtagggttgcccagctggctctgttggacggccccttcgcagaccttggcgatggaggctgctacggagacctgttttgtaaggcgctgaagacttataacatgttgtgcttcggcatctatcggctacgcgatgctcatctgagcaccccatcccaatgtacaaagcgatacgttatcacaaatccgccctatgaattcgaactggtgcccacggacctgatcttctgccttatgcaatttgatcacaatgccggacagagtcgagcgagcctatcccactcgtctcacagtagccagtcaagtagcaaaaagagctcgagcgttcatagcattcctagcaccgctaacagacagaatcgtccaaagtcccgcgaatctcgggacaagcagaaccggaaagagatggtgtaccgatag

SEQ ID NO: 129492 - DNA, 3678 bp, Artificial Sequence
  Description of Artificial Sequence: Synthetic coding sequence
cccaaaatggacgctctgattataccagtcacaatggaagtgccttgcgatagcagaggccagcggatgtggtgggctttcctggccagctctatggtgacctttttcggaggcttatttataattcttttatggaggaccttgaagtacctatggacagtgtgttgtcactgcggaggcaagacaaaggaggcccagaaaatcaataatggcagcagtcaagctgacggcactctgaagcccgtggacgagaaagaggaagcagttgcagccgaagtaggctggatgaccagcgtgaaagactgggccggggtgatgatctctgctcaaacgcttactggcagagtgctggtggtactcgtcttcgccctctccattggcgctctcgtgatttattttattgattcatcaaatcctatagagtcttgtcagaacttttacaaggacttcacgttacagatcgatatggccttcaacgtgtttttcctcctctacttcggtctgcgatttattgccgcgaatgataagctgtggttctggctcgaggtgaattccgttgtggactttttcactgtgccccccgtatttgtcagcgtttatctgaaccggtcttggttgggtctgcgtttcctgagagccctgcgtctgatacagttctcggaaatccttcagttcctaaacattctaaagacctctaattcgataaagctcgtcaatttgctgtctatctttatcagcacatggctgacagccgctgggttcatccacctggttgagaacagcggagacccttgggagaactttcagaacaaccaggccctgacatattgggaatgtgtctaccttctcatggtgaccatgagcacagtgggctatggggacgtttacgccaagaccacactcgggcgtctttttatggtgttcttcatcctgggaggcctcgctatgttcgcctcttacgttcccgagattattgaactcatcggaaatagaaagaagtacggcgggagttatagcgccgtgagtggcaggaaacacatcgttgtgtgtggacacataacactggagagcgtctcaaatttcctgaaggacttcctgcacaaagaccgggacgatgtaaacgtagaaatcgtgttcttgcacaacatttcacctaacttagaactggaagcactgttcaaaagacacttcacccaggtggaattttaccagggatcagtcctgaatccgcatgatctcgcacgtgtgaaaatagaatctgctgacgcatgcctcatactcgcaaataaatactgcgctgatccggacgccgaggatgccagtaatataatgagggtgattagtataaagaattatcacccaaaaattaggattattacacagatgctccagtatcacaacaaggcccaccttttaaatatcccgtcgtggaactggaaggagggcgacgacgcaatttgcctggccgagctgaaacttggatttattgctcagagctgtcttgcccagggtctctcaacaatgctggcaaacttattttcgatgcggagcttcatcaagatagaggaggacacttggcagaaatattacttggagggcgtctcaaatgagatgtacaccgagtacctctccagcgcttttgtgggattgtcatttcccacagtgtgcgaactttgcttcgtgaaacttaaacttttaatgatcgccattgagtataaatcggccaaccgcgagtcgcgaatcctgatcaatccgggtaaccatctcaaaattcaagaaggcactctgggcttctttatcgcatccgatgccaaggaagtgaaacgtgcattcttttactgcaaagcatgtcatgacgacattaccgacccgaagaggattaagaagtgcgggtgtaagcgtccaaaaatgagcatatacaaaagaatgcggcgggcctgctgttttgactgcggcaggagcgaacgagattgctcttgcatgtcaggtagagtgcgcggcaacgtggacacgctggagagggcctttcctctgtcgagcgtgtccgttaacgattgcagcactagcttccgagcgtttgaggacgaacagccgtctacattatccccaaagaagaaacaaaggaacggcggcatgcggaatagccccaacacaagccctaaactcatgagacacgaccccctcctgattcctggaaatgaccagattgacaacatggattcaaacgtcaagaaatacgattccaccggtatgtttcattggtgtgcgcccaaggagatcgaaaaagtcatcctgacacggtccgaggccgccatgaccgtactcagcgggcacgtggtggtctgtatttttggagacgtgagtagtgcgctcattgggctgcgaaatctcgtcatgcccctgagagcaagcaactttcactatcacgagctgaagcacattgtttttgtgggatctattgaatatttgaaaagagaatgggagaccctgcacaacttcccgaaagtatccatacttccaggcacaccattgtctcgcgcagacctccgggcagtgaacattaatctgtgtgacatgtgtgtcatcctgagcgccaaccaaaataatattgatgatacttctctgcaagacaaggagtgtatactcgcttcgctgaatatcaagtccatgcagttcgacgactccataggggtattacaggccaacagtcaaggttttaccccccccggtatggacagaagcagtcctgataatagtccggtgcatggtatgctgcggcagccttctataacaacgggcgttaacattcccatcatcacagaactcgtaaacgatacaaacgtgcaattcctggaccaggacgatgatgacgatccagacactgagctttatttaacccagccttttgcctgtggcacagccttcgccgtttcagtgctagacagcctgatgtcagccacttattttaacgacaatatccttaccttaattcgaaccctggtcacagggggagccacacctgagctggaggcactgatcgcggaggaaaacgcacttcgtgggggatactccactcctcaaacattggctaacagagatagatgtagagttgcacagctggctttgcttgacggaccttttgctgatctgggtgacgggggctgttatggcgacctattttgtaaagctctcaagacctataatatgctttgcttcggtatctatcgtctgagggacgcgcacctttcaacaccctcccagtgtactaagaggtacgtgattacaaatcctccttacgaatttgaattagtccctacggacctcatcttctgcctgatgcagtttgaccacaatgctggccaatcccgggcttccttatctcactcctcacactctagccagtctagttcaaaaaagtctagtagcgttcactctattccttccactgcaaacagacagaatcgacccaagtcccgcgaaagccgagataaacaaaatgctacacgcatgaatcgcatgggacaggagaagaaatggttcaccgatgaaccagacaatgcttatccgaggaatatccaaattaaacccatgtctacccacatggccaatcagattaaccaatacaagagcacaagttctttaatccctccgataagagaggtagaagatgagtgctag

SEQ ID NO: 129493 - DNA, 3660 bp, Artificial Sequence
  Description of Artificial Sequence: Synthetic coding sequence
atggctaacggcggcgggggcggcggtgggtcgtccgggggaggcggcggaggcggagggtctagtctgagaatgagctccaatattcacgccaatcaccttagcctggacgcaagctcctcctcgagcagctctagcagctcctccagctcctcgtcatcctctagtagttcttccagcgtgcatgagccaaagatggacgccctgatcatccctgtgacaatggaggttccgtgtgatagtcgtggtcagcgcatgtggtgggctttcctcgctagctcaatggtgacgttcttcggcggattgttcatcattttgctgtggaggacccttaaatatctgtggacggtgtgttgccattgcggcggcaagacaaaggaggcacagaagattaacaacgggtcgagccaggcagatggtaccctgaagcctgtggacgaaaaagaggaagcagtggctgccgaggtcggatggatgactagtgtgaaagattgggctggcgtaatgatttccgctcagacgctgacgggacgcgttctagtcgttctggtgtttgcactatctatcggagctctggtcatctattttatcgattcctccaaccctatcgaatcatgccagaatttttacaaggacttcactttgcagattgacatggcatttaatgtcttcttcctgctgtatttcggtctgcgtttcatcgctgcaaatgataagctgtggttctggctggaagtgaattccgtggtggacttcttcaccgtgcccccagtgtttgtgagtgtttacctgaatagatcctggttaggactgcgctttcttcgcgctttacgtttgatccagttcagtgaaattttgcagttcttaaacatactcaaaacttcgaactcaattaagctggtaaatctactgtccatttttattagcacctggctgaccgcggctggtttcatccacctggtcgaaaatagcggtgatccctgggagaacttccaaaataatcaggccctgacgtactgggagtgtgtatacttactcatggtcaccatgtctacagttggatacggagacgtctatgctaagaccacactcggccggttatttatggtcttcttcatcctgggcggactggctatgttcgcttcatatgttccggaaatcatagaactgattgggaataggaagaagtacggcggcagctatagtgccgtgagtggccggaaacacatagttgtgtgcgggcacatcaccctggaaagcgtgagcaactttctgaaggacttccttcataaggaccgcgatgacgtcaacgtggaaattgtgtttctgcataacatatcccctaacctggaactggaagccctcttcaagcgtcatttcactcaggttgagttttaccaaggaagcgtgctgaacccacatgacctggcaagagtgaaaatcgagagcgccgatgcctgtttgatccttgctaataagtactgtgctgatcctgacgcagaagacgcctctaatattatgagagtgattagtatcaagaactatcaccccaagatacgaatcataactcagatgttacaataccacaacaaagcccacttgctcaacattccttcgtggaactggaaggagggtgacgacgccatatgcctcgctgagttaaagctgggctttatcgcccagtcatgtctagctcagggtctgtccactatgctcgccaacctattctcgatgcggagttttattaagattgaagaggatacatggcagaaatactatcttgagggcgtgtcaaacgaaatgtacacagagtacctgagtagcgcatttgtaggtctgtccttccccaccgtctgcgagctgtgtttcgtcaagctgaaactgctcatgatcgccatcgagtacaaatctgcaaaccgggaatcgcggatcctgatcaaccctggcaaccatctcaagatccaggaaggaacattgggattcttcatagccagcgatgcgaaggaagtgaagagggcatttttttactgtaaagcttgtcatgacgacatcactgaccctaagcgcattaagaagtgcgggtgcaagcggttagaagatgaacagccgagtacactgagtcccaagaagaaacagcgcaacggcggcatgcgcaatagccccaacaccagcccgaaattgatgcggcatgaccccttgctgattcccggcaatgatcagatagataatatggatagcaatgtcaagaaatacgattccacaggcatgtttcactggtgtgcacccaaagagattgagaaggttattcttgtaactgggtggatgccctatctcggtccccgcgtactcatgacatgcctcgacatcggagttgtctgcatgcccactgacatccagtctacatccccagcgtcaatcaaaaaattcaaggaaacacgctcagaggctgctatgactgtattgagcggccacgtggtcgtgtgcatttttggggatgtatcgagcgccttgataggtctaaggaacctcgtgatgccgttgcgggcctcaaactttcattatcacgagctgaagcacatcgtttttgtgggtagcatagagtatctgaagcgggaatgggagacgctgcacaactttccgaaagtgagtatcttgcctggaactcctctgtcacgcgctgatctcagagccgtaaatatcaacttatgtgatatgtgtgtcatcctctccgctaaccagaataatatcgacgatacaagtctccaggataaagagtgcatactcgcctccttaaacatcaagtctatgcagtttgatgattctataggcgtgcttcaggccaacagtcagggtttcactccccccggaatggatcgaagcagtcccgacaactcgccagtgcacgggatgctgaggcaaccatctattacaaccggcgtgaacatccctataatcacagaactcgtgaacgatacaaacgtccagttcctcgatcaggatgatgatgatgaccctgatacagagctgtacctgacacaacctttcgcatgtggtacagcatttgctgtgagcgtgctggatagcctgatgagtgcaacctactttaatgataatattttgacactgatcaggacactcgtaacaggcggtgctacccccgagttggaggccttgatcgcagaagaaaacgctttacgcggcggctactccacaccccagacactcgccaacagggaccggtgcagagttgcccagctagctctgttggatggcccctttgccgaccttggggatggaggttgctacggcgacctcttctgcaaggccctgaagacttataatatgctctgtttcggaatctacagacttagggatgcacatttatctacccctagccagtgcactaagcgctacgtgataacgaacccaccttacgagtttgagttagtgcccaccgacctaatattttgtttgatgcagtttgaccacaacgccggacagtctcgggcctcgctctcccacagttctcattcgtctcagagctcctccaaaaagtcttcatccgttcactccattccttctaccgcaaaccgacagaacagacccaaatcccgggaatctcgggataaacagaagtacgtacaggaagagcgcctctag

SEQ ID NO: 129494 - DNA, 3723 bp, Artificial Sequence
  Description of Artificial Sequence: Synthetic coding sequence
atggccaatggcggcggcggcggtggaggctcctctggcggcggggggggcggcggcggatcaagtctgagaatgtcctctaacatacacgccaatcacctcagcttagatgcttccagtagcagcagttccagcagttcctcatcctcctcatctagctcgtcatcaagttcgtcttcggtacacgagcccaagatggatgccctcatcattcccgtgaccatggaggttccatgtgactcacgagggcagcggatgtggtgggcttttctggcgtccagcatggtgacattcttcggaggcctttttatcatactgctttggaggaccctgaagtacctgtggacagtgtgctgccactgcggggggaagacaaaagaggcccagaaaatcaacaacggctcctcccaggcggacggtactctgaaaccagtcgacgagaaggaggaagcagtggcagctgaagtcggctggatgaccagcgttaaagactgggctggcgttatgatctcggcccagaccctcaccggccgggtgctcgtggtgcttgttttcgctctcagcattggagcgctggtcatctactttatcgatagctcaaatccaattgaatcttgccagaatttctataaagattttaccctgcagattgatatggccttcaatgtgttcttcctgctgtactttggcttaaggttcatcgctgctaatgataaactttggttttggctggaagtaaactctgtcgttgattttttcaccgtgccccctgtgttcgtgtctgtgtacttgaacagaagctggctgggcctccgctttcttagagccctgaggctcatccaattcagcgaaatcctacaattcctgaacatcctgaagacatccaattcaatcaagctcgtgaatctgctgagcatattcataagtacctggttgaccgcagccggattcattcatttagtcgaaaactcaggggatccttgggagaattttcagaataatcaggcgctgacttattgggagtgtgtgtatctcctgatggtaactatgagcactgtgggatatggcgatgtctacgccaagactacgctgggccggttatttatggtattctttatacttgggggattggccatgtttgctagctatgtccctgagattattgagctaatcgggaataggaaaaagtatggaggatcatacagtgccgtgtcagggcggaagcatatcgttgtgtgtggccacattacactagagagcgtctcgaattttttgaaagactttctccacaaggatcgagacgatgttaatgtggaaatcgtgtttctgcacaatatcagtcccaacctggagctggaagccctgtttaagagacatttcacccaggtggaattctaccaaggctctgtcctcaacccccatgacctggctcgagtcaagatcgaaagcgcagacgcttgcctaatcttagctaataaatattgcgcggacccggatgcagaagacgcctctaatatcatgagagtcatttcaatcaaaaattatcatcctaaaatcaggatcatcacgcagatgttgcagtatcataacaaagcccatcttttgaatattccctcttggaattggaaagagggtgatgacgctatttgcctggccgagttaaaactgggctttattgctcaaagttgcttggcccaggggctctcaactatgttggccaacctgtttagtatgcggagcttcattaaaatagaggaggacacctggcagaaatattatctggagggcgtgtcgaatgagatgtatacggagtatctgtctagtgcctttgtggggctaagctttccgaccgtttgtgaactctgcttcgtgaaactcaaactattgatgatcgccattgaatataagagcgcgaacagggagtccagaggccggctcagcatcttaataaacccaggtaatcatcttaaaatccaggaggggaccctgggcttttttatagccagcgacgccaaggaggtcaagcgcgccttcttctactgtaaggcgtgtcacgatgatataacagaccccaaacggatcaaaaaatgtggttgtaaacgcccgaagatgtccatttataagaggatgaggagagcctgctgctttgactgtggccgctccgaacgcgattgcagctgcatgtccggtcgagtaaggggaaatgtggatacactagagcgtgcctttcctttatcttcggttagcgtgaatgactgttccacaagttttagggcttttgaggatgaacaaccctcgacgctttcaccaaagaagaagcagagaaatggaggcatgcggaatagccctaacacttcaccgaaacttatgagacatgatcctctgttaatcccgggaaatgaccaaattgacaacatggattccaatgtgaaaaagtacgattcaacaggcatgtttcactggtgcgcaccgaaagagattgagaaagtgatcctaacaagatccgaggctgccatgaccgtactgagcggccatgtggtggtgtgcatttttggggacgtttcatccgctctgattggtctgcggaatcttgtaatgcctttgagggcttccaatttccattaccacgagctcaaacacattgtatttgtgggctctatagagtatcttaagcgcgagtgggaaacacttcataattttcctaaagtgtctatcttgccaggaaccccacttagtagagccgacttgcgggccgtgaatatcaacctgtgtgatatgtgtgtgattctctccgccaaccaaaacaacattgacgacacatctctgcaagacaaggagtgtatcttagcctcactgaatatcaagagtatgcagtttgatgactcaatcggggtgctgcaggcgaatagtcaagggtttacccccccaggcatggacagaagttctccggataactcaccagtccacggaatgcttcgccagccaagcattaccacaggggtgaatatccctatcatcacagagctggtaaacgacactaatgtccagtttctcgaccaggacgatgacgatgatccagacactgagttatacctaacacagccatttgcctgcggaacagcgttcgcggtgagcgtgctggatagtcttatgtcagcaacttacttcaatgataacatcctgaccttgattaggacacttgtcacagggggggccacaccagagctggaagcattaatcgccgaggaaaacgccttgcgcggcggatattccacaccgcagaccctcgccaatcgagatcgctgcagagttgcacagctggccctcctggacggacccttcgcagatctgggagacggtggatgctacggcgaccttttttgtaaggcgctgaaaacctacaatatgctgtgtttcggcatctatcgtttacgggacgctcacctttcaaccccaagccagtgcactaagagatacgtgatcacaaaccctccctacgagttcgagctggtgccaacagatctcatcttctgtttgatgcagttcgaccacaacgccggccagtcccgtgctagcctttctcacagctctcattcaagtcagagctcctcgaaaaaatccagctcagttcattcaatccctagcaccgctaaccgccaaaatagaccgaagagcagggagtctcgggataaacaaaagtacgtgcaggaagagcggttatag

SEQ ID NO: 129495 - DNA, 2970 bp, Artificial Sequence
  Description of Artificial Sequence: Synthetic coding sequence
atggccttcaacgtattctttctgctgtatttcgggctcagatttatcgcagcgaacgacaaactgtggttttggctggaagtgaactccgtggttgatttctttactgtaccacccgtgtttgtgagtgtgtacctcaatagatcgtggctggggctccgctttcttcgcgcgctccggctgattcagttttcagagatcctccagtttctgaatattttgaagacctcaaactcaatcaagcttgttaatctactttcaatcttcatctctacctggctcactgcagccggatttattcatctcgtcgagaacagcggcgacccgtgggagaattttcagaacaaccaggcattgacctactgggagtgtgtgtatctattgatggtgactatgtctactgtagggtacggtgatgtgtacgcaaagaccaccctggggcggttgttcatggtgttcttcattttaggggggcttgcaatgttcgcaagctacgtgcccgagattatcgagctgattggaaaccgcaagaagtacggcggttcctactctgcggtgagtgggcgcaaacacatagtcgtgtgcggccacatcaccttggaatcagtctcaaacttcctgaaagatttcctgcacaaggatcgcgacgacgttaatgtggaaatcgtgtttttacataacatctcaccaaacctggaacttgaagccctttttaagcgtcatttcacgcaggttgaattctaccaaggctctgtgctgaacccccacgacctagctcgcgtgaaaattgaaagcgccgatgcctgtctcatcctcgccaataagtactgcgcggatccagacgccgaggatgcctcaaatatcatgagggttatatctataaaaaactaccacccgaagattcggataattacgcaaatgctgcaataccacaacaaagcccaccttctcaatatcccttcgtggaactggaaggaaggagatgacgcaatttgcctcgcagaactgaagctcggttttatagcccagtcctgcctagcgcaggggcttagtaccatgctggccaatctattcagcatgcgctcatttattaagatagaggaggacacctggcagaaatactacctggagggcgtctccaacgaaatgtatactgagtatttaagcagcgccttcgtgggactttcctttccaacagtctgtgagctgtgttttgtaaaactcaagctgctgatgattgccatcgagtataaatccgccaatagggaatcaaggattttaattaacccgggcaaccatttgaaaatacaagaggggaccctgggatttttcatagcttccgacgccaaagaagttaaacgcgcctttttttactgcaaagcctgtcacgacgatatcaccgatccaaagaggatcaagaagtgcggctgtaagagacttaaggttgcggctaggagccgctatagtaaggatccattcgaatttaagaaagagaccccaaacagccgacttgtgaccgagccagtcgaggacgagcagccttccaccctatctcctaaaaaaaaacagagaaacgggggaatgaggaattccccaaacacaagccctaaattgatgcgccacgatcctctcctcattcccgggaacgatcagatcgacaacatggattccaacgtgaagaagtacgacagcacaggtatgtttcactggtgcgctcctaaggagatcgaaaaggttatcctcaccagatccgaggccgcaatgactgtcctcagtggtcacgtggtggtgtgtatctttggtgacgtatcatccgcattaatagggctcagaaacttagttatgccactgcgggccagcaactttcactatcacgagcttaaacacatagtcttcgtggggtccatcgagtaccttaaaagggagtgggaaacactgcataattttcccaaggtgtccatcctccctggcacaccgcttagtcgggcagatctcagggcagttaatattaacctatgtgatatgtgcgttatattgtctgccaaccaaaataacattgatgatacctccctgcaggacaaagaatgcatcctagctagtctgaacataaagtcaatgcagtttgacgatagtataggagttctgcaagccaatagccagggcttcacaccccccggcatggacagaagctcaccggacaattctcccgtgcacggcatgctgcgccagccctctattactaccggggttaatatcccaattattactgagctggtcaacgatacaaacgtgcagtttctagaccaggacgacgacgacgacccagatacggaactgtacctgacacaaccctttgcgtgtggaaccgcctttgccgtctcagtgctggattccctcatgagcgccacctacttcaatgataacatactgacgctgatccggaccttggtgacgggtggagctactccagagcttgaggcactcattgccgaagaaaacgctctccgtggcgggtacagcacaccccaaactctcgcaaatagggataggtgccgtgtagcacagctggctctgttggatggaccattcgctgacctaggtgacggtggctgttacggcgacttgttctgcaaagcattgaagacatacaatatgctgtgcttcggcatttataggctgcgagacgcccacctctcgacaccctcacaatgtaccaagcggtacgtcatcactaatccaccctatgaattcgagctcgtccctaccgatctgattttctgtctcatgcagtttgaccataacgccggccagtcccgcgctagcctcagtcactcctcgcattcctcacagtctagctcaaaaaagagctctagcgtccatagcattccctcaaccgcaaataggcaaaataggcccaaatcgcgcgagagcagggataaacagaagtatgtccaagaggagaggctgtag

SEQ ID NO: 129496 - DNA, 543 bp, Artificial Sequence
  Description of Artificial Sequence: Synthetic coding sequence
taaaaaattaggattatcacacagatgctccagtaccacaataaggcccatctgttgaacataccttcatggaattggaaagaaggcgacgacgccatctgtctggcagaactcaaattggggtttattgcccagtcgtgcctggcacaaggattatccaccatgctggccaatctgttttctatgcggtctttcatcaaaattgaggaggatacatggcagaaatactatctggaaggtgtgagcaacgagatgtataccgaatacctttccagtgcctttgtcggcttgagtttcccgaccgtgtgtgaactgtgctttgtcaagctgaaattactcatgattgcgatcgaatataaatccgctaacagggagagcaggattctcatcaatccaggcaaccacctgaaaatccaagagggcacattgggatttttcatcgcatcggacgccaaagaagtcaagcgccctccccaactttgtctgcccctggctgctcagaaacgttgctttcagtcagataagctcgatatctttatctag

SEQ ID NO: 129497 - DNA, 2661 bp, Artificial Sequence
  Description of Artificial Sequence: Synthetic coding sequence
taaaatagcggtgacccgtgggaaaatttccaaaataaccaggccctgacttattgggagtgcgtgtacttgctgatggtgactatgtcgaccgtagggtacggggatgtgtacgcaaagacaacattgggcagactgtttatggttttctttatcctcggaggattagccatgtttgcctcttacgtgccagaaattatcgaactcataggcaaccggaagaagtacggaggatcatattcagcagtgtccggacgaaagcacatcgtcgtctgcggacacatcacactggagtccgtgtctaattttttaaaagattttcttcacaaggacagagatgatgtcaacgtggagatcgtattcttgcacaatatcagtcctaatcttgagctggaagcattatttaagagacacttcactcaagttgaattttaccagggcagcgtgttgaacccccatgacttggccagggtgaagatcgaatctgctgacgcttgcttgattcttgctaataagtactgtgcagatcctgacgcggaggacgcatctaacattatgagagtgatcagcatcaagaactaccaccctaaaatcagaatcatcactcaaatgctccagtatcacaataaggcacacctgctgaacattcccagctggaactggaaggagggggacgacgccatctgtctcgcagagttgaaactgggcttcattgcccagtcttgcctggcccaagggctaagtacaatgcttgcaaatctgttttctatgaggagctttatcaagatcgaagaggacacctggcagaagtactacctggagggtgtctcaaatgagatgtacaccgaatacctcagtagcgccttcgtaggattgtcgttccctaccgtttgtgagttgtgcttcgtcaagttgaagcttcttatgattgccattgagtacaaaagcgcaaacagagaaagcagaatactgatcaaccccgggaatcacctaaagatccaagagggcactctaggcttttttattgctagtgatgcgaaggaggtcaaaagggctttcttttactgtaaggcttgccatgatgatatcacagatccaaagaggataaaaaaatgtggctgtaagcgtttgaaagttgcggcccggtctcggtactccaaggacccttttgaattcaagaaggagacccccaacagtaggctggttacagagccagtggaggacgaacaaccaagcacattaagcccaaaaaagaaacagagaaatggaggaatgcgaaatagccctaatacaagccctaagctcatgcgccatgatcctctgcttatcccggggaacgaccaaatagataacatggacagtaatgtgaagaagtacgattcaaccgggatgtttcattggtgcgcccccaaggagatcgagaaagttatcttgacaaggagcgaagcagccatgacggtgctgtccgggcatgtcgtcgtctgcatatttggcgatgtgtccagtgctctcatcggcctgcgcaacctggtcatgcccctacgggcgagcaatttccactatcacgagctgaaacacattgtcttcgtcggatccatcgagtacttgaaacgcgaatgggagaccctgcataacttccctaaggtaagcatcctgccaggcacccctctgtcacgagccgacctgcgcgcagtcaacatcaacctctgtgatatgtgtgtgatcctgagtgcaaaccagaataatatcgatgatactagtctgcaggataaggagtgcatcctggcctcgctcaacataaaaagcatgcagttcgacgacagcattggggtgcttcaggccaactctcagggcttcactcctccgggtatggacagaagttccccagataacagccctgtacacgggatgttgagacagccaagcatcaccacaggagtaaatattcccatcattaccgaactcgtaaacgatacaaatgtccagtttttggaccaagatgacgacgacgatcccgacacagaactgtatttgacacagccttttgcttgtggcacggcgtttgcagtgagtgttctggactcactgatgtccgctacatacttcaacgataatatactcacactgataagaaccctggtgaccggcggcgcgacaccagaattagaggccctgattgcggaagaaaatgctcttcgtgggggctattccacccctcaaacactggccaatcgagatcgctgtcgggtggctcagctggcgctcctggatggtccatttgctgaccttggtgatggaggctgctacggggacttgttctgcaaggctttgaaaacttataatatgctatgctttggaatctaccgtctcagggacgcccacctcagcacccctagccagtgcactaaaaggtatgtgatcacgaaccctccatacgagttcgaactggttcccaccgatctgatcttctgtcttatgcagttcgatcacaatgctggccagtcccgggcttcactctctcacagttcccacagctcccagtcctcaagcaagaaaagcagctctgtacactccattccatctaccgccaaccgacagaaccggccgaagtcacgcgaaagccgcgacaagcagaaatacgtgcaggaagagcgcctgtag

SEQ ID NO: 129498 - DNA, 795 bp, Artificial Sequence
  Description of Artificial Sequence: Synthetic coding sequence
tgagtgatttccatcaaaaattaccacccgaaaataagaatcattactcagatgctgcagtaccataacaaggctcacctcctcaatatcccttcttggaattggaaagagggggacgacgctatctgcctcgcagaattgaagttggggttcatagcccaatcatgccttgcacaggggctgtctacaatgctggcaaatctgttctccatgcgaagttttattaaaatcgaagaggacacctggcaaaagtactacctggaaggtgtgtccaatgagatgtatactgagtacctgagcagcgcctttgtgggactgtcattccctactgtctgtgagctgtgttttgttaagcttaagctgctgatgatcgccatagaatacaagtcagcgaacagggaaagtcgtattctgattaatccgggaaatcatctgaaaatccaggaaggaaccttaggattcttcatcgcctccgatgctaaggaagttaagagagcatttttttactgcaaagcatgccatgacgatatcactgaccccaagcgcatcaagaaatgcgggtgcaagcgcttggccggctcccaggatacacaccctgactccttttaccaccaagctgtgaacgctagttcctatctccatgggggtgggcagatgtggcctgtgagcagctcttcaagcatattgctgcattatttacgacggcaaatgcctgggcctgccaggctgccgctggagctatcatgccaggggagcgccctcagccctaatccggacctatactgtatgaagtag

SEQ ID NO: 129499 - DNA, 3630 bp, Artificial Sequence
  Description of Artificial Sequence: Synthetic coding sequence
tctaacattcacgcaaaccacttgtccctcgatgcctcatcttcatcatctagctcaagttcatcgtcatcctcaagctcgagctcttctagtagctcaagtgtgcacgagccgaaaatggatgccttaatcataccagtgaccatggaggttccttgtgacagtcgagggcagcgcatgtggtgggcatttctcgcttcctcaatggttacttttttcggggggctgttcatcattttgctctggagaaccctgaagtatctgtggacggtttgctgccactgcgggggaaaaaccaaagaggcgcagaagattaataatggctcaagccaggctgacggaaccctgaagcccgtggatgaaaaagaagaggcggtggccgccgaggttggttggatgacttcagtgaaagattgggcaggtgtgatgatctccgctcagactctgacaggaagagtgttagttgttctggtttttgcattgagcattggagctttggtaatatattttatcgatagcagcaatcctatcgaaagctgtcagaatttctataaggattttaccctccagattgacatggccttcaacgtgttctttctgctgtatttcggcctgaggttcatcgctgccaacgacaagctctggttctggctagaggtgaattccgtcgttgacttctttaccgtcccgcccgtgtttgtgtcggtctacctcaatagaagctggctggggttgcggtttcttagggcgctgcgcctgatccagttctccgagattctgcagttcttaaatattctaaaaacttccaattcgatcaagttggtgaatctacttagtatattcattagtacttggttgaccgcagctggatttatacatttggtcgagaattctggtgatccctgggaaaactttcagaacaaccaggcgctgacctactgggagtgcgtgtacctcctgatggtgactatgagcactgtaggatacggagatgtgtacgcgaaaactactctcggcaggctattcatggtctttttcatccttggcggcctggccatgttcgcctcttacgtgccagagatcatcgagctgatcggcaaccgcaagaaatatggggggtcttattcagccgttagcggccgaaagcatatcgttgtgtgtggccacatcactctcgagagcgtttctaattttctgaaggattttctgcacaaggatagagatgatgtaaatgttgagatcgtttttctgcacaacatcagccccaatttggaacttgaagcattgtttaagaggcacttcacacaggtagagttctaccaggggtctgttctaaatccacacgacttggcgcgggtgaaaatagaatctgcagacgcatgtctcatcctcgcaaataagtattgtgcagaccctgacgccgaagacgctagcaacataatgcgggtgatctctataaaaaactaccaccccaagataaggattattactcagatgttgcagtaccacaacaaagcccacttgttaaacatcccatcatggaactggaaggaaggtgacgacgcaatttgccttgccgaactcaaactggggtttatcgcgcagagttgcttagcccagggcctctccaccatgttggccaacctgttcagcatgagatcattcattaagatcgaagaggacacttggcaaaaatattatctggagggagtgagcaatgagatgtacaccgagtacttgtcttccgctttcgtgggtctcagcttcccaacagtttgcgagctgtgctttgtaaaactcaagctcttaatgatcgccattgaatacaagtctgcaaaccgtgagtctcggatactgattaatccgggcaaccacctgaagatccaggagggaacactgggctttttcatcgcatctgacgccaaagaggtgaaaagggcttttttctactgtaaggcatgccacgatgatataacagaccccaagcgaattaagaagtgcggctgcaaacgacccaaaatgtcaatatacaagagaatgagacgagcttgctgctttgattgtggaaggtctgagcgcgactgtagctgcatgtctggtagagtaaggggtaatgtcgatacattggaacgagcttttccactgtcctcagtgagcgtcaatgattgttcgactagtttcagagcgtttgaagatgagcaaccctccaccctgagtcctaaaaaaaaacagcgtaatggagggatgaggaactcgccaaatacgtccccaaagctgatgcgccacgacccacttctgattcctggcaacgaccagatcgacaatatggacagcaatgttaagaagtacgattctacagggatgtttcactggtgcgccccgaaagagattgagaaagttatcctgacaaggtcggaggccgcgatgacagtgctgtccgggcacgtggtggtgtgcatcttcggtgatgtctcttccgccctcatcggactcaggaatctcgtcatgcccttgcgagcctcaaattttcactatcacgagttgaaacacatcgttttcgttggctcaatcgagtatcttaaacgggaatgggagacacttcataatttccctaaggtgagcattctaccaggaactcccttaagcagggccgacctgcgggccgtcaatatcaacctgtgcgacatgtgcgtcatcctaagcgcaaaccagaataatatcgatgatacctctctccaggataaagagtgcattctcgcgtcattgaatatcaaaagcatgcagttcgacgattctatcggagtgctgcaggccaatagtcaagggttcacgcctccgggcatggatagaagttcgccagataatagcccagtccatggtatgctcaggcaaccttccattacgacaggcgtgaacatacccataatcaccgagctggtgaacgacactaacgtgcaattcttagaccaggatgacgacgacgaccccgacaccgaattgtatctaacgcagcctttcgcctgcggcacggctttcgcggtatccgtgttggacagtctgatgagtgccacttattttaatgacaacatacttactctcattcggaccctggtgactgggggggcaaccccagagctggaagctcttatcgccgaggagaatgcattgcgcggagggtactcaaccccccagactcttgctaaccgtgatcggtgcagggtggcccagctggccctgttggacggccctttcgctgatctgggggacggcggctgttacggtgatctcttctgtaaggccctgaagacctacaatatgctctgtttcggtatctaccgcttgcgagacgcgcatttatcaactccatcacagtgtactaagcgctatgtcatcaccaaccctccatacgaatttgagctggtccctaccgacttgatcttctgcctgatgcagtttgaccataacgccggacagtcaagagcctcactgagtcattcatctcattcaagccaaagcagcagtaagaagagctcaagcgttcactcaattccaagtactgccaataggcaaaacagaccgaagagtcgagagtcgcgggataagcagaagaaagagatggtctatagatag

SEQ ID NO: 129500 - DNA, 576 bp, Artificial Sequence
  Description of Artificial Sequence: Synthetic coding sequence
atggtgaagaagcttgtgatggcccagaagagaggagaaaccagagctctgtgtctgggggttactatggtcgtttgcgcggtcataacttactacatcctggttactactgtgttgccactataccagaaatctgtatggacgcaagagagtaagtgccacctcatcgagactaatattagagaccaagaagagttgaagggcaagaaagtcccacagtacccgtgtctgtgggtgaatgtatcggccgcgggtcggtgggccgtcttgtatcatacagaagacaccagagatcagaaccagcagtgttcgtatattccagggagtgtggataactaccaaactgctcgggctgatgttgaaaaggtgcgcgccaaattccaggagcagcaggttttttattgctttagcgcccccagaggaaacgagacctcagttctgtttcagcgactctatggaccacaggctctgctcttcagcttattttggcctacgtttttgctgaccggcggactattaatcattgccatggtgaagtccaatcagtatctgtccattcttgccgcccagaaatag

SEQ ID NO: 129501 - DNA, 393 bp, Artificial Sequence
  Description of Artificial Sequence: Synthetic coding sequence
atggtcaagaaactggtgatggcgcagaagagaggcgaaacaagagccttatgcctcggcgtgaccatggtcgtatgcgccgtgataacctattatatcctggtcacgacagtattgcctttgtatcagaaatccgtttggacccaggagagcaagtgccatttgatcgagaccaacatccgggaccaggaggagttgaaagggaaaaaggtgccccaatacccatgcctgtgggtcaacgtgagcgccgctgggcgctgggcagtgctctaccacacagaggacacacgagatcagaatcagcaagtgctgaattggcgtgacggggacacaagcttgtatccttgccaggtttgcgagccggtaccaaattgtccgtgcccgaggggctag

SEQ ID NO: 129502 - DNA, 633 bp, Artificial Sequence
  Description of Artificial Sequence: Synthetic coding sequence
atggccaagcttcgcgtagcctacgaatacactgaggctgaagataaaagcataagactggggctctttctgattatttcaggtgttgtctcactgttcatttttggattctgttggctatcccctgctctccaggacctgcaggccactgaagccaactgtacagttttgagcgtccagcagatcggtgaggtgtttgaatgcacttttacgtgtggggccgactgccggggcactagccagtacccttgtgtgcaggtatatgtgaataacagtgaatccaactctagggctcttttacactctgacgaacatcaactgctgacaaatcctaaatgtagctatatccccccttgcaagcgagaaaaccagaagaatctcgagtcggtgatgaattggcagcaatactggaaggacgagatcggatcccagccttttacctgttactttaaccagcaccagcgacccgatgatgtgctgttgcaccgaacacacgacgaaatcgtgctgctacattgcttcctgtggccactcgtgacatttgttgttggagtgcttatagttgtgctgacaatctgtgctaagtcccttgctgtcaaggctgaagcaatgaaaaaacgcaaatttagctag

SEQ ID NO: 129503 - DNA, 2259 bp, Artificial Sequence
  Description of Artificial Sequence: Synthetic coding sequence
atgaagcctgctgagcacgccacaatgttcctaatcgtgttgggatgcttaatcctcgcggtgttgactaccttcaaggagtatgaaaccgtgagcggcgactggctgctccttctcgaaacttttgccatcttcatctttggagcagaatttgctctgcggatttgggccgccggctgctgctgtcgctataaggggtggcgcggcaggctaaaatttgcccggaagcctctctgcatgttggacatctttgtccttatcgcttccgtgccagttgtagccgttgggaatcaaggcaacgtgctggctacctccctgcggagcctgaggttcctgcaaatccttcgcatgctccgtatggataggcgcggggggacctggaagttgctcggatccgcaatatgcgctcattccaaagagttgatcactgcttggtacataggcttcttgaccctgatcctctcaagtttcctcgtctacttggtcgagaaggacgtgcctgaagttgatgcccagggggaagaaatgaaagaggagttcgagacatacgctgatgccctgtggtggggtctgattactctggcaactatagggtatggagataaaacgccgaaaacctgggaagggcgtctgatcgccgcaacctttagtcttattggagttagcttttttgccctacccgccggtatactcggttctggactcgcgctgaaggtacaggaacaacatcggcagaagcacttcgagaagagaagaaagcccgctgcagagcttatacaggccgcttggcggtactacgccactaatcctaataggatcgacctcgtggccacatggagattttatgagagcgtggtgtccttcccgttcttccgaaaagagcagctcgaagccgcctccagccagaagctgggactcttagaccgtgtgcggctgtcaaatccgagaggctctaacacaaagggcaaactgttcacacctctcaatgtggacgccattgaggagtctccatccaaggaaccgaagcctgtgggcttgaataacaaggagcgcttccgcactgcatttcggatgaaggcttacgccttctggcaatcctccgaggatgccggcaccggggaccccatggcagaagacaggggttacggcaatgattttcctattgaagatatgatcccaaccctgaaagccgccattagagccgtgcgtattctgcagttccgattgtacaaaaagaagttcaaggaaacgcttcgaccgtatgacgtgaaagacgtcatcgagcagtattccgctggacatctggatatgttaagcagaattaaatacttgcagaccagaatcgacatgatttttacccctgggccccccagtacccctaagcataagaaatcccaaaaaggctctgcatttacatttccttcccagcagagccctaggaacgagccctatgtagcgaggccaagtaccagcgaaattgaggatcaaagcatgatgggcaaattcgtcaaggtagagcgacaggtgcaagacatggggaagaagctggattttctcgtagacatgcatatgcaacacatggagaggctgcaggtgcaggtgacagagtactaccccacaaagggcacctcaagtcccgcggaagcagagaaaaaagaagataaccgctactcagacctgaaaactattatctgcaactatagtgagaccggtccaccagagccaccctactctttccatcaagtcaccattgataaagtttccccgtacggattcttcgcccatgatcccgtcaacttgccaaggggggggccatcctcaggcaaagttcaagccacccctccctcctcagccacaacttatgtggaaaggcccacagtgctgcctattctgaccctcttagactccagggtcagctgccactcccaagccgatctccaggggccatacagcgacagaatttctccccgccaacgcaggtctattacccgcgacagtgacactcccctaagccttatgtcagtgaaccatgaagaactagagaggtccccatctggcttctcaatcagccaggacagggatgactacgtgttcgggccaaacgggggaagctcatggatgagagagaaaagatatttagcagagggtgagaccgacactgacaccgatccgtttactccttcgggtagcatgcccctatcaagcacaggagatggcatctctgattctgtctggaccccaagcaataaacccatctag

SEQ ID NO: 129504 - DNA, 1434 bp, Artificial Sequence
  Description of Artificial Sequence: Synthetic coding sequence
atgacaggccagagtctgtgggatgtgtcagaagcaaatgtggaggacggtgaaatccggattaatgtgggagggttcaagcggcggctgaggtcccacaccctcctcagattccccgagacgcgcctgggaaggcttctgctctgccattcaagggaggccattctggaattatgcgacgattacgacgatgtccagagggaattctattttgacaggaatcctgagcttttcccatatgtactgcatttttaccacaccggaaagctgcacgtcatggcagagctctgtgtcttcagcttttcacaagagatcgagtactgggggatcaacgagttctttatcgattcttgttgttcctattcctatcatggtcgcaaggtcgaaccagagcaggaaaaatgggatgagcagagcgatcaggagagcacgacatcatcgtttgatgagatcttagctttttacaatgatgccagcaagttcgatggacagccactgggcaactttcgcagacagctatggctggctcttgataatccaggatatagcgtattaagccgggttttctccatcctgagtatactcgttgtgatgggatcaattattacaatgtgtctgaattctctgcccgacttccagatccccgactcacaaggtaatcccggagaagaccctaggtttgagatcgtggagcattttggtatcgcttggttcactttcgaactggtggcccgatttgccgtcgcgccagactttctcaagtttttcaaaaacgccctgaacctgatagacttgatgagcattgtccccttctatatcacattggttgtgaacttagttgtggaatctacgcctaccctggcgaatctgggacgtgtggcacaggtgctgcgtttgatgcgcatattccggatattgaaattggctagacactctactggccttcgaagccttggagctacgctgaaatactcctacaaggaggttgggctacttctgctgtacctgagcgttggaatctctattttcagcgtggttgcctataccatcgaaaaggaggagaatgaggggctagcaaccatcccggcttgctggtggtgggcaaccgtcagcatgactacagtcggatacggagacgtggtcccaggtacgactgccgggaaactcaccgcctcagcatgcatcctcgccggcatcctggtagtcgtgctcccaataaccttaattttcaataaattctctcacttctaccgacgccagaagcagttagaaagcgctatgcgctcttgtgatttcggggatggcatgaaggaagtcccaagtgttaatctcagagattactatgcccacaaagttaagagcttgatggcctcattaactaacatgagccggtcaagcccatcagagctgtcgcttaacgacagcctacgctag

SEQ ID NO: 129505 - DNA, 1434 bp, Artificial Sequence
  Description of Artificial Sequence: Synthetic coding sequence
atgactggacagtccctgtgggacgtgagcgaagccaacgtggaggatggagaaataaggatcaacgtcggtggttttaagagacggcttagatctcacaccttgctcagattcccagagacccgtcttgggcgcctgctcctctgtcactccagagaagctatcctagagctctgtgacgattatgacgacgtccagagggaattttacttcgataggaatccggaattgtttccctacgtactgcatttctaccatacgggcaaactccatgtgatggcggagctgtgcgtgttttcattctcccaggagattgagtactggggaatcaacgagttctttatcgatagctgctgtagttattcgtaccacggcaggaaagtagaaccagaacaagagaagtgggatgaacaatctgaccaggaaagcacaacttcaagcttcgatgagattcttgcgttttacaacgacgcgtctaagtttgatggccagccgctgggtaacttccgacgacaactatggttggccttagataaccctgggtactccgttctcagtcgggtattttcaattctgtccatcttagtcgtcatgggtagcatcattacaatgtgcctaaacagcctgcccgactttcaaataccagactcacaaggcaatcccggggaagatcctaggtttgagattgttgaacactttgggatagcatggtttacttttgagctagtggcacgctttgcagtggccccagacttcttgaagttcttcaaaaatgctctgaacctcatcgatctcatgtctatcgtgcccttctatattaccctcgttgtaaacttagtcgtcgagtccactcctacactcgctaaccttgggcgggtagctcaggttctgcggttaatgaggatcttccgaattctgaaactggcacggcacagtaccgggctgcgtagcttgggggccacgcttaaatattcatataaggaggtgggcctgctgcttctctaccttagcgtgggtatctccatcttttcagtcgtagcatatactatcgagaaggaggaaaacgaaggtctggctacaatccctgcttgttggtggtgggcaactgtctccatgactacggtcggatacggtgacgtcgtgcctggaaccacagctgggaaactcaccgcgagtgcttgcattctcgcgggaattttggtggtcgtactcccaatcaccctgattttcaataagttcagtcacttctatagaaggcagaaacagctggaaagtgctatgagaagctgtgacttcggcgatggcatgaaggaggttccatccgtcaacctgcgggactactacgcccacaaggtgaagagtctcatggcaagtctgacgaatatgtctagatcaagtccatcggagctgtcactaaacgactccctgcgttag

SEQ ID NO: 129506 - DNA, 1476 bp, Artificial Sequence
  Description of Artificial Sequence: Synthetic coding sequence
atggtgttcggagaattttttcatcggcctggacaagacgaggaactggtgaatctgaacgtcggcggtttcaagcagtcagttgaccagagcacattgctgcgttttccccatacacgcttgggcaagcttttaacgtgccacagtgaagaagcaatactggaactttgtgatgattactccgttgcggacaaggagtattattttgatcggaatccgtcattgttcaggtatgtgcttaatttctattataccggcaaactgcacgtgatggaggaattatgcgtgttctccttttgccaagagatcgagtactgggggattaatgaactgttcatcgatagttgctgttctaatcgttatcaggaaaggaaggaggagaatcatgagaaggattgggatcagaagagccacgacgtgtctactgactcttcatttgaggaaagttccttatttgagaaagaactcgagaaatttgacacacttcgctttggacagcttcgaaagaagatttggattagaatggaaaatcccgcctattgtctctctgccaaactgatcgctatttcgtccctcagcgttgtgctggcctcaatagtcgccatgtgcgtacactcaatgtccgagttccagaatgaggacggcgaggtcgacgaccccgttctggaaggggtggagatcgcctgtatcgcttggtttacaggggagctggccgtccggctggccgctgccccatgccagaagaaattctggaaaaaccccctgaacatcatcgactttgtgagtataatacccttttacgccacgctggccgtggacactaaggaggaggagagcgaggacatcgaaaatatggggaaagtagtgcaaattctacgcttgatgagaatctttcgtatcctgaagttagcccgccattctgtgggtctaagaagtctgggcgcaacccttcgtcattcatatcatgaagtcggccttcttctgctgtttctctcagttgggatttccattttcagcgtgcttatttattcggtcgagaaagacgatcacaccagctcattaacttctattcccatatgttggtggtgggcaaccatctccatgactacagtgggctacggtgacacccaccccgttactctggcaggtaagctgatcgcgagcacttgcatcatatgtggtattcttgtggtggctctgcccatcactataatctttaacaaattcagcaagtactaccagaagcagaaggacatcgatgtcgaccaatgcagcgaggacgccccggagaaatgccacgaactgccttactttaatatccgagatatctacgcccagagaatgcacacgttcatcacctctttgtcttccgtgggcattgtcgtgtccgatcctgattctaccgacgccagcagtattgaggataacgaagacatctgtaatactacttctctcgaaaactgcaccgccaagtag

SEQ ID NO: 129507 - DNA, 1476 bp, Artificial Sequence
  Description of Artificial Sequence: Synthetic coding sequence
atggttttcggtgaatttttccatagacctggacaggacgaagagctggttaatttgaatgtaggtggcttcaagcagtctgtcgaccagtcgacacttctgcggttccctcatacaagattgggtaaactcctcacctgtcatagtgaggaggcaattctcgagctctgcgacgattattcggttgccgacaaggagtattactttgatcgcaatcctagccttttccggtacgtcctgaacttttattatactggcaagctgcacgtgatggaggagctatgtgtcttcagtttctgccaggaaatagagtactggggtattaatgaattgtttatcgattcctgctgctccaatagataccaggagcgcaaggaggaaaatcatgaaaaggattgggatcagaagtcccacgacgtgagcactgactcatcctttgaggagagcagcctatttgagaaagagctggagaagtttgatacactcagattcggtcagctacgaaagaagatatggattcggatggagaacccagcctactgcttatcagcaaaactcatcgcaatctcttctttatctgttgtgcttgcctccattgtggccatgtgcgtgcattctatgtcagaatttcagaacgaggacggggaggtggatgacccagtgctggagggagtggagattgcttgtattgcatggttcacaggagaactggcagtgagactcgccgcagccccgtgtcagaagaaattttggaagaacccccttaacattattgactttgtcagtatcattccattttatgctacactggcggtcgatacaaaggaagaagagtcagaagacattgagaatatggggaaagttgttcagattctgcgtctgatgcgcatctttaggatcctaaagctcgctagacactctgtcggtctccggagcctgggtgctaccctgagacactcttatcacgaggtggggcttcttctcctgttcttatccgtgggaatatcaatcttctccgtattgatatactccgtcgaaaaggatgaccataccagttcccttacctcgatcccaatttgctggtggtgggcaaccatctcaatgacgacagtcggatacggcgacactcacccagtcaccctagctgggaagttgatagcaagtacctgtattatttgtggcattttagttgttgctcttccaatcaccatcatttttaataaattctcgaagtattaccagaagcagaaagacattgatgtggatcagtgttcggaagacgctcccgagaagtgccacgagctcccctattttaatatccgtgatatctatgcgcagaggatgcacacctttatcacctccctgtccagtgtggggatcgtggtgtccgaccccgacagcaccgacgcttcttcaattgaagataatgaggatatttgcaatactacttctctggagaactgcaccgccaagtag

SEQ ID NO: 129508 - DNA, 225 bp, Artificial Sequence
  Description of Artificial Sequence: Synthetic coding sequence
atggtctttggtgaattctttcatcgcccaggtcaggacgaagaactggtgaatctcaatgttgggggctttaagcagtctgtggatcagtcaacccttctccgctttccccacacccgacttggaaagctcttaacctgccacagtgaggaagccatacttgagctgtgcgatgattacagcgttgctgacaaggaatattatttcgatcgtaacccaagctag

SEQ ID NO: 129509 - DNA, 390 bp, Artificial Sequence
  Description of Artificial Sequence: Synthetic coding sequence
atgatcttgagcaacaccaccgccgtgacccctttcctaactaagctgtggcaagagaccgtgcagcagggaggtaacatgtccgggttagcacggcgaagcccacggtccagcgatgggaaattggaagcactctatgtgttgatggtcttaggctttttcggcttctttacactcggcataatgctgtcatacatccggagcaagaagctggaacattcgaatgacccattcaatgtatatatagagtcggatgcctggcaggagaaagataaggcctatgtccaggcccgggtgctcgaatcatataggagttgttacgtggtcgagaatcacctggccattgagcagcccaatacacaccttccagaaactaaaccctccccatag

SEQ ID NO: 129510 - DNA, 390 bp, Artificial Sequence
  Description of Artificial Sequence: Synthetic coding sequence
atgatcctatctaacaccaccgcggtgactccattcctcactaagctctggcaggagacagttcaacaaggcgggaatatgtcaggcttggctcggagatcacctaggtcctctgacgggaaactggaagccttgtacgtattgatggtgctagggtttttcggcttttttaccttaggcatcatgctcagctatatccgctccaagaagctcgagcactcgaacgatcctttcaacgtgtacatcgaaagcgatgcatggcaggagaaggataaagcatatgtgcaggcgcgcgtgctggagtcatataggagttgctacgtggtcgaaaatcacctggcaatcgaacagccaaacacccatcttcctgaaaccaagccaagtccgtag

SEQ ID NO: 129511 - DNA, 390 bp, Artificial Sequence
  Description of Artificial Sequence: Synthetic coding sequence
atgattctgtctaatacgactgctgtaacaccatttctcaccaagctgtggcaggagaccgtgcagcaagggggcaatatgtcaggactcgcgcgaagaagtccccggagctcggatgggaagctggaagctctgtatgtcttgatggtgctggggtttttcggattttttactcttgggatcatgctgagttatatccgctccaaaaagctcgaacactcaaacgatcctttcaatgtgtatatcgaatcagatgcatggcaggagaaggataaggcgtacgtgcaagcacgcgtgctggagtcatatcggtcatgctacgtcgtggaaaaccacctcgccatcgaacagccaaatacccatctacctgagactaagccttccccgtag

SEQ ID NO: 129512 - DNA, 390 bp, Artificial Sequence
  Description of Artificial Sequence: Synthetic coding sequence
atgattctttcaaacactacagccgtgacgccttttttgacaaagctgtggcaggagaccgtccagcaaggcggaaacatgagtggactggccaggaggtcaccgaggagttctgatggaaagctcgaagcattgtacgtactgatggtccttggattctttggcttttttactctggggatcatgctttcctatattagatccaaaaagctggaacacagcaatgatccattcaatgtgtacatcgagagcgacgcttggcaggagaaagataaagcctatgtccaggcacgagtgctagaaagttatcggtcatgctatgtggtcgaaaaccacctcgccatcgagcaaccgaatactcacctaccagagaccaagccctcaccatag

SEQ ID NO: 129513 - DNA, 390 bp, Artificial Sequence
  Description of Artificial Sequence: Synthetic coding sequence
atgattctctctaatacaactgccgtgacacctttcctcacaaaattgtggcaagagacagtgcaacagggtggtaatatgtcgggcctagcacgccggagtcccaggtcgagcgatggtaaactggaagcgttgtacgttctgatggtccttggcttttttggcttttttactctgggtatcatgctatcctacattcggagcaagaagctggaacactctaacgaccctttcaacgtctacatcgagagcgatgcgtggcaggagaaagacaaggcatatgtccaggccagagtgctagaatcctaccggtcgtgttacgttgtcgagaaccatctcgccatcgagcagcccaacacccaccttcctgaaacaaagccatctccatag

SEQ ID NO: 129514 - DNA, 390 bp, Artificial Sequence
  Description of Artificial Sequence: Synthetic coding sequence
atgatcctgtcgaataccactgccgttacgcctttccttaccaagctgtggcaagagactgtccagcaaggaggaaacatgtccggcctggcacggaggtccccgcgctccagtgacgggaaactggaagcactgtacgtgttgatggtgctcgggttcttcggcttcttcacactgggtattatgctgagctatattagatcaaaaaaactggagcacagtaatgaccccttcaacgtttacatcgaaagcgatgcgtggcaggagaaggacaaagcttacgtgcaggcaagagtgctcgaaagttacaggtcctgttacgtggtcgagaaccatctcgccattgagcagccaaacacacatctgccggagacgaaaccttcaccctag

SEQ ID NO: 129515 - DNA, 372 bp, Artificial Sequence
  Description of Artificial Sequence: Synthetic coding sequence
atgtccactttgtccaatttcacgcagacactggaagatgtctttagaaggatctttataacatatatggataactggagacagaacactacagccgagcaagaggccctccaggcaaaggtggatgctgagaacttttactacgtgatattgtatctcatggtcatgatcggcatgttttcattcatcatcgtggccattttggtctctactgtaaagagtaaacgccgggagcatagcaacgatccttatcaccagtacatagtggaagattggcaagagaagtataaatcccaaattctgaatctggaggagtccaaagccaccattcatgagaacatcggtgctgccgggttcaagatgagtccttag

SEQ ID NO: 129516 - DNA, 312 bp, Artificial Sequence
  Description of Artificial Sequence: Synthetic coding sequence
atggagacaactaatggcactgagacatggtatgagtctcttcacgcagtgctgaaggcgctcaacgccactttgcatagtaacctcttgtgccggcccgggccaggactaggccctgataatcaaacagaagaaagaagggccagtcttccaggccgtgatgacaacagctacatgtacattctcttcgtaatgttcttgtttgccgtgactgtgggttctctaatcctggggtataccagatcacgcaaggtggataagcgaagcgacccctaccatgtatacatcaagaacagagttagtatgatctag

SEQ ID NO: 129517 - DNA, 312 bp, Artificial Sequence
  Description of Artificial Sequence: Synthetic coding sequence
atggaaaccacaaacggaactgagacttggtacgaatccctacacgctgtgctgaaggctctcaacgccactctccattctaatttactatgccggcccggccctggactcggacctgacaaccaaactgaggagagaagggcctccctgccaggccgagatgacaactcatatatgtatatcctctttgtgatgtttcttttcgccgtgacagttggatcgctgatccttgggtacacaagatctcgaaaggtggacaagcgctcagatccgtaccacgtgtacataaaaaacagggtgagcatgatctag

SEQ ID NO: 129518 - DNA, 39 bp, Artificial Sequence
  Description of Artificial Sequence: Synthetic coding sequence
atggaaacaacaaacgggactgagacttggtacgaatag

SEQ ID NO: 129519 - DNA, 153 bp, Artificial Sequence
  Description of Artificial Sequence: Synthetic coding sequence
atggaaaccaccaatggcacggaaacctggtacgaaagcttacatgcagtgctcaaagcactgaacgctacactccatagtaatctcctctgcagaccggggcccggactcggacctgataatcagacggaagaaaggcgggcatccctgtag

SEQ ID NO: 129520 - DNA, 162 bp, Artificial Sequence
  Description of Artificial Sequence: Synthetic coding sequence
atggagaccaccaatggaactgaaacctggtatgagtcccttcatgccgtgcttaaagccctcaatgccacactacactctaacttgctctgccgtcccggcccaggtttgggacctgacaatcaaacagaggagagacgtgccagcctccctgggcgatag

SEQ ID NO: 129521 - DNA, 300 bp, Artificial Sequence
  Description of Artificial Sequence: Synthetic coding sequence
atggagactactaatggcacagaaacgtggtacgagtccctgcacgccgtgctgaaggccctaaacgcgacactgcactctaacctgctgtgtcgacccggacctggtctggggccagataaccaaacggaagaacgacgcgcaagcctgcctggccgggacgacaacagctacatgtatatcctgttcgtgatgttccttttcgccgtcacagtggggtctctgattctggggtataccaggagccgaaaggtggacaagcggtctgacccgtatcatgtctatattaagaatagatag

SEQ ID NO: 129522 - DNA, 513 bp, Artificial Sequence
  Description of Artificial Sequence: Synthetic coding sequence
atgctgaaaatggagcccctgaatagcacacacccagggaccgcagcaagcagctccccactggagtcaagggctgcagggggaggcagcgggaacggaaatgaatacttctatatcctggttgtgatgtccttttatgggatcttcctgatcggtatcatgttgggctatatgaagtcaaagcggagggaaaagaaatcatccctgctgctgctatacaaagatgaagagcgactgtggggtgaggctatgaagccacttccggttgttagtggactgaggtccgtgcaggtcccattgatgctgaatatgctacaggagagcgtggcccccgccctgagctgtacactctgcagtatggagggcgattctgttagctcagagtcgtcctctcctgatgtccacctcaccatacaggaggagggtgccgacgacgaactcgaagagaccagcgagaccccactgaacgaatcatcagagggctcaagtgagaacatccatcagaacagttag

SEQ ID NO: 129523 - DNA, 2031 bp, Artificial Sequence
  Description of Artificial Sequence: Synthetic coding sequence
atggctgctgcttcatcaccaccccgggctgaaagaaagcgctgggggtggggacgcctcccgggggcaaggaggggctcagcaggcctggccaagaagtgcccctttagtctggagttagctgaaggggggcccgctggtggcgcactgtacgcacctatagcaccaggtgccccaggccccgccccccctgcgagtccagccgccccagccgcacccccagtcgccagcgacttgggtccccggccaccagtctcccttgatccccgggtctccatctatagtactaggagacccgttctcgctaggacacatgtacaaggacgtgtgtacaactttctggagaggcccacaggctggaaatgctttgtataccatttcgcagtcttcctaatagttctcgtctgcctcattttttccgtactcagcactattgagcagtacgctgctcttgccaccggcaccctgttttggatggagatcgtgctcgtggtcttctttggaaccgaatatgttgtcaggttatggtctgctgggtgtagatccaaatacgtcgggttatggggaaggttgcgctttgcacgcaaacccatcagcatcattgacttgatcgtggtggtagctagcatggtagtcctgtgcgtcgggagcaaggggcaggtgttcgcgacatccgccatacgggggattcgattcttgcagatactgcggatgctacatgtggatcggcagggcggcacctggagacttctggggtcagtggtattcattcacaggcaggaattgattacgacactctacattgggtttttaggcctgattttttccagttactttgtgtaccttgccgagaaggacgccgtgaacgagagcgggagagtggagtttggatcttacgccgatgccctctggtggggcgtggtgaccgtcaccaccattggttatggggacaaggtgccgcaaacatgggtgggaaaaactatcgcttcttgcttctccgtttttgccatttctttcttcgcactgcctgctggtattctggggtcaggtttcgccctgaaggtgcagcagaagcagcggcagaagcacttcaaccggcaaatacccgctgccgcctccctgatccagaccgcatggcggtgttatgccgcggagaatcccgactctagcacatggaaaatctacataagaaaagctcctcggtcccacacactcctgagcccttcacccaagcctaaaaaaagtgttgtggtgaagaaaaaaaaatttaaactcgacaaagacaacggggtaacgccaggggagaaaatgttgaccgtaccccacattacctgtgatcccccagaggaaaggcgcctggaccatttctcagtggacggctacgactcctcagtcagaaagagtcctacgctgctggaagtgtccatgccgcacttcatgcgaaccaatagctttgccgaggatctggatttggaaggcgaaactctcttgacccccattacgcacatctctcagctgcgtgagcatcatcgagcgaccattaaagttatccgccgcatgcagtacttcgtggccaaaaaaaagttccagcaagcacggaagccttacgacgtccgggatgtcatagaacaatatagtcagggacacctgaatcttatggtgagaataaaggagctacaacggaggttggatcagtccatcggaaagccctctttatttatttccgtctctgaaaaatcaaaggatcgaggtagcaatactataggtgcgagactcaatcgggtggaggataaagtgactcagctggatcagcgtctcgctctgataacagatatgctccatcagttgctcagcctgcacggaggatccacccccggatcgggaggtccacctagggagggcggagcacacatcacacagccctgtggatctgggggctctgtggacccagagctcttcctgccttccaacacactgcctacctatgagcagctcacagttccccgccgtggtccagatgagggcagctag

SEQ ID NO: 129524 - DNA, 1650 bp, Artificial Sequence
  Description of Artificial Sequence: Synthetic coding sequence
atggactttctcattgtcttggtgtgcctgatcttctcggtactgtcgaccattgagcagtatgcagccttggccacaggaactttattttggatggagatcgtgctagtcgtcttctttggcactgagtacgtcgtgcgtctatggtctgcgggctgccgatcaaaatacgtgggcctctggggacggcttcgttttgcccgaaagccaatttcgattattgacttgatcgtggttgtagcaagcatggtcgttctgtgcgtgggcagtaaagggcaggtgtttgcaacttctgccattagggggataagattcctccagatattaagaatgcttcatgtggaccgtcaaggcgggacctggcgactactgggctcagtggtctttattcatcggcaagaactgatcaccacgttgtacataggcttcctcgggctcatctttagtagttactttgtgtacctggccgagaaggacgcagtgaatgagtcaggaagagtggaatttggatcatacgctgatgcgttgtggtggggcgtcgtgactgtgaccaccattgggtacggagataaggtgccccaaacatgggtgggcaaaactatcgcctcttgtttttcggtgtttgctatatcattcttcgccctccctgcgggaatactcggatctggctttgccctaaaagtgcagcagaaacagaggcagaagcacttcaacagacagatacccgctgccgcttccctgatacagaccgcctggcgatgttacgctgctgaaaacccagactcttcaacatggaagatttacattaggaaggcacctcgatcacacacgttgctgtccccctcacctaagcctaaaaaaagtgtggtagtgaagaaaaaaaaatttaagctggacaaggacaacggcgttactccaggggagaagatgcttacggtgccacacataacatgtgaccctcctgaagaacgccgactggaccacttcagcgtggacggctatgattcctctgtgaggaagtcacctacacttttggaggtgagcatgccacatttcatgcggaccaactccttcgcagaggacctcgatctcgagggggaaaccctgctgaccccgattacgcacatcagccagttgcgggagcatcaccgggccaccattaaggtgattagaagaatgcagtactttgtcgccaaaaaaaagtttcagcaagcacgaaaaccatacgatgttagggacgtgattgaacagtattctcagggacatctcaacctgatggttaggataaaggaacttcagcggaggctagaccagtcgatcgggaagccatctctgttcattagcgtgtccgagaaaagtaaggatagaggctccaacaccatcggcgccagactcaatcgagtggaagacaaagtgactcagctcgatcagaggctggcactgatcacagatatgctgcaccagctgctgtccttgcacggcgggtcaactccgggatccggaggcccaccgcgcgaagggggcgctcacattacccagccctgtgggtccggtggttcggtggaccctgagctttttctgccatcaaacaccctgcccacgtatgaacagctgacagtccccaggcgaggaccagacgagggctcttag

SEQ ID NO: 129525 - DNA, 1182 bp, Artificial Sequence
  Description of Artificial Sequence: Synthetic coding sequence
atggtccaaaaatccaggaatggtggtgtataccctggcccatcaggggaaaaaaagctaaaagtgggatttgtggggcttgatccgggcgcacccgatagcacaagagatggcgctctgctcattgccggctctgaagcccccaagaggggctctatactgtccaagccaagggcaggaggtgccggtgcagggaagccacccaagcgcaatgccttctacaggaagctacagaactttctgtataacgttctagaacgacctagggggtgggcatttatctaccacgcctacgttttcctcctggtcttctcatgccttgtgctcagcgtattcagcacgataaaggaatacgagaaatccagcgagggtgcgctgtacatcctggagatagtgaccatcgttgtgttcggggttgaatactttgtaaggatttgggcagccggctgctgctgtcgttaccgcgggtggcggggcaggctgaaattcgcacgcaaacccttctgcgtgatcgatatcatggttttaattgctagcattgcagttcttgccgccggaagccagggcaatgtgtttgccacctcagctcttagatcactccgctttctgcagattctccgaatgatacgcatggatcgacggggtggtacctggaagctgctagggtctgtggtgtacgcacacagcaaagagttagtgaccgcttggtacatcgggttcctttgcttgatactcgccagtttcctggtctacttagccgagaagggcgaaaatgatcacttcgacacgtatgccgacgcactttggtggggtctaataaccctgactacgattggctacggtgacaagtatccacagacatggaacggtagattattggccgccaccttcaccctcattggagtaagtttttttgccttacccgcgggtattctcggctccgggttcgccctgaaggttcaggaacaacacagacagaagcacttcgaaaaaaggcgaaatcctgccgcgggacttatccaaagtgcttggaggttctacgcgacaaacctgtctcgaacagacctgcactccacctggcagtattatgaacggaccgtcactgtgcccatgtacagataccgtagaagagctccagccactaaacagcttttccattttctgttctccatctgttcgtag

SEQ ID NO: 129526 - DNA, 2607 bp, Artificial Sequence
  Description of Artificial Sequence: Synthetic coding sequence
atggtgcaaaagagtagaaacgggggggtttacccggggcctagtggtgagaagaaactgaaagtgggctttgtcggacttgatcccggcgcccctgatagtactcgcgatggtgccctactcattgctgggtcagaggctccgaagaggggcagcattcttagtaagcccagggccggcggcgccggcgctggaaagccacctaaaaggaatgccttctatcggaagttgcaaaactttctttacaacgtcctggagcgccccagaggttgggcatttatttatcatgcctacgtgtttctgctcgtgttcagctgcctggtgctttccgtgttctctactattaaagaatatgaaaaatcgagcgagggggctctctacatcctcgaaatcgtgaccatcgtggtgtttggcgtcgaatacttcgtcagaatttgggccgccggttgttgctgccgatatagagggtggcgaggtcggctgaaattcgcccggaagccattctgtgttattgacattatggtattaattgcctcaattgcagtgttggccgcaggttcacagggcaatgtctttgcaacttccgctctcagatcactgcggttcttacaaattctacggatgattcgcatggaccgaagaggtggcacctggaaactgctcgggagcgtcgtgtacgcacacagtaaggaactggtgaccgcttggtacattgggttcctttgcttgattctggccagctttctcgtttaccttgctgaaaaaggcgaaaatgatcactttgatacttatgcagacgctctttggtggggtctgattacactgacgacaatcggttatggcgataagtatccgcagacatggaacggtcggctgctggcagctacctttaccctcatcggcgtatccttttttgccctgccagccggcatccttgggagcggattcgccctgaaagttcaagagcagcacaggcaaaaacacttcgagaagcgccgtaaccccgcagctgggctcattcagagtgcatggcggttttacgccacaaacttatcccgtacagatctgcacagcacgtggcaatactatgaaagaacagtcacagtgcccatgtatcgattgatccctcctttgaaccagctcgagctgctgcggaacctgaagtcaaaaagcggtctggcctttcgaaaagatccccctcctgagccgtcgccttcaccccgaggagtcgccgcaaagggcaagggcagcccacaggcccaaaccgttcggcggagcccttccgccgatcagtccctggaggactccccctccaaggtgccaaagtcatggagtttcggggacagatcaagagcccggcaggcctttcgcatcaagggggccgcctcccggcaaaattctgaggaagccagtctgcctggggaagatatcgtcgatgacaagtcctgcccttgtgagtttgtgaccgaagacctcacacccgggttgaaagtgtcaatccgcgcggtctgcgtgatgcgcttcctggtgtccaagagaaagttcaaagaatctctacgaccatatgacgtgatggacgtgatcgagcagtacagcgccggccacctggacatgctgagcagaatcaagtctttacagagcaggattgatatgattgtaggtcccccccctccttctactcctcggcacaagaaatatcctacaaaggggccaactgctcctcctagagaaagccctcagtacagtcccagggtagatcagatcgttggcaggggtcccgccatcactgataaagatcgaacaaaagggcccgccgaggccgaactgccagaagatccatctatgatggggagactaggaaaagtggagaagcaggttctgtccatggaaaaaaaactcgactttctggtgaacatttatatgcagcgaatggggataccacccacggagaccgaggcctacttcggcgccaaggagccagagccagctcctccctaccactcgcctgaggatagcagggagcatgttgatagacatgggtgcattgtcaaaattgttcgcagttccagctccacagggcagaaaaacttttcagctccccctgccgcccccccggttcaatgtccaccgtccacaagctggcagcctcaaagtcaccctagacaaggtcatggcacctctcctgttggagaccacggttccctggtcagaatcccccctccccccgcacacgaacgcagtctgtcagcatatggaggcgggaatagggctagtatggagttcctgagacaggaggatactccagggtgccgccctcctgaagggaatctccgtgactctgacacatcaatttctattccctccgttgatcatgaggagctggagcggagtttctccggtttctccatctctcagtccaaggagaatttggacgcactgaactcctgttatgctgccgtggccccatgcgcgaaagtgaggccttacatcgcagaaggcgagagcgataccgactccgatctgtgcactccgtgtggaccacctcctaggagcgccacaggcgaaggtccttttggggatgtcggctgggcaggccctcgtaaatag

SEQ ID NO: 129527 - DNA, 2643 bp, Artificial Sequence
  Description of Artificial Sequence: Synthetic coding sequence
atggtccagaagtcacgcaacgggggagtctacccaggcccttcaggagaaaagaaattaaaagtggggttcgtgggtctggatcccggggctccggattccaccagagacggagctctgctgatcgccggaagcgaagcaccaaagagagggtcaattctcagcaagcctagggccggcggcgcaggcgctgggaagccaccaaaaagaaatgccttttatagaaaactgcagaacttcctatacaacgtcctcgagcgaccccgcggatgggcctttatttaccatgcctacgtgtttcttctggttttcagctgccttgtactcagtgtgttcagcaccatcaaggagtacgagaaatctagcgaaggcgccctgtatattctggagatagttacgattgtagtctttggagtcgagtactttgtgaggatctgggccgctggctgttgttgtcggtatagaggctggcggggccgtttgaagtttgctcgcaagccattctgcgtcatagacatcatggtccttatcgcaagcatagccgtcttggccgccggtagccagggtaatgtatttgccaccagtgccctacgatccctgagattcctgcagattcttcgcatgatccggatggatcgaaggggagggacatggaagcttttaggctccgtggtctacgcccacagcaaggagctggtgactgcttggtatataggcttcctgtgtttgatactagcgtcctttttggtgtatctggccgagaaaggagaaaatgatcatttcgatacctatgccgatgcactttggtggggactgatcacactgacaacgatcggatatggcgacaaatacccacagacctggaatggcaggcttcttgcagctacttttacattgataggcgtaagctttttcgcccttcccgctgggatactgggaagtgggttcgcccttaaggtgcaggaacagcaccgccagaagcattttgaaaagcggagaaaccctgctgccggacttatccagagcgcatggagattctacgcaactaacctgtccaggactgacttacattctacctggcaatactatgagagaacagttactgtgccaatgtatcgcctcatcccccccctcaaccaactagaactgttacgcaatcttaagtccaagtccggattagcgtttaggaaggatcctccaccagagccttctcccagccagaaagtgtcacttaaggaccgtgttttttcctctcccagaggggtggcagccaaggggaaaggatccccacaggcacagaccgtgcggagatctccaagcgccgaccagtcacttgaggacagccccagtaaggtccccaagtcttggagtttcggtgatagatcgcgggcccgccaagcatttagaatcaagggtgctgcttccaggcagaatagcgaagaagccagcctgcccggagaggatattgttgacgataagagctgtccctgtgaattcgtcaccgaagaccttacccccggcctgaaggtctcaataagggccgtgtgtgtcatgaggttcctggtctcaaagcgaaagttcaaggaatcactcagaccatacgacgtgatggatgttattgagcaatattcggctggccatctggacatgttgtctcggattaagtcattgcagacaggaatagatatgatcgtcggaccgccgccacccagcaccccgaggcacaagaaataccccaccaagggaccaacagctcctccccgcgaatctccacagtatagtccgcgggttgaccagattgttggaagaggacctgcaattaccgataaggataggactaaagggccagcggaggcggaactaccggaagatccctcgatgatggggagactgggaaaggttgaaaagcaggtgcttagtatggagaaaaagctggatttcttggtaaacatatacatgcagcggatgggaatcccacctacggagactgaagcctacttcggagcgaaggaaccagagcccgcccccccatatcatagcccggaggacagtcgagagcatgtggatagacacggctgcatagttaaaattgttcgctcctcgagcagcaccggacagaagaattttagcgcgccccctgccgcccccccagtccagtgccctccctccacatcctggcagcctcagtcccatccacgccagggccacggcacttctccagtcggcgatcacgggtccttggtgcgaattccccctccccctgcccacgagcgatcccttagcgcctacggcggggggaatagagcctccatggaatttctgcgtcaggaggatacgcccggatgtaggccgcccgaaggcaatctacgagacagcgacacctcaatttcgattcccagcgtagaccacgaggagctcgagcgatctttcagcggctttagcattagtcagtctaaagaaaacctggatgccttgaattcttgctatgccgcggtggcgccatgcgctaaggtgaggccatatattgcagagggcgagagcgataccgattccgatttatgtacaccctgcggccccccgccacgaagcgcaactggggaaggcccttttggggatgtggggtgggcgggacccagaaagtag

SEQ ID NO: 129528 - DNA, 2565 bp, Artificial Sequence
  Description of Artificial Sequence: Synthetic coding sequence
atggttcagaagagccggaatggtggggtgtatccaggtccatccggagagaagaaactaaaagtgggatttgtgggattggatcctggcgctccagatagcactcgggatggcgcgttgctgatcgccggctcagaagcccctaaacgggggtcgattctgagcaaacctagagccggcggtgctggcgcaggtaaacctccgaagcgaaacgccttctatcgcaaactgcagaatttcttatacaacgtgctagagagaccccgcggatgggctttcatctatcatgcctatgtgttcctgctggtcttttcttgtctggttctaagcgttttctcgaccattaaggagtatgagaaatccagtgaaggtgccctgtacatcctggagatcgtgaccatcgtcgtgttcggggtcgagtacttcgtcaggatctgggccgccggatgctgttgtaggtaccgaggatggcgggggcggctgaagtttgcccgtaagcccttttgcgtgatcgacatcatggtcctgatagcatccatcgctgtgttagctgccggaagtcaaggcaacgtgtttgctacctctgctttgcggtccctccgattccttcagattttgagaatgatccgcatggaccgcaggggaggcacatggaaactcctcggcagcgtagtctacgcacactccaaggagctggtcacagcatggtacattggcttcctctgtttgatcctggcgtcgtttctggtgtacttggccgagaaaggcgagaatgaccacttcgacacctatgcagacgcactgtggtggggtttaatcaccttgaccactatcggatatggggacaaatacccacagacttggaacggacgcttattggcagctacgtttaccctgatcggagtgtctttttttgccctgcccgccgggatactgggctccggttttgcattgaaggtgcaagagcaacatagacagaaacactttgaaaaacgcaggaatcctgctgcaggattgatccagtctgcgtggcgcttttatgctaccaatcttagccgaacagacctgcacagtacttggcagtattatgagcgcaccgtcacagtcccaatgtactcgtcccagacacagacctacggggcaagcagacttatcccgcccctgaatcagctggaactcctaaggaacctcaaaagtaagtccgggctcgcctttagaaaagaccctccgccggaaccttctccttcccagaaagtcagtcttaaagatcgagtttttagcagccctaggggtgtggccgccaaagggaagggatctccccaagcacagactgtcagacgatccccatctgctgatcagtctctggaagatagtccaagcaaggtgcctaagtcatggtcctttggcgaccggagtagagctcggcaagcctttaggatcaaaggtgctgcgtctaggcagaattctgaggaagcctctctgcctggagaagacattgtggatgataaaagttgtccttgtgaatttgttacagaggacctcaccccaggcttgaaggtgagcataagggctgtttgtgtcatgaggtttctggtgtctaagagaaaatttaaggagtctctacgtccttacgacgtcatggatgtgattgagcagtactctgctggccatctagacatgctgtctagaattaagagtctgcaatcccgcgtggatcagattgtgggacgcggcccagctattactgacaaagataggaccaaaggacccgctgaagctgagcttcccgaggacccaagcatgatggggagactcgggaaagtcgaaaagcaggtgctttcaatggagaaaaaactcgactttcttgtcaatatctacatgcaacggatgggaatccccccgacggagactgaagcgtatttcggggccaaagaacccgaacctgccccaccgtaccattctcctgaagattcccgcgaacatgtggacagacacggctgtatagtaaagatcgttagaagtagcagtagcacagggcaaaaaaacttctccgcaccaccagccgcaccccccgtgcaatgccctccctccacaagctggcaacctcagtcacacccacggcaaggacatgggacaagcccagtcggtgaccacgggagcctggtgcgcatccctcccccccccgcacacgagaggtctctctcagcgtacggcggcggaaaccgcgcgagcatggagttcctccgccaggaagacactcctggctgtcgcccacctgaaggtaatctgcgcgactccgacacatcgatttcaatcccctccgtcgaccatgaagagttggagcggagcttttcaggtttttccatttcccagtccaaggagaatctggacgctcttaactcctgttatgctgccgttgccccctgcgccaaggtgcggccatacatagctgaaggcgaaagtgacactgacagcgacctgtgcactccatgtggacccccaccgcgcagcgctactggcgaaggaccttttggcgacgtggggtgggccggcccccgcaagtag

SEQ ID NO: 129529 - DNA, 2619 bp, Artificial Sequence
  Description of Artificial Sequence: Synthetic coding sequence
atggtgcaaaaatcccggaacggcggggtgtatccgggaccatcaggggaaaaaaaattgaaggtgggatttgtggggctggaccctggagctcccgatagcactcgcgacggagccctgctcattgcggggtccgaggcccctaaaaggggctccatactcagcaaaccgagagctggcggagctggtgcaggcaagccgcctaagaggaacgccttctacagaaaactccagaatttcctatacaatgtgctggagcggccacgggggtgggcgttcatttaccatgcctacgtgttcctgctggttttttcctgtcttgtactatctgtgtttagcaccattaaagagtatgagaagtcgagtgagggtgcactatatattttagaaattgtcaccatagtggttttcggcgtagaatacttcgtcaggatttgggccgcagggtgttgctgcagatatcgaggctggcgaggacgcctaaagttcgccaggaaacccttctgtgttattgatattatggtgctcatcgcatcaatcgcagtgctggccgcaggaagccaggggaacgtgtttgccacaagtgcactgagaagtctccgattcctgcagatcctccggatgattcggatggatcgacggggcggcacctggaagcttctgggaagtgtggtgtacgcacactccaaagaactggtcacagcctggtatatcggatttctgtgtctcatattggcctccttccttgtttatctggctgaaaagggagagaatgatcattttgatacttatgctgacgcgctgtggtggggtctcattactttaactactattggttatggggacaaatatccgcagacatggaacggccgactgttagctgccacttttacgttaattggagtcagcttttttgctctgcccgccggcatactgggctccggattcgctctgaaggtgcaagagcagcacaggcagaagcactttgagaagaggcgaaatcctgccgcagggctgatccagtctgcctggaggttttatgcgactaacctcagcaggacagacctacactccacatggcagtattatgagaggacagtgacagtccctatgtacagttcccagactcaaacttatggggcttcaaggctaatccccccccttaaccagctcgaacttctacgcaatctaaagtccaaaagcggactggccttccgtaaagatccccctcctgagccatcaccctctaaaggatcaccatgccgcggaccattatgcggctgctgcccaggtcggtcttcccaaaaagtgagcttgaaggatcgggttttcagttcgcctcgtggcgtggcagccaaaggaaagggatccccacaggcgcagaccgtccgcagaagcccatctgctgaccagtcactggaggatagcccatccaaagtccccaagagctggtccttcggagatcgcagtcgagcaaggcaagcttttcgaatcaagggtgccgcctctcgtcagaacagcgaagaggcctctctcccaggcgaggatattgtcgatgataaaagctgcccgtgtgagtttgttaccgaagatctgacaccagggcttaaagtcagcatcagggccgtgtgcgtcatgcgtttcctggtctcgaagcgtaaattcaaggagtctctccgaccatatgatgtgatggacgtcattgagcagtacagtgccggccacctggatatgctgtctcggatcaagtccttgcagtcccgcgtggatcagattgtgggaagaggccccgcaataaccgacaaggatagaaccaaaggacccgccgaagctgagctgcctgaagacccatcaatgatgggccgactaggcaaagtggagaaacaggtcctgtccatggagaagaagctggacttcctggtgaatatctacatgcagcgcatggggattcccccaactgaaacggaggcatacttcggggctaaggaacctgagcctgcacccccttatcactccccagaggattctcgtgaacatgtggatcggcacggatgcattgttaagatcgttcggtcttctagtagtactggacagaagaattttagcgccccccctgccgcgccaccggttcaatgtcctccctctacctcttggcagcctcagagccacccaaggcagggccatggaacaagcccagtgggcgaccatggcagccttgtgcgtatccctccaccgccagcccatgaacggtcactatcggcttatggcggcggaaaccgggcgagtatggaattcctcagacaggaggacacgccaggctgcaggcctcctgagggaaacctgcgcgactccgacacctccatcagcatcccgtctgtagaccatgaagagctcgagagatcattttccggcttttctatttcacagagtaaggagaatctcgacgcgcttaactcctgttatgctgcagtggctccatgcgcaaaagtccggccatatatcgcagagggtgaatctgatactgactctgatctgtgcaccccatgtgggcctcctccccgcagcgcaactggagaagggcccttcggtgatgtaggctgggcaggccctcgcaagtag

SEQ ID NO: 129530 - DNA, 2619 bp, Artificial Sequence
  Description of Artificial Sequence: Synthetic coding sequence
atggtccaaaagagcagaaacggaggggtctatccaggcccgtccggcgaaaagaaacttaaggtaggctttgtggggctagatccaggtgcgccggactccacgcgagacggcgctctactgatagccggaagcgaggcccccaagaggggatccattctgtccaagccgcgcgctggcggcgccggcgccggcaagccaccaaaacgcaacgctttctatcgaaagctgcagaattttctgtataatgtccttgaacgaccccgaggatgggccttcatctaccacgcctacgttttcctgctcgtgttttcctgtctggtactgtcagtgttttcaactatcaaagagtatgaaaaaagcagcgaaggggccctttatatcctcgagattgttactattgtggttttcggcgttgagtactttgtgcgcatttgggcggctgggtgttgttgcagatacagaggatggcggggcaggcttaaatttgcgagaaaacccttctgcgtgatagacattatggtgttgattgccagcatagcagttctcgcagctggaagccaaggaaatgtttttgcaactagcgccctgcggtcactccgatttctgcagatcctaaggatgatccggatggatagacgtggcggcacctggaaactgcttggatcagtggtctacgcacattctaaggaattggttacggcgtggtacatcggttttctgtgcctcatcctggcctccttcctagtgtacctggcggagaaaggggaaaacgaccactttgatacatatgccgacgcgctgtggtgggggctgattaccctgactaccattggctatggcgacaagtacccccagacctggaacgggagactgctcgcagctacctttaccctgataggggtgtcattcttcgccttacctgctgggatccttggctctgggtttgctctcaaggtgcaggagcaacatagacagaagcatttcgagaagcgcagaaatcctgcagctggactgatccagagtgcatggagattttatgctacaaacttgtcccggacggatctgcattctacatggcaatattatgaaagaactgtcactgtacccatgtactcttcccaaacacagacatacggtgcctcacgactgatcccaccactgaatcagttagagctgctaagaaacttaaaatccaaatccggcctggcatttcgaaaggaccccccacccgaaccctctccctcaaaaggaagtccatgcagaggcccactgtgcggttgctgccctggtagatcctcccaaaaagtgagtttgaaagatcgcgtgttcagttcaccgagaggagtagccgctaagggcaagggctcaccgcaggcacagacagtacggcggtcaccaagtgccgaccaatctctggaggactcccccagcaaagtgcccaaatcctggagctttggagatcggtctcgggctcgtcaagcattccgtatcaagggtgcggcatcacggcagaactcagaggaggccagtcttcccggagaagacatcgtggacgacaagagctgtccctgcgagttcgttacggaggatctgacacctggcctgaaggttagcattcgggccgtgtgcgttatgcgattcctggtgtctaaaaggaagttcaaagaaagccttagaccatacgacgtcatggatgtcattgagcagtacagtgctggccatctggatatgctgtctaggatcaagtctctccagtctcaggtagaccagattgtggggcgtggacccgccatcacagacaaagataggaccaagggtcccgccgaagctgaacttcctgaggacccttcaatgatgggcaggctcggcaaggtcgaaaagcaggtactctctatggaaaaaaaactggatttcttagtcaatatctacatgcagcggatggggataccacctactgagacagaagcctatttcggtgcaaaggaacctgagccagcaccaccctaccacagcccagaagactccagagagcacgttgataggcacggctgtatcgtcaaaattgtgcggtcaagctcgagtaccggacagaagaatttttccgctccacccgccgcccctccagtgcagtgccccccctctacatcatggcaaccacagtctcaccctaggcagggtcatggtacttctccagtcggagatcacggtagtctggtgcggatcccgccaccgccagctcacgagagaagtctttctgcttatggaggaggcaacagggcgagcatggagtttctcagacaagaggatacaccaggctgcaggccccccgagggaaacctcagagacagcgacacctcgataagcattccctctgtggaccacgaggagctggagcgcagcttctcaggctttagcatctcccaatctaaggaaaatctcgatgctttgaacagttgttacgctgccgtagcaccttgcgcaaaggtgcggccgtatattgctgaaggtgagtcagacaccgattcggatctttgcaccccatgcggccctccacccaggtccgctaccggcgaaggtccattcggcgacgtcggctgggctggaccgcgaaagtag

SEQ ID NO: 129531 - DNA, 2535 bp, Artificial Sequence
  Description of Artificial Sequence: Synthetic coding sequence
atggtccaaaagagtagaaatggaggcgtatatccaggcccatctggggaaaagaagctgaaggtcggcttcgtggggcttgatcctggggctcccgattccacccgggacggcgcactgctcatcgccggctccgaagcaccaaagcgggggagcatcttgtccaagcctagggctggcggggccggcgcggggaagccaccaaaaagaaacgctttttacagaaaacttcagaactttctttataatgtgttggaaagacctcgaggttgggcctttatctaccatgcctacgtgtttctactcgttttttcttgcctcgtgctcagtgtcttcagtactatcaaggagtatgaaaagagtagtgaaggtgcgctctacatcctggaaatcgtcactatcgtcgtgtttggtgtggagtattttgtcaggatctgggccgcgggatgctgctgtaggtacagaggttggagaggacgcctgaaattcgcacggaaaccgttctgcgtgatagacataatggtgcttatcgcatccattgcggtgcttgccgccgggagccagggaaacgtgttcgccacgtctgcactgcggtccctcagatttctgcagattttacgcatgattcgcatggataggaggggcggcacttggaaactcctgggcagcgtggtatacgcgcatagcaaggaactggttacagcttggtacatagggtttctgtgcttgattctggcttcattcctcgtctatttagcagagaagggagagaatgaccatttcgacacttacgccgacgccctgtggtgggggttaatcacgctcacaactattggctacggtgataaataccctcaaacctggaacggacgcttgctggctgccaccttcacccttattggcgtctcgtttttcgccctgcccgccggaattctgggcagtggattcgccctgaaagtgcaggagcagcatcggcagaagcacttcgagaaaagacgtaaccctgctgccgggttaattcaaagcgcctggcgcttctatgcgaccaatctgagtagaaccgatctgcattcgacttggcagtactacgagcgcaccgtcactgtcccgatgtatagattaattcccccattgaaccagttagaactgctgcgaaatctgaagtcaaaaagcggcctggctttccggaaggatcctccaccagagccttcacctagtcagaaggtgtcacttaaggatcgagtgttttcatccccccgtggcgtggcagctaaaggcaaggggtccccccaggcccagactgtccgacgcagtccaagcgccgaccagagcctggaggatagtccaagtaaggtccccaaatcttggagctttggggatcgtagcagagctaggcaggctttcagaatcaaaggggctgcttcgagacaaaactctgaagaggcctccttgccaggagaagacatagtagacgacaaatcctgtccctgcgaattcgtgacggaagatttaaccccaggccttaaagtgtccatcagagcagtatgcgtcatgcggtttctggtcagcaagcgtaagtttaaagaaagtctgcggccatacgacgtgatggatgtgatcgagcagtattctgctggccatttggatatgctctccagaatcaagagtcttcagtcgcgcgtcgaccaaatcgtcgggagaggacccgccattactgataaggacaggacaaaggggcctgccgaggccgagttaccagaggaccctagcatgatgggccgcctggggaaggtagaaaagcaagttctgtccatggagaagaaactcgactttttggtcaatatttatatgcagaggatgggtatcccgccaactgagactgaggcatatttcggtgcaaaagaaccagaacccgcccccccttaccactcgccagaagattcccgcgagcatgtggatcgtcatggctgcatagttaaaatagtgcggagcagtagttccaccggccagaaaaatttttcagccccccctgccgccccacctgttcagtgcccaccaagcacttcctggcagccacagagccatcccaggcagggccatggaacaagtcctgtcggcgaccacggtagcctcgtgagaattccacctcctcctgcccacgagcgatcactcagtgcatatggcggcggtaacagagcgtccatggaatttctccggcaggaagatacgccaggctgccgccctccagaagggaacctaagggactcagatacctctatcagtataccttcagtagaccatgaagaacttgaaaggtcattttcggggttctcgatcagccagagcaaggaaaatttggacgctctgaactcctgctatgcggcggtcgccccctgcgctaaggtaagaccctacattgccgaaggggagagcgacacggacagcgacctgtgtacaccatgtggcccaccccccagatcggccaccggcgagggcccattcggagatgtgggctgggccggcccccgcaaatag

SEQ ID NO: 129532 - DNA, 1311 bp, Artificial Sequence
  Description of Artificial Sequence: Synthetic coding sequence
atggtccagaagagccgcaacgggggggtctacccaggcccttccggagaaaaaaagctcaaagtgggattcgtcgggctggatccaggtgctccagattctactcgtgacggggcgttattgattgccggctcggaagctccgaagaggggctccattctgtcgaaaccgagagctggtggcgccggagcaggcaagccccccaagaggaacgccttctatcgaaaactccagaactttctgtacaacgtactggagcgtcccaggggctgggcatttatataccatgcctacgtatttctgctcgtgttcagttgtttggtgctatccgtgttcagtactatcaaagaatatgaaaagtcctcagaaggggcactgtatattttggagatcgtaacgatcgttgtatttggggtggagtattttgttaggatctgggccgccgggtgctgttgtaggtatcgggggtggagaggccgactaaaatttgcgcgcaaacccttttgcgtcatcgatattatggttctgatcgccagcatcgcggttctcgccgcaggtagccagggtaacgtgtttgcaacaagcgcccttcggagcctgcgcttcctgcagatacttaggatgattaggatggataggcgcgggggcacatggaaacttctgggtagtgtcgtctacgcccacagcaaggaactggtaaccgcgtggtatatagggtttctctgtttgatcctggcatcttttctcgtgtacctggccgaaaaaggggagaatgaccactttgatacctacgccgatgcactttggtggggcctgattacactcacaaccatcgggtacggcgacaaatatcctcaaacatggaacgggcgcctactggccgctacatttacacttattggagtcagttttttcgcattacccgctggcattctgggctccgggtttgcattgaaagtccaggaacaacatcggcagaaacattttgagaagaggcgcaacccagcagccggcctcatccagtctgcttggcgattttatgctacgaacctctcccggactgacctccattcaacatggcagtattatgaacggacggtgactgtccctatgtatcgcttgatcccccctctgaaccagttggagctgcttcgaaatctgaagtcaaagtctggtttggcttttcggaaggacccaccgccggagccaagcccccggtccgtgccccccgccgccactctggtgtctgccgtatgtacggcggtttggtcgttatcgcacacttgtgcgcagccagtgatggagatgtag

SEQ ID NO: 129533 - DNA, 1848 bp, Artificial Sequence
  Description of Artificial Sequence: Synthetic coding sequence
atggtccagaagtctcggaatggcggcgtctaccctgggccgtccggggaaaagaagctcaaagtgggcttcgtgggtctcgaccccggagccccagattctacccgggacggtgccctcctcatcgctggctcagaggcgccgaagcgcggatctatcctgagcaaaccccgtgccggaggcgcaggcgccgggaaaccacctaagaggaatgcattctaccggaagctgcagaattttctgtataacgtgctagaacggccacggggttgggcctttatttatcacgcttacgtcttcctcctggtcttcagctgcctggtgctgtctgtcttcagcacgattaaggaatatgaaaagtcttctgagggcgcgttatatatcttagagatcgtgacaattgtggtgtttggggtcgaatattttgtgcggatctgggcagctgggtgttgctgcagatacagaggttggaggggtcggctgaagtttgctagaaaacctttctgcgtgattgacatcatggttctgatagcttctatcgcagtgttggcggccggttcccagggaaacgtctttgcaaccagtgctcttcgctctcttaggttcctgcaaatactccggatgatccgaatggaccgtaggggcggcacctggaaattactggggtcagtggtgtacgcacattccaaggagctagttaccgcatggtacatcgggttcctgtgtctgatcctggccagctttcttgtgtacctggccgagaagggggagaacgaccattttgacacctacgctgatgcattgtggtgggggctgattaccctgacaacgatcggctatggggataaatatccgcagacatggaacggccggcttctggccgcgacttttacgttgatcggggttagctttttcgcactccctgccggcatcctggggagtggatttgccctcaaagtacaagaacagcacagacagaagcatttcgagaagagacgaaacccagcagcagggctaattcagtccgcgtggcggttctatgctacgaatctgagtaggacggacctacacagtacatggcagtattacgagcggacagtgaccgtgccaatgtacagacttattcctcccctgaatcaattagaactactgcgcaaccttaaatcgaagtcagggctagcgttccgtaaggatcccccccctgagccttcaccgtcgcaaaaagtgtctctcaaggaccgcgtgttctcttctccccggggcgtagcggctaagggcaagggcagtcctcaggcacagacagtgaggcgctctccctctgctgaccagagcctcgaggactctcctagcaaagtgcccaagtcgtggagcttcggggaccgctctagagcccggcaggctttccggatcaaaggagctgcctcccgccaaaactcagaggaggcctctctgccgggcgaagacatcgtcgacgacaaatcctgtccatgcgagttcgtgaccgaggatctcacacctggcttgaaggtctctatcagagccgtgtgcgtaatgaggttcctcgtgtccaaaaggaagttcaaggaatccctacggccatatgacgtgatggacgtcattgaacagtatagcgccggccatttggacatgctctcccgcatcaagtccctgcaaagtaggcaggagccaaggctcccagttcagcagggaacccggactggatgggcatctggaacgaagccaactgtcgctcacggtggctccgctggcggagtatgggccgggccccctccacatccgcgcaggcccctcagtgcgagcgtggtctccagccaatccttattctag

SEQ ID NO: 129534 - DNA, 2643 bp, Artificial Sequence
  Description of Artificial Sequence: Synthetic coding sequence
atggttcaaaaatctagaaacggtggcgtgtaccctggaccctcaggagagaagaagttgaaggttggatttgttggtttggatcccggcgcccccgatagcactcgtgatggtgccctgctgatcgctggcagcgaagctcctaagcggggctcgatcctgagtaagccaagggctggtggggctggggcgggcaaaccaccaaaaagaaatgccttctataggaaactgcaaaactttttgtacaatgtgcttgagcgcccccgcgggtgggctttcatttaccatgcgtacgtttttcttttagtgtttagctgcctcgtcctcagcgtgttctcgacaattaaagagtacgagaaaagttcggagggtgccctctacattctggaaatagtgacgatcgtggtctttggcgtcgagtacttcgtgaggatttgggctgcaggctgctgctgtcgctaccgcggctggcgcggccgcctgaagttcgcccgaaaacccttctgtgtaattgacattatggtccttattgctagcattgctgtcctggccgcgggttcccaggggaatgtgttcgcaacttccgctcttcgctctctgagatttctgcagatcctgagaatgatccgtatggatagaaggggcgggacatggaagctgctaggctcagtggtgtatgcacacagcaaagagctggtgacggcttggtacattggatttctgtgtctgatcctggcgtccttcctggtgtatctggccgaaaaaggcgagaatgatcacttcgatacctacgcagacgcactctggtgggggctgattacattgaccaccataggctacggggataaatacccccagacatggaacggacgcctgctggccgcaacatttaccctgatcggagtttcattttttgccctgcctgcgggcatactggggtcaggattcgcgctgaaagtccaagagcagcatcggcagaagcacttcgagaaaaggcggaaccctgccgcagggttaattcaatctgcctggcgtttttatgcaacaaatttgagcaggaccgatcttcacagtacatggcagtattacgagcgaacggtcaccgtcccaatgtaccggttaattccgccattgaaccagctggagctcctgcgcaacttgaaatctaaaagcggcttggcattccgaaaagatccccctcccgagccctcgccctctcaaaaagtgagccttaaggacagagtgttttctagcccaagaggggtggcagcaaaggggaagggctcccctcaggcacagactgtgcgtagaagcccatctgccgaccagagccttgaggatagtccctccaaagttcctaaaagttggtcattcggtgatcgttctcgagccagacaagccttcagaatcaagggcgctgctagcaggcagaattccgaagaggcctccctccctggggaggacatcgtggatgataagtcatgtccctgcgaattcgtgacggaggatcttacccccgggctcaaggtttctatccgggctgtttgcgtgatgcgcttcctggtctcaaagagaaagttcaaagaatcacttcgcccctacgacgtgatggacgtcatcgagcagtattctgccggacatctggacatgttatctaggattaaatctctccagagtaggattgacatgattgtgggacctcctccgccttccactcctaggcacaagaagtaccccaccaagggacctaccgcgccacccagagagagcccacagtactcacctagagtcgatcagatcgtcggacgtggacctgccattacagacaaggacagaactaagggtcccgccgaagccgagctccctgaggacccatccatgatgggaaggctgggaaaggtcgagaagcaagttctgtccatggagaaaaaactcgactttctggtgaatatttatatgcagcggatgggcatccctcctaccgagacagaagcatactttggcgctaaagagcccgagcccgcgccgccataccacagtccagaggattctagggagcacgtggacagacatggctgcattgtcaaaatcgtgaggtcttcgagttcaacgggacagaagaatttttccgctcccccggcagcaccgcccgttcaatgcccaccaagcacaagttggcaacctcagtctcaccccaggcaaggacacggtactagccccgtgggagatcatgggtctttggtccgaattccacccccccctgcacatgagagatcgttatccgcctacggtggagggaaccgcgcatcaatggagttcctgcgccaagaagatacgcctgggtgtcggccccccgaagggaatctccgagactccgacactagcatcagtatcccctccgtggatcatgaagagctggaacgaagctttagtggcttctctataagccagagtaaggagaatctcgatgctttgaactcttgttacgccgccgtggctccatgcgcaaaggtgcggccgtacatcgccgagggggagtccgataccgattctgacctttgtacgccctgtgggccaccacctagaagtgccactggcgaggggcccttcggtgatgtgggctgggccggaccacgcaagtag

SEQ ID NO: 129535 - DNA, 2529 bp, Artificial Sequence
  Description of Artificial Sequence: Synthetic coding sequence
atggtccagaaatcccggaacggaggagtatacccgggacccagtggcgaaaaaaagttaaaggttggtttcgtgggactggatcccggagcacctgactccactcgagatggcgcccttttgattgccggaagtgaagctccaaagcggggtagcattctcagcaagccaagggccggaggcgcgggagccggaaaacctcctaagcgaaacgcattttatagaaaattacagaattttttgtataacgtccttgaacgccctcggggctgggcttttatatatcatgcctatgtcttcttgctcgtgttctcatgcctggtactctctgtctttagcactatcaaggagtatgaaaagagcagcgagggtgccttatatatcctcgagatcgtaacaatcgtcgtttttggcgtggagtactttgtgcgaatctgggcagcaggctgctgctgtcgatatcggggctggcgggggagactcaagttcgccagaaaacccttctgtgtcattgatatcatggtcctcatcgcgtcaattgctgtgctggccgcgggctcccagggcaacgtgttcgctacatctgctctgcgctcactgagattcctacagattcttcgcatgataaggatggataggagggggggcacctggaaactgctggggtccgtggtgtatgcccactcaaaagaactggtaaccgcctggtacatcggcttcttgtgcttaatcctggcctccttcctcgtgtatctcgccgagaagggcgaaaatgatcactttgacacatacgccgatgctttgtggtggggactgattaccttaacaacaattggatacggcgacaaatacccacaaacttggaacgggcggctacttgccgccacctttacacttatcggcgtatcgtttttcgccctgcctgccggcatactgggcagtggtttcgcattgaaagtgcaggaacagcacaggcaaaagcactttgagaagcgccgcaacccagccgcaggcctgatacaatctgcctggcgtttctatgccaccaatctgagtagaactgatcttcacagcacttggcagtactacgaacggactgtcactgtgcctatgtacagttcccagacccagacatatggggcgtctaggcttatccctcccctgaaccagttagagcttctgagaaacctcaagtcaaagtctggccttgcgttccggaaggacccccccccagaaccctccccctctcctcgaggagtggctgcaaaaggcaaggggtctccccaagcacagaccgtgaggagatcaccatctgccgaccagtctctggaagacagtcctagcaaagttccaaagagttggtcattcggagataggagtagagcccggcaggcctttaggatcaaaggggccgcaagtaggcagaactcagaagaagcatcgctgccaggcgaagatattgtggatgataagtcttgcccctgtgaattcgtgaccgaggaccttacaccaggactgaaagtgagtatccgggccgtatgcgtgatgaggttcctcgtgtcgaagaggaagttcaaggaaagcctgcgcccttacgacgttatggatgtcatcgagcagtactctgctggccacttagatatgctcagccgcataaaatcgcttcagtcaagagtggaccagattgtgggtcgaggtcccgccattacagataaagataggaccaaggggcctgccgaggctgagttacctgaagatccttcgatgatgggtcgactaggtaaagtagagaagcaggtactcagcatggagaaaaaactggattttcttgtcaacatttatatgcagcggatggggattccccccaccgaaacagaggcctatttcggagccaaagaacctgaaccggcgcccccttaccattctccggaagattcccgtgagcatgtcgataggcacggctgcattgtcaagatcgtgagaagtagctcatccaccggccaaaagaattttagcgcaccgcccgccgctcctcctgtgcagtgcccaccttccacctcgtggcagcctcagtcgcaccctcggcagggtcatggcaccagcccagtcggtgaccatgggtcccttgtgcggattcctccacctcccgcccacgagcggagcctgtctgcttatggcggcggcaacagggcctctatggagttcctgcgtcaagaagatacacccggttgcaggccccctgagggcaacttacgggactccgacacctcaatcagcatcccgtccgtggatcatgaggaacttgagcgctccttcagcggcttctcaattagccagagcaaagagaatctggacgccttaaatagttgttacgctgcagttgccccatgcgcaaaagtgcgcccctacattgcggaaggggaatctgataccgattctgacttgtgtaccccctgcggcccccctcctcgatcagctactggcgaaggccccttcggtgacgtaggctgggctggaccgagaaaatag

SEQ ID NO: 129536 - DNA, 2526 bp, Artificial Sequence
  Description of Artificial Sequence: Synthetic coding sequence
atggtgcagaaatctaggaacggcggcgtttaccccggaccatccggcgagaaaaagttgaaagtaggttttgtagggctggatcctggtgctcccgatagcaccagggatggcgctcttctgattgccggttcagaggccccaaagcgcggatcgattttgagcaaaccacgagcagggggcgccggcgcaggcaaacccccaaagagaaacgccttctacaggaagttgcagaacttcttatataatgtactggagcgtcctcggggatgggctttcatttatcacgcctacgtgttcctcctggtgttcagctgcttagtgttatcagtcttttctactatcaaagaatacgagaagtccagtgagggtgctctgtacatcctggaaattgtgactattgtagtgttcggtgtggaatattttgtccggatatgggcagctggatgttgctgtcgctaccgtgggtggaggggtaggttaaaattcgcccgaaagcctttctgtgtgatagacataatggtgctgattgcaagtatcgccgtgctcgctgccggttcccaggggaacgtattcgctacgtctgctcttcgcagtctacgatttctccagattctgcgcatgattcggatggacaggagaggcgggacatggaaactcctcggctccgtggtgtacgctcacagcaaggagctggtgacagcttggtacattggcttcctttgcctgatcctggcctcattcctcgtgtacttggccgaaaaaggcgagaacgaccacttcgacacttacgcagatgctctatggtgggggctgatcactctgacaacaatcggatatggagacaagtatccacagacgtggaacggcagactcttggcggccacctttaccctaattggggtaagttttttcgctctacctgccggcatactaggaagcggatttgccctcaaggttcaggagcagcataggcagaagcatttcgagaaacggaggaaccccgccgccggattgatccaaagtgcatggcgattttacgcaacgaacctgtctagaaccgatctccactccacatggcagtactacgagcgtactgttaccgttcccatgtacagctcacagacacagacatacggcgctagccgacttattcctcccctaaaccagttggaacttctgcgaaatctgaaaagtaagagcggcttggcattccgcaaggacccacctcctgagcccagcccgtccccacgcggggtcgctgcaaagggcaagggctccccccaggctcagaccgtccggcgaagcccatcggcagatcagagcctggaagattcaccaagtaaggtgccaaaatcttggtccttcggcgaccgaagccgggcacggcaggccttccggatcaaaggcgccgcaagccggcagaattccgaggctagcctccccggtgaggacattgtcgatgacaaatcatgtccttgtgagttcgtaactgaggacctgactcccggactcaaagtctctatcagagcagtttgcgtgatgcggttcctcgtgtctaagcgcaagttcaaagagtcactcagaccctacgacgtgatggatgtcatcgaacagtattccgctgggcatctcgacatgctgtcacgtattaagtcattacagtctagagtggaccaaatcgtagggagaggccccgctatcacagacaaagacaggacaaaaggcccggcagaggcagaacttcctgaggaccctagcatgatgggtcgattgggtaaagtggagaagcaggtattgagcatggagaagaagctagattttttggttaacatctatatgcagcgcatgggaatccctcctactgagacagaggcatattttggtgccaaagagcctgagcccgccccaccttatcattccccagaagactcgagggagcacgtggatagacatggctgcatcgtcaagatcgtgcgatcctcctcctcaactggtcagaagaacttttcagcccctcctgccgcgccgcccgtgcagtgtccaccatctacatcatggcagccacaaagccatccccgacaggggcatggaacctcaccagtgggagaccatgggagtttagtgcgcatccctccccctcccgctcatgagagaagtctttccgcgtatggtggcggcaatcgagcaagcatggagttcctgagacaggaagacaccccggggtgtagaccacccgaggggaacctgagggattctgacacctctatcagcatacctagtgtcgatcacgaagaactggagcgttcttttagcggtttttccattagtcagagtaaagaaaacttggatgcgcttaattcctgctatgcagctgtggccccatgcgctaaagtgcggccctatattgccgagggggagtctgatacagatagcgatctctgcactccctgtggacctcctcctagatcagccacaggggaaggtccttttggcgacgtgggctgggccggcccccgcaaatag

SEQ ID NO: 129537 - DNA, 2619 bp, Artificial Sequence
  Description of Artificial Sequence: Synthetic coding sequence
atgggtctgaaagctagaagagctgccggtgcagccggaggaggcggcgatgggggcggaggcggtggaggggcggccaatccagctgggggagacgcggccgcagccggcgatgaagagcggaaggttgggctggctccaggggatgtcgagcaagtgacactggccttaggtgccggtgccgacaaagatggcacattactcttagaaggcggaggcagggacgagggtcaacgccgaaccccccaggggattggtctgctagcgaagaccccactgtcacgccccgtcaagcgcaacaatgctaaataccgtcgtatccaaacacttatttacgacgcactggagagacccaggggttgggccctgctctaccatgcgttggtattcttaatcgtcttggggtgcctgattttagcagtactgacgacttttaaggagtatgagacagtgtccggggattggctgctacttcttgagacattcgccatttttatattcggggcagaattcgcactgcgcatctgggccgccggatgctgttgcaggtacaagggatggcggggcagactgaaattcgctcgcaagccactgtgtatgctggacattttcgtcttgatagcgagcgttcctgtggtggcagtcggaaatcagggcaacgttcttgcgacgagtctcagatcgttgcgattcctgcagattctccgaatgcttagaatggatcgccgcggaggtacctggaagttattgggaagcgcaatatgtgcacattctaaagaactaataacggcttggtacatcggtttcctgactttgatcctttcctcttttctggtgtatctggtggaaaaagacgtgcccgaggttgacgcgcagggagaagagatgaaagaagaattcgaaacctatgctgacgccctctggtggggactcattacactggctactattggctatggggacaagaccccgaaaacctgggaggggcgtctcatagcagcaaccttctccctgataggagtgtcgtttttcgcacttcccgcaggcattctgggttccgggctggcactgaaggttcaggagcaacacagacagaaacacttcgagaagcgtcgaaagcctgccgcagaattaatacaggcggcctggcgatattacgcaaccaacccgaaccgcatcgacctggttgctacctggcgcttttatgaatccgtggtatctttcccgttcttcaggaaagagcagctcgaggccgccagctcccagaagctaggacttttggaccgggttaggctgagtaacccacgaggatcgaataccaaaggaaagctatttaccccactcaacgtggatgcaatcgaggagtccccctctaaggagccaaagcccgtgggtctcaataacaaagagcgttttcgcacagcgtttaggatgaaggcatatgctttctggcagtcatcagaagatgcaggaactggcgatcccatggctgaagaccgggggtatggaaatgattttcctatcgaagatatgatccccacactcaaagcagctatacgagccgtccgcattctgcagtttcgtctttacaaaaaaaaatttaaagaaacactgcgcccatacgatgttaaggatgtgattgaacagtactccgctggacatttggatatgctatctcggattaaatacctccagactcggatcgacatgatctttaccccgggcccaccctcaactccaaagcacaaaaaatcacagaagggctcagcgttcacattcccgtcgcaacagtccccgcggaatgaaccatatgtggcacgcccttctacatctgagatcgaagaccaatctatgatgggtaaattcgtaaaagtcgaaaggcaggtgcaggatatgggcaaaaaactcgatttcctggttgatatgcacatgcagcatatggaacgtcttcaggttcaggttaccgagtattatcctaccaaagggacatcgagccccgccgaggccgagaagaaagaagataatcgttactccgacttaaagacaataatatgtaattatagcgaaaccggaccaccagagcccccatattctttccaccaggtgaccatagacaaggtcagtccctacggcttctttgctcatgacccagtgaacctcccccggggcggaccatcctccgggaaagtgcaggctactccgcccagctctgccaccacctatgtggagcgcccgacagtgcttccaattctcacactcctcgacagcagagtttcttgccacagccaagccgacctgcaaggaccttacagtgatcggatcagtcctaggcagcggagatccattactagagactctgacacacctctgtccctgatgtcggtgaaccatgaggagttggagcggtcaccttccggcttcagcatttcacaagacagagatgactacgtttttggccccaacgggggctcctcttggatgcgagagaagaggtacttagcagaaggcgagactgatactgatacagatccgtttaccccctctggtagtatgccactctctagtaccggggatggaatcagcgacagcgtctggacaccctctaataaacccatttag

SEQ ID NO: 129538 - DNA, 2256 bp, Artificial Sequence
  Description of Artificial Sequence: Synthetic coding sequence
aagccaaagaaacacgggccaatgttcctgatcgtgctgggctgcttgatacttgccgtcttgaccacgtttaaggaatatgagaccgtttccggggactggctccttctgcttgagactttcgcaattttcatatttggtgccgaattcgccctcagaatttgggccgcaggctgttgttgccggtataaaggttggaggggaagactgaaattcgcccgtaagccactctgtatgttggacatttttgtcctgatagcttcagtgccagtggtggctgtgggtaatcaaggcaatgtactggctacaagtctgagatctctgcggtttttgcaaatcttgaggatgttgaggatggaccgcaggggtggaacatggaagcttctgggtagcgccatttgtgcacattctaaggagctcatcacggcatggtacatcggcttcctgaccctgatcctgagctcattcttagtgtacttggtggagaaggatgtacccgaagtggacgcgcagggagaggagatgaaagaggaatttgagacctacgccgacgctctgtggtggggcctcattacgctcgccacaattgggtatggtgacaaaacacctaagacttgggaagggaggttgattgcagctaccttttctcttattggtgtgtccttttttgcgttgcccgccgggatactgggcagcggcctggcactgaaagtccaggagcagcaccgtcagaaacactttgagaagaggaggaagcctgccgcagagctcatccaagccgcctggaggtactatgcaacaaatccaaataggatcgatctggttgccacatggcgcttttacgaatccgtggtgagctttcctttttttcgtaaggagcaactggaggcagcaagttcccagaagttggggctgttggatagggtacgcctgagcaacccacgggggtccaatacaaaagggaagctgttcacgcccctcaacgtagacgccattgaagagagccctagtaaggagccaaagcctgtaggattgaataacaaggaacggtttaggaccgcctttcggatgaaagcttatgcgttttggcaatctagtgaagatgctggcacaggagacccaatggccgaggaccgcggttatggaaatgattttcccattgaggacatgattcctactctgaaagccgcaatcagggccgttaggatactccagttcagactctataagaagaagttcaaggaaactctgcggccatatgacgtcaaggacgtcattgaacaatacagcgccggccacctggatatgctcagccggatcaagtatctacagacccggatcgacatgatttttacgcccggcccaccttctacacctaagcataaaaaaagtcaaaagggtagtgcgttcacattcccttcacagcagtctccacggaacgagccgtatgtggcgcgtccctcaacctctgagattgaggaccagtccatgatgggtaagttcgtaaaggttgaacggcaggttcaggacatgggcaagaagctggacttcttggtagacatgcacatgcaacatatggagaggttgcaggtgcaggtcacagaatattaccctacgaagggaacctcatccccagctgaggctgaaaagaaagaggataaccgctattctgatctgaagacgattatctgtaactattccgagacaggtccacccgaacccccctacagctttcaccaggtcacaattgataaggtgtcaccatatggcttcttcgcccacgaccccgttaatctgcctagaggaggtcccagttcgggtaaggtccaggctacacctccgtcctcagctacaacgtatgtagagaggcctacggtactgcccatcttgacgcttctcgactccagggtgtcatgccattcacaggccgatctccagggaccctattccgatcgtatatctccccgccagcggcgcagtatcacacgcgatagcgacactcctctgtcccttatgagtgtgaatcacgaggagctggagagatctccatccggctttagcatttcccaagacagagacgactatgtctttgggcctaatggcggaagctcatggatgcgtgagaagcgctatctcgcggaaggggaaactgacacagacacggatccgtttacccctagcggtagcatgcctctcagcagtaccggggatggtatcagcgattccgtgtggacgcctagcaataagcctatctag

SEQ ID NO: 129539 - DNA, 2550 bp, Artificial Sequence
  Description of Artificial Sequence: Synthetic coding sequence
agggcggccgcggagaaggcgaagcgtccagccggtgcacggcagatgggtctgaaggcccgacgtgcggccgctggggacgaagagcgcaaagttggactggctcccggcgatgtggagcaagttacactggctctgggcgccggcgccgataaggacggtacacttctgctcgagggtggcggaagggacgagggacagcgccgcactcctcagggtatcggccttttggctaagacccccctgagtaggcccgtcaaaaggaacaacgctaagtaccggagaattcaaacactgatctacgatgccctggagcgaccaagagggtgggctctgctttatcacgccttggttttcttgatagtcctgggttgcctgattttggctgtactcacgacctttaaagagtacgagacggtatctggggactggctcctgttgcttgagacatttgcgatcttcatattcggcgccgaattcgcactgaggatttgggctgcaggctgctgctgcaggtataagggctggagaggaaggctgaagtttgcgcgcaaaccactgtgcatgctggacatttttgtgctgattgcctcagtgccagttgtggcggtcggaaaccaaggaaacgtgctcgctacatcattgcgctcgcttcgatttctgcaaattctccgcatgctgcggatggacagacgtggcggaacttggaagctgctcggctcagccatctgcgctcactctaaagagctgataactgcctggtacattggtttcctaaccttaattcttagcagtttcctggtgtatctcgtagagaaggacgtgcctgaagtggatgcccagggcgaggagatgaaagaagagtttgagacttatgcggatgccttgtggtggggtttgatcacgctggctaccatagggtacggcgacaaaaccccaaaaacctgggaaggaagactgattgccgcaacattcagcctgatcggcgtgagctttttcgctctgccagccggaatactggggagtggtcttgcactgaaggttcaggagcagcaccgacagaaacattttgaaaaaaggagaaagcccgccgcagaactcatacaggcagcctggagatattacgccactaatcccaaccgcattgatttagtggcaacgtggcgcttttatgagagtgtggtaagtttcccatttttccggaaagagcagctggaggccgcttcgtcccagaagctcgggctgctggaccgcgttcgccttagcaatccccgcggctccaacacaaaggggaagctcttcacaccactcaatgtcgatgctatcgaggaaagcccctcgaaggagcccaagcctgtgggcctgaacaacaaggaacgatttaggactgcttttagaatgaaagcctatgccttctggcagagctctgaagatgccggcaccggcgaccccatggcagaagaccggggatatggaaacgacttccctattgaagacatgattccaaccctgaaggccgctattcgggccgtccggattcttcaattcagactgtacaaaaaaaagtttaaggagactctccgcccgtatgacgtgaaggacgtcatcgagcagtattccgcagggcacctcgatatgctaagtaggataaaatacctgcagacccgtattgatatgatcttcacacccgggccacctagtactccaaagcacaaaaagtctcagaagggaaacgaaccttacgtcgcacgcccctccacatccgagattgaggaccagagcatgatgggaaaatttgtcaaggtagagcggcaggtccaagacatgggcaagaagctcgactttctggtcgatatgcacatgcagcacatggagagactccaggtgcaggtgaccgagtattatcctactaaaggaacatcatctcccgccgaggctgagaaaaaagaagataatagatactctgacctcaaaactatcatctgcaactattctgagaccgggccacctgagcctccttactcatttcaccaggtcaccattgataaagtgtctccttacggattcttcgcacatgacccagtcaacctgcctcgtggaggacccagttctggtaaggtccaggcgacccctccttcctctgcaaccacgtacgttgaaagaccaacggtcttgccaatccttactctgctcgattccagggtttcatgccactcccaggccgacctacagggtccatactccgatcgaatttctccccggcaacgtagatccattactcgcgatagtgacaccccactgtccctgatgtccgtgaatcacgaggaactcgagagatcccccagtggcttctctatatcccaagaccgtgacgactacgtatttggacccaacggtggaagctcctggatgagggaaaagaggtacctggcagagggcgagaccgacacggacaccgatccttttacaccctccggctctatgccgctgagctctacaggcgatggcataagtgactcagtgtggaccccttccaataaacccatctag

SEQ ID NO: 129540 - DNA, 2088 bp, Artificial Sequence
  Description of Artificial Sequence: Synthetic coding sequence
atggctgaggcaccaccacggaggctgggtttgggcccgcctcctggagatgcccctagagctgagctggtggcgctcaccgcagtgcagagtgaacaaggcgaggccggtggcggcggatctcctcgtcggctgggccttctcggttctcccctaccacctggcgccccactgcccggacccgggtccggctccggaagcgcatgtggtcagagaagctccgccgctcacaaaagatacaggcgccttcagaactgggtctataacgtgctagagagaccccggggatgggctttcgtgtaccatgtgtttattttcttacttgtcttctcatgcctcgtcctatcagtgctgtctaccatccaggagcaccaagagctagcaaatgagtgcttactaattctggaattcgtgatgattgttgtgttcggtctcgaatacatagttcgggtgtggtccgccgggtgttgttgcaggtacaggggatggcaaggccggttcaggtttgcccgaaaacccttctgtgtgatcgattttatcgtctttgtggcttctgtagccgtgattgcagctggtacccagggaaacatctttgccacgtccgccctgcggagcatgagatttttgcagattctgaggatggtgcggatggatcgtcggggagggacttggaagcttctgggatcagtagtgtacgcgcatagtaaggaactgatcactgcctggtatatagggttcctggtccttattttcgcctccttccttgtttacctggccgagaaggacgcgaactccgacttcagtagctatgccgactcactctggtgggggactatcactttgaccactatcggttacggagacaagacgccccatacttggctcggaagggtcttagccgcaggctttgccctgctcggcatctcttttttcgctctgccggcaggtattttgggatcaggcttcgctctcaaagtgcaggaacagcatcgacagaagcacttcgaaaaacggcgcatgcccgcggcaaatcttattcaggctgcttggcgactatactccactgatatgtcaagagcctaccttaccgctacctggtactactacgacagcattctcccaagttttagagaactggccctcctgttcgaacatgtacagcgcgcacggaacggcgggctgaggcccctggaagtccgccgggccccggtgccagatggtgctcctagtcgatatcccccagtggccacatgtcacaggccaggctctacctctttctgccctggtgagagttcaaggatgggcataaaagaccgcattcggatgggaagcagccagagaaggacaggccccagcaagcagcatctggctcccccaacaatgcctaccagtccttccagtgagcaggtaggggaggccacttccccgacaaaggttcagaagagttggtctttcaacgatcgaaccagatttagagcatccttgcggctgaagccaagaacctcagccgaggatgcaccatctgaagaggtcgccgaggagaagtcctaccagtgcgagctcaccgtggacgacataatgcctgctgttaagaccgtcatccgctcaatacggatcttaaagttcttggttgcaaaaagaaagtttaaggagaccctgagaccgtatgatgtaaaggacgtgatcgagcagtacagtgccggccatctggatatgctgggacggatcaagtcactgcagacaagagtcgatcaaatcgtgggccggggtcctggggaccgcaaggcccgcgagaagggagacaagggaccttctgacgccgaggtggtggacgagatctctatgatggggagagtggtcaaagtggaaaagcaagtgcaaagtatcgagcacaagttggatctgctgttagggttctactcccgatgtctgcgctcagggactagcgcttctttgggcgccgtacaggttccactgttcgaccctgacatcacttctgactatcacagtccagttgatcacgaggatatcagcgtttcggctcagacactgtcaatttcacggtccgtctctacaaatatggattag

SEQ ID NO: 129541 - DNA, 2856 bp, Artificial Sequence
  Description of Artificial Sequence: Synthetic coding sequence
atgccacggcatcacgctggaggcgaggaaggaggtgctgccggtttgtgggtgaagtctggggcggccgccgcagcggcgggtggcggtcgcctgggaagtggaatgaaggacgtcgagtccggaagagggcgcgtgctgttaaacagcgcggctgctaggggagacgggttgttactcctgggtacgagggctgctacattgggtggagggggtggcgggctgcgagagtctagacgtgggaagcaaggggctagaatgagcctgctgggaaagcctttgtcttacactagcagtcaatcttgtagaaggaacgtcaagtataggcgcgtgcagaactatttgtacaatgtcctagagagacctaggggctgggccttcatttaccatgcctttgtctttctcctggtctttggttgtttgatactttcagtattcagcactatcccggagcacactaagctggcttcatcatgtctgcttatactggaatttgtgatgatagtcgtgttcggactcgagttcatcattcggatctggtctgcgggatgttgctgcagatatagaggatggcaggggcggctgcgattcgcccgaaagccattttgcgtcatcgacaccatcgttcttatcgcttccatcgccgtggtctcagcgaagacgcagggaaacatcttcgcaacttccgctctccggtcactgcggtttttacagattctgagaatggtgcggatggaccggcgggggggaacctggaagttgctgggttccgtggtatatgcacattccaaagaactaattactgcctggtatatcggcttcctcgtcttaatcttctcatctttccttgtttacttggtcgaaaaggacgctaacaaagagttcagcacatatgccgacgccctctggtggggcaccattaccttaactaccattggttacggagacaagacccccctaacatggcttggcaggcttctctctgctggctttgccctgttggggataagcttttttgccctgcctgcaggcatacttgggagcgggttcgccctgaaggtgcaggagcagcaccggcagaagcattttgagaaaagaagaaatcccgcggcaaatttaatccaatgtgtctggagaagctatgctgccgatgagaaaagcgtgtcgattgccacttggaagccacatttgaaggctctgcacacctgctcccctactaaaaaggagcagggtgaagcgtcatctagcaaattctgtagcaataaacagaaactgtttcggatgtacacctctcggaagcagagtcagaagctgagcttcaaggagcgggtcagaatggctagtccacgtggacagtccatcaaatctaggcaggcttctgtcggagatagaaggtcgccaagcactgacatcacagctgaagggtcacccactaaagtacagaaatcttggagcttcaacgaccgcacccgattccgtccctcactacgtctgaagtcatcacagcccaaacctgtgatcgacgctgataccgccctaggcactgatgacgtgtacgatgaaaaaggatgtcaatgcgacgtgtctgtggaagatctcacacctccattgaagaccgtgataagagcaatccgaataatgaagttccacgtggctaagcgaaagtttaaagagactctgcggccatacgacgtgaaagatgtcatcgagcagtacagcgccggccacctcgatatgctctgcagaatcaaaagcttgcagacccgtgtagatcagatactgggcaagggccaaataacatccgacaaaaagtctagagagaaaattacagctgagcacgagacaaccgacgatctttccatgctcgggcgggtcgtgaaggtggagaagcaggtgcaatccattgagagcaaacttgactgtctgctcgacatctaccagcaggtgctacggaaaggctcagctagcgccctggctttggcctcattccaaattccaccctttgaatgcgaacagacatctgattaccagtcaccggtggacagtaaggacttgagcgggagcgcacagaattccggctgtctttcccggagcacaagcgccaacatcagtcgtgggcttcagtttattctgactcctaatgagttctcagcacagactttctatgcattgtcaccaaccatgcatagccaggccacacaagtccctataagtcaatctgatgggtctgcagttgccgccaccaacaccattgctaaccagataaacaccgccccaaaacccgccgcccccacaaccctacagataccaccgccacttccagccatcaagcacttgccccgccccgagactctccaccctaatccagccggactgcaagaatccattagtgacgttacaacctgcctggtggcatccaaggaaaacgtgcaggtggcgcagagcaacttgaccaaggatcgtagcatgagaaaaagctttgacatgggaggagaaaccctgcttagcgtgtgcccgatggtgccgaaggatttgggaaagagccttagtgttcagaacctgattcgctccaccgaagagcttaacatccaactttccggatccgagagtagtggaagcagaggatctcaggacttttaccccaaatggcgggaatctaagctgtttatcaccgatgaagaagtgggccccgaggaaacagaaactgacacatttgacgccgctcctcagcctgctagggaggccgcattcgcctcagatagcctgaggactggccgatcacgctcctcacaaagcatttgcaaggcaggcgagtctacagacgccctgtccctaccacacgtcaaactcaaatag

SEQ ID NO: 129542 - DNA, 2799 bp, Artificial Sequence
  Description of Artificial Sequence: Synthetic coding sequence
atgccacggcaccacgccggaggtgaggaagggggggcagctggcctgtgggtgaaatcgggagccgccgccgcagctgctggaggcggtaggctgggctctggcatgaaggacgtggagtccggacgtggacgcgtcctgttgaactccgcggctgcccgaggcgatggactccttctgttgggcactcgtgccgcaacactgggcggcggcggcggtggattgcgggaatcaagacgcgggaagcagggcgcgaggatgtcattgcttggaaagcctttgtcgtatactagcagccaatcatgccggagaaacgttaagtacaggcgagtgcagaactatttgtataatgtacttgaacgcccccgcgggtgggcatttatctatcatgcctttgtgtttctcccagttttcggctgccttatactgagtgtgttcagcacaattcctgaacacaccaagctggcatcctcctgtctcctgattctggagttcgtgatgatcgtggtgttcgggctagagttcattattcgcatctggtccgccggttgctgctgcaggtacagggggtggcagggcaggcttcgcttcgcccggaaaccgttttgcgttattgatacgatcgttcttatcgcttccatcgccgtagtctctgccaagacccaaggtaacatcttcgcaacctcagcattgcgttctttacggttcctgcaaattcttcggatggtccgaatggacagaagaggcggcacctggaaactgcttggtagtgtggtgtacgctcactcaaaagaactgatcactgcctggtacatcgggtttctggtgctgatatttagctccttcctggtttacctcgtggagaaggacgcaaacaaagaattcagtacttatgccgatgccctatggtggggtactatcacgctgactacaattggctatggcgataagacacccctgacatggttgggtcgattattgagcgccggctttgcactgttgggcatcagtttctttgcattgccagccggaattttgggaagtggcttcgcactgaaagtccaggagcagcaccggcagaagcatttcgaaaaaaggcggaacccagcggccaatcttatccaatgcgtttggcgatcatatgcggccgatgagaaatctgtgtcaatcgccacatggaaaccacacctgaaggctctccacacttgctctccaaccaagaaggaacaaggcgaggcctcctcttctcaaaagctaagttttaaagaaagagttcgcatggcatcgccaagaggccagagcatcaagtcaaggcaggccagtgtcggagatagaagatcgccctcaacagacatcacggccgaagggtcgccgaccaaggtacagaagtcctggtcttttaacgaccggaccagattcaggcccagcctgcgactgaagagctcccagcctaaacccgtcattgatgccgacactgccctgggaactgacgacgtctacgatgaaaagggctgccagtgtgatgtgagcgtcgaggacctaactcccccactcaaaaccgtaattcgggccattcgcatcatgaagtttcacgtggccaaacggaaattcaaggaaactctccgcccttatgatgttaaggacgttatcgagcagtatagtgctggccaccttgatatgctttgtcgcataaaaagcctccagacccgggtggatcagattctcggaaaagggcagatcacatcggacaagaagtcacgggagaaaatcacagcagaacatgagacaacagatgatctaagcatgctcgggagggttgtcaaggttgagaaacaggttcagtcaattgagtcaaaactcgactgcctgcttgacatctaccagcaggtgctccgaaaagggtcggcatctgctctcgctctcgcatcctttcaaattcccccctttgaatgtgagcaaacgtctgattaccagagccccgtcgacagtaaggatctctctggcagtgcccaaaacagtggctgtctgtccagaagcactagtgccaacatatctcgcggtctacaattcatccttacccccaatgagttctcagcacagaccttttatgctttgtcccctacgatgcattcgcaggctacacaagtgccaatttcgcaaagcgacggctctgctgtcgccgccactaacactatcgcaaaccagatcaacacagcacccaagccagctgcaccgacgaccttgcagattccgcctcccctccctgcaataaaacatctgccacggcctgaaacgctccatcccaatccagcaggcctgcaagagagcataagcgacgtgactacctgtctggtggctagcaaggaaaatgtgcaagtcgcccaatccaatttaactaaagacagaagcatgcggaagagcttcgatatgggcggggaaactctgctgtcagtgtgccccatggttccaaaagacctgggcaagtctctttctgtgcagaatctgatacggtctaccgaggagcttaatattcagttgagtggcagtgagagcagtggttctcggggctctcaagacttctatcccaaatggcgagagagcaagctgttcatcaccgacgaggaggtggggcccgaggagactgaaacagataccttcgacgcagcccctcagcctgctagggaagccgcattcgccagtgactctttgcgtacaggtcggtcccgtagctcccagagcatctgcaaggctggcgagtccaccgacgccctctctctacctcacgtgaagctgaagtag

SEQ ID NO: 129543 - DNA, 2802 bp, Artificial Sequence
  Description of Artificial Sequence: Synthetic coding sequence
atgcccaggcaccacgcgggaggcgaggaggggggcgccgctgggctctgggtgaagtccggcgccgcagctgcagccgccggggggggacgactaggcagtggaatgaaggacgtcgagagcggcagaggcagggtgctgctgaatagcgctgcggcaagaggcgacgggctcttactgcttggaaccagagccgccaccttgggcggcggaggggggggtttgagggagtcccggagaggcaagcagggagccagaatgagtctacttggcaagcccctgagttataccagcagtcaaagttgccggcgtaacgttaagtaccggagggttcagaattacttgtacaatgtcctggagagaccaaggggttgggccttcatctatcatgcattcgtgtttttactcgtgtttggatgtctgatcctgtcagtattttcaacgattcctgagcacacgaagctcgcgtcaagctgcttattgattctcgaatttgtgatgattgtcgtttttgggcttgagttcatcatccgtatttggagcgctggctgctgttgtcggtacagaggctggcagggtagactgcggttcgcaagaaagccattttgcgtgattgatactattgtgctgattgcttctatcgcagttgtatctgccaaaactcaggggaatatcttcgcgacctcggcactccgatccctgagattcctgcagattcttagaatggtgagaatggatagacggggaggcacgtggaaactgttggggtcagttgtatacgctcatagcaaggaactcattactgcttggtatataggattcctcgttttgatcttttcttcgtttcttgtttacctagtcgagaaggatgccaataaagaattctcaacctacgcagacgctctgtggtggggcacgattacactgactaccatcggctacggtgataagacacctctaacatggttgggccgcctactttccgctggctttgccctcctaggaatctcattcttcgccctccccgccggcattttggggtccggattcgcccttaaagtccaggaacagcacaggcagaagcatttcgaaaagagacgcaatccagcagctaacctgatacagtgtgtttggaggtcttacgccgcggacgaaaaaagcgtcagtatcgccacatggaagccacatctgaaagctcttcacacatgttctcctacgaagcaaaaccagcagggcgaatctcagtcatgccagaagctgtcttttaaggaaagagtccgtatggcttcccctcgaggccagtcaatcaagagccgccaagccagcgtaggcgaccggcgttctccgtcaacagatatcacggctgaaggatcacccactaaagtgcaaaagtcctggtctttcaacgacagaacccggttccgcccgagcctgagactgaaatccagccagcccaagcccgtgatcgatgctgatacagcactggggactgacgatgtctatgacgagaagggctgtcagtgcgacgtatccgtagaggacctgactcctcccctcaagacggtcatcagggccattcgcatcatgaaatttcatgtcgccaaaagaaagtttaaggagacactccgtccttatgacgtgaaggacgtgatagaacaatactccgcagggcatctggacatgctatgtcggatcaagtccctccaaacacgcgtggatcagatcctcgggaaggggcagatcacttccgacaagaagtccagagaaaagatcacggcagaacacgaaaccactgacgacctgagcatgttggggcgggtggtcaaagtggagaagcaggtccagtcaatcgagtctaaactcgactgtctcctcgatatctaccagcaggtcctgcgcaaggggtcggcttccgccctggcgctggcctcatttcagatcccacctttcgaatgcgagcaaacttcagactaccagtcacctgtggattctaaggacctgagcggttccgcgcaaaacagcgggtgtctctcacggagcacaagcgccaacatcagccgtggattacaattcatcctgacacccaacgaattttctgctcagactttttatgccctaagtccaacaatgcacagccaggctacgcaagtaccgatatcccagagtgacggatcagctgtggcggccaccaatacaattgcaaatcagattaacactgctccgaaacccgccgctccaaccacactgcaaatccccccccccctgcctgccattaaacacctccctcgtcccgaaacactgcatcccaaccccgcaggtctgcaagagtcgatctctgatgtcacaacttgcctggtcgcttcgaaggagaacgtgcaagtcgctcagagtaatctcaccaaagacaggagcatgcggaaatcttttgatatggggggggagacactgctctctgtctgccccatggtgccaaaagacctgggcaagtccctgtctgtgcagaatctcataagatcaacagaagaactgaatatccaactgagcggcagtgagtcatctgggagccggggctcccaagacttctatcctaagtggagggaatccaagctcttcattacagacgaggaagtgggtcccgaggagacagaaactgatacgtttgatgctgctccacagcccgctcgagaagcggcatttgctagcgacagcttgcgaactggcagatcaagatcctctcaaagcatctgcaaggcaggagagagcacagacgctcttagcctgccgcacgtcaaattaaaatag

SEQ ID NO: 129544 - DNA, 1284 bp, Artificial Sequence
  Description of Artificial Sequence: Synthetic coding sequence
atgccacggcatcatgcggggggcgaggaaggaggcgctgccggcctgtgggtaaagagcggtgcggccgccgcggctgcggggggcggccgtcttggctcagggatgaaagatgtcgaatctggtagggggcgggtcctgttgaactccgctgcagctaggggagatggactactattactcgggactcgtgctgcaacactgggggggggcggtggcggactccgagagagtagaagaggcaaacagggcgcaaggatgtcacttctgggtaagccactgtcatatacctctagtcagtcctgcaggcggaacgtcaaataccgccgggtgcagaactatctctataacgtccttgaaagaccaagaggctgggcatttatttaccacgccttcgtcttcttgctagtgttcgggtgtctgatcctgtcggtgttcagcaccatacccgagcacacaaagctggcgtcatcttgcctgcttattttggaattcgtgatgatcgtcgtctttgggttagaatttatcatcagaatctggtctgctggctgttgctgccggtaccggggctggcagggcaggcttcggtttgccaggaaaccattctgcgttatcgatacaattgtactgatcgcaagcatagccgtagtgagcgccaagacacaggggaatatattcgctactagcgcgctgcgatctctgaggttcctgcagatcctcaggatggtgcgcatggaccgaaggggcggcacctggaaactcctggggagcgtggtgtacgcacacagtaaggagctgattactgcttggtacatcggatttctggtgcttattttttcctcattcctggtctatctggtagagaaagatgcaaataaagaattctccacttatgccgacgcactctggtggggtactattaccctcactaccatcggatacggggacaaaactcccctcacctggctcggacgcctgctttccgcaggcttcgccttgctcggtatcagcttttttgctctccccgccggtatcctgggctccgggttcgccctcaaggtacaggagcagcaccgtcagaaacattttgagaaacgcagaaaccccgctgccaatctgatccagtgtgtttggaggtcgtatgcggctgacgagaagtcagtctcaattgctacttggaaacctcatttgaaggccctccatacatgcagtccaacgaagaaagagcagggggaggcatctagccgtttcgtaatctctttactgctgcacgtttgtctatag

SEQ ID NO: 129545 - DNA, 2799 bp, Artificial Sequence
  Description of Artificial Sequence: Synthetic coding sequence
atgcctcggcatcatgccgggggcgaagaggggggtgccgcaggactgtgggtaaaatccggcgcagccgctgccgcggccggcggcggcagattggggtccggaatgaaggacgttgagagcgggagaggccgggtgttactcaattctgcagccgcccgtggagatggcttgctgctcctggggactagggccgctaccctgggtgggggcggtggggggttgcgtgagagcaggcgagggaagcagggtgcgcgaatgagcctgctcgggaaacccctgagctacacatcctcccagtcctgccgccggaacgtcaaatatagacgggtgcagaattatctctataatgtgttggagagacccagaggatgggcatttatttatcacgccttcgtatttcttctggtttttgggtgcctgatcctatccgtgttctctacgattccggaacatactaagctggcgagttcttgccttttgattctggagttcgtcatgattgtggtgtttggtctggaatttattatcaggatctggagcgcggggtgttgttgccgttacagaggatggcagggcaggctccgcttcgctcgtaagccattctgcgtcatcgacactattgtgttaatcgcctccatcgctgtcgtgtctgccaagacccagggtaacatatttgccacgagtgccctgcgtagccttaggttcttacagatcctccggatggtccgcatggatcggagaggcggcacgtggaaactcctgggatctgtggtgtatgcccactccaaagagctcattaccgcctggtacattggctttcttgtcctaatcttctcttcttttctagtgtacctggtggaaaaagacgccaataaagaattttcaacttacgctgatgctctgtggtggggcactatcacacttactactattggctacggagataaaacccccttgacttggctgggacgactgctgtctgcaggctttgccttgcttggcatttctttttttgccttacccgccggcattttagggagcgggtttgcccttaaagtgcaggagcagcaccgacagaaacatttcgagaagcgacggaatccagctgctaacctgatccagtgtgtgtggaggagctacgccgcagatgaaaagagcgtctctatcgcaacctggaaaccacaccttaaagccctgcacacctgtagtcccacaaaaaaggaacagggggaagcctcttcttcgcagaagctgtcgttcaaagagcgcgtgagaatggcaagtccgcgcggccaatctatcaagagtaggcaagcatcggtgggcgaccggcgatcaccatcaactgatataactgcggagggttccccaacgaaggtccagaaatcctggagcttcaacgaccggacacgattccgtccttccctgcgtcttaagtctagtcagccaaaacccgttattgacgccgataccgcactgggtacagacgacgtgtatgacgaaaaaggctgccagtgtgacgttagtgttgaagatctaacccccccactgaaaaccgtaatccgagcgatacgcataatgaaatttcacgtcgccaaacgaaaattcaaggaaactttacgcccgtatgatgtgaaggacgttattgaacagtatagcgcgggtcacttggacatgctgtgtagaatcaaaagcctgcagacaagagtcgatcagatccttggtaaaggccagattacatcagacaaaaaatctcgagaaaaaataaccgcggagcatgagaccaccgacgacttatccatgctgggccgtgtcgtcaaggtagaaaaacaggtgcaaagcatagagtcaaagctggattgcctcttagacatttaccagcaggttttgagaaaaggttccgctagtgcactggcgttagcctcattccagatacccccattcgaatgcgaacagacgagcgactatcagtcccctgtagatagcaaggacctgagtggatccgctcagaactcaggctgcctttcgagaagtacctccgcaaacattagtcgcggcttgcaatttatacttacacctaacgagttctccgctcagaccttctatgctctatcacccaccatgcacagtcaggcaactcaagttcccatcagccagagcgacggctcagccgtggcagccactaacactattgctaaccagatcaataccgccccaaaaccagccgcgcccacgactctccagatcccaccgcctctccccgctatcaaacacctgccacggccagagaccctgcatccaaacccagctggtctgcaggaatctatctcagatgtaaccacctgcttggtggcttctaaggaaaacgttcaggtcgcccagagcaatttgaccaaggatcgaagtatgagaaagagtttcgacatgggcggcgagaccctgctgagcgtgtgtcccatggtccctaaggacctggggaagtccctgtctgtccagaatctcattagatccacagaagagttgaacattcagctgagtggcagtgaatcctctgggtcacgagggagtcaggacttttatcccaagtggagggagtccaaactgttcattaccgatgaggaggttggccccgaggaaactgagacagataccttcgatgctgccccacagccagccagggaggccgcattcgcctccgattcactccgtacagggcgcagcagatcgtcacagagcatttgcaaggccggagaaagtacggacgctctcagcctgccccacgtaaaactgaaatag

SEQ ID NO: 129546 - DNA, 2829 bp, Artificial Sequence
  Description of Artificial Sequence: Synthetic coding sequence
atgcccagacaccacgcaggtggcgaagagggcggagctgctggcctttgggtaaagtctggagcagcagccgccgccgccggcggcggacgactaggctccggcatgaaggacgtggagagcggtagaggcagggtgttgctaaattcagccgccgcacgcggtgatggacttctgctgttggggaccagggcagccactctgggaggcggcggtggagggctccgggaatcaaggcgtggtaagcaaggggccaggatgagcttgttaggcaagcctctctcttatacctcgtcacagagctgtcgtcggaacgttaagtatcggcgcgtgcagaactacctgtataacgttctggagcgcccccgaggatgggcgttcatctaccatgccttcgtgtttctcttggtattcgggtgtctgattctgtccgtgtttagtacaattccagagcacaccaagctggcatcgagctgtctgctcatcctggaatttgttatgattgtggtgtttgggctcgagttcatcattcgcatttggagcgctgggtgctgttgccgatatcggggatggcaggggaggctgcggtttgcacggaagccgttctgtgttatcgataccattgtcctgatagcttcaatcgcagtggtgagcgcaaagacccagggtaatatattcgcgacatctgccctacggtcccttcgctttctccaaatcctgcgaatggtgcgaatggatcgcagggggggcacctggaaactgctggggagcgtggtctatgcacatagcaaggagctcattaccgcctggtatataggatttcttgtgttgatcttctctagttttctggtgtaccttgtagagaaggatgcaaataaggagttttccacatatgccgatgccctgtggtggggcactatcacactgaccaccataggttatggcgacaagactcctctgacatggttggggcgactacttagcgctgggtttgccttgctgggcatatctttctttgccctgcccgctgggatattggggagtggtttcgctctgaaagtacaggaacagcacagacagaagcactttgaaaaaagaagaaacccagctgctaatctaatccagtgcgtttggagatcctatgccgcggacgaaaagtcagtctccattgctacctggaaacctcaccttaaagctttgcatacgtgtagccctacaaataaattttgtagtaataagcagaaactcttcagaatgtatacttctagaaagcagtcccagaaactgagctttaaggagagggtgagaatggcctccccacgcggacagtcaatcaagtcccggcaggcctctgttggggacaggcgcagcccttccactgacatcactgcagaagggtcccccactaaagtgcagaaatcatggagcttcaacgatagaactcggtttagaccctccctgagactgaagtcttcacaacccaaacccgtgattgacgcggacactgcgctcggaactgacgacgtgtatgacgagaagggctgccagtgtgacgtgagcgtcgaggatctcactccccctctgaaaaccgtaatacgcgctataagaattatgaagtttcacgttgcaaagagaaaatttaaggagacactccggccgtatgacgtgaaggatgtcattgaacagtattccgctggtcacctagacatgctctgccggatcaaaagcctccaaacacgcgtggaccaaatcctggggaaggggcagattaccagcgataagaagtcccgggagaaaatcaccgcggaacacgagacaactgacgatctttccatgctgggtcgtgtcgtcaaagttgagaaacaagtccaatcgattgagagtaagcttgattgtctgctggacatctatcaacaagtactgcggaaggggtctgcatcagcccttgccctggcttcctttcagatccccccttttgagtgcgagcagacttcagactatcagagccctgtagatagcaaggacctgtccggttctgcacagaacagtggctgtctgagtaggagcacatccgccaacatctcacgtgggctacagtttattctcacccctaacgagttttctgcccagacgttctacgctctgtcacctactatgcattctcaggcgacacaagtaccaatttctcagtctgatggatctgctgttgcggcgaccaacactatagcaaaccagattaacacagcccccaagccagcagctccgacaacgctccagattcctccccctctacctgctattaaacatctgccgcgaccagagaccctgcacccaaatcccgctggcctacaggagagcatcagtgacgttaccacctgtctcgtggcttccaaagaaaacgtacaggtggcccaatctaacctaactaaggacaggagcatgaggaagtcatttgacatgggaggggaaacactgttgtcggtttgtcccatggtccctaaagaccttggaaagtcactgagcgtgcagaatctgatccgttcaacagaagaattaaacatccagctttccggctctgagtcttcagggtcccgcggatctcaagacttctatccgaagtggagagaatctaagctttttatcacggatgaggaggtgggcccggaagagacagagactgacacattcgatgctgctccccagccagctagggaggcagcatttgcctccgactcactccgaaccggccgcagtcgctcttcacagtcaatctgcaaggcaggggaaagtacggacgcgctttccctgcctcatgttaagcttaagtag

SEQ ID NO: 129547 - DNA, 2772 bp, Artificial Sequence
  Description of Artificial Sequence: Synthetic coding sequence
atgccacgtcatcacgctggtggcgaggagggcggggcagccggcctctgggtgaaaagtggcgcagctgcagcagctgctggtgggggccggctcggctccggtatgaaagacgttgaatctggtcgaggtcgggtccttttgaactccgcagcggcgaggggagatggtctcctcttgctgggtaccagggctgctacactgggaggagggggcgggggcctgagggaatctagaagaggaaagcagggagcccggatgtctctgctcggaaagcctctttcttataccagcagccagtcctgtcgcagaaatgtaaagtatagaagagtccagaattatctgtacaacgttctggagagaccaaggggttgggcatttatataccacgcattcgtcttcttgctggtgtttggctgcctgattctgtcagtgttctcaactattccagaacataccaagcttgccagttcttgcttactgattctagagttcgtgatgattgtggtctttggcctagagtttatcatccgcatttggagcgccggttgctgctgccgctatcgtggatggcagggccgactgaggtttgcccggaagccgttctgtgtgatcgacaccatcgtccttatcgcatctatcgcagtggtgagtgccaagactcagggtaatatcttcgccacgtctgccctgcggagcctgaggtttctgcagattctgaggatggtgaggatggatcggcggggaggtacgtggaagcttttggggagcgtagtctatgctcatagcaaggaattgatcacagcctggtacattggcttcctcgtcttgatttttagctccttcctggtctatctggtggaaaaggatgcaaacaaagagttttccacctatgccgacgccctgtggtggggcactattacgctcacaaccattgggtacggggacaagacacctctgacttggttaggccgactcctgagcgctgggttcgcactcctcggcatttctttttttgccctgccggctggtatcctcggtagcggttttgcactaaaggtccaagagcaacatcggcaaaagcatttcgagaaaaggaggaatcctgccgcaaatcttattcaatgtgtgtggagaagctacgccgctgacgagaaaagtgtgagcatcgccacttggaagccacatctgaaagcccttcatacatgcagccccacaaatcagaagctgagcttcaaggagagagtccgcatggcttcgccaaggggtcagtcgatcaaatcccgtcaggcctctgtgggcgaccgacgcagcccgtcgactgatatcaccgcagagggttccccgactaaggtgcaaaaaagctggtcatttaacgaccgcacgcggtttcgcccatccctgaggctgaagtcaagccaaccgaagcccgtcattgacgctgacaccgccctgggaactgacgacgtgtatgatgaaaaaggatgccagtgtgatgtgtccgtggaggacctaacgccgccattaaaaaccgttatccgcgccattcggatcatgaaattccacgttgctaaaaggaaatttaaagagacacttagaccctatgatgtcaaagatgtgatcgaacagtacagtgctggacatctggacatgttatgccgcattaagtccttgcagacaagagtcgaccagatcttgggcaagggacagattactagcgacaagaaaagccgagaaaagatcaccgccgaacacgaaacaaccgacgacctgtccatgttgggtcgcgttgtgaaggtggagaagcaagtgcagtcaatcgagtctaaactagactgtctcctggacatataccaacaggtgttgagaaaggggtccgcctcggcgctcgcactggcatcttttcagatccccccgtttgagtgcgaacagaccagcgactaccagagccccgtggattccaaggacctgagtggaagtgctcagaactccggctgcttgagcaggagtacctccgccaacattagccggggactccagttcattctgactccaaacgagtttagtgctcaaacgttctacgctcttagcccaactatgcactcacaggccacccaggttcccatcagtcagagcgatgggagcgctgttgctgcgacgaataccatcgccaaccagatcaacactgcccccaagccagctgctcccaccacccttcagatccccccacccctaccggccatcaaacacttgcccaggcccgagacacttcaccccaatcctgccggtttgcaggagagcatctcggacgtcactacatgcctggtggcgagtaaggaaaacgtgcaggttgcccagtccaatttgaccaaagataggagcatgcgcaagagttttgacatgggtggtgagacacttctttctgtctgccctatggtgcccaaggatcttggtaagagcctgagcgtgcagaacctgatccgcagcactgaggagctgaacatacaactgagtggcagcgaatcttcaggatcccgtggctctcaggatttctacccgaaatggagagaatccaaactgtttatcaccgatgaagaggtgggacctgaggagaccgagactgatacctttgacgccgcgccccaaccagccagagaggctgcatttgcctccgattccctcagaacaggcagatctcgctcctctcagagtatttgtaaagctggcgagagtaccgatgccctgtcgctgcctcacgtgaaactgaaatag

SEQ ID NO: 129548 - DNA, 2469 bp, Artificial Sequence
  Description of Artificial Sequence: Synthetic coding sequence
atgcctaggcatcacgccggtggcgaagaaggtggcgccgccgggctgtgggtcaagagcggcgccgctgccgccgctgccgggggaggccgtcttgggtctggtatgaaggatgtggagtcaggacgcggtagggtgcttctcaatagcgcggctgcaaggggggatgggctgttgctgctggggaccagggctgctactctcggcggaggcggcggaggactgcgtgaatcaagacgtggcaagcagggcgcaagaatgtccttactgggcaagcccctttcatacacgagctctcagtcctgcagacgcaacgtaaagtaccgccgggtgcagaactatctgtacaacgtcttggaacgaccacggggctgggcgttcatttatcacgcctttgtgttcttactggtgtttggatgcctcatcctctccgtcttctccactatccctgagcacactaaactggccagctcttgcttgctgatcttagaattcgtgatgattgtcgtgtttggactggaatttatcattcggatctggtctgctggatgttgttgccgctatcgtggctggcagggaagactgaggtttgcgaggaagcctttttgtgttatcgatactattgtgctgatagcttcaattgctgtagtaagcgctaaaacacagggaaacatcttcgcaacatccgccctccgtagcctgagatttctccaaattctgaggatggtgcggatggaccgacggggcggcacttggaagctgttgggatcggtggtgtatgcacacagcaaggagcttattactgcttggtatattggattcctcgtgttaattttttcttccttcctggtctatctggtcgagaaagacgcaaacaaggagttctctacatacgcagacgctctgtggtgggggacaattaccctcactacaatcggctatggagacaagactcctcttacatggctggggagactcctttccgctggttttgctttgctgggaatcagttttttcgccctgccagccgggattctcgggagtggattcgccctgaaagtccaggaacagcaccgacaaaagcactttgaaaagagacgaaacccagctgctaatctcatacagtgcgtgtggagaagttatgcggcggatgagaaaagtgtatccattgctacctggaagcctcacctgaaggcgctgcatacctgttccccgaccaagaaggagcaaggtgaggcctcttctagaatcatgaagttccacgttgcaaagagaaagttcaaggagaccctgcggccctacgacgtcaaagatgtgattgagcagtactccgccgggcacctcgatatgctgtgtcgcatcaagtcactgcagactcgtgtagaccaaatcttaggaaaaggtcagatcacctccgataagaaatcccgggagaagattactgccgaacacgagacaacagacgatttaagcatgttgggccgagtggtgaaagtggagaagcaggtgcagtccattgaatctaaactggattgcctactggatatttatcagcaagtcctgcgcaaggggagcgcctccgcacttgcgctggcctccttccagattcccccattcgagtgcgagcaaacctccgattatcagtctcctgtcgactcaaaggacctgtcaggctccgcccagaacagcggttgcctctctaggtccacgtccgctaacatttctcgtggcttacagtttattctgacccctaacgaatttagcgcacagaccttctatgcactaagtccaactatgcacagccaagctactcaggtaccaattagccaaagcgacgggtcagctgtagccgctactaacactattgcgaatcagattaataccgcccccaaacccgcagctccaaccaccttgcagattcctccccctttgccggctataaagcacctgccccgtcccgaaacgcttcaccccaatcccgctggcctgcaggaatctatctccgatgtcacaacttgtctggtcgcgagcaaggaaaatgtacaggttgcccagagcaacctgacaaaggacaggtcaatgagaaagagttttgacatggggggcgaaacattgctgagtgtctgccctatggtccctaaggatctaggtaagagtttgtccgtccagaatttgatccgaagtacggaggagctgaacatccagcttagcgggtccgagtctagcggttcaagaggctcccaagacttctatcctaaatggcgggaatcaaagttattcatcactgatgaggaagtcggcccagaggaaacggagactgataccttcgatgctgcaccacagccagcccgagaagccgcctttgcaagcgactccctgcgcaccgggcgctcccgatcttcacagtccatatgtaaagctggggaatccacagatgccctgtcactgccacacgttaaactgaagtag

SEQ ID NO: 129549 - DNA, 2856 bp, Artificial Sequence
  Description of Artificial Sequence: Synthetic coding sequence
atgcctaggcatcacgcaggaggcgaggagggtggcgccgcagggctgtgggtgaagagcggagctgcagccgctgcggccgggggcgggcgcctggggtctggcatgaaggatgtggaatccggaaggggacgcgttctgttaaattcggccgcagccagaggagatgggctactgctcctgggaactcgtgccgccacattgggcggcggcgggggcgggctccgggagtccaggagaggtaaacagggtgccagaatgagccttttaggtaagcccctctcatatactagttcacagtcttgcaggcggaacgttaaataccggagggtgcaaaattacctttataacgtcctcgagcgtcctcgcggttgggcttttatttaccacgcatttgtcttcctgcccgtgtttggctgcttgatcctgtctgtgttctccaccatccccgagcacactaagctggcctcgtcttgtttgctgatcctcgagttcgtcatgatcgttgtctttggcctggaattcatcattagaatctggtcagctggatgctgctgtcgctaccgcggttggcagggccggttgagatttgcacgcaagccattttgcgtgatcgacaccatagtcctaatagcttctatagctgtcgtgtctgccaaaacacagggcaatatttttgccacaagcgccttgcgatccctccggtttctgcagattctgagaatggtacgcatggaccgacgggggggcacttggaaattattgggatccgtagtgtacgcacacagcaaagaacttattaccgcatggtacattgggtttctcgtgctgattttttccagcttcttagtgtatctagtggaaaaagatgcaaacaaggaatttagcacgtacgccgacgccctttggtggggcactataaccctcaccacaattggatatggcgataagacccccctcacatggttagggcggttactgagtgcaggcttcgcgcttttaggtataagcttctttgctcttcccgccgggattctgggttcaggcttcgcccttaaggtacaggagcagcacagacaaaagcattttgaaaaacgccgaaatcctgcagcaaacttaatccaatgcgtctggagatcatacgcagcagatgaaaaatcggtgtctatcgcgacatggaaacctcacctaaaagccctgcacacttgctcacctacaaagaaggaacagggagaggctagctccagtaagttttgttcaaacaagcagaaactatttcgaatgtacacctcccggaagcagtctcaaaaactgagcttcaaggagagggtacgaatggcctcacccagaggacagtccattaaatctagacaagcttcagttggcgacaggaggtccccttctaccgatatcaccgcagaagggagccctaccaaagtccaaaagagctggtcatttaatgatcgcaccaggtttaggccttctcttagattaaagtcctctcagcccaaaccggttatcgatgctgacacagccctgggcacagatgatgtgtatgacgaaaaggggtgccagtgcgatgtcagtgtagaggacctcaccccgcccctgaaaactgtaattagggccatacgtatcatgaagttccacgtcgctaaacgtaaatttaaggaaaccctccgaccgtatgacgttaaggacgtgatcgaacagtactccgccgggcacctggatatgctgtgcaggatcaagtcgctgcaaacaagagtggatcagatcctaggaaagggccagattacaagcgacaagaagagtagagaaaaaatcacagccgaacacgagacgactgacgatttgtcaatgctgggaagagtagtgaaagtggaaaaacaagtccaatctatagaaagcaaactcgactgtctgctggatatctaccagcaggtgctccggaaaggtagtgcaagtgctctggccctggcttcgttccagatccctccgtttgaatgtgagcagacatccgactaccaatccccagtcgatagtaaggacctttctgggtcagcacagaactctggctgcctctcaagaagcacaagtgccaatatatcccggggcctccaattcattctcactcctaatgagttctccgcacaaaccttttacgccttatcacccacgatgcatagccaggcaacacaggtgccaatttcgcagtcagacgggagcgccgttgccgctacaaataccatcgccaaccaaattaacactgctccgaaacccgccgctccaactactcttcagatcccacctcctttaccggccattaagcatctgccccggccagaaactctgcaccccaatccagcggggctgcaggagtctatcagcgacgttaccacatgcctggttgcctctaaagagaatgtgcaggtggcccagtctaacctgaccaaggatcggtctatgaggaagagctttgacatgggcggggagactctgctgtccgtgtgcccaatggttcccaaagatctggggaagagcttgtccgtacagaatctgatacgctcaacagaagaactgaacattcagttgagtggttcggagagtagcgggtcccggggcagtcaggacttctaccccaaatggcgggagtcgaaacttttcataaccgacgaagaggtgggccccgaagagacagaaaccgacacgtttgatgcagcgcctcagcccgcccgagaggctgccttcgcatcagattccctgcggacagggagatccagatcttcccagtccatttgcaaggccggagagagtaccgacgcactttctctccctcatgtcaagttaaaatag

SEQ ID NO: 129550 - DNA, 2577 bp, Artificial Sequence
  Description of Artificial Sequence: Synthetic coding sequence
atgccggccggtatgacaaagcatggcagccgttcaacctcaagcctgccccctgaacccatggaaatagtgaggtctaaggcctgcagcagacgcgtgcggttgaacgtaggcgggctggcgcacgaggtactgtggagaactctggacagactgccacggacacgcctggggaagttgcgggattgtaatacacacgacagcctgctggaggtgtgtgacgattatagcctggacgataacgaatattttttcgatcggcacccgggagccttcacctcgatcttaaacttctaccggaccgggcgtctgcacatgatggaggagatgtgcgcactcagcttctcgcaggagctggattattggggcattgatgagatctatctggaatcctgttgccaggcccggtaccaccaaaaaaaagagcaaatgaatgaagagcttaagagagaggcagagactctgagagagagagaaggtgaagagtttgataatacttgttgtgccgagaagagaaagaagctgtgggacctgctggaaaagccgaatagctcggtggcagccaagattctggctataatttctataatgttcattgtgctctccacaattgccttatcattaaacactctgccggagcttcagagtttagatgaattcgggcagtctacagacaacccccagctggctcatgtcgaggcagtgtgtatcgcctggttcacaatggagtatcttttgcggtttctttcatctcccaaaaagtggaaattttttaaaggtcctttgaacgctatagatctgctcgccatcctcccctattatgtaaccatctttcttacggaatccaataagagcgtgctgcaatttcaaaacgtgcgtagggtggtacagattttccggataatgcgcattctgcgcatcctcaagctggcccgccattcaacagggctgcaatccctgggttttaccctgcggcgctcctacaatgaactggggctcttgatattgttcctcgccatgggcattatgattttttctagcctggtgttctttgcagaaaaggacgaggacgatacaaagtttaaatcaatccctgccagcttctggtgggctaccataactatgaccactgtggggtacggcgacatctaccctaagaccctgctgggaaagattgtggggggtctgtgttgcatcgccggcgtcttggtgatagctttgcctatcccgattatagtgaacaatttttccgagttctataaggaacagaagcgtcaggaaaaagctattaagagaagggaggcattggaaagggcaaagcggaacggcagcattgtatctatgaacatgaaggacgctttcgcgagaagtatagagatgatggacatcgtagttgaaaagaacggagagaacatgggcaagaaggacaaggtacaggataaccacttgtctccgaataagtggaaatggacgaagcgtaccctctccgagacttcctcaagcaaatcatttgaaaccaaggagcaggggagccctgagaaggctaggagctcaagctccccgcagcatctgaatgtgcagcaactcgaggacatgtataataaaatggccaagacccagtcgcaaccgatcctgaataccaaggagagtgcagcgcaaagtaagcctaaggaggagctggagatggaatctatcccctcccccgttgccccattacccacccggacagagggagtcatcgatatgcgatccatgtccagcatcgacagctttatctcctgtgctacggacttcccagaagccactcggttctctcactccccactcacgagcctgcctagcaagacagggggatccacggcgcccgaggtggggtggcggggcgctcttggcgcctctgggggtagattcgtggaagccaacccatccccagacgcctcccaacattcctcatttttcatagagtcacctaaatcctctatgaaaactaacaatcccctcaagctgcgagccctgaaggtgaacttcatggaaggcgacccatcacccctgctgccagtattggggatgtaccatgaccccttgaggaaccgggggagcgcagccgccgcggtcgcaggcctggaatgcgcaactctgctggataaggcggtgctgagcccagaaagcagcatctacaccaccgcatcagccaagactccacctagatcacctgagaaacacaccgcaatcgccttcaactttgaggcaggcgtccaccagtatatcgacgctgacacagacgatgaaggccagttgctgtacagcgtggacagctccccacccaagtctctgcctggcagcacctctccaaaattcagtacaggcaccaggagcgagaagaatcattttgaatcgagtccactgcctacctcccccaagtttcttcggcaaaattgtatttattcgacagaggccctgaccgggaagggcccgagcggtcaggagaagtgtaagttggaaaaccacattagtcccgatgttcgcgttttaccaggcggaggcgctcacggaagcactcgagaccagagcatttag

SEQ ID NO: 129551 - DNA, 2442 bp, Artificial Sequence
  Description of Artificial Sequence: Synthetic coding sequence
cgggacggaggggaaaaaactgcagtcaccagactgggtaaactgcgggattgtaatacccacgacagcctcctcgaggtgtgtgacgattactctctggacgataacgagtacttctttgacaggcaccccggcgcattcacttcaatcctaaacttctatcgtactggccgccttcatatgatggaggaaatgtgtgcactgagcttttctcaggaactggattactgggggatagacgagatttacctggagtcatgttgtcaggccaggtaccatcagaagaaggaacaaatgaacgaggagctgaagagggaggcagagacactgcgcgaaagggagggagaggagtttgacaatacctgttgtgcagaaaagcgaaagaagctttgggacctgctggaaaagccaaattcctccgttgccgcgaaaatcctggctatcatcagcatcatgtttatagtacttagtacgatcgccctctcgttaaatacacttcctgaactgcaatcccttgatgagtttggccagagtactgacaatccacaactggcccatgtcgaggcggtctgtattgcatggtttactatggaataccttctgcggtttttgagctcgccaaaaaaatggaagttcttcaagggccctctcaatgctatagacctgctggcaatcttaccgtattatgtaaccatctttttgacggagtccaataaatctgtcctacagtttcagaacgtcagaagggttgttcagatctttcgcattatgcggatcctgaggatcctaaaactggcccgtcactcaacgggacttcagagcctgggtttcaccctacgccgaagttataacgagttggggctcctgattctgttccttgccatgggcatcatgatcttttcatcccttgttttttttgcggaaaaggacgaagacgacaccaagtttaaatcaatcccggctagcttttggtgggccacgatcactatgaccaccgtcggttacggcgacatttatcccaaaaccttgcttggcaagatcgtgggagggctttgctgtattgccggcgtactagtgatagctctcccgatacctattatcgtgaataatttttctgaattttacaaagagcagaagcgacaagagaaggcgatcaagcgccgcgaagcactcgagagagctaaacgcaacggtagcatcgtttcaatgaatatgaaggatgcttttgcgaggtcaatcgaaatgatggacattgtcgtagagaagaatggagaaaacatggggaagaaggataaggttcaagacaatcacctgagccctaataagtggaaatggacaaaacgcacactcagcgagacttcttcttccaaaagtttcgagacaaaagagcagggatccccagagaaagctaggagtagcagttcgccccagcacctcaatgtgcagcagctggaggatatgtacaataagatggcaaagactcagagccagccaattttgaataccaaggagagcgcagcccaatcaaaaccgaaggaagagttagaaatggaatccattcctagtccagtggcccccctgcctacacggactgaaggagtcatcgatatgagaagcatgtcctctattgacagtttcatatcgtgcgccacagatttccctgaagcaacgaggttttcccactcacccctgacaagtctcccatctaaaacaggaggtagcacagcccccgaagtgggttggcgtggggcccttggggcctcgggagggagattcgtggaggctaatccgagccccgacgcgtcacagcattcctcattctttattgaaagtcctaagagctccatgaaaacgaataatcccttgaaactgagagctctgaaagtcaattttatggaaggagacccttcacctctgctccccgtcttgggtatgtaccacgatccgctgcggaatagaggctccgctgctgctgccgtggcgggcttagagtgcgctactctgctggataaagccgtgctttctcctgagtcaagcatctacaccaccgcatcagcaaagacaccaccccgtagtccagagaagcacacggccattgctttcaactttgaggccggagtgcaccaatacattgacgccgatactgacgacgagggtcagttgctgtactcggtggattcatctcccccaaaaagcctccccggctcgaccagcccaaaattcagcaccggaacacgcagtgagaaaaaccattttgagtcaagtcctctgccaacatccccaaagttcctacgccagaactgcatttattctactgaggctctgaccggcaagggccctagcggccaagagaaatgtaaactggaaaaccacatcagcccagacgtcagggtgctgcctggagggggcgcccacggctctacgagggaccagtctatctag

SEQ ID NO: 129552 - DNA, 2736 bp, Artificial Sequence
  Description of Artificial Sequence: Synthetic coding sequence
atggccgaaaaagcccctccagggttgaatcgcaagacctctcgctcaaccctgagtctgccaccagagccggtggacattatcagatctaaaacttgttccaggcgagtcaagatcaacgttggcggcttaaaccacgaggttctctggaggaccttggaccgtttaccgcgtacacgcctgggaaagctgagagactgcaacactcatgagagtctcctggaagtttgtgacgattacaacctcaatgaaaacgaatacttttttgacaggcacccgggggctttcacctctatcctgaacttctatagaactggcaaactgcacatgatggaagaaatgtgcgcactgtcattcgggcaggagctagattactggggaatcgacgagatttatctggaatcatgttgccaggcaagatatcaccagaagaaggagcagatgaatgaggaactcagaagggaagctgaaactatgagggagcgagaaggcgaggaatttgataatacttgctgtcccgataagaggaagaagttatgggatctgcttgagaaaccaaattcctcagtggctgcaaagattctggccatagtttccattctcttcattgtgctcagtacaatcgcactgagtctcaacacactgcctgagctgcaagagaccgatgagtttggccagctgaatgataacagacagctcgcacatgtggaggccgtctgtatagcatggtttactatggaatatctgttgcgctttttgtcgtccccgaacaagtggaagtttttcaaaggaccgctcaatgttattgacttactggcaatcctcccatattatgtaactattttccttaccgagtctaacaaaagtgttcttcagttccagaacgtcaggagagtggtgcaaatatttaggatcatgaggatcctccgaatccttaagctcgcccgacattcaactggccttcagagcctaggctttacgctcagacgatcttataacgagctaggactattgatcctctttctcgcaatgggtattatgatcttcagctcactggtgtttttcgcagaaaaagacgaggatgctactaagttcactagcatccctgcttctttctggtgggccactatcacaatgacgacagttgggtacggggatatctaccctaaaacactattaggtaagatcgtgggcggcctatgctgtatcgccggagtccttgtcattgccttgccaattcctatcattgtgaacaatttttcagaattttataaggagcagaagcgccaggaaaaggccataaagcgcagggaggccctcgaacgggccaagaggaacggatcaatcgtgtcgatgaatctgaaagacgcctttgcacggtccatggagttgattgatgttgcagtggagaaagccggagaatccgccaacaccaaagattctgctgacgataatcacctctccccatcccggtggaagtgggctcggaaagctttgtctgagacctccagcaacaaaagtttcgaaaataagtaccaggaggtatcccagaaggacagccacgagcagctgaataacacctcttcgagctcccctcagcatctgtctgcacagaaattggaaatgctgtataatgagataacgaagacacagccccattcccaccctaacccggactgccaggagaagcctgagaggccttcagcttatgaagaggagatcgagatggaggaggtggtatgccctcaggaacagctagccgtcgcacagacggaggtcatcgtagatatgaagagtacctcctcaatagattcttttacctcatgcgccaccgactttacggagacagaacgctctcctctgcctcccccttccgcttctcatctgcagatgaaatttcctactgacctccctggaactgaagaacatcaacgtgctaggggccccccttttcttaccctgtccagagagaaaggacccgccgcacgtgatggtacgttggagtacgcccctgtagacatcactgttaatctcgatgctagcggatctcagtgcggcctgcattccccactacagtctgataacgccacagacagtcctaagagctctctgaagggttccaatcctctcaagagcagaagcctgaaagtgaactttaaagagaaccgcggctccgcccctcagaccccgcctagcaccgccagacctctgccggtgaccactgctgatttcagtcttactacgcctcaacacatcagtacgattttgctggaggagacgccttctcagggggacagacccctcctggggaccgaggtgtctgctccgtgccaagggccaagtaagggcctgtcccctcgattcccgaagcagaaactgtttcccttctcttcgcgggaacggcggtctttcaccgagattgacaccggcgacgacgaggacttcctagagttgcccggtgctcgcgaggaaaagcaggttgatagctctccgaattgtttcgccgataagccttcagatgggcgggaccctcttcgagaggaggggtccgtggggtcatcaagcccccaggataccggacataactgccggcaggacatctatcatgcagtgtcagaggtgaagaaggattcctcccaggaaggctgcaaaatggagaaccatctgttcgccccagagatccactctaaccctggagacaccggctattgtccaactagggaaacgtcaatgtag

SEQ ID NO: 129553 - DNA, 1206 bp, Artificial Sequence
  Description of Artificial Sequence: Synthetic coding sequence
atgcaggtcagcattgcctgtacggaacataaccttaagtctcgcaatggtgaagaccggttgctgtcaaaacaatcttccacagcacccaatgtggtgaacgccgccagagctaagttccgaactgtggcaatcatcgcacgctcgcttggcacatttaccccacagcaccatatctcattgaaagaaagtacagccaagcagaccggcatgaagtacagaaacctgggaaagagtggcctgcgagtgtcctgtctgggattagggacttgggtgacatttgggggccagatatccgacgaagttgctgagaggctgatgaccatcgcttacgaaagtggagtgaatctctttgacaccgccgaggtttacgcagcagggaaagcggaggttatcctgggttccatcatcaaaaaaaagggctggcggagatcctctctcgtgattacaacaaagttgtactggggtggaaaggcagagactgaacgaggtcttagcagaaagcatataatcgagggacttaagggatcactgcagaggctgcagctggaatacgtcgacgttgtttttgctaataggccggactcaaatacgcccatggaagaaatagtgcgggcgatgacccacgtgattaatcagggaatggctatgtactgggggacctcacggtggtcggctatggaaattatggaggcttacagcgtggctaggcagtttaatatgatacccccagtgtgcgagcaggccgagtaccacctgttccagcgggaaaaagtcgaagtgcagctgcctgaactgtaccacaagatcggggtgggggcgatgacctggagcccactcgcttgcggcatcatctccggaaagtacggaaacggtgttcccgagagctcacgcgcatctctaaagtgttatcaatggctgaaagagagaattgtgtcggaagaaggcagaaagcagcaaaataagctgaaagacctatctcccattgcagaaaggttgggatgtaccttgcctcaactcgccgtcgcctggtgtctgcgaaacgaaggggtcagctccgttttgcttggtagttctactcctgagcaactcatagaaaacctgggagccattcaggtattgccaaagatgaccagccatgtcgtgaacgagattgataacatactcaggaataagccgtatagtaagaaagactatagaagctag

SEQ ID NO: 129554 - DNA, 1173 bp, Artificial Sequence
  Description of Artificial Sequence: Synthetic coding sequence
atgttagctgcccggaccggcgcagcgggctcccaaatttccgaggagaatactaagctacgcagacagtcggggttctccgtcgccggaaaggacaaatctccgaaaaaggcaagtgaaaacgctaaggattcctccctctcacctagcggagaatctcaactgagggcaagacagctcgcccttcttcgcgaagtagagatgaattggtacttgaagttatgtgacctctcgagtgaacacactaccgtgtgtaccacaggcatgcctcatagaaatctgggtaagtctggcctgagagtctcttgcttgggtttgggaacttgggtcaccttcgggggccaaataagcgacgaggtggccgagagactcatgacaatcgcttacgaatctggagtgaatctgtttgacacggctgaggtttacgctgcaggtaaagccgaagttatcctgggctcaatcataaagaaaaagggctggcggaggtccagcttagtcattaccaccaaattgtattggggcggaaaagccgagaccgaaaggggcttgtcacggaagcatattattgaggagatcgtgagggccatgacccacgtgattaatcagggcatggctatgtactggggtacaagcagatggagcgccatggagatcatggaagcttactcagttgctcggcagttcaacatgatccctcccgtgtgcgagcaagcagagtaccacctgtttcagagggaaaaagtcgaagtgcagttgcctgagctgtatcataagatcggtgtgggagctatgacttggtctccattagcatgcggcatcattagcggcaaatatggcaatggcgtgcccgagagctccagggcatccttgaagtgctaccagtggcttaaggagcgtatagtctccgaagaaggcaggaaacagcaaaataagctgaaggatctgtctccaatcgcggagaggttgggttgcacacttcctcagctggccgtcgcatggtgcctgcgcaacgagggcgtttcctctgtgcttctaggctcttcaacccccgaacagctgatagagaatttgggagccatacaggtcttgcccaaaatgaccagccatgtggtgaatgagatagacaacatccttcggaataagccatacagcaagaaggattatcgttcctag

SEQ ID NO: 129555 - DNA, 1227 bp, Artificial Sequence
  Description of Artificial Sequence: Synthetic coding sequence
atgcatctgtacaagcctgcttgcgcagacatcccaagtccgaagctgggcctgcctaagtcttcggagtcggcactgaagtgtagatggcacctcgcagtgacaaagacccagccgcaggccgcatgtaaacctgttagaccctctggtgctgcagagcagaaatacgtggagaagtttcttagggtccacggcattagcctccaggaaacaaccagggcagaaaccggaatggcgtacagaaacctggggaagagcggcctgcgcgtgagctgcctgggcctcggcacgtgggtcacatttggaggccagatttccgatgaggttgctgaaagacttatgaccattgcctacgaatcaggtgtcaacctatttgatactgccgaggtgtatgccgccgggaaggctgaggtaatcctgggttcaatcattaagaaaaaaggatggcgccgttctagcctcgtcatcaccaccaaactgtactggggtggtaaagctgagacagaacggggcttgtcccgaaagcatattatcgaagggcttaaggggagcctccagagactgcagctggaatacgtcgacgtcgtgtttgcaaatcgtcccgacagcaacacccctatggaggagatcgtccgggccatgacccacgtcattaaccagggtatggccatgtactggggcacttctagatggtctgcgatggaaatcatggaagcatacagcgtggcaaggcagttcaacatgattccgcctgtgtgcgagcaggctgagtaccacctgttccaacgcgagaaagtggaggttcagctccccgagctttatcataagattggcgtgggggccatgacctggtcgccactggcttgtggtatcatttcaggtaagtacggcaacggtgtgcctgagtctagtagggcaagcctgaaatgttaccagtggcttaaggagcggatcgtaagtgaggagggcaggaagcagcagaacaaactcaaggatctgagtcctatagcagaacgcctgggttgtactctgccccagcttgccgtggcctggtgcttacggaatgagggtgtgtccagtgtcctgcttggttcgtcaacgccagagcagctcatcgaaaacctgggggccatacaggtgttgcctaagatgacaagtcatgtggtcaatgaaatcgacaatatcttgaggaacaaaccttactctaaaaaggattataggtcctag

SEQ ID NO: 129556 - DNA, 1260 bp, Artificial Sequence
  Description of Artificial Sequence: Synthetic coding sequence
atgctggccgcacggacaggtgctgcgggctcgcagataagtgaagagaacacaaagctgcggaggcaatccggctttagtgtggcaggcaaagacaaaagtcctaagaaggcaagcgaaaatgctaaggactcctctctgtctccgtccggagaatctcagttgcgcgcacggcagctagcgctgttgcgggaggtggagatgaactggtacctgaagttatgcgatttgagttcggagcatactaccgtctgcaccactggcatgccccacaggaacctaggcaagagcggattgcgggtttcatgtctcggacttggaacctgggtgacatttggtggccagatctctgatgaggtggctgagcgactgatgaccattgcatacgagagcggcgtgaacctgttcgacacggccgaagtgtacgcagcagggaaggccgaggtgattttaggaagcattatcaaaaagaaagggtggaggcggagttcactggtaatcactacaaaattatattggggcggtaaggccgagaccgaacgggggctatcccgaaagcatataattgaagggctcaaaggatctctgcaacgtctgcagctcgaatacgttgatgttgtcttcgcaaataggcccgattccaacactcctatggaagagatcgtgagggccatgacacatgtgatcaatcagggaatggcgatgtattggggcacatctcgttggagcgcgatggagattatggaagcttattcggtagcaaggcagtttaatatgatcccaccagtatgcgagcaggccgaataccacctctttcagcgcgagaaggtcgaagttcagctccccgaactttaccacaagataggcgtgggagccatgacctggtcgcccttggcctgtggcatcataagcggaaagtatggtaatggagtgcctgagtcctctagagccagtcttaaatgttatcagtggcttaaggaaagaattgtgtctgaggaggggcgcaagcagcagaacaaactgaaagacctgtcacctatcgctgagcgccttggttgcactctccctcaactggcagtggcctggtgcctcaggaacgagggtgtaagcagcgtcctcctcggatctagcacgcctgagcagctgatagagaacctcggtgccattcaggtgctgcctaaaatgacctctcacgtggtaaatgaaatcgacaatatattacgcaataagccctacagcaagaaggactatcggagttag

SEQ ID NO: 129557 - DNA, 1104 bp, Artificial Sequence
  Description of Artificial Sequence: Synthetic coding sequence
atgtatcccgagtccaccactggctcgcccgcgcgacttagccttcggcagactggatctcccggtatgatctactcgactagatatggtagtcctaaacggcaactgcagttttacaggaacctgggtaagtccggtctgagagtaagttgcctgggtttgggcacttgggtgacttttggcggtcagataactgacgaaatggccgagcagcttatgacactcgcctatgacaacggaatcaatctttttgatacggctgaggtttacgcggccggaaaggccgaagtggttctgggcaacataattaagaaaaaaggatggcgtagatcatctctagttattaccacgaaaattttttggggtggcaaggccgagactgaacgcggcctgagtaggaaacacatcatcgagggattgaaggctagcttggaacgacttcagctggaatatgtagacgtggtgttcgccaaccgacccgatcctaacactccaatggaagagaccgtccgtgccatgacacacgtgattaaccaaggcatggctatgtattggggaacttcccggtggtcctcaatggagatcatggaagcctattccgttgcaaggcagttcaaccttaccccacctatatgtgagcaggccgaataccacatgttccagcgtgagaaggtggaggttcagctgccagagttgttccacaagattggagttggtgccatgacttggagccctctagcctgtggaatagtgtcagggaagtacgactccggcatccctccttattccagggcctctcttaagggatatcagtggctcaaggacaagattttgtccgaagaggggaggcggcagcaagcaaaacttaaggaactgcaggcaatcgccgagagactaggctgcaccctgccccagctcgccatcgcttggtgcctgcgcaatgagggcgtgtcaagcgtgctgcttggcgcatcaaacgccgatcagttaatggagaatatcggcgcaattcaggtcctgcctaaactcagtagcagcattattcacgaaatcgactccattttgggcaataagccttactccaaaaaggactacaggtcctag

SEQ ID NO: 129558 - DNA, 1104 bp, Artificial Sequence
  Description of Artificial Sequence: Synthetic coding sequence
atgtatcctgagtcaacaacaggcagtcccgccaggttgtccctcaggcagacaggctcacccgggatgatctactcaacccgatacggcagccctaagcgacagctccagttttatcgcaacctgggcaaaagcggtctgcgtgtgagctgtctgggactcggcacttgggttactttcggcggccagatcacggacgagatggccgagcagctgatgactcttgcttatgataacggaatcaacctttttgataccgccgaagtttatgcagcgggtaaagcagaagtcgtcctgggcaatataatcaagaagaaaggttggcgaaggagctctctggtcatcactaccaagatattctggggaggcaaggctgaaaccgagcgtggactgagcagaaaacacattattgagggcctcaaggctagcttagagaggctccagctcgaatacgtggacgtcgtgtttgcaaatcgccctgacccaaatacacctatggaggagacggtgcgggcaatgactcatgtaatcaaccagggaatggccatgtactgggggacatcccgttggtcatccatggaaataatggaagcctacagtgttgcgagacagtttaacttaactcctccaatttgtgagcaggctgagtaccacatgttccagcgagagaaggtggaggtgcagctccccgagctgttccacaaaataggcgtgggagcaatgacctggtcccccctcgcgtgcgggattgtgagcggcaagtatgactccgggataccaccctattcccgggcatctctgaaggggtaccagtggctgaaggacaaaatcctctctgaggaagggaggagacaacaggccaagcttaaagaactgcaggccatcgccgagagactgggatgtactctgccccagttggccatcgcctggtgtctgcgaaacgagggcgtgtcttccgtgctcctgggcgcctccaacgctgatcagctgatggaaaacataggcgccatccaggtgttaccaaagttatcaagttctatcatccacgaaattgactccatcctgggcaataagccatatagcaagaaagactatcggtcatag

SEQ ID NO: 129559 - DNA, 1062 bp, Artificial Sequence
  Description of Artificial Sequence: Synthetic coding sequence
atgtaccctgagtctacgactggctctcctgctcgactaagcttacgacagacaggaagtccaggaatgatttaccgtaacctcggcaaaagcggtctgcgggtgtcatgcctcggccttggcacctgggtaacctttggtggacagattacagacgaaatggctgagcagctgatgaccctggcatatgacaacggtatcaatttattcgatacagccgaagtttatgccgccgggaaggcagaagttgtcctcggaaatattattaagaaaaagggctggcggcgctcttctctggtgataaccaccaaaattttctggggcggcaaagctgagactgaaagggggctttcccggaaacacatcatcgagggtctcaaggcgagcctggagcggctgcagctagagtacgtcgacgtcgtgtttgcgaaccgcccagatccaaataccccaatggaagagacggtgcgcgccatgacccacgtaataaaccagggcatggccatgtactggggcacctctcgctggtccagcatggagattatggaagcatattccgtggccagacaatttaacttgacgcctcccatctgcgagcaggcggagtatcacatgttccaaagggaaaaagtggaggtacagctccctgaactgtttcacaaaattggagtaggagcaatgacatggtcacctctggcatgcgggattgtgagtggcaaatatgactctgggataccaccctacagtcgggcatcactgaagggctatcagtggttgaaagataaaatcctttctgaagaaggacgtaggcagcaagccaaactgaaagagctacaggctatagcagagaggctggggtgtactctgccacagctcgcgatcgcttggtgtcttaggaacgaaggagtgagttcagttctgctgggcgcatccaatgctgaccagctcatggaaaacattggtgcgattcaagtgcttcctaagttgagctcctccatcattcatgaaatcgatagcatcctaggcaacaaaccctactctaagaaagattatcgcagctag

SEQ ID NO: 129560 - DNA, 1248 bp, Artificial Sequence
  Description of Artificial Sequence: Synthetic coding sequence
atgttatccatgacatattccgagtctttacggagtgtctcgtcgagatgccatagtgaatgggcccttcatcccgtgcggcaaaccgacaccttggagctgcagcgcttgcgagaagttcgggctgctgcccaggcccggaacatggaaagcttcctgcggatgcatggactgtctttagacggttgtaccgctcagagaactggcatgaagtacagaaacctgggcaagagtggcctcagagtgtcttgtctcggactcgggacttgggtgacctttggtgggcagatcacagatgagatggctgaacaattgatgaccttagcttatgataatggtatcaatctattcgacactgctgaagtttacgcagccggcaaagcggaagtggtactggggaatatcattaagaagaaaggttggcgaagatctagtctggttatcaccaccaagatcttttgggggggcaaggcagaaacagagcgtggcctctctcgcaagcatatcatagagggcctcaaagcttctctggagaggctgcagcttgagtacgttgacgtggtatttgctaacaggcctgacccaaataccccgatggaaggcgatcctttttcaagctccaagtccaggacttttattattgaggagaccgttagagctatgacacacgtcattaaccagggcatggctatgtattggggaacgtcccgatggtcctcaatggagatcatggaagcatactctgttgctcgacagttcaatctaacccctcccatttgcgagcaagccgaataccacatgttccagcgggaaaaagtggaggtgcagctgcctgagttgttccacaagatcggagtcggtgctatgacctggtcacccctggcatgtgggattgtgagcgggaaatatgactctggaatccccccctactcaagggcctccctcaaaggctaccagtggttgaaggacaagattctgagcgaggaggggcggcggcagcaggccaagctcaaggagctgcaggccattgctgagcggctcggatgtacattaccccagttagctattgcctggtgcttgcgcaatgagggagtcagctcggtgctcctaggagcttccaacgccgaccaactaatggagaatatcggagcaatacaggtccttccaaagctgagctcatctattattcacgagattgattccatcctagggaataagccttattcgaagaaggattatagatcgtag

SEQ ID NO: 129561 - DNA, 522 bp, Artificial Sequence
  Description of Artificial Sequence: Synthetic coding sequence
atgtaccccgaaagtactacaggaagccctgcacggctgtcattgcgacagaccggctcccccggcatgatctactcaacacgctacggcagccccaagcggcagcttcaattttacagaaatctagggaagtctggacttagagtgtcatgtctgggtctcggaacctgggtgactttcggtggccagattacagacgaaatggctgaacagttgatgactctggcctacgacaacggcatcaacctcttcgacaccgcggaggtgtatgccgcaggaaaagccgaggtggtactgggcaacatcatcaagaaaaaaggttggtcccagcagggagaacgggccgggcaggcaagagtcaccccgccatgctctttgggccgtcgagctagagatgcttccaagagtgccggcgctggatgccacctgcaggcacaagcatgtgttccctcctcaacacaggccctgcaaacgactcgcggcagagcccctctgaagccacccccaccactggcctcgtag

SEQ ID NO: 129562 - DNA, 1062 bp, Artificial Sequence
  Description of Artificial Sequence: Synthetic coding sequence
atgtaccccgaatccacaactggcagtccggctaggctgtccctgaggcagaccgggtcacccggcatgatttataggaacctcggcaaatctggcttacgcgtgtcttgcctgggcttgggtacctgggtgaccttcggtggccagatcaccgacgaaatggctgaacagctaatgaccttggcgtacgacaatggcattaacctgttcgatactgccgaagtctacgcggccggcaaagcagaggtggtgcttggaaacatcattaaaaagaagggctggcgtcggagctctctggtgataaccacaaagattttttggggggggaaggcagagactgaacgagggttgtcgcggaaacatattatcgagggcctgaaagcgtcactggagaggctccagctcgagtatgtggatgttgtgttcgccaataggcctgatccgaatactcccatggaggagaccgtgagagccatgacccacgtaattaaccaggggatggcgatgtactggggaacgagtcgctggagcagcatggagatcatggaggcttactcagtagcccgacagtttaacctgacgccccctatctgcgagcaggccgagtaccacatgttccagcgcgaaaaggttgaggttcagctgcctgagctgttccataagatcggggtgggtgccatgacgtggagtcctctcgcttgtggcatagtaagcggtaagtacgattcgggcatcccaccatattcccgagcttctcttaaaggctaccagtggctaaaggacaagattctaagcgaggagggtagaagacagcaggcaaagcttaaggaactgcaggccattgcggagaggctgggatgtaccctgccccagctggccatcgcctggtgtctccgcaatgaaggagtctcttctgtgctcctaggagcttccaacgccgatcagctgatggagaatattggcgccatccaggtactgccaaagctttcgtcttctattatccacgaaatagactccatattgggcaataaaccctactccaaaaaggactaccggtcatag

SEQ ID NO: 129563 - DNA, 1104 bp, Artificial Sequence
  Description of Artificial Sequence: Synthetic coding sequence
atgtaccccgagtctaccacaggcagccccgcacgcctcagcctgaggcagacgggctcgccgggcatgatctatagtacccgatacggctcccccaagcgccaattacaattctatcgcaatttgggcaagagcgggctgagggtttcctgtttaggactgggcacttgggtcacttttggcggtcaaattacagacgagatggcagaacagttgatgactctcgcatacgacaacggtattaacctgtttgacaccgccgaggtgtacgccgccggaaaagctgaggtagtgctgggaaatataatcaagaagaagggatggcgtagatcatcactggtgattactacaaagattttttggggagggaaagcggagactgaacgcgggctgagtcgaaaacacataatcgaaggactgaaggcctccctcgaaagattgcagctggaatacgtcgacgttgtgtttgctaacagaccggatcctaacaccccaatggaggagactgtgagagcgatgacccatgtcatcaaccaaggcatggctatgtattggggcacatcccgctggtcctccatggaaatcatggaggcctattccgtggcaagacagttcaatctcacaccaccgatctgtgagcaagccgaataccacatgttccagcgggagaaagtcgaagtgcagcttcctgagttgttccacaagatcggggtcggagccatgacttggtcccctttggcttgcgggatcgtgtcaggcaagtatgactccggcatccccccgtactcacgcgctagtcttaagggctaccagtggcttaaagataagattcttagtgaagaggggcgcaggcagcaggccaaattgaaagaattgcaggcaatcgccgaacggttggggtgcaccctgccccagctagctattgcctggtgtctaaggaacgaaggcgtcagctccgtgctgttgggggcctcaaacgccgaccagttgatggagaacatcggtgctattcaggtcctgcctaagctaagcagtagcataatccatgagattgattcgatcctgggtaacaaaccctacagtaaaaaagactaccgctcttag

SEQ ID NO: 129564 - DNA, 522 bp, Artificial Sequence
  Description of Artificial Sequence: Synthetic coding sequence
atgtacccggagtccacaacaggctccccagctcgcttatccctgagacaaactggctctccgggaatgatctatagcactaggtacgggagtccgaaacgccagctgcaattttaccgcaacttaggcaaatcagggctgagggtaagctgcctggggctgggaacgtgggtcacatttggtggacaaattaccgatgagatggcggagcagctgatgaccctggcctatgataatggcatcaacttattcgatactgctgaagtgtacgcagctggtaaggctgaggttgtccttggtaatataattaagaaaaaagggtggcgccaaaggggggagagggcaggccaggcccgcgtgacccccccatgttctctaggtagacgtgccagagacgcaagcaagtctgctggagccggatgtcacctgcaggctcaggcttgtgttccttctagcacccaggccctccagaccactcgggggcgggcgccgctgaagccgcccccacccctggcatcctag

SEQ ID NO: 129565 - DNA, 762 bp, Artificial Sequence
  Description of Artificial Sequence: Synthetic coding sequence
atgtaccctgagtccacaaccggctctcctgccagattatcgcttcgacaaaccggaagcccaggaatgatttattcaaccaggtatggcagtcctaagaggcagttacagttttaccggaatttgggcaagtccgggctgcgcgtatcatgtctgggactaggaacctgggttaccttcggagggcaaattactgatgaaatggcagaacagctgatgactttggcgtatgacaacggcataaatctctttgacaccgccgaggtttatgccgcagggaaagccgaagtggtgcttggcaatatcatcaagaagaaagggtggaggcggtcgagcctggtcatcaccaccaagatcttctggggtggcaaagccgaaacagagaggggtctttccagaaaacacatcattgagggtttgaaggcgagtttggaacggctgcaactcgaatatgtggacgtcgtgtttgccaaccggcctgatccaaatactccaatggaagaaaccgtgagggctatgacccacgtcatcaatcaggggatggccatgtactgggggacttctcggtggagttcaatggagatcatggaagcttacagcgtggccagacagtttaatctgacaccccctatctgcgagcaagccgagtatcacatgttccagcgcgagaaagtggaagtgcaactgccggagcttttccacaagataggtgtcggcgcgatgacttggtcccctctagcctgcggaatcgtgtcagggtag

SEQ ID NO: 129566 - DNA, 765 bp, Artificial Sequence
  Description of Artificial Sequence: Synthetic coding sequence
atgtaccccgagtccacaacaggctctccggcgcgattgagtctgagacagacaggatcccctggaatgatttataggaatctgggcaagtctggactgagagtttcttgtcttggcctggggacctgggttaccttcggggggcagataacagacgaaatggcagagcaactgatgactctagcttatgataatgggattaacttgtttgatactgctgaagtgtatgccgcgggcaaggccgaagttgtgctcggcaacatcataaaaaaaaagggctggaggcgctcctcgctggttataactaccaaaatcttctggggcggtaaagcagagaccgagagaggtctgtctcggaagcatatcatcgagggtttgaaagctagcctggaacgcttgcagcttgagtacgttgatgtagtatttgcaaataggcctgatcccaatacacccatggaggagaccgtcagagccatgacacacgtgataaaccagggaatggcaatgtactggggcacatcccggtggtcttctatggagatcatggaggcttattccgtcgctcgacagtttaacctcaccccccccatctgcgaacaggctgaataccacatgttccaacgggagaaagtggaggttcagttgccagagctcttccacaaaatcggggtcggggccatgacttggtctcctctggcttgcggaatcgtttccggcaagtatgattcaggcatccctccttacagcagggctagccttaaatag

SEQ ID NO: 129567 - DNA, 288 bp, Artificial Sequence
  Description of Artificial Sequence: Synthetic coding sequence
atgtatcctgagtctactactggaagccccgccaggctatcactgcggcagacaggatctccaggcatgatttatcgcaacctcggtaaatcagggttgagagtctcttgccttggattggggacttgggtgacctttggagggcagatcaccgacgaaatggcagagcagctgatgacacttgcgtacgacaatggtattaacttgtttgacactgccgaggtgtacgcagccggcaaagccgaagtagtcctgggcaacatcataaagaaaaaaggatggaggtag

SEQ ID NO: 129568 - DNA, 159 bp, Artificial Sequence
  Description of Artificial Sequence: Synthetic coding sequence
atgtaccctgaatccactacagggagccctgcgcgcctgtccctaaggcagactggatctccaggcatgatctacagcacacggtatggcagtcctaaaaggcagctgcaattctatagaaacctcggaaagtctgggctgcgggtctcttgtctttag

SEQ ID NO: 129569 - DNA, 903 bp, Artificial Sequence
  Description of Artificial Sequence: Synthetic coding sequence
atggccgaacagctgatgaccttagcctacgataatggcattaatcttttcgacacagccgaggtgtatgccgccgggaaagcagaagtggtgctcggtaacataataaagaaaaaagggtggaggaggagttcccttgtaatcaccacaaagatcttttggggcgggaaagcagaaacagaacgcggcctcagcaggaagcacattattgagggtttgaaagcttctctggaacgcttacaactggagtacgtggatgtggtctttgctaatcggcctgacccaaataccccaatggaagagacagttcgagccatgactcacgtaattaaccagggaatggccatgtattggggcactagtaggtggagcagcatggaaattatggaggcctactccgtagctagacagtttaaccttacgccccccatctgtgagcaggccgaataccatatgtttcaacgggagaaagtagaagttcagctgccagagttattccacaaaataggagttggtgccatgacctggtctccacttgcttgcggtattgtaagtggcaagtacgactcaggtatccccccgtactccagagcgagtctcaaggggtatcaatggttaaaggacaagatactgagcgaggagggaagaagacaacaggctaaacttaaagaactccaggccatagccgaaaggctggggtgtaccttaccacaacttgcaatcgcctggtgtctgaggaacgagggtgtgagttcagtgctgctgggggccagtaacgctgatcagctgatggaaaatatcggagccatccaagtgctcccaaagttgagcagctctatcattcacgagatcgatagtattctgggtaacaagccctactcaaaaaaagactacaggtcttag

SEQ ID NO: 129570 - DNA, 1215 bp, Artificial Sequence
  Description of Artificial Sequence: Synthetic coding sequence
atgcaggtgtctattgcttgcaccgagcagaatctgcgcagccgcagcagcgaggacagactgtgcggccctagacccggaccaggcggcggcaacggcgggcctgccggaggcggacacgggaacccacccggtggcggcgggagcggacctaaagcccgggccgccctggtacccagaccacccgcccccgcaggtgccctgcgagaatcaacaggtcgcgggactggaatgaagtacagaaaccttggcaaatcggggctccgtgtgagctgccttggactaggaacctgggtgacctttggcagtcagatttcagatgagaccgccgaggatgtactcaccgttgcctacgagcatggtgtcaacctgtttgataccgcagaagtgtatgccgccgggaaagcagagcggaccctggggaacattttgaagtccaaagggtggagaagatcatcgtacgtgataacaacaaaaatcttttggggaggccaagccgagaccgagagaggactgtctcggaagcacattattgagggcctgagaggctccctcgagcggctccaacttggctacgttgatattgtgtttgctaacagatccgaccccaattgtcctatggaggagatagtgagggcaatgacttacgtcattaatcaggggttggcactgtactgggggacttcccgctggggcgcggcagagatcatggaggcatactcgatggcccggcagtttaacttgatacccccagtctgtgagcaggctgagcaccacctcttccaaagagagaaagtggaaatgcagctgcctgaattgtatcacaagatcggagtgggatccgtgacatggtatccgctggcatgtggactgatcacttccaaatatgatggaagggttcccgacacttgtagggcctcgataaaggggtaccagtggcttaaggacaaagtgcagtccgaagatggcaagaaacagcaagctaaagtcatggacctactgccagtagcccatcagcttggatgcacagtggctcagctcgccatcgcatggtgcctgcgtagcgaaggtgtcagctccgtattgctcggagtttctagcgcagaacaactcattgagcacctcggagcactgcaggtgcttagtcagctcacgccccagaccgtgatggagatcgatggactcctcggaaacaagccccacagcaagaaatag

SEQ ID NO: 129571 - DNA, 2562 bp, Artificial Sequence
  Description of Artificial Sequence: Synthetic coding sequence
atgagcgaaaaggtcgattggctgcaaagccaaaacggcgtatgtaaagtagacgtgtacagccccggcgataaccaggctcaggattggaagatggacacttcaaccgatcctgtgagggttttatcatggctgcggagagaccttgagaagagcacagcggagtttcaggacgtccgctttaagccaggcgaaagcttcgggggagagacaagtaacagcggcgacccccataagggattctcggttgactattataatacgactacaaagggtacgcccgaaaggttacacttcgagatgacacacaaagaaatcccgtgccagggaccaagggcgcagctgggaaacggcagcagcgtcgatgaggtgagcttttatgctaatcggcttaccaatctggttattgctatggcccggaaagagatcaacgagaaaattgatgggagcgaaaacaaatgcgtgtaccaaagtttgtacatgggtaatgagccaaccccaaccaagtctctctctaaaattgccagcgagttagttaacgaaacagtcagtgcttgctcaagaaatgccgcccctgataaggcgcctgggtcaggtgaccgcgttagtggctcatcgcagtcccctcctaatctcaagtacaagtcaacattaaaaataaaggaatctaccaaagagcgccagggcccagatgacaagcctccgagcaaaaaatcattcttttacaaggaagtattcgaatccaggaatggcgactacgcacgcgaaggaggaaggttctttcctagagaaagaaagcgttttagggggcaggaacgacccgatgacttcaccgctagtgtgtcagaaggcattatgacctatgccaacagtgtggtgtccgacatgatggtatccatcatgaagactttgaagatacaagttaaggatacaaccattgctaccatcctcttgaaaaaggtcctgctaaagcatgccaaggaggtggtgtctgatctgattgacagctttctacggaatctacactctgtaaccggtactctcatgacggatacccaatttgtatctgccgtcaaaagaaccgttttctctcatggcagtcagaaggctacagacattatggatgctatgttacgtaagctgtacaatgtaatgtttgcaaagaaggttcccgagcatgtcagaaaggcccaggataaggccgagagctactctctgatttccatgaagggaatgggcgacccgaaaaaccgcaacgtaaactttgccatgaaaagtgagactaagctgagggaaaagatgtactctgaaccaaagtctgaagaggagacttgcgccaaaacgctcggcgagcatattataaaggagggcctcacactttggcataagacgcagcaaaaagaatgcaaaagcctaggatttcagcatgctgcattcgaggcacccaatacccaacgcaagcctgcctccgatatctcatttgagtatcctgaggacattggaaatttgagcctgcccccctacccgccagaaaaaccggaaaactttatgtacgactctgacagctgggccgaggacctgattgtgtccgctctcctgctgattcaatatcatctggctcagggcggccgccgggatgccaggtcctttgtcgaagcagcagggaccacaaactttcccgccaatgaacccccggtcgcaccagatgagtcctgtttgaagtctgcaccaattgttggcgaccaagaacaggctgaaaagaaggatctaagaagcgttttctttaactttattcgcaatctgctgtcggagacgatttttaaacgggaccagtcccctgaaccaaaggttcccgagcagccagtgaaggaggacaggaagctatgcgaaaggccgctggccagctctcccccgcgtctgtatgaggatgatgaaacccctggtgccctatcggggctcactaaaatggcggtgtcccaaatagatgggcacatgagcggacagatggtggaacatctgatgaattctgtcatgaagttatgcgtgattatcgccaaatcttgcgacgcaagtctggctgagctcggtgacgacaagagcggggacgccagccggctgacgtctgctttcccggatagcctttacgagtgtctgcccgccaagggcaccgggagtgctgaagccgtgctccagaacgcataccaggcaattcataacgaaatgaggggtacaagcggccagcccccagagggttgtgctgccccaaccgtcattgtgagtaatcacaatctgacagacacggtgcagaacaagcagctgcaggccgtgttgcagtgggtggctgcgagtgagctcaacgttcccattctctatttcgctggcgatgacgaaggaattcaggaaaaactactgcaactgagcgccgccgctgttgacaaggggtgctcagtgggagaagttctccaatctgtgctgaggtatgagaaagaacgccagctgaatgaagccgtagggaatgtgacacccttgcagttactagactggttaatggtgaacctttag

SEQ ID NO: 129572 - DNA, 1488 bp, Artificial Sequence
  Description of Artificial Sequence: Synthetic coding sequence
atgacagtgatgtcaggcgagaatgtagatgaggccagtgctgcccccgggcatccccaagacggctcataccctaggcaggccgatcatgacgaccacgagtgctgcgaaagagtggttattaatatctccggtctcagatttgagacgcagctcaagaccttggcacaattcccgaataccctgctaggaaaccctaaaaaaaggatgcggtatttcgacccgcttcggaatgaatattttttcgatcgtaacaggccaagctttgatgcaatcctttactattaccagagtgggggacgactgcggaggccagtgaacgtccctttggatatgttctccgaagaaataaaattctacgaactaggcgaggaggctatggagaagttcagagaagacgaggggttcataaaggaagaggagaggcctctgccggaaaaagagtaccagcgacaagtatggttgctgtttgagtacccggaatcttcaggacccgctcgagtgatcgccatcgtttcagtgatggtgattctgatctctattgtgatcttctgtctggagaccctgccggagcttaaggacgataaggatttcaccggcaccgtgcataggatagataacacgacggtgatctataactccaacatctttactgatcctttcttcatcgtggaaacattgtgtatcatctggtttagcttcgagcttgttgtgagatttttcgcgtgcccttccaaaaccgacttttttaagaacattatgaattttatcgacattgttgcaattataccctatttcatcactctgggtaccgagattgcggaacaggaaggaaatcagaaaggggagcaggctacctctctcgcaatcctgagggtgatcagactcgttagggtcttcagaattttcaagctgtctcggcacagcaagggcttgcagattctggggcagactctgaaggcttcaatgcgtgagctgggcttgctgattttctttctgtttatcggagtgatattgttctccagcgcagtgtatttcgcagaagccgaggaggctgagagccattttagcagcatacccgacgccttttggtgggcggtggtctcaatgacgacagtgggctacggtgatatgtaccccgtcacaatcgggggcaagattgtaggttccctatgcgccatagctggcgttctgactattgcactccctgtgcctgtgattgtgagcaactttaattacttttatcatagggagactgagggggaggaacaggcgcagctgttgcatgtaagctccccaaacctggcatctgatagtgacctgtctagacgctcatcttccaccatgagtaaaagcgaatatatggaaatagaggaagatatgaacaattctatagcccactacaggcaagtgaacatcagaacagcaaactgcaccacagccaaccagaactgtgtgaacaagtcaaagctgctgacagatgtgtag

SEQ ID NO: 129573 - DNA, 1536 bp, Artificial Sequence
  Description of Artificial Sequence: Synthetic coding sequence
atggacgtatgcggatggaaagagatggaggtggctctcgtgaatttcgataacagcgacgagatccaggaggagcccggttacgccacagactttgactcgacaagtccaaagggtcgcccaggaggaagttcgttctcgaatggcaaaattttgatttccgaatccaccaaccatgaaactgcgttctccaagctgcccggggactacgcagaccctcccggaccagaacccgtggttttgaatgaaggcaatcagagagtgataataaatattgccggcctgcggttcgaaacgcagttgcgaactctgtcgcagttcccagaaacgcttctgggtgacagggagaagcggatgcagttttttgatagcatgaggaacgagtatttctttgaccgcaacaggcctagcttcgacggaattctttactattatcaaagtggtggtaaaatcagacggcctgcaaatgtgcccattgacatattcgctgacgagattagtttttatgagctaggtagcgaggcaatggaccaatttagggaagacgagggatttatcaaagatcccgagacacttctgccaacaaatgacattcatagacagttttggctccttttcgaataccctgaatcatcatctgctgctcgggcagttgctgtggtttctgtcctggtggttgttatttctatcacgatcttctgcctggagactttgcctgagttccgtgaggatcgcgagctcaaggtggtaagagacccgaacctaaatatgtctaagacggtgcttagccaaaccatgtttaccgacccgttcttcatggtcgaatccacttgtatcgtgtggtttacctttgagctagtactgcgctttgtggtgtgtccatcaaagaccgactttttccggaacatcatgaatatcatcgatattatctctatcattccatatttcgccactttgattaccgagttggtacaggagaccgaaccttccgctcaacaaaatatgtctctcgccatattgcggatcatcaggctggtccgggtttttcggatctttaagctctctcggcacagcaaaggactgcagatcctgggacagacgctgaaggcctcaatgcgcgaacttggactactgatcttcttcctttttatcggtgtaattctgtttagctctgcagtgtattttgccgaagtagacgaacctgagtctcatttcagtagcattccagacggattttggtgggctgttgtcacaatgaccaccgtgggatacggcgacatgtgtcccacaacgcctggagggaaaatcgtcggcaccctctgcgccatcgccggagtgctgacaattgccctgccagtgccagtgatcgtgagtaatttcaactacttttatcatagagagaccgagaacgaagagaaacagaatatcccaggcgagattgagcggatcttgaattcggtgggatctcgcatggggtctactgattcactgaacaagactaatggcgggtgcagtactgagaagtcccggaaatag

SEQ ID NO: 129574 - DNA, 1728 bp, Artificial Sequence
  Description of Artificial Sequence: Synthetic coding sequence
atggacgagcggctgtccctgctaagaagccccccaccaccttctgctaggcaccgggcccatcctccccagcgtcctgcctcgtccggaggcgcacacaccctggtaaaccacgggtacgccgaacccgccgcaggtagggagctcccccccgacatgacagttgtgcctggcgaccacttgctggagcccgaggtggctgacggcggcggggccccgccccaggggggatgtggcggcggcggctgcgaccgatacgagcccctgcctccttctctgccagcagccggcgagcaggattgctgcggcgagagagtggttattaacatctctggtctgagattcgagacacaactgaagactctgtgccaattcccagagacgctgttgggcgacccaaaaaggagaatgagatatttcgacccgctgaggaatgagtatttcttcgatcgcaatcggcctagctttgatgccatactgtattactaccagtcgggagggaggattaggcgaccagtgaacgtgcctatcgatatcttctccgaggagatcagattctaccagctgggggaggaggctatggaaaagtttagagaagatgaaggatttctgcgggaggaggagagaccactccccaggcgcgacttccagagacaggtctggctgttattcgagtatccagagtcgagcggccccgcccggggaatagccatagtttcagtcttggtcatcctgatcagcatcgtgattttttgcctggagaccttgcccgaatttcgtgacgagaaggattacccggcttctacatcccaggacagttttgaggctgcggggaacagcaccagtggtagccgggcaggtgccagcagtttctcagaccctttttttgtcgtggagaccctgtgtatcatatggttctctttcgagctgctggtcaggttttttgcctgtccaagcaaagcaaccttcagtaggaatattatgaacctcatcgacatcgtggccatcatcccctactttataaccctaggaaccgaacttgcggagaggcagggcaacgggcaacaggcaatgagcctggctatcctaagggtaatcaggttagtgagagttttcaggatttttaagctgagcagacacagtaaaggactacagatactgggtcagacactcaaggcctccatgcgtgagctgggtttgctgatcttttttcttttcatcggagtcatcctttttagcagcgcggtctattttgccgaggccgacgacccgacaagtggatttagctcaatacctgatgccttctggtgggccgttgtcaccatgacaaccgtcggttatggagacatgcatccagtgaccatcggcggcaagatcgtgggttctctgtgtgccatcgctggcgtactcactatcgcgctgcccgttcccgttatagtgagcaatttcaattatttctaccacagggagacagagggggaggaacagtctcagtatatgcacgttggaagttgccagcacttgtcctcctccgccgaagagctgcggaaagctcgcagcaactcaacattatcaaaatccgaatacatggtgattgaggaaggaggaatgaaccacagcgcatttccccagactccattcaagactggtaacagtaccgcaacatgcaccacgaacaacaatcccaactcttgcgttaatataaagaaaatcttcacagacgtttag

SEQ ID NO: 129575 - DNA, 1962 bp, Artificial Sequence
  Description of Artificial Sequence: Synthetic coding sequence
atggaggtggccatggtctccgccgagagttccgggtgcaattcacacatgccttatggctacgctgctcaagcccgtgcacgcgagagagagcggctcgctcacagccgtgccgctgccgctgcggctgtcgcagctgctaccgcagccgtagagggatctggtggttcaggtggggggagccatcaccatcatcaatcccggggggcttgtaccagtcacgatccccagtcgtcaaggggaagccggcgccgccgcaggcagcgctccgagaagaaaaaggctcattaccggcagagttccttccctcactgctccgatctgatgccgtctggctccgaagagaaaatactccgcgagctgtctgaggaggaggaggacgaagaggaagaggaggaggaggaagaggagggacggttttactattccgaagacgatcatggggacgaatgctcctatacggacttgttgccccaggatgaaggaggtggcggatactcctcagtgcgctattccgactgttgtgagagagtagtgatcaatgtttctgggcttcgtttcgaaacccagatgaaaacactagcacagttccctgaaaccttgttaggagacccagagaagcggacccagtacttcgatcccctgcggaatgaatactttttcgacagaaacaggcctagttttgacgctattctgtactattaccagtccggtggacggctcaagcggcctgttaatgttcccttcgacatcttcaccgaggaagtgaaattttatcaattaggagaggaagctctgctcaaattccgagaagatgagggcttcgtacgggaagaggaagatcgggctctaccagagaacgaattcaaaaagcagatttggcttttatttgaatatccggaaagctccagccccgcacgtgggatcgccattgtctctgttctcgtaattttgatctccatcgttatattttgtttggagacactgcccgagtttagagatgatcgggatttggtcatggccttaagcgccggagggcatggagggctgctgaacgatacctcagcacctcacctggaaaacagcggacacactattttcaatgatcccttctttatcgtggagactgtgtgcatcgtctggttctctttcgaattcgtggtgaggtgctttgcttgcccatcgcaggctttgttcttcaaaaatattatgaatatcatagatattgtcagcattctgccttactttatcacgctggggacagacctcgcccagcagcagggtggaggaaatgggcagcagcagcaagctatgtcttttgcgatactgcgtataatacgccttgtacgcgtgttcaggatcttcaagttgtctcgacactcgaaggggctacagatacttgggcatacactccgagctagcatgagagaactgggactgcttatcttttttttgtttatcggagtgatcctgttttcatcagccgtctatttcgccgaggcagacgagcccaccacacactttcagtcaatccctgacgccttttggtgggctgtggttaccatgacgactgttggatatggagacatgaagcctatcacagtcggcggaaaaatcgtcgggtcactgtgcgctattgccggcgtgctgaccatagctctgccagtgccggtaatcgtgagtaattttaattacttctatcaccgagaaaccgagaacgaggagcaaacccagttgactcagaatgcagtgagctgcccctatctgccatcgaacctcctgaaaaagtttcggagctctactagttcttcactgggtgataaatcggaatatctagagatggaggagggcgtcaaagaatccctgtgcgctaaagaggagaagtgccaaggcaaaggtgatgattccgaaaccgataagaataattgttctaacgctaaggcggttgagacagatgtgtag

SEQ ID NO: 129576 - DNA, 1842 bp, Artificial Sequence
  Description of Artificial Sequence: Synthetic coding sequence
atggaaattgccctcgtccctctggagaatggcggagccatgaccgtcaggggcggcgacgaggccagagccgggtgtggccaggcaacaggaggtgaattgcagtgcccccctaccgctgggctcagcgatggacctaaggaacccgcccctaagggcaggggcgctcagcgggacgccgattcaggtgttcgcccactgccgcccctgcctgacccaggggtgcggccccttccacctcttcctgaagagctgccacgccctcggagacctcctcctgaggacgaggaggaagagggtgaccccgggcttggtacggtggaagatcaagctctcggtactgccagccttcatcatcagcgtgtccatatcaatatttctggattaaggttcgagactcaattagggaccctggcacagttcccaaacactcttctgggcgatcccgccaaaagattgcggtacttcgatccattgagaaacgagtattttttcgatcggaaccgcccctctttcgatggaattctgtactattaccaatccggcggtcgcctgaggcgtccagtgaacgtgagcctcgatgttttcgccgacgagattcgcttctaccagctgggcgacgaagccatggaacgctttcgcgaagacgaaggctttatcaaggaagaagaaaagccattgcctcggaacgagtttcaacgtcaagtctggttaatctttgagtatcctgagagcagcggcagcgcacgcgccattgcgatcgtatcagttctggtcatcctgatttcaatcatcacgttttgcctggagacgctgccagagtttcgagacgaaagggaactcctgagacatccccctgccccacatcaacccccagccccggctcccggcgctaatgggagtggcgttatggccccaccgagcgggccgacggtggctcccctgctgccacgtacattggcagatcccttctttattgtggaaaccacttgtgtcatctggttcaccttcgagttgttagtgaggttctttgcttgtccatccaaggctggcttcagccggaatattatgaatattatcgacgtggtcgcaatctttccctattttatcactctcggaactgaactagctgaacagcaaccagggggtgggggtggaggtcagaatggccagcaggccatgtcacttgcgattttacgggttatccgcttagtgcgcgttttcagaattttcaaactgtcccgccacagcaagggtctccagattctgggcaaaacccttcaagccagtatgagggagctcggacttttgatcttctttctatttatcggcgtcatcctgttctcgtccgccgtgtattttgccgaagcagataaccaagggacacacttctcctctatccctgacgccttctggtgggctgtcgtgaccatgaccactgtcggttacggtgacatgaggcctatcactgtaggcgggaagattgttggctctctgtgcgcgattgccggcgtcttgactatcgccttacctgtccctgttatcgttagtaactttaactacttctaccatagggagaccgatcacgaggagcccgccgtactgaaggaggagcagggcacacagagtcaggggccaggcctggacaggggtgttcagcgtaaggtttccggttcaaggggctccttttgcaaggctggaggaacactggaaaacgctgacagcgcccgccgcggcagctgccctctcgagaagtgtaacgtaaaggctaaatcaaatgtggatctgcgccggtccttgtacgccttgtgccttgatacaagtagagaaacggatctttag

SEQ ID NO: 129577 - DNA, 1557 bp, Artificial Sequence
  Description of Artificial Sequence: Synthetic coding sequence
atggccgcaagcatggcgcggaggctctggcccctccttacccggcggggcttcaggcctcggggcggatgtatctccaatgacagcccacgcaggtctttcacgacagagaaaaggaaccgcaacttgctctacgagtacgctcgcgaaggatattcggcccttccacagttggatatagagaggttctgtgcttgtccagaggaggctgcacacgctctcgaattgagaaagggcgagctgagaagtgcagacctcccggcgatcatctccacatggcaagagctgcggcaactccaggagcagatccggtccttggaggaggaaaaagcggccgtcacagaagccgtgcgggcactgctggccaatcaagacagcggcgaggtgcaacaggatccgaaatatcagggtctgagagccaggggtagggagatcagaaaggagctggtgcatctctaccctcgggaagcacaacttgaagagcagttctatctccaggctcttaagttgccaaaccagacacacccggacgtgcccgtgggcgatgagtcccaggcacgagtccttcatatggtaggcgacaaaccggttttctccttccagccgcgggggcacctcgaaattggagagaaactggatataataagacagaaaagattatctcatgtgtcaggtcacaggtcttactaccttaggggcgctggggccctgctgcagcacggcctggttaatttcacctttaataagctcctgcggagaggttttactccgatgactgtgccggacctgttgaggggcgcagtgtttgagggctgcggtatgacccctaatgccaatccatcacaaatttataatattgatcctgctcgattcaaagacttgaatctcgccggaacagcggaggtgggattggctggctactttatggaccacactgttgcattccgcgaccttcctgttagaatggtgtgtagcagtacctgctacagagccgaaaccaacactggtcaagagccaagagggctctaccgcgtgcaccattttactaaagtcgaaatgttcggcgtgactggaccgggcctcgagcagagctcacaattactggaagagtttctttcattacagatggagatcctgacggagttaggattgcattttcgggtgttggacatgccaacccaagagctgggtctgccagcttatcgaaagtttgatattgaggcatggatgcccggcaggggaaggtttggagaggttacctcagcctcaaattgcaccgacttccagtctcgcagattgcacatcatgttccagaccgaggcaggggaattgcagtttgcgcacaccgtgaacgcgacagcttgtgccgtgcccagacttctgattgctctgctggaatctaaccaacagaaggacgggagtgtgctggtacccccagcattgcagtcctacctgggtacagacagaattaccgcccccacacacgtgcccctgcagtacattgggcccaatcagccacggaagcctgggctccctggccagccagctgtctcgtag

SEQ ID NO: 129578 - DNA, 1893 bp, Artificial Sequence
  Description of Artificial Sequence: Synthetic coding sequence
atggcagcaggcgtcgccgcttggttgccctttgccagggctgctgccatcggctggatgccggtggccagtggcccaatgcctgctcccccaaggcaggaacggaagcgaacccaggatgccctgattgttctgaatgtcagcgggacgcgctttcagacctggcaggatacattggaacggtatccagataccctcctgggcagcagcgagagggattttttttaccacccggaaactcagcagtatttcttcgatcgcgatccagatatcttcagacacatcctcaatttttaccgcacaggaaagctgcattaccctaggcacgaatgtatctctgcctacgacgaggagcttgcctttttcggtctcatcccggagataataggtgattgttgctacgaggagtataaagataggcgccgagaaaacgcagaaagacttcaagacgacgcggataccgataccgctggcgagtccgccctcccaactatgacggcccgacaaagggtttggagggcgttcgagaatccgcatacgtccacaatggcattggtgttttattacgtaactgggttttttattgctgtttccgtgatcgctaatgtggtcgagacagtgccatgcggttcttctccagggcatataaaggagctgccatgtggcgagcgctatgccgtggctttcttttgcctagatacggcatgtgtcatgatcttcaccgtcgagtacctgttaaggctcgccgccgccccctcccgttaccgattcgtgcgcagcgttatgagcattattgacgtagtggcgattcttccatattacataggacttgtgatgacagataacgaagatgtgtccggggccttcgtgaccctacgcgtctttcgagtcttccgcattttcaaattcagcagacacagtcaaggcctgagaatacttggctacacgttaaagagttgcgcttctgaattagggttccttttgttttcgctgacaatggccataatcatttttgcaactgtgatgttctatgctgagaagggttcctcggcctctaagttcacctcgatccctgcagccttctggtacaccattgtcaccatgacaaccctcgggtatggcgacatggtgccaaaaactatcgccggaaagatattcggcagcatttgcagtttgtcaggggtgctcgtcatcgctcttccagtacctgtcatcgtttccaatttcagtcgcatctaccaccagaaccagagggctgacaaacgaagggcacagaagaaagcaaggctggctcgcatcagagccgcaaaaagcggctcagcaaacgcttatatgcagtctaagcggaatggccttctgtcaaaccagctgcagagcagtgaggacgagcaggcttttgttagtaagtctgggtcttcattcgaaacccagcaccaccacctgttacactgtcttgagaaaaccacaaatcacgaattcgtggacgagcaggtcttcgaagagtcctgcatggaggttgcgactgttaaccgacctagctcccattctccgtccctgtctagccagcaaggagtgacctcaacttgctgtagccgccgccataagaagacttttcgaatacccaatgcaaatgtgtcaggatcacatcagggatctatccaggagctgtctacgatacagatacggtgcgttgagagaacacctctgtcaaattcacggagctctctgaacgccaaaatggaagagtgcgttaaacttaactgcgagcagccttatgtaactacggcaattatctccatccctaccccccctgtgaccactcctgagggcgatgatcggccagagtccccggagtattcgggtggaaatattgtgcgcgtgtcagccctgtag

SEQ ID NO: 129579 - DNA, 1911 bp, Artificial Sequence
  Description of Artificial Sequence: Synthetic coding sequence
atggctgctggagtggctgcctggctcccctttgccagagccgccgcaattggctggatgccagtggcgaattgccccatgcccctcgcaccagccgataagaataagaggcaggatgagctgatagtgctcaacgtttctgggcgcaggtttcagacatggaggacaactctggagagataccccgacaccctgctggggagcactgaaaaagagtttttttttaacgaggacacaaaagaatacttcttcgaccgcgatccagaggtgtttcggtgtgtgctgaatttttatcgaaccggaaagctgcattacccccgttacgaatgcatctccgcctatgacgacgaactggctttttacggtatactacctgaaattataggcgactgctgctatgaagaatataaagacagaaagcgcgaaaacgccgaaagactgatggacgacaacgacagcgagaacaatcaggagagcatgcctagcttgtcctttcgccagaccatgtggagagcgtttgagaatccccatactagtactttagcactggtcttctactacgttactgggttttttattgccgtctctgttattacaaatgtagtcgagacagtgccttgtggcacagtgccaggcagtaaggaattgccttgcggggaacgctacagcgtcgccttcttctgtctagacaccgcctgtgtgatgatttttacagttgagtacctcttacgcctgttcgcagccccctcccgttatcgatttatcaggagcgtgatgtcaattattgacgttgtggcgatcatgccatactatatcggtctggtgatgacaaataatgaagacgtgtcaggagctttcgtgacactgagagtcttccgtgtcttccggatttttaaattctcaagacattctcagggtttgcggattctaggctacacgcttaaatcctgtgctagcgaattaggatttcttttgttttctctgaccatggccattatcattttcgcgactgtgatgttctatgctgaaaagggctcctcggccagcaagttcacctcgatccccgcttctttttggtacactattgtgaccatgacaaccctcggatatggcgacatggtgcccaagaccatcgcaggcaaaattttcggctccatttgctcactgagtggcgtgctcgtgattgccttgccagtgcccgtaatagtgtcaaactttagccggatttaccaccagaatcagcgggctgacaaaagacgtgcgcagaagaaagcccggttagcgcgtatccgcgtcgccaagactggaagcagcaacgcctacctgcacagcaaacgtaatggcctgctgaatgaggccctggagctgactggcacaccagaagaagagcacatggggaagactacctctttgatcgagagccaacaccaccacctgttgcactgcctggagaagaccaccaaccacgaatttatcgatgagcagatgttcgaacagaactgtatggagtcttctatgcagaactacccatctaccagatccccatctttaagcagccatccaggcctgacaactacttgctgttcgcgacgcagtaaaaagaccactcacttaccaaactctaatttaccagccactagacttcggagcatgcaggagctctctacgatccacattcaaggaagcgaacagccctctcttaccacatctcggagctccctgaatttgaaggctgacgatggtttacgacctaactgcaagactagccaaataactacagctatcatctccatcccgactccgcctgccctgactccagaaggagagtctcgtcccccccctgccagcccaggaccaaacaccaatattccaagtatcgccagcaatgtagtgaaggtgagcgccctgtag

SEQ ID NO: 129580 - DNA, 1968 bp, Artificial Sequence
  Description of Artificial Sequence: Synthetic coding sequence
atggccgcaggggtcgccgcctggctgccctttgcacgggctgccgctataggttggatgcccgtggcaaactgccccatgcccctagcacccgcagataagaataaaagacaagacgagctgattgtattaaacgttagtgggcggcggttccagacttggaggacaacacttgaacgataccctgatacactgctgggctcaaccgagaaagagtttttctttaacgaagacacaaaggaatacttttttgatcgggaccctgaagtctttagatgtgtgctcaatttctatagaacaggtaaactgcattatccacgatacgagtgcatctcagcctatgacgacgaacttgcgttctatggcattctaccagaaattattggagactgctgctatgaagagtacaaggatcgcaagcgggagaacgctgagcgccttatggacgacaacgactccgagaataatcaggagtccatgcctagtctgtccttccgccagactatgtggcgcgctttcgaaaacccccacacgagcacactagctctggtgttttattacgtaaccggcttcttcatcgccgtttctgtgataacaaacgttgttgagactgtcccgtgcggcactgtgccaggctcgaaagaactgccctgcggtgagcggtattccgtcgcctttttttgcttggacactgcatgcgtgatgatctttaccgtggaatacctcctgcggctgttcgccgcaccaagcagatatcgattcatacgttccgtaatgtcaatcatagacgtcgttgcaattatgccttactacatcggactggtgatgacaaataatgaggacgtctcaggtgcttttgtcactctccgggtcttccgcgtttttaggatcttcaagtttagtaggcactcccaaggactgagaattctaggctacaccctcaagtcttgcgccagcgagttaggtttcctgctcttcagccttacaatggcgataataatctttgcaacagtgatgttctacgcagaaaaggggagctctgcctccaagtttacgagcatccccgcaagtttctggtataccatagtgactatgactacgctgggatacggtgatatggtaccaaaaaccatcgcaggtaaaatttttggcagtatatgctcactttccggcgtgctcgtgattgctttaccagtgccagttattgtctccaatttctctaggatttatcaccagaatcagagagccgataaacggcgggcccagaagaaggcgagactggcacgaatccgggtggcaaaaacaggcagttctaacgcctacctacactccaagcgcaatggattgctgaacgaagcactggagctgactgggactccagaggaggaacacatgggtaagactacatcattaattgaaagccagcatcatcatctcctgcactgcctggaaaagaccacgggactgagctacctggtcgacgatcccctgctctccgtgcgcacgtcgactataaagaaccacgagtttatcgacgaacaaatgtttgagcagaattgcatggagagctcaatgcagaactatccttccactcgttccccttctttgagctctcaccctgggctgacaaccacatgctgctcgagaagatccaagaagaccacacatctccctaattcaaatctgccagctacaagactgagatccatgcaggaattatcaaccattcacatccagggaagcgagcagccaagccttactacgtctcggtcctcccttaatctcaaagcggacgacgggttaagacccaactgtaaaaccagccagataacgacggcaattattagcatacccacccctcctgcactgaccccagaaggagaatctcgccctcccccagcttccccagggcctaataccaacattccttctatcgcttccaatgtggtgaaggtctccgcactatag

SEQ ID NO: 129581 - DNA, 1911 bp, Artificial Sequence
  Description of Artificial Sequence: Synthetic coding sequence
atggcagcaggcgtggctgcctggttgccgttcgcccgcgccgcggccattggctggatgccagtcgccaactgcccgatgcctctggcccccgcagacaaaaataagcggcaggacgagttgattgttttgaacgtgtctgggcggaggttccagacctggagaactacgcttgaaagatatcctgatacattgttaggaagtacagagaaggagttcttcttcaacgaggacactaaagagtactttttcgatcgtgatcctgaggtctttcgctgcgtgctgaacttttatagaaccgggaagctgcactatccaagatacgaatgcataagtgcatacgacgatgaattggcattctacggcatcctcccggagataatcggagactgctgctacgaggagtacaaggacagaaagagagagaatgcagaaaggttgatggacgacaacgactcggagaataaccaggagagtatgcccagtcttagctttcggcagacaatgtggcgtgctttcgagaacccacacacctctaccctggctctagtattctactacgtgactgggttttttatcgctgtttccgtgattacaaacgtcgtcgaaactgttccttgtgggaccgtgcccggcagcaaagagcttccttgcggcgagcgttactcagtggcctttttttgtttggataccgcttgcgtcatgattttcaccgtggaatatctcttgaggctgttcgcagccccctcacgataccgttttattcgctcagtgatgagcattatcgatgtcgtcgccatcatgccgtattacatagggttagtgatgaccaacaacgaggatgtttccggcgccttcgttactctcagggtgttccgggtcttcaggatcttcaagttttctagacatagtcaaggattgaggatccttggttacaccctgaaatcctgcgcctccgaacttggattcctgctgttcagcctgacaatggctatcataatctttgccacagtgatgttctatgccgaaaaaggttcctctgccagcaaattcaccagcattcccgccagtttctggtataccatcgttaccatgaccacactggggtacggagacatggtgcccaagactatagccgggaagatttttggcagtatctgttccctgtcgggcgtcttggtgattgcccttcctgtacccgttatcgtctccaatttctctcgcatttaccaccagaatcagcgtgctgacaaacgccgggctcaaaaaaaagcccggctggcccgcatcagggtggccaagacaggatccagtaacgcataccttcacagcaagagaaatggactccttaatgaggcactggaactgacgggcacacctgaggaagagcacatgggcaagacaacatcactcatcgagtcccagcaccatcacctccttcattgcctggagaagaccacgaaccacgagttcattgatgagcagatgttcgagcagaactgcatggagagctctatgcaaaattacccttcaactaggagccccagcttgagctctcacccaggcctcaccacaacctgttgctctcggaggagcaaaaagacgacacatctgcctaacagcaaccttccagccaccagactgaggagcatgcaagaactgtccaccatccacatccagggaagcgagcaacctagcttaactacttctcgcagctccttgaacctgaaggccgatgacggcttacggcccaattgcaagacttcccagattacaacagcgattattagtattccaacgccacccgcccttacccccgagggggaatcacgacctccccccgctagccctgggcccaacactaacatcccaagtatcgcttctaatgtcgtgaaagtaagtgcactgtag

SEQ ID NO: 129582 - DNA, 1758 bp, Artificial Sequence
  Description of Artificial Sequence: Synthetic coding sequence
atggggcagggagatgagagcgagcgcatcgtcatcaatgtggggggaacccgacatcagacctatcgatctacacttaggaccctgcccggtactcgactggcatggctggcggagcccgacgcccactcccactttgactatgatccccgagcagatgaattcttttttgacaggcatccaggagtgtttgcacacattcttaattactacagaaccggcaagctccactgccctgcagacgtgtgcggacctttgtacgaagaagaattggctttctggggcattgatgagaccgacgttgaaccctgctgctggatgacatacaggcaacacagggatgcggaagaagcactggactctttcggcggtgcgcccttggacaacagtgcagatgacgcggatgcagacggccccggagatagcggcgacggggaggacgaacttgagatgaccaagcgcctggccctcagtgactcccccgacggcaggccgggtggattctggagaaggtggcagcctagaatctgggccctgtttgaggacccgtatagctcacgttatgcacggtacgtggcctttgctagcttattttttatcctggtgtctatcactaccttctgccttgagacacatgagcgctttaatcccatagttaataagaccgagatcgagaatgtgaggaacggcacacaggtgcggtactatcgcgaagctgagacagaggcgttcttgacctatatagagggagtgtgcgtggtctggtttacctttgagttcctgatgagggttattttttgtcctaacaaggtggagttcatcaaaaatagtctcaacatcatagattttgttgccatcctgcctttttacttagaggtcggtcttagcggactcagctctaaagccgctaaagatgtgttgggtttcctacgagtggtcaggttcgtgcggattctgcgaattttcaagttgacacgacattttgtcgggctacgcgtgcttgggcatactctgcgggcatctaccaacgagtttctgctccttatcatattcttggcgctgggagtccttatctttgccacaatgatctattacgccgagcggatcggggctcagcctaacgatccgtccgcaagtgaacacactcactttaaaaatatccctataggattctggtgggccgtcgtgaccatgaccacattggggtacggggatatgtatccacagacttggtcaggtatgctggtgggggccctgtgtgccttagctggggtgcttaccattgcaatgccagtaccagttatagtcaacaactttggaatgtattactccctcgcaatggctaaacagaagctacccaagaagaaaaaaaaacatataccaaggcctcctcagctgggctcgccaaattattgcaaatcagtcgtgaacagtccacatcacagtacccagtccgatacctgccccctcgcccaggaagagattctagaaattaaccgtgcagactcaaagctgaacggggaggttgccaaggcggcactggctaatgaggattgtccccacatagatcaggcactcacgcccgacgaagggttacccttcactcgctccgggactagagagcgatatggaccatgtttcctactgtcaactggagaatacgcctgtccccccgggggcggtatgaggaaagatctctgcaaagagtccccagtgatcgcgaagtacatgccgaccgaggccgtgcgggtgacctag

SEQ ID NO: 129583 - DNA, 1536 bp, Artificial Sequence
  Description of Artificial Sequence: Synthetic coding sequence
atggggcagggggatgaatctgaacgcatcgtcattaatgtgggaggtacacgacatcagacctatcggtccactctgcgaacactccctggcacgcgcttggcatggctggccgagcccgacgcacacagccatttcgactatgaccctcgtgctgatgagtttttttttgatagacaccctggcgtctttgcacatattctgaactactatcgcacaggtaaactgcactgcccagccgatgtatgtgggcccctgtatgaggaggaactcgccttctggggcatcgatgaaaccgatgttgagccctgctgttggatgacctatagacagcacagagacgccgaggaggccttagattcctttgggggtgctccgctggacaattccgctgatgatgcggacgcagatggtcctggggacagtggcgacggggaggatgagctcgagatgaccaagaggctagctctgtcagactctcctgatggacgccccggcggtttctggcgacggtggcaaccccgcatttgggcacttttcgaggatccatacagctcccgttatgccagatatgtggcttttgccagtctgttttttatcctggtgagcatcacaacgttttgtcttgagacccatgagcgtttcaacccgattgtgaacaagactgaaatcgagaatgttaggaatgggacacaggtcaggtattatcgggaagccgaaactgaggctttcctcacttatattgaaggggtgtgtgtcgtgtggtttacatttgagttccttatgcgcgtgatattttgccctaacaaggtagaattcataaaaaactctctcaacattatcgatttcgtagccatactgcccttctacctggaggtcggcctcagcggtctttcctccaaggcagcgaaggacgtgctcggatttctccgggtagttcgatttgtccgcattctgcgcatctttaaactgaccagacatttcgtcgggctgagagttctcggacacaccctgagggcatccaccaacgagttccttctgctgattatcttcctagctttaggagtgctaatattcgctaccatgatctactacgccgagcggataggcgcgcagcccaacgacccttccgcatcagaacacactcacttcaaaaatattcctatcgggttttggtgggctgtggtgacaatgactaccctcggatatggggatatgtatcctcagacctggtccggtatgctagtgggcgccctgtgcgccctggcaggtgtgctgacaatagccatgcccgtgccagtaatagtgaataattttggaatgtattacagcctcgctatggccaaacagaagctgcccaaaaaaaagaaaaagcatatccccagacccccacagttaggttccccaaattattgtaagtcagtcgtcaacagcccacatcacagcacgcagagcgatacatgtccattagcccaagaagaaatcttggaaattaaccgggccggcagaaagccactccgaggaatgtcgatttag

SEQ ID NO: 129584 - DNA, 1842 bp, Artificial Sequence
  Description of Artificial Sequence: Synthetic coding sequence
atggggaaaatcgagaacaatgaaagggtgatactgaacgtgggcggcaccaggcacgagacctatagatccaccctgaagaccctgcctggaaccagactggccttgttagcaagcagcgagccacccggggactgcctgactacagcaggagacaaattgcagccctcccccccccccctgtccccaccaccacgcgcacccccgctatctccgggaccaggggggtgcttcgaagggggcgccggaaattgctcttcccgtgggggccgagcctctgaccaccccggcggaggaagagagttcttttttgatcgacatccgggagtatttgcttatgtattgaattattatcggaccgggaaactgcattgccctgccgatgtgtgcggtcctctgtttgaggaggaactggctttttggggcatagacgagacagacgtggaaccatgttgctggatgacctacaggcagcatagagacgcagaggaagctctcgacatatttgaaactcctgaccttattggcggggatccaggcgacgacgaggacttagctgctaagcggctcggcatcgaggacgccgccggcctcggcggccccgatggaaagtctggacgttggagacgtctccagcctcgtatgtgggcattgttcgaggatccttacagcagccgggcagcacggtttatcgcgttcgcctccctgtttttcatactcgtgagtattaccaccttttgtcttgagacccacgaagccttcaatatcgtcaaaaataagacagaacctgtcatcaatggcacatctgtcgttctgcaatatgagattgaaactgaccctgctctgacttatgtggaaggcgtttgtgtggtttggttcactttcgaatttctagtaaggatcgtgttctctcctaataaattagaatttatcaaaaatctcttgaacatcatcgacttcgtagcaatcttgcccttctaccttgaagtgggactctccgggttatctagcaaggccgcaaaggacgttctgggctttctcagagtagtgcgctttgtcagaatcctcaggatttttaaacttactcgacactttgtgggtttaagggtgcttggccacactttgagggcatccaccaatgagttcctgcttctgatcatattcctggcattaggtgtgctgatctttgcaacaatgatatattacgcggagagggtcggagcacagcccaacgacccctcagccagcgaacacacccagttcaaaaatattccaattggtttctggtgggccgtcgtaactatgacgacccttgggtatggcgacatgtatcctcagacctggtcaggtatgctggtgggggccctctgcgcactggcgggggtgctgaccatcgcaatgcccgtgccagttattgttaacaattttggcatgtattactcactggccatggccaaacagaagctgccaagaaagaggaagaagcacataccacccgccccccaggcttctagtcctaccttctgcaagactgaactcaatatggcctgtaacagtacccagtccgatacatgtcttggcaaagacaaccgccttctcgaacacaaccggagtgtgttgtccggggacgattcaactggtagtgagcctcctcttagtccccctgaacgactccctatacggagaagttccacacgggacaaaaatcgaagaggcgagacttgtttcttactgacaaccggcgattatacctgcgcttccgatggaggcattcgtaaagataactgcaaggaggtcgtgatcacggggtacacacaggccgaagctcggagccttacctag

SEQ ID NO: 129585 - DNA, 1890 bp, Artificial Sequence
  Description of Artificial Sequence: Synthetic coding sequence
atggggaaaattgaaaataacgagcgggtgattctgaatgtgggaggcaccagacatgagacgtaccggtccactctgaagacgctccctggcactaggcttgcccttttggcttcctctgaaccccctggcgactgcctcacaaccgctggggacaagctgcagccaagtcctccgccactcagtccgcccccgcgtgctcccccgctctctccaggccctgggggatgtttcgaaggtggggcaggtaattgttcgagccgcggaggaagagcatcggatcaccccgggggcggccgtgagttctttttcgatcggcatccgggggtctttgcctacgtgctcaattattataggactgggaagttgcattgcccagccgacgtgtgcggtccgttgttcgaggaggagctggcattctggggtatcgatgagactgatgtggagccctgctgttggatgacataccgtcagcaccgcgacgcagaagaggctctggatatcttcgaaactccagatctgattggaggtgaccccggggatgacgaggatctagccgccaagcggctcggaatagaggacgctgctggcctcggtggccccgacggcaagagcgggagatggagaaggctgcagcctcgcatgtgggccctgttcgaggacccctattctagccgggccgcccgcttcatcgcgtttgcttctctattctttattctcgtctccatcacgacattctgcctagagactcatgaagcctttaacatcgtcaaaaataaaaccgagcctgtcattaatggtaccagcgtggttcttcagtatgagatcgagacagaccccgctctgacatacgtcgagggggtgtgtgtcgtgtggtttactttcgagtttctagtgcgaattgtgttttcacctaataaactggaattcataaagaacctgttgaatatcatagatttcgtggctatcttgcccttttatctggaggttggcttgagtggactgtcaagtaaggctgccaaggatgtgttgggattcctgcgggtggtgcgtttcgtgcggatcttgcggatcttcaagctgacccgccactttgtgggtctgagagtgctaggccatacactccgagcttcaaccaacgagttcttacttctgatcattttcctggctttgggagtgctcatatttgcaactatgatttattacgcagaaagggtgggcgcacagcccaatgacccttccgccagtgaacatacccagtttaaaaacatacccatagggttctggtgggccgtggtcaccatgacaacattaggatatggggacatgtacccgcagacatggagtggaatgcttgtcggcgctctgtgtgctctggcgggcgtgcttacaatcgcaatgcctgtgcccgtcatcgtgaacaacttcgggatgtactacagtctagctatggctaaacagaagctcccacgaaagagaaagaaacacatcccccctgccccccaggcttcaagtccaactttctgcaagaccgaattgaatatggcgtgtaacagcacacagagcgacacctgtctaggaaaagataatcggttgcttgagcacaatagaagcgtgttatccggcgacgactcaacaggatcagaaccccccctgtctccccccgagcggctccccatcagacggtcatcaacacgggataagaacagaagaggcgagacctgctttctgctgaccactggtgattatacttgcgcgtccgacggaggcatcaggaaggtgctttataggatttaccacggcttgctaacggcagaaaagggcacagtagagttctcacataccaaggattacactggcaatagactgttactgttgaacgtgccttag

SEQ ID NO: 129586 - DNA, 1677 bp, Artificial Sequence
  Description of Artificial Sequence: Synthetic coding sequence
atggggaaaatcgaaaataatgagagagtgatactgaacgtaggagggaccagacatgagacttatcggagtacgctgaagacactgcccggaacgagactcgcattgttggcatcttctgagcctcctggcgattgcctgaccaccgccggtgacaagcttcagccgagtcctccgcccctgagccctcccccacgagctccgcctctcagccctgggcccggggggtgttttgaggggggagccggcaactgcagtagccgggggggcagagcgtcagaccatccgggcggaggacgggagttcttcttcgaccggcaccccggggtcttcgcatatgtactgaattactatcgtacaggaaaactccattgccctgcagatgtctgcggaccccttttcgaggaagagctcgctttttggggtatcgacgaaacagacgtcgaaccttgttgctggatgacttataggcaacacagagacgccgaagaggcattggatatctttgaaactccggatctgattggcggcgatcctggcgacgatgaggacctcgccgccaaacgcttgggaatagaggacgcagccggactgggagggccagacggcaagtctgggaggtggagaaggctgcagccccgaatgtgggcccttttcgaagacccttacagctctcgcgctgctaggtttatcgcatttgcatctttattttttatcctggtttctattacaaccttctgcctggagactcacgaagcattcaacattgtcaagaacaagaccgagcccgtaataaacggcacgtcagtcgttctccagtacgagattgaaaccgatcctgccttgacttacgtggaaggagtctgtgtcgtttggttcacctttgaatttttagtgagaatcgtgttttcgcctaataagctggagttcataaagaatttacttaacattatcgatttcgtggccattctacccttctatctcgaggtggggctttcagggctgagcagcaaagccgcgaaggacgttctgggctttctcagagtagttcgtttcgtgagaatcctgcgtattttcaagctcaccagacactttgtaggcctgcgggtgctaggccacactctacgggcctcaaccaacgagtttctactccttattatcttccttgctctcggcgtgctgatatttgccactatgatctactatgccgagcgggtgggggcacagccaaacgacccttcggcgtctgaacatacccagttcaagaatatcccgatcggcttttggtgggcagtggtcactatgacaacccttgggtatggcgatatgtacccccagacatggtctggcatgcttgtgggcgctttgtgcgcacttgcaggggtgctgacaatcgccatgccagttccagttatcgtgaacaacttcggaatgtactattccctggctatggctaagcagaaactgcccagaaaacggaagaagcacataccacctgcgcctcaggcctccagtcctacattttgtaagacagagctaaacatggcatgcaattctactcaatctgacacctgtctgggcaaagataaccgcctgctggagcacaatcgctcagataattgtaaagaagtggttattacaggctatacccaagccgaggcccgcagcctcacatag

SEQ ID NO: 129587 - DNA, 1842 bp, Artificial Sequence
  Description of Artificial Sequence: Synthetic coding sequence
atgggaaaaattgaaaacaatgaacgggtgattctaaacgtcggggggactcgccatgaaacttatcggagcacactgaagacgttgccgggcacaaggctggccctgctcgcttcgagtgagccacccggagactgtttgaccacagctggagataagttgcagccgtccccccctcccctctctccccccccacgagcacctcccttaagcccggggccagggggttgcttcgagggcggggccgggaactgctcaagccgaggcggacgggcctcggaccatccgggaggcggacgcgagttcttctttgatcgacatcccggggttttcgcatatgtcctcaattactataggactggcaaactgcattgccccgctgacgtgtgcggacctctctttgaagaggagcttgctttctggggcattgatgaaacagatgtagagccttgctgctggatgacttaccgtcaacaccgtgatgcggaggaagccctggatatcttcgagactccggaccttatcggaggagacccgggcgacgatgaggatctggcagctaagcggcttggcattgaggatgcagcggggctgggaggtcctgacgggaagtccggtcgctggcgtcggctgcagccccggatgtgggcattatttgaagatccctacagtagcagagctgccaggttcatcgcttttgcttcattgttttttattctggtcagtatcaccacattctgcttagaaactcacgaggcattcaacatcgtgaaaaacaaaaccgaacctgtaatcaacggcacatccgtcgttctccaatatgaaattgaaactgaccccgctcttacttatgtcgaaggcgtgtgcgttgtttggttcacatttgagtttcttgtgcgcatcgttttctctccaaacaagctcgagtttatcaagaacctactcaacatcattgatttcgtggccatcctgccattttacctggaagtcgggttgtcgggactgtcaagcaaggccgccaaggatgtcctgggattcctgagggtagtcagattcgtacggatattaagaatcttcaagttgacgcgtcactttgtcggattgcgtgtcctgggccacactctcagggcctcaactaatgagttcctcttactgatcatttttctagccctgggggtgcttatcttcgctaccatgatttactacgccgaacgggtaggcgcacaacctaatgaccctagtgctagtgagcatacacagtttaaaaacattcccatcggtttttggtgggccgtggtcaccatgaccaccctgggttacggcgatatgtatcctcagacgtggagcggtatgcttgtaggggctctttgcgctctggcgggcgtgctcacgatagctatgcccgtccccgtcattgttaataattttggaatgtattactccttagcaatggcaaaacagaagctgccaagaaagagaaaaaagcacatccctcccgctccgcaggctagctcaccgacattctgcaagactgagctaaacatggcatgtaattccacgcagagtgatacctgccttggcaaagataaccgcctcttagagcacaaccggagtgtgctgtctggcgatgacagcactggctcagagcctcccctctctcctcctgagagactgccaattcgccgctcctccacaagggataagaacagaaggggtgagacatgctttttgcttaccacaggcgactatacttgcgcctctgatggcggtatacgtaaagacaactgtaaagaggtggtgattacaggatacacgcaggcagaggccaggtcattaacatag

SEQ ID NO: 129588 - DNA, 1917 bp, Artificial Sequence
  Description of Artificial Sequence: Synthetic coding sequence
atgggtaaaatcgagaacaatgagcgggtgatactaaacgtggggggcaccagacacgagacatacaggtcaacactgaaaactctccctggtaccagactggccctgctcgccagttccgaacctccaggcgattgcctgaccactgccggcgataaactgcagccctcacccccacctctgtctcctccaccccgcgcaccccccttgtctcctggtccaggaggatgctttgagggaggcgctggtaactgttcctcccgtggcggacgagccagtgatcacccaggtggcgggcgcgagttcttctttgatagacatcccggcgtgtttgcttacgtcctgaactactataggaccggaaagttacactgtcccgcagatgtctgcggccccctgtttgaggaagaactggctttttggggaatcgacgaaactgacgtggaaccgtgctgttggatgacctaccggcagcatcgtgacgcagaggaagcactagacattttcgagactcccgatttgatcggaggcgatccaggagacgatgaggatcttgcagcgaaacgcctgggcattgaggacgctgcaggactcggcggtcctgatgggaaaagcgggaggtggcgccgcctgcagcctcgcatgtgggcactgtttgaggacccctactcctcccgtgctgcacgctttatcgcctttgctagtctctttttcatactagtgtccattacaaccttttgcttggagactcatgaggcttttaatatcgtcaagaataaaacggaacctgtgattaatggaacctctgttgtgctgcagtacgagatcgagactgacccagctttgacctacgtcgaaggcgtgtgcgtggtctggtttacgtttgaatttctcgtgaggattgtgttctcccctaataagctcgagtttatcaagaacttgctgaacatcatagatttcgtggctattctccccttttatttggaggtggggctgtcggggttgtcctcgaaagccgctaaggatgtcttgggatttctgcgcgttgtgaggtttgtacggatcctgaggatattcaaactgacacgacattttgtaggattacgtgtgctaggacacaccctgcgggccagtactaacgaattcttgttgttaatcatattcctagcattgggggtgctgatctttgctacgatgatctactacgcggagagagtgggcgctcaacccaacgacccctctgcttcagaacacacacagtttaaaaacattccgattgggttctggtgggctgtggtcaccatgacaactctcggttacggtgacatgtacccccagacttggtccggaatgttagtgggggctctctgtgccctggccggagtcctcacaatagctatgccagttcccgtcattgtaaataactttggaatgtactattcgttagctatggctaagcagaaacttcccagaaagcgcaaaaagcacattccgcccgcgccccaggctagcagtcctacattctgtaaaactgaattgaacatggcatgcaacagcacccagagtgatacgtgtctgggaaaagacaatcgtcttttggagcacaatcgctccgtcctcagcggggatgattcgacaggcagcgagccacccttgtcaccccccgagaggctgcccatacggaggtctagcacccgcgataagaaccgcagaggagaaacctgcttcctgttgaccacgggcgactacacctgcgcttcggacggcggtatccggaagggctacgaaaaaagcagatcattgaacaacattgctggcctcgctggaaacgctctccgcctgagtcctgtgacgtcaccttacaactcaccatgccctctgcggagaagtagaagccccataccatccatactttag

SEQ ID NO: 129589 - DNA, 1890 bp, Artificial Sequence
  Description of Artificial Sequence: Synthetic coding sequence
atgggcaagatcgaaaacaacgagcgagtgatcctgaacgtcgggggaacaaggcatgagacataccggagcactctaaaaaccctccccggaactaggcttgccttactcgcttcgtctgagccacccggggattgccttacgacagccggcgataaactacagccaagtccccctccccttagccctcctccacgcgctccacccttatcacccgggccaggaggctgctttgaaggcggggccggaaactgtagttctaggggaggcagggcgagcgatcacccgggaggcgggagagagttcttctttgatcgacaccctggcgtctttgcctatgttctgaattactacagaacaggcaaattgcactgtcctgcagacgtctgtgggcctctgtttgaagaggaattggccttctggggtatcgacgaaacagatgtggagccctgttgctggatgacatatagacagcaccgtgacgcggaggaagctttagacatcttcgaaacgccagacctgattggcggtgacccgggcgacgatgaagacctggcagcgaagcgcttgggaatcgaagacgccgctgggctcggaggccccgatggcaaatcaggacgctggcggagactgcagccccgaatgtgggcgttgtttgaggatccctactcttctcgggcagcacgattcattgcgtttgcatcgcttttttttattctggtgagtatcaccacattttgtcttgagactcatgaggcttttaacatagtgaaaaacaagaccgagccggtgatcaacggaaccagcgtcgtgctccaatatgagatcgagactgatcccgccctgacatacgtggagggtgtgtgcgtggtgtggtttacattcgaattcttagtaaggattgttttctcccctaataagctggagtttatcaaaaatctgctgaatatcattgattttgtcgcaatactacccttttatctggaagtcgggctgtcaggcctgagctcaaaggcagcaaaagacgtgcttggctttttgcgtgtagtgcgtttcgtcagaattctcaggatcttcaagctgacaagacacttcgtcggcctgcgcgtcctggggcacacccttcgcgcgtcaacaaacgagtttcttctcctgattattttcctcgcattgggagttctgatcttcgcgactatgatatactatgccgagagagtcggagcccagcccaacgacccttcggcatccgaacatacccaattcaaaaacatccctataggattttggtgggccgtggttacaatgacgactcttggctatggcgacatgtatccacagacctggagtggaatgctagtcggggctttgtgcgcgctagccggagtgctgacaattgccatgccggtaccagtcatcgtgaataactttgggatgtactactctctcgcaatggccaagcagaagttaccgagaaaacgcaaaaagcatatcccacccgctccgcaggcctcatcgccgaccttctgtaagactgagttgaatatggcgtgtaattctacccaaagcgatacctgtttaggcaaggacaataggctgctggaacataaccgcagcgtgctcagcggggacgactccacaggtagcgaacctccgctctccccgccagagcgactgcccattaggagatctagcactagggacaaaaaccggcgtggggagacatgtttcctgcttaccaccggggactacacgtgtgcttcggacggtggcatccggaaggtgctataccgcatatatcatggactcctgaccgccgaaaaaggcactgtggaattcagccatacaaaggactatacagggaaccggctattgttactgaatgtaccatag

SEQ ID NO: 129590 - DNA, 2187 bp, Artificial Sequence
  Description of Artificial Sequence: Synthetic coding sequence
atgttgtcatcagtgtgcgtgtccagttttaggggtcggcagggcgcttctaaacaacagcctgctcccccaccacagccaccagaatctccacctccccctcccttaccaccccaacagcagcagccagctcagcccggccctgccgcgtcgcctgccggccctcccgcaccgagggggccgggggacagaagggccgaaccttgtcctggactcccagccgccgccatgggtcgccacggcggaggcggaggcgacagtggaaagatcgttatcaatgtcggaggcgttaggcacgaaacctataggtccactcttcgcaccttaccaggcacaaggctcgccgggctaaccgagcccgaggctgctgccagatttgattacgaccctggcgccgacgaattctttttcgatcggcaccccggcgtctttgcttacgtactgaattattaccggacaggcaaattgcactgtccagccgacgtgtgtggccccctcttcgaagaggaactgggcttctggggtatcgacgagaccgacgtggaagcctgttgttggatgacttaccgtcagcaccgggatgccgaagaagccttggattcatttgaggcccccgacccagccggggcagcgaacgccgccaacgctgccggcgcacatgacggagggctagacgatgaggccggggccgggggcggggggctggatggagctggaggtgaactgaaacggctgtgcttccaggacgctggtgggggagcagggggccccccaggtggagccggtggtgcagggggcacctggtggagaaggtggcagccacgcgtgtgggcccttttcgaggatccatactcttctagagctgcacgctatgttgcttttgcaagtctcttttttattctcatctctatcacgacattctgtctcgaaacgcatgaggggttcattcacatctccaataaaacagtgacccaggcctcacctatccctggagctccccccgagaatattaccaacgtggaagttgagaccgagccatttctcacctacgtagagggagtgtgcgtggtatggtttaccttcgaatttttaatgcgcatcacattctgccctgacaaggtcgagttcctgaagtcgtctcttaacattatcgattgcgtggcaattctgccgttttaccttgaagtggggctttcgggtctgtctagcaaagcggccaaggatgtgttgggctttttgcgggtggtacggttcgtgagaatcttacgcattttcaagctcacacgccactttgtgggcctccgagtgcttggacacaccctgcgcgcgtcaacaaacgaatttctgctccttattatcttcctagccctcggggttttaattttcgctacgatgatctactacgcggagcggattggcgctgacccggatgacatcttgggctcaaaccacacatattttaaaaacatccctattgggttctggtgggctgtggttaccatgactacgctggggtacggagacatgtatcccaagacgtggtcaggcatgctagtgggggctctgtgtgccttggccggggtcctgacgatcgccatgcctgttcccgttatcgtgaataattttggcatgtactactccctggctatggcaaaacagaagctccccaagaaaaagaacaagcacatcccgcggccaccgcaaccaggctcccccaattactgcaaaccggatccccccccacctcctcctcctcaccctcatcacgggtccggaggtatttcccctccacccccgatcacaccaccttctatgggagtgactgtggccggagcctatcctgctggccctcacacccaccccggtttgctgcgcggcggcgccggaggcctggggatcatgggtcttccccctttacccgctcctggtgaaccctgccctctcgcccaagaggaggtcattgagataaacagagccgacccacggcctaatggcgacccagccgctgccgccctggctcatgaagattgtccggccatcgaccaacctgctatgtcgccggaggacaaatcacccataactccagggtctaggggccggtacagcagagatagggcttgttttttgctgactgattatgccccttctccggatggcagtatacggaaggccctggttacagcctag

SEQ ID NO: 129591 - DNA, 468 bp, Artificial Sequence
  Description of Artificial Sequence: Synthetic coding sequence
atgggaatccgacaacagctcaggctccccacccgtactgcacaaccactcactagcttgccttgtccaaggaaaacaagggcgcccagcagactggaggcagtcgccgcgattgccggcaccgagccggcctcttccagccccaccatgccactcccgctgatggccccaagcgagaagttgctttctcctcccgagacttcaagggactttagaagcccccctccactgccaccccgcctgcgtgagatcccccagccacaacagcatcggggaccggagagaggcgtcccagccccacgggctccttgtcacccaccctggctaagtcctggaaggcctcccagatcccctgatccagccctgcaccccctggccctgccgagccctctgtggggggacagcggtgttactggcaagaaggtgaaaggcgccggcggcggcgggtggggcaaggggttcttttag

SEQ ID NO: 129592 - DNA, 1629 bp, Artificial Sequence
  Description of Artificial Sequence: Synthetic coding sequence
atgacatacaggcagcatcgtgacgctgaggaggctcttgactccttcgaggccccagatcccgccggcgctgccaatgcagccaatgccgcgggggcccacgacgggggactcgacgatgaggctggtgccggaggcgggggactcgatggcgccggaggagagctgaaaagactctgttttcaggacgccggaggtggtgccggcgggccgccaggcggggccggaggggccggaggcacctggtggagacgatggcagcccagggtctgggccctgtttgaggatccatactcaagccgcgccgctcggtatgtggcattcgcctctctgttttttatcctgatctcgatcaccaccttttgtttggagacacacgagggttttattcacatttctaataagacagtgactcaagcttcacccatcccgggcgcccctcccgagaacataacgaatgtcgaggtagaaacagaaccatttctgacgtatgtggaaggagtctgtgtggtgtggtttacctttgaatttctgatgcggattacattttgtccagataaagtggagttcctcaaatcctctctcaacatcattgactgcgttgctatcctaccgttttatctggaggtggggctaagtggtctgtcctcgaaggcagcaaaggacgtgctcgggtttctacgggtggtgaggttcgtgcgtatcctgagaatcttcaagttgacccgccacttcgtggggctaagggttctagggcacactctcagggcttcaacaaatgagttcctgcttcttataatatttctggccctgggggtgctaatcttcgctactatgatctactatgcagagcggataggcgccgacccggatgatatccttgggtctaaccatacgtactttaaaaacatcccgatcggtttttggtgggctgtagtcactatgacaacgttgggctacggcgatatgtatcctaaaacttggtccggtatgctcgtgggggcattatgcgcgcttgcgggagttctgacgattgcaatgcctgtgccagttatcgtgaataactttggcatgtactattccttggcaatggcaaaacaaaagctccccaaaaaaaagaacaaacacatacctcggccgcctcagcccgggtcccctaactactgtaaaccggatccgcccccacctcctcctccgcacccccaccacggatccggcggaattagccctcctccacctatcaccccaccaagcatgggagtgaccgtggccggcgcctatcccgccggtcctcacactcacccaggccttcttaggggcggcgctggagggttaggtattatgggactgccacccctccctgccccaggtgaaccctgcccgctggcgcaggaggaagtcatcgagatcaaccgagccgacccccgcccgaatggtgatcctgcagccgccgcacttgcacatgaagactgcccggccatcgatcagcctgctatgagcccagaggataagtcgccgatcacacccggcagtcggggcagatacagtagggaccgcgcctgtttccttctgaccgattacgccccatcacccgacgggagcattcgtaaggccctcgtgactgcatag

SEQ ID NO: 129593 - DNA, 2274 bp, Artificial Sequence
  Description of Artificial Sequence: Synthetic coding sequence
atgttgtctagcgtttgtgtgagcagtttccgggggagacagggagcttcgaagcagcagcctgcccctcccccacagcctcccgagtcacccccaccacctcctctgcccccccagcagcagcagcctgcgcaacccggccctgccgcgtcacccgcagggcctcctgccccccgcggcccgggggatcgacgggccgaaccctgccccgggctgccggcagccgccatgggccgccatggcggcggcggcggtgatagtggtaagattgttattaatgtaggcggcgtgcgacacgaaacgtaccgcagcactctcagaactctacctggaacccgcctggccggactcacagaacccgaggccgccgctagatttgactatgatcctggagccgacgagtttttcttcgaccgccaccctggggtgttcgcatacgtcctgaactattaccggaccggtaaactgcattgtccagctgacgtctgtggccccctgttcgaggaggagcttggcttctggggaatagacgagacagacgtcgaagcatgttgttggatgacctataggcaacacagggatgccgaggaagcattggattcctttgaagctcctgaccccgccggagctgctaatgcagccaacgccgccggggcccatgacgggggtctggacgatgaagccggcgccggcggaggcggtcttgatggtgcgggaggcgaactgaagcgtctgtgcttccaggatgctgggggcggcgccggcggtcccccaggtggggctggcggcgcaggaggcacatggtggagaaggtggcagccacgggtgtgggcgctgttcgaagacccatattcctcccgggcggcacgatacgtcgccttcgcgtccctctttttcatcctgatctccatcactactttttgcttggagacacatgagggctttatccatattagcaataaaacagtcactcaagcgagcccgatacccggggctcctcctgagaacatcactaatgtggaagtcgagaccgagcccttcttgacctacgtggagggggtatgtgttgtttggttcacatttgagttcctgatgaggattactttttgccccgacaaggtggaattcctcaagtccagcttaaacattattgactgtgtcgccattctgcccttctacttagaggtgggtctcagcggtctgtccagtaaggccgccaaagacgtccttgggtttcttcgtgttgtgcgtttcgtccgcatcctccgaatttttaaattgactcgccattttgtgggcttgcgagtgctcggccacaccttgagggcaagcacgaacgaattcctgttactcataattttcttagctctgggagtcctgatctttgccacaatgatatattacgccgagcgcatcggagcagaccctgacgatatcctgggatccaatcacacctactttaagaatatccccatcggcttctggtgggcagttgttaccatgaccacgctgggttacggcgatatgtatccaaaaacttggtccggcatgctggtcggagctctgtgtgcactcgcaggcgttctgactatcgcaatgcccgtgcctgttatcgtcaacaatttcggaatgtattatagtctggccatggctaagcaaaaactgccaaaaaaaaaaaacaaacacattcctcgacccccccagcctgggtccccaaattactgcaaacccgatccaccccctccgcccccccctcacccccaccacgggtccggagggatctcgcctcccccgcctattacgcctcccagtatgggagttaccgtggccggagcctaccctgctggaccccacacccaccccggactgctgcgtggaggcgccggcgggctgggcatcatgggccttccgccactgcctgcaccaggcgagccctgccccctggctcaagaggaagttatagagattaatagagcagatccacggccaaatggagatcccgccgcagccgcactggcccacgaagattgtcctgccatcgaccaacccgcgatgtcccccgaagacaagtccccaataacacccggtagcagagggcgttacagcagagaccgcgcctgctttctcttgacagactacgcccccagtccggacggctccatccgtaaagctactggggctccaccactaccgccccaggattggcgcaagcctggcccccccagttttctgcccgacctgaatgccaacgccgccgcatggatctctccttag

SEQ ID NO: 129594 - DNA, 1908 bp, Artificial Sequence
  Description of Artificial Sequence: Synthetic coding sequence
atgattagctccgtgtgtgtgtcttcttaccgtggtcgaaagagcggaaacaaacctccaagtaaaacatgcctgaaggaggaaatggcaaaaggggaggccagcgagaagataattatcaatgtgggagggacgaggcatgagacctaccgaagcacgctcagaacgctcccaggcaccaggcttgcctggctggcggatccggacggggggggaaggccggagaccgatggagggggggtgggatcttccggctctagtggagggggcggttgcgagtttttctttgaccgccaccccggggtctttgcatacgtgctgaattattaccgcaccggaaaactccactgtccagctgatgtctgcggacccctgtttgaggaagaactgacattctggggaattgacgaaacagatgtcgaaccttgctgttggatgacatataggcagcatagggatgcggaagaagccctggatatcttcgagtctcctgacggtggaggttccggagctggaccgagcgatgaggccggcgatgatgaaagagaactcgctttgcaaagattgggaccccacgagggcggagccggccacggggctggcagcggcgggtgcaggggttggcagccgagaatgtgggcattattcgaagacccttactcctccagagcagcccgcgttgtggccttcgcttctttgtttttcattctggttagcatcactacattctgtctggagacgcatgaggcctttaatatcgacagaaacgtgacggagattcttagagtgggaaatatcacgagcgtgcactttcgccgggaagtggaaaccgagccaatcctcacttatatcgaaggtgtttgcgtgctgtggtttaccttggaattcctggttcgtatcgtatgctgccctgataccctcgactttgtgaaaaatctactgaatataattgacttcgtagccattctaccgttctatctggaagtgggcctcagcggcctgtcctcaaaagccgcacgagacgtgttagggtttctgcgcgtggtccggttcgttcggattcttagaatcttcaagttgactcggcactttgtagggctgcgagtcctaggtcacacgctgagagccagcactaatgaatttctactgttaatcatcttcctggctctaggagtgctgatctttgctaccatgatctattatgccgaaagaattggggctcggccttcagaccctaggggaaatgaccacacggatttcaaaaacataccgatcggcttttggtgggcggtggtgacaatgacaaccctggggtacggggacatgtatcctaagacgtggagcgggatgttagtaggcgccctgtgcgcattggcgggtgtgcttacaattgctatgcctgttccggtgattgttaacaattttggaatgtactactctctcgctatggctaaacagaaactgccgaaaaagagaaaaaaacacgtcccaaggcctgcccagctggaaagtcccatgtactgtaaatccgaggaaacctcaccaagggactctacctgctcagacacgtcaccacccgctagggaggagggcatgatagagagaaagcgcgcggattccaagcagaacggtgacgctaacgccgtccttagtgatgaggaaggcgcgggacttactcagcctctcgccagctcaccaacccccgaggagcggcgagcgctgcgacggtccaccaccagagaccgtaacaaaaaggctgctgcatgttttctgctttcaacaggcgactacgcctgcgccgatggctcggtgcggaagggcaccttcgtgcttcgcgacctgcccctgcaacacagtcccgaggccgcttgcccccctactgccggcacactcttcctgccccattag

SEQ ID NO: 129595 - DNA, 1881 bp, Artificial Sequence
  Description of Artificial Sequence: Synthetic coding sequence
atgatcagctccgtgtgcgtttccagctatagaggtcgtaagtcgggaaacaagcccccttcaaagacatgcttgaaggaagagatggccaagggagaggcttcggagaagatcatcattaacgtcgggggcacacggcatgagacttataggagcacactgagaacactaccaggcacacgattggcttggctcgccgatcccgacggtgggggaaggccagagactgacggcggtggagttggaagctccggtagcagcggcggtggaggttgtgaattttttttcgaccgccaccccggcgtgtttgcatatgttctgaattactacagaacggggaagctgcactgtcccgcagacgtttgcggccctctcttcgaagaagagctcacattctggggtatcgacgaaacagacgtcgagccttgttgctggatgacttacagacagcatcgtgacgcggaagaggcactcgacatttttgaatctcctgatgggggcggatccggcgccggcccatccgacgaagcaggcgatgacgagcgagagctggccctgcagcgattgggaccacacgaaggtggagcaggacacggtgccgggtctggggggtgcagaggctggcaaccccgcatgtgggcattgtttgaggacccctacagttcacgcgctgctcgggtcgtcgcgttcgccagcctcttttttatcctggtttccatcaccactttttgcctggagacacacgaggcatttaacattgataggaacgtaaccgagatccttcgcgtgggtaatattactagtgtgcatttccgaagagaggtggagactgagcctatcctcacgtatatcgagggagtctgtgtgctctggttcaccctggagttcctggttaggatcgtgtgctgtcccgacaccctcgactttgtaaagaacctcctgaacattattgatttcgtggctatcctcccgttctatctggaggtgggactctccggcctttcttctaaagcagccagagacgtgctcgggttcctgcgggtagtcagatttgtgagaatcttgagaatttttaaacttacgaggcattttgtaggactgcgggtgctgggacataccctgagagcatctacaaacgaatttttgttactcatcatattcctggcccttggggtgttgattttcgctactatgatctactatgctgaaaggatcggcgcccggccctctgacccaaggggaaatgaccacactgacttcaagaacatccctattggattctggtgggccgttgtgaccatgacgaccttgggctatggggatatgtatcctaagacctggagcggaatgttggtcggagctctgtgtgcgctcgcaggagtgttaacaatagccatgcctgttcccgtaatcgtgaacaacttcgggatgtattactcactagccatggcgaaacagaagctgccaaagaagaggaaaaaacacgtgccccgaccggcacagctggagtctcccatgtattgcaagtccgaagagacaagcccacgtgattcgacatgcagtgataccagtccacctgcccgggaggaaggcatgatcgagcgaaaaagagccgactcaaaacagaatggcgatgcaaatgccgtattgtcagatgaagagggggccgggctgacccagccattggcttcctcacccacacctgaggagcggagagctttgcgccgctctacaacacgtgacagaaataagaaggccgccgcatgctttctcctgagtactggagattatgcttgtgcggatgggagcgtacggaaggagacctgccaggacgccttatcaagcaattatgcacaggcagaggttcttacactcagctag

SEQ ID NO: 129596 - DNA, 1908 bp, Artificial Sequence
  Description of Artificial Sequence: Synthetic coding sequence
atgattagctctgtctgcgtctctagttacagagggcgtaaaagcggcaacaaaccccctagcaaaacatgtctgaaggaagaaatggctaagggcgaggcaagtgaaaagatcattattaatgtcggcggtacccgacatgagacataccgatccacactgaggaccctgccggggacccgtcttgcctggcttgcggaccccgatggaggggggcggcccgaaacagacggtggaggggtgggatcatcgggatctagtggcggtggtggatgcgagtttttttttgatcgacaccccggagtttttgcgtacgtgctcaattactaccgcacaggcaaattgcactgcccggctgacgtgtgcggaccactgtttgaagaggaacttacattttggggaatcgacgaaaccgatgtggagccctgctgctggatgacctaccgccagcatagggacgcagaagaagctctggacatcttcgagtccccggacggaggtggcagcggagctggacccagcgatgaggctggtgacgatgagcgagagctggccctgcaacggttgggacctcatgagggaggagctggtcacggagcaggttccggcggctgtcggggctggcagcctcgcatgtgggctctatttgaagatccatatagctccagggccgcaagagttgtggccttcgcatccctgttttttatcctggttagcataacaacattctgtctggagacacatgaagctttcaacatagataggaatgtaacagagatcctgcgggttggtaatataacttcagtacattttagaagagaggtggagaccgagcccatcctgacctacatcgaaggcgtatgcgtcctatggtttactcttgaatttttagtgcgcattgtctgttgtccagacaccctcgacttcgtcaaaaacttactgaacatcattgacttcgtggccatccttcccttttacctggaagtgggcttgtccggcctttcatccaaagccgcccgagacgtcctaggctttctcagggtggtgaggttcgtccggattctgcggattttcaaactcaccagacacttcgttggactgcgcgttctggggcataccctacgggcatcgaccaacgaattcctcctgcttattatctttttagctcttggggtgcttatcttcgccacaatgatttattacgcagagagaattggcgccaggccaagtgacccaaggggcaatgatcacaccgattttaagaatatcccgattgggttctggtgggcggttgtcactatgaccaccctcggatacggcgatatgtacccaaagacatggagcggtatgcttgttggcgcactctgcgccctcgcaggcgtacttaccatcgctatgcccgttcccgtaatcgtcaataacttcggcatgtactattcattggctatggcgaagcagaaactgcccaagaagcgcaaaaagcatgtgcctagaccagcgcagctggaatcaccaatgtactgcaagtcagaggagacatctcctcgcgattctacctgttccgacacatcacctccagcccgcgaggagggaatgatcgaaagaaaacgcgcagattccaaacaaaatggggatgcaaacgctgtactttccgatgaggaaggtgccggattgacccagcctctagcctcatccccgacgcccgaagagagaagagcactgagaaggtccaccactcgagatcggaacaagaaggctgctgcatgctttttactcagcaccggtgactacgcttgtgcagatggcagcgtgcgaaaagggacttttgtcctcagggatctgcctctacaacattccccggaggccgcttgccctcccactgcaggtactcttttcttgccccactag

SEQ ID NO: 129597 - DNA, 1485 bp, Artificial Sequence
  Description of Artificial Sequence: Synthetic coding sequence
atggacggctctggagagcggtccctgcccgaacctgggtctcagagcagcgccgcctcagacgacattgagattgtagtgaacgtggggggtgtgaggcaggtgctctacggggacctcttgtcccagtatcctgagacccgactagccgaactcataaattgcctggccggaggctacgatactattttttccctttgtgacgactacgatcctgggaagcgagaattctactttgacagggaccctgatgccttcaaatgcgttatcgaggtgtattattttggggaggtgcatatgaaaaagggaatctgcccaatttgcttcaaaaatgagatggacttctggaaagtggacctgaagttcttagatgactgttgcaaatctcacctcagcgagaaaagggaagaactggaggagattgcccgccgggtgcaactgattcttgacgatttgggtgtggacgcagccgagggtcggtggcgccggtgccagaaatgcgtgtggaaatttctggagaaacctgagtcttcctgcccagctagagtggtcgccgtcctcagctttctactgatcctcgtctctagcgttgtgatgtgcatgggtaccattccggaactgcaagtcctagacgcggagggaaaccgtgtggagcatcctaccctggagaatgtcgaaacagcctgcataggctggtttacgctcgaatatttgctgaggctgttttcatcacctaataaattgcattttgccttatcatttatgaacatcgtggatgttctcgctatcctgcctttctatgtgtccctgacccttacgcatctgggcgcaagaatgatggagttaaccaatgtgcagcaggcagtgcaggctctgagaattatgcgaatcgcccggatctttaaactggccaggcacagtagcggcctgcagacacttacctatgccctcaagaggtcattcaaggagctgggcttactcttaatgtacttggccgtggggatctttgttttttcagcccttgggtatacaatggagcaaagccaccccgagacgttgttcaagtctattccacaaagtttctggtgggcaatcatcacaatgaccacggtcggatacggcgatatctatccaaagaccaccttaggcaagctcaatgcagcgatttcttttctctgcggggtaatagccattgctctccccatccaccccataatcaacaatttcgtgagatactataacaagcagcgcgttcttgaaaccgccgccaagcacgaactggagctgatggaactgaacagtagcagcggaggggaggggaaaaccgggggttctcggtccgaccttgataatctgcctcctgaaccagcggggaaagaggctccctcttgctcgtccaggctgaagttatcgcactcggacacgttcatacccctgctgaccgaagaaaaacatcaccggaccaggctgcagtcatgcaaatag

SEQ ID NO: 129598 - DNA, 1542 bp, Artificial Sequence
  Description of Artificial Sequence: Synthetic coding sequence
atgactctgctgcccggcgataatagcgactacgattacagcgccctatcctgcacaagtgatgccagttttcatccagcattcctgccgcagcgacaagccatcaagggggctttttatcggcgggcacagcggctccggccacaggacgagccccggcagggctgccagccggaggaccgcagacggcggatcatcatcaacgtcggcggcataaaatattctttgccttggacgactttagatgaatttccactgacacgattggggcaactgaaggcctgcactaatttcgacgacatcttgaacgtttgcgatgattacgatgttacatgtaatgaatttttttttgatcgcaatcccggcgcgttcggaacgatcttgacattcctacgtgctggcaaactacggcttctccgtgagatgtgcgctctgagcttccaggaggagttgctgtactggggaatcgccgaggaccatctggacgggtgttgcaaaagaaggtacctgcaaaagatcgaggaatttgccgaaatggtggagagggaggaggaagacgatgcccttgattccgagggcagggattctgaggggcccgccgagggagaagggcggctggggcgctgcatgaggcggttgagggacatggtggagcggccccatagcggcctgcccggcaaggtattcgcctgtctgagcgtgctatttgtgacggttactgccgtaaatttatccgttagcaccctccccagcctgagggaggaggaagagcaaggacattgcagtcaaatgtgccacaatgtgtttatagtggaatctgtatgcgtggggtggttttcattggaatttttactcagacttattcaggcaccaagcaaattcgctttcctgaggtctcccctgacactgatcgatctggtggcgattctaccatattacattacactcctggtggatggggcggccgcaggaaggcgcaagccgggggcgggaaattcatacctcgataaggtcggactcgtcctgcgcgtgctaagagccctccgcatcctctatgtgatgcggctcgctaggcatagccttgggctacagactctcggactcactgcaagacgttgtactagagagtttgggctgctgctgctgtttctgtgcgtggcaatcgcccttttcgcgccgctactgtatgtgattgagaacgagatggccgacagccccgagttcacctcaatcccggcatgctattggtgggccgtcatcaccatgaccacagtagggtacggggacatggtgcccagatcgacaccaggtcaggtggtggctctatcctccatcttaagtggcatacttctgatggctttcccagttacatccatattccatacattctcgcgctcatacttagagctgaagcaggagcaggagagagtgatgtttcggagggctcagtttttgataaagacgaagtcgcagttatccgtgtcacaggacagtgatatcctcttcggtagcgcatcctccgatactcgagataataattag

SEQ ID NO: 129599 - DNA, 828 bp, Artificial Sequence
  Description of Artificial Sequence: Synthetic coding sequence
atgacactgcttccaggcgacaactcagattatgactatagcgccctaagctgcacctctgacgccagctttcacccggctttcttgcctcagcggcaagcgattaagggagcattctataggcgcgctcagcggctaagaccacaggatgagcctaggcaaggttgtcaaccagaagaccggcggagacggatcattatcaatgtgggagggattaagtactctctaccttggaccaccttggatgagttcccactcaccaggctcggccagctgaaggcttgcactaattttgatgatatacttaacgtgtgtgatgattatgacgtcacttgcaacgaatttttctttgatcgaaatccaggggcatttggcaccatcctcaccttcctgcgggcaggaaagctccggcttctccgggagatgtgtgcactgtccttccaggaggagttgctctactggggcattgcagaggatcacctggatggatgctgcaaaagaaggtacctgcagaaaatcgaggagtttgcagagatggtcgagcgggaagaggaggatgatgcccttgatagtgagggccgggacagcgagggaccagccgagggagagggcaggctggggaggtgtatgaggcggctcagagatatggtggaaaggccgcatagcggcctccccgggaaggtcttcgcatgcctcagtgttctatttgtaactgtcacagcagttaacctctcagtttctactctcccctctttgcgcgaggaggaagaacaggtgcgtgcccatgcgccccgcggcaacgctccgccccgcggaaaagggctgtag

SEQ ID NO: 129600 - DNA, 543 bp, Artificial Sequence
  Description of Artificial Sequence: Synthetic coding sequence
atgacgctgcttccaggcgataattctgactatgactactccgccctcagttgcacgagtgacgctagtttccaccctgcgttcttaccacaaagacaggctatcaaaggtgccttttatagaagagcccagagactgcgccctcaagacgagcccagacaagggtgtcagcccgaggatcgccgacggcgcataatcataaacgtgggcggtattaaatacagcctgccctggaccacgttggatgagtttccactgaccagactgggccagctgaaggcgtgcactaattttgatgatatactgaatgtctgcgacgattatgatgtcacatgcaacgagttcttttttgacagaaatcctggggcctttggaacaatcctcacatttttacgagccggcaagctacgactgctccgggaaatgtgcgcactttcgtttcaagaggaactgctttattggggcatcgcagaagaccacctggatgggtgttgtaaaaggaggtacctgcagaagatagaggagttcgccgaaatggtctag

SEQ ID NO: 129601 - DNA, 291 bp, Artificial Sequence
  Description of Artificial Sequence: Synthetic coding sequence
atgactcttctgccgggagacaactctgactatgactactctgccctgtcatgtacaagtgatgcgagcttccaccccgcctttctcccccagcgccaggcaattaagggtgctttctaccggcgcgctcaacgcctgagaccacaggatgaaccccggcagggatgccagccagaggaccggcggcgacggatcattattaacgttggaggcatcaagtacagccttccttggactaccctagacgagtttccactgacacgcttaggccagcttaaagcctgtacgtag

SEQ ID NO: 129602 - DNA, 777 bp, Artificial Sequence
  Description of Artificial Sequence: Synthetic coding sequence
atgaccctattgcctggagacaacagcgattatgactattccgccctctcttgcactagcgacgctagcttccaccccgccttcctgcctcaacgccaagcaatcaagggagccttctatcgccgcgcccagcgtctgagaccacaggacgagcccaggcagggttgtcagcccgaggaccgaagacggcgtattattattaacgtgggtgggatcaagtacagccttccctggaccacgctggatgaatttcccttgacgcgcctcgggcagcttaaagcctgcactaacttcgatgacatcctaaatgtgtgtgacgactatgatgtcacatgtaacgaattcttttttgacaggaatccaggcgcctttggaaccatccttacttttctgagagctgggaaactaagactgttgagggagatgtgcgctctgagctttcaggaagaactgctgtactggggaattgctgaggaccatctcgatggatgttgtaaacggagatatctgcaaaaaatcgaggaattcgccgagatggtagaacgggaagaggaggatgatgcactcgactctgagggcagggattccgaaggacccgcggaaggagaagggagactggggagatgcatgagaagactgagagatatggtcgagaggccacatagcggcttgcccgggaaggtgtttgcttgcctttctgtgttatttgtcactgtgaccgccgtaaacttgtccgtgagcacactgcctagcctgagagaggaggaggagcaatag

SEQ ID NO: 129603 - DNA, 147 bp, Artificial Sequence
  Description of Artificial Sequence: Synthetic coding sequence
atgactctgctcccaggggacaatagtgattatgattactctgcactgagctgcaccagtgacgcatcctttcatcccgcctttctgccacaacggcaggcaattaaaggggccttttatcggcgcgcccagaggttacgcccatag

SEQ ID NO: 129604 - DNA, 1311 bp, Artificial Sequence
  Description of Artificial Sequence: Synthetic coding sequence
atgacctttggcaggagcggtgcagcttccgtcgttctcaatgtgggtggagctagatactctttatctcgggagttactgaaggacttcccactgcgccgggtgtctaggttacacgggtgtaggtcagaacgggacgtgctcgaggtgtgcgatgactacgatagggaacgaaacgaatatttcttcgaccggcactccgaagcctttgggttcatcctgctgtacgtgcgaggccacggcaagctcagattcgcgcccaggatgtgtgaactgtcgttttacaacgaaatgatctattggggcctggaaggtgctcacctggaatactgctgccaacgaaggctggatgatcgcatgtctgatacctacaccttctattccgcggatgagcccggcgtgctagggcgtgatgaggcgcggccgggcggcgctgaagctgcaccaagccggcggtggcttgaacggatgcgccgtacgtttgaagagcctacttcgtcattggccgcccagatcctggcaagcgtgtccgtggtgttcgtgatagtgtctatggtcgtgctctgcgcctcgacgctgcctgattggcgaaacgcagcagctgacaataggtcactggatgataggtcccgatacagtgctggccctggaagggaaccgagcggaattattgaagccatatgtatcggctggttcaccgctgagtgcattgtgagattcatcgtatccaaaaacaaatgcgagtttgtgaagcggccactaaatattatagacctgctcgccattaccccctactatatttccgtcctcatgactgtcttcactggcgaaaattctcaactgcagagggccggagtcacactgcgcgtgttaaggatgatgagaattttttgggtgatcaagctggctagacattttatcgggctgcaaaccctgggcttgacactaaagcggtgctatagggaaatggtaatgctgctagtttttatttgcgtggccatggctatctttagtgccctgtcacagctgctggagcatggtctggaccttgagacctccaacaaggacttcacttccataccagctgcatgctggtgggtcatcatcagcatgactactgtgggctacggggatatgtatccaattaccgtacctggccgaattttgggaggggtgtgcgttgttagtggcatcgtgctgcttgccctgccaattacgttcatctatcactcatttgtccaatgctatcacgagctgaaatttcggagcgctaggtattcacgatcactgtctaccgaatttctaaactag

SEQ ID NO: 129605 - DNA, 1278 bp, Artificial Sequence
  Description of Artificial Sequence: Synthetic coding sequence
atgacattcggtcgcagtggcgctgctagtgtcgtcctgaacgttggaggcgcgagatattctctgtcaagagagctgctgaaggatttcccgcttagaagagtgtctcgactacacgggtgccgaagcgaacgggacgtgctggaggtgtgtgacgactatgaccgggagcggaatgaatattttttcgatcggcacagcgaagctttcgggttcatcctgctgtatgtccgaggtcacggcaaactacgattcgcaccccgtatgtgcgaactctcattctataatgagatgatttactgggggctggagggcgcccacttggagtattgctgtcaacgccggttggacgacaggatgtcggacacatatactttttactcggctgatgagccgggcgtactcgggagagacgaggcccgcccagggggagccgaagccgccccgtcgagaaggtggcttgagagaatgcgccgcactttcgaggaaccaacaagttcactcgcggctcagatcttagcctctgtcagcgttgtgttcgtgattgtcagtatggtggtgctctgtgccagtacgcttcccgattggcggaacgccgcagctgacaaccgatcattagacgatcgatccagaatcatcgaagccatttgtatcggctggtttaccgcggagtgtatcgtccggtttattgtttcaaaaaacaagtgtgagtttgtgaagcgccccctgaacataatcgacctcctagccatcaccccatattatatcagtgtgctcatgaccgtgttcacaggcgaaaactctcagctgcaacgtgccggcgtcacacttagggtcctacgcatgatgcgtattttttgggtgatcaaactcgcccgccactttattggcctgcagactctcggcttaacgctgaagaggtgctatcgtgagatggtaatgctgctagtgttcatttgtgtcgctatggccattttttccgcgctgtctcagttgctggagcacggactggacctggaaacatcgaacaaggactttaccagcattccggctgcatgctggtgggtgatcatcagcatgactactgtgggatacggagacatgtatccgatcacagtgccaggaaggatactcggcggagtgtgcgttgtttcagggattgtgctgttggcacttcccataacatttatctatcactcatttgttcagtgttaccacgaattaaagttccgaagtgccaggtactcccggtctttatccaccgagttcctcaattag

SEQ ID NO: 129606 - DNA, 1560 bp, Artificial Sequence
  Description of Artificial Sequence: Synthetic coding sequence
atgccaatgccaagtagagacgggggcctgcacccacgtcatcatcattacggcagtcactcgccgtggagtcaattactgagctcaccgatggaaacgccctctattaaggggctttactatagaagggtccgaaaggtcggcgccctggacgcctctcctgtggatctgaagaaagaaatcctgattaacgtggggggaagaagatacttactcccttggagcacgctggatcgctttcctctctctagactgagcaagctgaggttatgtcgaagctacgaggagatcgttcagctgtgcgacgattacgatgaggactcgcaagagtttttctttgatcgcagcccgagtgcttttggggtgatcgtcagcttcctagccgccgggaaactcgtccttttgcaggagatgtgcgcattgtcctttcaggaggaactcgcttattggggaatcgaggaggcgcatctggaaaggtgctgtctgcggaaattgctgcgtaagttggaagagctagaagagttggccaaactgcaccgagaggatgtcctgcggcagcaacgcgaaacgagacggcccgccagccatagctccagatggggattatgtatgaaccgtctgagagagatggttgaaaatccacagagcggattacctggtaaagtttttgcctgtttgtcaattttgtttgtggccactactgcagtctccctctgcgtgagtacaatgccagatttgagagctgaagaagaccaaggggaatgctctagaaaatgctactacatttttatagtggagaccatctgcgttgcatggttctcacttgagttctgcctgcgattcgttcaagcacaagataaatgtcaattttttcaaggccctcttaatataatcgacattctggcaattagcccatactatgttagccttgctgtgagtgaggagccccccgaggacggcgagaggccgtcagggtctagttacctggagaaagtcggactggtgttaagggtcctcagggccctcagaatcctttacgtcatgcgactggcgagacactcgctaggcttgcaaaccctgggcctgacggtgagacgctgtacccgggaatttgggcttcttctgctgtttctggctgtcgccataacactgttttcccccctggtgtatgtggctgagaaagagtcaggcagagtgctggagtttacctccataccagcatcttactggtgggccattatatccatgacgactgtgggatatggagacatggttcctcgatccgtccctgggcagatggtggcgctgtcctctattctcagcggtatattgatcatggcctttcccgccacttccatcttccatactttttcacattcctacctcgaactgaagaaagagcaggaacagctgcaggccagactgaggcaccttcagaatactggtcccgctagcgaatgtgaactgctggacccccatgttgcgtcagaacacgaactgatgaacgacgtcaatgatctcatactggagggacccgctttgcctatcatgcacatgtag

SEQ ID NO: 129607 - DNA, 2970 bp, Artificial Sequence
  Description of Artificial Sequence: Synthetic coding sequence
atgaccatggccgggggaagaagaggactcgtggctcctcagaacacattcctggagaatatagttcgcaggagcaatgataccaactttgttctcgggaatgcccagatagtggactggcccatcgtgtatagcaacgatggtttctgcaagctaagcggctatcacagagccgaagttatgcagaagagtagtacttgctctttcatgtacggggagctgaccgataaagatacgatcgagaaggtgcggcagacttttgagaactacgagatgaacagtttcgaaattttgatgtataagaagaaccggactcccgtgtggttttttgtcaagatcgccccaatccgcaacgagcaggataaagtcgtgctgtttttgtgtactttctccgacataaccgcgttcaaacagcccatcgaggacgactcttgtaaaggttgggggaagtttgcgagacttacaagggcactgacgagcagtaggggggtgctccagcaactggcgccctctgtgcaaaaaggcgagaacgtccataaacacagcagactagccgaagttctccagctcggatctgatatcctgccccagtacaaacaggaagcccctaagacccctccccacatcattctccattactgtgtgttcaagacaacttgggactggataatactgatactaacattctatactgctatattggtgccctacaatgtgtcctttaaaaccagacagaacaatgtggcctggctggttgtagatagtattgtcgacgtgatcttcctcgtggatatcgtgctgaatttccataccaccttcgtcggcccagccggcgaggtgatttcagaccctaaactgatcagaatgaattacctgaaaacatggttcgtgatcgacttgctgagctgtctcccatacgatgtcattaatgcattcgaaaacgtggacgaagtgtccgcttttatgggggatcccgggaagattggatttgccgaccaaattcctcctcctctagaaggtagggagagtcaaggaatatcaagcttattttcaagtcttaaagttgtccggctgttgcgtctgggcagagtcgcacgtaagttagatcattacattgaatacggagccgcggtgctggttcttctagtgtgtgtcttcggtctcgccgcacactggatggcgtgcatctggtatagcattggcgattatgaaattttcgacgaggacactaagactattcggaataatagttggttgtatcagttagccatggacatcggaacgccttatcagttcaatgggtcaggctcaggcaagtgggagggaggtccttccaagaacagcgtgtacatcagctctctatacttcaccatgacttctttaacaagcgtgggcttcgggaatatcgcaccttctacagatatcgaaaagattttcgccgttgccatcatgatgatcggctcactactgtacgcgacaatctttgggaatgtaacgacgatattccagcagatgtacgccaatactaacaggtaccatgaaatgttaaatagtgtaagagacttcctgaaactgtaccaggtcccaaagggcctttccgaacgtgtgatggactacatcgtgagcacatggtcaatgagcaggggcatagacaccgagaaggtcctccaaatctgcccaaaagacatgcgggccgatatttgcgtacacctaaaccgaaaagtttttaaggagcatcccgcctttagattagccagcgacgggtgtttaagagccctcgctatggagttccagacagttcattgtgctccaggcgacctgatttatcacgcaggcgaaagtgtagattctctttgttttgtggtcagtgggagtttggaagtaattcaggatgatgaggtcgtggccatactgggtaaaggggacgtgttcggagacgtattctggaaggaagccactttggctcagagctgtgccaatgttcgggccctcacgtattgtgatctccacgtcatcaagagggatgctctgcagaaagtgctggagttctatacagccttcagccattcatttagtcgtaatcttatcctaacgtataatctgcggaagcgaatcgtgttcaggaaaatcagcgacgtaaaacgagaagaagaggagagaatgaaacggaagaacgaggctcccctcatcctgccccccgaccacccggttagaagactctttcagcggtttcgacagcagaaggaggctcggctggcagccgaacgcggaggtagggatttggatgacctggacgtggaaaaaggcaatgtgcttactgagcacgcttcagccaaccactcactggtaaaagcctcagttgtgactgtgcgggaatcacctgcgacccccgtttccttccaggcagctagcacctcaggggtgccggaccacgccaaactgcaggcacccggaagcgaatgcctgggccccaaaggggggggcggcgattgcgccaagcggaagtcctgggctcggttcaaggatgcttgcggcaagagcgaggattggaacaaggtctctaaggcagaatcaatggagacacttccagaacggactaaggcctccggggaagccactttgaagaaaaccgactcatgcgactctggcattaccaaatcagaccttcggctcgataacgtgggtgaggccaggtcgccccaggaccgaagccctatcctggccgaagttaagcattcattttacccaatcccagaacagactctgcaggcgacggtgcttgaagtacgccatgagttaaaggaagacatcaaggctctcaacgcgaaaatgacaaacattgagaagcaactgagtgagatcttgcgcattctgacgtccaggcgctctagtcagtcgccccaagaactcttcgagatttctcgtccccagagtccagaaagcgagcgggacatttttggggcatcctag

SEQ ID NO: 129608 - DNA, 2889 bp, Artificial Sequence
  Description of Artificial Sequence: Synthetic coding sequence
atgacaatggccggcgggaggcgcggtctggttgctccccagaacacattcctggagaacatcgtgcgaagatctaacgacactaatttcgtgctgggtaatgctcagattgtggactggcccatcgtctatagtaatgatggattctgcaaattatcaggataccaccgcgccgaggtgatgcagaagtcctccacttgctctttcatgtacggcgagttgactgataaagacacgatagagaaagtgaggcagacattcgaaaattacgagatgaatagtttcgagatcctcatgtacaaaaaaaacagaacacccgtgtggttttttgtaaaaatcgcccctatccgcaatgagcaggacaaagtggtgctgtttctgtgtaccttctccgatatcacagcattcaagcaacctattgaggacgacagctgcaaagggtggggaaagttcgcacgtctgaccagggccttaacttcctctaggggggtcttgcagcagttagcccctagcgtgcagaaaggagagaacgtgcacaagcacagtcggctggctgaagtgctccagcttggctctgacatcctcccccaatataagcaagaagccccaaagacacctcctcatataatcttgcactattgcgtgtttaaaacaacctgggattggattattctcattttgacattttacaccgccatcctggtgccctataatgtatcttttaaaacacggcagaataacgttgcgtggctggtagtggatagtatcgtggacgtcatattccttgtggacatcgtactcaactttcataccaccttcgtggggccagcaggggaggtgattagcgacccaaaactgataagaatgaattacttaaagacatggttcgtcattgacctgctgagttgcttgccttatgacgttataaatgcatttgagaacgtcgacgaaggaatctcctctctgttctcttctctcaaggttgtcagactcctgcgcctggggagagtcgcgagaaaattggatcactatatcgaatacggagcagccgtcctagtgctcctggtttgtgtctttggactagcggcccactggatggcgtgtatttggtatagcatcggtgattatgaaattttcgatgaagatacaaaaaccattagaaataactcctggctgtatcagctcgcaatggatatcgggactccataccagttcaacggaagcggttctggtaagtgggaaggcggcccctccaaaaactccgtgtacataagttctctctatttcaccatgacctccctgaccagtgtcggcttcggcaacatcgcgccatcgactgacatcgagaaaatctttgccgtagccattatgatgatcggttctttgctgtatgccacaatattcggaaacgtcacaactatcttccaacagatgtacgcaaacacgaatcggtatcacgaaatgctgaattccgtgcgggacttcctaaaattatatcaagtgccaaaaggactgtctgaacgggtaatggactatatagtgtcaacatggagtatgtcacgagggatcgataccgaaaaggtgctccaaatttgcccgaaagacatgagggctgatatctgcgttcatttgaacagaaaagtcttcaaggagcatcccgcattcaggctggcgagcgatgggtgcctgcgcgcacttgccatggagttccagaccgtgcattgtgctccgggagatctcatctatcacgcgggcgagagtgtagactcactgtgcttcgtggtgtccgggtccttggaggtcattcaggatgacgaggtcgtggctatcctcggtaagggggatgtgtttggtgatgtgttctggaaggaggcgacgttggcgcagagctgcgccaatgtgagagcccttacatactgcgacttgcatgtgatcaaaagagatgctctgcagaaggtgctggaattttataccgcattcagccactccttctctcggaatctcatcctaacttacaaccttcgcaaaaggattgtgttcagaaaaatatcagatgtgaaacgcgaggaagaggagcggatgaaacggaaaaacgaggcaccactgatcctgccacctgatcatcccgtgcgtagattgtttcagcggttccggcagcaaaaggaggccaggctcgcggccgagcggggaggtagggacctcgacgacctagatgttgagaaggggaacgtactgacagagcacgcttctgccaatcattcactggtcaaggcctcagtggtgacagtacgcgagagccctgccacaccagtgagctttcaggccgcctccacttccggtgttcctgaccacgctaagctgcaggcacctggcagtgagtgtctgggccctaagggcggcggtggcgactgtgcaaaacgcaaatcatgggcccgattcaaggacgcctgtggcaaaagtgaagactggaacaaagtcagcaaggccgagtccatggagacgttgcctgagcgcacgaaagcctcaggtgaagcaaccctgaagaagacagacagttgcgattcaggcatcacgaaatccgacctaagacttgataacgtcggcgaggcgcggagtccccaggataggtcccccatcttggctgaggttaagcatagcttctatcccattccagagcagacactgcaggccactgtactggaggttaggcatgagctgaaggaggacattaaagctctcaatgctaaaatgacaaacatcgaaaaacagctaagcgaaatcctcagaatcctgacatctcgaaggagcagccagtctcctcaggaactgtttgagatctcccgcccacaatctccagaatccgaacgtgatatttttggggctagctag

SEQ ID NO: 129609 - DNA, 3480 bp, Artificial Sequence
  Description of Artificial Sequence: Synthetic coding sequence
atgcccgtgcggcggggccacgtcgcccctcagaacacattcctagataccatcatccgcaaattcgaaggacaatcaagaaagtttatcatagccaatgcgcgcgtggagaattgtgctgtgatctactgtaacgacggattttgcgagctgtgtggctactcccgggcggaagttatgcaacgcccctgcacttgtgacttcctgcacggaccacggacacagcgcagagccgcagctcagatagctcaagccctcttaggagcagaggaaagaaaggtggaaatcgcattttatcgaaaggatggatcgtgtttcctgtgcctggtggatgttgtaccagtcaagaatgaagatggggcagtcatcatgtttattcttaatttcgaagtggtgatggagaaggatatggtaggatcccccgctcacgatacaaatcatagaggaccacccacttcttggttggcaccaggccgggccaaaactttcagacttaagttacctgcgcttctggcactcactgcaagggagtcgagcgtgagaagtggaggggcaggtggggccggtgcccctggcgctgttgtcgtggacgtggacttaactcccgccgccccatcatccgagtcattggccttagatgaggttacggccatggataatcacgtagcaggactggggcctgccgaagagaggcgggctctggtgggcccgggttcacctcccagatctgcacctggacagctcccctccccgcgggcccatagtctcaacccagatgcctctgggagctcttgctcacttgcaagaactcggagtagagaaagctgtgcttccgtcaggcgggcatccagcgcggatgacatagaggcaatgagagccggggttcttcctccccctccacgccacgccagtaccggagccatgcaccctttacgcagcgggctgctgaattcaacatcagactccgacttagtcagatacaggactatctctaagattccccagataactctgaattttgtggacctgaagggagaccccttcctagccagtcctaccagcgatcgggaaattatagcccctaagataaaggaaagaacccataacgtcacagaaaaagttacccaggtactgtccctgggcgccgacgtacttcccgaatacaagctgcaggccccgagaattcaccgctggacaatcctgcactacagtccattcaaagcggtatgggattggctgatcctgctgctagtgatctacaccgccgtttttaccccatatagcgctgccttcctgctgaaggagacggaagaaggtccacccgcaacagagtgcggatacgcttgccaacccttggctgtggtagatctcattgtcgacatcatgttcatagttgacattctgattaattttcgcactacttatgttaatgccaatgaagaggtcgtcagccaccctggacgcatagctgtgcactactttaagggctggttcctgatcgatatggtggctgcaatcccatttgacttgctgatctttggctcggggagcgaagaactgatcgggctgctaaagaccgccagactgcttaggctggtccgcgtggccaggaagctggacagatattcggagtacggagccgccgtcctcttcctacttatgtgcacctttgcattaatcgcacattggctcgcctgcatctggtacgccatcggcaatatggaacagccacatatggactctaggattgggtggctccacaatctcggcgatcagatcgggaagccatataatagcagtgggctcggggggccatctatcaaggacaagtacgtgactgcactctattttactttcagttctttgacatcagtcggctttggaaatgtcagtccgaatacaaactccgagaaaatcttctctatttgtgttatgcttatcgggagtttgatgtacgctagtatctttggtaatgtgtcagcgataattcaacggctgtactcaggcaccgcaagataccacacccagatgctcagagtgcgggaatttattaggttccaccagattcctaatcccctacggcagcgactggaggaatacttccagcatgcatggtcctataccaacggaattgatatgaatgccgttttgaaggggttccctgaatgtcttcaggcagatatctgccttcacttgaacaggagcctacttcagcactgcaagccatttaggggcgctactaagggatgcctcagggccttggctatgaagtttaagaccacccatgctccccccggagatacccttgtccatgctggagacctgcttacagctctttactttatcagtcgggggagcatcgaaattctgcgcggcgacgtagttgtggcgatcctgggtaaaaacgatatatttggggagcccctgaacttgtatgcaaggcccggcaagtctaatggcgatgttagagcccttacctactgtgacctgcataagatccatcgtgacgatctattggaagtcttggacatgtaccccgagtttagcgatcacttctggagcagtctggagattacttttaacttacgtgataccaatatgatccctgggtcacctgggtcaactgagcttgaaggtggctttagcaggcagcggaagcggaaactgtccttccgacggcgaacggataaggatacagagcaaccgggggaggtgagcgccctggggccaggaagagcgggagccggcccaagctcccgagggaggcccggagggccgtggggagaatcaccttcaagcggcccatcctcgcccgagagctccgaggatgaaggcccggggcggtcttcctctccactgcggctagtgccattttcttcaccacgcccccccggcgagccacctggcggtgagcctcttatggaagattgtgaaaaatcaagcgacacttgcaatcccctaagcggggccttcagtggagtgagtaatatctttagtttctggggcgattccagaggtaggcagtaccaggaacttcccaggtgtcccgcccctaccccgtctttgctcaacatccccctttcaagtcccgggagacgaccaaggggggacgtagaatcgcgactggacgctctccagcggcagctcaatcgactggaaacgagactgtctgccgacatggctacagtactgcagcttctgcagcggcagatgaccctcgtgccccctgcatattccgccgtcactacccccggaccagggccaacctcgacatccccccttctgccggtgtcccccttgcccaccttgacacttgatagcctctcccaggtaagtcagttcatggcctgtgaggaattaccacctggcgccccagagctccctcaggaaggacctacgcgcagacttagcttacccgggcagctcggcgcgctgacgtcacagcctttgcatcggcatgggagtgaccctgggagctag

SEQ ID NO: 129610 - DNA, 2460 bp, Artificial Sequence
  Description of Artificial Sequence: Synthetic coding sequence
atggccgctcctgctgggaaggcatcgcggaccggggctctgaggccacgagcacaaaaggggagggtccgccgcgctgtgcggattagcagcttggtggcccaagaggtgctctcactaggggccgatgtgcttccggagtacaaactccaggcacccaggatacacagatggacaattctgcactacagtccgttcaaggctgtctgggattggctcattctgttactggttatatacacagccgtgtttactccttattcggcagccttcctgctcaaagagacagaggagggcccacccgcaactgaatgcggctatgcgtgtcagccactcgccgtcgtggacttgatcgttgacatcatgtttatcgtggacatcctgatcaactttcgtactacttacgtgaacgctaatgaagaggtggtctctcaccctgggaggattgcagtgcattacttcaagggatggttcctcatcgatatggtggccgctatccccttcgatctgttaatcttcggaagcgggtctgaggagcttattggcctgctcaagactgctcggctgcttcgcctggtgcgagtggcccgtaaactagatcggtattccgagtacggggccgcagtcttgtttttgctaatgtgtacgttcgccctgatcgcccactggttggcctgcatctggtacgccattgggaacatggaacagcctcacatggactctcgcattgggtggttgcacaatctgggtgatcagatcgggaagccatataactcttctgggctgggcgggccatcgatcaaagacaagtacgtcacggccttgtacttcactttcagttcactgacttcagtggggtttggaaatgtttccccgaataccaactcagaaaaaatttttagtatctgcgtgatgcttattggctccctcatgtacgcctcaatctttggaaacgtgagcgccattattcaacggctgtacagcggtacagcgagataccacacgcagatgctgcgtgtgagggaatttatccgtttccaccagattccaaaccctctgaggcaaagactggaggaatactttcagcacgcatggagctacacgaatggtatcgacatgaacgcagttttgaagggctttccggagtgtctgcaggccgatatctgccttcacctgaataggtctctactccagcactgcaagcctttcaggggggcaacaaagggatgcttgcgggcacttgcaatgaaattcaaaactacacatgccccacccggagatacactggtgcatgccggagacttgctgaccgctttatatttcatctcccgtggctcgattgaaatattgcgcggggacgtggtagtggctatcctggggaagaacgacatctttggcgaacctcttaacctctacgcccgacccgggaagtccaacggggatgtgcgagctctcacatattgtgaccttcacaaaattcatcgggatgacttgttagaagtactggatatgtatccagaattctctgaccatttttggagcagtctcgaaataacatttaacctccgtgatactaatatgattcctggctctcctggctcaaccgagttggagggcggcttctctagacaacgaaagcgcaagttgagctttcggcgcagaactgacaaggatacagagcagccgggagaggtatctgccttaggccccggccgagccggcgccggtccgtcctctcgaggccggcctggaggcccttggggcgaaagcccatcctcagggccatcatcccccgaatcatccgaggacgaagggccaggcagatccagctctcccctccgtctggttcccttcagttcgccaaggcctcccggtgaaccccctggaggggagcctctgatggaggattgtgaaaagtcttcagacacatgcaacccactaagtggggcattctccggggtgagtaatattttctcattttggggcgattcccgcgggcgccagtaccaggaactcccacggtgcccggctcctaccccctctcttttgaacatccctctgtcatcaccagggcggcgtccgcgaggcgacgtggaaagtagactggatgctctgcagcgacagctgaatcggctggagacgaggctatcagccgatatggcaactgtacttcagttgttgcaacggcagatgacattagtccccccagcatactcagcagtaactacaccaggccctgggcccacctccacctccccactgctgcctgttagccccctcccgaccctcactctcgatagcctgagccaggtcagccaattcatggcttgcgaggaattaccccccggagcacctgagctgccccaggagggacctacccgaaggttgtccctgcctggtcaactcggtgctctgacatctcagcctctgcatagacatgggtccgaccccggaagctag

SEQ ID NO: 129611 - DNA, 1182 bp, Artificial Sequence
  Description of Artificial Sequence: Synthetic coding sequence
atggcggcccccgcaggaaaagcatcacgtactggagctttgcggccccgggcccagaagggtagggtccgccgcgccgtcaggatcagcagcctggtggctcaagaggtcttatctctcggagcggacgtgctccctgaatacaaactgcaagcccccagaatccatagatggaccatcctccattacagtccttttaaggcagtgtgggactggttaatcctgctgctcgtgatttataccgcagtgttcactccatactccgcagcattcctgctgaaagagaccgaagagggacctccggcaaccgagtgtggttacgcatgccagcccctcgcagtggtcgacctcattgtggatatcatgttcattgtagacattctcatcaattttaggacaacctacgtaaacgcgaatgaagaagtggtgagtcaccctggccgcatagcagtgcactattttaaaggctggtttcttatcgatatggttgccgccattccatttgatctactgatctttggttccggcagcgaggagttgattgggttactgaaaacggctcggctcttgcggctagtgcgggtggcacgaaagctagatcgttacagtgaatatggggctgcggttttgtttctactaatgtgcacatttgccctcattgctcattggctggcctgtatctggtatgctatcggaaatatggaacaaccccatatggactcccgcatcggatggcttcacaacctcggcgaccagattgggaaaccttacaactcaagcgggcttgggggtccatcaatcaaggacaaatatgtgaccgccctctactttacgttctcttcattaacatccgtgggattcggcaacgtatcaccaaatactaactccgagaagatattcagcatatgtgttatgctgattggctctctgatgtatgcctcaatcttcggtaacgtttcagcaatcatccagcgcctttacagcggcactgcgcggtaccatactcagatgctgcgcgtaagagagtttattcgcttccaccagatccctaaccctctgcgccaatgttgcgatcacccaggagcttggccccactttcatattcccgcggtggcacgacagcctcccccgcatcctcatcttggcctcgctttcagcggatttcccgtccatggagtttag

SEQ ID NO: 129612 - DNA, 3192 bp, Artificial Sequence
  Description of Artificial Sequence: Synthetic coding sequence
atgagcagtcacagcgccggctcctgcttcctttgcctggtggatgtcgtgcccgtgaagaacgaagacggcgcagtcatcatgtttatactgaacttcgaggttgtaatggagaaagatatggtgggcagtcccgctcacgacacgaatcaccggggtccgccaactagctggctcgcacctgggcgggcaaagacctttcgcttaaagcttcctgctttattggctttgaccgcaagggaaagctctgtccgatcgggcggggctggaggcgccggcgcccctggcgccgtggtcgtggacgtcgacctcactcccgccgcgccaagttctgagtccctcgcactggatgaagttacagctatggacaaccatgttgctgggctcggccccgcagaggagcgcagggcattggtggggcccggttcgcctcccagaagcgccccaggtcagcttccttctcccagagcccactcactgaatcccgacgcttccggttctagttgttcattggcccgcaccagatctagagaatcctgtgccagcgtgcgaagagcctcttctgctgacgatatcgaagcaatgcgcgccggggttctccccccaccacccagacacgcctcaaccggtgctatgcacccattgaggtccgggctcctcaactcaaccagcgacagtgacctggtcaggtaccgtaccatcagtaaaattccccagatcactctcaacttcgtcgatctcaagggtgacccgtttcttgcatcaccaacttcagatcgcgagattatcgcccccaaaattaaggagcgcacgcacaatgtgaccgagaaggtgactcaagtgctaagcctcggagctgacgtgctgcccgagtacaaattgcaggcccctaggatccaccgatggactattctccattacagcccattcaaagccgtctgggattggttaattctgctgctggtgatttataccgcagtttttactccatatagtgcagcttttctgctgaaggaaacagaggaagggcctccagcgacggagtgcggctatgcttgccaaccattggccgtcgtcgacctcattgtggacattatgttcatcgttgatatccttattaatttccgaacaacttacgtgaatgcaaacgaggaagtagttagccaccctgggagaatcgcagtccactactttaaaggctggttcctcattgatatggtcgcagctattccattcgatctactgatctttggctctgggagcgaagaactcattggactgcttaaaactgctaggttactgcgtttagtgcgtgtcgccaggaaactggatcggtacagcgaatacggagctgcggttctgttcctgctgatgtgtacttttgccctgatcgcccactggctggcatgtatctggtatgcgattgggaatatggagcagccacacatggattcacgtattggctggctccacaaccttggcgaccaaattggcaaaccttacaactcctctgggctgggaggaccgtctatcaaagataagtacgtaacggccctgtattttactttttccagtctgacgtctgtggggtttggcaatgttagtccgaataccaactcggaaaaaatcttcagtatctgtgttatgctgattggctccctgatgtatgccagtatctttggaaacgtctccgcaataatccagcggctctatagcggaaccgcaagatatcacacacaaatgttacgggtgcgggagttcataagatttcatcaaatacctaacccgctgaggcagagactagaagaatatttccagcacgcatggtcttatacaaacgggattgacatgaatgccgtattgaaggggttcccggaatgcttgcaggctgacatctgtctgcatctgaacaggagcttgctccagcactgcaagccttttcggggggcaaccaaggggtgtctgcgggctcttgctatgaagtttaagacaacccatgccccacccggggataccctcgttcatgctggtgacctcctgactgcgctttatttcatttctcgcggcagtatcgagattctgaggggcgacgtggtcgtggccatccttgggaagaatgacatcttcggagagccattgaacctctacgcacgtcccgggaaatccaacggtgatgtccgggcactaacttattgtgaccttcacaagatccacagggacgacttgttggaagtcctcgacatgtacccagaattttccgaccacttctggagcagcctggagatcacctttaatctccgcgatacaaacatgattcctgggtctccaggatcaactgagctcgaaggtggcttcagccggcaacgaaagcgtaagctctctttccggagaagaaccgacaaagacaccgaacagccaggggaagtgagtgcactcggccctgggcgggctggggccggaccatctagccgggggaggcccggtggcccatggggtgagtcccccagcagtggcccttcctcaccggaatcgagtgaggatgagggccccggacgctcatcaagccccctcaggctggtacccttctcatctcctcgtccacctggtgagccccccggtggcgaacccctgatggaggactgtgaaaaatcttctgacacctgcaatcccctaagcggggctttttcaggggtgtcaaacatcttttctttttggggagattcgcgagggaggcagtatcaggagctgcctcggtgtccagccccaaccccgtccttgcttaacatcccccttagttcaccgggccggcggccaagaggcgatgtagagtctaggctcgatgccctccagcgtcagttgaataggttggagacacgcctttccgccgatatggctactgttctgcagcttctacagcgccaaatgacgctcgtgcccccggcctattccgccgtgacaactccaggtcccggccctacctcgacaagtcccttgctgcccgtcagccccctacctaccctgacgttggattctctgagccaagtgtcccagtttatggcatgcgaggagcttccccccggggcaccagagctgccgcaggagggaccgaccaggaggctcagcctgcccggacagctcggagcactgacatcgcagcctcttcatcgccacggtagtgatcccggctcatag

SEQ ID NO: 129613 - DNA, 2667 bp, Artificial Sequence
  Description of Artificial Sequence: Synthetic coding sequence
atgccagtccgccgcggacatgtggcgcctcagaataccttcctggacaccatcatccggaaattcgaaggccagtcgagaaagttcatcatcgcaaatgcgcgggtagaaaactgcgcggttatttactgcaatgacggtttttgcgagttatgcggatactctagagccgaggtgatgcaaagaccttgtacttgtgatttcctccacggacctaggacgcagcgccgcgccgccgcccaaatcgcacaggcacttctcggagctgaagagcggaaagtagaaattgcattctatagaaaggacgggtcgtgttttctgtgcttagtggatgtggtgcccgttaagaatgaagatggtgcagtcatcatgtttatactgaattttgaggtcgtcatggaaaaagacatggttgggtctccggcgcacgataccaaccacaggggacctcctacatcttggctcgcccccgggcgcgccaagacttttcggctcaagcttcctgctttgctagctcttactgcgcgagagagctctgttcggagtgggggggccggcggagcaggagcacccggcgccgtcgtggtggacgtggatttgacgccggccgccccgagctccgaatcgctggctctcgatgaggttaccgccatggacaaccacgtggccggtctcgggcctgcagaggagcggagagctcttgtgggcccaggcagtcctcctcggagtgcgcctgggcagctgccatctcccagagcccactccctgaacccggacgcttctggatcatcatgcagcctggcccgcactcgctcgcgggagagctgtgccagtgtgcgaagggcttcttcggccgatgatattgaggccatgcgtgctggcgtcttaccgcccccccctcggcacgccagcaccggcgctatgcaccctttaagaagtggcctcctgaactctacctcggactccgacctggtgcggtacagaactatcagcaaaattcctcaaataacccttaacttcgtagatctgaagggggatccctttctagcctctccaacaagtgaccgggagattatcgccccaaagattaaggaacggacccacaacgtgaccgagaaggtgacacaagtactgtcactgggagctgacgttctacccgagtacaaactgcaggccccgcggatacaccgatggacaattctgcactattcacccttcaaggctgtttgggactggctaatactcctactggtgatctatactgctgtgttcactccttatagtgcagctttcctgcttaaggaaacagaggagggaccccctgcaaccgagtgcggatacgcgtgtcagccccttgcagtcgttgacctcattgtggatatcatgttcatagtggacattttaatcaacttcagaaccacctatgtgaacgcgaacgaggaggttgtgtctcacccaggacgcattgctgtgcattattttaaagggtggttcctgatcgacatggtcgcagccattcccttcgatctgttgatttttggatctggcagtgaagagctgatcgggttgctgaagacagcacgcctcctgcgtctggtacgtgtggcgcgtaaactggaccgctactccgagtatggagcagcggtgttattcttgttaatgtgcacctttgcactgatcgctcattggctcgcttgcatctggtacgccatcgggaacatggaacaaccccacatggacagtagaataggctggttacacaacttgggggatcaaatcggaaagccgtataatagcagtggtctcggtggcccttccattaaggacaaatacgtcactgctttgtattttaccttctcctccctgacctccgtgggtttcggtaatgtttctcctaataccaactccgaaaaaatcttttctatatgtgtgatgttaattggaagcctgatgtacgcgtccatatttggaaacgtgagtgcaattatacagagactctattccggcacagcaaggtaccacacacagatgttgagagtacgggagttcatccggtttcaccagattcccaacccactgcggcagcggctggaggaatatttccagcatgcctggagctacacgaacggtatcgatatgaatgcagttttgaaaggttttccggaatgtttgcaagcggatatttgtctacacctcaaccgatcactgcttcagcattgcaagccgtttcgcggtgctaccaaggggtgtttacgagccttggcgatgaagttcaagacaacacacgccccaccaggggacactctggttcacgctggggacttgttaacagcactgtatttcatatcccggggaagcatcgagattctgagaggcgacgttgtagtggcaattctcggcatgggctggggcgctggcacagggttagagatgccttcagcagctagcaggggtgcctcactgttgaacatgcagtcattaggcctctggacctgggactgcctgcaaggtcactgggccccattgatccatctcaattccggcccacctagcggcgccatggaaagaagtcctacttggggcgaggctgctgaactctggggaagccacatcctcctcccgttccgcataaggcataagcagaccttgttcgcgtctctgaagtag

SEQ ID NO: 129614 - DNA, 3252 bp, Artificial Sequence
  Description of Artificial Sequence: Synthetic coding sequence
atgcccgctatgcgcggactgctggcaccacagaacacattcctcgatacaatcgccactcggttcgatggaacccacagcaatttcgtgctgggaaatgcacaagtggctggcctattcccagtcgtctactgttccgatggattttgtgatcttacaggcttctccagggcggaggtgatgcaacgggggtgcgcgtgctcttttctttatggccctgacacttccgaactggtgagacagcagatacgcaaagccctcgacgaacataaggagtttaaggcagaattgatcctctatcgaaaatccggcctgcctttttggtgtctcctcgacgtcatccctattaaaaatgaaaaaggggaagtggcattgtttctggtgtcgcataaggacatctctgagacgaaaaatcggggcggaccggatcgctggaaggagacaggcggtgggcgaaggagatacggacgagctcgctctaaggggtttaacgcaaaccggaggcggtcaagagcggtactataccatctgtccggacatctgcagaaacaacccaaaggcaagcacaaattaaacaagggggtgttcggcgaaaagcccaatttaccagagtacaaggtggcagccattagaaagtcacctttcatcttgctccactgcggtgctttgcgggccacatgggacggatttatactattggcaaccttatacgtggccgtcaccgtaccatactcagtgtgtgtgagtaccgctagagagccatcggccgcccgaggacctcctagcgtttgtgacctggccgtagaggtcttatttatactggacattgtgctaaatttccgcacaacattcgtgagcaagtccggccaagtcgtgttcgcgccgaaatcaatctgtctacactacgtgactacgtggttccttttagatgtaatcgcagcgttgccatttgacctgctgcacgcattcaaagtgaacgtgtactttggggcgcacctcttgaagacagtgagactgctgcggctgctgaggctgctgccacgtctggaccgttactcccaatactcagctgttgtgctaaccctgttgatggcagtgtttgctctgctcgcccattgggtggcctgcgtgtggttttacatcggccagagggaaatcgaatcttccgagagcgagctcccagagattggctggctgcaggagcttgctcgacgcttggaaaccccctactatctggtggggcgcagaccagccggcgggaatagctcggggcagagcgataattgctcctcatcctcggaggccaacggtaccggactggaactgctcggtggaccctcgctgcggagcgcatatattaccagtttgtactttgctcttagctctctgaccagtgtcggcttcggcaatgtttcagctaatacagacacagaaaaaatctttagcatctgtactatgcttataggcgctctgatgcatgccgtagtgtttgggaatgtgacagctatcattcagcgcatgtacgctcgtagattcctctatcactccagaacccgggacttacgggattacattaggattcaccgcattccaaaaccgctcaaacaacgtatgcttgagtactttcaggccacctgggccgtaaacaatggcatcgataccaccgaactcctccaatcccttccagatgaattgcgcgccgacattgccatgcatctgcataaagaggtgctacagctcccgctgtttgaggccgcaagcagggggtgtctccgcgccttgtcactggctctgagacccgccttttgcacccctggtgaatatttgatccaccagggtgatgctctgcaggctctttatttcgtgtgttctggctcaatggaagtcttgaagggggggactgttcttgctatattaggcaaaggcgatttgataggctgcgagctgcctcgccgggagcaggtcgtcaaggccaacgcagacgtcaagggactcacttattgtgtgctacagtgcctccagctggctggtttgcacgactcactggccctgtaccccgagttcgcccctcgtttttcgcgcggactccggggggagctgtcttacaatctgggcgctggcggtggctcagccgaggtggatacctctagtctgtctggggataatacactgatgtctacgttggaggagaaagagactgatggcgaacaagggcccacggtaagccccgctccggcagacgagccctctagcccgcttctctcccctgggtgtaccagctccagttcagccgcaaaactgctcagcccccggagaacagcgcccagacccagattaggaggaagaggaagacccgggcgtgcgggagccctgaaagctgaagcagggccgtctgccccacccagagcgctggaagggctcagactccccccaatgccttggaacgtgccaccagatttgagcccacgagtggtggacggaatcgaagatggatgtggatctgaccaacccaaattcagttttagagtgggccagagcggacccgaatgctccagctccccctcccctggacctgagtctggcctacttaccgtaccgcacggcccatcagaggccagaaacaccgatacattggacaaactgcgacaggctgttacggaattatccgagcaagtgctccagatgcgggagggattacaatcactccggcaggcggttcagcttgtcctcgctcctcacagagagggcccctgtccccgtgcatccggggaaggaccctgcccagctagcactagtggcctcttgcagcccctgtgtgtcgatactggagctagcagctactgtctgcaacctcctgccggctcagttctgtcaggcacatggccccatccaagacccgggccaccgccactcatggccccctggccatggggaccccccgcttcccagtcctcaccgtggccacgggctaccgccttttggacgagcacatcagacagtgaaccccctgccagtggcgatctatgctctgagccttccaccccggcatctcctcctcccagtgaggaaggggcgcgcacaggtccagccgaacctgtatctcaggccgaggctacatccactggtgagcctccgccaggcagcgggggcctggcactgccctgggatccccattccctcgaaatggtgcttataggctgtcatggctccggaactgtgcagtggactcaggaggagggtaccggtgtctag

SEQ ID NO: 129615 - DNA, 2967 bp, Artificial Sequence
  Description of Artificial Sequence: Synthetic coding sequence
atgccaggcgggaagcggggtctggtcgcgccccagaacaccttcttggagaacattgtcagacgtagctctgagtcatcttttttacttgggaatgcccaaattgtggattggccagtggtgtacagcaatgatggattctgtaaattgtcagggtaccatagagcagacgttatgcagaaaagcagcacttgttccttcatgtacggcgagcttactgataagaaaaccatcgagaaagtcaggcagacatttgataattacgagtctaactgtttcgaggtcctcctctacaaaaagaaccgcacaccagtttggttttatatgcagatcgcacctattcgtaacgaacacgaaaaggtggtcctattcctttgtaccttcaaggatatcacactgtttaaacaaccgatcgaggacgatagcactaagggatggactaaattcgcgcggctaacgagagctctcacaaattccagaagtgttctgcagcagctcacccctatgaacaaaacggaagttgttcataagcactcccgactggctgaagtcctgcaacttggctccgatattctgccgcaatacaaacaggaggcccctaaaacacccccccacattattctgcattattgtgcgttcaagactacgtgggattgggtcatcctgatccttactttttataccgctatcatggtgccctataacgtgtcatttaagaccaagcagaacaatattgcttggttggtcctggatagcgtggtggacgtcattttcctagttgacattgtcctgaatttccacacaaccttcgtcggaccaggtggcgaggttatcagcgatcccaaactgatccgaatgaattatctcaagacgtggttcgtcatcgacctcctgtcatgtctgccgtacgatatcattaacgcttttgaaaacgtcgacgaaggcatttctagtctattctccagcctgaaagtggtaaggctgttgcggttagggcgtgtggctcgcaaactggaccactatctggaatatggggctgcagttctagtcctgttggtgtgtgtcttcggactggtggctcattggctcgcgtgcatttggtactcaattggggactacgaggtgatcgatgaagttacgaacaccatccagatcgatagttggctgtatcagctagcactttccattggaactccgtacagatacaacacaagtgcgggcatctgggaaggggggccttctaaggatagcttgtatgtaagctcactatattttacgatgacctcactcactaccataggtttcggcaacattgccccgacaacagatgtggagaaaatgttcagtgtggcaatgatgatggtcggatctctcctgtacgccaccattttcggcaacgtaaccacaatttttcaacagatgtatgctaacacgaataggtaccacgagatgttgaataacgtgcgcgacttcctgaagctatatcaggtaccgaaggggctgagtgaacgagtgatggattacattgtcagtacctggagtatgagcaagggcatcgacacagagaaagtcttgagtatctgccctaaagacatgagagctgacatctgtgtacacctgaacagaaaggtatttaatgagcatccagctttccgtcttgctagcgatggatgcctgagggcactggccgtggagttccagacaatccactgcgcacctggagacctgatttatcatgctggcgaaagcgtagacgctctgtgcttcgtggtgtcaggctcactggaagtgatccaggatgatgaagttgtggcaatccttggaaaaggtgatgtctttggcgatatcttttggaaggaaacaacactggcccacgcttgcgctaatgtccgtgccctgacatactgtgacctccatattatcaaaagggaggccctcctcaaggtgctggacttctatacagccttcgccaactcattctctcgcaatttgaccttgacttgtaacctgcgcaagcggataatctttagaaagatcagtgatgtgaagaaggaggaagaagagcggctgagacagaagaatgaggtgactctttctatccccgtggaccaccctgtcaggaagctcttccagaagtttaagcagcagaaggagttgaggaaccaaggatcaacccagggagaccccgagaggaaccaactccaagtagaatctagaagtctccagaacggtgccagcattaccggtacaagtgtcgtgaccgttagtcagattacccccattcagaccagtctggcttatgtgaagacatcagagtcgttgaagcaaaacaaccgagatgcaatggagctgaagcccaatgggggtgccgaccagaaatgcctgaaagtgaactcccctatccggatgaaaaacggcaacgggaaaggatggctaaggcttaaaaacaacatgggggctcacgaagagaagaaagaagattggaacaacgtgacaaaggccgaaagcatgggattgcttagcgaggaccccaagtcaagcgattccgaaaattctgtcactaaaaacccacttcggaagacagacagctgtgacagcggcattacaaagtctgacttacggttagataaagcaggcgaggctcgttctcccctggaacactctcccatccaggcggatgccaaacaccctttttatccaattcctgaacaggcactccagacaacacttcaggaagttaagcacgaactcaaggaagatattcagctcctgtcctgcagaatgaccgctctggagaagcaggtcgccgagatactaaaaatcctgtctgaaaaaagtgtaccccaggcctcaagccccaagtcgcagatgccattacaggtgccacctcagataccatgccaggacatttttagtgttagccgtccggagtccccagaatctgacaaagacgaaatccacttttag

SEQ ID NO: 129616 - DNA, 1269 bp, Artificial Sequence
  Description of Artificial Sequence: Synthetic coding sequence
atgcagaagagcagcacatgcagtttcatgtacggagaacttacagacaaaaaaacaattgaaaaagtgcggcaaacttttgataactacgaatccaattgctttgaagtcctcctgtataagaagaaccggacgcctgtgtggttctacatgcagatcgcgcccattcgaaacgagcacgaaaaagtagtcctcttcctgtgcactttcaaagacatcaccctgttcaagcagcccatcgaggacgacagcacaaaggggtggaccaaattcgcaaggttgaccagagcacttaccaactcccgctccgtcctacagcagctgacgccaatgaataagacggaagttgtgcataaacatagccgactagctgaagtcctgcaattgggatccgacattctgcctcaatataagcaggaggctccaaagactcctcctcacatcatcctccactactgcgcctttaagacaacatgggactgggtcatcctgattctaacgttctacacagctatcatggtcccatacaatgtctcattcaaaactaagcaaaataacattgcgtggctagtgctcgatagcgtagtcgacgtgatctttctggttgacatagtgctgaactttcatacgactttcgtgggccctgggggcgaggttattagtgatcccaaactgatcagaatgaactacctgaaaacctggtttgtcattgacctgctgtcctgcttgccgtatgatatcatcaatgccttcgaaaacgtcgacgaaggaatatcgtctctgtttagctcactgaaagtggttcgactcttacgccttggaagggttgcgcggaagctcgaccattatctcgagtacggggctgccgtgctcgtgctgcttgtgtgtgtcttcgggctggtggcacattggttggcgtgcatctggtactccatcggagactacgaagtgatcgacgaggtcacaaacaccatccaaattgattcatggctatatcaactggccctgagcattggaactccctataggtataatacctcagctgggatctgggaggggggacctagtaaagattcactgtatgtgagttcactgtactttactatgactagtcttaccaccattggcttcggcaacatcgccccaacaaccgatgttgaaaaaatgttctccgtggcaatgatgatggtaggctgcaagtactttaactttttcattgagaactactgctactggcaattcagctggctgcagtcgcagattgggtag

SEQ ID NO: 129617 - DNA, 2199 bp, Artificial Sequence
  Description of Artificial Sequence: Synthetic coding sequence
atgcctgtaaggcgaggacacgtggctccgcagaatacgtttctgggcaccattatccggaaattcgaaggacagaataaaaagttcatcatcgcaaacgctcgggtgcaaaactgtgctattatatactgtaacgacggattctgcgagatgacgggcttttccagacctgatgtgatgcagaagccgtgcacctgtgactttctccacggacctgaaaccaagcgacatgacattgcccagattgcacaagccctgctgggctccgaagagcgcaaggtggaggtgacgtactaccacaaaaatggttcaacatttatttgtaatactcatataatccccgtgaaaaaccaggaaggagtggcgatgatgttcattattaactttgagtacgtaaccgacaacgagaatgctgccacacccgagcgcgtgaaccctattctcccgataaaaaccgtaaaccgaaagttctttggatttaagtttccgggattacgggtcctgacctatcgaaaacagagcttgcctcaggaggacccagacgtggtggtgattgatagcagcaaacattccgatgacagcgtggcaatgaagcattttaagtcacctacgaaggagtcgtgttccccctctgaggcagacgacaccaaggcactgattcagcccagtaaatgctccccactggttaatatttctgggcctctagaccattccagccccaagaggcagtgggatagattgtatcccgatatgcttcagtcttcgagccaacttagccattctcggagtagggaaagcttgtgcagtatccgccgggccagttcagttcatgatatcgaggggttcggggtccatcctaaaaatatctttcgggaccgtcacgctagcgaggggccgttcaaccacatcaagagcagccttttgggttcaacttctgacagtaatctaaataaatactcaaccatcaacaaaatcccacaactgacactcaatttttcagaggtgaagacagagaagaaaaactcttccccccccagctctgacaagaccatcattgctccaaaggtgaaagataggacgcacaacgtcaccgaaaaagtgactcaagtcctaagtcttggggcagacgtcctgcctgaatacaagcttcagacaccaagaataaacaagttcactatcctccattactctccatttaaagctgtttgggactggcttattctcttgctggtcatctacacagccatctttacgccctactccgccgcgtttcttctcaacgacagggaggagcagaagcggagagaatgtggttatagctgtagtcctctcaatgtcgtagacttgattgtcgatataatgtttattatcgatatattaattaacttcagaacgacatatgtaaatcaaaatgaggaggttgtgtctgaccccgctaaaatcgcgattcactacttcaaaggttggtttttgatcgacatggttgccgctatccccttcgacctcctgatattcggcagtggatccgatgaaacaaccacactcatcggcttgctgaagaccgccagactgttgaggctggtacgcgtggctcgtaaattggacaggtactctgaatacggggctgccgtgctgatgctgctgatgtgtatatttgctctgatcgctcactggctggcctgtatctggtacgcaatcggaaacgtagaaagaccatatctaaccgataaaatcggctggttggattcacttggccaacagattggaaagcgttacaatgacagcgattcctctagtggaccatcaatcaaggacaagtatgttactgcactgtatttcacctttagttcactaacgtccgtgggattcgggaacgtgtccccaaatactaactcagaaaaaatcttttctatctgtgtcatgctaattggctcactaatgtacgcaagtatctttggcaatgtgagcgccataatccagaggctttatagtggaacagcccgttaccacatgcagatgctacgagtcaaggaattcatccggtttcaccaaatccccaaccccttgagacagcgcctggaggaatacttccaacacgcctggacctacaccaatgggatcgatatgaatatggtttgtatgtctgtattccaaaacgaaagcgcagctggcataattgtgattgcaaagatggaatag

SEQ ID NO: 129618 - DNA, 3591 bp, Artificial Sequence
  Description of Artificial Sequence: Synthetic coding sequence
atgcccgtcaggagagggcacgtcgccccgcaaaatacattcttgggcaccatcatacgcaaattcgaagggcagaacaaaaagttcatcattgccaacgcacgggtccagaactgcgcaattatatactgcaatgatgggttctgcgagatgacaggcttcagtaggccagatgtgatgcagaaaccctgcacatgcgattttctgcacggccccgagacaaagaggcatgacattgcacagatcgctcaggcgctactcgggagcgaggagaggaaggtggaagtgacgtattatcacaagaacggctcaacattcatttgtaacacacacattattcccgttaagaatcaggagggggtcgctatgatgttcataattaattttgaatatgtgaccgacaatgagaacgctgcaacccccgagcgcgtgaatccaatcttgcctatcaaaaccgtgaacagaaagttttttggattcaagtttccaggtctcagggtgctgacctatagaaagcagtctctaccccaggaagatcccgatgtggtggtgattgattcatccaaacattctgacgactccgtggcaatgaagcacttcaaatctcccacaaaggagagttgctcaccatcagaggccgatgataccaaggccttaatccagccatcaaaatgctcacctcttgtaaatatctctggcccactcgatcattcgtcccccaagagacagtgggatcggctttacccagacatgctgcagagttcaagccagctttcacactctcggtctagagagtctctctgcagtatacggcgtgccagcagtgtacatgacatagagggatttggcgtccacccaaaaaatatcttccgggaccggcatgcgtctgaggacaacggcagaaacgtaaaagggccgtttaaccatatcaagtcctcactgctggggagtacctcagatagcaacctcaataaatacagtacgattaacaagattccacagctgaccctgaatttttccgaagtaaagaccgaaaagaaaaacagctcaccccctagcagtgacaagacaattatagcccccaaggtgaaggaccggacacacaacgtcacggagaaagttacacaggtcctctcccttggagctgacgtgctccccgagtacaaactgcagactccacgtattaacaagttcacgatcttgcactattcgccattcaaagcagtgtgggactggctgatcctcctgctggttatctacacggcaatttttacaccgtacagcgctgcatttctgctaaacgacagagaggaacagaagaggcgggagtgtggctattcgtgcagccccttgaatgtggtcgacctcattgtggacatcatgttcattatcgacattcttattaatttcaggaccacttacgtgaatcagaacgaagaagtggtgagtgaccctgcaaaaattgccatccactacttcaagggatggtttctgattgacatggtggccgccattccctttgaccttctgatctttgggagcggctctgacgagacgactacactcatcggcctcctgaagacagcaaggcttctccgcctggtacgcgtcgcacgtaagcttgacaggtactccgagtatggagccgcggtgttgatgttgctcatgtgcatttttgcattgattgcccactggctggcgtgtatttggtatgctataggcaacgtggagcggccatacctcacagataaaatcggttggctggacagcttaggtcaacaaatcgggaaacggtacaacgacagtgatagctcttcaggacccagcatcaaggataagtacgtcacggcgctttacttcaccttcagttctctgacatccgtcggctttggtaacgtatcgcctaataccaactccgaaaagatcttctctatctgtgtgatgcttatcgggagtttaatgtacgcctcgatatttggtaatgtgtcagccatcatccagcggctctactccgggaccgcccggtaccacatgcagatgctacgagtaaaggagttcatcagattccatcaaattccaaatcctctaaggcagcggttggaggaatatttccagcatgcatggacctatacaaatggcattgacatgaatatggtcctcaagggattcccggaatgtctgcaggcagatatctgtcttcatcttaatcagacactgctgcaaaactgcaaagcttttcggggggcatcgaaaggttgtcttcgagccctagccatgaaatttaaaacaactcacgccccaccaggagatacactggtacattgtggcgacgttctgactgcgttatacttcctgtccagagggtctatagagatccttaaagatgatatcgtggttgcaattctgggaaagaatgacatttttggtgagatggtgcacttgtacgctaaacctgggaaaagtaatgccgacgtgcgagctctgacctactgcgacttgcacaagatacaacgcgaggatctcttggaggtgttggatatgtacccagagtttagtgatcatttcctaactaacctggagttaactttcaacctaaggcacgagtccgccaaagcagatctgttgcggagccagtccatgaacgactctgaaggcgacaattgcaagctccgaaggaggaaactgagcttcgagagcgaaggagaaaaggaaaattccacgaatgacccagaggactctgccgacacgatcagacattaccagtcaagcaagcgccatttcgaggaaaaaaaaagtcggagctccagcttcattagttcaattgacgacgaacagaagccactattcagtggcattgtggacagctctccaggcattggaaaggccagtggcttggatttcgaagagacagtgcctacctctgggagaatgcacattgacaagagatctcactcttgtaaggacatcacagacatgcgcagctgggagagggaaaatgcgcatccacagccagaagacagttccccatcagcccttcagagagcagcctggggaatcagtgagacggaatccgatctgacttatggagaggttgaacagcggctggatctgttgcaggagcagctgaataggttggaaagccagatgactactgacatccagacaatactccaactgctacagaaacagaccaccgtcgtcccacccgcctacagtatggtgaccgccggatctgagtaccagagaccgattattcagctgatgaggacatcccagcccgaagcttcaatcaaaaccgaccgcagctttagcccttctagccagtgccccgaatttctggacctggaaaagtcaaaactgaagtcaaaagaaagcctgtcctctggcgtacacctcaacacagccagcgaggataatctgaccagcctcctaaagcaggatagtgacttgagcctagagctgcacctgaggcaacgcaagacgtacgttcaccctatcagacacccatctttgccagactcatcactgtccaccgtgggcatcgtcggacttcacagacatgtatccgacccaggattgccaggaaagtag

SEQ ID NO: 129619 - DNA, 1755 bp, Artificial Sequence
  Description of Artificial Sequence: Synthetic coding sequence
atggtcgccgaggtgtgttcaatgcccactgccagtactgttaaaaaacccttcgacctgaggtcaaaaatgggaaaatggtgccatcatcggttcccatgttgcaggggcagcgggaaatctaatatgggtacatctggtgaccatgatgacagctttatgaagatgctaagaagcaaaatgggaaagtgttgtagacactgcttcccatgctgccggggaagcggcacatccaacgtaggaaccagcggagaccatgaaaactccttcatgaagatgctacgtagcaaaatgggcaagtggtgctgtcattgctttccctgctgccgcggttcaggaaagagtaacgtgggcgcctggggggactacgatcatagtgcttttatggaaccgcgatatcacataagacgcgaggacttggataagctgcacagggccgcttggtggggcaaggtcccacggaaagacctaatcgttatgctgcgcgataccgatatgaataaaagagacaaagagaagcggactgctctccaccttgcatccgctaacggaaactcggaagtagtccaactgctgctggaccgaaggtgccagcttaacgttttagataataaaaagcggactgcactaattaaggccatccaatgtcaggaggatgaatgcgttctgatgctattagagcacggagcagacagaaacattcctgacgaatatggcaacactgccttacactatgctatttataatgaggataaactgatggctaaggctctgttactctatggcgctgatattgagagcaaaaataaatgcgggttgacgccactattactgggagtccatgaacagaaacagcaagtggtgaagtttctgattaagaagaaagctaatctcaatgtgctcgataggtacggaagaactgcattgatcctggctgtgtgttgtggaagtgcaagcatcgtcaatctgctgcttgagcagaacgtggacgtctcctctcaggacctttctgggcagacggctagggaatacgccgtatcctcccaccatcacgtaatctgtgagttactgagcgactacaaggaaaagcagatgctcaagatttcatcagaaaattccaatcctgaacaggacttgaagctgacttccgaggaagaatcgcagcggcttaaggtcagtgagaactcccagcctgagaagatgtcccaggaacctgagattaataaggactgtgatcgggaggtagaggaggaaatcaagaaacacggatcaaatcccgttgggttgcctgaaaacctcacaaatggggccagcgccggtaatggagacgacggcctcattccccagcggcgctcccgtaagcctgagaaccagcaatttcctgacacggagaacgaagaataccactctgatgagcagaatgacactcggaagcagctgagcgaggagcagaatactggtatctcgcaagacgagatcttgacaaacaagcagaaacagatcgaagtcgcagagcagaagatgaattccgaactttccctgtcccataaaaaggaagaggaccttctgcgggagaattccgtgttgcaagaggaaatcgccatgttgagattggaattggacgagaccaaacaccagaaccaactgcgcgagaacaaaattttggaggaaattgagtccgtcaaagaaaagaccgacaaattgttgagagctatgcagctcaacgaagaggcattaactaagacaaacatctag

SEQ ID NO: 129620 - DNA, 1638 bp, Artificial Sequence
  Description of Artificial Sequence: Synthetic coding sequence
atggtcgcggaggccggaagtatgccagccgccagttccgttaagaaacctttcggactgaggtctaagatgggtaagtggtgtagacattgctttgcttggtgcagaggctctggcaagtctaacgtcggaacatccggtgatcatgacgacagcgccatgaagacactgagaagcaagatgggcaagtggtgctgccattgcttcccttggtgcaggggtagcggtaagtcaaacgttggcaccagcggcgaccatgatgactctgccatgaaaaccctgaggtcgaaaatggggaagtggtgttgccattgttttccatgttgccgggggtcggggaagagcaacgtgggaacgtctggcgaccatgatgacagtgccatgaaaaccctgaggtctaaaatgggaaagtggtgctgccactgcttcccttgctgccgtggcagtgggaaaaacaaggtgggcccttggggcgattatgacgactctgccttcatggaacctcgttaccacgtgaggagagaggacctggataagttgcaccgagctgcatggtggggcaaagtgcctaggaaggatttgattgttatgctaaaagacaccgacatgaataagaaggataagcagaagcgtacggccctgcacttagcgtcagcaaatggtaatagcgaggttgttaagttgctgctcgataggaggtgtcagttgaacatcctggacaataagaagcggactgctcttacaaaagccgtacagtgccaggaggacgagtgtgccctaatgctcctggagcacggcaccgaccccaacattcccgacgaatatgggaacactgcgctgcattatgctatctataatgaggataagctgatggctaaagctctgctcctatacggtgccgacatagaaagtaagaataaacacggattaacacccttactactgggcgtacatgagcaaaagcagcaagtcgttaaatttttgattaagaaaaaagctaatctgaatgctttggacaggtatggacggacagccctcatcctggccgtctgctgtggcagcgcctccatcgtatcacttcttctggaacagaacatcgatgtgtcctcacaggacttgagcggacagacagcacgggaatatgcagttagcagtcgtcacaacgtgatctgccagctactgagcgattataaggagaagcaaatcctgaaggtttctagcgagaactccaacccagaacaagacctcaagctgacgtccgaggaagaatcccaacgactgaagggctcggaaaacagtcagcctgaggagatgtcgcaggagcccgagattaacaaagggggagaccgcaaggtggaggaagaaatgaagaagcatggttcgacccatatgggcttccccgagaacctcacgaatggcgccactgccgataatggcgacgacggcctcatccctcctagaaagtcccgcaccccagaatcacagcagttccccgatactgagaacgagcaatatcacagcgacgaacaaaatgacacacagaaacaacttagtgaagaacaaaatacggggatcctgcaggatgaaatccttatccacgaagagaaacagatagaagtggctgagaacgagttctag

SEQ ID NO: 129621 - DNA, 867 bp, Artificial Sequence
  Description of Artificial Sequence: Synthetic coding sequence
atggtcgcagaggccggatccatgcctgccgcatccagcgtcaaaaaaccttttggactgcgttccaagatgggcaaatggtgtaggcactgctttgcctggtgcaggggctctggtaaatctaacgtcggaacttccggagatcacgacgatagcgcaatgaagacactccgttcaaagatgggtaaatggtgctgtcactgctttccatggtgccgcggttccggcaagtccaatgtgggcacgtctggcgaccacgatgactccgccatgaaaaccctcagaagtaaaatggggaaatggtgctgccactgtttcccttgctgtagagggagtggaaaaagcaacgtgggaaccagcggtgaccatgatgacagtgcaatgaagacacttcggtccaagatgggtaaatggtgctgccactgttttccttgctgtagaggtagcgggaagaataaggttggaccttggggcgactatgacgattccgccttcatggagccacggtatcacgtgaggcgggaggacctggataaacttcaccgggccgcctggtggggaaaggttccccgcaaggatcttattgtgatgttgaaagatacggatatgaataaaaaagacaaacagaagagaaccgctctgcacctcgccagcgcaaacgggaactccgaggtggtgaagctcctgctggatagacgctgccagctgaatatacttgacaataaaaaaagaaccgctctcactaaagccgtccagtgccaggaagacgaatgtgctcttatgctgttggaacacggcaccgatccaaacattcctgatgagtatggaaacacagccctgcactatgctatttataatgaggattag

SEQ ID NO: 129622 - DNA, 1527 bp, Artificial Sequence
  Description of Artificial Sequence: Synthetic coding sequence
atggtggctgaggcgggatctatgccagctgcgtcttctgtcaagaaacccttcgggctgagatctaaaatgggcaaatggtgccggcactgctttgcttggtgtcgcggctctgggaagtctaacgtagggacgagcggcgaccacgacgactccgcaatgaagaccctgcgctctaagatggggaagtggtgttgtcactgcttcccgtggtgtcgcgggtctggcaagagcaacgtcggcacaagcggtgaccacgacgactctgcaatgaagacattaaggagcaagatgggcaagtggtgttgtcactgcttcccgtgttgtcgcgggtctggaaagaataaggtgggcccatggggcgattacgacgacagcgcattcatggagcccagataccatgttagaagggaggatttagacaaactgcatcgggctgcatggtgggggaaggtgccgcggaaggacctgattgtgatgctcaaggacaccgatatgaataagaaggataaacaaaaaaggacagccctccaccttgcgtcagccaacggcaacagtgaggtcgtgaaactactgctggacaggcgctgccagttaaatatcctggacaataagaagcggacagctctcacgaaggctgtgcaatgccaagaagacgagtgtgctcttatgctgctagaacatgggactgatccgaatatcccagacgaatatggtaataccgctctgcactatgcaatttataacgaggacaaactcatggccaaagccttgctcctttacggcgcagacatcgaaagtaagaataaacacggcctcacaccactgctgctgggtgtccatgagcagaaacaacaggtcgtgaaattcctgatcaagaaaaaagcgaatctgaatgctctcgaccgttatggccgcacagctcttattctcgctgtatgctgtggctcagcaagcatcgtaagtttgctccttgagcagaatatcgatgtgagttctcaggatctgtcggggcagacagcaagagagtatgcagtctccagtaggcataatgtgatttgtcagttactgagcgattacaaagaaaagcagatcttgaaggtctcttctgaaaatagcaaccctgaacaggatctcaagctgacctcagaagaggagtctcagcgtctgaaagggtccgaaaactcacaacctgaagaaatgtcccaggagcctgagataaacaagggcggagaccgcaaggttgaggaggaaatgaaaaagcacggctctactcatatgggctttcctgagaaccttactaatggagcaaccgctgacaatggcgacgatggtttaattccgcccagaaaatcccggacaccagaaagccagcagtttcccgataccgagaatgaacagtatcactcagacgagcagaacgacactcagaagcagctgtccgaagaacaaaatacagggattctgcaggacgagattcttattcacgaagagaaacagatcgaagtcgccgaaaatgaattttag

SEQ ID NO: 129623 - DNA, 954 bp, Artificial Sequence
  Description of Artificial Sequence: Synthetic coding sequence
atgagttgtcaggcctttacctccgctgatacgttcattccattgaactctgacgctagcgccacgctgcctctgatcatgcatcacagcgccgcggagtgcctgccagtctccaatcatgccacaaatgtcatgtccaccgtgccttcaattctctctcttatccagacccccaaatgtctctgcacacacttttccgtgactaccttggggaacactgctacgggacttcactactccgtcccttcatgtcattatgggaaccagccatccacctatggcgtgatggccgggtcactaaccccgtgcctgtacaagtttcccgatcacactctcagtcacggcttcccaccaatacaccagcctctgctggccgaggaccccactgcggcagactttaagcaggagttgcggcgaaaatctaaattagtagaagagcccatcgacatggattctccggagattcgggagctggaaaaattcgctaacgaatttaaggttaggagaatcaagctgggctacacacagaccaacgtcggcgaggcgctagcagctgtgcacggatcggagttctctcaaactaccatatgccgttttgaaaacttgcagctgtcttttaaaaacgcctgcaagctgaaagccattctgagtaagtggctggaggaagccgagcaggtgggcgctctgtacaatgaaaaagttggagccaacgagagaaagaggaagagacggaccacaatcagcattgccgcaaaggatgccctcgaacgccatttcggagagcaaaacaaacccagctcgcaggagattatgcgcatggcggaagaactaaacctcgaaaaagaggttgtcagagtctggttttgcaacaggaggcagcgcgagaaaagggtgaagacgtcactcaaccagtccctttttagcatctcaaaggaacatttggaatgtagatag

SEQ ID NO: 129624 - DNA, 876 bp, Artificial Sequence
  Description of Artificial Sequence: Synthetic coding sequence
atgtcctgccaggcctttaccagtgccgacaccttcattcccctgaattcagatgcttcggctactctacctcttattatgcaccacagcgctgccgaatgtctgccagtgtctaaccacgctactaacgtgatgagcactgcaacaggtctccactactccgtaccgagctgtcactacggaaatcagccgtccacttacggagtcatggcgggctcactcacaccctgtttgtacaagtttccagaccatactctcagccacggtttccccccaattcatcagcccttgctggccgaggatccaacagccgcagacttcaagcaggagttgcgtaggaaatccaaactggtggaggagccaattgatatggacagcccagaaatccgggaactagagaaattcgccaatgagtttaaggtgaggcgtatcaagcttggctatactcagaccaacgttggggaagccctggctgccgttcacggatccgagttctctcaaacaaccatttgtagattcgaaaacctccagttgagctttaagaacgcatgtaagcttaaggccatcctgagcaaatggctcgaagaagcagaacaggtgggtgcgttatacaatgagaaggtgggagccaatgaacgaaaacgtaagcggcgtactacaatcagtatagccgcaaaggacgccctggaaagacacttcggggagcaaaacaagccttcatcacaggagattatgcggatggccgaggaactgaatctggagaaggaggttgtgcgcgtgtggttttgtaacagacgccagagagagaagagagttaaaacatctttgaatcagtcactgtttagcatctcaaaggagcacctcgagtgccggtag

SEQ ID NO: 129625 - DNA, 771 bp, Artificial Sequence
  Description of Artificial Sequence: Synthetic coding sequence
atgctctggcagaagcctacggctccagagcaggccccagcgcctgcaagaccctatcagggagtgcgcgttaaagaaccggtgaaagagctcttgcggcggaagcggggccacgcgtcttctggcgctgcacctgcccccacagcagtggtactgccccaccagccacttgccacctataccactgtcggtccatcttgcctggacatggagggatccgtcagcgctgtgacagaggaggcggccctctgcgcgggttggttgtcacagcccacacccgcgacgctgcaaccgttggccccttggacaccgtataccgaatatgtccctcacgaggccgtcagctgcccttactctgccgatatgtacgtgcagcccgtttgtccctcatacactgtggtagggcccagttctgtcctgacctatgcgtcgccacccttgatcaccaacgtgaccactcggagttctgccactcctgccgtgggccccccactcgaggggccggagcatcaagcacctttgacgtacttcccctggccccagccccttagcaccctgcctacctcaactctgcagtatcagcctcccgcccctgctttaccaggtccccaattcgttcagctgccgatcagcatccctgagcccgtgctgcaggatatggaggacccaaggagggccgctagttctctaacaatagataagttgttgctcgaggaggaagactctgacgcttatgccctaaatcacactctcagtgtggagggcttttag

SEQ ID NO: 129626 - DNA, 1440 bp, Artificial Sequence
  Description of Artificial Sequence: Synthetic coding sequence
atggtccactcttccatgggcgcccccgaaatccggatgtcgaagccccttgaggcggagaaacaaggattagacagcccctccgaacacaccgatacagagcgcaacggcccggataccaatcatcaaaatccccagaacaaaacatcccccttcagtgtctcccctacaggcccctcaactaaaataaaggcagaggaccctagcggcgattcagccccggccgcccctctgccacctcagcccgcacaaccacacctcccacaggctcaactgatgctcaccggaagccagttggcaggcgacattcaacagttgttgcagctgcagcagcttgtgttggtccccggccaccatctccagcctccagcccaattcctgcttccacaggcgcagcagagtcagcctggacttctgcccactccaaacctttttcagctgccccagcagacccagggcgctctgctcactagccagccaagggctgggctgccaacccaggctgtaaccagacccacactcccagaccctcacctttcacatccacagcctcccaagtgcctggagcctcctagccatcctgaggagccatctgacctggaggaacttgagcagttcgctagaacatttaaacagaggagaatcaagctcggtttcacccaaggtgacgttggcttggctatgggcaaactgtacggcaacgatttcagccagaccaccatcagccgattcgaggcacttaacctctctttcaaaaatatgtgcaagttgaagccacttctggagaaatggctaaacgacgctgagacgatgtccgtggatagcagcctgccttcacccaatcagttatctagcccatccctggggtttgacggcctgcccggccggcggagaaaaaaacgcaccagcatcgaaacgaacgtgaggttcgcactagagaaatcgttcctcgctaaccagaaacccacttctgaagaaatcctgctgatcgcagagcagcttcacatggaaaaggaggtgataagggtatggttttgtaaccgacgccaaaaggagaagaggattaacccatgttctgctgccccaatgcttccatcacctggaaagccggcttcttatagtccgcatatggtgactcctcaagggggcgcaggcaccctccctttatcacaggcatcttccagcctgagcaccactgtcacaactttaagcagtgccgtcggaacattgcacccctcaaggacagctggaggtggaggaggtggagggggagcagcgcccccactaaactcaattccctctgttacgccacccccacctgctactaccaattccaccaacccttctcctcaagggtcacatagtgcaattgggctgtccggcctgaacccttccacaggacccgggttatggtggaaccctgccccgtatcaaccgtag

SEQ ID NO: 129627 - DNA, 1809 bp, Artificial Sequence
  Description of Artificial Sequence: Synthetic coding sequence
atggtccatagttccatgggcgcaccagaaatacgcatgagcaaacccctggaggctgagaaacaggggctggatagccccagcgagcacaccgatactgaaaggaacggacccgacaccaatcatcagaatccacaaaacaaaaccagcccattcagcgtctctcctacggggccgtctacaaaaattaaagccgaagaccctagtggcgactcagctcctgcagcccctctacccccacagcccgctcagccacatctcccacaggcccagctgatgttgaccggttcccagcttgccggagatatccagcaattactccagctacagcagttagtgttggtgccaggccaccaccttcagccccccgcccagttcctgctgcctcaggcccagcaatcacagcctgggttactccctactcctaatctgtttcagctcccccagcagacgcagggagcccttttaactagccagccacgggccggcctcccaacccaggctgtaacacgccccacattgcctgatccccacctgtcccatccccaaccgcccaagtgtctggaaccaccaagccacccagaagaaccctctgacctggaagaactcgaacaattcgcgagaacattcaaacagcggaggattaagttaggtttcacacagggggatgtgggcctggcaatgggaaaactctacggcaatgatttttctcagacgacgatcagtaggtttgaggccctgaatctgtcatttaagaatatgtgtaagttaaagcccctgctggaaaagtggctcaacgatgcggagacgatgtccgtggattctagtctaccttcccccaaccagctgagcagcccgagcctgggatttgatggcttgccgggacgcaggcgcaaaaagaggacatcaatagagaccaacgttagatttgccctggaaaagagctttctggcgaatcagaagccgacaagcgaagaaatactgctgatcgccgaacagctgcacatggagaaagaggtcatcagggtgtggttctgcaatagaagacagaaggagaaacgaattaacccctgttccgccgcccccatgctgccttcccctgggaaaccagcaagttactctccacatatggttaccccacaggggggtgccggcactctgcccttatcccaggcctcttcttcgttatccacaacagtcactacactgagctcggccgtgggaacattgcatccctcacgaacggctggcggcggcggtggcggcgggggcgcagcaccgccgctcaacagcattcctagcgtcactcctccccctcctgccactacaaacagtacgaacccatcgccgcaggggtctcatagtgcaataggcctttctggtctgaatccatccaccggctcgactatggtgggcctttctagtggactgtcgcctgccctgatgagcaacaaccccttggctacaatccaggcgctcgcctccggtggcacactcccattaactagcttggatggtagcggcaaccttgtgcttggggccgccggcgccgctccagggtcaccaggcttggtcacctctcctctgttcctgaaccacgccggtttgccactgttatctacccccccaggggtagggcttgttagcgcagctgcggccgctgtggctgcgtctattagcagtaaatctcctggcctgagtagttcctcctcctcctcttcttctagctccagttccacttgttctgaaacggcggcccagactccaggcggacccggtggcccggaagcaggaagcaaaccagagtag

SEQ ID NO: 129628 - DNA, 1392 bp, Artificial Sequence
  Description of Artificial Sequence: Synthetic coding sequence
atggtccatagttccatgggagcaccggagatccgcatgagtaaaccgttagaagctgagaagcagggcctggacagtcctagcgaacacacagacaccgaacggaatggacctgatacaaaccaccagaatcctcaaaacaaaacgagtccattctccgtgtccccaacaggccctagcacaaaaatcaaagccgaggacccttcaggtgatagcgccccggctgcaccattgcctccacagcccgcccagccccacctcccccaggcccagctcatgctgactggtagccagttggcaggagacatccagcaattactccagttgcagcagctggtgctcgtgcccgggcatcacctgcagccgccagcacagttcctgctgccacaggctcagcagtctcagccgggcttgctgcccacacctaatctgtttcagcttcctcagcagacacagggtgcactgctcacaagtcagccacgcgccgggctgccgacacagcctcccaaatgtcttgagcccccgtcacatcctgaggagcccagcgacctggaggaactggagcagttcgccaggactttcaagcagaggaggatcaaactgggattcacgcagggcgacgttggattggctatggggaagttatatggtaatgactttagccaaactaccatctccagatttgaggctcttaacctaagttttaaaaacatgtgtaaactcaaacccctattggaaaagtggctgaacgacgctgagacgatgagtgtggactcgtcactcccctccccaaaccagctcagctccccttcgctcggcttcgacggccttccaggacgcaggcgaaaaaaaaggacctccatcgagaccaacgttaggttcgctcttgaaaaatccttcctggcaaatcagaaacccaccagcgaggagatactactcatcgctgaacagctgcatatggagaaagaagtaataagagtgtggttttgtaacaggcggcagaaggaaaagcgcatcaatccatgctccgccgcacctatgcttccatcaccaggcaaacctgccagctacagccctcacatggtgaccccccagggcggcgctggtactctccctctatcccaagcctcctcatcactgtccacgactgtaaccaccctttcatccgctgttggaaccctccacccatcccgaacagccggggggggtggaggcggcggcggcgcggcccccccgctgaattctatacctagtgtgacacctcctccccccgcgacaacaaacagtaccaatccaagcccacaaggttctcactcagcgatcggccttagcggcctgaatccatctacaggacccggactgtggtggaatccggccccttatcaaccttag

SEQ ID NO: 129629 - DNA, 1425 bp, Artificial Sequence
  Description of Artificial Sequence: Synthetic coding sequence
atgggggctccagaaatcaggatgtcaaagccgcttgaggcggaaaagcaaggactggatagtccttctgaacatactgataccgaacgaaacggccctgacactaaccaccaaaacccccaaaacaagacatccccgttcagcgtgagtcccacaggcccgagcactaaaatcaaggcggaagacccatcgggtgactctgctccggccgcgcctctgccacctcagccagcccagccccaccttccccaagcccaactgatgcttacaggatcccagctcgccggcgacatccagcagctgctgcagctccaacaactggtacttgtgcctggccatcatctgcaacctcctgcccaatttttgctgccccaggcccaacagtcacagcccggccttctgccaaccccaaacctctttcaactgccacagcaaacacagggggcactcttaacaagccaaccaagagccggtctgcctactcaggccgtaacccggccaactcttcccgatcctcacttgagccatcctcagccacctaagtgtttggagccaccttctcaccctgaggagccttcagacttagaagagctggagcaattcgccaggactttcaagcagcgcagaattaagctgggctttacacaaggcgacgtgggtctggccatggggaagctgtatggcaatgatttttcccagacaaccatctccagattcgaggcgctcaacctgtcttttaaaaatatgtgcaagctaaagcctctgttggaaaaatggctcaacgacgctgagacgatgtcggtggattcatcactcccttccccaaaccagctctccagtcccagtctcggttttgatggcctacctgggagacgtaggaaaaaaaggacctcaattgagaccaacgtgagatttgcccttgaaaagtctttcctggctaaccagaagcccacctccgaggagattctcctgattgccgagcaactgcacatggagaaggaggtgatcagagtgtggttttgcaatagacggcaaaaagagaagagaatcaatccatgctccgccgcccctatgctcccatccccgggtaaacctgcctcgtatagcccacatatggtaactccgcaaggcggtgcaggaactctgccactcagccaggcttcctcatcactgtccacaacggtgacgacattaagcagtgcagtagggactctgcacccctcccgcacagccggcggcgggggcggggggggtggcgctgcgccgccgctgaattctattccttctgtaactccacccccgcccgcaaccacaaatagcacaaaccctagccctcagggtagccactctgctatagggctctccggtctgaatccatctactggcccaggcctgtggtggaatcctgccccctaccagccttag

SEQ ID NO: 129630 - DNA, 1203 bp, Artificial Sequence
  Description of Artificial Sequence: Synthetic coding sequence
atggtgcactcatctatgggtgcacccgagattagaatgtctaaacccttagaggcagaaaagcagggtctggattcacccagcgaacataccgacaccgaacgaaatgggcctgacaccaaccaccagaacccccagaacaagaccagtcccttttccgtgagcccaacaggacccagcactaaaatcaaagctgaagaccccagcggagacagtgctccagctgctccgctaccgccccagcccgcccagccgcaccttcctcaggcacagctgatgctgacaggtagccagctcgctggtgacatccagcagctccttcaattgcagcagctggtgctggtcccgggacaccacctccagccccccgcccagttcctcttgccccaagcccaacagtcacagcctggcttgttgcccactccgaatctcttccagttgccacagcaaactcagggagccttactgacgagtcagccaagggccggtttacctacccaaccccccaaatgtctggaaccacctagccatccagaggagccgagtgacctggaggagttggagcagttcgcaagaacatttaagcagaggaggataaagctgggtttcacgcaaggcgatgtgggccttgcaatgggaaaattatatggaaacgatttttcacaaacgactatctcgcggttcgaggccctgaacctgtccttcaagaatatgtgtaaactaaagcctctgctggagaaatggcttaacgacgcggaaactatgtctgtagatagcagtctcccgtccccaaatcagctgtctagcccctcactggggttcgacggcctgccaggcaggcgccggaaaaagcgtacgagtatagagaccaatgtccggtttgctctcgaaaagtcatttctcgccaaccagaagccaacgtccgaggagatacttctcatcgctgagcaactccacatggagaaagaagtcattcgggtgtggttttgcaaccgaagacagaaagaaaaaagaatcaacccttgctcggccgctcctatgttgccttcgcccgggaagccagcttcttattccccacatatggtgaccccccaagggggtgctggaacattgccactttcccaggcctcgtcttcactgagcactacggcccagactccggccctgaaagccgccacaaggctgtctgcatgccaggcatag

SEQ ID NO: 129631 - DNA, 1404 bp, Artificial Sequence
  Description of Artificial Sequence: Synthetic coding sequence
atggtgcacagctcgatgggggccccggagatcagaatgtctaaacctttggaggctgagaagcagggattggactcccccagcgaacacacagataccgaacgcaacgggcctgacacgaatcatcagaatccacagaataaaacaagtccgttctcagtcagccccaccggaccatctactaagatcaaagcggaggatccgagcggtgattcggccccagccgcacctctcccgccgcagcctgcccagccccacctcccccaggcccagctcatgctgaccgggtcccagctagccggcgatatccagcagttgctgcaactccagcagttagtgctggttcctggacaccaccttcagccgccagcccagttccttctgccccaagcgcaacaatcccaaccaggccttctgccaacccccaatctttttcagttgcctcagcaaacacagggtgcgttactgaccagtcagccaagggcaggattgccgacgcaagcggtgactcggccaactctgcctgatccacatctgtctcaccctcaacctcctaagtgtctcgagcccccttcccacccggaggagccatcagatttggaggaactggaacagttcgcaagaacgttcaaacagcgacgaattaaacttggttttactcagggcgatgtagggcttgccatgggcaaactgtatggtaacgattttagtcagaccaccatttctagattcgaagccctaaacctgtcctttaagaatatgtgcaaactgaagcctctactcgaaaaatggctcaatgatgcagaaacaatgagtgtagattcatctctgcccagcccaaatcaactgtccagcccatccctaggtttcgatggtttgcccggcagacgacggaaaaaaaggacgtccattgaaactaatgtgcggtttgccctggagaaaagctttctagcgaatcagaagccaacttccgaagagatacttctgattgccgagcagctacacatggaaaaggaggtgatccgtgtttggttctgtaatagacggcaaaaagagaagagaatcaacccctgttccgctgctccaatgttgccttcccctggaaagccagcaagctactctccacacatggtcactccccagggaggggcaggaactctcccactgagccaggcctcttccagtcttagtacaacggtcacaacactgagcagcgccgtgggtacattgcatcctagtaggacggcagggggaggagggggcggcggcggagccgctcctccactaaactcgatcccttcagtgactccgcctcccccagccacaacgaatagcaccaacccttcaccgcaaggaagtcattccgcgataggactgagcggcctcaatccaagtaccggttag

SEQ ID NO: 129632 - DNA, 1761 bp, Artificial Sequence
  Description of Artificial Sequence: Synthetic coding sequence
atggttcactcctccatgggcgcacctgagatccggatgtctaagcccttagaggcggagaagcagggccttgatagtccaagcgaacataccgacacagagcggaacggaccagacaccaaccaccagaatccacagaataagacaagtcccttcagtgtgagcccaaccggcccctcgactaagattaaagccgaggacccatctggagactctgcgcccgcagcgccactgcctcctcaacccgcccagcctcatctcccgcaggcccagctaatgctgaccggtagccagctcgccggcgatatccagcagctactacaactacagcagctggtactcgtaccgggccaccacctccagccccctgctcaattcctcctcccacaggctcaacagtcgcaacccggccttttgccgacccccaacttgtttcaactccctcagcagacacagggggccttgctaacctcccaacctagggccgggctgcccactcagccccccaaatgtcttgagccgcccagccatcctgaggagccttcagacctggaggagctggagcagttcgcccgcaccttcaaacaaaggaggatcaagctggggttcacccagggggacgtggggctggcgatggggaagctgtacggaaatgacttttcccaaacaaccatctccaggtttgaggctctcaatctgagctttaagaatatgtgtaaactgaagcctttgctggagaaatggttaaatgatgccgaaaccatgagcgtggactcctctctgccttccccaaatcaactgagctctccatctcttgggtttgacgggctgcccggaagacgccgaaagaaacgtaccagtatcgaaaccaacgtgcgcttcgccctcgagaaatctttcctcgccaaccaaaaacccactagtgaggagatcctgctgatcgctgagcagctacatatggagaaggaagtcatacgtgtatggttctgcaatagacggcagaaggagaagcgcataaatccctgcagcgcagccccaatgcttccatcccccgggaaacctgcatcctactcaccacacatggtcacccctcagggcggcgctggtaccctgcccctgagtcaggcgtcttcctctttgtcaactactgtcaccactctgtctagcgccgtcggaactctccacccatctagaactgccggggggggtggaggcggggggggggctgcaccccctcttaattccatcccatccgtcacaccgcccccaccagctacgacaaattctacaaatccttccccgcagggcagtcatagtgccatcgggcttagcggactcaatccatcaacaggctctactatggtgggactgagcagcggtctaagcccggctctgatgagcaataaccccctagccaccatccaggctctggcatcgggcggcaccttgcctctcacctcgctggatgggtccggtaacctggtgctgggcgctgcaggggcagcccctggttcccctgggctcgtgacctcccctctctttctcaaccacgccggtctccccttgttgagcactcccccaggagtggggttggtatccgctgccgcggccgctgtcgctgcaagcatttcatcaaagagcccagggctgtcaagttcctctagttcttcttcctcgagcagcagtagtacatgtagcgaaactgccgctcagactccgggtggacccggcggaccagaggccggcagcaaacctgaatag

SEQ ID NO: 129633 - DNA, 1311 bp, Artificial Sequence
  Description of Artificial Sequence: Synthetic coding sequence
atggtaaaccttgagtccatgcacaccgacataaagatgagcggcgacgtcgctgatagcaccgacgcacgatccaccctgagccaggtggagcccgggaacgaccgaaatggtctggactttaaccgccagattaagacagaagatctctccgacagcctccagcaaaccctgtcgcaccggccttgccatctgtcacaaggccctgcaatgatgtcagggaatcagatgtctggactgaacgccagcccatgtcaggacatggccagcctgcatcctctgcagcagctggttctcgtaccgggccacctgcagtctgtttcccagtttctccttagccaaacacagcccggccaacaggggctccagcccaatctgttaccattcccacagcagcagagcggtctgctgctgccccagaccggacctgggttggcttcacaggcattcggccacccagggcttccaggaagcagccttgagccccacctggaagcttcccagcacctgcccgtacctaagcatctgccttcctccggaggggccgacgagcccagtgacctcgaggagctagagaagttcgccaaaacttttaagcaacggcggatcaaattagggttcacacaaggggatgtgggcttggccatggggaaactgtacggtaatgactttagtcaaaccacaattagccggtttgaagcattgaatcttagcttcaaaaatatgtgtaagctgaaacccctgctggagaaatggttgaacgacgcagagtcatctcccagcgacccctctgtgagtaccccatcttcctacccgtcactttctgaggtctttggacggaaacggaaaaaacgaacctcaatcgagactaatattcgtttgacacttgagaagaggttccaggacaaccctaaacctagtagcgaggagatctccatgattgctgagcagctctctatggagaaagaggtagtcagggtgtggttttgtaatcggagacagaaagagaagaggattaactgtccagtcgccactccaatcaagccacctgtgtataactcaaggcttgtgtccccttcaggatccctgggacctctgagtgttcctccagtccatagtacaatgccaggaaccgtgacgagcagctgttctcccggaaacaacagtaggccatcaagtcccggatccggactgcatgcctcatctcccaccgcttcccaaaataattcaaaagctgcagtcaattcggccagcagcttcaattcttcagggtcctggtataggtggaatcacagtacttacctgcactag

SEQ ID NO: 129634 - DNA, 1317 bp, Artificial Sequence
  Description of Artificial Sequence: Synthetic coding sequence
atggagtctcctaggacagccaagggaggtcgtgacattaagatgagtggagacgtcgctgatagtactgatgcccgctccacgttgagccaagtggagcctgggaatgataggaatggtttagattttaaccgacagattaagacggaggacctgtctgattccctccagcaaaccctatcccacaggccctgccatctttcccaaggtcccgcaatgatgtccggaaatcagatgtccggcctgaacgcttccccatgccaggacatggcatccctgcacccattacaacagctcgtactggtgccaggtcatttacaatccgtttctcaattccttctgtcccaaacacaacccggacagcaggggctccagcctaatttactgcctttccctcagcagcaatccggactgcttttaccgcagacgggtcccggactggcctcccaagccttcggacatccgggtttgcctggatcatcacttgaaccgcacctggaggcttcacagcacttacccgtacctaagcacttgccctctagtgggggggcggatgagccctcagacttggaggagttggagaagttcgccaagacatttaaacaaagaagaataaaattaggattcacccaaggagacgtcggcttagctatggggaagctctatggtaacgatttctctcagaccactatctcccggtttgaagctctgaatctgtctttcaaaaacatgtgtaaactgaaacctctcttagagaagtggctgaacgatgcagagagttctccaagcgatcccagcgtgtccacccccagttcataccctagcctgtcagaggtgttcggacggaaacgaaaaaagagaacgtctattgagactaacataaggctgactcttgagaagcggtttcaggataatcccaagccctctagtgaggaaatcagcatgattgcagagcaactgagcatggagaaggaggtagttcgagtttggttctgcaataggcggcagaaggaaaagcgaattaactgtcccgttgcaaccccgattaaacctccagtgtacaacagtcggctggtgtccccaagcggaagccttggacctctgtctgtccctccagtgcactcaactatgcccggtaccgtgaccagttcttgctcaccagggaacaactctcgccctagtagccccggcagcgggctgcacgcctcttctccgacagcctctcagaataacagtaaagcagccgtcaactccgccagctcatttaacagcagcggaagttggtaccggtggaaccacagcacatatttgcactag

SEQ ID NO: 129635 - DNA, 1356 bp, Artificial Sequence
  Description of Artificial Sequence: Synthetic coding sequence
atggcaactaccgcccaatacctgcccagggggccaggcgggggtgcagggggaaccgggccgctgatgcatccggacgcagcggccgcggccgccgccgccgcggcagccgagcgtctccacgctggggccgcttacagagaagtgcagaagcttatgcaccatgaatggctgggagctggcgcgggacatcctgtaggcctagcgcatccccagtggctgccaaccggggggggcggcggaggtgattgggccggcggccctcacctggaacacggaaaagctggcgggggaggcactgggcgcgccgatgatgggggagggggaggaggatttcatgcacgactggtccaccagggcgcagcacatgccggtgcagcatgggctcaagggagcactgcacaccacttaggtcccgccatgtctccctcccctggggcttcgggagggcaccagccccagcctctcggtctgtacgcacaggccgcctaccctggaggcgggggaggcggattagcaggcatgttggcagcgggcggggggggggccgggcccggccttcaccacgcgctgcacgaggatggccacgaagcacagctggagccctctcccccgccacacctcggcgcgcacggccacgcccacggccatgctcatgctggcgggcttcatgcagccgctgctcacctgcaccccggggcgggcggaggcgggagttctgttggagagcatagcgatgaggatgctccatccagcgatgacctagagcagttcgctaaacagtttaagcaaaggagaatcaagctggggtttacgcaggccgacgtcggtctggcactcggaacactctacggcaacgtcttcagccagactactatatgccgctttgaggcactgcagctctctttcaagaacatgtgcaaacttaagcccctgctgaataaatggctagaggagactgactcatcatccggtagcccaactaacctcgacaagatagccgcgcagggacgtaaacgcaagaaacgtacctccatcgaagtaggagtgaagggcgccctggagagccacttcctcaaatgccccaaacccagcgcacacgagattacaggccttgccgactctcttcagctggaaaaagaggtggtccgagtgtggttctgcaaccgcagacagaaggaaaagaggatgactcctgctgcaggcgccggccacccaccaatggacgacgtgtatgcaccaggggaactcggacctggaggcggtggagcttctcccccttctgcaccaccaccaccaccacctgctgcgttgcaccaccaccatcatcacacgttaccaggctccgtgcaatag

SEQ ID NO: 129636 - DNA, 1332 bp, Artificial Sequence
  Description of Artificial Sequence: Synthetic coding sequence
atggcaacagcggcctccaatcattactctttgctgaccagttctgccagcatcgtgcacgctgaaccacctggcggtatgcagcagggtgcaggggggtaccgcgaagcacagtctctcgtacagggagactacggcgctctgcagtccaacggccaccctttgagtcatgctcaccagtggatcacagccctgtcccacggcgggggtggtggtggtggaggcggaggcggtggaggaggaggcggaggtggaggcgggggcgatggatccccttggagcacttcccccttaggtcaacccgatatcaaaccctcggtcgtggtccagcagggagggcgaggggacgaactgcatgggcctggcgcattgcagcagcagcaccagcagcagcagcaacagcagcagcaacagcagcagcagcagcaacaacagcagcaacagcagaggcccccacatctggtgcaccacgcagctaaccatcatcccggtccgggcgcatggaggtccgcagcggccgccgcgcaccttccaccgtctatgggcgcctcgaatgggggattgttgtatagtcagccaagcttcaccgtgaatgggatgctgggtgccggaggccagccggccggcctgcaccaccatggactccgagacgctcacgacgagccccaccacgcagaccatcatccgcatccccattcgcatccccaccaacaacctccaccaccgcccccccctcaagggcctcccggccatcccggggcccatcacgatccacatagtgatgaggatactcctacaagtgacgacttggaacagttcgcaaaacagtttaagcagcgtagaattaagctgggctttactcaagcggacgtgggccttgcgttgggaaccctctatggtaatgtcttttcgcagactacgatctgccggttcgaggctctgcaactgtctttcaagaatatgtgcaagctgaaacctttgctgaacaaatggttggaggaggccgattccagttcaggctcacctaccagcatcgacaagatagctgcccaaggaagaaaaagaaaaaaaaggacatctatcgaggtgtctgtgaagggggcactggaaagtcactttctgaagtgtccaaaaccttcggctcaggagataacaagcctagccgactcgctccagctggaaaaggaggtcgtgcgtgtgtggttttgcaacagacgccagaaagaaaagaggatgaccccccctgggggcactctgccaggtgcagaggacgtgtacggcggctcacgagatacacccccacatcacggcgtgcagacacccgtgcagtag

SEQ ID NO: 129637 - DNA, 1131 bp, Artificial Sequence
  Description of Artificial Sequence: Synthetic coding sequence
atggctaccgctgcatccaaccactatagcctcctgacctcatccgcctcgatcgtccacgctgagccccccggcggaatgcagcagggcgccggaggctatcgcgaagctcagtcacttgttcagggcgattacggcgccctgcaatcaaacggacatccattatcgcatgcccaccagtggattaccgctttgtcacacggtggggacgggagcccttggtcaacatccccccttggccagcccgatatcaaaccgagcgtggtggtgcagcagggggggaggggtgacgagctgcatggacccggcgccctgcaacagcagcatcagcagcaacagcagcagcagcagcagcagcagcagcagcagcagcagcaacagcagcagcagagacccccacacctggtgcatcacgccgctaaccaccatcctggaccaggtgcctggcgttctgcagccgcggcagcgcatctgccgccttccatgggcgcatcaaacggaggcctcctttacagtcagcctccacctcccccccagggacctcctgggcaccccggagctcatcatgatcctcattccgacgaagatacccccacttcggatgatttggagcagtttgcaaagcagttcaagcagaggcgtatcaagttaggatttacccaagccgacgtgggcctggcgctcggtacgctgtacgggaatgtgtttagccaaaccaccatttgccgcttcgaggcactgcagctcagcttcaagaatatgtgtaagctcaaacctctgctgaacaagtggctggaagaagctgattcaagcagcgggagccctacaagtattgacaagatcgccgcccaaggccggaagcggaaaaaacgcacctccattgaggtgagtgtgaagggtgcccttgagtcacactttctgaaatgtcccaagccatcagctcaggagataacttcccttgccgacagtttgcagttggaaaaagaggtggtgcgtgtgtggttctgcaaccggagacagaaggaaaaaagaatgacaccccccggcgggacactgccgggagccgaggacgtttatgggggtagccgggataccccgccacaccacggagtacagactcctgttcaatag

SEQ ID NO: 129638 - DNA, 1503 bp, Artificial Sequence
  Description of Artificial Sequence: Synthetic coding sequence
atggccacggcagcttctaatccgtatctgcccggtaacagcctcctggcggctggttccatagtacacagcgatgccgcaggggccggagggggcggcgggggtggggggggaggcggaggtggtggcgcgggcgggggcggtggcggcatgcagcctggttccgccgccgtgaccagcggcgcatacagaggcgacccctcctcagtcaaaatggtacagagcgacttcatgcagggggctatggctgctagcaatggtggacacatgctatcccacgcacaccaatgggttacagctctcccacacgccgcagccgctgctgcagctgctgccgctgcagctgtcgaggcttcatccccctggtcaggcagcgccgtgggaatggcgggttctccacagcagcctccacaacccccccctcctcccccccaggggcccgacgtcaagggaggagccggacgcgatgatctgcatgcggggactgcgctacatcaccgtggaccaccgcacctcggtccaccacccccacctcctcatcagggacatccagggggttggggcgctgccgccgcggctgctgccgccgccgctgccgcagcggcagcagcccacctgcctagcatggctggcggtcagcaaccccccccccagtctcttctctattctcagccaggaggcttcactgtgaatggaatgctctcggcccctccaggccctggaggcgggggtggcggcgccgggggtggtgcccaatcactcgtccatccgggactggttagaggcgacacgccggaactggctgaacaccaccaccaccatcaccatcacgctcatccacaccctccccacccgcaccacgcacaaggaccgcctcaccacggggggggaggaggaggagccggacccgggttaaactctcacgatccacattccgacgaggataccccaactagcgacgaccttgagcagttcgccaagcaatttaagcagcgaagaatcaagctggggttcacacaagcagatgtggggcttgcactcggcaccctctatgggaacgtatttagtcaaaccaccatttgtaggttcgaagcccttcaattgagcttcaagaatatgtgcaagctcaagccacttcttaacaagtggctggaagaagcagatagtagcacagggtcacccacctctattgacaagatagccgcccagggaagaaagcgaaagaagcgcaccagtatcgaagtgtctgtgaaaggcgctttagagagccacttccttaaatgtcccaagcctagcgcgcaagagataacaaaccttgcggattcccttcagctggagaaagaggtggtgcgtgtttggttttgcaatcgtaggcagaaggagaaacggatgactcccccaggcatccagcagcaaaccccagacgatgtatatagccaggtggggaccgttagcgccgacactcccccccctcaccacgggcttcagacttcggtccaatag

SEQ ID NO: 129639 - DNA, 1086 bp, Artificial Sequence
  Description of Artificial Sequence: Synthetic coding sequence
atggccaccgccgcctccaacccgtattctatcctctcttcgacttccctcgtgcatgctgatagtgcagggatgcaacaaggcagcccatttcgcaatcctcaaaaattactccaatccgactatctccagggagtgcctagcaatggacacccgcttggacaccattgggtgacaagtctcagtgacggcggaccctggtccagcaccctggccacctcgccactggatcagcaggacgtgaaacccggcagggaagacttacaactgggtgcaatcattcaccatcgtagccctcacgtggcccaccacagtccccacacaaatcatcccaatgcatggggtgcctccccggccccaaatccttctataacaagctctggccagccgttgaatgtgtatagtcagccaggtttcacagtgtctgggatgctcgagcacggcggactaaccccaccccctgccgcagcatccgctcagagtctgcacccagtgctgagggaacctcctgatcacggggagctgggcagccatcactgtcaggatcactcagacgaagagacccccacgagtgatgagcttgaacagttcgctaagcagtttaaacagcggcgcataaagttgggcttcactcaggccgacgtcgggttagcactggggaccctgtacgggaacgttttttctcaaactaccatctgtagatttgaagggttacagctgtcattcaaaaacatgtgcaaactcaagcccctcctcaataaatggctggaggaggccgattcttccacaggatctcctaccagtattgataaaattgctgcccaaggccggaagagaaagaagagaacgtctatagaggtgtcagtgaagggcgtgctcgaaacccactttctaaagtgtcccaagccagcagcccaggagatatcctccttggcagatagcctgcagctggagaaggaggtggtgagagtttggttctgtaacaggaggcagaaagagaagcggatgacaccaccgggtgatcagcaaccacacgaggtgtactcccacacggtgaagacagatacaagctgccatgatctttag

SEQ ID NO: 129640 - DNA, 1260 bp, Artificial Sequence
  Description of Artificial Sequence: Synthetic coding sequence
atgatgtccatgaactctaaacaaccccactttgctatgcaccccaccctgcccgaacacaagtatcctagcctgcactcatcgtctgaggccatccggcgagcatgcctgccaactcccccccttcagtctaatttgtttgcttcacttgacgaaaccctgttggctagagcagaggcattagcggctgtggacattgcagtgtcccagggcaagtcacacccatttaagccggatgctacctatcacacaatgaatagtgtcccttgtacatctactagcactgtgcctctcgctcaccaccaccaccatcaccaccatcatcaagctcttgagcctggagacttgcttgatcacatttcttcgccgtccctggccctcatggcgggagccgggggggccggcgctgctgccggcggaggcggggctcacgatggacctggaggggggggcgggcctggtggaggcggggggccgggaggaggccccggcggcggcggcggtgggggacccggtgggggaggtggcggccccggtggaggtctcctgggtggctcagctcatccgcacccccatatgcatagtcttggtcacctttcccacccagcagcagccgctgccatgaacatgccgtcaggacttcctcacccaggcctcgtagccgctgctgcgcaccatggggctgccgctgctgcggcggctgctgcagccggacaggtggccgccgctagcgccgccgctgctgtcgtcggcgccgccggactggcctcgatctgcgattccgacacagatcccagggaactggaagcttttgccgagaggtttaaacagcggcggatcaaactgggcgtgacacaagcagacgttggctctgccctggccaaccttaaaatccctggcgttgggtctctgagccagagcaccatttgtcgattcgagagcctcaccctgtctcataacaatatgatcgcactgaagcctatcctgcaggcctggctagaggaggcggagggggcgcaaagggagaaaatgaataaacctgaactgttcaatggtggcgaaaagaagcgaaagcggacatctattgccgctcccgagaagaggtccctcgaggcgtacttcgccgtgcagcccaggccaagctcagagaaaattgccgccatcgctgaaaagctggacctgaaaaaaaatgtagtgcgcgtgtggttttgcaaccaaaggcagaaacaaaagagaatgaagttctctgctacctattag

SEQ ID NO: 129641 - DNA, 1911 bp, Artificial Sequence
  Description of Artificial Sequence: Synthetic coding sequence
atgaaaaagctccagggagcgcacttgcggaagcccgtgacaccagacctgctaatgacaccatcagaccagggtgacgtagatctcgacgtggactttgccgcccataggggtaattggactggcaagcttgactttctcttaagctgtatcggatattgcgtagggttaggcaatgtttggcgtttcccctacagggcttataccaatgggggcggagccttcctggttccttacttcctcatgttggctatctgtggcattccactgttttttctggagctgagcctcggacagttcagcagcctgggccctctggccgtctggaaaatttcaccgttattcaagggcgctggcgccgcaatgctcctaatagtaggcttagtggccatctactataatatgattattgcatatgttttgttttacctgttcgctagcttgacttctgatctcccgtgggaacactgcgggaactggtggaatacagaactctgtctagagcacagggtgagcaaggacggcaatggtgctctgcctctcaatttgacatgtaccgtctctccttcagaggagtattggtctcgttatgttctgcacattcagggatcccagggtataggaagccccggggagatccggtggaatctctgcctgtgtctgctcctggcctgggtgattgttttcctgtgcattctgaaaggcgtgaagtctagtggtaaggttgtttactttacagcgaccttcccctatctgattcttcttatgctgctcgtgcgaggtgtcactttgcctggagcgtggaagggtatccagttttacttaactcctcagtttcatcacttgctctccagtaaggtgtggatcgaggcagccctgcagatattctactctttgggagtaggcttcgggggcctccttacattcgccagttacaacactttccaccagaacatataccgtgatactttcatcgtgacgctcggcaacgccatcacttctatccttgctggattcgccatattcagcgtcctaggatacatgtcccaagagctcggcgtgcccgtcgaccaggtggctaaagctggccccgggctcgcgttcgtggtctacccacaggcaatgactatgctgcccctcagccctttctggtcgttcctgttcttctttatgcttttgacattgggattagactcacagtttgccttcctggagacaatagtgactgcagtgacagatgaattcccatactacctcaggccaaaaaaagctgtgttctccggtcttatctgtgtggccatgtatctgatgggactgatcttgacaactgacggcggaatgtactggctggtactcctagacgactactctgcttcctttggacttatggtggttgttatcaccacctgcctcgcggttacaagagtttacggcatccagcggttttgtcgggacatccacatgatgttgggtttcaaacccggcctctatttcagggcatgttggttatttctctctcctgcaacccttttagctctgatggtgtatagcatcgtaaaataccagcctagcgaatatggcagctacaggttcccgccttgggccgagttgctgggaatcctgatgggactcctctcttgccttatgatcccagccggaatgctggtagccgtcctgcgcgaagagggtagtctctgggaacgtcttcaacaggcctccaggccggccatggattgggggccttccctggaggagaaccgaacaggaatgtacgtggctaccctcgcagggtcccaatcccctaagccccttatggtgcatatgaggaagtacggtggcattacttccttcgagaatactgctatcgaggttgatcgggaaatcgctgaagaagaggagagcatgatgtag

SEQ ID NO: 129642 - DNA, 798 bp, Artificial Sequence
  Description of Artificial Sequence: Synthetic coding sequence
atgcacttctaccgactattcctgggcgctactcgccggtttctaaatcccgagtggaagggcgagatagacaattggtgcgtgtatgtgctgacctcgctgctgccattcaagatacagagtcaggacatcaaggctcttcagaaagagttagaacaatttgctaagttgctgaagcagaaacgaatcactctgggatatacgcaggcagatgttggcctgactttgggcgtgctgtttggcaaggtattttctcagactacaatttgccgcttcgaggcactccaactctcatttaaaaacatgtgtaaactgaggcctctgctgcagaagtgggtcgaggaggccgacaataacgaaaacctgcaggagatctgtaaggcggagaccctcgtgcaagcacggaaacggaagagaacttccatcgaaaaccgagtcaggggtaaccttgagaacctgtttctgcaatgtcccaaaccgactctgcagcaaatctcccacatagctcaacaactcggtctggagaaagacgtggtgcgagtctggttttgcaacagaagacagaaaggcaagcgaagctcgagtgactacgctcagcgggaggacttcgaggcagctggatctcccttttctggaggacctgtctcattcccacttgccccaggcccccatttcgggacacctggctatggctctcctcacttcaccgccctgtattcttccgtacccttccctgaaggggaggcttttccacccgtgtctgttacgactctaggttcgcccatgcattctaactag

SEQ ID NO: 129643 - DNA, 1083 bp, Artificial Sequence
  Description of Artificial Sequence: Synthetic coding sequence
atggctggacatctagcatctgattttgccttctctccccctcctgggggcgggggagatggacctgggggcccggaacctggctgggtggacccgcgcacttggctcagcttccaggggccacctggcgggccaggtattggcccaggggtcgggcccggaagcgaggtctggggaattccaccttgcccgcccccctacgagttctgcgggggaatggcatactgtgggccacaggtgggagtggggttagtgccacaaggaggtcttgaaacaagccaacctgaaggggaggcgggcgtaggcgtggaatcaaactccgacggcgctagcccagaaccttgtactgtaacacccggcgccgtgaagttggagaaggaaaaactagaacagaatccggaagagtcccaggacattaaagctctgcaaaaggaactcgaacagttcgccaagctgcttaagcagaagaggatcacgctgggctatacccaggcagatgtgggcctaacacttggagtcctgttcgggaaagtttttagccagacgaccatttgccgatttgaggccctgcagctgtcgtttaaaaatatgtgcaaattgcgcccccttctgcaaaagtgggtcgaagaggccgacaataacgaaaatctgcaggaaatctgtaaagcggaaacgcttgtgcaggcccgtaaacggaaaaggacctcaatagaaaatagggtccggggcaacctagagaatctgtttctgcaatgtcctaaacctaccttgcaacagatttcacacatagcccagcagttgggcctcgagaaggatgtggtccgggtgtggttttgtaatcggcggcaaaaaggaaagcggagcagtagtgactatgcacagcgtgaggactttgaggcagcgggatcacccttctctggaggaccagtgagctttccactagctccaggccctcatttcgggactcctggctacggttctccccattttaccgcactgtactcatccgtgccattccccgagggagaggcctttccacccgtctctgtaaccacattaggctcccctatgcatagcaattag

SEQ ID NO: 129644 - DNA, 372 bp, Artificial Sequence
  Description of Artificial Sequence: Synthetic coding sequence
atggcgggccacctggcgtccgatttcgcattcagtcctcctcccgggggcggtggcgacgggcccggcggccccgaacccggctgggtagacccaagaacatggctgtctttccaggggcccccgggcggtccaggcataggaccaggagtaggcccaggatccgaggtgtggggcatacctccctgtccacccccatatgaattttgcgggggaatggcgtattgcggaccacaggtaggggtgggattagttccacaaggcggactcgaaacttcacagccagagggcgaagccggggtaggagtcgagaccccaatgggtccaccacgaagtcctgccccacatccgttccccttcccattactgtag

SEQ ID NO: 129645 - DNA, 558 bp, Artificial Sequence
  Description of Artificial Sequence: Synthetic coding sequence
atggccggacacctggcgagtgacttcgcgttcagtcctccaccaggaggcgggggggacgggcctggtggcccggaacccggctgggtcgacccacgcacatggttatcctttcagggaccacccggcggaccagggataggccctggcgtgggaccaggaagtgaggtttggggtatcccgccttgcccccctccatacgagttttgtggaggcatggcatattgtgggccgcaagtgggagtggggctggtgcctcagggcggacttgagacctctcagccagaaggcgaggcgggtgtgggggtggagagtaactcagatggagctagccccgagccatgcacagtgacccctggagccgtgaaattggagaaggagaaacttgaacagaacccagaggaaagccaagatataaaggccctccagaaggagctggaacagtttgctaagcttctaaaacagaagcggatcaccctcggatatactcaggccgatgtccatccaggcgggagtatttgggagggcattcagcccaatgaccacctcccgttgtag

SEQ ID NO: 129646 - DNA, 558 bp, Artificial Sequence
  Description of Artificial Sequence: Synthetic coding sequence
atggcggggcatttggcaagcgatttcgccttctccccaccccccggtggtggcggtgatggcccgggcggacccgaaccgggctgggtagaccctaggacctggctgtccttccagggcccacccggggggccagggattggacctggtgtgggaccaggcagcgaagtttgggggatccctccttgtcctcccccatatgagttttgcggaggaatggcatactgtgggccacaggtgggtgtcggcctggtccctcagggaggcctggagacttctcagccagaaggcgaagcaggcgtgggggtggaaagtaacagcgatggcgcatctcctgagccgtgcacagtgactccaggcgccgtcaaactcgagaaggaaaaactggagcagaacccggaggaatctcaggatataaaggctctgcagaaggagctggagcagtttgccaaactcctcaagcagaagcgcattactcttggatacacacaggccgacgtgcacccgggtgggtctatctgggaggggattcagcccaacgaccacctgcctctctag

SEQ ID NO: 129647 - DNA, 495 bp, Artificial Sequence
  Description of Artificial Sequence: Synthetic coding sequence
atgtgcaaactacggcctctactccagaaatgggtggaagaggctgataacaatgaaaatctgcaggagatttgtaaggccgagacactggtgcaagctagaaagagaaaacgcactagcattgaaaaccgcgtgcgggggaatctcgagaatcttttccttcagtgtcctaaacctactctgcaacaaatttcccacatagcccagcagctggggttagaaaaagacgtcgtgagagtgtggttttgtaaccggaggcagaaaggcaagcggtcttcctccgactatgcccagcgggaagacttcgaagcggccggctctcctttctcagggggccccgtgtcatttcccctcgctcctggacctcacttcggcacaccaggctacgggagcccccacttcactgcattatattcgagtgtaccctttcccgagggtgaagcctttccacctgtgtcagttaccacactgggatcacccatgcacagcaattag

SEQ ID NO: 129648 - DNA, 495 bp, Artificial Sequence
  Description of Artificial Sequence: Synthetic coding sequence
atgtgcaagctgcgtcccctgctccaaaagtgggtggaagaggccgacaataatgagaacttacaagagatctgtaaggcagagactcttgtccaagctcggaagaggaagcggactagtattgaaaacagggtgcgcggtaatctggaaaacctatttctgcagtgtccaaagcctacacttcaacagatcagccacattgcacaacagctgggcctcgaaaaggatgtcgttcgcgtttggttctgcaatcgaaggcaaaaaggtaaaagatcttcatccgattatgcgcaaagagaagactttgaggctgctggctctcccttctctgggggccccgtctcgttccccttggctcctggaccacacttcggtactccaggctacggatctccacactttacagcactgtactcctcggtgcctttccccgagggcgaggctttcccacccgtgtctgttactaccttaggcagtccaatgcactccaattag

SEQ ID NO: 129649 - DNA, 2076 bp, Artificial Sequence
  Description of Artificial Sequence: Synthetic coding sequence
atgagcgcattactgcaggatcctatgattgcaggacaggtctcaaaacctttgctcagcgtcaggagcgaaatgaatgctgaactaaggggagaagacaaggcagctactagtgatagcgagttaaacgaaccgctgctcgctccagtagaatcaaacgatagtgaggacacgcccagtaaactcttcggggctcgcggtaaccccgctctgtctgaccccggtaccccggaccagcaccaggcctcccagacacatcctcccttcccagttggcccgcagcctctgcttaccgcccaacagctggcttcagccgtggctggcgtcatgccgggggggccaccagctctcaaccagcctattttaataccctttaacatggccggccaattagggggccaacagggcctggtgctcactttgccaaccgccaacctaacaaacatccagggtctggtggcggccgctgccgcaggcgggatcatgacattacccctccagaatctccaggctaccagctcccttaacagccagttacagcagctacagctgcagttgcagcaacagcagcaacagcaacagcagcagcccccacccagcacaaaccaacaccctcagcccgcacctcaggccccaagccagtctcaacagcaaccactgcagcccaccccgccccagcagccccccccagcttctcaacagcctcctgctcccacgtcccaactccagcaggccccccagccccagcaacaccagccccactcccatagccagaatcagaatcaaccgagcccgacacagcagtctagcagccccccacagaaaccttctcaaagccctgggcatggcctgcctagtcctctgacccccccgaatcccctgcaactcgtgaataaccccttggcctcccaggccgctgcggctgccgctgcgatgtcctccattgcaagctctcaggcattcgggaacgcgctctcgtctctgcagggggtgactggtcagctggtcaccaacgctcaaggccagataattggcaccattcctctaatgcccaaccctggcccctccagccaggcggcctctgggacccagggcctacaggtgcagccgatcacgccccagctgctaacgaacgcccaggggcagattatcgccactgtgatcggtaatcagatcctgccagtgataaacactcagggaatcaccctgtctcctataaagccagggcagcagcttcaccagccgtcacagacgtcagtagggcaggccgcaagtcaaggcaatctcctccacctagctcatagtcaagcctccatgagccagtccccagtccggcaggccagttcgtccagcagcagcagttcatcatccagcgccctttcggtgggacagctggtatcaaatccccaaacggccgctggcgaagtcgacggggtgaacctcgaagagatcagagaatttgcaaaggctttcaaaataagacgtttgtctcttggactgacacagactcaggtcggccaggcactaagtgcaacagagggcccagcatactctcagtcagccatctgccggcacacgattctgagaagtcattttttcctgccacaagaggcacaagaaaacaccattgcttccagtctgactgctaagctcaaccccgggctgctgtaccccgcccgattcgaaaaactcgacataacccctaaatcagcacagaaaataaagccagtcctggagaggtggatggccgaagcagaagccagacacagagcagggatgcagaatctgactgaatttattggaagcgagccaagcaagaaacgtaaaagacggacaagttttactccccaagcgttagaaatcttgaacgcccacttcgaaaagaatactcacccttcagggcaggaaatgaccgagatcgcagagaagctgaactatgaccgagaggtggtgagagtgtggttttgcaacaagcggcaggctctaaagaataccattaagagactgaaacagcacgagccagccaccgcggtgcccctagaacctctgacagatagcttggaggaaaattcctag

SEQ ID NO: 129650 - DNA, 1968 bp, Artificial Sequence
  Description of Artificial Sequence: Synthetic coding sequence
atgtctgccttactccaggatcccatgattgccggccaagtttctaaacccctgctgtctgtccggagcgaaatgaacgcggagctgcgcggtgaggataaagccgctacttccgatagtgagcttaatgagcctcttctggctcccgtagaatccaatgattcagaggatactcccagcaaactctttggggcccggggcaatcctgctctgtccgatccgggcacccctgatcagcaccaggcttcccagacccacccaccttttcccgtggggccccagcccctcctgacagctcagcaactcgcgtccgccgtggctggcgtgatgcctgggggcccaccggcattgaaccagccaatcctgattccattcaatatggccggccagctaggaggacagcaggggctagtgctaaccttacctactgctaatctgacaaacatccagggtctggtagccgcggccgcggccggcggaattatgacactaccccttcagaacctgcaggccacgtcatcactgaattctcagctgcaacagctgcaattacagctgcagcagcaacagcagcagcagcagcagcagccacccccatccactaatcaacatccccagcccgccccccaggcgccctcacagagccagcagcagccactacagccaactccccctcagcagccccctcccgcaagccagcagcctcctgcgccgacctctcagctgcagcaggcacctcagcctcagcagcaccagccgcactcgcactcacagaatcagaatcagccgtcccccactcaacagtcatcatccccgccacagaaaccgagtcagtctcctggtcacggtctgccttcaccattgacgccgccgaatcccctccagctggtgaacaacccattggcatctcaggccgccgccgcagccgcagccatgagttctatcgcgagctcacaggccttcggtaacgcactgtccagcctgcaaggcgtgactgggcagctggtgaccaacgcacagggccagatcataggtacaatcccactgatgcctaaccccggcccatcttctcaggccgcctcaggcacacaagggttgcaggtgcagccaatcactccacaactgctgaccaatgcccaggggcagatcatcgctaccgtcatcgggaaccaaatcctaccagtgatcaatactcaaggtatcaccctgagtcccattaaaccagggcagcaattgcatcaaccatcccagacgtccgtgggacaggctgctagtcagggcaacctgttacatctggctcacagccaggcctccatgtcccagagccctgtgcggcaggccagctcctcatcaagttcctcaagctccagttccgccctttccgtagggcagcttgtgtctaatccgcaaacagctgctggcgaggttgacggagttaatctggaggaaatcagagaatttgccaaagccttcaagataagaaggctgtctctggggctaacacagacacaagtcgggcaagcactgtccgccactgagggtccagcctacagccagtccgctatctgccgttttgagaaactggacatcacacccaaaagcgcccagaaaattaagcctgtcctcgagcgatggatggccgaggctgaagcacggcaccgggccggtatgcagaatttgactgagttcattggcagcgaaccttccaagaagcgaaagcgacgaacctcctttaccccacaggccctcgaaatcctaaatgctcattttgaaaaaaatactcacccatcgggtcaggagatgaccgagattgccgagaaactaaattacgaccgggaggtggtgagggtgtggttttgcaacaagaggcaggccctgaagaacaccatcaaacggctaaaacagcatgaacccgcaaccgcagtaccactcgaacccttaactgactcactcgaagagaattcatag

SEQ ID NO: 129651 - DNA, 2076 bp, Artificial Sequence
  Description of Artificial Sequence: Synthetic coding sequence
atggaaaaaatctattcaaggggtgaactgcatcactttatagatgggtttaatgaagaaaagagtaattggatgaggtatgtgaaccccgcacacagtcctagagagcagaaccttgccgcttgtcagaatggaatgaacatctacttttacacgatcaaaccaatccctgctaatcaagagctgttagtatggtattgccgtgacttcgcggaaagactccactatccttatcccggagagctaaccatgatgaatctcacgcagacacagagctcgcttaaacagccttcgacagaaaagaacgagctgtgtccgaaaaacgttccgaaaagagaatatagcgtaaaggaaatactgaagctggattctaacccttcaaagggtaaagatctctatcgtagcaacattagccctctcacatccgaaaaggacctagacgacttccggcgcagaggatcccccgagatgccattttatccccgggtggtgtaccctataagagcgcccttgccggaggacttcctgaaggcctctcttgcttatgggatcgagcgacccacctatatcactcgatcacccattccaagcagtacaactccaagtccctcggcccgcagctcccctgatcagtctctcaaatccagttccccgcatagctcccctggaaatactgtctcgcccgtggggccaggctctcaggagcatagggatagttacgcatatctgaacgctagctacggaacagaaggcctgggatcctacccagggtacgcccccctcccgcacctgcctcctgccttcatcccgtcatataatgcccactatcctaaattcctcctcccgccctacggaatgaattgcaacggcctgtcagcggttagtagcatgaatggaatcaacaactttggtctgtttccccggctgtgtccagtttattccaacctacttggaggaggctctctgccccatcctatgctcaaccctacttcactccctagctccctacccagtgatggcgcgcggcgtctgcttcagcccgaacacccacgcgaggttctggtacctgccccgcattctgccttcagcttcacgggtgctgccgcctccatgaaggataaagcgtgtagccccacatccgggagcccaactgctggcacagccgctaccgctgagcacgtagtccagcctaaggcaacttctgctgccatggctgcacctagctccgacgaggcaatgaaccttattaagaataagcggaacatgaccggctataagacactgccatatcccctgaagaaacagaatggcaaaattaagtacgagtgcaacgtctgcgccaaaactttcgggcagctgtcaaacctcaaggtgcatctgagagtgcattccggcgaacgcccctttaagtgtcaaacgtgtaataaaggctttacccagcttgcgcacttgcaaaagcattatctggtacacacgggcgagaaaccacacgagtgtcaggtctgtcacaagcggttctccagtacctctaatctgaaaactcacctccgtctccacagcggcgaaaaaccctaccaatgtaaggtgtgtcccgctaagttcactcagttcgtgcacctgaaacttcataagcgcctccacaccagagaacgtccccacaagtgtagccagtgccataaaaattacattcatctctgtagcctcaaggtgcatctaaagggaaactgtgctgccgcacctgctcctggtctgcctcttgaagatttaactcggattaatgaggagatcgaaaaattcgatatatctgataacgctgatcggttagaggacgttgaagacgacattagcgttatcagcgtggtagagaaggagatccttgccgtcgtccgaaaggaaaaagaggaaaccggcctcaaggtctcattgcaacgcaacatggggaacgggctcctgtcgtctggctgttctctctatgaaagttctgaccttccactcatgaaactccccccctcaaatcctctccccctggtacctgtgaaagtgaaacaggaaaccgtagagccaatggacccctag

SEQ ID NO: 129652 - DNA, 2370 bp, Artificial Sequence
  Description of Artificial Sequence: Synthetic coding sequence
atgaagatggacatggaggacgccgacatgaccttatggaccgaagccgaattcgaagagaagtgcacctatattgtaaacgatcatccgtgggattctggggctgacggcggcacatccgtacaagccgaggcctctctacccaggaatttgctgttcaaatatgccaccaacagcgaagaggtaatcggtgtgatgagcaaggagtatatcccaaaaggaacccggttcggcccactgattggtgaaatctacaccaacgacaccgttcccaaaaatgccaacaggaagtacttctggagaatttactcccgcggagagttgcaccattttatcgacggattcaatgaggagaaaagcaattggatgagatacgtcaaccccgcgcattcacctagagaacagaacctcgccgcctgtcagaacggtatgaacatctacttttacacaataaagccaatcccggccaatcaggagctgctggtgtggtattgtagggacttcgcagaacgtttgcactacccctaccctggagaattaaccatgatgaatctcactcagacgcagtcttcccttaaacagccttctactgagaaaaacgagctgtgccccaagaatgtacccaaacgagagtattctgtgaaagagatcctgaaactggactcgaacccatccaagggaaaggatttgtaccgctctaacatttcccccttgacatcagaaaaagatctggatgactttcggcgtcgtggcagccctgaaatgccattttaccctagagtcgtgtaccctattagagcccctctgcccgaagactttcttaaggccagcctggcctacggcatcgagcgcccgacctacattactcgcagccccattccgagctccacgaccccttcgccctccgctcgctcttcacctgaccagagtttgaaaagtagttcaccgcatagcagcccagggaacaccgtttcccccgtcggccctggctcccaggagcatcgggattcgtacgcctacttaaatgcatcatatggcacagaagggctaggcagctacccggggtacgctcccctgcctcatctgccccccgcgttcatcccttcatacaacgcccattacccgaagttccttctgcctccctacgggatgaattgtaacgggctgagcgctgtcagctctatgaatgggataaataatttcggactgtttcccagactgtgtccggtatattctaatctcctgggtggcggtagtctgcctcatccaatgctgaatcccacgagccttccctccagtctgccttctgatggggcgcgccggctgctacagcctgagcatccacgggaggttttagtgccagctccacatagcgctttttcctttacaggggccgctgcttcaatgaaagataaagcctgttctccaacctccggtagcccgacagccggcacagccgcaacagcggagcacgtggtccagcccaaggctacctccgccgccatggcagctccgagttcagacgaggccatgaacttaatcaagaacaagaggaacatgactggatacaaaactcttccctatcctctgaagaagcaaaatggcaaaattaagtacgaatgcaacgtgtgtgcaaaaaccttcgggcagctgtccaacctgaaggtgcatttgcgggtccacagtggagagcgaccttttaagtgtcagacttgcaacaaggggttcacgcaattagcccacctgcaaaagcactatttagtccacactggggagaagccccatgagtgtcaggtttgtcacaagaggttttcaagtacatccaacttgaagacccatctccgcttacacagcggagagaagccataccaatgcaaagtgtgccccgccaaatttactcagtttgttcatctcaaacttcacaaaaggctccacactcgcgaacgaccccataagtgcagtcagtgccacaaaaactatatccatttatgcagcttgaaggttcatctcaaagggaactgtgccgctgcacccgcgcctggcttgcccctcgaggacctcacacggatcaatgaagagattgagaaatttgacatctccgacaacgccgatcgcctggaggatgtggaagacgacatttcagtaatatctgtggtggagaaagagatattggcagtcgtaaggaaagaaaaggaagaaacaggcctaaaagtgtctttgcagagaaacatgggtaacggactgctgtccagcggatgcagtctctacgaaagttccgatctgcctttgatgaaacttcctccctcaaacccactgccactggttccagtaaaagtcaaacaggaaactgtcgaaccaatggatccctag

SEQ ID NO: 129653 - DNA, 2478 bp, Artificial Sequence
  Description of Artificial Sequence: Synthetic coding sequence
atgcttgacatctgtctagagaaaagagtgggaacaactctagctgcaccgaagtgcaatagctcaactgtcagatttcaggggttggctgagggtacgaaaggcaccatgaagatggacatggaggacgctgatatgactctatggacagaggccgaatttgaagagaaatgcacctacatagtcaatgaccacccgtgggatagcggcgccgatggcggtaccagtgtgcaggcggaggcaagtctgccacgaaacctcttgttcaaatacgccaccaactcggaggaggttatcggggtaatgagcaaggagtacatccccaagggaacccgcttcgggcctttaatcggggaaatttacactaacgacaccgtacccaagaacgccaatcgcaagtatttttggaggatttactcccggggcgagttgcatcactttatcgacggtttcaatgaagagaaatcgaattggatgcgatacgtcaatcctgcccacagtccccgcgagcaaaacttggctgcgtgccaaaatggcatgaacatatatttctatacaatcaaacctatcccggcaaaccaggaacttctcgtgtggtattgtcgtgactttgccgagcgtctacactatccgtaccccggagagctgactatgatgaacctcacacagacgcagtcaagtttgaaacaaccaagcacagagaagaacgaactatgtcctaagaacgtgcccaagagagaatacagtgtaaaagagatactgaagctggattctaatccgagcaagggaaaagatctttacaggagcaatattagccctctcaccagcgagaaggacctggacgactttcggcgcagaggaagccccgagatgcccttttatcctcgggtggtgtacccaattcgcgctccactccctgaagatttcctgaaggcctctctggcctatggcattgagcggcccacttatattacacggagcccaattccctcaagcaccacaccttccccttccgcgcgctcatcacccgatcaatcactcaaaagcagctcaccccacagctcaccaggaaatactgttagccctgtggggcccggaagccaggagcaccgggactcatacgcatatctgaacgccagttacggtacagagggcttaggatcatacccaggctacgctcccctcccccacctccctcctgctttcattccgtcttacaatgcgcattacccgaaattcctcctgccaccttacgggatgaactgtaacggactttcagccgtgtcctccatgaacggcatcaataatttcggtctgtttccaaggttgtgtcccgtttacagtaatctattaggcgggggttcattaccccaccccatgttaaaccctaccagcttacctagttctctgccctccgacggcgcccgcaggcttctgcagccggagcacccgagggaggtgcttgtaccagccccgcacagcgcattcagtttcaccggcgcggctgcgtctatgaaagacaaagcctgcagccctacatcaggaagtccgacagccggcacagcagcaacagcggagcacgtggtgcaacccaaggctaccagcgcggctatggccgcaccttctagcgatgaggcaatgaatctgatcaagaacaagcgcaacatgaccggctacaagacactaccgtacccgttgaagaaacagaacggtaaaataaagtacgagtgcaacgtgtgcgctaaaactttcgggcagctgtctaacctcaaagttcacctcagggttcactccggcgagcgaccatttaaatgccaaacctgcaacaaaggctttacacagctggcccacctgcaaaagcactacctggtgcatactggcgagaaacctcatgaatgtcaggtctgccacaaacgcttttcatcaacctccaatctgaaaacgcaccttcgtctgcatagcggggagaagccataccaatgcaaggtctgccccgccaaatttacccagttcgtgcacctgaagctgcacaagagactgcacacccgggagaggccccataagtgttctcaatgccacaagaactatatccacctttgcagccttaaggttcacctgaaaggaaattgcgcagccgcccccgccccaggcctgcccttggaagatcttaccagaatcaacgaggagatcgaaaagtttgacatttcggataacgcggacaggctggaagatgtcgaggacgacatctcagtcattagtgtggtagagaaagaaatcctcgcggtcgttcggaaagagaaagaagagaccgggctgaaagtttcgctgcagcgcaacatgggaaacggactactctcgtctgggtgttccctctacgaatcttctgatctccctctgatgaagctcccaccttctaaccccttacccctggttcccgtcaaagtcaaacaggagacagtcgagccgatggatccctag

SEQ ID NO: 129654 - DNA, 192 bp, Artificial Sequence
  Description of Artificial Sequence: Synthetic coding sequence
atgaaaatggatatggaagatgccgacatgacactttggacagaggcagaatttgaggagaaatgtacatacattgtcaatgatcacccctgggatagcggcgcagatgggggaacgtccgtgcaagccgaagcttctcttccgagaaacctcctcttcaaatacgcgactaattccgaggaggttatttag

SEQ ID NO: 129655 - DNA, 2367 bp, Artificial Sequence
  Description of Artificial Sequence: Synthetic coding sequence
atgaagatggatatggaggatgctgatatgactttgtggaccgaggccgagtttgaagaaaagtgcacatacatcgttaacgatcacccatgggattcgggggccgacggggggacatccgtccaggcggaggcatcactgccccgcaacctgctcttcaagtatgctaccaactcagaggaagtgatcggcgttatgtcaaaagaatatatcccgaagggtacaaggttcggccccctgattggagagatttacaccaacgacaccgtgcctaagaatgccaataggaagtatttctggagaatctattctagaggggagctgcatcactttatcgacggcttcaatgaagagaagtccaattggatgcggtacgtaaatcccgctcatagcccaagggagcagaaccttgcagcgtgccagaacggtatgaatatatatttttacacaatcaagccaatacctgccaatcaggaactcttggtatggtattgccgcgactttgctgaaagactgcattacccatatcctggcgaacttactatgatgaacttgacccagacccaaagcagcctaaaacaaccaagtacagaaaaaaacgagctgtgtcctaagaatgtccccaagagggagtatagtgtgaaggagatcctgaagttggatagcaatccttctaaaggcaaggacttgtatcgaagcaatataagtcccctgacaagtgaaaaagacttggatgactttagacgccgcggcagccccgagatgccgttctatccacgggtggtgtatcccatcagagctcctctgcccgaagacttcctgaaggcaagcctcgcttacggtatagagcgtcctacctatatcacccgctcccccattccttcgtcaaccacacccagcccctctgcccggtcatctccggaccagtctttgaagtcctctagcccgcattctagcccagggaataccgtgagcccagtgggcccgggttcacaagagcatagagattcatatgcgtatctcaacgcttcctacgggacggagggcttgggaagttatcctggttatgctccgctacctcacctcccgcctgctttcatacctagctataacgctcattacccaaagttcctgctgcctccgtacggcatgaactgcaacgggctgtcagcagtcagctccatgaacggcattaacaactttggactgtttcctcggttatgtccagtgtactctaacctgctgggtggcggctccctacccacgccctgttccaccccactactcccctctagcctgccatccgacggagcacggaggctgctgcagcctgaacaccccagggaagtactcgtgccggctccacattccgcttttagtttcacgggagccgcagctagcatgaaggacaaggcatgttcgcccacttctggatctcccaccgctggaacagccgcgactgctgagcacgtggtacagcctaaagctacaagcgctgcaatggcagccccgagcagtgatgaggctatgaacctgatcaagaataagcggaacatgaccgggtacaaaacactcccatatcctttaaagaagcaaaacggtaaaattaagtacgagtgcaacgtttgcgcaaaaacttttggccagctgtccaatctgaaggtgcatctgcgcgtgcattctggagagaggccattcaagtgtcagacatgtaataaggggttcacacaactggcccacctgcaaaagcactatctggtgcacacaggagagaaaccacacgaatgccaggtatgccataaaagattttcctcaactagcaacttaaagacccaccttcgtctccacagcggagagaagccttaccagtgtaaagtgtgtccggccaagtttactcaattcgtgcatctcaagctccacaaaaggctccatacaagagagcggccgcataaatgttctcagtgccataaaaattatatacatttgtgctccctgaaggtgcacttgaaaggcaactgcgccgccgcacccgcccccgggctgccccttgaagacttgactcgaatcaacgaggagattgagaaatttgacatctctgataatgctgataggttagaagatgtggaagacgacatctcggtgatcagcgttgtggagaaggagattctggctgtggttcgcaaagagaaagaggaaaccgggttaaaggtcagcctgcagcgcaacatgggcaacggcctgttgagttcaggatgctcactatacgaatcaagcgatctgcccctgatgaaactgccccccagcaatcctctacccttagtgccagtaaaagttaagcaggaaaccgtggagccgatggacccctag

SEQ ID NO: 129656 - DNA, 1716 bp, Artificial Sequence
  Description of Artificial Sequence: Synthetic coding sequence
atggccctgccacgccccagcgaagcagtcccccaagacaaagtttgctatccacctgagtcgagtccccagaatttagcagcctactacactcccttcccctcatacggccactatcgaaactcattagcaacagtcgaggaagattttcagccattcagacaactagaggccgccgctagcgctgcacccgctatgccgccctttccgttccggatggccccccctctacttagtccgggacttggcctccagcgcgagcctctgtatgacctgccctggtattctaagctgccaccgtggtacccaattcctcacgtgccccgggaggtgccacctttcctgagctcaagtcacgaatatgcaggggcatccagcgaggatttgggtcaccagattattgggggagacaacgaatccggtccttgttgcggtcccgacaccctgatccctccccctcctgctgatgcatctctgcttcccgaaggactacgtacaagtcaattgctgccatgctctccctctaagcaatccgaggatggcccaaaacctagtaaccaggaaggcaaatcccccgcccggttccagttcaccgaggaggatcttcacttcgtgctgtatggggtcaccccttctctggaacacccagcttctctgcatcatgctatctccggactgttggttccccctgatagcagtgggtctgactctctgccccaaactttggataaggatagtctgcagctacctgaagggctttgccttatgcagactgtttttggtgaagtgccacactttggagtgttctgcagcagttttatcgccaagggggtgcgatttggtccttttcagggaaaggttgtaaacgccagtgaggtgaaaacttatggtgacaattccgtgatgtgggagatctttgaggatggccatttgtcccatttcattgatggaaaagggggcaccggcaactggatgagttacgtgaactgcgcgagattccccaaggaacagaacctggtcgcagtgcagtgccagggacacatcttctacgaaagctgtaaagaaattcaccaaaatcaggagctactggtgtggtacggagattgctatgaaaagttcctggacataccagtgtctttgcaagtgactgagccggggaagcaaccatctggaccctccgaggagtccgcagaaggctacaggtgcgaacgctgcgggaaggtgttcacatataaatattatagggataaacacctcaaatacactccatgcgtggacaaaggtgaccgcaaatttccttgttcgctctgcaagcgaagtttcgagaagagggataggctccggatccacattctacacgtgcatgaaaaacacagaccacataaatgctctacctgtggcaagtgcttttcccagtctagtagcctgaacaagcacatgagagtacattctggcgacagaccctaccagtgcgtttattgcacaaagcgctttactgcctcctctatcctccgcactcatatccggcaacattccggagagaagccatttaagtgcaagtattgcggaaaatcattcgcttcccacgcagcacatgatagtcatgtgcgcaggtctcataaggaggacgatggctgcagctgctcaatctgcggtaaaatcttttcagatcaggaaactttctatagccacatgaaattccatgaagattattag

SEQ ID NO: 129657 - DNA, 303 bp, Artificial Sequence
  Description of Artificial Sequence: Synthetic coding sequence
atggcactgcctagacccagcgaagcagtgccgcaggataaggtgtgctaccctcccgaatcttcgccacagaacctcgcagcctattacaccccctttccgtcttacggacattaccgcaattctctggcaacagttgaggaagacttccagccctttagacagctggaagcagctgcctcagcggcccccgctatgcccccgttcccctttaggatggctccccctcttctcagtccagggctgggcctgcagcgagaacctctgtacgacctgccatggtattctaagctgcctccttag

SEQ ID NO: 129658 - DNA, 3831 bp, Artificial Sequence
  Description of Artificial Sequence: Synthetic coding sequence
atgagatccaaagcgcgggcacggaaactcgccaagtcggacggggacgtggtcaataacatgtatgagcccaacagggacctattggccagccacagcgcggaagatgaggctgaggactcggctatgtctcccatacctgtggggccaccttccccttttcctacctcggaagacttcacacctaaagagggatccccgtacgaagccccagtttacattccagaggatatccctataccagctgacttcgaactgcgagaaagttcaatccccggagcagggctcggtgtgtgggctaagagaaagatggaagccggcgagcgtttaggaccatgcgtggtggttcctcgcgcagccgccaaagagaccgacttcggctgggaacagatattaactgatgtcgaggtgagcccacaggaggggtgcattaccaagatatccgaggacctggggagcgagaagttttgtgttgatgccaatcaggctggtgccggctcttggctaaaatacataagagtagcctgcagttgtgatgatcagaatttgacgatgtgtcaaatcagcgagcaaatttactacaaggttattaaggacatagagcctggcgaagaactgttggtgcacgtcaaagaaggggtataccctctaggtacagtcccacccggactggatgaggaaccgacgtttcggtgcgatgaatgtgatgagctgtttcagagcaaacttgacctacggcggcacaagaagtacacctgcgggagcgtgggagctgcactttatgaggggttagctgaggagttaaagccagagggcctaggcggaggctccggccaggctcacgaatgcaaggactgcgagagaatgttcccaaacaaatattcgctggaacaacacatggttattcacactgaagagagagagtacaaatgcgaccagtgtcctaaagcgtttaattggaaaagtaaccttattcgacatcagatgtcccatgactcagggaagcgttttgaatgcgaaaactgcgtgaaggtttttactgaccctagtaatctccagcgacacatccggagtcagcacgtaggcgctagggcccatgcatgtccagactgcggtaaaacttttgctactagttcaggccttaaacaacacaagcacatacatagcaccgtgaagccttttatctgcgaggtgtgtcacaaaagttatacacaattctccaacttatgtcggcacaagaggatgcacgccgactgtcggacacagattaagtgcaaggattgcggacagatgttttcaaccactagttctctcaacaagcatcgaaggttttgtgagggtaaaaaccactacacgcctggcggtatcttcgctccaggacttcccctcactcctagccccatgatggacaaagccaagccaagccctagcctgaatcacgcgagcttaggctttaacgagtactttccctcacgcccacatccaggctccctgccctttagcaccgcccccccaacattccctgccctcacgcccggctttccgggcatcttcccaccaagcttgtatcctcggccaccccttttaccacccacatctctcctcaagagtccactcaaccacacacaagacgcaaagcttcctagcccactggggaacccggcgctgccactcgtgtccgccgtgtccaattcctcccaggggactactgccgcggcaggacccgaagaaaagtttgagtctcgtcttgaagattcgtgtgttgaaaagctcaagaccagaagctctgacatgagcgatggcagcgattttgaggacgtcaataccactacaggaacggatctggatactacaaccggcacaggctctgacctggacagtgatgtcgactcagaccctgacaaagacaagggtaagggtaaatcagccgaaggtcagccaaagttcggcgggggcttggcaccaccgggtgcccccaactccgtggctgaggtgcccgtattttatagccagcactctttcttcccacctccagatgaacagctgcttactgctaccggcgccgccggcgactcgataaaggcaatcgcctcaatagcagaaaaatatttcgggccaggctttatgggaatgcaggagaaaaagttaggttcgctgccctatcattctgccttccctttccagttccttcccaattttccacactctctgtatccattcacagacagagccctggctcataatctattggttaaggccgagcccaagtcccctagggacgcactaaaggtaggtgggcctagcgcagagtgtcctttcgacctcaccactaaaccgaaagatgttaaacccattctgccgatgccaaagggtccgagtgcacccgcctccggtgaagagcagcctttagacctctctataggcagccgggctcgcgcgagtcagaatggaggcggcagggaaccccggaaaaaccacgtgtacggggagagaaagcttggagctggcgaaggtctccctcaggtgtgtcctgcaaggatgccacagcagcccccactgcattacgccaaaccaagcccgttcttcatggacccaatctactcccgggtcgagaagcgaaaagtcactgaccctgtaggcgctctcaaggaaaagtatctgagaccatcacccctgctgttccatccgcagatgtccgccatcgagacaatgaccgaaaagctcgagagctttgcagcaatgaaggccgactctggatcttcactgcagccactgccgcaccatccgtttaattttcgatcaccgcctccaaccctgtctgatcccatactccgcaaagggaaggaacgctacacttgtcgctactgtggaaagatattcccgaggtccgcgaacctaactcgacacctgaggactcataccggagagcagccctacagatgtaaatattgcgacaggtccttttccatatcatccaatctgcaaaggcatgtgcggaatattcacaataaagaaaagccctttaagtgtcacctctgcaaccggtgctttggtcagcagaccaacctggaccggcatctaaagaagcacgaacacgagaatgctccagtgtctcagcatccgggagtgttaaccaaccacttgggaaccagcgcctcaagccctacatccgagtccgataaccacgcgctactggacgagaaggaagactcatacttctccgagattaggaatttcatcgctaacagcgaaatgaaccaagctagtacacgaactgagaaacgcgccgacatgcagattgtggatggcagcgcccagtgccctggtttagctagcgagaagcaagaggacgttgaggaagaggacgacgacgatttggaagaagatgacgaagattccttagcgggcaaatcccaagacgacacagtttctccagctcctgagccgcaggcggcctacgaggacgaggaagacgaggaacccgccgccagcctagccgtgggcttcgaccataccaggcgatgtgctgaagatcacgaggggggactgttggcattggaacccatgccaacttttggaaagggattggatctgagaagggcagcagaggaagctttcgaggtgaaggacgtgctaaactcaacattagacagcgaggcgctgaaacataccctgtgtaggcaagccaagaaccaagcttacgcgatgatgctatctctttccgaggacacaccactgcacacgccctcacagggatcacttgatgcttggttaaaagtgactggcgctacctccgagtcaggcgcatttcaccctatcaatcacttgtag

SEQ ID NO: 129659 - DNA, 3831 bp, Artificial Sequence
  Description of Artificial Sequence: Synthetic coding sequence
atgcggagtaaggccagggcacgtaagctggccaagagtgacggcgacgtggtgaataatatgtacgaacccaacagagatttactggctagtcactccgccgaggacgaagcggaggattccgcgatgagcccaatcccagtcggtcctcccagtccctttccaacaagcgaagacttcaccccaaaggagggtagcccatacgaggccccagtttacattcctgaggatatcccaataccagccgactttgaactgagggagagctcaattcccggggctgggctgggtgtgtgggcaaagcgcaagatggaggctggggagagactggggccatgcgtggttgtgcctcgtgcagcagccaaggagacagatttcggatgggagcagatattgaccgatgtggaggtgagcccacaggagggttgcatcaccaaaatcagcgaagatctcgggtccgaaaaattttgtgtggacgccaaccaggcaggagctggctcctggctgaaatacatcagggtcgcctgtagctgcgatgatcagaacctgaccatgtgtcagatttctgagcaggtcatttactacaaggtgattaaggacattgaacctggagaagagctcctggtgcacgtgaaagaaggggtgtatcctttaggtacagtccctcccggtctggatgaggagccaacatttcgttgcgacgaatgtgacgagttatttcaaagtaaactcgacctccgacggcataaaaagtatacgtgcggcagcgtgggcgccgccctctatgagggtctggccgaggagctgaaaccagaaggcctgggcggtggtagtgggcaagctcatgagtgtaaagattgcgagagaatgttcccaaataagtactcactggaacaacatatggtcattcacactgaagagagagagtacaagtgcgatcagtgcccaaaggctttcaattggaagagtaacctgatcaggcaccagatgagccatgactcgggcaagcgattcgagtgcgaaaattgcgtgaaagtcttcactgatccttccaatttacaaagacatatccgcagtcagcacgttggcgctcgagcccatgcatgccctgactgtggaaagacctttgcaacctcatcaggcctgaaacagcacaagcatatccactctacagtcaagccctttatttgcgaggtgtgccataagtcgtatactcagttctcaaatctgtgtcggcacaaacgaatgcatgccgactgtagaacccaaatcaagtgtaaggactgtggccagatgttttctacgacttcgagtctgaacaagcaccggagattctgcgaaggtaaaaaccactacacccccggtggcatatttgccccaggcctccctttgactccatcccctatgatggataaagcaaagccctccccctccctaaatcatgcatctctgggctttaacgagtacttcccttcaaggccgcacccaggcagtctgccattctctactgcgccgcccaccttcccagcgctcaccccagggtttccagggatcttcccaccgagtttgtacccccgtccgcccctcttgcctccaacctccctgctgaagagtccgttgaaccatactcaagatgcaaaactcccaagccccctcgggaacccagcactccccctggtgagcgccgtctccaacagctcccaaggtaccactgccgccgcaggccctgaagaaaaatttgaatcccggctcgaagactcgtgcgtcgagaaattgaaaacccgcagcagtgatatgtccgatggctccgacttcgaagacgtaaacacgacaaccggaacagatctcgatactaccacgggcacgggcagtgatctggactcagacgtggattctgaccctgacaaggataagggcaaaggcaagtctgcagagggccagccaaagttcggtgggggcttggcacccccaggtgcaccaaattcagtggccgaggttcccgtattctactcccagcacagtttcttccctccaccagacgagcaacttctcacagccacaggagccgccggtgattctattaaggctatcgcatccatcgcagaaaagtactttgggccaggcttcatgggcatgcaagagaaaaaattgggttccctaccttatcatagtgccttccctttccagttcctccccaatttcccccattcattgtaccccttcacggatagagcacttgcgcacaacctgctggtgaaagccgagccgaagagtcctagagatgcactcaaagtgggcggaccgagcgcagaatgtccatttgacctcacaaccaagcccaaagacgtcaagccaattcttcccatgcctaagggcccgtccgcccctgcaagtggtgaggagcagccgttggatctcagtatcggatcacgcgccagggcaagccagaacggcggcggcagagagccacgtaagaatcatgtttatggcgagcggaagttaggcgctggagaggggctgccccaagtctgtcctgcacggatgccacaacaacccccactacattacgccaagccatcccctttctttatggaccccatttatcgggttgaaaaacggaaggtcaccgatcccgtaggagctctcaaagaaaagtacctgaggccctccccattactcttccacccccagatgagcgccattgagaccatgactgaaaaactggaaagctttgctgcgatgaaggccgattccggaagctccctccagcctctgcctcaccatcccttcaactttcggtcgccgccacctactttgagcgaccctattctgaggaagggcaaggaacggtatacctgccggtactgtggcaaaatattcccccgtagtgcgaaccttactcgccatcttcggacgcatacgggagaacaaccctaccgctgcaaatactgtgaccggtccttctctatctcttccaacctgcaacgacacgtgaggaatattcataataaagagaaaccctttaaatgtcatctgtgtaacaggtgtttcggtcagcagactaacttggaccgtcacctgaaaaagcacgagcatgagaacgcgcccgtaagccagcatcccggcgtcttgacaaaccacctaggtacctcagcttcgtctccgaccagcgaatcagataaccatgctctactcgacgagaaagaagacagctatttttccgagattagaaactttatcgcgaatagcgagatgaaccaggcttcaacgagaaccgagaaaagggctgatatgcaaattgtggacggatctgcccagtgtcccggactagctagcgagaaacaagaagatgttgaggaggaagacgatgatgacctcgaggaagacgatgaagacagtcttgctggcaagtctcaggatgacacggtgagccctgctccggagccgcaagccgcgtatgaggacgaagaagacgaggaacccgccgcttccctggctgttggtttcgaccatacgcgtagatgtgcggaggaccacgaaggcggccttctggctttggagcctatgcctaccttcggcaagggccttgatctgagaagggctgccgaagaggcattcgaggtgaaggacgtgctgaatagcacactagatagcgaagctctcaaacacaccctgtgtcgtcaggcgaaaaatcaggcttatgctatgatgctgagtctgtcagaagacactcctctgcacaccccttctcaaggcagtcttgacgcctggttaaaagtcacaggtgctacgagtgaatctggagcctttcatccgattaaccatttgtag

SEQ ID NO: 129660 - DNA, 3279 bp, Artificial Sequence
  Description of Artificial Sequence: Synthetic coding sequence
ttttgtgcttacagtgctaagatctattataaagtcatcaaagatattgaacctggcgaagagctgctggtccacgtgaaagagggcgtttatcccctggggactgtcccgccaggcttggatgaagagccgaccttcaggtgcgacgagtgcgacgaactgttccaatctaaacttgatttgcgtcgccacaagaaatatacgtgcggaagcgtgggagcagcactctacgaagggctcgcggaggaacttaaaccggagggccttggaggcggaagcggacaggcccatgagtgtaaggattgcgagagaatgttccccaacaagtactcgctcgaacagcacatggtgatacacacagaggaacgcgagtataaatgcgaccagtgtccaaaggcctttaactggaaatccaatctgattcggcatcagatgagtcacgatagtgggaagcggtttgaatgcgagaattgtgtaaaagtattcaccgatccttcaaacctccagcggcacataaggtctcagcatgtcggagctcgggctcacgcgtgtccagattgtggtaagacattcgcaacaagtagtggtttgaaacaacataaacatatccactccacggttaagccattcatctgcgaggtctgccataagtcttatacacagttcagcaacctgtgccggcataagcggatgcacgcagactgtcgcacccaaattaagtgcaaggactgtggccaaatgtttagtacgacatctagtctgaacaaacacaggaggttctgtgagggaaagaatcactatactccgggaggaattttcgcaccgggactgccactgacgccctcccctatgatggacaaggccaaacccagtccatccctgaaccacgcctctctgggatttaacgaatactttccttcccgcccacacccgggttctcttccatttagcactgccccacccacttttccagccctcacgccagggttccccggcatatttccaccctccctctacccaagaccccctctcctgcccccaacctcacttctgaagagccctctcaatcacacccaggacgcgaaactcccgtcccctctgggaaatcctgcactccccctggtcagtgcagtgtctaactcctcccaaggcacaactgccgccgctggccccgaagaaaagttcgaatccaggctcgaggactcatgtgtggagaagcttaaaacaagaagcagcgatatgagcgacggcagtgacttcgaagatgtcaatacaacgacaggcacagatcttgacacaaccaccggtacaggctcggacttagatagcgatgtcgactcagaccctgacaaggacaagggcaagggaaaaagcgccgaagggcagcccaagttcgggggtggtctggcgcctcctggagccccaaattccgtggcggaggtccctgtgttttacagccagcattcttttttccctccgccagacgaacaacttctgaccgctaccggcgccgcaggtgatagcattaaggctatcgccagcatagccgagaaatactttggccccggattcatggggatgcaggagaagaaactgggctctctgccctatcattcagctttccctttccagttccttcccaacttcccacactctctctatccttttacggatagggccctcgcccataacctgctggtgaaagccgagccgaagtcacctcgcgacgcactcaaggtcggtgggccttcagccgaatgcccattcgacttgaccacaaaaccaaaagatgtgaaaccaattctgcccatgccaaaggggcctagtgcacccgcatccggggaggaacaacctctcgacctatccattgggtcacgcgcgcgcgcatcccagaatggggggggacgcgagccacggaaaaaccatgtgtatggcgaacgcaagctcggcgcgggagaaggcctgccccaggtgtgtccagcaagaatgcctcagcagccaccactgcactatgccaaacccagtcctttttttatggaccccatttacagtcgagtggagaaacggaaggttacagatcccgtgggcgcactgaaggagaaatatttgcgtcccagtccactgctgtttcacccacagatgtctgcaattgagacgatgactgaaaaactggagtcttttgccgctatgaaggccgatagcgggagctctctgcagccattaccacaccacccttttaactttcgctctccgccccctaccctcagcgaccccatcctgaggaaaggtaaagagcggtacacctgcaggtactgtggtaaaatctttcctcggtccgctaacctcaccagacatctacgtacccacaccggcgaacaaccataccggtgtaagtactgtgaccgcagtttttctattagctccaacctgcagcgccacgtccgaaatatccacaacaaagaaaagccctttaaatgccacttatgcaataggtgcttcggacagcaaacaaatctggataggcacctgaagaaacacgaacatgaaaacgcgcctgtcagccaacaccctggggtgcttacaaatcatctgggaacatctgcaagttcccctacgagcgaatcagacaaccacgcattactggacgaaaaagaagactcttatttctccgagattcggaatttcatagccaattccgagatgaaccaggcctctactcgtacagaaaagagagcagacatgcagatcgtggacggctccgcccagtgtcctggtctagcctcggagaaacaggaagatgttgaggaagaggacgatgacgacctggaagaagatgatgaagactcgttggcaggaaaatcgcaggatgatactgtgtcccccgcccctgaacctcaggctgcgtacgaggacgaagaggatgaagagccagctgcttccttggccgtgggattcgatcacacacgacggtgcgcggaagaccacgaaggagggcttttagcactcgaaccaatgcccactttcggtaaaggtctggatttacgaagggctgcggaggaagctttcgaggtcaaggacgtgctgaacagtacgctggactccgaagcactcaagcatactctctgccgtcaagcaaaaaaccaggcatatgccatgatgttgtcactttccgaggatactcctctgcacactccttcacagggcagcctcgacgcttggctcaaggtgactggggccacttccgagtctggggcattccatcccattaaccacctgtag

SEQ ID NO: 129661 - DNA, 3828 bp, Artificial Sequence
  Description of Artificial Sequence: Synthetic coding sequence
atgcggtctaaagcccgtgcaaggaaactggcaaagagtgacggcgatgtcgtcaataacatgtatgaaccaaatcgtgacttacttgcttcgcactcagcggaggacgaagccgaggactctgccatgtccccaatcccagttggtcctccgtcgccgttccctacttcagaggacttcaccccgaaggagggaagcccctacgaagcgcctgtatacatccctgaagacataccaattcctgccgactttgaactgcgagagagtagcatcccaggagcaggcttaggagtttgggccaagcgtaaaatggaagcaggcgagcggttggggccctgcgtcgtggtgcccagggctgccgcgaaggaaacggatttcggttgggaacaaatattaacagatgtggaagtgagtccccaggaggggtgcatcacgaagatcagtgaggacctcggctccgagaagttctgtgtggacgccaatcaggccggcgctggatcgtggctcaaatacattagagtggcctgttcctgcgatgaccagaatctcacgatgtgccagatctccgaacagatctactataaggtgataaaggatattgagccaggggaggagctgctggttcacgtcaaggaaggagtgtacccactgggcaccgtaccaccaggcctcgatgaagagccaaccttccgctgtgacgagtgtgatgaattgttccagtccaagctggatctacggcgacacaaaaaatacacttgcggaagcgttggagccgctctgtatgaggggcttgccgaagagttgaaacctgagggactggggggggggtcaggacaggctcatgaatgcaaggattgcgaacgcatgttccctaataaatatagtctggaacagcatatggtgatccacaccgaagagagagagtacaagtgtgaccaatgtcccaaagcttttaactggaagtccaacctgataagacatcagatgagccacgattccgggaaacgcttcgagtgtgagaattgtgtgaaggtgttcaccgatccatctaaccttcagaggcatatacggtcccagcacgtaggtgctagagcccatgcctgtcctgactgcggcaagaccttcgccacatcctccggcctgaagcagcataaacacatacactctacggttaagccatttatctgcgaagtatgccataaatcctacacacagttttcaaatttatgtagacataaaagaatgcacgccgattgtcgtacccagatcaaatgcaaggattgtggacagatgttctccactacatcttcacttaataagcaccgtcgcttctgcgaaggaaaaaaccactatacgcctggcggaattttcgccccaggtctccctctcaccccgagcccaatgatggacaaagcaaaaccaagtccctcactgaatcacgcctctttggggttcaatgagtacttcccctcacgaccccaccccgggtccctcccattctccacagccccaccaacgtttccagcactgacccccggattccctggcatcttccctcctagtttgtatcctaggcctccccttttacctcccacctccctgctcaagtcgcctctgaatcatacacaagacgctaaactccctagcccactgggcaacccagctctgcctctcgtttccgccgttagcaattcctcccagggcacaacagccgcagccggaccagaggaaaagttcgaatccaggctggaggatagctgcgtggagaagctcaaaactcgctcttcagacatgagcgacgggtcagacttcgaggacgtcaatactaccacagggactgacctcgataccactacaggaaccggatctgatttagacagtgatgtagactccgaccccgacaaggacaagggcaagggcaaaagcgccgaaggccagcctaaattcgggggcgggctggcccccccaggcgctccaaactccgtagccgaagtgcccgtcttttattctcagcactccttcttccccccacctgatgaacagctgctgactgcaactggcgccgctggtgacagcattaaggctatcgcatcgattgctgaaaagtatttcggacccggatttatgggtatgcaggaaaaaaaactgggctccttgccctatcattccgcttttccctttcagttcctgccaaactttccgcacagtctgtaccccttcaccgatcgagcgctagcgcacaacctgctggtcaaggctgagcctaagtctccacgggacgcactgaaggtgggcggcccctccgcagagtgccctttcgacttaaccactaagcccaaagatgtgaagcctattttgccaatgccaaaggggccctcagctcccgcttctggcgaagaacagcctttggatctctccatcgggtcccgggcccgcgccagccagaatgggggcggaagggagccacgaaagaatcacgtgtacggtgaaaggaagttgggggcaggcgaaggattacctcaagtgtgcccagctcggatgccacagcaaccccctctacactatgcaaagccgtcccccttctttatggatcccatatatcgagtagagaaaagaaaggtgactgatccagtcggcgccttgaaggaaaagtacctccgcccatcacctttattgtttcatccacagatgagcgctatagaaacgatgacagagaaattagaatcttttgcggccatgaaggccgattctggtagttccctgcagcccctgccccatcacccatttaattttcgatctcctccccctaccctgagcgaccctatactaaggaaggggaaggaacggtatacttgtcgatattgcggcaaaatctttcctagaagtgctaatttaacacggcatttgaggacacacaccggtgagcagccctatcgatgtaagtactgcgaccgctcgttttccatctcctctaacctacaacggcacgtccgcaacattcacaacaaggagaagccgtttaagtgccatctatgcaaccgatgtttcggtcaacagaccaacctggaccgtcacctcaagaaacatgaacacgagaatgccccagtgagtcaacatccaggcgtattgaccaaccaccttgggacatctgcctcttccccaacgtccgagagtgacaatcacgccttgctggatgaaaaagaggactcatacttctcagagatacgcaatttcatagctaacagcgagatgaatcaggcctcaacacggactgagaaaagagccgacatgcaaattgttgatggcagcgcccaatgccctggtttggctagcgagaagcaggaggacgttgaggaagaagatgacgacgacctcgaggaggacgacgaggattccctagcaggaaagagtcaggatgacacagtgtcacccgctcccgaacctcaagcggcctacgaagacgaggaagatgaagagcctgccgcaagcctggcggtaggctttgatcatacccgacggtgtgccgaggaccatgagggcggattgctggcactcgagccgatgcccacatttggcaagggtctcgacctccgccgagcggccgaggaagctttcgaagtgaaagacgttttgaacagtaccttggactctgaggctctgaagcacaccctgtgtagacaagccaagaaccaggcctatgctatgatgctctctttaagcgaagataccccactgcatactccttcccaaggatcattggatgcctggctgaaagtgaccggcgccacgagcgagtcaggcgctttccatccaataaaccatctgtag

SEQ ID NO: 129662 - DNA, 3771 bp, Artificial Sequence
  Description of Artificial Sequence: Synthetic coding sequence
atgagatctaaggccagagctaggaaactggcgaagtctgacggtgacgtggtgaataacatgtacgagccaaatcgcgatctactggcttcacacagtgccgaagatgaagcagaggactccgccatgagccccattccagtcggtccaccttccccgtttcccacatctgaagacttcactcctaaggagggaagtccgtatgaggcacctgtatatattccagaggatatcccaattccggcagattttgagttacgagaaagctcgatcccaggggcaggactgggcgtctgggcaaagagaaaaatggaagcaggagagaggctcggaccctgtgtcgttgtaccacgcgctgcagcgaaagagactgactttgggtgggaacaaatattgactgatgtggaagttagtcctcaagaggggtgcatcacgaagatttctgaggatcttggctccgaaaagttttgcgtggacgctaatcaagccggcgccggcagctggttgaagtacattagggtggcctgtagttgcgatgaccagaatctgactatgtgtcagatatctgagcaaatatattacaaggttatcaaggacatcgagcccggcgaggagctgttagtgcatgtgaaagagggcgtatacccactgggaactgtcccccccggcctcgacgaagaacctacctttaggtgcgatgagtgtgacgaactcttccagtcaaaactggatttgcggcggcacaaaaagtacacgtgcggatcagttggagccgccctctacgagggactggcagaggaacttaaacctgagggtctggggggcggatcagggcaggcccacgagtgtaaagattgtgaacgtatgtttcccaacaagtattcactcgaacagcatatggtcatccacaccgaagagcgggaatacaagtgtgaccagtgtccaaaagccttcaactggaagagtaatctcattcggcaccaaatgagccacgattccggcaaacggtttgaatgcgagaactgtgtgaaagtgtttaccgacccctcaaatctgcagcgccacattcgttcacaacatgtgggagccagggcacacgcatgtcccgactgtggtaaaactttcgcaacatctagcgggttgaaacaacacaagcacattcacagtacagtgaaaccatttatatgtgaggtgtgccacaagtcttacactcaattttctaatttatgtcgccataaacgtatgcatgcagattgcaggactcagattaagtgcaaggactgtgggcagatgtttagtactactagttccttgaataagcatcgaagattctgcgaagggaagaatcactatacgcccggtgggatcttcgcacctggccttcctcttactccctcccccatgatggacaaagcaaagccttccccaagcttgaaccacgcatctctcggatttaatgagtacttcccgtctaggccccatccagggtccctgcccttctccactgccccacccactttccccgcccttacccccggcttccccgggattttcccaccgagcctgtatcctcgaccgcccctgctgccccctaccagcctgctgaagagccccctgaaccatacccaggatgcgaagctgccttcaccactcggcaaccctgccctaccactagtttctgcggtgagtaattcttcacagggcacaactgctgctgctgggcctgaggaaaagttcgagtcaagattggaagatagctgcgtggaaaaactgaaaacccggtcgagcgatatgagcgatgggtctgattttgaggatgtgaatactacaaccggtaccgacctggataccaccacaggaacaggatctgatctggattccgatgttgattctgatccggataaggataaaggtaaaggtaaatccgctgagggacagccaaagtttgggggcggactggcgcctcccggcgcccctaacagcgtggctgaagttccagtgttctattcgcagcattcattctttccccctccagacgagcagctgcttacagctaccggggctgccggggattcgattaaagccattgcatctatagcggagaaatactttggccccggttttatgggaatgcaggagaagaaactcggctctctgccctaccacagcgcgttcccatttcagttccttccaaattttcctcacagcctgtatccgtttaccgaccgcgcactggctcacaacctgctcgtaaaggctgagcctaaatcccctcgtgacgcccttaaagtcggtggcccttctgctgagtgccctttcgatttaacaactaagcccaaagacgtgaagccaatcctcccgatgcctaaaggtccctctgccccggccagtggcgaggaacagcccctggacctatctattgggtcaagggccagagcctcacagaatgggggaggtcgcgagcctcgaaaaaaccacgtttatggcgagagaaaattgggggccggcgagggcctcccacaggtgtgccccgctaggatgccccagcagcctccattgcattatgccaaaccatccccttttttcatggatcccatctatcgcgtggaaaaaagaaaagtgactgatccagtgggtgctcttaaagaaaaatacctcagaccctcacccttactgttccatcctcaaatgagtgcaatcgagaccatgacagaaaagttggaaagctttgccgctatgaaggcagactccggatcaagtttacagcctttgcctcatcaccctttcaactttcggagcccccccccaacattgagcgatccaatactaagaaagggcaaggagaggtacacctgcaggtactgcggaaagatttttcccaggtctgctaatctgactcgtcatctaagaacacacactggagagcagccctatcggtgtaagtactgtgacaggtccttttccatttcgagcaatctgcagaggcatgtgcgcaatatccataataaagaaaagccatttaagtgtcacctttgtaacagatgcttcggacagcagaccaacctagaccgacatttaaaaaaacatgaacatgaaaacgcccctgtctctcaacatcctggagtactgactaatcacctcggaacatccgcaagcagcccaactagcgagtctgataatcatgcattactggacgagaaggaggattcatacttctctgaaattcggaattttatagctaacagcgaaatgaaccaagcaagcaccaggaccgaaaaacgcgcggatatgcagatcgttgatggcagtgcacagtgtcccggactcgcaagtgagaaacaggaggacgtggaggaagaagacgacgatgatctcgaagaggatgacgaagacagcctcgcagggaaatctcaagatgacaccgtgtctcctgcccctgagcctcaggctgcatacgaggacgaggaagatgaagagcccgcggcatccttagccgtaggctttgaccacaccagacgttgcgcagaggatcacgaaggtggattactggccctggagccaatgcccacgtttgggaaaggcctggacctgcggagagctgctgaagaggcttttgaggtgaaggacgtgctgaacagcactctcgattcggaagccctgaaacatacactatgtcggcaggccaaaaaccagggctccctggatgcttggctgaaggtgacaggtgccacatctgaatcaggtgccttccaccctattaatcacttatag

SEQ ID NO: 129663 - DNA, 3255 bp, Artificial Sequence
  Description of Artificial Sequence: Synthetic coding sequence
atctactacaaggtcatcaaggatatagagcctggagaagaattgctggtacatgtgaaggagggtgtgtaccctctgggcaccgttcccccagggttagacgaagagcccacattccgatgcgatgagtgcgatgaattattccagtccaaacttgacctacgaaggcacaaaaagtatacatgtggaagtgtcggcgctgcgttgtacgagggactcgctgaggaattaaagcctgaggggctggggggcggctcagggcaagcacatgagtgtaaggattgcgaaagaatgtttccaaataaatattctctcgagcagcacatggttatccacaccgaagaacgggagtacaagtgcgatcagtgtcccaaagcgtttaattggaagagcaaccttattcgtcaccaaatgtcccacgatagtgggaagaggtttgagtgtgagaactgcgtgaaagtattcacggatccatcaaatttgcagcgacacatccggagccagcatgtaggcgccagagctcatgcctgcccagactgcggcaaaaccttcgcgacttcgagtggcttaaaacagcacaagcacatacactccaccgttaagccgtttatttgcgaggtctgccataaaagctacactcagttttccaatttgtgtcggcacaagagaatgcatgctgactgccgcacccagattaaatgtaaagactgcggtcagatgttcagcacgacaagcagcctgaataaacaccgacgtttctgcgagggcaagaaccattacactcccggaggtatatttgcccccggtcttcccctaacacccagcccaatgatggacaaagcaaagccttctcctagcctcaatcacgcctccctgggattcaatgaatatttcccttccaggccccacccaggctctctgccctttagcactgccccaccaactttccctgccttgactccgggctttccaggcatcttcccccctagcctgtaccctaggccacctttactgccacctacctcactccttaagtcccctctgaaccacacacaggatgcaaagcttcctagtcctctcggtaatccggcgctgcctctcgtatccgctgtctccaactccagtcaggggactacagccgcagctgggcctgaggaaaaattcgagtctcgccttgaagacagctgtgttgagaagctgaaaacgagaagttccgatatgagtgatggatcagatttcgaagatgtgaatacgaccaccggaaccgaccttgacactacaactggcaccggatctgacctggacagtgacgtagattctgacccggataaggacaaaggcaagggaaaatctgcagagggacagccaaagtttgggggagggctggcaccccccggcgccccaaactcagttgcagaggtgccagtgttctacagccaacactcattttttccaccgccggatgaacagcttctgaccgccactggggccgctggcgactccataaaagccatagcaagcattgccgagaaatattttggccctggcttcatgggcatgcaagaaaagaagctcggctctctgccctatcactccgccttcccattccaatttctgcccaattttccacacagtctgtatcccttcacagatagagccctggcgcacaacctgctggtgaaggctgagccaaaatccccgcgagacgccctgaaggtgggcggcccaagcgccgaatgccccttcgacctgacaacgaagcctaaagacgttaagccaatcctcccaatgccaaagggaccctcggcgcccgccagcggcgaggagcagcctctggacctgagtattggctcacgggcaagagcgagtcagaacggagggggtcgcgagcctaggaagaaccacgtgtatggcgaaagaaagttgggagctggagaaggtctcccccaagtttgcccagctcggatgcctcaacaaccccccttacactacgcaaagccctctcccttctttatggacccaatctatagagttgagaaaagaaaggtgactgacccagtcggcgcgctgaaagagaaatacctcaggccctcccccctcttgtttcatccccagatgtccgctatcgagaccatgaccgaaaagctggaaagtttcgctgccatgaaagccgacagcggctcttccttacaacctttacctcatcacccctttaatttcaggtcacctccccccaccttgtccgacccaattctgagaaaaggcaaggagcggtatacgtgccgctattgtggaaagatcttccctcgcagcgccaacctcacacgccaccttcggacacatactggagagcagccctatcgatgtaagtattgtgatcgctcctttagcatctccagtaaccttcagcgccacgtgcgcaatatccacaataaagaaaagccattcaagtgtcacctctgtaataggtgctttggacagcaaactaacctcgataggcacctgaaaaagcacgaacacgagaacgcaccagtctctcagcatcctggcgtattgaccaaccacctcgggaccagcgcatccagtcccactagcgaaagcgataaccatgctttgctggacgagaaggaggactcttatttctcagagatacggaacttcatcgcaaattcagagatgaaccaggcgagtacacggacggaaaaacgggcagatatgcagatagtagacggttctgcacaatgccccggcctggcaagcgagaagcaagaggatgtcgaggaagaagacgatgatgatttagaggaagatgatgaggactctctcgctggtaaatctcaggatgatactgtctccccagccccagaaccccaggccgcatacgaagatgaagaagacgaggagccggccgcctccctggccgttggatttgaccacacacgacggtgtgctgaggaccacgaaggcggactacttgcacttgagcccatgcccacatttggaaaagggctggacttaagacgagcagctgaggaggcgtttgaggttaaggacgtactgaatagcaccctggattctgaagccttgaaacacactctttgtagacaggcaaaaaaccaagcctacgctatgatgttgagcctcagcgaagacacgcccctgcacaccccgagccagggatcactggacgcctggctgaaggttaccggcgccacctctgagtccggcgccttccaccccatcaaccacctgtag

SEQ ID NO: 129664 - DNA, 3774 bp, Artificial Sequence
  Description of Artificial Sequence: Synthetic coding sequence
atgcggtcaaaagcaagggcccggaagttggctaaatccgacggagatgtcgtgaacaacatgtacgaacctaatcgggatctgcttgcctcacacagcgccgaggatgaagcagaggattccgccatgtcacctatccctgtcggtccaccaagccccttccccacaagcgaagattttactccaaaagaggggtccccatatgaggcccctgtctacatacccgaggacatcccaattccagccgatttcgaactgcgcgaaagctcaatccctggagctggactcggagtgtgggctaaaaggaaaatggaggcaggtgagcggcttggcccctgcgtggtggtgccaagagcagctgcaaaggagactgacttcgggtgggagcagattctaaccgacgtggaggtctcaccacaggaaggatgcattaccaagatatctgaagatctgggcagcgaaaaattttgcgtcgacgccaatcaggccggagcagggagctggcttaagtatatcagagtggcttgttcctgtgatgaccagaatctgaccatgtgtcaaatcagcgaacagatctattataaggtgataaaggatatagaacctggtgaagaacttttggtgcacgtaaaggaaggtgtgtatccactgggaacagttccgcctggcctggacgaggaaccaactttccgctgtgacgagtgcgatgaactgttccagtctaaactcgatttaaggaggcacaagaaatacacatgcggatcagtgggggctgcactgtacgagggcctagccgaggagctgaagccagaaggcctcgggggcggatccggtcaagcacatgaatgtaaagattgcgagagaatgtttcccaataagtatagtttggaacagcacatggtcatccataccgaggaaagggagtacaagtgtgatcagtgccccaaggcgttcaactggaaatcaaatctgattagacaccagatgtcccacgatagcggcaagcgtttcgaatgcgaaaactgcgtgaaggtgtttaccgaccctagtaacctccaacgacacatacgctcccaacatgtgggggctcgagcccacgcctgcccggattgcggcaagacattcgccaccagttcaggactcaagcaacataagcacatccattccaccgtgaagcccttcatctgcgaggtgtgccataagtcttatacccagttctccaacctctgtcgacataagcggatgcatgccgactgcaggacacaaattaagtgcaaggattgtggtcagatgtttagtaccacatctagcctgaacaagcaccggcgtttttgcgaaggcaagaaccactatacgcccggaggcatttttgcccccggcctcccactcacgccaagtccaatgatggataaggcaaaaccttccccaagtctcaatcatgcatccctcgggttcaatgagtacttcccatcccgaccacaccccggcagtctgcctttttccaccgcccccccgacctttccagccctcacccccggtttcccaggtatatttccaccatctctatatcctagacctccactgttgccccccacctctttgctgaagagtccactgaaccacactcaggacgcaaaactgccaagcccactgggaaatcctgccctgccactggtctctgccgtgtcgaatagttctcaagggactacggcagccgccgggcccgaagaaaaatttgaaagtcgcctggaggattcctgcgtggaaaaactcaaaactagaagctcggatatgtctgacgggtccgacttcgaagatgtgaacaccaccacaggaacagatctagataccaccactggtaccggctctgatttggactctgacgtagatagcgaccctgataaagataagggaaagggcaagagtgccgaggggcagcccaagttcggaggtggcctggccccaccaggagcccctaacagcgtagccgaggttcctgtgttctacagtcagcatagctttttcccacctcctgatgagcaactcttgactgccacaggtgccgctggcgacagtatcaaggccattgcctccattgccgagaaatattttggaccaggttttatgggaatgcaggagaagaagctgggctcgttgccttaccacagtgcattcccctttcagtttttgcccaatttcccacatagcctgtatccgttcacggatagagctctggctcacaatcttttagtcaaggcagagccaaaaagtccccgggatgctttgaaggtcggtggcccaagcgcggagtgtccatttgacctcaccaccaagcccaaagatgtgaagcctattttacctatgcccaaggggcccagcgcccccgctagcggcgaggaacagcctttagacctgagtatcgggagcagagctagagcttctcagaatggcggaggccgggagccaaggaaaaaccatgtctatggcgaacggaaactgggcgctggtgaaggactacctcaagtgtgtcctgcccgaatgcctcagcaacctccactccactatgcaaaaccctctcccttcttcatggaccccatatatagtcgcgttgagaaaaggaaggtaaccgatcccgtgggagccctgaaagagaagtatctgcgcccatctcctctgcttttccatcctcagatgagtgctattgagacaatgaccgagaaattggaatcattcgctgccatgaaggccgatagcgggtcaagtctgcagcccttaccccaccacccgttcaattttaggagtccccctcccacgctgagcgatcctatcttgaggaagggtaaagaacggtatacctgtaggtattgcgggaagatctttcccagatccgccaacctaacacggcacctgaggacccatacaggcgagcagccttatagatgtaagtactgtgaccggtccttcagtatttccagtaacttgcagcggcacgtccggaatattcataacaaggagaagccatttaagtgtcacctgtgcaacaggtgtttcgggcagcagaccaacctggaccgacatctcaagaagcacgagcacgagaacgcacccgtatcccaacatcccggcgttctgacaaatcatctcggcactagcgcatcttctcctacaagtgagtcggacaatcacgctctgcttgatgagaaggaagattcctatttctcagagatcaggaacttcattgctaactccgagatgaatcaagcctcaacccgaacagaaaaaagggctgacatgcagatcgtggatggctccgcccaatgtccaggattagcgtcagaaaagcaggaggacgtggaagaggaggacgacgacgatttggaagaggatgacgaggacagcttggctggaaaatcccaagacgacaccgtcagccctgcccccgaaccacaggctgcatatgaggacgaggaggacgaggagccagcggcatccctcgcagtgggctttgatcatacccgacggtgtgctgaggatcacgaaggcggcctgctggctcttgaacccatgccaacgtttgggaagggtcttgacctgcggcgcgcagccgaagaggcctttgaagtcaaggatgtcttaaacagcactctggatagcgaggccctgaaacacacattgtgtcgccaggccaaaaatcaggggtcccttgatgcatggctaaaagtgacaggcgcaacaagtgagagcggtgccttccatcctatcaatcacctgtag

SEQ ID NO: 129665 - DNA, 600 bp, Artificial Sequence
  Description of Artificial Sequence: Synthetic coding sequence
atgagcagtgagaattgtttcgtcgccgagaactcaagcctgcaccccgagagcggacaggaaaatgatgctacctcaccccacttctctacccgccatgagggtagttttcaggtccctgtgctgtgcgcagttatgaatgtcgtgttcatcacgatcctgattatcgccctaatagctctaagtgttggccaatacaactgcccaggccagtatacattctctatgccttctgactcacacgtgagcagctgctcagaagattgggtgggctaccaaaggaagtgctacttcataagtactgtgaagcggagttggacaagtgcgcagaatgcatgctccgaacatggcgcaacactcgctgttattgactcagaaaaagatatgaactttctcaaaagatacgccgggcgtgaagaacactgggtcgggctcaagaaagaaccggggcatccatggaaatggagtaatggtaaggagttcaataattggttcaacgtgactgggtcagataaatgcgtgttccttaagaacacggaggtcagttcaatggaatgcgaaaagaatctctattggatttgcaacaagccttataagtag

SEQ ID NO: 129666 - DNA, 228 bp, Artificial Sequence
  Description of Artificial Sequence: Synthetic coding sequence
atgcaccaccggatgaatgaaatgaatcttagtcccgtgggaatggaacaattaacaagcagcagtgtctcaaacgcattgcccgttagcggctcacacttaggcctggccgctagccccacgcatagcgccattcccgctcccggcttgcccgtcgccatccccaatctgggccccagcctgagcagtctgccctctgccctctcgctgatgctcccgatgggatag

SEQ ID NO: 129667 - DNA, 1893 bp, Artificial Sequence
  Description of Artificial Sequence: Synthetic coding sequence
atgctggggatgtatgtgcctgaccggttctcactgaagtcctcacgcgtccaagatggaatgggcctttacacagcccgcagggtgaggaagggagaaaagtttggccctttcgccggcgaaaaacgaatgccagaggacttggacgagaacatggactatagactcatgtgggaagtccggggctccaaaggcgaggtactgtatatcctggacgctaccaatcctcggcactcaaactggctccgctttgtacatgaggccccatcgcaggagcagaagaacttggcagcaattcaggaaggagagaatatcttctacctcgctgtggaggacattgaaactgacacagagctgctcatcggctatcttgattccgatatggaggccgaagaggaagaacagcaaatcatgactgtcatcaaggagggcgaggtggaaaattcccgccggcagtctacagctggtagaaaagaccgcttggggtgtaaggaggattatgcatgccctcaatgtgagtcatcttttactagcgaagatatcttggcagaacatctccagactctgcatcaaaagccaactgaggagaaggaattcaaatgcaaaaactgtggcaaaaagttcccggtcaagcaggccttacagagacacgtgctccagtgtactgcaaagtcatcattgaaggagagttctcgcagtttccagtgtagtgtctgcaactcttcttttagcagcgcatcgagctttgaacaacaccaggagacatgcaggggggacgccagatttgtgtgtaaagccgatagttgtggaaaaagactcaaatccaaagacgcgctgaaacgccatcaagagaatgttcatactggtgaccccaaaaagaaacttatatgtagtgtttgtaataagaagtgctctagtgcgtcctctctgcaggagcaccggaagatacacgaaatcttcgactgccaagagtgcatgaagaaattcatttctgctaaccagctcaaacggcatatgatcactcattcagaaaagagaccctacaactgcgagatatgtaataagtcttttaaaaggctcgatcaggtgggagcccataaagtaatccattccgaggacaagccatataaatgcaaactgtgcggcaaaggttttgcccataggaacgtgtacaagaaccataaaaaaacccatagcgaagaacgaccttttcagtgcgaggaatgcaaagctctgttccggacgcccttctccctgcagcggcacctactgatccacaatagcgagcgcaccttcaagtgtcatcactgtgacgccacttttaaaaggaaagatactctgaatgttcacgtgcaggtagttcacgaacggcacaaaaagtaccgctgtgagttatgtaataaggcctttgtcaccccgagcgtgttgcgcagtcataagaagacacacacaggggaaaaggaaaagatctgtccttattgtggacagaagttcgccagcagcggaaccctccgggtgcacattaggtcccacactggcgaacggccctatcagtgcccatattgtgagaagggattctcaaaaaacgacggattgaaaatgcacatacggacccacacgcgagagaaaccctacaagtgcagcgaatgcagtaaagcattttctcagaagcgaggtctggacgaacataaacgaacgcatacaggtgagaaacccttccagtgtgacgtgtgtgatctagccttttccctcaagaagatgctgatccgacacaagatgacccacaaccccaaccgcccacttgctgagtgccagttctgccacaaaaagtttactcggaacgattatctcaaagttcacatggataacattcatggggtagccgattcttag

SEQ ID NO: 129668 - DNA, 336 bp, Artificial Sequence
  Description of Artificial Sequence: Synthetic coding sequence
atgttaggcatgtatgtgcccgacaggttttctttgaaaagctcacgggttcaggacggcatgggactctacacagcacgtagggttcggaagggcgaaaaattcgggccatttgcaggagaaaagcgcatgcctgaggatctcgacgagaacatggactaccgtctcatgtgggaagttcgtggcagtaagggcgaggtcctgtatatcctggacgctaccaatccgcggcatagcaactggctgcggtttgtgcacgaggcccccagccaagagcagaaaaacctggcggcaatccaggacaaaaatctcggccccgcagagtggaggggatag

SEQ ID NO: 129669 - DNA, 1800 bp, Artificial Sequence
  Description of Artificial Sequence: Synthetic coding sequence
atgttgggcatgtatgtgcctgacagattctccctcaaatcatctagggtgcaggacggcatgggcttgtacaccgcgaggcgtgttagaaagggtgagaaatttggccctttcgccggtgagaagagaatgccagaagatctggacgagaacatggattacagacttatgtgggaagtacggggctccaagggtgaggtgctttatattctggacgccaccaaccctcgccactccaattggctgcgatttgttcatgaggcccccagccaggagcagaagaatctggccgccatccaggaaggggagaacattttctatttggctgtcgaagacatcgaaaccgatacggagttgctaatcgggtatttagactccgacatggaggccgaggaggaagaacagcagataatgacagtaatcaaagaaggagaggtggagaactctcgaaggcagtctacggccggtaggaaggataggctcggctgtaaggaagattatgcgtgtccccagtgtgagtcttctttcacctcagaggatatactcgctgagcacctccagactctacatcagaaacctaccgaggagaaagaatttaagtgcaagaactgcggaaagaaattcccagtgaagcaggccttacagaggcacttcgaacagcaccaggagacatgtcggggggacgctaggttcgtgtgtaaagccgattcctgcgggaagcggctcaagagcaaggacgcgctgaagaggcaccaggaaaatgtgcacacaggagaccctaagaaaaagctcatttgttcggtgtgcaacaaaaaatgcagcagcgcatcatcacttcaggaacataggaaaatacatgagatttttgactgccaggagtgcatgaaaaagtttatttccgccaatcagctgaaaagacacatgatcacgcactccgaaaaacggccctataattgtgagatttgcaacaagtcctttaagcgccttgatcaagtgggcgcccacaaagtgattcactccgaggataagccatataagtgtaagctctgcgggaagggtttcgcacatagaaacgtctacaagaatcacaaaaagactcactccgaagagaggcctttccagtgcgaggaatgcaaagccctgtttaggacccccttctctctacagaggcaccttctgattcacaacagcgagaggacattcaagtgccatcactgtgacgccacattcaagaggaaggacaccctgaacgtgcacgtacaggtggtgcacgaacgccacaaaaagtaccggtgcgaactgtgtaataaagcttttgtcacgccatccgtgttgaggagccacaaaaaaactcacacgggggaaaaggaaaagatttgtccctactgtggtcagaaatttgccagctcaggcacattgcgagtacacatcagaagccacactggggaacggccttatcagtgcccttactgtgaaaagggcttcagtaagaatgacggcctgaagatgcacattcggactcacacgcgggagaaaccgtacaagtgctcagagtgttctaaagcttttagccagaaaaggggactcgacgaacataagaggacccatacaggagagaagccatttcagtgcgacgtctgcgatttggcgttctccttgaagaaaatgctcatacgtcataaaatgacgcacaatcctaataggcccctggctgagtgccaattctgccacaaaaagttcacccgcaacgattacttgaaggtccacatggacaacatccacggcgtggccgactcctag

SEQ ID NO: 129670 - DNA, 1506 bp, Artificial Sequence
  Description of Artificial Sequence: Synthetic coding sequence
atgctcggcatgtacgtgcccgaccgattctccctgaagtcaagtcgagttcaagacggcatggggctgtatactgctcggcgcgtcagaaaaggtgagaagttcggcccattcgccggcgaaaaacggatgccagaggacttggacgagaatatggactataggcttatgtgggaggtgcgtggctccaagggtgaggtgctgtacattctggatgccacaaacccccgccatagcaactggctgcgttttgttcacgaagctcccagtcaggagcagaaaaatctcgccgcaatccaagaaggggagaacatcttttacctcgcagtggaggatatcgaaacagacaccgagctgctcattggatatctggattctgatatggaagcagaagaggaggagcaacagatcatgacggtcataaaggaaggagaggtcgaaaactcaaggaggcagagtaccgctgggcgcaaggaccggcttggatgcaaggaggattatgcctgcccccagtgtgaaagttcttttacttccgaagacatccttgcagagcacctccagacacttcaccaaaaacccacagaagaaaaagagtttaagtgtaaaaactgcggcaagaaatttccagtgaaacaggccctacagcgacacttcgagcagcaccaggagacctgccgcggcgacgccagattcgtgtgtaaagctgactcctgtggaaagcgattaaaatccaaggacgccctcaagaggcatcaagagaatgtgcacactggagatcccaaaaaaaagctgatttgctctgtatgcaacaagaagtgcagctccgcaagtagcttgcaggagcacaggaaaattcacgagatctttgattgccaggaatgcatgaagaagtttattagcgctaaccaactaaagcggcacatgattactcatagcgaaaaaaggccctataactgtgagatttgtaacaagtcattcaagcgactcgaccaggtgggcgctcacaaggtgatccattctgaggacaaaccgtataagtgcaaactgtgcgggaaggggttcgcacaccgaaatgtgtacaaaaaccataagaagactcacagcgaggagcgccctttccagtgcgaggagtgcaaagctttattcaggacccctttctccctgcaacgacatcttttgatacacaatagtgaaagaacatttaaatgccaccattgtgacgccacattcaagcgcaaagacaccctcaacgtccatgtgcaggttgtccatgaaaggcacaagaaataccgctgtgagctctgcaacaaggctttcgtgacaccctccgtcttacggtcccacaagaagacccataccggcgagaaggaaaaaatatgcccatattgcgggcagaaatttgcttcgagtggcacactgcgggtccatatccgctcccatacaggtgaggccgtccaggtgcttcgggtgcagcagggcctgcagcccgaggccaggccaggctag

SEQ ID NO: 129671 - DNA, 1227 bp, Artificial Sequence
  Description of Artificial Sequence: Synthetic coding sequence
atgtgtcagaatttcttcattgatagctgcgcagcccacggccctccaacttttgtaaaagattcagccgtcgacaagggccatcccaaccgttccgccctgtctttaccccccggtctccgtataggaccctccgggattcctcaagctgggctgggcgtctggaacgaggctagtgatttgcccttaggccttcacttcggaccctatgaaggccggattactgaagacgaagaagccgctaataatggctactcctggctgatcaccaagggtagaaattgctacgagtatgttgacggcaaggacaaatcatgggccaattggatgaggtacgtgaactgcgctagggacgatgaagagcagaaccttgtggcgttccagtatcaccgtcagatcttttatcgcacatgtagagttataagacctggctgcgagcttctggtgtggtatggagacgagtacggccaggaactcggcataaagtggggtagcaagtggaagaaagagctcatggccgggagggaacctaaacctgagattcacccgtgcccctcttgctgcttagctttttctagccagaaattcctaagtcagcacgtcgaaagaaatcatagctcccaaaattttcctggaccctcagcccggaaactgctgcagcccgaaaatccctgccccggcgatcaaaatcaagaacagcaatatcctgatccccactcccggaatgacaagactaaaggtcaggaaattaaagaaaggtctaaactcttgaacaaaagaacctggcaaagagagatttcgagggccttttctagtccacctaaggggcaaatgggctcttgccgcgtagggaagaggatcatggaggaggagtcaagaacaggacaaaaggttaaccctggtaacactggtaaacttttcgtgggcgtcggcatctcaagaatcgcaaaagttaaatacggagagtgcgggcaaggcttttcggttaagtctgacgtaattactcaccaacgaacccacacaggagaaaagccttacgtgtgccgcgagtgtggccgaggtttcagctggcagagcgtactattgactcaccaaaggacacacaccggagagaagccgtacgtatgtcgcgaatgtggccgcgggtttagccggcagtcagttttgctcactcaccagaggacacacaccggtgagaaaccctacgtgtgccgggaagacgaatag

SEQ ID NO: 129672 - DNA, 2685 bp, Artificial Sequence
  Description of Artificial Sequence: Synthetic coding sequence
atgtcgcctgaaaagtcacaggaagaatctccggaagaggacacagagcggaccgaacggaaacctatggtaaaggatgcgttcaaggatatatcaatttatttcacgaaagaagagtgggctgagatgggcgactgggaaaagacacgatatagaaatgtcaaaaggaactataatgccctcataacaatcggtctgagggctactaggccagcgttcatgtgccaccgtcgacaagcgatcaaactgcaagtggatgacaccgaagacagcgatgaagagtggacaccccgacaacaggtcaaacctccttggatggcactgcgagtcgagcaaaggaaacaccagaagggaatgcccaaagcgtctttttccaacgaatcgtcattgaaagagttgagcagaacggccaatctcctcaatgcctcgggttctgagcaagcccagaaacctgttagcccaagtggcgaagccagcacctcaggccagcattccaggctgaaactggagctgcgaaagaaagagacagagagaaagatgtatagtctgagggaaagaaaagggcatgcctacaaggaagtgagcgaaccacaggatgacgattacctttattgtgagatgtgccaaaatttcttcattgacagttgtgctgcccatggccccccaaccttcgttaaggattccgctgtagataagggacatcctaatcgctctgcactgagcctgccccctggcttaagaatcggaccttcaggcatcccccaggccggactaggagtatggaacgaagcctccgatcttcccttgggtctccattttggcccctatgaagggcgcattactgaagatgaggaagctgccaacaatggctactcttggctcatcactaaaggtagaaactgttatgaatacgtcgacgggaaagataagtcctgggccaattggatgaggtacgtaaactgcgcaagggacgatgaggagcagaacctggtagcttttcagtaccatcggcagatcttttatagaacctgcagggtgattcgccctggatgcgagcttctcgtgtggtatggcgatgagtatggacaggaactggggattaaatggggatccaaatggaaaaaagagttgatggctgggcgagagcctaaacccgaaattcacccatgtcccagctgttgtctcgctttttcttcacaaaagtttcttagccagcacgttgaacgcaaccactcgtcccaaaactttcccggccctagtgcgcgaaaactgcttcagccagagaatccatgtccaggtgatcaaaaccaagagcagcaataccccgaccctcacagccgaaatgacaagactaaaggacaagaaattaaagaaaggagtaaactgttaaataagcgaacctggcaacgagagataagtcgggcattcagtagcccccctaaaggtcagatgggtagctgcagggttggtaaacgaatcatggaggaggaatcaaggaccggccaaaaggtcaacccaggcaataccggcaaactcttcgttggcgtaggtataagtcgcatcgcgaaagttaagtacggcgagtgtgggcagggattctctgtgaaaagcgacgtcattacccaccaacgcacgcacacaggtgagaagctctacgtctgcagggagtgtggacgcggattttcttggaagtcccatcttttgatccatcagaggattcacaccggtgagaagccttacgtttgcagagaatgtggccgcggctttagttggcagtcagtgctcctaacacatcagaggacccataccggggaaaagccttatgtctgtcgggagtgcggccgcgggtttagtcggcagagtgtcctcttgacccaccagcggcggcatacaggggaaaagccatatgtgtgccgcgagtgcggccgcgggttctcccgtcagagcgtattacttactcaccagcgtcgccatactggcgagaagccatatgtgtgcagggagtgcggtcgtgggttcagttggcagagcgtcctccttacccaccagcgcacacataccggtgaaaagccctacgtctgccgcgagtgtggtcggggtttttcctggcagtcggtgctgttgacacaccagcggacacatactggcgagaagccctatgtttgcagagagtgcggccgaggtttcagtaacaaatcacatctcttgcgacatcagaggacccacacaggagagaagccatatgtgtgtcgggaatgtgggcgagggtttagggacaagtcccatctattacgccatcagagaacgcacactggggagaagccctacgtctgccgcgagtgcggtcgcggttttagggacaagtctaatcttctatcacaccagcgaacacataccggtgaaaaaccatacgtgtgtagagaatgtggacggggtttttccaataaatcccacttactcaggcatcagcggacacacaccggagaaaagccttacgtgtgccgggaatgtggacggggcttccgcaataagtcccacttgctcagacatcagagaacccacaccggagaaaagccttatgtttgccgggaatgtgggagaggtttctcagatcggtcctcgctctgttaccaccagcgtactcacacaggtgaaaagccttacgtgtgtcgtgaagatgagtag

SEQ ID NO: 129673 - DNA, 303 bp, Artificial Sequence
  Description of Artificial Sequence: Synthetic coding sequence
atgtcccccgaaaagtctcaggaagaaagccctgaggaggatactgaacggaccgaaagaaagcctatggtgaaagatgcattcaaggatataagcatctatttcacaaaagaggagtgggccgagatgggggattgggagaaaactcggtatcggaatgtgaagaggaactacaatgcgttaatcacaattggcctgagagcgacgaggccggcctttatgtgccatcgccgccaagccattaaactgcaggttgacgataccgaggactcagacgaagagtggaccccccgtcagcagtag

SEQ ID NO: 129674 - DNA, 537 bp, Artificial Sequence
  Description of Artificial Sequence: Synthetic coding sequence
atgtcagaagtgcgactgccccctttacgggccttggacgactttgtcctcggtagcgcccgtcttgctgcccccgatccttgcgaccctcagcgttggtgtcacagggtgatcaataacctcttgtattatcagacaaactacctgctgtgtttcggtatagggctcgccctagcaggatacgtcagacctcttcataccttgttgtctgccctggtcgttgccgtggccctcggcgtgctggtgtgggccgccgagactcgcgccgccgtacgccgctgcaggagatcacaccccgccgcttgtctggctgcagttttagcagtcggtctgctggtcctgtgggtggctgggggggcgtgcaccttcctgttctctatcgccggtcccgtgctgctgatcttagtgcacgcctccctcagattgcggaatctcaagaacaagatcgaaaataagattgagagtatcgggttaaagcgtaccccaatgggactgctgctggaagcactgggccaggagcaggaggcagggtcctag

SEQ ID NO: 129675 - DNA, 846 bp, Artificial Sequence
  Description of Artificial Sequence: Synthetic coding sequence
atggccggcacttggctattactactcctggcgctgggctgcccagctctgcccactggggtcgggggaacaccattcccctccctcgctccacccattatgcttttggtcgacggaaagcagcagatggttgtcgtttgtttggtcctagatgtagccccccccggactcgattcccccatttggttttcggcaggtaacggcagcgctttagacgccttcacatacggcccttcccccgctaccgatggtacatggaccaaccttgctcatctgtctcttcctagcgaggagctggctagttgggaacccttagtctgccacaccggccccggggctgaaggccattcgaggtcaacgcagccgatgcacctctccggggaagcatcgacagcccgaacttgtccacaggagcccttaagaggaactccaggaggagcgctgtggttgggggttctgagacttctcttattcaaactgctactttttgatttgttgctgacctgctcttgcctgtgcgaccctgccggccctctcccttcccccgcgacgactactcgactccgagcccttggaagccatcgactgcaccccgctaccgaaacagggggacgcgaagccacaagcagcccccgccctcaaccaagggatcgaagatggggcgacaccccccccggtcgcaagcccgggagccctgtttggggagagggcagctatctgtccagttaccccacctgccccgcccaggcctggtgctcgcgttccgcactgcgggccccatccagttcccttggcgccttctttgccggcgatctcccgcctcctctccaagcaggcgctgcctag

SEQ ID NO: 129676 - DNA, 384 bp, Artificial Sequence
  Description of Artificial Sequence: Synthetic coding sequence
atggccgctacctcccctggaccttgggtaagtagcccaacccaccgctcgtgcttcctacccttcctcacaaggggatgccacaaccgggtatgggcagcacaccctttcctattgtggccccatcaatcttgttgttggtggatggagagctccagatggtggtggtcagcctggtccctgatgctgcatcctctggctttgaccgctccaggccggaagcccgggtcaccagtttggggagaggggagctacctctctagttacccaacttgcccagcccaggcttggtgctcaaggtccgccctgcgtgccccttctagcagcctcggcgccttctttgcaggagatctgccccccccattgcaggccggagcagcctag

SEQ ID NO: 129677 - DNA, 771 bp, Artificial Sequence
  Description of Artificial Sequence: Synthetic coding sequence
atggcaggtacgtggctcctcttattgctcgcactgggctgtcccgctttgccaactggtcccgtttccttcccctcaagtcccgaagcagctaccactggacctatttggttctcagcaggtaacgggtcagctctggatgccttcacatacgggccgtcacctgctacggacggaacttggacaaatctcgcgcatctgagcctgccttccgaggaattggcatcctgggagccacttgtttgccatacgggaccaggcgccgagggccattctcggtctacccagcccatgcacctctctggagaggcatctacggctcgcacttgcccacaggagcccctgcgaggcacaccggggggggccctgtggctgggtgtattgcggctgctgctctttaaacttctcctgtttgacctcctcctcacttgtagctgcttgtgcgacccagcaggacccctccccagccccgcgaccaccactaggcttagggctctgggcagtcaccgcctccacccagcaaccgagacaggtggacgagaagctacctcaagtccccgtcctcagccacgagaccgacgctggggggatacccctcccggtaggaagcctgggtcacccgtgtggggcgaaggtagctacctgagctcatacccaacttgtccagctcaggcctggtgctccagatccgccctccgcgcccctagttcaagcttaggtgcgttctttgcgggggatttgcccccccctttgcaggctggagcagcctag

SEQ ID NO: 129678 - DNA, 525 bp, Artificial Sequence
  Description of Artificial Sequence: Synthetic coding sequence
atggccggcacatggctgctgctgctgctggctctgggatgtcccgccctgcccacaggagaagcaagcacagcccggacctgtcctcaggaaccgctccgagggacacccggcggagccttgtggcttggcgtgttgagactgctgctctttaagttacttctcttcgatctgctgctgacctgcagctgcctctgcgaccccgccggccctttaccaagtccagcaacgactaccaggcttcgcgcattggggagtcataggctgcatccggcaactgagaccgggggtagggaggccacttcaagtccaagaccacagcctagagatcggcggtggggcgatactcctcccggcagaaagccagggtcacccgtatggggcgagggttcatatctgagctcttaccccacctgcccggcgcaggcctggtgttcccgtagtgcactgagggcaccttcttcctctctgggagccttcttcgccggcgatctgccacctccattacaggccggagccgcttag

SEQ ID NO: 129679 - DNA, 438 bp, Artificial Sequence
  Description of Artificial Sequence: Synthetic coding sequence
atgtcatgggccccggtactgctgatgctttttgtgtactgcactggttgtggcccacagcctgttcttcaccaacccccagctatgtcaagcgcactcggcacgaccatacggctaacgtgtaccctgcgtaacgaccatgacattggagtatactccgtctactggtatcagcagcggccaggtcatccgccccgcttcctcctccggtacttcagccaaagtgataagtcccaaggcccccaggtgcctcctcggtttagtgggagcaaagatgtggccaggaataggggctatctatcaatcagcgaactgcagcccgaggatgaagccatgtactattgtgccatgggcgcccggagctcagagaaggaggaaagagagcgagagtgggaggaggagatggagcccaccgccgctaggacccgcgtgccctag

SEQ ID NO: 129680 - DNA, 372 bp, Artificial Sequence
  Description of Artificial Sequence: Synthetic coding sequence
atggcttgtagatgcctctccttcctccttatggggacattcctgagcgtgagtcagacagtcctggcacaacttgacgccctgttagtgtttcccggacaggtcgcccagctatcctgtaccctgagtccccaacatgtcaccattcgcgattacggggtgagctggtaccagcagcgagccggaagtgcaccgcggtatctgctgtactaccgttcagaagaggaccatcacagaccggctgatattcccgacagattcagcgcagctaaggatgaagcccacaacgcatgtgtgttgaccattagtcccgtccagccagaagacgatgcagattattactgctctgtgggctatgggtttagcccctag

SEQ ID NO: 129681 - DNA, 513 bp, Artificial Sequence
  Description of Artificial Sequence: Synthetic coding sequence
atggacgagcaaccccgactcatgcatagccacgccggcgtagggatggctgggcatccaggccttagtcagcacctccaggacggcgcaggaggaaccgaaggggagggcggtaggaagcaggacattggtgacatccttcagcagatcatgacaatcactgatcagtctctggacgaagcccaggcccgaaagcacgcactgaattgtcaccgtatgaagcccgctctgttcaatgtactgtgcgagattaaggagaagacagttttgtccatacgcggtgctcaggaggaggagccaacagatcctcaactgatgaggctggacaatatgctcctggccgagggtgtggccggccccgaaaaaggcggtggatccgccgcggcggcagctgctgctgctgcaagtggcggcgcagggtcagataattcggtcgagcactccgactatagagcaaaactgagccagatccgccagatctatcatacagagctggagaagtatgaacagtag

SEQ ID NO: 129682 - DNA, 1044 bp, Artificial Sequence
  Description of Artificial Sequence: Synthetic coding sequence
atggacgaacagccccggctgatgcattcccacgccggggtgggaatggccgggcatccaggactcagccagcatctgcaggacggggctggtggaaccgaaggggagggaggcagaaagcaagatataggcgacattctgcagcagattatgaccattaccgatcagagcctggacgaagcccaagcaagaaagcacgccctcaactgtcataggatgaaaccagcactattcaatgtgctgtgtgagatcaaggagaagaccgttctttcaattcgcggggcgcaggaagaggagcccacggatccacagctgatgagacttgacaacatgttactcgccgagggagtggccggccctgagaagggtggaggatctgcagccgccgcagccgctgcagccgcttccggtggcgccggaagcgacaattcagtggagcattcggattaccgcgccaaattaagtcaaattcgccagatctaccatacagagctggagaaatacgagcaggcttgcaatgagttcaccacacacgtgatgaacctcctaagagaacagagccggacccggcccatttccccgaaggagatcgagagaatggtgtcaatcattcatcggaaatttagctctatccaaatgcagctgaagcaatccacatgcgaagcggtgatgatcctgcgctcaaggttcctcgatgcacgacgcaaaaggcggaattttaacaagcaggccaccgaaatactgaatgagtacttctacagccatctttcaaacccctacccctcagaggaggctaaagaggagctggctaaaaaatgcggaattaccgtcagccaagtgagcaattggttcggaaataagcgcatccgatataagaaaaacataggcaagttccaggaggaggccaacatttacgccgctaagaccgctgtcaccgcaactaatgtgtctgcccacggtagtcaggccaacagcccatccacaccgaactccgcagggggctatccaagtccttgttatcagccagatcgtaggatccagtag

SEQ ID NO: 129683 - DNA, 1044 bp, Artificial Sequence
  Description of Artificial Sequence: Synthetic coding sequence
atggatgaacagccccgacttatgcattcccacgcaggcgtcgggatggcgggacaccccgggctatctcagcatctacaggatggtgccggtggtacagagggcgaaggaggccgcaaacaggacattggagatatcctgcagcagatcatgactattacagaccagtccctggacgaggcccaggccagaaagcacgcactcaattgccacaggatgaaacctgcactcttcaatgtcctgtgcgagatcaaggagaaaaccgtcctaagtattcgcggcgcccaggaggaggaaccaaccgacccacaattgatgaggctggataacatgctcctggccgagggagttgcaggcccagaaaaggggggcggcagcgcggcagctgcagccgctgccgctgctagtggtggtgccggcagcgacaattccgtggagcattccgattaccgggctaaactatcccagattagacagatataccacaccgagctggagaagtacgaacaggcttgtaatgaattcactacccacgttatgaaccttctgagagagcagtcccgcacaaggccgatctcccccaaagagattgagagaatggtctcaatcatccacaggaaattttcctctatacagatgcagctgaagcagagcacttgcgaggctgtcatgatcttgcgctccaggtttctggacgcacgccggaagcggagaaattttaacaagcaggccactgagattctgaatgagtatttttactcgcacctttccaacccttacccctcagaagaagctaaggaagagctagcaaagaaatgtggcatcaccgtatcacaggtgtccaactggttcggaaacaagcgtattagatacaagaaaaatatagggaaattccaggaagaagccaacatctacgctgctaaaaccgcggtcaccgccacaaatgtgagcgcccacggatcacaggccaatagtcctagcaccccaaattctgccggtggatatccttccccttgctaccagcccgatagaaggattcaatag

SEQ ID NO: 129684 - DNA, 1293 bp, Artificial Sequence
  Description of Artificial Sequence: Synthetic coding sequence
atggatgagcagcctcgcctgatgcactcgcatgcaggggttgggatggctggacaccctggactcagtcagcacctgcaggatggtgctgggggtacagagggcgagggaggacgaaagcaggacatcggagatatactgcagcagatcatgaccattaccgaccagtctctggatgaagcacaagctcgaaaacacgccctcaactgtcatcgtatgaaacccgcgttgttcaacgtgctctgtgagattaaggagaagaccgtcctgagcattcggggagcccaagaggaagagccgactgacccacaacttatgcgactggacaacatgctcctggcggaaggagtggccggacctgagaagggggggggctctgcagccgctgcagctgctgctgctgccagcgggggagctggctccgacaactccgtggagcactctgactaccgggctaaactcagccaaatccgacagatttatcataccgaattagagaagtacgagcaagcgtgtaacgagtttactacccatgtcatgaacttgttgagggagcagagccgaaccagaccgatcagtccaaaggagatcgagagaatggtgagtattatccatcgaaaattctcctctatccagatgcagctcaaacagagtacttgtgaggctgtgatgatattgaggagccgctttttggacgccaggcgcaagcgcaggaattttaataagcaggccactgagattttgaatgagtatttttattcgcatctgtcaaacccatatccaagcgaagaagccaaggaggaacttgccaagaaatgtgggatcacagtgtctcaggtttctaattggtttggcaataagaggatacggtacaaaaagaatattggaaagttccaggaagaggccaatatctacgcagctaagacggcggtcaccgcaacaaacgtatccgcacacggctcgcaggctaattcaccatctaccccaaacagcgcagggagctctagtagttttaatatgtctaatagcggggacctgtttatgagcgtgcagtctctgaatggagacagttatcagggcgcccaagttggggccaacgtccagagccaggtggatacccttcggcacgtcatcagtcagacaggaggctattctgacggcttggccgccagccaaatgtattctcctcagggaatctcagcaaatgggggatggcaggatgccactacaccctcttctgtaacctcacccacggagggccccggttcggtccacagcgacaccagcaattag

SEQ ID NO: 129685 - DNA, 978 bp, Artificial Sequence
  Description of Artificial Sequence: Synthetic coding sequence
atgcgcctagacaacatgctcctcgctgaaggggtcgctgggcccgagaagggcggcggttctgccgccgcggccgcagcagcagcggccagtggtggagccggatcagacaactccgttgaacacagcgattatagagccaagctgtcacagattcgtcaaatctaccatacagagttagagaagtatgaacaggcgtgcaacgagtttaccactcatgttatgaacctactgcgggagcagagcaggaccagaccaatctccccgaaggagatagagagaatggtctctatcattcacagaaaattctctagcatccagatgcaactcaagcaaagcacttgtgaggccgtgatgatcctccgcagcagatttttggacgccaggcgtaaacgcagaaactttaataaacaggcaacggagatcctcaacgagtacttctatagtcacctgtcaaacccctacccgtccgaggaggcaaaagaggagttggccaaaaagtgtggaattaccgtgtctcaggtgtcaaactggttcggaaacaagcggatccgttacaaaaaaaacatcgggaaatttcaggaagaggcaaatatttacgcggcaaaaaccgctgtaacggccaccaacgtgagcgcacatggctcgcaagccaattcccccagtacccccaattccgccggtagcagctcctcctttaacatgtcgaactctggcgacttattcatgagtgtgcagagcctgaacggtgatagctatcagggagcacaggtaggggccaacgtgcagtcacaagtggacactctgcgccatgtgatctctcagaccgggggatacagcgatggcttggccgcctctcagatgtatagccctcaaggtataagtgctaatggcggctggcaagatgcgactaccccctcatctgttacctcccctaccgaaggacctggaagcgtccattccgatacgtccaattag

SEQ ID NO: 129686 - DNA, 1113 bp, Artificial Sequence
  Description of Artificial Sequence: Synthetic coding sequence
atgctcctggtctttttcgtcctgtggacttgctccttggctctgctagcctcttcccagtctccacctccaccgtgcgcctctgttctttccatacggggcgcccaggaagaggagcctacggatccccagctgatgcggcttgataacatgctcttagctgaaggagtcgcaggacccgagaagggagggggcagtgctgccgcggccgcggccgctgccgcttccggcggcgccgggtcagataattctgtggaacacagtgactatcgggcgaaactctctcagattaggcagatttatcacaccgaactggaaaaatatgagcaggcctgtaatgagtttacgacacatgtcatgaatctgctcagagaacagtctcgcactcgtcccattagccctaaagaaatagaaagaatggtctccattatccatagaaaattcagtagcatccaaatgcagcttaaacagagtacctgtgaagccgtgatgatcctacgtagccgatttttagatgcccgtcgaaaaaggcgtaacttcaacaagcaagccaccgagatactcaatgagtacttttattctcatctgtccaacccctaccccagtgaggaggctaaagaggagctggcaaagaagtgtgggatcactgtgtcccaggtgtctaactggtttggtaataagagaatccgatataagaagaacattgggaagttccaggaggaagccaatatttatgcggccaagacggccgtcacagctaccaatgtcagcgcgcacggatctcaggctaatagccccagcacccccaatagcgccgggtctagcagttcgttcaatatgtccaatagcggcgaccttttcatgagtgtgcagtctttgaatggagattcctatcaaggcgcccaggtgggagccaacgtccagtcgcaggttgatacactgaggcacgtcatttcccagacaggaggatactccgatggccttgccgctagtcagatgtattcccctcagggcatctctgcaaacggcgggtggcaagatgccacaactcccagcagcgtcaccagtcccacggagggcccaggtagcgtgcactctgacacctctaattag

SEQ ID NO: 129687 - DNA, 1263 bp, Artificial Sequence
  Description of Artificial Sequence: Synthetic coding sequence
atggacgaacagcccaggcttatgcacagtcacgccggtgtaggcatggctgggcatcccggtctcagccagcacctgcaggacggggcagggggaaccgagggtgagggcggcaggaagcaagacattggagacatcctgcaacagatcatgactatcactgatcaatcgttagacgaggcacaggctcgtaagcacgcattgaactgccaccgtatgaagccggccctgttcaatgttctctgtgagatcaaggagaagactgtactgtctatccggggtgctcaggaggaagagccaactgatccccagctcatgaggctcgataatatgctgctcgcagaaggagtggctggaccagaaaagggtggtgggtctgctgcagcagccgcagccgccgcggccagcggaggtgctgggtcagacaattcagtggagcacagcgactaccgagctaaactgtcccagatcagacaaatatatcatactgagctggagaagtatgagcaagcgtgcaacgagttcacaacccacgtcatgaatctgttgcgggaacagagccggactaggcccatctccccaaaggaaatcgagcggatggtgagcattatccatcgcaaattcagtagcattcagatgcagctgaagcaatctacttgcgaggccgtcatgatcctgagatcgcgcttccttgacgctaggcgcaaaagaaggaatttcaacaagcaagccactgaaattctcaacgaatatttctatagccacctctccaatccgtacccgtctgaagaggccaaggaggaactggccaaaaaatgcgggattaccgttagccaggtgagcaactggtttggtaataagcgaattcggtacaaaaagaacataggcaagttccaggaagaagcaaatatctatgccgcaaaaaccgccgtcacggccaccaatgtgtccgcccatggaagccaggcgaactctccgtctaccccgaattcagccggatcctctagttctttcaatatgtcgaattccggagatctatttatgtccgtgcagagcctgaatggggattcatatcagggcgcccaagttggagctaatgtgcagagccaagtggacacacttcggcacgtcatctctcagaccgggggctactccgacggccttgccgccagccagatgtactcgccacaaggaatatcccaccttccacgccatcccaggcaggcccactatcactttagattgccgacatggcatccgtag

SEQ ID NO: 129688 - DNA, 906 bp, Artificial Sequence
  Description of Artificial Sequence: Synthetic coding sequence
atgcgactggacaacatgctgctggcagaaggggtcgctggacccgagaaaggcggaggttcagctgctgctgcagccgctgctgccgctagcggaggcgccggctctgacaactccgttgaacactccgactatcgagccaagttgagccagatccgccaaatctatcacacagagctggagaagtacgaacaggcctgcaatgagttcacaacacatgtgatgaatctcctgcgcgaacagtcgagaacgcgaccaatatcacctaaagagatcgagcgcatggtgtccataatccatcgtaagttttcatcaatccaaatgcagttaaagcagtctacctgtgaggcagtgatgatcctgagatctaggtttctggacgcacgcaggaagcgccggaattttaataaacaagcaaccgagattttgaacgaatacttttatagtcatcttagtaatccatacccgagcgaggaggctaaagaggaactcgcgaagaagtgcggtatcaccgtgtcccaggtgtccaactggttcggaaacaagagaattcgctacaagaaaaatattgggaagttccaggaggaggctaatatctatgccgccaaaacagccgttaccgctactaatgtgtcagcccacggctctcaggctaactcgccgagcactcccaactcagccggatcctccagtagctttaacatgagcaacagcggagatctcttcatgtccgtccaaagtttaaatggagactcttaccaaggcgcccaggtgggcgccaatgtccagagccaggtggacacacttagacacgtcatcagccagaccggaggatactcagacgggttggcagcctcacagatgtatagcccacaaggaatctcagaaatcgcgagaacgtactag

SEQ ID NO: 129689 - DNA, 1020 bp, Artificial Sequence
  Description of Artificial Sequence: Synthetic coding sequence
atggacgaacagccccgacttatgcacagccacgcaggcgtaggaatggccggacaccccggtctgagccagcacttacaggatggagccggagggacagagggcgaaggcgggcgcaagcaagacattggggatatcctacaacagataatgacaattactgaccaatctttagatgaagcgcaggctcgtaaacacgcacttaactgccaccggatgaagccggctctatttaacgtgctatgcgagattaaagaaaagacagtcctgtctatcagaggagcacaagaagaagaaccaaccgatccccagttgatgcgcctggataatatgcttctggcggaaggcgtcgccggcccggaaaaggggggagggagtgcagccgctgctgcagccgctgccgcctccggaggtgccggctccgataactccgtcgaacactctgactaccgggccaagctgagtcagattcgacaaatataccacaccgaattagaaaagtacgaacaggcttgcaacgaattcacaacccacgttatgaacttactgcgcgagcagagtagaacacgccccatatcaccaaaggagatcgagcgtatggttagtatcattcaccgtaagttttcctctatccaaatgcagcttaagcagagcacctgcgaagccgtgatgatcctgcgctctcgattcctcgatgcaagaagaaagaggaggaacttcaataaacaagccaccgagatcctgaacgagtatttttattcacatctctccaatccataccccagcgaagaggccaaggaagaactagccaaaaagtgtgggattacggtctcacaggttgatacccttaggcatgttatatcacaaactggagggtactcggatgggctagcggcatcccagatgtattccccccaggggatctccgctaacggtggctggcaggacgccacaaccccttcttcagtcaccagcccgacagaggggccaggatctgtccacagcgacactagcaattag

SEQ ID NO: 129690 - DNA, 978 bp, Artificial Sequence
  Description of Artificial Sequence: Synthetic coding sequence
atgcgccttgataatatgctcctcgcggagggggtcgccggtccagagaaagggggtggcagcgccgctgctgctgccgccgctgccgcctctggcggcgccggatcagacaacagcgtggaacattctgattacagggcaaagctgtcacagattagacagatctaccacaccgaactggagaaatacgagcaggcctgcaacgaattcacaactcacgtgatgaatttactcagagagcagtctcgcaccaggccaatctctccaaaggagatcgagcggatggtcagcataatccatcgaaaattttccagcatccagatgcagctcaagcagagtacatgcgaggcggtcatgattctccgctctcgatttctggatgctcgcagaaagcgcagaaatttcaataaacaggctaccgagattttgaatgagtacttctactcgcatctgagtaatccctacccatcggaggaggccaaggaagagctcgccaaaaaatgtggtattaccgtgtcacaggtgtccaactggtttggaaacaagagaattcgatataagaagaacatcgggaagttccaggaggaggccaacatttacgctgctaaaaccgcagtgaccgccactaacgtctcggcacacggctcccaggctaacagtccttctacacccaattcagccggaagtagctcttcctttaatatgtccaatagcggggacctgtttatgagtgtacagtcacttaacggagactcatatcagggggcacaggtaggcgctaatgtccagtcccaggtggataccctacgccacgttatctctcagacaggcgggtatagtgatgggcttgctgccagccaaatgtattctccgcaaggaatctccgccaacgggggatggcaagacgccacaacaccttctagcgtgacctctcctacagagggccctggctcggtgcattcagataccagcaactag

SEQ ID NO: 129691 - DNA, 978 bp, Artificial Sequence
  Description of Artificial Sequence: Synthetic coding sequence
atgcgtctcgataatatgcttctcgccgagggcgttgcagggcccgagaagggaggcggaagtgcagccgccgctgccgccgccgccgctagtggaggggccggcagtgataatagtgtcgaacactccgattatcgtgccaagctgtcacagatccgtcaaatttatcacactgagctcgagaaatatgagcaggcttgcaacgaattcaccacccatgttatgaacttgctccgggaacaatccaggactaggccaatttctcctaaagaaattgaacggatggtgtcgattattcatcggaagttttctagcatccaaatgcagttgaagcagagcacgtgcgaggctgtgatgatcctccgtagcaggtttctcgacgcgaggaggaaaaggcgaaactttaacaagcaggccactgaaatcctgaacgagtatttctactcccatttatctaatccatatcctagcgaagaggctaaggaggagctggccaagaaatgtggcattacagtgtctcaagtgtccaattggttcggcaataagcgtatcaggtacaaaaagaatattggcaagtttcaggaagaagcaaatatttatgccgcgaagacagcagtcactgccacaaatgtgtcagcccacggctctcaagctaatagcccctccacaccaaacagcgctgggtcctcttcctcctttaatatgtccaattctggcgacctgttcatgagcgtacaaagcctgaatggagacagctaccagggcgcccaggtcggcgccaatgtgcagtcacaggttgatacccttcgtcacgtcataagccagaccggcggttacagtgacggcctggccgcttcacagatgtactctcctcagggaatctcagctaacggaggatggcaagacgcgacgacgcctagctcggtgacatcaccaaccgagggtcccgggtcagtccactccgacacgagcaactag

SEQ ID NO: 129692 - DNA, 1293 bp, Artificial Sequence
  Description of Artificial Sequence: Synthetic coding sequence
atggacgagaggctgctgggaccaccacccccaggaggcggccgggggggtctgggtctggtgagtggcgagcctggaggaccaggtgaacctccagggggcggagacccgggaggggggtcaggcggggtccctgggggacggggtaaacaagacataggggacatcctgcagcaaatcatgacaatcactgaccagtcgctcgatgaggctcaggccaaaaagcatgccctcaattgtcaccggatgaagcccgcccttttctctgtgctatgcgagattaaggagaagactggcctcagtattaggtcatcccaagaggaggagcccgtggacccccagctgatgagactcgacaatatgttattggcggagggcgtcgccggtcccgaaaaaggcggtggctctgccgctgcagccgctgcagcagccgcatccgggggaggagtctctcccgataacagtatagagcattccgactaccgcagtaagctggctcagatccggcatatctaccactccgagctggagaagtatgagcaagcgtgtaacgagttcaccacccacgtcatgaatctcctgagagagcaaagccgcactcggcccgttgcccctaaggagatggagcgcatggtctcaataattcaccgaaagttctcagctatacagatgcagttgaagcagtctacctgcgaagccgtgatgatactgcgctccagatttctagatgcccgcagaaagcgtcgcaatttctcaaagcaggccacagaggtgctgaacgagtacttttacagtcatctgtccaacccttacccctccgaggaggcgaaagaagagctggccaaaaagtgcggtatcactgtgtctcaggtctctaattggttcggcaacaagaggatccgctataagaaaaacatcggaaaattccaagaggaagccaacatctacgctgttaaaactgcagtgagtgtgactcagggagggcactctagaacatcttccccaactccccctagctctgcaggaagtggcggctccttcaacctatctggaagtggcgatatgtttctgggtatgccgggcctgaatggcgatagctatagcgcatcgcaggtggagtctttgaggcattctatggggcctggcgggtacggcgacaatttaggcggcggccagatgtatagcccacgcgagatgcgggcaaacgggtcgtggcaagaagctgtcacaccctctagtgtcacaagtcccactgaaggcccggggagcgtgcactccgacacatctaactag

SEQ ID NO: 129693 - DNA, 1293 bp, Artificial Sequence
  Description of Artificial Sequence: Synthetic coding sequence
atggacgagcggctactgggtcctccacccccaggtggagggcgcggcggccttggactcgtgtcgggagagcccggaggccctggcgaaccacctggcggtggagacccgggcggcggaagcggtggcgtccccgggggcagaggcaagcaggacattggtgatattctgcagcagatcatgacaattacagatcagtccctggacgaggcccaagccaaaaagcatgctttgaactgtcataggatgaagcctgccttgttttccgtcttatgcgagattaaagaaaagactgggctctccatcaggtcgtctcaagaggaagaacccgtagatccccagttgatgaggctcgacaacatgctgttagctgagggagtcgccggcccagaaaagggcggcgggtccgcagctgccgcggctgctgccgcggctagcggagggggggttagcccagataacagcatagagcacagtgactaccgctcaaaactggcgcagatccgtcatatttatcactccgagctcgaaaagtacgagcaggcctgtaacgagtttactacccacgtgatgaatctcttgcgcgagcagagccgtacgcgccccgtcgcacctaaagaaatggagaggatggtgagcatcatacacagaaagtttagcgccattcagatgcagttgaagcagagcacttgtgaggctgtgatgatcttacgctcgcgctttttggatgcgcgtcgcaagaggagaaatttttctaaacaggccacagaagtgctgaatgagtacttctatagtcacttgagcaacccatacccctcagaagaggccaaggaggagctggccaaaaaatgtggtatcactgtctcacaggtgtccaattggtttggcaacaaacgcatccgctataagaaaaatattggcaagttccaagaggaggctaacatctatgcagtgaaaacagcggtcagcgtaacacagggagggcactcacgcactagctctccaacaccaccctcttcagcgggctctggaggaagctttaacttatccgggagcggtgacatgttccttggaatgccgggactgaatggagactcttactctgcctcccaggttgagagcctgaggcactcaatgggaccaggaggctacggagacaacctcgggggagggcagatgtattccccccgagaaatgcgagcaaacggatcttggcaagaggcagttacaccttcctctgtcacatctccgaccgagggcccaggctctgtgcactcagatacatccaattag

SEQ ID NO: 129694 - DNA, 1293 bp, Artificial Sequence
  Description of Artificial Sequence: Synthetic coding sequence
atggacgagcgcctactgggaccacctccccctggcggcgggcgtggtggactaggacttgtgtccggagagccaggcggtccaggcgagccgcccggaggtggcgacccaggaggaggctccgggggggtgccaggcggccgggggaaacaggacattggcgacatactccaacaaatcatgacaatcacggaccagagcctggacgaagcccaagcgaagaagcatgctctcaactgtcaccggatgaagccagcactgttttccgtgttatgtgaaattaaagagaagacggggctgtcaatccgcagttcccaggaggaagagcctgtcgacccacagctgatgaggctggacaacatgttgctggcggagggggtggcaggacccgaaaagggcgggggatcagcagcagctgctgcggccgccgccgcctccggcgggggcgtgtcccccgataactcaatcgaacattccgactatagatctaaactggcccagatccgccacatttaccattctgagctcgaaaagtatgaacaagcatgcaacgagtttaccacacacgtcatgaatttgctgcgcgagcaaagtagaacaaggcccgtggctcccaaggagatggaaagaatggtgagtattattcatcgtaagttttctgccattcagatgcagctcaaacaatcgacttgcgaagcagtgatgatcttgcggagtcggttcctggatgctaggcgtaaacggaggaacttcagcaagcaggctacagaggtgctaaacgagtatttttactcccaccttagtaacccatatccctccgaggaggccaaagaggagctggctaagaagtgtggaatcaccgtgtcacaggtcagcaactggttcggcaataagaggatcagatacaagaaaaacattgggaagtttcaggaggaagctaatatctatgctgtgaaaacggctgtttctgtcacacagggcggccacagtcgcaccagttccccgacccccccaagcagcgcaggttcaggaggaagtttcaacctctccggttctggagacatgttcctggggatgcctgggttaaacggcgatagttatagtgccagtcaagttgagagcctccgacactccatgggcccaggtggatatggcgacaatctgggaggaggccagatgtactcgcccagagagatgcgggctaatggaagttggcaagaggccgttactccatcaagtgtcacaagtcctacagagggacctggatcggtgcatagcgataccagcaattag

SEQ ID NO: 129695 - DNA, 1293 bp, Artificial Sequence
  Description of Artificial Sequence: Synthetic coding sequence
atggacgaaaggctattggggcccccaccaccgggcggaggtagagggggcctgggcctggtgagcggggagcctgggggaccaggagaaccccccgggggaggagatccgggtgggggcagcggaggggtgccaggtggacggggcaagcaggacatcggagatatacttcagcagatcatgaccatcactgatcagagtctggatgaggcccaggctaagaagcacgctttaaattgtcaccgaatgaaaccagccctattcagtgttctgtgcgaaatcaaagaaaaaacaggtctgtccatccggagttctcaggaggaggaacccgtggacccccagctcatgaggctggataacatgctcctcgcagagggcgtcgcgggccccgaaaaaggcggaggaagcgcagcggcagcggccgccgcagccgcttccggaggaggcgtgagccctgataactctatcgagcatagtgactataggtccaagttggcacagatacgccacatttaccattctgagttggagaaatacgaacaggcgtgcaacgaatttacgacacacgttatgaacctgttgcgggagcagagccggacccgcccggttgccccaaaggagatggagcgaatggtgtccataatccaccgcaaattcagcgctatccagatgcagctcaagcagagtacatgcgaagccgtcatgattttgagaagtcggttcctcgatgcccgacggaaacgccgtaacttctcgaagcaagctaccgaagtactcaacgagtatttctacagccacctgagtaatccatatccgagtgaagaggctaaagaggagttagcaaaaaaatgcggaattaccgtctcacaggtatccaattggttcggtaataagcgcatcaggtacaaaaagaacatagggaaattccaggaggaggctaatatttatgccgtgaagaccgccgtttcagtgacccagggaggccacagccggacgtctagcccaactcctccttcttctgccggctcaggcgggagtttcaatctgagcggatctggtgacatgttccttggcatgccagggctgaatggagatagctattccgcatctcaagtggagtctcttcggcacagcatgggaccaggcgggtatggggacaacctgggcggcggacagatgtactcgcctagagagatgagggccaatggatcttggcaagaggctgtcacgccatcatcggtgacatcgccgacagagggccccgggtcagtgcactctgatacatcaaactag

SEQ ID NO: 129696 - DNA, 1293 bp, Artificial Sequence
  Description of Artificial Sequence: Synthetic coding sequence
atggatgagagattgttaggtccacccccccccggcggcgggcgcggtggactgggattagtgtcaggcgagcctgggggacctggcgaacctcctggcgggggggatcccggaggagggtcgggtggcgtgcccggtgggagaggtaagcaggatattggcgacatcctgcagcagatcatgaccatcacagatcagtccttagacgaagcacaggctaaaaaacatgctcttaactgccacagaatgaaacctgcactattctccgtgctgtgcgagatcaaagaaaaaacaggcctgtcaatcagaagcagccaggaggaggaacccgtcgaccctcagctgatgcggttggacaatatgctgttggcggaaggggttgctgggcctgaaaaggggggcggtagcgccgctgccgccgctgctgcagctgcctccggcgggggcgtttccccagacaattcaatcgaacacagcgactatcgcagcaagttggcccagatccgtcatatttatcacagcgagctcgaaaaatacgagcaggcttgtaatgaattcacaacacacgttatgaatctcttacgcgaacaatccagaacaagacccgtggcaccgaaagagatggaaagaatggtctcgatcatacacaggaaattttccgcaattcagatgcaacttaagcagtccacttgtgaggccgtaatgatattgaggtccaggttcctggatgcgagacgcaagagacgtaacttttcgaaacaggccacagaagtgctgaacgagtacttttactcccacctcagcaacccttatccttctgaagaggctaaggaggagctggctaagaaatgtggtataactgtaagccaagtttccaactggtttggtaataagcggattcgctataaaaagaatatagggaagtttcaagaggaggccaacatctacgcagtgaagacggcagtatctgttacccagggtgggcattccagaacatctagcccaactcccccctcttcagcaggcagcggcggctcttttaacctgagtggaagcggcgatatgttcctcggtatgcccggcctgaatggagactcatacagcgcttcacaggttgagagtttgcgccactctatggggccagggggatatggcgacaacctgggcgggggccagatgtactcccctcgcgaaatgagagccaatggtagctggcaagaggccgtcaccccttcttctgtaacgtctcctactgaggggcccggctctgtgcattcagacacaagcaattag

SEQ ID NO: 129697 - DNA, 1293 bp, Artificial Sequence
  Description of Artificial Sequence: Synthetic coding sequence
atggatgaacgccttctggggcccccccctcctggtggcggcaggggaggactgggactggttagcggcgagcctggaggcccaggcgagcctcctggggggggcgatcccggtggtgggagcggcggggttccaggcggccgaggcaagcaagacataggagatatccttcagcagatcatgacaattaccgaccagagcttggatgaggctcaggccaaaaagcacgcactcaactgtcaccgcatgaagccagctcttttctctgtcctgtgtgagatcaaggagaagacgggactctcaataagatcgtctcaggaagaggaacccgtcgatccacagctcatgcgtctcgacaacatgttactggctgaaggagtggcaggacctgaaaagggcggtggcagcgccgctgccgctgcagccgctgctgcttcaggcggcggtgtgtcccctgacaactccatcgaacactccgactaccgtagcaagcttgcgcagattcgccatatctatcactcagaactggagaagtatgagcaggcttgcaatgagtttactacgcacgtgatgaaccttctaagggagcagagtagaacccggcctgtggcccctaaggagatggaacgaatggtgagcatcatccatcggaagttctccgcgatccagatgcagctgaaacagtccacatgcgaagccgtgatgatactgaggtctaggtttcttgacgccagacgcaaacggcgtaactttagtaagcaggctaccgaagtgctgaacgagtacttttacagtcacctttcgaatccttaccctagcgaagaggccaaagaggaactagccaagaagtgcggcatcacagtgagtcaggtatccaactggtttggcaataagcgcattcgctataaaaaaaatatcggcaaattccaagaggaagccaacatctacgccgtgaagactgccgtgagcgtcacccagggggggcactcgcgaacctctagccccaccccaccgagttctgctggaagtggcgggagcttcaacctatctgggtctggcgacatgttcctggggatgcccggtctgaatggggatagctactccgccagtcaagtggagtcgctcagacacagcatgggtccagggggctacggggataatctgggtggaggtcagatgtatagccccagggagatgcgtgccaacggatcttggcaagaagctgttactccatcaagtgtcacatcgcccactgagggcccaggatctgttcattccgacacttccaactag

SEQ ID NO: 129698 - DNA, 1293 bp, Artificial Sequence
  Description of Artificial Sequence: Synthetic coding sequence
atggacgaaaggctcctggggccgccacctcccggaggcggccgaggcggtctaggcctggtatctggagagcccggcggaccgggagaacccccaggcggtggcgatccagggggcggcagtggaggcgtccctggaggcagaggaaaacaggatatcggggatattttacaacaaataatgactattaccgatcaatcgcttgatgaggctcaggccaaaaagcacgccctgaactgccaccgcatgaagccagccctgtttagcgttctgtgcgaaatcaaggagaagaccggtctttcaattcggtcaagccaggaagaggagcccgtggatccccagctcatgcggctggataacatgctattagcagaaggggtggccggtccagagaaaggaggcggatccgccgccgccgcagcagccgcagccgcatcaggtgggggggtcagccctgataattccatagaacattctgactacagatctaaattagctcagatccgccatatctaccacagcgagctggagaagtacgagcaggcgtgtaacgagttcacaacacacgtgatgaacttactacgcgagcagtctaggaccaggcccgttgctcccaaagagatggagaggatggtctccatcattcatcgcaaatttagcgccatccaaatgcaactgaagcagtctacctgtgaggctgttatgattttaagaagccgctttctggatgcacgtcgaaagaggcgaaacttttctaagcaggcgaccgaagtgctgaacgaatacttctactctcacctcagtaacccatacccctccgaagaggcaaaggaagagctagcaaagaaatgtggcatcacagtaagccaggtcagcaactggtttggaaacaagcggatccgctacaaaaagaacatcggaaaatttcaggaagaggccaatatctatgcggtgaaaacagccgtgagcgtcactcagggcggccatagtcggactagctcccccacacccccctccagcgcggggtccggagggagctttaacctcagtggttctggcgatatgtttctcggcatgcctggcctgaatggagatagttactcagcctctcaggtggaatccctccggcactctatgggaccaggaggctacggggacaatttggggggtggacagatgtactcgccccgggagatgagggctaacggttcttggcaggaggccgtcaccccctccagcgtgacctctccaaccgaaggccctgggtcggttcacagcgatacctctaattag

SEQ ID NO: 129699 - DNA, 1392 bp, Artificial Sequence
  Description of Artificial Sequence: Synthetic coding sequence
atggacgagcgcctgctgggcccccccccaccagggggaggcaggggcggacttggactggtgtccggagaacctggtgggcccggggaacctcctggcggaggcgacccaggaggggggagcggaggggtgcctggtggcagaggaaagcaagacatcggtgacatccttcagcagatcatgacgatcactgatcaaagtctggatgaggctcaagcgaagaagcacgccttgaattgtcatcgtatgaagcctgcgctgttttccgttctgtgtgaaattaaggagaagacaggtctgtcgattaggagttcacaggaggaggaacctgttgacccccagctcatgagactcgacaacatgttactggctgagggggttgcaggccctgaaaagggcgggggatcggcagcagccgcagctgcagccgctgccagcggaggaggcgtgagccctgataattcaatcgaacatagtgactacagatcgaaactggctcaaatccgacacatctaccactctgagctggagaagtacgaacaggcttgtaacgaattcacaacacacgtgatgaacctcttgagagagcagtcccgcactcgacctgtggccccaaaagaaatggaacggatggtcagtatcattcatcgaaaattctctgcaattcagatgcagttgaagcagtctacatgcgaggccgtgatgatcttacgatcaagattcctcgatgcaaggagaaaacgtcggaatttctctaaacaggcaacagaggtgctcaacgagtacttttactcgcacttatccaatccctacccgagtgaggaggcaaaagaggagttggctaagaaatgtggcatcacggtttcccaggtcctctggcgactgagagaggagctctccggaaaagtgcatgcatctcaattgggcgcggtcgtttcaaactggttcggcaataagcgaatccgctataagaagaacatcggaaagtttcaggaggaagctaacatttatgccgtgaaaaccgccgtgatcatagccgagcgagggccttttggcgttcggggaacagaattaagtctgccttcgttacctcctcaaggctctgggggcagctttaacctgtccggttccggagacatgttcctgggcatgccaggcctgaatggcgactcctacagtgccagtcaagtcaggtgtcctagccctctgcaggtcgagtcccttaggcactctatgggacccggagggtatggcgataacttgggtggtggtcagatgtactcaccaagggagatgcgagctaatggctcctggcaggaggctgttacaccgtctagcgtcactagccccaccgagggcccaggcagcgtacatagcgacacatcgaattag

SEQ ID NO: 129700 - DNA, 1392 bp, Artificial Sequence
  Description of Artificial Sequence: Synthetic coding sequence
atggacgagaggttactcgggccacctcccccaggcgggggaaggggggggctggggttagtatctggggaacccggcggccctggggaacccccaggaggcggtgatcccggtggggggtccggaggcgttccaggtgggagggggaaacaggatattggcgacatcctccagcagattatgaccattaccgaccagtcactggacgaggcccaagcgaaaaagcatgcacttaattgccatcgtatgaaaccagccctcttctccgtactatgtgagattaaagagaagacaggtctgagcatccgaagctcgcaggaagaggagccggtggatccccaactaatgagattggataacatgcttctggcagaaggcgtggccgggccagaaaagggggggggaagcgctgccgccgccgctgcggcagccgcctcaggtggcggtgtctcgccagataatagcattgagcattcagattatcgctccaaactcgcccaaattagacatatatatcatagtgaactggagaagtatgagcaagcatgtaatgagttcaccacgcatgtgatgaatctgttgcgggagcagagccggacaagaccggtggctcccaaggagatggaaaggatggtcagcataatacaccgaaagttcagcgcgatccagatgcagcttaagcaaagtacatgcgaagccgtgatgatactgagatccagattcctagacgctcgacgaaagcgccgcaacttctctaaacaggccaccgaggttctgaatgagtatttttactcacatttatctaatccgtacccatctgaggaggccaaagaagagcttgcaaaaaagtgcggaatcactgtgagtcaagtgctttggagattaagagaagagctgtcaggaaaggtccacgccagtcaacttggcgccgtcgtgagcaattggttcggaaacaaacgaataagatacaagaaaaatatcggtaagttccaagaggaggccaacatttatgccgtgaagacagccgtcattattgcagaacgcggtcccttcggagtaagaggaactgagctgagcctcccaagtctacctccccagggctccggaggtagtttcaatctttctggttccggagatatgttcctgggaatgcccggccttaacggtgacagctactcagcctctcaggtgcggtgccccagcccgcttcaggtcgaatctctccgacatagcatgggcccaggtggctacggagataacctgggcggaggacagatgtactccccgcgcgagatgagagcaaacggcagttggcaggaagctgtcaccccttcctcagttacaagccctacagaaggacctgggagtgtgcactcagacacatcaaactag

SEQ ID NO: 129701 - DNA, 1317 bp, Artificial Sequence
  Description of Artificial Sequence: Synthetic coding sequence
atggatgaaaggctcctgggtccgcccccaccagggggggggagaggaggacttgggctcgtcagcggcgaacctggcgggccaggcgagccccctggcggcggggacccaggtggtggaagcgggggggtgccagggggaagaggcaagcaggatattggcgatatcctccaacagattatgactataactgatcagagtctggacgaggcacaggctaagaagcacgcacttaactgccaccgaatgaaacccgcgttgtttagcgtgttgtgcgagatcaaagaaaagaccggcctgagcatccggtcttcccaagaagaggagccggtcgacccgcagcttatgaggctggataatatgctgctagccgaaggagtggctgggcctgaaaagggaggtggcagtgccgcggcagcggccgccgcggctgcaagcggtggcggtgtatcccccgataactcgatcgaacattctgactacagaagcaagctcgcacagatcaggcacatctatcattccgagctggagaagtacgaacaagcttgtaatgagttcactacgcacgtgatgaacctgctgcgcgagcaatcgcgaacccggcctgtggcccctaaagaaatggagcgcatggtttccattatccatcgaaaattctccgccattcagatgcaactgaagcagagcacttgcgaggctgtgatgatcctccgcagtaggttcctggatgcccgcaggaagcgtaggaacttcagcaagcaggcaacagaggttcttaatgagtacttctactcccatcttagcaatccatatccctccgaggaggctaaggaagagctggccaagaagtgtggaataacagtgtctcaggtttccaactggttcgggaacaagcggatccgatacaagaaaaatattgggaagtttcaggaggaggctaacatatacgctgtaaagacagcagtctcggtcacacagggaggacactcccgtacttcgtcacccaccccaccttcatcagccggctccggcggctctttcaacctgtctgggtccggcgatatgttcctaggcatgcccggtctgaacggggacagctatagtgcctcccaagtccggtgccccagccctttacaggtggagtcccttcggcacagtatgggtccggggggatacggagataacctcggaggcggccagatgtattcacctcgcgagatgcgggccaatggatcttggcaggaggccgttacccccagcagtgtcacttctccaactgaaggtcccggttcggttcactccgataccagcaattag

SEQ ID NO: 129702 - DNA, 1317 bp, Artificial Sequence
  Description of Artificial Sequence: Synthetic coding sequence
atggacgaacgcctgctgggtccaccaccacccggcggaggccggggtggtttgggactggtctccggcgaacctgggggccccggagaacccccaggcggaggtgacccagggggcggatccggcggtgtgccagggggaaggggaaagcaggatattggagatatcctacaacagattatgactatcacagatcagtcactggacgaggctcaagccaaaaagcatgcattgaattgccacagaatgaagcccgctctgttttcagtactgtgcgaaattaaagaaaaaactggactgtcgattagatcctctcaagaagaggagcccgttgatcctcagttaatgaggctggacaacatgctgctggcggagggcgtggctggccctgagaaaggcggcggaagtgccgccgccgctgcagctgcggccgcaagtggaggaggcgtctctccggacaactctatcgaacattccgattaccgctctaaactggcccagatccgccatatttatcacagtgaactcgagaaatacgaacaagcatgcaatgaatttacaactcacgtaatgaacctgctgagggaacagagccgcactagaccagtcgcccctaaagaaatggaaaggatggtttctattatacatcggaagttcagcgccatccaaatgcagttgaagcagtcgacctgcgaggcagtgatgattttgcgttcacgcttccttgacgcccgaaggaagcgcaggaacttttctaagcaggccaccgaggtactgaacgaatacttttattctcatctaagcaatccgtatccgagtgaagaagcaaaggaagaattagccaaaaagtgtggtattacagtgtcccaagtcagcaattggttcgggaacaagcggatcagatacaaaaaaaacattgggaaatttcaagaggaggcaaacatttatgccgtgaagaccgcagtctccgtgactcagggcggacattctcggacctccagccccacgcctccatcttcagctggctctggcggttcctttaacctcagtgggagcggcgacatgttcctcggcatgcccgggctgaatggggattcctattcagcttcccaggtccgctgtccgtcgccgttgcaagtagagtcactgcggcattccatgggaccaggtggatacggggataatctaggaggcggccaaatgtactcccccagagaaatgagggccaatggcagttggcaggaggcagtgacaccttcttcggttacgagtcctaccgaaggtcccggctccgtccacagtgacactagcaattag

SEQ ID NO: 129703 - DNA, 1392 bp, Artificial Sequence
  Description of Artificial Sequence: Synthetic coding sequence
atggacgaacggctgctgggcccccctcccccgggaggcggtagaggaggactgggccttgtgtcaggcgaaccagggggtcctggcgaaccaccaggaggcggtgatccgggcggcgggtcaggcggtgtgcctggcggacgcggcaagcaggacattggagacatcctccagcaaattatgaccatcactgaccaatctctggacgaagcccaagctaagaaacatgcccttaactgccatagaatgaagcccgcccttttctctgttctctgtgaaatcaaggaaaaaacaggtcttagcattcgaagctcccaagaggaggagcctgtggatccacaactcatgcggctggacaacatgctattggcagaaggagtggcaggccccgagaagggcggtgggagtgccgccgcagcggctgccgcggctgcttctgggggaggagtgtctcccgacaactcaatcgagcatagcgattaccgatctaagttggctcagataagacatatctaccattcagaactcgagaagtacgaacaggcctgcaatgaatttaccacccatgtcatgaacctgctgcgagaacagtcccggacacgtcccgttgccccaaaggagatggagcggatggtctccatcatccaccggaagtttagcgccattcagatgcagctgaagcagtccacctgcgaagcggtcatgatcctccgctcaagattcctggacgcgagacgaaagcggcggaacttctcaaagcaagctactgaggttttaaatgagtacttttattcccacctgagcaacccttacccttccgaagaggccaaggaggaactggccaaaaagtgcggcataaccgtctcacaggtcctgtggcgtctgagggaggagctgagtggtaaggtgcacgccagtcaactgggtgctgtggtaagcaactggttcggaaacaagcgtatccgctataagaaaaatataggaaaatttcaggaagaagctaacatttacgccgttaagaccgccgtgataatagccgaaaggggtcctttcggggtcagaggaaccgagctgagtctgccaagcttgcctccacagggttctggtgggtcttttaacctgtcaggaagtggggatatgtttttgggcatgcccggccttaatggcgactcctatagcgcgagccaagttaggtgcccttctccactgcaggtggaaagcctgaggcactccatgggtcccggcggttacggagacaatctggggggaggccagatgtattcaccacgcgaaatgcgcgccaatggtagttggcaggaggcagtcaccccttcgtccgtcacttccccgacagagggtcctggaagtgtgcactccgacaccagcaattag

SEQ ID NO: 129704 - DNA, 1392 bp, Artificial Sequence
  Description of Artificial Sequence: Synthetic coding sequence
atggatgagagactgctgggtcctcctccccctggaggcgggcgcggaggactgggcctcgtctctggggagcccggtgggcccggggaacctcctggcggtggggaccccggcggtggatcagggggcgtgcctggagggagaggtaagcaggatattggcgatatcctgcagcaaatcatgacaattacagatcaaagcctggacgaggctcaggctaaaaagcacgccctgaattgtcaccggatgaaacccgcactgttctccgttttgtgtgaaattaaagagaagaccggcctctctataaggagctcacaggaggaagagccagttgatccccaactaatgcgcttagacaatatgctactggctgagggagtagcaggacctgagaagggcgggggcagcgctgccgctgccgccgcagccgcagccagtggcggcggggtttctcccgataatagtattgaacatagcgactatcggtccaagctggcccaaatcagacacatttatcattctgagctggaaaagtatgagcaggcttgtaatgagttcaccacccacgtcatgaacctgttacgtgagcaatccagaacccggcctgtggcgccaaaggaaatggagcggatggttagtattatacaccgcaaattctctgcgatccaaatgcagctgaaacagtccacctgtgaggcggtgatgatcctgcgtagccgctttctggacgcccggcggaagcgtaggaacttttcaaagcaggctacagaggtattgaatgaatacttctatagccacctctctaacccatacccgagcgaggaagctaaagaggagttggccaagaaatgcggcatcacagtttcacaggtcctttggagattacgggaggagcttagcggtaaagtacatgcctctcaactaggggctgttgtttccaactggtttggcaataagagaatccgatataagaagaacatcggaaagtttcaggaagaggccaatatttatgccgtgaagaccgccgttataattgcggagaggggcccttttggcgtgagaggcacagagctgtccctgccaagtctgcctccacagggaagcggcggttctttcaacctgtctggatctggcgacatgttccttgggatgcctggcctgaacggtgatagctatagcgcaagtcaggtccgctgtccgagtccactgcaggtcgagtccctgaggcactctatgggcccaggcggatatggagacaacctgggcggcggccagatgtacagtccaagggagatgagagccaatggctcatggcaggaggcggtgacgccgtcaagcgtaacatcacctaccgaggggccgggctcagtccatagcgatacgtcaaactag

SEQ ID NO: 129705 - DNA, 1332 bp, Artificial Sequence
  Description of Artificial Sequence: Synthetic coding sequence
ggggcggagcagggcggtgggctaagagctcccccccagctctggacaaatggctactggggaagacccctccaggccggggccggcggcttgggcttggtctcaggcgaacccgggggtccgggggaaccaccaggcggcggggaccccgggggaggttccggtggcgtgcccggaggcagaggcaagcaggatattggagatattttgcagcagattatgaccatcacagaccagagcctggacgaagcgcaggccaaaaagcacgctctgaactgtcatcggatgaaacccgccttgttcagcgtcctctgtgaaataaaggagaaaaccggactttcaatccgctctagccaggaagaggaaccggttgaccctcaactgatgagactcgataacatgctgctcgctgaaggcgtagcagggccagagaaaggaggaggatcagccgctgctgccgctgccgctgctgctagcggaggcggcgtgtcaccagacaatagcattgaacactcagattataggagtaagctagcgcaaatccggcacatttatcactctgagctggagaaatatgagcaggcgtgtaatgagttcactacacatgtaatgaatctgctccgagagcagtcgcggaccagacccgtggcgcctaaagagatggagcgcatggtgtccatcattcatagaaaattcagtgctatccagatgcagttgaaacagagtacctgtgaagcagtgatgatcctgcggtcacgctttctggatgctaggagaaagcgacgtaatttcagcaaacaggccacagaggtcctcaacgaatacttttactcacacttgtccaacccataccctagcgaagaggctaaagaggaactggccaaaaaatgtggtataacagtgagtcaggtgagtaactggtttggcaataagcgaatccggtacaaaaagaacattggtaagttccaagaggaggccaatatatacgcggtcaaaacggcggtgagcgtaacccaggggggacactcacggacatccagtccaacgcctccttcatctgcgggttcaggcgggtcattcaacctaagcggatctggggatatgttccttgggatgcctggcctcaacggagacagctattctgctagtcaggtggagtcactgcgacactccatggggcctgggggatatggggacaacctaggtgggggccagatgtattcccccagagaaatgagggcgaacgggtcctggcaggaagctgtgacaccaagctccgtgacatctccaaccgaagggccagggagcgtgcatagcgacacaagcaactag

SEQ ID NO: 129706 - DNA, 1332 bp, Artificial Sequence
  Description of Artificial Sequence: Synthetic coding sequence
ggggctgagcaaggcggagggctccgcgccccccctcaattgtggacaaatggttactggggccgtccccttcaagcaggagcaggtggattgggcctggtctccggggaaccagggggtccgggggagccgcctggcggcggggatccaggcggagggtcaggcggggtgcccggagggagaggaaaacaggatatcggggatatcttgcaacagattatgacgataaccgaccaatccctagatgaggcacaggctaaaaaacacgccctgaattgtcacaggatgaaacccgcattattcagtgtgttatgtgagattaaggagaagacggggttgtccatcaggagctcacaggaggaggaacctgttgatccccagctcatgcgtctggataacatgctcctggcagaaggagtcgctggccctgagaaggggggaggcagcgccgccgcagccgccgccgccgctgcctcaggtggcggcgtctctcccgacaattccatcgaacactctgactatcggtcaaagcttgcacagatcaggcacatctaccatagtgagctggagaaatacgaacaggcctgcaatgagtttactacacacgtcatgaacttgctacgagaacagtcccgaacccggcccgtggcacctaaagagatggagaggatggttagcattatccacaggaaattcagcgcaattcagatgcagttgaaacaaagcacgtgcgaagctgtgatgattttgcgttcccgcttcttggacgccaggcgcaaacgtcggaattttagcaagcaagccactgaagtgctgaacgagtacttctatagtcacctgtcaaatccctatccaagcgaggaggcaaaagaggaactagctaaaaaatgtggcatcacagtatctcaggtgagcaactggtttggtaataagagaatcaggtacaagaagaatataggcaagttccaggaggaggctaatatatacgcagtaaaaaccgcagtatccgtgactcagggcggacactcacgtacgtccagtccgactcctccttcttctgcggggtcaggtggctccttcaatttaagcggtagcggagacatgtttctcggtatgcccggactgaatggcgattcttactctgcctctcaggtggaaagtctgcgccattccatgggacccggaggctacggcgataatctcggcggggggcagatgtactcacctagggagatgagagctaacggatcctggcaagaagcagtcacccccagcagtgtgacttcaccaactgagggccctggcagcgtgcatagcgatacaagtaactag

SEQ ID NO: 129707 - DNA, 1317 bp, Artificial Sequence
  Description of Artificial Sequence: Synthetic coding sequence
atggatgagaggctgttgggacctcctcccccgggaggaggtcggggaggcctgggactggtgagtggcgaaccgggcggacctggggaaccaccaggtggcggtgaccctgggggaggttctgggggggtgccaggagggaggggaaagcaggatatcggggacatcctgcaacagattatgactatcacggatcagagccttgatgaagcgcaggcaaaaaagcacgcgctgaattgtcatcgcatgaagcccgcccttttcagtgtactgtgcgaaataaaggagaagaccggtctgagtatacggtcatctcaggaggaagaacccgtggatcctcagctgatgaggctggataacatgttgctggcggagggagtggcaggaccggagaagggaggtggatctgcggccgctgctgctgccgctgcggcaagcggagggggagtgtcccctgataactcaatagaacactcagactataggagcaagctggcacaaatacggcatatttaccactccgaacttgagaagtatgagcaagcatgcaacgaattcacaacccatgtcatgaatcttttgcgggagcagtcacgtactcggcccgtggctcccaaggaaatggagcggatggttagtataattcatcggaaatttagcgccatccagatgcaacttaagcagtctacgtgcgaggcagtgatgatcctgcggagccgcttcctggacgccaggcggaagaggaggaatttcagcaaacaggcaacggaggtcctcaatgaatatttctacagccatctctctaatccataccctagcgaggaggcaaaggaagaactggccaaaaaatgcggaattactgtctctcaggtatccaactggtttggcaataaaagaatcagatataagaagaacatcggaaaattccaggaagaggcgaatatctacgccgttaaaactgccgtctccgtgacccagggcggccactcccgcacctcctcaccaactcctccatcatccgcaggctcgggcggatcgtttaacctgagcggatctggggatatgttcctggggatgcccgggctgaacggagactcttactctgccagtcaggtgcgatgtccgagcccactccaggttgaaagtttgagacattctatggggccggggggctacggggacaaccttggggggggccagatgtactcaccgcgagaaatgagggccaatgggagctggcaggaagctgtcacacccagttccgtgaccagtccaacagaaggcccaggttccgtgcattctgatacctccaattag

SEQ ID NO: 129708 - DNA, 1380 bp, Artificial Sequence
  Description of Artificial Sequence: Synthetic coding sequence
atggacgagcgtttactaggccccccccctccaggaggtggtagaggaggacttggactggtgtctggcgaacccggcggccctggtgagccccccggcggcggcgatcctgggggcggctcaggaggcgtaccaggcggtcgagggaaacaggatataggcgatatattacagcagattatgactataactgaccagagcctggacgaggcacaggcaaagaagcatgcactgaactgccaccgaatgaagcctgcactctttagtgtgctctgcgaaattaaggagaagacgggcttgagtatccgctcgtcccaggaggaggagccagttgacccccagttgatgcgtctggataatatgctgctggctgagggggtagcaggtccggagaagggtggaggttcagctgctgcggccgctgccgccgccgcctctggtggaggcgtgagccctgacaactcaattgaacactccgactacaggtctaagctggctcagattagacacatttaccatagtgagctcgagaagtacgaacaggcttgcaacgagtttaccacacatgtgatgaatctgttgagggagcaatcacgtactagaccggttgccccgaaagagatggagcggatggtgtctatcattcacagaaaattcagcgctattcagatgcaacttaagcagagtacttgtgaagccgtaatgatcctgagaagccggttccttgacgcgaggagaaaaagaagaaacttcagcaagcaggcaacggaggtgctgaacgagtacttctattcccacctctccaatccatacccatcagaagaggcgaaggaagagctcgcaaaaaagtgtggtatcacagtctcccaagtgttatggcggctgagagaggaactgtctgggaaagtgcatgcctctcagctgggtgcggtagtgagtaattggttcggcaataaacgcattagatacaaaaaaaacatcgggaagttccaggaggaggctaatatttatgcagtgaagaccgctgtgagcgtgacacagggtggccacagcagaacatcatcgcctacacctccatccagtgcgggctcgggaggcagctttaacctgtctggttccggtgacatgttccttgggatgccgggattaaatggggactcatactcagctagccaagtgaggtgtcccagtcctctgcaagtagagtctctgcggcacagcatggggcctggtgggtatggagacaacctgggagggggacagatgtactccccacgagaaatgagagcgaacgggtcgtggcaggaagcagtcacccctagcagcgtgacatctcctacagaggggcctgggtcagttcattccgatacctctaattag

SEQ ID NO: 129709 - DNA, 1332 bp, Artificial Sequence
  Description of Artificial Sequence: Synthetic coding sequence
ggggctgagcagggcggcggacttcgagctcctcctcagctttggactaacggatactgggggagaccactgcaggctggcgctggtggcctgggattggtgtccggtgagccaggggggcccggtgaaccccccggtgggggggacccaggtggtggttcaggcggagtgcccggagggaggggaaaacaggatataggggacatcttacagcaaatcatgacaattaccgatcaatcactggatgaggcacaggccaagaagcatgcgttgaattgtcacaggatgaagcccgcccttttttccgtgctgtgcgagataaaagagaagaccgggctgtctatccggtcctctcaggaggaagagcctgtggatccccaactcatgagactggataatatgcttttggcagagggagtagctgggcccgaaaagggaggtgggagcgccgcggccgctgccgccgctgctgccagcggaggtggcgtctcacccgataacagtatagagcattccgactaccgcagtaaactggctcagatccgccacatatatcactcggagctggaaaaatatgagcaagcctgtaacgagtttaccacgcatgtgatgaacctgttaagggagcagtctcggacaagaccagtggcacccaaggagatggaacgcatggtgtcaattattcaccgaaagttcagcgctatccagatgcagttaaagcagtccacatgtgaggccgtaatgatccttaggagcagattccttgatgcaagacgcaaacggcggaatttcagcaagcaggcgactgaagtactaaacgagtacttttactcacacctgagcaatccttatccttcagaggaggctaaggaggaactggcaaagaagtgtggaatcacagtatcacaggtctccaactggtttgggaacaagcgaatcaggtataaaaaaaacattggaaagtttcaggaagaggctaacatctacgccgtcaagacagcggtgagcgtcactcagggagggcacagccgtaccagttcacccaccccaccctcctctgcagggagcggtggctcattcaatctcagcggatccggcgatatgtttctgggcatgcccggacttaacggcgactcctatagtgcaagtcaggttgaatcactgcggcactcaatgggacctggaggctacggagataacctgggagggggtcagatgtattcaccgagagagatgcgagcaaacggttcctggcaggaagccgtcactccgagttcggtcacatctccaactgagggaccggggtctgtccacagcgatacctccaattag

SEQ ID NO: 129710 - DNA, 1317 bp, Artificial Sequence
  Description of Artificial Sequence: Synthetic coding sequence
atggatgaaaggctcctagggccgccaccaccaggcggaggtcgcggcggcctaggcctagtgagcggagagcctggcggtccaggcgagccccccgggggcggggacccaggagggggttccgggggtgtcccaggaggacggggtaaacaggacatcggggatatactacaacaaatcatgaccatcaccgatcagtcactggacgaggcacaagccaaaaaacacgccctcaactgtcatcgaatgaaaccagccctgttctctgtgctgtgtgaaattaaggagaagaccgggctatcaatccggtcaagccaggaggaggagccagtagatccccagctgatgagactggacaacatgcttttggccgaaggggtggccgggccagagaagggcggcggatctgcggcagcagccgcagcagcggcagccagcgggggtggtgtgagtcccgataatagcattgaacacagcgactaccgctccaaattagcccagataaggcatatttaccacagtgagctcgaaaaatacgaacaggcttgcaacgagtttactacgcacgtcatgaacctacttagggaacaatctaggactcggcctgtggcgcccaaggaaatggagcgaatggtaagtatcatccaccggaaattcagtgctatccagatgcagctgaaacaatcaacctgtgaggcagtgatgatcctgcgttcccgatttctggatgcccggcggaagcggaggaacttcagtaagcaggctacggaagtgctgaatgagtatttctactctcacctgagtaatccttacccttccgaagaagcaaaagaggagctcgctaaaaagtgtggcattaccgtctctcaggtctctaattggtttggaaataaacgcatccgatataagaaaaacataggaaaatttcaagaagaggcgaatatctatgctgtgaagacggccgtgagcgtgacccaaggaggccacagccgtactagctcccccacccccccgtcgtcagctggcagcggaggatcattcaacctgtctggatcaggggacatgttccttggcatgccaggcctgaatggggacagttattccgcaagccaggttcgctgcccctctccactccaggtcgaatccttgagacatagtatgggccctggaggatatggtgataacctcggaggggggcagatgtactcgccacgcgagatgagagccaatggctcctggcaggaggccgttactccctcttctgtcacaagtcctaccgagggccccggtagtgtccattctgatacgtccaattag

SEQ ID NO: 129711 - DNA, 1317 bp, Artificial Sequence
  Description of Artificial Sequence: Synthetic coding sequence
atggatgaaagactcctcggccctccacctcccggtggcggacgtgggggcctgggactggtgagcggcgagcccgggggcccaggagagccccccggcggtggcgatcccggggggggctcaggaggggtgccaggaggacggggaaagcaggacattggggacatcctccagcaaatcatgacaatcaccgaccagagcctggacgaggctcaggctaaaaagcatgccctgaactgccacagaatgaaacctgccctgttctctgtcctttgcgagattaaggaaaaaacggggctcagcatcaggagttcacaggaggaggagcccgtggacccccagctcatgagactggataatatgctcctggctgaaggtgtcgctggccccgagaaaggcggaggttccgccgcagccgccgcggctgccgccgcctccggagggggtgtgagcccagataactctattgagcactcagattacagaagtaagctcgcccagatccgacacatataccattctgaactggaaaaatatgagcaggcatgcaacgagttcacgactcatgttatgaatctgctgagggagcagtccaggactcggcccgtcgcgcccaaagagatggagagaatggtctcgattattcaccgcaaatttagtgccatccagatgcaacttaaacaaagcacttgtgaggccgtcatgattcttcgcagtagattcctcgacgctagacggaagcgccgtaacttcagtaaacaggctaccgaagtgctcaatgaatatttctattcacacctatccaacccatacccgagcgaggaagcaaaggaggagctggccaaaaaatgcggtatcacagtgagtcaggttagcaactggttcggcaacaaaagaatccgatataagaaaaacatcggaaaatttcaggaggaagccaatatctacgcagttaagacagcggtcagcgtcacccagggcgggcatagtcgtacgagctctcccacccctccctcctccgccggttccggaggaagtttcaacctctcggggagtggtgatatgtttctcggcatgcctggcctgaacggtgacagttatagcgccagtcaggtgaggtgtccgtctcccctgcaggtggagtctttgcgtcactctatgggccccggaggatacggtgacaaccttggaggcggacagatgtacagcccacgcgaaatgagggccaacggatcatggcaggaggccgtgacgcccagcagtgtgacgtcgcctaccgagggccccggcagtgtgcacagcgatacctcaaactag

SEQ ID NO: 129712 - DNA, 1332 bp, Artificial Sequence
  Description of Artificial Sequence: Synthetic coding sequence
ggggccgaacagggagggggcttgcgcgcaccaccccagctctggacgaatggatactggggcaggccgctccaagctggggctggtggcctaggactagtgtccggagaacctggcggcccgggtgagcctccgggcgggggagacccaggcggcgggagcggaggtgtacccggcggccgtggcaagcaggacataggagatattctgcagcaaataatgacaatcacagatcagagcctggatgaagcccaggccaaaaagcacgccctgaattgtcataggatgaagcccgccctcttttccgtgctttgcgagatcaaggagaagacaggcctcagcatcagaagttcgcaagaagaagaacctgtggatcctcagctgatgaggcttgacaacatgctgctggcggagggcgtcgccggtccggaaaaggggggaggctccgccgctgcagctgcggcagcagccgcaagtggggggggcgttagtcccgataactccatagagcacagcgattaccgatctaaactggcccaaattaggcatatttatcattctgagctggaaaaatacgagcaggcctgtaacgaattcaccactcacgtgatgaacctgctaagagagcagagtcggacccgacccgttgctccaaaagaaatggagcggatggtgagtattattcatcgaaaattctccgccatacagatgcagctcaagcagtcgacgtgcgaggccgtgatgatcctgcgctcgcgcttccttgacgccaggcgcaagcgccggaactttagcaagcaagcgaccgaggtgctgaatgaatacttctattcacacctgagcaatccatacccttccgaggaggccaaagaagagctggccaaaaaatgtggcatcacagtgtctcaggtgtcaaattggtttggcaataagcgaatacgctacaaaaagaatatcggaaagtttcaggaagaagccaatatttatgctgtgaagaccgccgtgtccgtgacgcagggggggcactctagaacctcctcaccgactccaccttcctccgccggatccggagggagtttcaacctgtctggctcaggagatatgttcctggggatgcccggtctcaacggggattcgtacagcgcctctcaagttgagtcgcttcggcactcaatgggtccggggggttacggggataacctgggtgggggacaaatgtactccccccgcgagatgagagccaatgggtcttggcaggaggcagtgaccccaagtagcgtgacttcccccacagagggtccaggttcagtgcactccgacactagtaactag

SEQ ID NO: 129713 - DNA, 1392 bp, Artificial Sequence
  Description of Artificial Sequence: Synthetic coding sequence
atggatgaacgactcctcggcccccccccaccaggaggcggacgtggcggcttggggcttgtctccggtgagcctggcggtcccggagaacctccagggggaggagatccgggggggggttcagggggtgtaccaggaggtcggggtaaacaggacataggcgacattctgcagcagattatgaccattactgatcagtctctcgacgaggcacaggctaaaaaacatgccttaaattgtcatcgcatgaaacccgctcttttcagcgtactatgtgaaattaaggagaagaccgggctttcaataaggtccagtcaggaagaggaacctgttgatcctcaacttatgcgcttagataacatgctcctcgctgagggagtcgctggtccagagaagggtgggggaagtgctgcagcagctgcagccgctgcagctagtggtggaggtgtatcaccagataactctatagagcatagtgattaccgctctaagctggcccagatacgtcatatctatcactccgaactggagaagtatgagcaggcatgcaatgaattcacaacacacgttatgaacctcttgagagaacagtcaagaacccgtcccgtggcaccaaaggagatggaacgcatggtgtctattatccacagaaagttctccgccatccaaatgcagctgaagcaatcgacctgcgaggctgtgatgatccttagaagccgcttcctggacgcccgcaggaagagaagaaacttcagtaagcaggccactgaggtgctgaacgagtatttttactctcatctgtcgaacccttaccccagcgaagaagctaaggaggaattggccaagaagtgcgggatcaccgtgtcacaggttctttggcggctacgcgaagaactgagtggtaaggttcacgcttcgcaactgggggccgtcgtgtccaattggttcggcaacaaacgcattcggtataaaaagaacattggaaagtttcaggaagaagccaatatctacgctgtgaagacagccgtaatcatcgctgagagggggccctttggggttaggggcactgaactgtcactgccgtctctccctccccaggggagcggtggaagctttaatctgtccggtagcggagatatgttcctcggaatgcctgggctcaatggagatagttacagcgcatcccaagtgcgctgcccctccccgctccaggtggagagcctccgacattccatgggtcccgggggctatggggacaatttgggcggaggacaaatgtactccccgcgcgagatgcgcgcaaacggcagctggcaggaagctgtaaccccaagcagcgtgacttctccaaccgaagggcctgggtctgtgcattcagacaccagcaattag

SEQ ID NO: 129714 - DNA, 1332 bp, Artificial Sequence
  Description of Artificial Sequence: Synthetic coding sequence
ggcgctgagcaaggtggcggcttgagggcacctccacagctgtggaccaacggctactggggcagaccccttcaggcaggcgccggtggactcggccttgtgtcaggcgagcctggtgggccaggagagcccccaggcggtggggatcctgggggcggcagcggcggcgttcccggcggccgaggtaaacaagatattggagatattctgcaacaaataatgacaataaccgatcaatcattggacgaagcacaggccaagaagcatgcccttaactgccatcgcatgaaacctgcactgttctccgtgctgtgcgagataaaggaaaagaccggactgagtatccgctcaagccaggaagaagaaccagtcgaccctcaactgatgaggttggacaacatgcttttggctgaaggcgtggctgggcctgaaaaaggtggcgggagcgccgctgccgcagcagcagctgccgcatctggcggcggcgttagcccagacaactcaatcgagcacagcgactatcgctcaaagctggctcagatacgacatatttaccacagcgagctagagaagtatgaacaggcatgcaatgagttcacaactcacgtcatgaacttattacgtgaacagtcccgcacaaggccagtggctccgaaggaaatggagaggatggtgagcattatccacagaaaattttcggctatacaaatgcagctcaagcagtctacatgcgaggcagtcatgattctgcgaagcaggtttctcgatgctcgtcggaagaggcgcaactttagcaagcaggccaccgaagtcctgaacgagtacttctactctcatttgagcaacccgtacccctctgaggaagctaaggaagagttagccaaaaagtgtggcatcacagtcagccaggtgtcgaattggttcggcaataagaggattagatacaaaaagaacatcggcaagttccaggaggaggcaaacatctacgctgtcaagactgccgtctctgtgactcaagggggacattccagaacaagcagcccaacaccgccgtcatctgcaggcagcggaggctcctttaatctgagcggatctggcgacatgttcctggggatgccaggattaaatggtgacagttacagtgcatcgcaagtggaatccctccgacactcaatgggcccggggggctatggcgacaacctgggaggagggcagatgtattctcctagggaaatgagagcaaacgggagttggcaggaggccgtgactcccagctccgtcacatcacccactgaaggaccagggtctgtccactcagatacgagtaactag

SEQ ID NO: 129715 - DNA, 1332 bp, Artificial Sequence
  Description of Artificial Sequence: Synthetic coding sequence
ggagctgaacaggggggcggcctgcgcgccccaccacagctgtggacaaatggctactgggggcgaccactccaagcgggggctggcggcttgggtttggtcagcggtgagcctggtggtccgggcgaacccccaggtgggggcgatcctgggggcggctctggaggcgtccccggggggagagggaagcaggatattggggacatcttgcagcaaataatgacgatcaccgatcagtccttagatgaggcacaggccaaaaaacacgctcttaattgccaccgaatgaagcctgcccttttcagcgtcctgtgcgaaattaaagagaaaacaggactgtcgattcgatcatcgcaggaggaagagcccgtagatccacaattgatgcggctcgataacatgctcctggcagagggggtggccggcccggaaaaaggagggggttcagctgcagccgctgctgctgctgccgcgtcggggggtggagtgagtccagataactcgatcgagcacagtgactaccgaagcaaattggcccagattaggcatatataccactcagagctggaaaagtacgagcaggcatgtaatgagttcactacacacgtgatgaatctcctgagagagcagtccagaacccggcctgtggctccaaaggagatggagaggatggtatctataatccaccgcaaattctctgcaattcagatgcagttgaagcagagtacttgcgaggccgtgatgattctgagaagtcgcttcctggacgcaaggagaaagaggaggaatttcagcaagcaagcaaccgaggtcttgaatgaatacttctattcgcatctgagcaatccctatccatctgaggaggctaaggaagaacttgccaagaaatgtggtatcactgtcagccaggtgtccaattggttcggcaataaacgcattcggtacaagaaaaatattgggaagtttcaagaggaggcaaacatatatgccgtgaagacagcggttagcgtcacacagggagggcatagtcggacaagttccccgacgccacccagcagtgctgggagcggcggctctttcaacctgtcgggcagcggcgacatgtttctgggcatgcctggcctgaatggagatagttactcagcaagtcaggtggaatccctgaggcactccatgggccctggcggctacggcgataacctgggaggcggacaaatgtacagccccagggaaatgagagccaatggaagttggcaagaggcagtgactccttcatccgtaacgagccccaccgagggacccggctcagtgcattccgatacttccaattag

SEQ ID NO: 129716 - DNA, 1056 bp, Artificial Sequence
  Description of Artificial Sequence: Synthetic coding sequence
atggacgaccagtcgaggatgcttcagactctggccggggtaaacttggcgggccacagcgtgcaaggaggcatggcgctgccaccaccgccgcacggtcacgagggggccgatggggacggccggaaacaggacattggcgacatcttacaccagattatgacgataacagaccaatcgctggatgaggctcaagcaaaaaagcacgccttgaattgtcatagaatgaagcccgcactgttcagcgttctatgtgaaattaaagagaaaacaggattgagcatcaggggggcccaggaagaagaccctcccgaccctcagctgatgagacttgacaacatgctgctggctgaaggggtaagcggacccgaaaagggaggaggctctgccgccgctgctgcagctgcggctgcgagcgggggcagctccgacaactctatagagcactccgattaccgtgctaaacttacccagatccggcaaatttaccatacagaactagagaagtacgagcaggcgtgcaatgagttcactactcacgtgatgaacctcctgagggagcagtctaggacacggcctatctctccgaaagaaatcgaacgtatggttggcataatccatagaaaattctcctccatccagatgcagctaaagcagagcacgtgtgaggcagtgatgattctgcgaagcagatttctggacgcgcgccggaagagaaggaatttttccaagcaggccactgaaatcctgaacgaatatttctactctcacttaagtaacccctatccatcagaggaagccaaggaggagctcgccaagaaatgtagcatcactgttagtcaagtttccaattggtttggcaataagcggatccggtataaaaagaacatcgggaagttccaggaggaggcaaacctatatgccgctaaaacggctgtgaccgctgcccacgctgtagccgccgccgtgcagaataaccagaccaatagccctacaacacctaatagcgggggataccccccctcctgctatcagtccgatggcagactgcagtag

SEQ ID NO: 129717 - DNA, 762 bp, Artificial Sequence
  Description of Artificial Sequence: Synthetic coding sequence
atgaacctcctcagagaacagtctaggaccagacccatttcacccaaagagatcgagcggatggtcggcatcatacacaggaagttcagctccatccaaatgcagctaaagcaatccacttgtgaagccgtgatgatccttcggtccaggttcctcgacgctaggcggaagcggaggaacttcagtaagcaggccacagaaattctgaacgaatatttctattcccacttaagcaatccatacccttccgaggaagctaaggaggaactagccaaaaagtgtagcattaccgttagccaggtcagtaattggtttggcaataaacgtatacggtataagaagaatattggcaaatttcaggaagaggccaacttgtacgcagccaaaacagccgtgaccgctgcgcacgccgttgcggccgctgtgcaaaataatcagaccaattctcctactactccgaactcaggaagcagcggcagcttcaacctgcctaactcaggggacatgttcatgaacatgcaatctttgaatggagactcataccaggggtcgcaggtcggcgccaatgttcagtctcaggtggatacattgcggcatgtgattaaccaaaccggtggatacagtgatggactgggagggaatagcctttattctccacataacttaaatgcgaacgggggctggcaagacgctacaaccccttcatccgtgacttcccctaccgagggccctgggagcgtgcacagcgataccagtaattag

SEQ ID NO: 129718 - DNA, 1368 bp, Artificial Sequence
  Description of Artificial Sequence: Synthetic coding sequence
atggacgatcagtcgcggatgctccagacccttgcaggcgtaaacctggcgggccatagcgtccaggggggcatggcccttccaccaccaccgcatgggcacgaaggcgcggacggggatgggagaaaacaggatatcggcgacatcttacatcagattatgactataacagatcagagtttagacgaggcccaggccaaaaagcatgcattaaattgtcaccggatgaaacctgccctgtttagcgtgttatgtgaaattaaggagaaaacaggactttcaatccgcggcgcacaagaggaggaccccccagatcctcagcttatgaggctggacaacatgctgctggcagagggagtgtctggcccagaaaaggggggtggaagtgcggccgctgcggccgcagccgcggcctcggggggaagtagcgacaattcgattgagcactcagactatagagcaaagctgacccaaattagacagatttaccatacagaactggagaaatacgagcaggcctgcaatgaatttaccactcatgtgatgaatctcctgcgtgagcagagccgcacccgccctatatctccaaaggaaattgagagaatggtgggcatcatccacagaaagttttcctcaatacagatgcagttgaaacagtctacctgtgaagctgtgatgatcctgagaagcaggtttttagacgctcgccgcaagagacgaaatttcagcaagcaggcgaccgagatactgaatgagtacttctacagccatctctcaaatccctacccaagtgaagaggccaaggaagagctcgctaagaagtgcagcatcacagtgtcacagagcctggtcaaagatccaaaggagcgcggcagcaaggggtccgatattcagcccacttccgtggtgtccaattggttcggcaacaagcgcatcaggtacaagaagaacataggtaagtttcaggaggaggcaaacctgtatgcggcaaagaccgcagtgactgctgctcatgcagtagcggcagccgttcagaataaccaaaccaacagccccactacccccaattcgggaagcagtggcagctttaatctcccaaattctggagacatgttcatgaatatgcagtctttgaacggggactcctatcagggatcccaagtgggcgccaatgttcagtcccaggttgatacactccgacacgtgatcaatcagacaggtggatacagcgacggattgggaggcaatagtctgtactccccacacaatctgaatgccaacggcggctggcaggatgctaccaccccaagttctgtgacatcgccaaccgaaggccccggaagcgtacattccgatacctccaattag

SEQ ID NO: 129719 - DNA, 1305 bp, Artificial Sequence
  Description of Artificial Sequence: Synthetic coding sequence
atggacgaccagtcccgaatgctgcagactctggcgggtgtaaatctcgccggtcatagtgttcagggaggcatggcgctgcctcctcccccccacggccacgagggagccgatggtgacggcaggaagcaggacatcggggatattctccaccagattatgaccatcactgaccaaagcctggacgaagctcaagccaagaaacacgctctcaattgccacagaatgaaacccgcactcttttcagtcctgtgcgagatcaaggagaagactggcctgtctattaggggggcgcaggaagaggatccacctgatccgcagttgatgcgattggacaatatgctcctggccgaaggcgttagcggccccgagaaagggggaggatccgctgctgcagctgctgccgccgctgccagtgggggaagcagtgataattcgatcgagcactctgattatcgagccaaactcacacagatacgtcagatctaccacacggagctggaaaaatatgagcaggcctgtaatgaatttacaacccatgttatgaatctcctgcgagagcagtctcggacacgacccatatcacctaaggagatcgagcgcatggttgggattattcatcgtaagttcagcagtattcaaatgcagttgaaacagtctacctgcgaagctgttatgatcctcaggtcacggttcctggacgcacgcagaaagcgacgcaacttcagtaaacaagccacagagatcctaaatgaatacttttacagccatttgagtaatccatacccctccgaggaggcaaaggaggagctcgccaagaagtgcagtatcacagtatctcaggtgtccaattggtttggcaataagagaatcaggtataaaaagaacatcggaaagtttcaggaagaggctaacctctacgcagccaaaacggccgtcaccgctgcccacgctgtagccgccgccgttcagaataaccagacgaattctcctactaccccaaatagtggcagttccgggagctttaaccttcccaacagtggtgatatgtttatgaacatgcagtccctcaatggcgactcctaccagggcagtcaggtgggcgcaaacgttcagtcccaggtcgatactctgaggcatgttattaaccagacaggcggctatagcgacggactggggggcaattccctctacagtccacacaatctgaacgctaatggcgggtggcaagacgcaacaactcccagctctgtgacctcccccacggaagggccaggatctgtgcacagtgatacttccaactag

SEQ ID NO: 129720 - DNA, 789 bp, Artificial Sequence
  Description of Artificial Sequence: Synthetic coding sequence
atgagggggctgagcatcagaggagcccaggaggaagatccacccgaccctcagctcatgagactcgataacatgctgttggcggaaggcgttagtggaccagagaaaggtggaggcagcgcggcagctgccgctgccgccgctgctagcggcggctcgtccgataattcgatcgagcattcagactaccgagctaagctcacacaaattcgccagatctatcacactgagttagaaaaatacgaacaggcctgcaacgagttcaccacacacgtgatgaacctgttgcgggagcaatcaagaacgcgcccaataagcccaaaggaaatcgagcggatggttggtattattcatcggaagtttagtagcattcagatgcaactgaaacagtcaacgtgcgaagctgtgatgatcctgaggtcacgcttcttggatgcacggaggaaaagaagaaacttctccaaacaggccacagaaatactgaatgagtatttctattcacacctgtcgaatccgtatccttcggaggaggccaaggaagaactggcaaagaagtgcagcatcacagtgtcccaggtgtcaaattggtttggcaacaaaagaatccgatataagaagaacataggcaaattccaggaggaggctaacctttacgccgcgaagaccgctgtcacagctgcccacgccgtcgcagcagcagtacagaacaatcagacaaactcccctacaacccccaactccggaggctacccgccctcatgttaccagtccgacggtagactccaatag

SEQ ID NO: 129721 - DNA, 1080 bp, Artificial Sequence
  Description of Artificial Sequence: Synthetic coding sequence
atgaaacctgccctgttctctgttctgtgtgagattaaagaaaagactgggctctccattcgcggagcacaagaagaggacccacctgatccacagcttatgagactggacaacatgttgctggctgaaggggtgagcgggcctgaaaagggcggcgggagcgctgccgcggctgccgctgctgccgctagcggcggctcatcggataatagcatcgaacacagtgactatcgcgcaaagctgacccagatcagacagatctatcacacagagttggaaaagtacgaacaggcatgcaatgagttcacaacacatgtgatgaacttgctgcgggagcagtcgaggacaaggccaatctcccccaaggagatcgaacggatggtgggcattattcaccgaaagtttagcagcatccagatgcagctgaagcaatcgacgtgtgaggcggtgatgatcctccgcagccggtttcttgatgctagacggaaaagaagaaatttctccaagcaagccacggaaatccttaatgagtacttctactctcatctgagcaatccatacccgagtgaggaggccaaggaggaactggctaaaaaatgctctataacagtgtcacaagtgagcaactggttcggcaacaaacgaattcgctacaagaaaaacatcggaaaatttcaggaggaggctaacctttacgccgccaagacagcagttacagcagcacacgctgtagccgccgcggtgcagaataatcagaccaatagtcccaccacacctaattctggctcatctgggagcttcaatctgcccaactcaggtgacatgtttatgaatatgcagtcactgaatggagatagctatcaagggtctcaggttggagcgaatgtgcagagccaagtcgacacacttaggcatgtgatcaaccagacaggtggctactccgacgggctcggggggaactctctgtactccccgcacaacctgaatgcaaacggtggctggcaggatgccactactccgtcttctgtaacaagcccgacagagggaccaggttctgttcatagcgatacaagcaactag

SEQ ID NO: 129722 - DNA, 1530 bp, Artificial Sequence
  Description of Artificial Sequence: Synthetic coding sequence
atggagaggaggcgattgtgggggagtattcagagcaggtacatctcaatgtcagtctggacatcccccaggcggcttgtggaactggcagggcagagcctgttgaaggatgaggctctcgcaatcgccgccctggaactcctgcctagagagttattccctccactattcatggcggcatttgatggtcggcattctcagacgctgaaagcaatggtgcaagcctggcccttcacatgtctcccgcttggcgttctaatgaaaggccagcatctacatcttgagacatttaaagctgtattggatggactggacgttcttctggcccaagaagttagaccccgtcgatggaagctgcaggttcttgacctccggaaaaactcacatcaggacttctggaccgtgtggagtggtaatcgggcatctctctacagcttccccgaaccagaagctgcacagccgatgaccaagaagagaaaggtcgacggcctgagcacagaggctgaacagccctttattcccgttgaagtgcttgtggatctattcctcaaggagggtgcctgcgatgagctctttagttacctcattgaaaaggtgaagcggaagaagaacgtgttgcgtctttgctgtaagaaattgaaaatattcgccatgcccatgcaagatattaagatgatactgaagatggtgcagcttgactctattgaggatctggaggtgacttgcacatggaagcttcccactctggccaagtttagcccttatttgggccagatgatcaatctgcgccgtttgctgttaagtcatatccatgctagttcctacatcagtcccgagaaagaggagcaatacattgcacagtttacttcccagtttctctccctgcagtgcctacaagctctgtacgtcgacagcctgttctttctacgaggacgtctcgaccagctgctacgacatgtaatgaatcccctcgagaccttgagcattacaaactgtcgcttgtctgagggcgatgtgatgcacctctcccagtctccttccgtctcgcagctgagcgtgttgagtttaagcggcgtcatgctaacagatgtgtcaccagaacctcttcaggccttgcttgagagagcatccgcaactcttcaggacctcgtgttcgacgaatgcggaatcacagatgatcaattattggccctgttgcctagcctgtcccattgtagccagctgactaccctttccttttatgggaattctatcagcatatccgccttacagagtttattgcagcacctaatcgggttgtcgaacctgactcatgtcctttaccctgtgcctctcgagtcttatgaagatatccacggtacccttcacctggagcgcctcgcttatctgcacgcccgcttacgcgaactgttatgtgagctgggacgtccctcaatggtttggttgagtgctaatccctgcccccactgtggggataggacattctacgatcctgaaccaattctgtgtccctgcttcatgccaaactag

SEQ ID NO: 129723 - DNA, 1530 bp, Artificial Sequence
  Description of Artificial Sequence: Synthetic coding sequence
atggagagacgtcggctgtgggggagtatccaatctcgatacattagtatgagcgtatggacatcacctcgccgactggtcgagctggcggggcaatcactgctgaaggacgaagccctcgctatagctgccttggaactcttgccccgcgaactgtttccacctctgttcatggccgccttcgatggccgacattctcagacactgaaagcaatggttcaggcatggccctttacttgcctaccactgggcgtcttgatgaagggtcagcatctccatctggaaaccttcaaggcagtgctggacggactcgacgttctgctggcacaagaagtccggccccgcaggtggaaactccaagtcctggatctacgtaagaactcacaccaggatttttggaccgtgtggtcaggtaaccgagccagcctgtactcatttcctgaaccggaggccgctcagcctatgactaaaaaaaggaaggtagatgggctgagtactgaggcagagcagccgtttatacctgtggaagtgctagtcgacctattcctaaaggagggagcctgtgatgaactcttctcttatctcatcgaaaaggtgaagcgaaaaaaaaacgtgctcaggctatgctgtaagaaattgaaaatctttgctatgcctatgcaggatattaaaatgatcctgaaaatggtgcagttggactccatagaggacctggaggtgacctgcacctggaagctccccactcttgctaaattttcgccttatctgggacagatgattaacctgagaagactgctgttgtcccacatccacgcctcttcttacatttcacccgaaaaagaggagcagtacatcgcccaatttaccagccaatttctcagcttacagtgccttcaggctctgtacgtcgactctttattcttcctgagggggaggttggaccaactgctccggcacgtcatgaatccgcttgagactctgtccattactaattgtcgcttgagcgaaggagatgttatgcacctgagtcaatcccctagtgtgagccagctcagtgtcctatcactgtcaggagttatgcttaccgatgtgtcccctgagcctcttcaagctctcctcgaaagagcaagcgcgactctccaagatttagtattcgacgagtgtggcattacggatgatcagttgctggccctcctgcccagtctgtctcactgtagccagctgacaacgcttagtttctacggaaacagtattagtattagtgctctccagtcactcttgcagcacctgatcgggctctccaatctcactcacgtgctctatccagtgcccctggagtcttatgaagacattcacggaacattacacttggagaggctggcatacctgcatgccaggcttcgagagctcctatgtgagcttgggcggccaagcatggtctggctcagtgccaacccgtgccctcactgcggggataggacattctacgatccggagcctattttgtgtccatgcttcatgcccaattag

SEQ ID NO: 129724 - DNA, 1530 bp, Artificial Sequence
  Description of Artificial Sequence: Synthetic coding sequence
atggaacgcaggcgtttgtggggcagcatccagtcccggtatattagtatgagcgtgtggacgtcgccaagaaggcttgtggaactagccgggcagtcactcctgaaggatgaagcgcttgctatagccgcacttgaactgttaccgcgagaactgttccccccgctcttcatggcggcttttgacgggaggcatagtcagacactgaaggctatggtccaagcctggccatttacgtgccttcctctgggagtgctgatgaaaggacagcacttacatctcgaaaccttcaaggccgtgttggacggccttgacgtgcttctggcacaggaagtcagacctaggcgatggaaactccaagttttggatctaagaaaaaatagccatcaggatttttggacagtctggtccggcaatcgtgcctccctttactcattcccagaacccgaagcagctcagcccatgacgaagaagagaaaagtcgatgggctttccacagaagcagagcagcctttcattccagtcgaggtgctggtcgatctctttctgaaagagggggcttgtgacgagttgttctcttatctgatcgagaaagtgaagagaaaaaaaaatgttctgcggctgtgctgtaaaaagctcaagattttcgcaatgccaatgcaggacatcaaaatgattcttaaaatggtccagctagattctattgaggacctggaagtcacttgcacatggaaattgccgaccctggcgaagttttctccctatctggggcaaatgattaatctccggagattgttgctgagccatattcatgcatccagctatatatccccagagaaagaagaacagtacattgcgcagttcactagtcaattcctttctcttcaatgtttgcaagctctttatgtggactcccttttcttcctccgaggccggctggaccagctgctgcgacacgtgatgaaccccctcgagaccttgtcaatcaccaactgtagactgagcgagggagatgtgatgcacctatcccaatcaccatcagtcagccagctgagcgtcctgagtttatcaggcgtcatgcttacggacgtttccccggaacccctgcaagccctgctcgaacgggcatcggcaactttacaggatcttgtctttgatgagtgcggcatcaccgatgatcaacttttggccttgctgccaagcctgtcccactgctctcaattgaccacattgagtttctacggcaacagtattagcatcagtgctcttcaatcactactccagcacttgatcggcttatctaacctgacccacgtgttataccccgttccgctcgagtcttacgaggatatacacggaactttgcacctcgagcgactggcgtacttacacgctagactgagggagctgttatgtgagctcggaagaccgtcaatggtttggctcagcgccaacccatgtcctcactgtggagaccgcaccttctacgaccctgagccgattctttgtccttgttttatgcctaactag

SEQ ID NO: 129725 - DNA, 261 bp, Artificial Sequence
  Description of Artificial Sequence: Synthetic coding sequence
atggagagaagaagactatgggggagtatccagtccaggtatataagtatgtcagtatggactagtcctcggaggctggtcgagcttgctggacagagcctcctgaaagacgaagcgctggctattgccgcgctggagctgttgccgagggagctgttcccccctctttttatggcggcctttgacggcaggcactcacagaccctgaaggccatggtccaggcatggccattcacatgtttgcctttaggagtgttgtag

SEQ ID NO: 129726 - DNA, 1530 bp, Artificial Sequence
  Description of Artificial Sequence: Synthetic coding sequence
atggagcgcaggcgtctgtggggttcaatacagtcccgctatatttcaatgtcagtatggacatcacctcggaggctagtagaactggccggacagagtctgctcaaggatgaagccctggccatagctgcactggagttgctccctagagaactttttccacctttgttcatggctgcctttgatggacgccacagccagacgctgaaggcaatggtgcaggcctggcctttcacatgtttgcctcttggggttttgatgaagggccaacacttgcacctggagaccttcaaggcggtgttggatgggctcgatgtactgctggctcaggaggtgcgtcctaggagatggaagctccaggtactggacctcagaaagaattcgcatcaggacttttggacagtatggagcggaaacagagcaagcctgtatagttttcctgagccagaagccgcccagccgatgacgaaaaagcgaaaggtggatggtctgtccaccgaagccgaacagcctttcatcccggtggaagtcctagtcgacctgttcctgaaggaaggtgcatgcgacgagctgttcagttatctcatcgagaaggttaaaaggaagaagaatgtgctgagactctgttgcaagaaactgaagatcttcgccatgcccatgcaggatatcaagatgattctaaagatggtgcaactcgattcaatcgaagacctggaggttacatgcacctggaaactgcctacattagcgaaattctctccctatctcggccagatgattaacctgcgccgccttctgctttctcatattcacgcttccagctacatcagtcccgagaaggaggaacagtacatcgcacagtttacgtcccagttcttatcactccagtgcttgcaggcgttgtacgtagacagtctgtttttcctacgggggaggctggaccaattacttaggcacgtgatgaatcctttggaaaccttaagcatcacaaactgtcggctaagcgagggggacgttatgcacttgtctcagtcaccttccgtgagtcagctgtccgtcttatcactaagcggcgttatgctgactgatgtttcgcctgagcccctccaggctttgttggaacgtgcttcagccaccctccaggatctcgttttcgatgaatgcgggattaccgatgaccaactcttggcccttctcccgtctttgagtcactgctctcagttgacgacgttgagcttctacggcaacagcattagtatctccgctctgcagtccctgttacaacatctcattggcctgagcaatctcacacacgtattgtaccctgtgcccctcgagtcgtatgaagacattcacgggactctgcacctggagcggttggcatatctccacgcgagactgcgcgagctgctgtgtgaattaggcaggccttctatggtttggttaagcgccaacccgtgtcctcactgtggagaccgtacgttctacgaccccgagccaatactgtgtccatgttttatgcctaattag

SEQ ID NO: 129727 - DNA, 348 bp, Artificial Sequence
  Description of Artificial Sequence: Synthetic coding sequence
atggagagaagacgtctatgggggagcattcagtcgcggtatatttccatgagtgtgtggacctccccaaggcgtctagtcgaactcgccggccaatcactgctgaaggacgaggccctcgccatcgccgctctggagttgctcccgcgcgagctgttccctcctcttttcatggccgccttcgatggacgccactcccagacccttaaggctatggtgcaggcctggcctttcacgtgcctccccttgggtgtcttgatgaaaggccaacatctccacttggagacctttaaagcagttttggacggattggatgtactcctggcccaggaagtgcggccacggtag

SEQ ID NO: 129728 - DNA, 459 bp, Artificial Sequence
  Description of Artificial Sequence: Synthetic coding sequence
atggaaagaaggcgtctttggggtagcattcagtcgcgttatataagcatgtccgtgtggacatcgcccagaagactagtggagctggccggtcagagcttactcaaggacgaagccctcgctattgctgctctggagctgcttccgcgggagctttttcctcctcttttcatggcggcctttgacgggcggcattctcagaccctcaaagcaatggtgcaggcgtggccgttcacctgcctcccactgggtgtactgatgaagggacaacaccttcatctcgagacgtttaaggcggtcctggacgggctcgatgtgttgctggcacaagaagtaaggccaagacggtggaagctccaggtgctggacttgcggaaaaacagccaccaggatttctggacggtgtggtccggaaaccgtgcctccctctatagcttccccgaacccgaagccgcttag

SEQ ID NO: 129729 - DNA, 1482 bp, Artificial Sequence
  Description of Artificial Sequence: Synthetic coding sequence
atgagcgtctggactagccctagaaggctcgtagagctggccgggcaatcactgttgaaggatgaggcgttggccattgccgcactggagctcctgcccagggagcttttcccccctctatttatggctgctttcgacggaaggcactcccagaccctcaaagctatggtgcaagcttggcctttcacttgtctgcccctcggcgtgctgatgaagggtcagcacttacacttagaaacatttaaagccgtgctcgacggtctggacgtgctcctcgcacaggaggtgagaccacgtagatggaagctgcaggtactggacctgcggaaaaatagtcaccaggacttctggaccgtctggtcgggaaaccgggcgtcactgtattcctttcctgagcctgaggcagctcaacccatgaccaagaagaggaaggtagatggactctcgactgaagctgagcaaccatttattcctgttgaagtgctggtcgacctcttcttgaaggagggagcctgtgatgagctgttctcctacctgatagagaaagttaaacggaagaaaaacgttttgcgtctgtgctgcaagaagctcaaaatcttcgccatgcccatgcaggacatcaagatgatcctgaagatggtgcagcttgactcgatcgaggacctggaggtcacctgtacttggaagctgccaacccttgcaaagttttccccgtatctgggccagatgatcaacctgagaagactcttgttgtctcacatccatgcatccagctatattagccccgaaaaggaagaacagtacattgctcagttcacaagccagtttctctcactgcaatgccttcaagccctgtatgtggattcattgttttttctgagggggcggttggaccaactcttacgacacgtcatgaaccctttagaaaccctgtccatcactaactgcagactctcagaaggtgacgtgatgcacctcagtcagagcccatcagtgagtcagctgtctgtactatctctgagcggggtcatgttgaccgacgtgtccccagagcccttgcaggctctgctggaacgcgcttcagctaccctgcaggatctggtgtttgatgaatgtgggatcaccgacgatcagctgttggccttgctcccctccctgagccattgctctcaactcacgaccttaagtttctatggcaactctatcagcatttctgccttacagtccctactccagcacctgatagggctcagcaatctaacccacgtgctgtatcctgtaccgctggagtcctacgaggacatccatgggaccctgcacctggaaaggctggcatacctgcatgcgcggctcagagagctcttatgtgagttaggtcggccaagcatggtgtggctttctgccaatccctgcccccactgtggtgatcgcacgttttacgaccccgagccaattctgtgtccgtgctttatgcccaattag

SEQ ID NO: 129730 - DNA, 606 bp, Artificial Sequence
  Description of Artificial Sequence: Synthetic coding sequence
atggagcgcaggcgactctggggatcaattcaaagcaggtatatttcaatgagcgtgtggacttctcctagacgcctcgtggagttggcgggccagtccctactgaaggatgaggcgttggccatcgccgccctggaactcctgccccgggaactgttcccaccgctatttatggccgccttcgatgggagacattcccaaacccttaaggctatggtgcaggcatggccatttacttgcctccccctcggggtgctcatgaagggacaacacctgcacctggagacctttaaagcggtcttggatggcctcgacgtgctcctggcccaagaagtgcgcccccgtcgctggaaactgcaggtgctcgatctgagaaagaactcccatcaggacttttggacagtgtggtccggtaaccgcgcaagcctatactcttttccagagcctgaggccgcacaacctatgacaaaaaaaaggaaggttgacggactgagcaccgaggctgaacagccctttatcccagtcgaggttctcgtcgacctgttcctgaaagagggcgcttgtgatgaactgttctcatatttaattgagaaggtgaaaagatag

SEQ ID NO: 129731 - DNA, 1482 bp, Artificial Sequence
  Description of Artificial Sequence: Synthetic coding sequence
atgtccgtctggactagcccgaggcgcctggtggaactcgccgggcagtcgctgttgaaggacgaggccctggcaatcgccgccttagaactgcttccccgagagctctttccgcctctgttcatggccgctttcgatggccggcacagccagactctgaaggcaatggtgcaggcatggccattcacctgtctgcccctcggtgtcctcatgaaggggcagcatctgcacctggagacctttaaagccgtcctggatggcttagatgttctccttgcgcaggaagttaggccgaggcggtggaaactgcaggtcctggacctgaggaaaaatagccaccaggacttctggacggtgtggtcgggtaacagagcaagcctatactcgttcccagagccagaggctgcccagccaatgacgaaaaaaaggaaggtagacggcctgtccaccgaggccgagcagccatttattcctgtcgaggtgctggttgacctatttctgaaagagggggcctgcgatgagcttttcagctatctcattgagaaggtcaagaggaagaagaacgttctgcgactgtgttgtaagaaattgaaaatttttgctatgccaatgcaggacataaagatgattcttaagatggtgcagctggattcaattgaggacctggaggtgacatgcacctggaagctgcccacattggcaaaattttctccttatctgggccaaatgattaatcttcggcgtctgctgcttagtcacatacatgcatccagttacatcagcccagaaaaggaggagcagtacatcgctcagtttacatctcagtttttgtcactgcagtgcctgcaggctctttatgtcgactccctgttcttcttaaggggccgcctcgatcagctcctgcggcacgtgatgaatcctttggagactctgtccataaccaattgtagattgagcgagggcgacgtgatgcacctctcacagtcgcctagtgtctcccagctatccgtgctctctcttagcggagttatgttgacagatgtgtcacccgagccactccaggctcttcttgaaagggccagcgcaactctgcaagatctggtgtttgacgaatgtggtattaccgacgaccagctgttagctctgctaccatctctgtctcactgcagccagcttactacactgtccttttacgggaatagcatctcaatttctgctctgcagtcactgttgcaacacttgataggactgtccaatttgactcacgtgctgtatcctgttcctctcgagagttacgaggacatccatggaacattgcaccttgagcggttagcgtacctccacgccagactacgcgagctgctgtgtgagctcgggaggccaagcatggtgtggctttcagcaaatccttgtccccactgtggggatcggactttttatgatccagagcccattctgtgcccctgttttatgccaaattag

SEQ ID NO: 129732 - DNA, 1530 bp, Artificial Sequence
  Description of Artificial Sequence: Synthetic coding sequence
atggagcggcgcaggctgtggggctccattcagtctcggtacattagtatgagtgtgtggacgagtccccgaagactcgtcgagctcgctggccagtcgctcctcaaggacgaagctctggcgatagcagccctcgagctcttgccgcgcgagctgtttcctcccctttttatggctgcattcgacggccgtcatagccagaccctgaaggcaatggtgcaggcatggccttttacgtgcttgccattgggcgttctaatgaaggggcaacacctgcatctggaaacattcaaagcggtgctggatgggctcgatgttctgcttgcacaggaggtgcggccgcggcggtggaaactccaagttttagatcttcgcaaaaactcacaccaggacttttggactgtgtggtccggaaatcgcgctagtctgtacagcttccctgagcctgaggctgcccagccaatgaccaagaagagaaaggtcgatgggctgtctacggaggccgaacagccatttatccctgttgaagttttggttgatctgttccttaaggagggcgcttgtgacgagctgtttagttatctgatagaaaaggtgaaaaggaaaaagaacgtgctaagactgtgttgtaaaaagctgaaaatttttgccatgcctatgcaagacattaaaatgatcctcaaaatggtgcagctggattctattgaagatctggaggtcacatgtacgtggaagctccccacactggcaaagtttagcccgtatctgggccagatgataaacctcaggagattgcttctctcgcatatacatgcctcctcgtatattagcccagaaaaggaggaacagtatatagcacagttcactagccagttcctctctctccagtgccttcaggctctgtacgtggatagtttattttttttgcgcggccgcctcgaccagttgctgaggcacgtcatgaaccccctagagaccctgagtataacaaattgccggctttctgagggagatgttatgcacctcagtcagtccccatcggtgtcacaactgtcggtcctatcactaagcggcgtcatgctgaccgatgtatccccggaaccgctccaggcgttgctggagcgagcaagcgcgacattgcaagatctggtgtttgacgaatgtggtatcactgacgaccagctcctggcactgctgccctcactttctcactgctctcagctgactacactgagcttctacggcaacagcatatctatctcagccctgcagagcttattgcagcatcttattgggctctccaacctgacccatgtgctgtaccctgttccattagagtcctatgaggacatccacgggaccttgcacctcgagcggcttgcctaccttcacgcccgattgagagaattactgtgcgagttgggtaggcctagcatggtgtggttgtctgccaatccgtgcccccactgtggagacaggacgttctacgatcctgaacccatcctgtgtccctgttttatgccaaactag

SEQ ID NO: 129733 - DNA, 369 bp, Artificial Sequence
  Description of Artificial Sequence: Synthetic coding sequence
atggccgcccccgtggacctggaactgaagaaagctttcacagagctgcaagccaaggtgatagacacccaacagaaagtgaagcttgcagatatccagatagaacagctgaatagaacgaagaagcacgcgcacctcaccgacaccgagatcatgaccctcgtcgacgaaacaaacatgtacgaaggcgtggggaggatgttcattcttcagtcaaaggaggccatccattctcagctgctggagaagcagaagatcgccgaagagaagatcaaggaactcgaacagaagaaatcctatcttgagagatctgtgaaagaagccgaagacaacatccgtgagatgctcatggcacgcagagcgcaatag

SEQ ID NO: 129734 - DNA, 465 bp, Artificial Sequence
  Description of Artificial Sequence: Synthetic coding sequence
atggcggaaaacagcggacgcgccggcaagtcttcaggctctggtgctgggaaaggcgccgtctctgccgagcaggtcattgcgggtttcaatcgcctcaggcaggagcaacgggggttagcctctaaggcagccgaactcgagatggagctgaatgaacactctcttgtgatcgatacccttaaggaggtcgatgaaacacggaaatgctatcgaatggtgggcggagtcctggtggagcgaactgtcaaagaagttcttccagctttggagaataataaggaacagatacagaagatcatcgagaccctgactcagcagctgcaagccaaaggaaaggagctcaacgagttccgagaaaaacataatataaggctcatgggggaggacgagaagccggccgccaaagagaatagtgagggagctggggccaaggcctccagcgctggcgtattagtgtcatag

SEQ ID NO: 129735 - DNA, 405 bp, Artificial Sequence
  Description of Artificial Sequence: Synthetic coding sequence
atggccgccacaatgaaaaaggcagctgcagaagatgtgaatgtcacattcgaagaccagcaaaagatcaataaattcgcgcgcaatacatcacggatcaccgaattaaaagaggaaatcgaggttaagaagaagcaattgcagaaccttgaagatgcatgcgacgatatcatgctggccgatgacgactgccttatgataccgtaccagattggcgatgtctttatcagccacagtcaggaggagacacaggagatgctggaggaggcaaaaaaaaacctccaggaagaaatcgacgcattagagagtcgggtggagtccattcagagggttctcgctgatttaaaagtgcaactgtacgctaagttcggtagtaacatcaatctggaggctgacgagagttag

SEQ ID NO: 129736 - DNA, 465 bp, Artificial Sequence
  Description of Artificial Sequence: Synthetic coding sequence
atggcacagagtatcaatataactgagttgaatctacctcagctggaaatgttgaagaaccagttggatcaggaagtggagtttcttagcacttccattgcccagctcaaagtcgtgcagacaaaatacgttgaggccaaagattgcctgaacgttctcaacaagtccaacgagggaaaggagctcttggtgcctttgacatcttcaatgtacgttcccgggaaactgcacgacgtggaacacgtactcatcgacgtgggaaccggttactatgtcgagaagacggcggaggatgcgaaggatttttttaagcgaaaaattgacttcctgaccaagcaaatggaaaagatacagcccgcacttcaggagaaacacgctatgaagcaggccgtcatggaaatgatgtcccagaagattcagcagctgacagcgctgggcgctgcccaggctaccgctaaagcgtag

SEQ ID NO: 129737 - DNA, 330 bp, Artificial Sequence
  Description of Artificial Sequence: Synthetic coding sequence
atggctcagagcatcaatattacagagcttaatttaccccagctggaaatgttgaagaaccagcttgaccagatgtatgtgcccggtaaactccacgatgtggaacatgtgttgattgacgtgggcacagggtactatgtggagaagactgcagaggatgctaaagacttctttaagaggaaaatagacttcctgacaaagcaaatggaaaaaattcagccagctttgcaggagaagcacgccatgaagcaggctgtaatggagatgatgtcacagaaaattcaacagttgaccgccctgggtgctgctcaggctaccgctaaggcctag

SEQ ID NO: 129738 - DNA, 465 bp, Artificial Sequence
  Description of Artificial Sequence: Synthetic coding sequence
atggcccagagcattaacatcaccgagcttaacctcccgcagctggagatgttgaagaaccagctggatcaggaggtcgagttcctctccacgagcattgcacaactgaaggtcgtgcagacgaaatacgttgaggccaaggactgtctcaatgtcctgaacaagagcaacgaaggaaaagaactgttggtgcctctgactagctccatgtacgtgcctgggaagctccacgacgtggagcacgtgctcattgacgttggtacaggctattatgtggagaaaacagctgaggatgcaaaggactttttcaagcgaaagatagatttcctaacgaagcagatggaaaagatccagcccgctctccaggagaagcacgccatgaagcaggccgtcatggagatgatgtcgcaaaaaatccagcaactcactgcactgggagcggcgcaagctactgcgaaggcctag

SEQ ID NO: 129739 - DNA, 1281 bp, Artificial Sequence
  Description of Artificial Sequence: Synthetic coding sequence
atgggcacactcagtgcacctccctgcacccagaggatcaaatggaagggtctgcttctaaccgcctcattacttaacttttggaacctcccaaccacagcacaggttactatagaagccgagccaactaaggtcagtgagggaaaggacgtcctgctgttagttcacaaccttccccaaaatctgacagggtatatctggtacaaagggcagatgcgtgatctctaccactacatcaccagctacgttgtagatggcgagatcatcatttatggcccggcatattcaggaagggagaccgcttactcgaatgccagtctcctgatccaaaacgtgaccagagaggacgccgggagctacacactccacattatcaaaggagacgatgggaccaggggggtgaccggacggtttactttcaccttacatctcgaaacccccaagccttccatatcttcatctaatttaaacccacgcgaaactatggaggccgtaagtctgacttgcgaccccgagacgcctgatgcctcttacctctggtggatgaacggacaatctctccccatgacccactctttgaagctgtctgagaccaatagaactctcttcctgttgggcgtaacaaaatatactgccggaccctacgaatgcgaaattaggaatccagtgagtgcttcccgttctgatccggtgaccttgaacttattgcccaaacttccgaaaccttacatcacgattaacaacctgaaccctagagagaataaggatgtactgaacttcacatgtgaaccgaaaagtgaaaactatacttacatctggtggcttaatggacagtcactgcctgtcagtccccgcgtcaaaagaccaattgagaatcgaatcttaattctccccagtgtgactagaaacgagacgggtccctaccaatgcgagatccgggatagatacggcggtatcagaagcgaccctgttactttaaacgttctgtacgggccggacctacctcggatctatcccagctttacatattatcgctctggagaggtactctatctgtcctgttctgccgattccaaccccccagctcaatattcgtggaccatcaatgagaagttccagctgccagggcagaagctgttcattaggcatataacaacaaagcacagcgggctgtatgtttgctcggtacgcaatagcgccacaggcaaggaatcttctaagtctatgacagtggaagtttctggcaaatggattcctgcctccctggccatcggcttttag

SEQ ID NO: 129740 - DNA, 432 bp, Artificial Sequence
  Description of Artificial Sequence: Synthetic coding sequence
atggggacacttagcgcgccaccctgtacccagcggatcaaatggaagggactccttcttactgcgtccctgcttaacttttggaatctgcctactaccgctcaagtcaccatcgaggctgaaccgactaaagtttcggagggaaaggatgtcttgttactagtacataatttaccacagaacctcactggatatatttggtataagggacaaatgcgcgacctctatcattatattactagttatgtcgtggacggggaaattataatatacggaccggcctattcgggcagagagactgcttatagtaatgctagccttttgatacagaacgtcacccgcgaggatgccggaagttataccctccatatcatcaagggggacgatggtaccagaggggtaacgggcaggtttaccttcactctgcattag

SEQ ID NO: 129741 - DNA, 1287 bp, Artificial Sequence
  Description of Artificial Sequence: Synthetic coding sequence
atgggaaccctgagcgcgccaccttgtactcaaaggattaaatggaaaggtttattgctgaccgcatccctgctcaatttctggaacctaccaaccaccgcacaggtcactatcgaagctgagcccacaaaggtttctgagggcaaggacgtgctcctgctggtgcacaacctccctcagaatctgacaggatatatctggtacaagggccagatgagagatctttatcactatattaccagttatgtggtggatggtgagattataatctatggtccggcctattcaggccgggagaccgcatactccaacgcgtcattgttgatccagaatgttacaagggaagacgccggcagttacaccttacacatcatcaaaggcgatgacggcaccagaggggtgaccggcaggtttaccttcacgctccacttggagacccccaagccatctatctcatcgtctaacctgaatcctcgagagactatggaagccgttagtttaacttgcgatcctgaaacacccgacgctagctacctttggtggatgaacgggcagagcctgccgatgacgcattccctgaagctcagtgaaacaaaccgaaccctgtttttactgggagtcaccaaatacactgctgggccatatgaatgtgagattagaaaccccgtgtcagcttcacgttcagatccggtgacgttgaatttactgcctaagctgccaaagccatatattaccatcaataacttgaaccctagggagaataaggatgttctgaattttacctgcgagcccaaatcagaaaactacacatatatctggtggcttaatggacagagtctccccgtgtctcctcgtgtgaaaaggcccatcgaaaatcgaattctgatcctgccatccgttactcgaaatgagactgggccttaccagtgcgagatcagagatcgttatggaggaatccgttctgaccctgtcaccctgaatgtgctgtacggaccagacttacctaggatctacccatctttcacgtattaccggtccggtgaagtcctctacctgagctgcagcgcagattcaaatccaccagcccagtacagctggactattaacgaaaaattccaactgcccggccaaaagctattcattaggcatattaccactaagcatagcgggttgtatgtgtgtagtgtgcggaacagtgccaccggtaaagagtcatccaagtccatgaccgtcgaagtgagtgcatattcctcctcaattaactatactagtggaaataggaattag

SEQ ID NO: 129742 - DNA, 1260 bp, Artificial Sequence
  Description of Artificial Sequence: Synthetic coding sequence
atgggcaccttgagtgctcccccttgtacacagagaatcaaatggaagggcctcctgcttacagctagtctgcttaacttttggaatctccccaccacggcacaggtgaccattgaggccgagccgacaaaggtgagtgaaggtaaggacgtcctgctgctggtgcacaatttgccccagaatctcactggatacatatggtacaagggacaaatgagggatctgtaccactacataacctcctacgttgtcgatggggaaataattatttatggtcctgcctactccgggagggagacagcctattccaatgcttccctgcttatccaaaacgtgacaagggaagatgccggaagctacacactccacatcatcaagggtgacgacggtactcgcggagttactggcagattcacatttacgctgcacctggaaacaccgaaaccctcaattagcagttccaatctgaaccctagagagacaatggaggctgtgagtctcacttgtgacccagaaacgcctgacgccagctacctctggtggatgaacggtcaatctcttccaatgactcactcactgaagctgtctgagaccaatcggaccctctttttgcttggagtcactaaatacaccgccggaccctatgagtgtgagatccgtaaccctgtgagtgcttcccgctctgacccagtgactttaaacctgttgcccaaattgcctaaaccctacattactataaacaacttgaatccacgcgagaacaaagatgtcctcaactttacctgcgaaccaaagagtgagaactacacttatatctggtggctgaacgggcagagcttgccagtgtccccacgtgttaagcgacctatcgagaaccggattttgattctccctagtgtaactagaaatgagactggcccctaccagtgcgaaattagggatcgctacggcggcatccggtctgatcccgtgactctgaatgttctatatggtcccgaccttcctagaatttacccaagcttcacatattaccggtcaggtgaagtgctttatttaagctgttctgccgattccaacccacccgcccaatattcttggaccatcaatgaaaagttccagttgcccgggcagaaactgttcatccgtcatataaccacgaagcacagcgggttatatgtctgttccgtgcgtaattcagcaacagggaaagagtcttccaaaagcatgaccgtggaagtatcagattggacagtgccctag

SEQ ID NO: 129743 - DNA, 1254 bp, Artificial Sequence
  Description of Artificial Sequence: Synthetic coding sequence
atggggacgctttctgccccaccttgcacacaacgtatcaagtggaaggggctgctgcttacagcatccctactaaacttctggaacctccccacaaccgcacaggttacaattgaagctgagccgacaaaggtgtcggagggtaaagacgtgctcctcctggtgcataacctgccacagaatttgaccggatatatttggtacaagggacagatgagggacctctaccactatatcacctcctatgtcgtcgatggagaaatcattatatacggccccgcctactcagggcgggagacagcctattctaacgcgtccttgcttatccagaatgtaacccgagaggatgccgggtcatataccttgcatattattaaaggggacgacggaaccagaggagtaaccgggcggttcactttcaccttgcacctggagactcctaagcccagcatttcatcctctaatcttaatcctagagaaacgatggaagccgtctctctaacctgcgatcctgagactcctgacgcaagctacctctggtggatgaacggccagtcactgccaatgacccacagtctgaaattatctgaaaccaacaggacactgttcctcctcggtgtaactaaatacacagccgggccttacgagtgcgagattcggaatccagtttccgcctccagatcagacccagtgactctcaacctcctgcccaagctgccaaaaccatacatcaccatcaacaacctgaatcccagagagaacaaagacgtgctgaattttacctgcgagcccaagtcagagaactacacatatatttggtggctaaacggccaaagcctgccggttagccctcgcgttaagagacccattgagaatcgaatactcattctgccttcagttacacggaacgagacaggcccttaccagtgtgagatccgtgaccgctacggcggcatcagatcagacccagtgactctgaatgtgttatacgggcccgatctgccccggatctacccatcgtttacatattatcgctccggcgaagtgctgtacctcagctgctccgctgatagcaacccaccggcccagtactcttggactatcaatgagaaatttcagctgcctggtcagaagctatttatccggcacattacgactaaacacagcgggctgtatgtgtgcagcgtgcggaatagtgcaacaggtaaagaatctagcaagagtatgaccgtggaggtttcagaggcactctag

SEQ ID NO: 129744 - DNA, 642 bp, Artificial Sequence
  Description of Artificial Sequence: Synthetic coding sequence
atgggccccctgtccgcccccccttgtaccgaacacatcaagtggaagggcctgctattgacagtggaaacccccaaacctagcatctcttctagtaacctgaaccccagggaagctatggagacagtcattcttacttgcaaccctgaaacacctgacgctagctacctttggtggatgaacggccagagcttacccatgacgcaccggatgcagctgagcgaaacaaaccggacactgttcctgttcggcgttactaagtatacagcaggaccctatgaatgcgaaatttggaactctggttctgccagccggagcgatcccgtcacacttaacctgctgcatgggcccgacttgccacgtatctttccctctgtcacttcatattatagcggcgagaacctcgaccttagttgctttgccaattctaatccacccgcacagtactcctggactatcaatggcaaatttcagctgagcgggcagaagttgttcataccccagatcactcctaaacacaatgggctttacgcctgtagtgcacggaactctgccacaggcgaggaatcttctacctctctgaccattagggtgatagcccctcctggactgggaacttttgcctttaacaacccaacctag

SEQ ID NO: 129745 - DNA, 1008 bp, Artificial Sequence
  Description of Artificial Sequence: Synthetic coding sequence
atgggcccactgagtgccccgccttgcaccgaacatattaaatggaagggccttctgctgaccgcgttgttgttgaatttctggaacctacccaccaccgcacaggtcatgatcgaggctcagccccctaaagtttcggagggaaaagatgtcctactccttgtgcataacctgccccagaatctcactggctacatttggtacaagggccagatccgagacctctaccattatatcacttcctacgttgtggacggccagatcataatttacgggccggcctactcgggaagagaaaccgtgtactctaatgcctctctgctgatacagaatgtcacgagggaggacgccgggagttacacacttcacatcattaaacgtggcgacggcacaagaggcgtgaccggctacttcaccttcactctgtatctggagaccccgaaaccatccatttcttctagcaacttgaaccctcgcgaagccatggagaccgtgatacttacctgcaatccagaaacgccagatgcttcctacctttggtggatgaatggacagtccctgccgatgacacatcgcatgcaacttagtgagaccaaccgcaccctgttcctgttcggagtgaccaaatacactgctggtccatatgaatgcgaaatttggaacagtggatcagcttcaaggtccgaccccgtcacattgaatctgctccacggccctgacctacctcgcatatttccctcagtgacatcttactacagtggtgagaaccttgatctgtcctgtttcgctaattccaatccccccgctcagtattcttggaccattaatgggaaattccaactgtctggccagaagctttttattccccagatcacaccaaagcataacggcctgtacgcttgctcagcgcgcaatagcgccaccggcgaggagagctctacgagcctgactattagagtgatcgctcctcctgggctcggaacattcgccttcaacaaccccacttag

SEQ ID NO: 129746 - DNA, 1008 bp, Artificial Sequence
  Description of Artificial Sequence: Synthetic coding sequence
atgggcccgctgagcgctcctccgtgtacagagcacatcaagtggaagggcctgctgctaactgctctgctgctgaacttctggaatttgccaaccactgcccaggtaatgattgaggctcagccacccaaagtaagtgaaggcaaggacgtgctgctgctagttcataacctgccccagaaccttaccggttatatatggtacaaagggcagataagggatctctaccattatatcacaagttacgtggtggatggccagataatcatctacggaccagcgtactcgggaagagagacagtttactccaatgcctccctgttgatccagaacgtaacacgagaggatgctggcagttacactctgcatattattaaacggggagatggcacacggggcgttaccggatattttacatttacattgtacttggagacccccaagccgtcaatttccagctcgaatctgaatccaagagaagccatggaaaccgtgattcttacttgcaatccggaaactccggacgcctcctacctatggtggatgaacggacaaagcctgcccatgacacataggatgcagctgagtgaaaccaacagaaccttgttcctattcggagtaaccaagtatactgcagggccctacgaatgtgaaatttggaatagtgggagcgcatctaggagcgaccctgtgaccttgaatttattgcatggccccgatctgccgaggatctttccgtcagtcacatcctactacagtggagagaacttggatctgtcgtgctttgcaaattctaatcccccagcgcagtatagctggaccattaatggtaagttccagctctccggacagaagttgtttatccctcagattacgccgaagcataatggtttgtatgcctgtagcgctagaaatagcgcgaccggcgaagagtcctcaacgtctctgacaattagagttattgcgcctcctggattgggcacctttgcttttaacaacccaacatag

SEQ ID NO: 129747 - DNA, 642 bp, Artificial Sequence
  Description of Artificial Sequence: Synthetic coding sequence
atggggcccctttcggccccaccctgtactgagcatatcaagtggaagggtctgctgctgactgtggagacacccaagccaagcatctcttcgagtaacctcaatcccagagaagccatggaaacagtcatccttacctgcaaccccgaaacgccagatgctagctacctctggtggatgaacggccagtctttacccatgactcaccgcatgcagctttctgagacaaacagaactctgttcttattcggagtgaccaaatacactgcagggccttacgagtgtgaaatctggaacagtggatccgcctcaagatcagatccagtgaccttaaatctcctccacggccccgacttacctcggattttcccttccgtgacatcttactactccggggaaaatctggacctgagctgcttcgcaaatagcaatccacccgcacaatactcgtggactataaatggtaaatttcagctgagcggccagaagttatttattccacagatcacaccaaagcacaacgggctgtacgcctgctcagcccggaactcggccacgggagaggaatcttcaacaagtttgaccatccgagttatagcaccacctgggctgggcacattcgcattcaacaacccaacttag

SEQ ID NO: 129748 - DNA, 1008 bp, Artificial Sequence
  Description of Artificial Sequence: Synthetic coding sequence
atgggacctctttccgctcctccttgcaccgaacacattaaatggaaaggcttgctggtgacagcttcgttgctgaatttttggaatctgccgactaccgcgcaggtaaccatcgaggctcagccccctaaagtaagcgagggcaaagacgtcctgctccttgttcataatctgccacagaatctgactggttatatctggtataagggccagattagagatctatatcattacatcacatcctatgtggtggacggccagattatcatttatgggcctgcctattctgggagagagacagcttattctaacgccagcttgcttatccaaaatgtgactagggaagacgcgggctcttacaccctccatattatcaaaagaggggacggtacccggggggtgacaggatacttcacattcaccctatacctggagactcctaagccgtccatctctagctctaacctaaacccaagagaggctatggaaactgtcatcttgacatgcgaccccgagaccccagacacatcttaccagtggtggatgaatgggcaaagccttccaatgacgcaccgcttccagttatcagagaccaaccggacactttttctgttcggtgtgacaaagtatacggctggcccatatgagtgcgaaataaggaacagtgggtccgcctcgaggtccgatccggtaacactaaatctgcttcatgggcccgatttaccacgaatccaccctagctacaccaattaccgttctggagacaacctgtatctgtcatgctttgccaactccaacccgccagcacagtactcttggacgattaacgggaagttccagcagagcggacagaatctcttcatcccccagatcactactaagcattccggtctgtacgtctgcagtgttcgaaactccgctactggcgaggaatccagcaccagcctgactgtgaaggtaagtgcaagcactcggatcggtctgctgccactgttgaacccaacttag

SEQ ID NO: 129749 - DNA, 1008 bp, Artificial Sequence
  Description of Artificial Sequence: Synthetic coding sequence
atgggaccattaagtgcccctccttgtaccgaacacatcaaatggaaagggctgctcgtgaccgcaagcctcctgaacttctggaaccttccaacgacagcccaggtcacaatcgaagcccagcctcccaaagtgagtgaaggcaaagatgtgttgttgctcgttcacaacctgccacagaatttgacggggtatatttggtacaagggccaaatccgggacttgtatcattatatcacttcatacgtggtggacggccagatcataatctacggacctgcctactctggccgagagaccgcttatagcaacgccagtttgctgatacagaacgtcacccgcgaggacgcgggatcatatacactccatataatcaaacggggggatggcacacgcggcgttacaggatactttacattcaccctttatctggaaactcctaagccctctatatcaagttctaatttgaatccacgagaagcaatggaaaccgtaattttgacttgcgaccccgagactccggatacatcctatcaatggtggatgaatggccaatccctaccaatgacccataggtttcagttgtccgagaccaacaggaccctcttcctgtttggcgttactaaatacacagctgggccttatgagtgtgagatcaggaactctggatcagcttctagaagcgacccagttaccttaaatctgctccacggccctgatctgccccggattcaccccagctatacgaactatcgatcaggggataatctgtatttgtcgtgtttcgctaactctaacccaccagctcagtattcatggactataaacgggaagtttcagcaatctggtcagaacctgtttattccgcagattactaccaagcatagcggcctgtatgtctgctcagtcagaaatagtgccacaggcgaggaatccagcaccagcctcaccgtgaaagtgtcagcctctactcggattggtttacttccactcctgaatcctacgtag

SEQ ID NO: 129750 - DNA, 1008 bp, Artificial Sequence
  Description of Artificial Sequence: Synthetic coding sequence
atgggacccctgagcgcaccaccttgcaccgagcacattaaatggaagggcctgctcgtgactgctagtcttcttaacttttggaacctgccaaccacggctcaagtaacaattgaggctcaacctcctaaggtgtctgagggcaaggacgtgcttctcctcgtccacaacctccctcagaacctgacaggatacatttggtacaaggggcagatccgggatttataccactatattacctcatacgtggtggatgggcagattatcatctacggccctgcttatagtggccgtgaaacggcctattccaacgcatccttgctaatccaaaacgtgacgagggaggatgcaggatcttacactctgcacattatcaagaggggagacggcactcgcggggttactggatatttcactttcaccctttatctcgagacccctaagccctccatcagcagttctaaccttaatcccagggaagctatggagactgttatcctcacctgtgaccccgagaccccagacacctcttaccagtggtggatgaatggacagtcacttccgatgacgcacaggttccagctgtctgagaccaatcgtaccctctttttgtttggggtgacaaaatatacggccggcccatatgagtgcgagatcaggaatagcgggagcgcttctcggtccgatccagtgacattaaaccttttacacggacctgatctgccacgaatccatccatcctacacaaactacaggagcggcgacaatctgtacctgagttgtttcgcgaattcaaacccccctgcgcagtactcgtggactattaacggcaaatttcagcaaagcgggcagaacctcttcattccccagatcacaacaaagcacagcgggctgtacgtttgctcagttcgaaactccgcaacaggagaggagtcatccacctcactcactgtaaaggtttccgcctctacccggatcgggctcctgcccctgctgaatcccacctag

SEQ ID NO: 129751 - DNA, 1287 bp, Artificial Sequence
  Description of Artificial Sequence: Synthetic coding sequence
atgggaccccttagcgcacctccatgcactcagcgcattacttggaagggcctgctgcttaccgctttattgctcaacttttggaacttacctactactgcgcaagtgactatcgaggccgaacctacaaaggtatcaaagggcaaagacgttctgcttctggtgcacaacttaccacagaacctcgccggatacatatggtacaaaggtcagatgaaggacctgtaccactatatcaccagctacgtggtggatggacaaattatcatttacggacctgcgtactctggccgtgagactgtctatagcaacgcaagcctgctgatacagaacgtgacacgtgaagacgcaggctcttacactctccatatcgtgaagagaggggatggcacacgaggcgagactggccattttacttttacactatatctcgagacgcccaaaccctccatcagctcctctaatctctaccccagagaggatatggaggcggtgagcctgacgtgtgacccagagacccccgatgcttcatacctgtggtggatgaacggccagtcactgccaatgacacactcacttcagctgtctaagaataagcggactctgtttctgttcggcgtcaccaagtacaccgcgggaccttatgagtgcgagattagaaaccccgttagtgccagcagaagcgaccctgtgacgctgaatctgctgcccaaactcccaaagccatatatcaccatcaataacctgaacccgcgcgagaacaaagatgttctggcttttacatgcgaacccaaaagtgaaaactatacatacatctggtggttaaatggacagagtctgccagttagcccccgggttaaaaggcctatcgagaatagaatcttaatcctgcccagcgtcacgcgaaacgaaactggcccctaccagtgcgaaatccaggatcgctatggagggatccggtcttacccggtgactctcaacgtcctctacgggcccgacttacctagaatctacccgtccttcacctactaccactccggtgagaacctctatctgtcatgctttgctgactccaaccctcccgcagagtactcttggacaataaatggaaagttccaactaagcggtcagaaactcttcatcccccaaatcactacaaagcacagcggactctatgcgtgttccgtcaggaatagcgctactggaatggagtcatccaagtccatgacagtaaaggtgtctgccccatcaggcacgggccatctgcctgggctgaatccgctttag

SEQ ID NO: 129752 - DNA, 981 bp, Artificial Sequence
  Description of Artificial Sequence: Synthetic coding sequence
atggggcccttatctgcacctccctgcacacagcgaattacgtggaagggggtgcttctgactgcatctctgttgaacttttggaacccccctacgacagcgcaggtgacaatcgaggcacaaccacccaaggtatccgagggcaaagatgtcttgttgcttgtgcataatctccctcagaacctggcgggatatatctggtataaaggtcagatgacctatctatatcattacatcacatcgtacgtggtggatggccaacgaattatatacggccccgcgtactcaggacgagaaagggtgtatagcaacgcttctctactaatccagaatgtaactcaggaagatgcgggctcttatactctgcacattatcaaacgccgggatggtaccgggggcgttaccggccattttacctttacattgcatctggaaacacccaagccctcaatttcaagctctaatttgaacccccgcgaagcaatggaagccgtcatcctgacatgcgatccggcaacacctgcagcttcctaccagtggtggatgaatggtcagagtctgccgatgacccacagactacagctttctaagactaaccggaccctgtttatcttcggggtcacaaagtatattgcaggaccatacgaatgcgagatccgaaaccccgtgagcgcctctcgctccgatcccgtgacccttaacctactgcacggaccagatttaccatccatctacccttcttttacctattaccgtagcggcgagaatctgtatctgtcgtgctttgctgagagcaatcctcgcgcccaatatagctggacaatcaacggtaagttccagctcagtggacagaagctctccatccctcagataacaactaagcactcgggcttgtacgcttgtagcgttcggaacagcgcgacaggcaaagagagtagtaaaagcatcacggtaaaggtgtcagactggattctaccttag

SEQ ID NO: 129753 - DNA, 1260 bp, Artificial Sequence
  Description of Artificial Sequence: Synthetic coding sequence
atgggtcccctgagcgccccgccttgcactcagagaatcacttggaaaggggtgcttctgacagcttccctgctgaacttctggaatcctcctacaacagcccaggtgacaatcgaggctcagccccccaaagtgtctgagggcaaggatgtgctgctgctcgtgcacaacctcccacaaaacttggctggctacatctggtacaagggacagatgacttatctgtaccactatatcaccagctatgtagtggatgggcagagaataatctacggaccagcctattccggacgggagagggtgtacagtaatgcatctctgctcatccaaaatgtgacccaggaagatgctggttcatacaccctgcacattatcaaaaggagggacggaaccggtggcgttaccgggcactttaccttcacactgcacctcgaaacgcccaagccctcaatcagctcatcgaacttgaaccctagggaagccatggaagcagtgatcctaacgtgcgaccccgccacgcccgccgccagctatcaatggtggatgaacgggcaatctctgcctatgacccatcggctccagctcagcaagaccaatcgaacgttattcatcttcggggttactaaatacatagctggaccctacgagtgtgagatccgaaaccctgtcagcgcatcccggtctgacccggtaactctgaacctcctgcccaaactctcaaagccctatatcacaatcaacaatttgaacccacgagagaataaggacgtgctgacctttacatgtgagccaaagtcaaaaaattacacttatatctggtggctgaacggccagagtctgcccgtgtccccgcgtgtcaaaagaccgatagagaaccgtattctgatcctgccgaacgtcacccgcaacgaaaccggcccttaccaatgcgaaatccgcgacagatacggcggcatccgttccgaccctgttaccctgaacgtattgtatggtcccgaccttcccagtatatacccctcttttacatattaccgaagcggggagaatctgtacctctcatgctttgcagagtccaatcctagagcccagtactcttggacaataaacggcaagtttcagctgagtgggcagaagctgagcatcccacagatcaccacaaagcactctggattatacgcatgcagtgtccggaatagtgctacaggcaaagagagtagcaaaagcattactgtcaaagtgagcgactggatactgccttag

SEQ ID NO: 129754 - DNA, 981 bp, Artificial Sequence
  Description of Artificial Sequence: Synthetic coding sequence
atgggacctttgtccgcccctccttgtacccaacgcattacatggaagggtgttctattaacagcttctctactgaatttctggaacccgccaactactgcccaggtgaccatcgaagctcaaccgcccaaagtttcagaaggtaaagacgtcctgctcctggtgcataacttgccacagaacctggccggctacatctggtataagggacagatgacctatctgtaccactatatcacgtcctacgtcgtcgatggccagcggattatttacggccccgcatactcaggcagagagcgggtgtactctaatgctagcctcttgatccagaacgtcacacaggaagacgccggttcttacaccctgcatattatcaagcgacgggatgggaccggtggcgtgaccgggcactttacctttacactgcatccaaagctgtccaaaccttatattactatcaataatcttaatccccgcgaaaataaagacgttcttacctttacctgtgagcctaaatcgaagaattacacctacatttggtggttgaacggacagtcactcccagtttcgccgcgggtgaagcggcctatagaaaacaggatcctgatcttacctaacgtaaccaggaacgaaaccggaccctaccagtgcgagattcgtgaccgctacggcggcattcgatcagaccctgtgactctaaatgtgctttacgggccagaccttcctagcatctacccaagttttacttactacagaagcggagagaatctttacctcagctgtttcgccgaaagcaacccacgcgcccagtacagttggacgatcaacggaaagttccagctctctggtcagaaacttagcattcctcagattacaactaaacattcagggctgtatgcttgttccgtgcgcaactctgcgaccggcaaagaatcctcaaaatccattaccgtgaaggtgtccgactggatcctgccctag

SEQ ID NO: 129755 - DNA, 1008 bp, Artificial Sequence
  Description of Artificial Sequence: Synthetic coding sequence
atgggaccgctgagcgcccctccttgtacccaacacatcacctggaagggactgctgttgaccgcctccttactgaacttttggaatcttcctattaccgctcaggttaccattgaggccctgcctccaaaagtatccgaaggtaaggatgtactcctactcgttcacaatcttcctcagaatctcgccggttacatctggtacaaggggcagctcatggacctatatcattacatcacaagctacgtggtggacggccagataaatatctacggcccagcctatactggacgtgagactgtctactcgaatgccagcctgctcattcagaatgtgacacgggaggatgccggtagttacacactgcatatcatcaaacgaggcgaccgaacaaggggggtgaccgggtactttaccttcaacctgtatctgaaactgcccaagccctatatcacaatcaataattctaagcctcgagaaaataaggacgttctggcctttacatgcgagccaaagagcgagaactatacctacatttggtggcttaatggtcaatctctcccagtctctcccagagtgaagaggcctattgaaaaccgcatcctcattctcccctcagtgactagaaacgaaacaggtccctacgaatgtgaaattcgcgacagagatggagggatgcggagtgatcccgtgaccctgaacgttctgtacggccctgatcttccgagcatttacccttcttttacgtactatagaagtggtgagaacctctacctctcctgctttgcagaaagcaacccaccagcagaatatttttggacaatcaatggcaaattccagcagtcaggccagaaactgagcattccccaaattacgactaagcaccgcggtctttatacgtgttccgttaggaacagtgccaccggaaaagagtcctcaaaatccatgaccgtggaggtgagcgccccatccggcatagggcggctgcccctgctgaaccccatttag

SEQ ID NO: 129756 - DNA, 1008 bp, Artificial Sequence
  Description of Artificial Sequence: Synthetic coding sequence
atgggccccttaagcgcgcctccatgcactcagcacatcacctggaaaggacttcttcttactgcctctttacttaatttctggaatctgcccatcaccgcacaggtcaccatcgaggccctccctccgaaggtttctgaagggaaagacgtgctgctgctcgtgcacaatctgcctcagaatctggctggctatatatggtataagggtcagctcatggatctgtaccattacattacttcctacgtcgttgacggccagatcaatatctacggtcctgcatacaccgggcgggaaacagtctactcaaatgcctccttgctcatacagaacgttaccagagaggatgccggaagctacaccctgcacatcatcaagaggggcgatcgcaccaggggagtgactgggtactttacctttaacctgtaccttaaactgccaaagccctacattactattaataactccaagcccagagaaaataaggatgtcctggcttttacatgcgagcccaaatccgagaattatacctatatctggtggcttaatggacagagcctgcccgtatccccacgggttaaacgaccaattgagaatagaattcttatcctaccaagcgttactcggaacgagacggggccctacgagtgtgagatccgggatagggacggcggcatgaggtccgatccggtaaccctcaatgttctctacggacccgacctcccatccatttatcctagctttacttactatcgcagtggcgagaatttatatctcagttgtttcgcagaaagcaatcccccagccgaatacttctggactatcaatggaaaatttcagcaaagcggtcagaaactttcgattccacagataacgactaaacacagaggcctgtacacctgcagtgtccgcaactctgccaccgggaaggaatctagcaaatccatgacagtcgaagtgtccgccccaagcggcattgggcgtctgcctctactgaatcctatttag

SEQ ID NO: 129757 - DNA, 1008 bp, Artificial Sequence
  Description of Artificial Sequence: Synthetic coding sequence
atgggcccactgagcgctccaccctgcacacaacacatcacttggaaaggactactcctgaccgcttcacttctgaatttctggaatttgccaataaccgcccaggttactattgaggctcttccccccaaagtgtcagaggggaaggacgttttgctattagtgcacaatctacctcagaatcttgccgggtacatttggtacaagggacagcttatggatctctatcattatatcacctcgtacgtggtggatgggcagataaatatctacggaccggcctacactggacgggagaccgtgtactcgaacgccagccttttaattcagaacgtcactcgggaggacgccggctcctacactctgcacattatcaaaaggggggaccgcactagaggggtcacagggtattttacattcaacctctatcttaaacttcctaagccctacataacgattaacaattcaaaacccagagaaaataaggatgtcctggcttttacatgtgagccaaaatccgaaaactacacctatatttggtggttaaatggacagagcttgccggtaagtccacgcgtgaagcgcccaattgagaatagaatcctgattttgccatccgtcacgaggaacgaaaccggcccctacgagtgtgagatccgagatagggatggaggtatgagatccgaccccgtgacacttaatgtgctttacggaccagacctaccctctatttacccatcattcacgtattaccggagcggcgaaaacctatatctgtcgtgcttcgcagagtccaacccgcctgcagagtatttctggaccattaatggtaaattccagcagagcggacagaaactgtcaatcccacaaatcactaccaaacatagggggctctatacatgttccgtgcgcaattctgccacgggaaaagaaagcagcaagagtatgacggtcgaggtgagcgccccgtccggcatagggaggctccccctgctgaatccaatttag

SEQ ID NO: 129758 - DNA, 1275 bp, Artificial Sequence
  Description of Artificial Sequence: Synthetic coding sequence
atgggaccactgtctgctcccccctgtacgcagcacattacctggaaaggactattgcttaccgcctctctgctaaacttttggaatctgcctaccacagctcaggtgattattgaggccaagccgccaaaagtttcagagggaaaagatgtgctactcttagtccataatcttcctcagaatctcaccgggtacatctggtacaaggggcagatgactgacctgtaccactatattactagttacgtggtccatggccagatcatctatgggcccgcgtacagcggccgcgagaccgtgtattcaaacgcgtcactgcttattcagaatgtcacgcaggaggatgctggatcgtacacccttcatattatcaagcgaggggacggaacaggcggcgtcaccggctactttaccgtaacactttactcggagacccctaagccgtctatctcttccagcaacctcaatccccgagaagttatggaagcggttcggcttatctgtgatcctgaaacacctgacgctagttacctgtggctcctcaatgggcagaacctgcccatgacacacagactgcagctatcgaagaccaaccggaccctctatctcttcggggtgactaaatacattgcaggcccctacgagtgcgagattcgaaaccctgtaagtgcctcaagaagtgacccagtgaccttgaatcttctgcctaaactgcccatgccatacatcaccatcaacaatttgaacccccgggaaaagaaggatgtgttagcttttacctgcgagcctaaaagtcgaaattacacatacatctggtggctcaacgggcagagcctccctgtgagcccccgcgtgaagagacctatcgagaaccgaatcttgatcctgccttccgtcacccggaacgaaactggtccttaccagtgcgagattcgggacagatatgggggtatccgtagtaacccagttactctgaatgtcctatacggcccagacttacctcgcatctaccccagcttcacctactatcgaagcggtgagaatcttgatctctcttgtttcgccgatagtaatcctcctgctgaatattcgtggacgatcaatggcaagttccagctgtctgggcaaaagctgttcattccccagataacaaccaaccactctgggctttatgcttgtagcgttagaaattccgccacgggaaaagagattagcaagtcaatgatcgtgaaagtctctggaccttgtcacggcaatcaaactgagtcccactag

SEQ ID NO: 129759 - DNA, 1308 bp, Artificial Sequence
  Description of Artificial Sequence: Synthetic coding sequence
atgggtcccctgtctgcgccgccttgcacacagcacatcacatggaaaggactgctccttactgcctccctgcttaatttctggaatcttcccaccacggcccaagtgattattgaggccaaacctcccaaggtctcagagggcaaggacgtgctgttgctcgtccataatttgccacagaaccttaccggatacatctggtataaaggtcagatgactgacctgtatcactacattacatcatacgtggttcacgggcaaatcatctacggccctgcatactcgggtcgggagaccgtgtatagcaatgcatccctgctgatccagaacgtgacccaagaggatgctggctcatatacgcttcacattattaagagaggggatgggacaggcggtgtcactgggtatttcacggtgaccctctatagcgaaactccgaagccctccatatcgtcctccaatctcaacccccgcgaagtgatggaggccgtgaggctcatatgcgaccctgaaacacccgatgcatcatacctttggcttctcaatggacaaaatctgcctatgacccatcgcctgcagttgtctaaaaccaatcgaacactatatctgttcggtgtcacaaaatatattgccggcccttacgagtgtgaaattcgcaaccctgtgagcgcatcacgttctgaccccgtgacacttaatctcttgcctaaactgccaatgccttatataaccattaataacctgaaccctagagagaaaaaggatgttctggccttcacttgcgagccgaagtccagaaactacacgtatatatggtggctcaacggccagagtcttcccgtgtcacccagagtcaaaaggcctattgagaatcgcatacttattttgccaagcgtaacaaggaatgaaaccggaccttaccagtgcgaaatcagagacaggtacggcggaattagatccaacccagttacactgaatgtgctctatggaccagatctccctcgtatctaccctagttttacctattatcgctctggggagaacctcgatttatcatgctttgcagactcaaatccgccagcagaatactcttggaccatcaacggtaagtttcagctttctggtcagaaactgtttattccgcagatcactaccaaccactccgggctgtatgcatgctcagtgagaaattctgccacaggaaaggaaatctctaagagtatgatcgtgaaggtgtctgaaaccgcctctccgcaagtaacatatgctggccctaacacatggttccaggagattctgctcctgtag

SEQ ID NO: 129760 - DNA, 606 bp, Artificial Sequence
  Description of Artificial Sequence: Synthetic coding sequence
atgggcggcgatgaaaatcggggggtcacaggtcactttacctttaccttgtacctggaaaccccaaaaccttcaatcagcagcagtaaactcaacccaagagaggctatggaggccgtcagtcttacctgcgatccggagaccccagacgcatcttacttatggtggatgaatggccagtcactaccaatgtcccacagactgcagctgagcgagaccaatcggactctgtttctcctcggggtgactaaatatacagctggaccctacgaatgtgagattcggaatcccgtatctgcctcacgatctgacccttttactctcaatctgcttcatggccccgacctgccaaggatttatccctcatttacttactaccggtcaggcgaagtcctgtacctctcttgcagtgctgactctaacccgccagcccagtatagttggacaattaacgggaagtttcagctctctggacagaagctctttattccacagatcactaccaagcatagcggattatacgcctgtagcgtacgcaactcagcaaccggaaaggaaagcagtaagtctatgactgttaaagtgagtgactggacccttccatag

SEQ ID NO: 129761 - DNA, 1281 bp, Artificial Sequence
  Description of Artificial Sequence: Synthetic coding sequence
atggggttgctgtccgctcccccatgtacgcagagaatcacctggaagggcctactgctgactgcttcccttctgaatttttggaatccccctaccacggcgcaggttactattgaggcacagccaacgaaggtgtctgaagggaaggatgtcctgttactcgtgcataatttgcctcagaacctgaccggatacatatggtacaagggtcaaattagagacctttatcattatatcacttcttatgtagtggatggtcaaataatcatttacggacctgcctattcaggccgggagacaatttactcaaacgcatccctgctaattcagaacgttacacaggaggatgccggttcttacacactacacattattatgggcggggacgagaatagaggagttacggggcattttacctttacgttgtaccttgagacacccaagccaagcatcagctccagcaagctcaacccgcgcgaggccatggaggccgtgtccttgacctgcgatcccgaaacacccgatgcttcctatctgtggtggatgaatggccaaagcctgccgatgtcccatcggctccaacttagcgagacgaacaggaccctgttcctgctaggggtgacaaagtatacagccggcccctacgagtgcgagatcaggaaccctgtgtcagcgagtaggagcgacccttttaccctaaatcttttaccaaaactgccaaaaccttacattaccataaataacttaaaaccaagggagaataaagatgttctgaacttcacatgcgagcctaaaagtgagaattatacatacatttggtggctgaatgggcagtccctacccgtatcccccagagtcaagaggccaattgagaaccgcattctcatactcccgagcgtcacgcgaaatgagactggcccatatcagtgcgagatcagagaccagtacggcggcattcgctcttatccagtgacactcaatgtcctgtatgggccagacctcccacgcatatatccttcatttacctattataggagcggggaggtcctttatctgtcatgctcagctgattctaatcctcccgcacagtattcatggactataaatgggaaatttcaattaagcggacagaagttatttatcccccaaattaccacaaaacactccggcttgtatgcatgttccgtgcgtaattccgccacaggtaaggagagctccaaatctatgacagtaaaagtctctgggaagcgtattccagtgtccttagccatcggaatctag

SEQ ID NO: 129762 - DNA, 717 bp, Artificial Sequence
  Description of Artificial Sequence: Synthetic coding sequence
atgagccacaggctgcagctctccgaaacaaatcggacccttttcctattaggtgtgacgaaatacacagcgggcccttatgaatgtgagattcggaacccagtgtctgccagcaggtctgaccccttcacactcaatttgctgcccaaactccctaagccctacattactatcaacaatctgaagccgcgcgagaataaggatgtgcttaacttcacctgcgagccgaaatctgagaactacacctacatttggtggctgaacgggcagagtctgccggtcagtccgcgcgtgaaaagaccaatcgaaaatcggatattgatccttcccagtgttacaaggaacgaaacagggccatatcagtgcgaaatacgcgaccagtatgggggcattcgatcttatcccgtcactttaaacgtgctctacggtcccgacttaccacgtatctacccttctttcacctattatagatcgggtgaagtgctgtatctgtcctgcagcgccgacagtaatcctccagcccaatactcatggacaatcaatgggaagtttcaactgagcggccaaaagttgttcatcccgcagattaccacaaagcatagcggtctgtacgcttgtagcgtaaggaactccgccaccgggaaagagtcatccaaaagcatgacagtgaaagtctctgcctatagttccagtatcaactacaccgccgtctactag

SEQ ID NO: 129763 - DNA, 1260 bp, Artificial Sequence
  Description of Artificial Sequence: Synthetic coding sequence
atgggtctcctttctgccccaccttgtactcagcgaatcacgtggaaaggactgctcctcactgcctcattactaaatttttggaaccctccaactacggcacaggtgaccatagaagcacagcctaccaaggtgtcagagggaaaagatgttctgctgcttgttcacaatctgccgcagaacttgaccgggtacatatggtacaagggtcagattcgggatctgtatcattacatcactagctatgttgtggatggacagataataatctacgggcccgcttacagtgggagagagacgatttatagtaatgcttcactgctgatccagaatgttacgcaagaagacgccgggtcttacacactccatatcatcatgggcggtgacgagaaccgcggagttacgggtcattttacattcacattgtatttggaaaccccaaaaccctcgattagcagttcaaagctcaaccccagagaggcaatggaagcagtctcgcttacatgcgatcccgagacacctgacgcttcatacctgtggtggatgaatggccaatctttgccgatgtcccaccgattgcagcttagcgagactaatcgaacactatttctgcttggagttacgaagtacaccgctggaccttatgaatgcgaaatccgtaatcctgtcagcgcatcccgatcggacccattcacgctcaacctcctgcccaaattacccaagccatacatcactattaacaacctgaagcctcgcgagaataaggacgtgctcaatttcacgtgtgagccaaaatcggagaactatacatatatttggtggttgaatggtcagtcactgccagtgtcacccagggtgaagcggccaattgaaaacaggatactaatcctaccctcggtgactcggaatgaaaccggcccgtaccagtgcgagatccgagatcagtacggtggcatacgctcctatccggtgacactgaacgtgctgtacggaccagacttgcctcggatttacccttccttcacctactacaggtcaggagaggtcctgtatttgtcatgcagtgctgattcaaacccaccagcccaatacagctggacaattaatgggaagttccagttgagcggccagaagctgtttatcccccaaattactaccaaacacagcggcctgtatgcctgcagcgtacgcaactccgcgaccggcaaagagtcttcaaagtccatgacagtaaaagtatctgattggaccctgccttag

SEQ ID NO: 129764 - DNA, 894 bp, Artificial Sequence
  Description of Artificial Sequence: Synthetic coding sequence
atgggactactgtctgccccaccatgtactcagcggattacatggaaaggcctgttgttaacggtggagacaccaaaacccagcatttccagctcaaagctcaaccccagggaagcgatggaagcagtgagtcttacttgcgatccagagacaccagacgcgtcttatttatggtggatgaatggccagtctctgccaatgtcacacagacttcagctgagcgagacaaataggaccctttttttactgggggtcaccaaatacaccgctgggccatatgagtgcgagatccgcaaccctgtgtctgcatccagatcagacccctttacgctcaatctgctgcctaagttgcccaagccttatatcacgataaataatctaaagcctcgcgaaaacaaggatgtgttgaacttcacttgtgaaccgaagtcagaaaattacacttacatatggtggctgaacggacaatctcttccagttagccctcgcgtgaaaagacccatcgaaaacaggatcctgattctgcctagtgtcacaagaaacgagaccggcccgtatcagtgtgagataagggaccagtatggagggatcaggtcgtatccagttaccctaaatgtgctttatggccccgacttgcctagaatctatccttcattcacttactatcggagcggcgaagtcctctacctttcatgcagcgccgacagcaacccacccgcgcagtattcgtggactataaatgggaaattccaactctctggccagaagctgttcattcctcagattacgactaaacattctggcttatacgcgtgttcggtgcgaaactctgccacaggtaaagagtcctctaagagcatgactgttaaagtgtcagactggacactaccttag

SEQ ID NO: 129765 - DNA, 1209 bp, Artificial Sequence
  Description of Artificial Sequence: Synthetic coding sequence
atgggccccctgccagcgccaagttgcacccaaagaattacatggaagggcctgttactgacagcttcattactcaatttttggaatccgccgacaacagctgaggtgacaattgaagcgcagccgcccaaggtgtctgagggcaaggatgtgctacttctggtccataatctgccgcaaaatctgcccggctacttttggtataagggtgagatgactgatctctatcactatatcatttcctacattgtggatggcaaaatcatcatctacgggccggcctatagcggacgggagacagtgtactcaaatgccagcctcttgatccaaaatgtgacccggaaggacgcgggcacatacaccctgcatatcataaagcgaggggatgagacacgggaggagatcagacacttcactttcactctctacctggagactccaaagccttatatctcctcttccaacctcaacccacgcgaggctatggaagctgtgcggttgatatgcgatccggagacactcgatgctagctatctatggtggatgaacggccagtctttacccgtcacccataggctgcaattgagcaagacgaacaggactctatatctgtttggagtgaccaagtatatcgccgggccctatgaatgtgaaatacgaaatcctgtgtcagcatccagaagcgatcctgttacactgaacctgctgcacggaccagatctcccaagaatttacccatccttcacctactatcggagtggtgaaaacttggacctgagctgttttaccgagtccaatcccccagctgagtacttctggacaattaatggtaaatttcagcagtctggtcagaagctgtttatccctcaaatcactaggaaccatagcggcctgtacgcctgcagcgtgcataactccgctacggggaaggaaatcagcaaatccatgacagtaaaggtgtccggaaagtggattccggcttccttagctgtaggcttttacgtggaaagcatatggctttccgagaagagccaggagaacatttttatacccagtctgtgccctatgggcacctcaaagagtcagatcctactgctgaaccccccaaatttatctctgcagaccctcttttcgctgttcttctgcttcctgatggctgaccttgtgagtggccttaagaaagtcggccggggattgtaccaaccgtag

SEQ ID NO: 129766 - DNA, 1281 bp, Artificial Sequence
  Description of Artificial Sequence: Synthetic coding sequence
atgggcccactccctgccccaagttgtacacagcgaatcacgtggaaaggcttgctgctcactgcatcactcctcaacttctggaatccaccaacaactgcggaggtgacaattgaggcccagccccccaaggtgtccgaggggaaagacgtgctcttgctagtgcacaatctgccacagaatttgcccggatacttctggtataaaggcgagatgacagacctttaccactacattatatcttacattgtggatggtaagattattatctacggtccagcatattccggtcgcgagacagtgtatagcaatgcttcactgttgatccaaaacgtaactcgaaaggatgccggtacatacacactgcacatcatcaaaagaggagacgaaactagagaggagattagacacttcaccttcacactctacctggagacccccaagccatatatttccagttcaaacttgaaccccagggaagctatggaggcagtccggctcatttgtgatccagagaccttggacgctagctatctgtggtggatgaacggccagtctttgccagtcacccatcggctgcagctcagcaagaccaatcgtacgctgtatcttttcggtgtgaccaaatacatcgcgggcccatacgaatgcgagatcagaaaccctgtatcagcttcccggtctgatcccgtcaccttgaacttactccctaagcttcctatcccgtatataaccattaacaacttgaatcccagagagaataaggatgtgcttgctttcacatgtgagcctaagtccgagaactacacttatatctggtggcttaacgggcagtcactgccagtatcccctggtgttaaaagacctattgaaaaccgcatactgattctacccagcgtgacaagaaatgagaccggcccttaccaatgcgagatacgagatagatacggcggtctgaggagcaatcccgtgattcttaacgtgctgtacggtccagacctacccagaatctatccctcgttcacctattaccgttccggcgagaacctggatctctcatgttttacagagtccaatccacccgccgagtatttttggactattaacggcaaattccaacagtctgggcagaagctctttattccccagatcaccaggaaccacagcggcctctatgcctgttctgtacacaattccgctactgggaaggagatttccaaatctatgactgtgaaggtgagtggaccatgccacggagatctgactgagtcacagagttag

SEQ ID NO: 129767 - DNA, 723 bp, Artificial Sequence
  Description of Artificial Sequence: Synthetic coding sequence
atggggcccctgcctgctccatcttgtacacagcgaattacttggaaaggtctgctcctgactgctagtctcttgaatttctggaacccccctactacagcagaagtcactatagaggcacagccacccaaagtttcagaaggaaaagacgtattgctgctcgtgcacaatttgccgcaaaatttgcccggctacttctggtacaagggagagatgacagatctctaccattacattatttcttatatcgttgatggaaaaatcatcatatatggaccagcctatagtggaagggaaacagtgtactcaaacgccagcctgctgatacagaacgttacccgtaaagacgccggaacgtataccctgcacatcatcaaaaggggggacgagaccagagaagagatcagacacttcaccttcaccctatattacgggcccgatctccctcggatttacccttccttcacgtactataggagcggggaaaatttggatctatcctgtttcaccgagtctaacccccccgccgagtacttctggacgattaatggcaagtttcagcagtctggccagaaactctttattccacagatcacccggaaccactccggactgtacgcatgtagcgttcacaactctgccaccgggaaagagatttccaagtctatgacggtcaaagtctctggtccatgccacggggacctgacagagtcacagagctag

SEQ ID NO: 129768 - DNA, 1164 bp, Artificial Sequence
  Description of Artificial Sequence: Synthetic coding sequence
atgggccccctgccagctccctcctgcacccagcgaatcacctggaaggggctgctcctaacagcctcgctcctgaatttctggtacaaaggagagatgacagacctttatcattatatcattagctatattgtcgatggaaaaatcatcatctacggtcccgcctacagcggcagagagaccgtatacagcaatgcgtctcttctgatccagaatgtcacccgcaaagacgccgggacgtatactctgcatatcatcaagcgtggggacgagacacgcgaagagatccgtcactttacctttacactgtacctggaaacaccaaagccctacatttcctctagcaatctgaatccacgggaggctatggaggctgtacggttgatctgtgacccagaaacacttgatgccagctatctgtggtggatgaacggtcaaagcctgccggtgacgcaccgcttgcagttaagcaaaacaaatcggacgctgtatctgtttggcgtgacgaaatacatcgccgggccatatgagtgtgagatccggaaccctgtcagtgcttctcgctcagatccagtcacgcttaatctgctccctaagcttcccatcccatacattacgattaacaatttaaatccaagggagaataaggacgtcctagcgttcacttgcgaaccaaaaagcgagaactacacctacatctggtggttgaacgggcaatccctcccagtctctccaggagtcaaacgacccatcgagaacaggattctgatcttaccatcagtgacgcgcaatgagaccggtccgtaccagtgcgaaatccgcgaccgatacggaggactgagaagcaacccagtgatcttgaatgtcctgtacggccccgacctaccacgcatctatcccagtttcacgtattaccggtcaggcgagaatctcgatctttcttgcttcaccgagagcaatccccctgcagaatacttttggacgatcaacggcaaattccaacaaagtggccaaaagctttttataccccagatcacaagaaaccattccggtctgtacgcttgttccgtgcacaatagtgccacgggaaaagagatttccaagtccatgactgtgaaggtgtcaggcccatgccatggtgacttaaccgaaagtcagtcctag

SEQ ID NO: 129769 - DNA, 1002 bp, Artificial Sequence
  Description of Artificial Sequence: Synthetic coding sequence
atgggacctttgcccgcccccagctgcacccagcgcattacgtggaagggactactgctgaccgcaagcctgctcaacttttggaacccacctacgactgctgaagtgacaatcgaggcacaacctccgaaggtgtccgaaggcaaagatgtgcttctgttggttcacaatctcccccagaacctccccggatacttttggtacaaaggcgaaatgactgatctatatcattacataattagctacatagtggacggcaaaataattatctacggtccagcttattccggtagagaaactgtttactcaaatgcctcacttttgatccagaacgtgacacgcaaggacgcgggcacttacacactgcacatcatcaaacgcggcgacgagactagagaggagatcaggcactttactttcacattgtatagcaagctccctataccttatataaccattaacaatctcaaccccagagagaacaaggacgtcctggctttcacatgcgaacccaagtctgaaaattacacatatatttggtggttgaacggccagagccttcctgtatcacctggcgttaagagacccatagaaaaccggatcctgattctcccaagtgttacccgcaacgagacaggtccctatcaatgtgagattagggaccggtacggagggctgcggtcaaatccagtgatcttaaatgtactgtacggacccgacctccctaggatttatccatctttcacatattataggtcgggagagaatttggatttgtcctgctttaccgaaagcaaccctcccgccgagtacttttggacaatcaacggcaagttccaacagtcaggacagaaactttttattcctcaaattactcgtaaccacagtggcctgtacgcctgtagcgtgcacaacagcgcgaccggcaaggaaatttctaagagtatgaccgtgaaagtctccggaccctgccacggggatctcacagagtcccagtcttag

SEQ ID NO: 129770 - DNA, 1032 bp, Artificial Sequence
  Description of Artificial Sequence: Synthetic coding sequence
atgctgctgctaaaaaagcacaccgaagacatttcttcggtatacgaaattagggagcgcctgggctcaggtgcatttagtgaggtggtcttagcccaagagcgggggagcgctcacctggtagctctgaagtgtatacctaaaaaggcactgcgggggaaagaagctctggttgagaacgaaatagccgtgctgcgccgcattagccacccgaatattgtggccctcgaggacgtccatgagtctccaagtcacctgtacctggccatggaactagttactggaggcgagttattcgatagaattatggagaggggatcctacacggagaaggatgcaagccatctggtgggacaggtcctgggcgctgttagttatctccatagcttaggaatagtccaccgcgacttaaagcccgaaaacctgctgtacgctacaccctttgaggattctaaaattatggtttcagatttcggcctgtccaagattcaagctggtaacatgctcggcactgcgtgcggcacacctggctatgtggcccctgaattgctggaacaaaaaccatatggcaaggccgttgacgtctgggctttaggcgtcatcagctatatattgctgtgtggctatcctccattctacgatgaatcggaccccgaactgtttagccagattctgcgcgccagttatgagttcgactcaccgttctgggacgatatttccgaatccgcgaaagactttatccgccatctgttagagagggaccctcagaagcgttttacctgccagcaggcactccgacatctatggatcagcggcgacacagccttcgatcgtgacatcctcgggagtgtgagcgagcagatccggaaaaattttgccagaacccactggaaacgggcatttaatgccacgagttttttgcgccacatccgcaagttaggccagatccctgagggcgaaggggccagtgaacaaggcatggctcggcacagtcacagcggcctccgagccgggcagccccccaagtggtag

SEQ ID NO: 129771 - DNA, 1101 bp, Artificial Sequence
  Description of Artificial Sequence: Synthetic coding sequence
atgctcctcctgaagaaacataccgaagacatcagctccgtgtatgaaatccgagagcggttaggctcaggagcatttagcgaggtggtcctggcacaggagcgtgggagcgcccacctcgtggcgctgaaatgcatccccaaaaaggccctgcggggcaaagaagccttggtggaaaatgagattgctgtgttgcggcgcattagccatccaaacatcgtcgcactggaagacgtccatgaaagtcccagccatctgtacctggctatggagctggtgacagggggagagctattcgacagaataatggagagggggtcctataccgagaaagatgcatcccacctggtgggccaggttttaggtgccgtgagctatctgcactctctgggcattgttcacagagaccttaagcctgaaaacctgttgtacgcaacacccttcgaagacagcaagataatggtgtctgattttggactgtctaagattcaggccgggaacatgctagggacggcctgcggtacgcccggatatgccgaacccgtaacactgagcgggatggccgcatgcgttcctgtgagggcaagcgtgtgtctttggccgccagcccctgagcttttagagcagaaaccgtatgggaaggctgttgatgtctgggccctgggcgtgatcagctatatccttctgtgtggataccctccattctacgatgagtccgatccagagcttttctcccagatcttgagagcatcttatgagttcgattcccctttttgggacgatatctcagaatccgccaaagatttcattcgacacctccttgagcgcgatccccagaaaaggtttacttgccagcaggccctgaggcatctctggattagtggcgacaccgcttttgatcgtgatatcctgggctcagtaagtgagcagattcgcaagaattttgctagaacccactggaaaagagcttttaatgctacatccttcttgcggcacattagaaaactgggtcaaattccggagggcgaaggcgcttcagaacaaggtatggctcggcattcacattcaggccttagagctggtcaaccacctaagtggtag

SEQ ID NO: 129772 - DNA, 1083 bp, Artificial Sequence
  Description of Artificial Sequence: Synthetic coding sequence
atgtggaggagagtgtgtggcggattggccggccgacgcccttctggtgatatgctgctcctgaagaaacacacggaggatatatctagcgtttatgagatacgtgagcgattgggatctggtgctttctccgaggtggttttggcacaagaaaggggctctgctcacttagtggccttaaagtgtatccctaaaaaagccctcagaggcaaggaggcacttgtggagaacgagatagccgttcttagaagaatcagccatcccaatatcgtggctctggaagatgtgcacgaatctccaagccacctgtacctggctatggaactggtcaccggtggcgagctgtttgatcggataatggaaaggggcagctacactgagaaggatgcttcccatctcgtaggccaagtgctgggcgccgtcagctatttgcattccttgggcatcgttcatcgggatttgaagccggagaatttgctttacgctactccgtttgaggactccaaaatcatggtttccgattttgggctgagcaaaatccaggcaggcaacatgctcggcactgcctgcggcacgccggggtatgtggcaccagagctcctcgagcagaaaccttacggaaaagccgttgacgtatgggctctgggggtgataagctacatactattgtgcgggtatccaccattttatgatgaatccgatcccgagctcttctcccagatccttcgcgcttcatatgagtttgacagtccattttgggacgatatcagtgaatccgcaaaagactttatccgacacctgctggagagggatccccagaagcgcttcacttgccagcaggcactgcggcatctatggatcagcggtgacacagctttcgatcgggacatcctcggtagcgtgtccgaacagattaggaagaattttgcaaggacccactggaaacgagctttcaatgccacaagctttctccggcacattagaaaattgggccagattccagaaggggagggcgcttccgagcaaggcatggccagacatagccatagtggactgagggcagggcaaccccctaagtggtag

SEQ ID NO: 129773 - DNA, 1032 bp, Artificial Sequence
  Description of Artificial Sequence: Synthetic coding sequence
atgctgctgctcaaaaagcatactgaggacataagctctgtgtatgagattcgggaacgactcgggtcaggagcctttagcgaggttgtgttagctcaggagagaggatccgcacacctcgtagccttaaaatgtattcctaagaaagcgctaaggggaaaggaagcactggttgagaacgaaatcgcagtcctaagaagaatctctcatccaaatatcgtggcactagaggacgtgcacgaatcaccaagccatctctacctggcgatggaactagtaactgggggcgagttgttcgatagaatcatggaacgcggaagctacactgaaaaggatgcatcccacctggtgggccaggttctgggggctgtgtcctatcttcactccctaggcatcgtacatcgcgatctaaaacccgagaacctactctacgccacaccttttgaggatagcaaaatcatggtctcggacttcgggctgagtaaaatccaggctggtaatatgctgggaacagcctgtggtacgcctggatacgttgcgccagaacttttggaacagaaaccctatggcaaggccgtggatgtttgggcactgggcgtcatcagctacatactgctgtgtggttatcctcccttctacgatgagtcagatcccgagctgtttagtcaaatcctgcgcgccagttatgagttcgattcccctttctgggatgacatcagtgaatctgccaaagactttatccgccatcttttggaaagagacccgcagaagaggttcacttgccaacaggctcttagacatctctggatctcgggtgatacagcattcgatcgagacatactcgggtctgtgtccgagcaaatcagaaagaacttcgccagaacccattggaagcgggccttcaacgcgacttcttttttaaggcatatcaggaaattaggccagatccctgagggcgaaggagctagcgagcaaggcatggctcgccactctcattccgggcttcgcgccggccagccacctaaatggtag

SEQ ID NO: 129774 - DNA, 1101 bp, Artificial Sequence
  Description of Artificial Sequence: Synthetic coding sequence
atgctcctgcttaagaaacacaccgaggacattagctccgtgtacgagatcagggaaaggctgggatcaggggcattcagtgaggtcgtcctcgctcaagagagaggttctgcccacctcgtcgcgttgaagtgcattcccaagaaagctctccgtggcaaggaggcgctcgtggaaaatgaaattgccgtcctcaggaggatcagtcaccccaacattgtggccctggaagatgtgcacgagtcaccatcccatctgtacttagctatggaattagttacgggcggagaactgtttgataggattatggagcgaggatcttacacagagaaagatgcctcgcatcttgtgggccaggtgctgggggcagtgtcatacctgcatagcctcggtatagtccatagggacctgaaacctgaaaatctgctgtatgcaacgccattcgaggatagtaaaatcatggtgtcggattttggcctctctaagatccaagccggtaacatgctggggactgcctgtggcacacccggatacgcagaaccagtgactttgtccggtatggccgcatgcgtccctgttagggcatctgtgtgcttatggccacctgcaccagaactgctggagcagaagccatacggcaaggccgtggacgtctgggccttgggggtgataagttatatcttgttatgtggctatcctcccttttatgacgaatcagaccccgagcttttttcccaaattctgcgcgcctcctatgagttcgactcacccttttgggacgacatttctgagagtgccaaggactttattagacacctgttggaacgcgacccccaaaaaagattcacatgtcagcaagccttgcgacacctgtggatctccggcgatacagcctttgacagggatatcttgggaagcgttagcgaacagatccgaaagaacttcgcaagaacacactggaaacgggcgtttaatgccacctccttcctgcgacatatcaggaagctcggccagatcccagaaggggaaggggcatccgaacaaggaatggcaaggcacagtcattcaggactgagggcaggacagccccctaagtggtag

SEQ ID NO: 129775 - DNA, 132 bp, Artificial Sequence
  Description of Artificial Sequence: Synthetic coding sequence
atgctccttctgaagaaacacacagaggacatttcatccgtgtatgaaatacgggaaagactcggctccggtgccttcagtgaagtggttctagcccaggagcgggggagtgcacaccttgtcgctctctag

SEQ ID NO: 129776 - DNA, 675 bp, Artificial Sequence
  Description of Artificial Sequence: Synthetic coding sequence
atgttacttctgaagaagcatacagaggatatcagttctgtgtacgagattagggaaagactcggaagcggcgctttttccgaggtggtgcttgcccaggaacgaggttccgcccatttggtggccctgaagtgtatcccgaagaaggctctgcgagggaaagaagccctggtggagaacgagatcgctgtccttaggcgtatatcccacccgaatatcgtggcactggaggacgtacatgagagtccctcacatctttacctggctatggaacttgtgactggtggtgagctcttcgacaggattatggaaaggggaagttacaccgaaaaggacgcctctcacctcgtgggccaagtcctgggcgctgtgtcctatttgcattccctgggtattgtgcaccgggaccttaagcctgaaaaccttctatatgccaccccgtttgaagactcaaaaattatggtgtcagatttcggcctgtctaagatacaggcaggcaacatgctgggaacggcttgcggcacccctggatacgtggccccagaattactggagcagaagccttacgggaaggcagtggacgtctgggccctcggggtgatctcttatattttgctttgcggttatcctcctttttatgatgagtctgaccccgagctattttcccaaatttag

SEQ ID NO: 129777 - DNA, 132 bp, Artificial Sequence
  Description of Artificial Sequence: Synthetic coding sequence
atgctgcttttgaaaaagcatacggaagacattagcagcgtgtacgagatccgagaaaggctaggttccggggccttttctgaagttgtattagcccaggagagaggttctgcccaccttgttgccctgtag

SEQ ID NO: 129778 - DNA, 132 bp, Artificial Sequence
  Description of Artificial Sequence: Synthetic coding sequence
atgctcttgctgaaaaagcacactgaagatatttcaagcgtttacgagatccgagaaaggctcggttccggcgcattctcagaagtcgtattggcgcaggagaggggttcagcacacctggtggctctctag

SEQ ID NO: 129779 - DNA, 261 bp, Artificial Sequence
  Description of Artificial Sequence: Synthetic coding sequence
atgcttctactgaaaaaacacaccgaagacatcagtagtgtctacgagatcagagagcgcctcggcagcggagccttctctgaggttgttctggcacaagagaggggttctgcacacttggtggccctgaagtgtatacctaagaaggctctgcgtgggaaggaagctctagtagaaaacgagattgctgtgttgagaagaatcagtcaccctaatatcgttgccctcgaggatgttcacgaatctccatcccatctgtag

SEQ ID NO: 129780 - DNA, 246 bp, Artificial Sequence
  Description of Artificial Sequence: Synthetic coding sequence
tgaatttcgggtgataccgcattcgatagggacattctgggtagcgtgagtgagcagatcagaaagaatttcgccaggacccactggaagcgggcattcaacgccacttcattcttgcgacacatccggaaactgggtcagatcccagagggagagggagcaagtgagcaaggaatggcccggcactcccattccggcggaccccagggactgagcttcttgcatgggtgctgtgttcttaggtag

SEQ ID NO: 129781 - DNA, 681 bp, Artificial Sequence
  Description of Artificial Sequence: Synthetic coding sequence
atgctcctccttaaaaaacacacagaggatatctcttctgtgtacgagattcgggagcgtctgggctctggcgccttctcggaggttgtcttagcacaggaacggggcagcgcacatttggtcgcgttgaagtgcatcccgaaaaaggcactccgagggaaggaggcccttgtcgagaatgaaatagctgtgttgcgccgcatcagccaccctaacatagttgctttggaagacgtgcacgaaagtcctagccacctgtacctagccatggagttggtaacaggaggcgagctgttcgataggatcatggagagaggctcttacacggaaaaggacgccagccaccttgtgggccaagtgctgggcgccgtttcgtatttacacagtctggggatagtgcacagggatctgaaacccgagaacctcctgtacgccacaccttttgaagactccaagataatggtaagcgactttggcctgtctaagattcaggcagggaacatgctggggactgcttgcgggacacccggctacgttgcccctgagctgctggaacagaagccctatggaaaagcggtggatgtgtgggcgctaggggtcatctcatatatcctcttgtgtggttatcctcctttttacgacgaatccgatcccgagttattcagccaaatactcagatag

SEQ ID NO: 129782 - DNA, 1281 bp, Artificial Sequence
  Description of Artificial Sequence: Synthetic coding sequence
atggaagcagcttttgggcaagtcgccgggtccgcttgccctagaagaggcggagagggtagagactggaaggcggagtcccttgccgatctgtggcccaagtcttctcctggagacagccatcggtggtgtaaggggccgggtgccggcccagccggacctcagctgcgggaggccgcccgcgcatccagcggccttggaggaggagggagacatcccagcagaattccagccattgcactgcaagatatgttgttgctcaagaagcatacagaggacatctcctcggtgtacgagatacgggagaggctaggctctggcgcgttctccgaggtcgtgctcgcgcaggagagaggcagtgcccacctggttgcattgaagtgtattcccaagaaagccctgcgaggaaaagaagctctggttgagaacgagatcgcggtgctgcgccgaatcagtcatccaaacatagtggctctggaagatgtccacgagtctcccagtcacctgtacctagccatggagctggtgactggcggcgagttatttgatcggatcatggaaagggggtcctacactgagaaagacgcttcccacttagtcggacaggtactgggtgccgtgtcttacttgcactctcttggaattgtacaccgggatctgaagcccgagaatctgctgtatgctaccccctttgaagactccaaaatcatggtcagcgattttgggctgagcaagatccaggcagggaatatgttgggtacggcttgtggcacacccgggtatgtggcacctgaactgttagagcagaaaccctatggtaaggcggtcgacgtgtgggccctaggagtcatctcatacatcctgctgtgcggctatccaccgttttatgacgaatcagatccggaacttttctcacagatcctgagagcaagctatgagtttgattcacccttctgggacgatatcagtgaatctgctaaggacttcatcaggcacttgctcgagagggatccacagaagcgtttcacctgtcagcaggctctgcggcacctctggatctccggagatactgcttttgacagggacatcttgggttcagtttctgaacagattcggaagaattttgctagaactcattggaaacgggcttttaatgccacatcgtttctgcggcatattagaaagctgggtcagattccagagggtgagggagcatctgagcagggcatggcaaggcacagccactccggtttgagggccggccagccaccgaaatggtag

SEQ ID NO: 129783 - DNA, 132 bp, Artificial Sequence
  Description of Artificial Sequence: Synthetic coding sequence
atgctccttcttaagaaacatacagaagacatttccagcgtatacgagatacgggagagactgggaagcggcgccttctccgaagtggtcctggctcaggaaagaggttctgctcatctcgtggccttatag

SEQ ID NO: 129784 - DNA, 4884 bp, Artificial Sequence
  Description of Artificial Sequence: Synthetic coding sequence
atgagactttggagttgggttctgcatctcggtctgctgtccgccgccctcgggtgcggcttggcggagaggccacgacgcgcccgtagagacccacgcgcaggcaggcccccgcgacccgcagccgggccagccacctgcgcgactcgagccgccaggggccgaagggccagtccgcccccaccacccccccccgggggagcctgggaagcggtccgagtgccacgacgtcgacaacagagggaagccagaggggccacagaagagcctagtccaccatcgcgagctctgtattttagcgggcgcggtgaacagttgaggctgagggccgatctcgagttacctagagatgcctttactctgcaggtgtggttgcgcgcagaaggcgggcagcggtcacccgctgttattacaggcctatatgataaatgctcctacattagcagggataggggctgggtggtggggattcacacgatctccgatcaagataataaagacccaagatatttttttagcttgaaaactgacagagccaggcaagtaacaactatcaacgcccatcggtcctacctaccaggacagtgggtctatctcgccgctacatacgacgggcagtttatgaagttatacgtaaatggggcccaggtggccacctccggcgagcaggttggtgggatcttttcccccctgactcaaaagtgcaaggtgctgatgttaggggggtctgccttaaaccacaattacagaggctatattgagcactttagcttatggaaagtggcaagaactcagagagaaattctatctgatatggagactcacggcgcacacacagctctgccccaacttctgctgcaggaaaattgggataatgttaagcacgcttggagcccgatgaaggacggctcctcccccaaggtggagttctctaacgcccacggattcttactggataccagcctggaaccaccgctatgcggccagaccttgtgtgacaatactgaggtgatcgcatcctataatcagctgagctcatttcggcagcctaaggtcgtgcgctatcgggtagtgaatctctatgaggatgatcataaaaatccgactgtgacaagagagcaggtagattttcaacatcaccagctggccgaagccttcaagcagtacaatatcagctgggagctggacgtcctcgaggtctctaatagttcccttcgcagacggctcatcctggccaattgtgatatctcaaagataggcgacgaaaattgtgaccccgagtgtaaccacacacttacgggccatgacggtggagattgtcgtcacctgaggcaccctgcatttgtgaaaaaacaacataacggggtgtgtgacatggattgtaattatgagaggtttaactttgacgggggcgaatgttgcgaccccgaaatcaccaacgtcacccagacatgctttgatcctgacagtccgcaccgcgcctatctcgatgtcaatgagctcaagaatattctaaagctggatggctctacacacctgaatatattctttgctaaatcgtcggaggaggagttagcaggagttgctacttggccatgggacaaggaggcattaatgcatttaggcggcatcgtgctgaacccttctttttacggaatgccaggacatacccataccatgatccatgagattggacatagtctggggctctaccatgtctttcgaggcatcagtgaaattcagagttgctccgacccttgcatggagactgaaccatcatttgagaccggtgatctgtgcaatgacaccaatcccgctcctaagcacaagagctgcggcgaccccggtcctggaaacgacacttgcggttttcatagcttctttaataccccatacaataatttcatgagctacgctgacgacgactgtacagactcattcacacctaatcaagttgcccgcatgcactgctacctcgatctcgtgtatcagggttggcagccgagccggaagccagcccccgtcgcgctcgcaccccaagtgctgggacatacgacagatagcgtcaccctcgagtggttccctccaatcgatggccattttttcgaacgtgagctcggctccgcctgccatctctgtctggaaggtcgtatcctcgttcaatacgcgagcaacgcctcatctccgatgccgtgctcaccttcggggcattggtccccccgggaggccgaaggtcatccggatgtggagcaaccatgcaagtcttccgtgcggacatggtctccgaattctgctgttaatccacatacagtgccacccgcttgccccgagccacaaggctgctatctggagctagagttcctctaccccctggtacccgagtctcttaccatatgggtaactttcgtgagtacagactgggacagctccggcgccgtcaacgacatcaagctcctcgctgtttccggaaaaaatatcagcctgggcccccagaacgtcttttgtgatgtgccccttactattcgcctgtgggatgtcggcgaggaggtttacggcatccagatttatacactggacgagcacctggagatcgatgcagctatgctgactagtaccgccgatactccactttgcctacagtgcaagcccctgaagtacaaggtggtgagggatccaccactgcaaatggacgtggcatctattctgcaccttaaccggaaattcgtggatatggacctcaacctcggatccgtgtatcaatactgggtgattacgatctcggggactgaagagtccgaaccttcgcctgcagttacatacattcacgggagcggctactgtggcgatggcattatccaaaaagaccagggggagcaatgtgacgatatgaacaaaattaatggggacggctgcagcctgttctgcagacaagaagtgagctttaattgcatcgacgaaccatcaaggtgttacttccacgacggcgatggagtctgcgaggagtttgaacagaaaacaagcattaaagactgcggcgtttacacgccacagggatttctcgatcaatgggcttctaacgcctctgtgtcccatcaggatcagcagtgtcctggatgggtgattatcggccagcccgcagcttcacaggtctgcagaacgaaagttatcgacctgagcgaggggatctctcagcatgcttggtatccctgtaccattagctatccctattcccaactggctcagactacgttttggctcagggcctattttagccagcctatggtcgccgcagccgtgatcgttcatctggtgacagacgggacttactatggagatcaaaaacaggagaccatcagcgtccagcttcttgacaccaaggaccagtctcacgacctgggcctccacgtgctgtcttgccgcaacaatcctctcattatcccagttgttcacgatttatcccagcctttctaccactcacaggcagtcagggtaagcttcagctctccattagttgccatctcaggggtggcgctgcggtctttcgataatttcgatcccgtgactctctcctcctgccaaagaggagaaacctactcccccgcggagcaatcttgtgtccactttgcctgcgaaaagaccgattgtccagaactcgctgtcgaaaacgcatctcttaactgctcaagcagtgaccggtaccacggtgcccagtgtaccgtgtcctgcagaaccgggtatgtcctccagatccggcgagatgatgagctgataaaaagtcagacaggcccttcggttaccgttacatgcacagaggggaaatggaataaacaggtggcctgcgagcctgtggattgttctatccctgatcaccatcaggtttacgcggctagcttttcttgcccggagggcacgacctttgggtctcagtgtagttttcaatgtaggcaccccgcccagttaaaaggcaataatagcctactgacttgcatggaggacgggctgtggagcttcccagaggcactctgtgagctgatgtgcctcgcaccacctcctgtgcctaacgccgatttgcaaacagctcgctgccgggaaaacaagcataaagtgggcagcttctgcaagtataagtgcaagccagggtaccacgtgcctgggagctctcggaagagtaaaaagcgtgcctttaagacccaatgtacccaggacggcagctggcaggagggggcatgtgttcctgtgacctgtgatcctccccctcctaagttccatggtctctatcagtgtacaaacggctttcaatttaactcagaatgcagaatcaaatgcgaagattctgatgccagccaagggctgggatctaacgtcatccactgccggaaggacgggacttggaacggctcatttcatgtctgtcaggaaatgcagggacaatgctcggtcccgaacgagctgaattccaacctaaagttacagtgccccgatgggtacgcgataggctccgagtgcgcaacttcctgtttggaccataactctgaaagtataattctgcctatgaatgtgacggtaagagatataccacactggctgaacccaacgagggtagagagggtcgtttgtacggcggggttaaaatggtatccacaccctgccctgatccattgtgtgaagggttgtgagccgttcatgggggacaactactgcgacgccatcaataatcgcgcattctgtaactacgatggtggagactgttgtacttctacagtgaagaccaaaaaagttacccctttccctatgagctgcgacctccagggcgattgtgcctgccgcgaccctcaggcccaggagcacagtcgaaaggacctgaggggttacagccacggctag

SEQ ID NO: 129785 - DNA, 1701 bp, Artificial Sequence
  Description of Artificial Sequence: Synthetic coding sequence
atggattgcaactacgagagattcaatttcgacggcggagagtgctgtgacccggagattacaaatgtgactcagacttgtttcgatccagatagcccccatcgcgcatacctagacgtgaacgagttgaagaatattctcaaactggacggcagcacgcacctgaacatcttttttgcgaagtcatcagaagaggaattagcaggggtcgccacctggccttgggataaagaagctctcatgcacctggatgatgactgtactgacagcttcacacccaatcaggtcgcccgcatgcattgttatttggacctagtctaccagggatggcagccatcccgcaagcctgccccagttgcattggctccccaagttttaggccatacaaccgactcggtgacacttgagtggttccctcctattgacgggcatttttttgaaagggagctcggctctgcctgccatctgtgtctggagggtaggattttagtccagtacgcttctaacgccagctcacccatgccatgctctccctctggtcattggagccctagagaggctgagggtcatcccgatgtcgagcagccctgtaagtcttcagtacggacatggtcaccaaactccgccgtcaaccctcacacagttccacctgcttgccccgaaccacagggatgttatctcgaacttgagttcctgtaccccctcgtgcccgagagcctgaccatatgggtgacctttgtgtcgacagattgggacagtagcggggcagtcaacgacattaaactccttgctgtgtccggtaaaaacatcagtttaggccctcagaacgtgttttgcgacgtgccgctgactatcaggctctgggatgttggagaggaggtttatgggattcagatatataccctggatgagcacctggaaatcgacgcagccatgctgaccagcacagcagatactcctctgtgtcttcagtgcaagcctctgaagtacaaggtggtcagggatcccccgctccagatggatgtggcgagtatcctccacttaaatcggaaattcgtggatatggatcttaacctaggatcggtgtaccagtattgggtcattactattagcggcactgaggaaagcgaaccatctcctgcagtaacgtacatacacggcagcggttactgtggggatggcatcatacagaaggatcaaggagaacaatgcgacgacatgaataagattaatggggacgggtgtagcttgttctgtcgccaggaggtttcgttcaactgcattgatgaaccctcaaggtgctactttcacgacggggacggcgtgtgtgaggaattcgagcaaaagacttctattaaggattgcggcgtgtatactccgcagggcttcctggatcagtgggcctcaaatgcttccgtgtctcaccaggaccagcagtgtcccgggtgggtaatcatcggtcagccagcagcctcccaagtctgtcgtactaaagtcatcgatctgagcgagggcatctccgcctgcctggttccattgcatcaccagctgcccatctttccggcggggtcagatcatttcctggccccaggggtcttttttagtacgaacggctgcagaagctgccattgccctcccggagatgggtgggacattctttggggacctaaggcaggcgatcatcaacgcgcggctgcctag

SEQ ID NO: 129786 - DNA, 1998 bp, Artificial Sequence
  Description of Artificial Sequence: Synthetic coding sequence
atgaacaaaataaacggcgatggatgttctctgttttgtcgtcaggaggtttccttcaattgcatcgacgaaccgtcccgctgttatttccatgacggagatggcgtttgcgaggagttcgagcagaaaaccagcatcaaagactgcggtgtctacaccccacagggctttctggaccagtgggccagtaacgcatcagtcagccatcaggaccaacagtgcccagggtgggtaattattggccagccagcagccagtcaagtgtgccgcacaaaagtgatagatttatcagaagggataagtcaacatgcgtggtatccctgcactatcagttacccgtacagccagctggcccagactacattttggcttcgggcctatttctcacagcctatggtggcagccgccgttatcgtccacctggtcaccgacggaacctactacggggatcagaagcaggaaacaatctctgtccagctgctagatacaaaggatcagtcccatgacttgggtctccacgtcctgagctgccgcaacaatccactcataattcctgtggttcacgatctttctcaaccgttttaccactctcaggccgtacgcgtctcttttagctccccactcgtagccatttctggcgtggctcttaggtcattcgacaacttcgacccagtgacactcagctcttgtcagcggggggagacctactcccctgcggagcaatcatgcgtgcacttcgcttgtgagaaaaccgattgcccagagctcgcggttgagaacgcctcgctcaactgctcttcctcggatcgctaccatggggcccagtgtacagtttcgtgcagaactggctacgtgctgcagatcagacgggatgatgagctcatcaaatcccaaaccgggccctccgtgactgtaacttgcactgaaggaaaatggaataaacaggtcgcctgcgagcctgtcgattgttctatccctgaccaccaccaggtgtatgccgcatcgtttagctgtcctgagggaactacctttggatctcagtgttctttccagtgtcgccaccccgcccaactcaaaggcaataattccctcctgacttgcatggaagatggtctttggtccttcccggaggcgctgtgtgagctcatgtgccttgcgcctccacccgtgcctaatgccgacttgcagaccgctcgatgtcgcgaaaataagcacaaggtcggatcgttctgcaagtacaagtgtaaaccaggatatcatgtgcccgggtccagccgcaagtccaagaagcgagccttcaaaacccaatgtacccaagatggaagctggcaggagggtgcatgtgttcctgtcacctgcgacccccccccaccaaagttccatggtctctatcagtgcactaatggcttccagttcaacagtgagtgtcggataaagtgcgaagactctgatgcatcccaggggctggggagcaacgtgatccactgccgaaaagatggaacttggaacggcagctttcatgtgtgccaggagatgcaagggcagtgcagtgttccaaatgaacttaatagcaacctcaaactgcaatgccctgacgggtatgcaattggctctgaatgcgcgacgagctgtctggatcataactccgaatccatcattctccccatgaatgtgactgtgcgcgatatccctcattggctgaaccctaccagggtggagcgggttgtgtgtacagccggcttaaaatggtatccccatcccgcattaattcactgtgtcaagggctgtgaaccttttatgggcgacaattactgtgacgcgatcaataacagggctttttgcaattatgatggtggagattgttgcacatccaccgtcaaaactaaaaaagtgacaccattccccatgagctgtgacttacaaggtgactgcgcctgccgggatccccaggcccaagagcactcccggaaggacctcagaggatactctcacggctag

SEQ ID NO: 129787 - DNA, 4449 bp, Artificial Sequence
  Description of Artificial Sequence: Synthetic coding sequence
atgcgtaaggaccggctgctacatctctgcctggtgctactgcttattctcctcagcgcctctgattcaaattcaacggaaccacagtatatggtgctggtgcccagcttattacataccgaagctccaaagaagggctgcgtgttgctgtctcacttaaatgagactgtgacagtgtccgcctctctcgaatcagggcgtgagaaccgttcacttttcactgacttagtggcagaaaaagacctcttccactgcgtcagtttcactctgccccggataagtgcgtcctctgaggtcgctttcctctcaattcaaattaagggtcccactcaggactttaggaagaggaatactgtcttagtcctgaacacacagagccttgtgttcgttcagacagataagccaatgtacaagcctggccaaacagtgagatttcgggtggtaagcgtcgacgagaactttcgcccgcgcaatgagcttatcccattgatctacctggagaatccaaggaggaacaggatcgcacagtggcagtccctgaaactggaggcgggtatcaatcaactcagttttcctttgtcaagcgaacccatccaggggagctacagggtggtggtccagacagagagcggagggcgtatccagcacccctttactgtggaggaatttgttctccctaaatttgaggttaaggtccaggtccctaagatcatctccatcatggacgagaaagttaatataaccgtgtgcggtgagtacacttacggaaagccagtgcccggcctagctaccgtgtccctgtgccggaaactgtctcgagtgttgaattgcgataagcaggaagtatgtgaggaattcagccagcagttgaactccaatggatgcattacacagcaggtacatacaaagatgctccagataaccaataccggcttcgagatgaaattgcgggtggaggcacgaatcagagaggagggtaccgatctggaagtcactgcgaaccgcattagcgagatcactaacattgtgagtaaactgaaattcgtgaaggtggacagccacttcaggcaaggcattccctttttcgcccaggtgctgctggtagatggcaagggcgtgcccatcccaaataagctattcttcattagcgtgaacgacgcaaactactattcaaatgcgaccaccaacgagcagggcttagcccagttctccattaacaccaccagcatttccgtgaacaagctgtttgtgcgcgttttcacagtgcatccaaacctgtgctttcactatagctgggttgctgaagaccaccagggcgcacaacatactgccaatagagtgttctcactttcaggtagctacatccaccttgaacctgttgcaggaacactgccttgtggacacacggaaactattaccgcccactacaccttaaacaggcaagccatgggggagttatcagagttatcttttcactatctgataatggcaaagggagtgatagttagatctggcacccatacactgccggtcgagtctggtgatatgaaaggctctttcgctttgtcttttcctgttgagagtgacgtggcccctatcgcaagaatgttcatttttgcaatactgccagacggcgaggtggtgggcgattctgagaaatttgagattgaaaactgcctcgccaacaaagtcgatctctcattctcacccgcccagtctcctcccgcatcacatgcccatctacaggtggcagccgcgccgcaatcactctgtgcgctgcgggctgtggaccaatccgtcctgttgatgaagcccgaagccgaactgtcagtaagtagcgtctacaacttgctcactgtgaaagacctcactaattttcccgataatgtagaccagcaggaagaagaacagggtcactgccctcgcccgttctttatccacaatggcgctatctatgtgcccttgagctcgaatgaggctgacatatacagttttttgaaaggcatgggcctaaaagttttcaccaatagtaaaatccgaaagccaaaaagttgtagcgtcattccaagcgtctccgccggcgctgtcggacaggggtactatggtgccggactgggcgtggtggagcgcccctatgtaccccagcttgggacatataatgtaatcccactgaataacgagcaatcaagtgggcctgtccctgagacagtccgttcgtatttccctgagacttggatctgggagttggtggctgtgaatagcagtggcgtggctgaggtaggcgtgactgtccccgacacgattaccgagtggaaagccggcgcattctgtctgagcgaggatgctggcctgggcatatcaagcactgctagtctaagagcctttcagccttttttcgtcgagctcacaatgccctattccgtgatacggggcgaagttttcactctgaaggcaacagtcctaaattatctgccaaaatgcatacgagtcagcgtgcagctgaaggcctcccccgctttcctggcctcgcagaacaccaagggcgaggagtcttattgtatttgtgggaacgagagacagaccctgtcatggaccgttacaccaaagaccctgggaaacgtgaatttctccgtcagtgccgaggctatgcagtccctagagttgtgtgggaatgaagtggtagaggtccctgaaatcaagcgaaaagatactgtgatcaagacgctcttggtggaagcagaaggaatcgagcaggagaaaaccttttcgagtatgacatgtgcgtcaggcgctaatgtgtccgagcaactgtctctgaagctgccaagtaatgtggtgaaagagagcgcccgggccagctttagcgtgctgggagatatcctagggtcagccatgcaaaatatacagaacctgctacaaatgccgtacggctgtggggagcagaacatggtcctgttcgctccaaatatctatgttctgaactatttgaacgaaacacaacagctcacccaagagatcaaggccaaggccgtcgggtatctgattaccggctaccagaggcagctgaactataagcaccaggatggtagttatagcaccttcggcgaaagatacggcagaaatcagggaaatacatggctcacagccttcgtgctgaagacctttgctcaggcaagaagctacattttcattgatgaggctcacatcactcagtctctgacatggctctcacagatgcaaaaagataatgggtgctttaggagctccgggtcccttctgaataacgctataaaagggggtgttgaagacgaggcaaccttgtcagcatatgtcacaatagcactcctagaaataccattgccagtaacgaatccaatcgtgcggaatgccttattttgtctggaatctgcttggaatgttgctaaggaggggacccatgggagccacgtttatactaaagctctcttggcgtatgcattcagcctgctggggaagcaaaatcagaacagggaaatcctgaactccttggacaaggaagcagtaaaggaggataatttggtgcactgggaacggccccagcgcccgaaggcacccgtgggacacctctaccaaacccaggcgccctcggctgaagttgagatgacaagctatgtgctgctggcttatttaacagcccagccagccccaacctccggggatttgacctcggcaaccaatatcgtgaagtggattatgaaacaacagaacgcccagggagggttttccagtacccaggatactgtcgtggcgctccacgccctctcccgctatggggctgctacttttacgaggacagaaaaaactgcacaggtaaccgtccaggattcacagacattctctactaacttccaggtcgacaacaacaacctccttctcctgcagcaaatttctttgcccgaactacctggagagtatgtcatcaccgtaaccggggagcgatgcgtgtatctacaaacatctatgaaatacaatattctccccgaaaaagaagattcaccattcgcactgaaagtccagactgtacctcaaacttgtgacggacataaagctcacacgagcttccagatttcactgacaatcagttatactggcaaccgccccgcttctaacatggtcattgtggatgtgaaaatggtgtccggctttatcccactgaagcccactgtcaagatgcttgaaaggtcttcttcagtctcaaggactgaagtgagcaataaccacgtcctcatctacgtcgagcaggtgactaatcagaccctttctttctcttttatggtcctccaggatatacctgtcggtgatctcaaacccgccattgtgaaggtttatgactattacgaaactgacgagtctgtggtagccgagtacatcgcgccctgcagcacagacaccgagcatggaaatgtatag

SEQ ID NO: 129788 - DNA, 3807 bp, Artificial Sequence
  Description of Artificial Sequence: Synthetic coding sequence
atgtctgaaagctaccgcagaacaacattcccagtcaggtttcgtgtcgtcagcgtggatgagaacttcaggccacggaacgaactgatcccgctgatttatcttgagaacccaaggagaaaccggattgctcagtggcagtccctgaaattggaggctggcatcaaccagcttagttttcccctgagctctgaacctatccaaggtagttaccgcgttgtggtccaaaccgagtcaggtggtagaatccagcacccattcactgtggaagagttcgttctgcccaagtttgaggtgaaagttcaggtgccgaaaattatcagtattatggatgaaaaggtgaacatcaccgtctgcggcgagtatacctacgggaagcccgtgcccggtctggcaaccgtgagcctgtgccgcaaactgtcccgggtcctgaactgcgacaagcaggaggtatgtgaggagttcagtcagcagcttaacagcaatggatgtattacacagcaggttcacactaagatgttgcagatcactaacaccggctttgagatgaagttgcgcgtcgaggccagaataagggaggagggaaccgacctcgaggtgacagcaaatagaatatctgagatcaccaatatcgtgtccaaactcaagttcgtcaaggtggatagtcacttcaggcaaggcattcctttcttcgcacaggtgctccttgttgatgggaagggagttccaattccaaacaagttgttttttatttcggttaacgatgcaaactactacagtaacgctaccacgaacgaacaaggcctggcccagttttctatcaacaccacaagcatttcggtgaataagctcttcgtgcgggtcttcactgtccaccccaacctgtgcttccattattcatgggtcgcagaagaccaccagggcgctcagcacacagccaatagggttttctccctgagtggaagttacatacacctggagcccgtagcaggtactcttccttgcggacataccgagaccataaccgcgcactatactctgaacagacaggctatgggagagctctctgagttatcctttcattatctgattatggctaagggcgtgatcgtccgctctgggacccatacactgcctgtggagtctggcgacatgaaagggtcctttgccctgagttttccggtggagtcagatgtcgctcccatagccaggatgtttatcttcgcaatcctgcccgatggggaggtggttggggacagcgaaaagtttgaaatcgagaattgcctggccaacaaagttgacctgtccttttcccctgcccagagcccccccgccagccacgcccacctgcaggtggcagccgcaccccaatccctctgcgctttgcgtgccgtggaccaatctgtcctgttgatgaagcccgaagccgagctgtcagtgtcatctgtatacaacctcctgacggtgaaggatctcaccaacttcccggataacgtggaccagcaggaggaagaacagggacactgcccaagaccgttttttatacataatggagcaatttacgtgcctctttcttcgaatgaagcagacatttactcattcctcaagggaatgggactgaaggtctttaccaattccaaaatccggaagcccaagagctgtagcgtgattccctccgtgagtgccggggccgtcggccagggatattacggagctggcctgggtgtcgtcgaaaggccatacgtcccgcaattaggcacctacaatgtcatcccgctaaacaatgaacagtcgtccggacctgtgcctgaaaccgtgagatcttacttcccagagacctggatatgggaactggttgcggtcaattcatcgggggtggctgaggtgggggtgaccgtgcccgacacgatcaccgaatggaaggctggcgccttctgcctttcagaagacgctggcctcggaattagctccactgcttccttacgcgccttccaaccctttttcgtggagctgacgatgccgtactcggtaatccgaggcgaggtctttaccctcaaagccacagtgttaaattacctgcccaagtgcataagggccgagggaattgaacaagaaaagactttttcctcaatgacatgcgcctctggggccaatgttagtgaacagctgagcctgaagctaccctctaatgtggtgaaagagtcagctagagcgagcttttctgtgctaggcgacattttggggtccgctatgcaaaacatccaaaacctgctgcaaatgccctacggctgtggggaacagaacatggtactgttcgcacctaatatttatgttctgaactacttaaatgagacccaacaactaacacaggagataaaggcgaaagctgttggatatctcataactggataccagcggcagcttaattacaaacatcaagatggctcctactccacattcggagagaggtacggcaggaaccagggcaacacttggttgaccgcctttgtgctgaaaactttcgcacaggccagaagttatatatttattgacgaagcccacattacccagagcctgacctggctcagccagatgcagaaggacaacggctgctttagatcctccggatctcttttaaataacgcaataaagggcggcgtggaggatgaggccaccctctcagcgtatgtgactatcgctctgctggaaatccctctccccgtgactaatcctatcgttcggaatgctctcttttgtcttgaaagtgcgtggaatgttgccaaggaggggacccacggctcacatgtgtatactaaagcacttttggcctacgccttttccctccttgggaaacagaaccagaacagagagatcctaaattctctggataaggaggccgtaaaggaggataatttggtacattgggagcgcccacagagacctaaggcgcccgtaggtcatctataccaaacacaggctccatcagccgaagtggaaatgacgtcttatgtcctgctcgcgtatctgacagctcagccagcaccaacaagcggtgacctgacaagtgctactaacatcgtgaagtggataatgaagcaacagaacgctcagggtggatttagcagcacacaagacactgtcgtggcactccatgcattgtctagatacggcgccgccacatttactagaacagagaaaactgcacaagtgacagtgcaagattcacaaacattcagcacaaactttcaggtggataataataaccttctgctgttgcagcagatcagcctacctgagctccccggcgagtatgtgattactgttaccggtgagaggtgcgtgtacctccagaccagcatgaagtataatattcttccagagaaagaggacagcccctttgcgcttaaagtgcaaaccgtaccccaaacttgtgatggccacaaagcccacacatcctttcaaatctcgttgactatatcatacaccggcaacaggccagcttctaacatggtgatcgtcgacgtaaaaatggtgtctgggtttataccgctgaaacccacagtgaagatgttagagcggtcttcatctgtgtcgcgcactgaggtgtctaacaatcacgtgctaatctacgtcgagcaggtgaccaatcaaaccctcagcttctcctttatggtgctgcaagacatccccgttggggatctgaaacctgccatagttaaggtgtacgactactacgaaacagacgaaagcgtggttgcagagtacatcgccccatgtagcaccgacaccgagcacggcaacgtctag

SEQ ID NO: 129789 - DNA, 660 bp, Artificial Sequence
  Description of Artificial Sequence: Synthetic coding sequence
atggttaagtatttcctagggcagagcgtgctccgctcttcatgggaccaggtgtttgctgccttttggcagcgttaccctaacccctactcaaagcatgtcctgacagaggatatcgttcatagggaggtgacaccagaccagaagcttctctcacgacgcttgctcaccaaaacaaacagaatgccaagatgggcggagagactgttccccgctaacgtggcccacagcgtctacgtacttgaagactcaatcgtggatccacagaaccagactatgactacctttacttggaacatcaaccacgccagacttatggttgttgaggaacggtgtgtctactgcgtgaactctgataattcgggttggacggaaatcaggcgtgaggcatgggtgagcagcagcctcttcggggtgtctagggctgtacaggagtttggacttgccagattcaaaagcaacgtaacaaagactatgaaggggttcgagtacatattggcaaaactgcagggggaagcccctagcaagactcttgtggagaccgcaaaggaagcgaaggaaaaggctaaggagaccgccctggcagcaactgagaaggctaaagatctggcaagcaaagccgccactaaaaagcagcagcagcagcagcaattcgtgtag

SEQ ID NO: 129790 - DNA, 1770 bp, Artificial Sequence
  Description of Artificial Sequence: Synthetic coding sequence
atgagttctagttattggagtgagactagcagtagcagttgtggcacccagcagctgccagaggtgctacagtgccaaccccagcattaccactgctaccaccagtctagtcaggcccagcagcctcctgagaagaacgtagtatacgaacgagttcgcacatatagcggacccatgaacaaggttgtacaggctctggatccatttaactcacgggaggtcctcagcccattgaaaacaacttcaagctaccaaaaccttgtttggtccgatcacagccaggaactacacagcccaactctgaaaatctccacctgcgcgcctagcaccttgcacattacacaaaataccgagcaggaactgcattcgccaaccgtcaagctgacaacatatccacagacaaccatcagaaaatacgtggttcagaacccagagcaggaacccctctcccaattcctgagagggtcacacttttttcccgggaacaatgttatttacgagaagacaatcagaaaggtcgagaagctaaataccgatcagggctgccaccctcaagcgcaatgtcaccaccacattatccagcagccgcaggttattcactccgcgcactggcagcaacctgattcaagccagcagatacaggccatcacagggaataaccctattagcacacatattggaaacgagctgtgtcactctggctcgagccagatttgtgagcaggtgatcattcaagatgatggcccagagaaactggatcctcgatattttggcgagctgctggcggacctcagtcgcaaaaacactgacctctatcattgcctgctggagcacttacagagaatcgggggatcaaaacaggacttcgaaagcactgatgagtccgaggacatcgagagcctcattccaaaggggctgagcgaatttacaaaacagcagattagatatattctgcaaatgagaggcatgtccgacaagtccctgcgtctggtcctcagcactttctctaatattagagaggagttgggacacttgcagaacgacatgacatcccttgagaatgacaagatgcggcttgagaaagatctgagcttcaaggacacgcagctcaaagagtacgaagaattactcgcctcagttcgagccaacaaccaccagcagcaacagggacttcaggacagttcatccaagtgtcaggccctcgaagagaataacttgtcacttagacacacgctgtccgatatggagtatcgcctaaaggaactcgaatactgtaagcgcaacctggagcaggagaaccaaaatctgcgcatgcaagtgagcgagacatgcaccggcccaatgctgcaggccaaaatggatgaaattggcaatcactacaccgagatggtaaagaacctgcgcatggagaaggatcgtgagatttgtaggctccgctcacagcttaatcagtaccataaagacgttagtaagcgggaaggctcctgttctgattttcaattcaagcttcacgaacttaccagcctgctcgaggagaaggattcccttatcaaacggcaaagcgaggagctgtcaaagcttagacaggagatctatagttcccataaccagcctagcacgggcggcaggacaaccatcactactaagaaatatcggacacaatacccaatactgggcctactctacgacgactatgaatatatccccccaggatccgagactcaaactatagtcatcgagaagactgaagataagtatacttgtccatag

SEQ ID NO: 129791 - DNA, 921 bp, Artificial Sequence
  Description of Artificial Sequence: Synthetic coding sequence
atgtctagctcttattggtcagaaacatctagcagttcttgcggcacacagcaactgcctgaggtcctccagtgtcagccacagcactatcactgctaccatcaaagttcacaagctcagcagcctccggaaaaaaatgtggtttatgaaagggtgagaacatattccgggcccatgaataaggtagtgcaggcccttgacccattcaacagccgagaagtgttgagccctctcaagaccaccagttcttaccaaaacctggtgtggagcgatcactcgcaagagctccattcgcccactctgaagatttccacctgtgccccctctacattgcacataacgcagaacacagagcaagagctgcattctcctaccgtcaaactcactacctacccacagacaactatcaggaagtacgtagtccagaatcctgaacaggaacccctcagccaattcctgagaggctcacacttctttccaggcaataatgtgatttatgagaagaccattcgcaaagtggaaaaactgaacacggatcaagggtgccatcctcaagcccaatgccaccaccatattatacagcaaccccaggtgattcactctgcacactggcaacagcctgacagcagtcagcagattcaggcaattacgggaaacaacccaatctcgacacacataggcaatgagctgtgccattccggttcatctcagatatgcgagcaagttatcatccaggacgacggcccggagaaactggacccccgatatttcggtgaactgctggctgacctgtctcgcaaaaataccgacctctaccactgcctgctggaacacctccagcgtattgggcgcaaacagtccttgagctctacctacaccattaggcacggaattcagacaaaaagaaccgggatattatag

SEQ ID NO: 129792 - DNA, 1788 bp, Artificial Sequence
  Description of Artificial Sequence: Synthetic coding sequence
atgagtagttcctattggtcagagacttcttcctcaagctgtggaacccagcagttacctgaggtgcttcaatgccagcctcagcactaccactgctaccaccaaagctctcaagctcagcagccacctgaaaagaatgtagtctatgagcgagtgagaacttatagcggccccatgaacaaggttgtacaagcgctcgatcctttcaatagtcgtgaagtgctctccccactgaaaacaacttcgagctaccaaaatttggtatggtcggaccacagccaagagttgcactctcctacccttaagatcagtacatgtgccccctcgaccctccatataacccaaaatactgaacaggaattgcactccccaaccgttaagcttactacatacccacaaaccactatccgcaagtatgtggttcagaatcctgagcaggagccattgtcgcagtttctcagaggcagtcatttttttcccggcaacaacgtcatctatgagaaaaccatccgtaaggtggagaagttgaacacagatcaaggctgtcatcctcaggcccaatgtcatcatcacatcatccagcagcctcaggttatacactccgcgcactggcagcagcccgattcaagccagcaaatccaggcaattacaggcaacaacccaattagtactcacatcggtaatgagctctgtcatagcggatccagccagatctgtgagcaggttatcattcaggacgacggaccagagaagctcgatccccggtacttcggtgaactgctagcagatctttcaagaaagaacacagatctttaccattgcctccttgagcacctgcagaggattgggggctcaaagcaggattttgagtccaccgacgagagtgaggacattgaatctctcatccccaagggccttagcgaatttacaaagcagcagattaggtatattcttcagatgcgtgggatgagcgacaaaagcttgcggctggttctgtctaccttctcgaatatccgtgaggaactcgggcatctccagaatgatatgacgtccctggaaaatgacaaaatgcggctcgagaaagacctgagctttaaggatacacaactgaaagagtacgaggagctgttggcgtctgtgagggcgaataatcatcagcaacaacagggattgcaggactccagttccaagtgccaggccttggaggagaacaatttgagcctcaggcatactctctccgacatggagtacagactcaaagagctagagtactgtaagcgaaaccttgaacaggaaaaccagaatcttaggatgcaggtatcagagacttgcactggtccaatgctccaagccaagatggacgagattggcaatcactataccgagatggtaaaaaatctgcggatggaaaaggatcgtgagatctgcaggttgagatcacaactcaatcagtatcacaaggacgtgtccaagcgagaggggtcgtgttcggacttccaattcaagctccacgaactaacatcattgttagaagagaaggattctttgattaagcgccagtctgaagaactaagcaagttacggcaggaaatttactcttcccacaaccagcccagtacaggaggacgcaccaccattacaacaaagaaatatcggactcagtatcctattctcggacttctatacgatgactacgagtatataccccccgggagcgagactcagactatagtgattgagaagacagaggataaatacacttgcgtgagctcactcggtcacttttag

SEQ ID NO: 129793 - DNA, 921 bp, Artificial Sequence
  Description of Artificial Sequence: Synthetic coding sequence
atggcatctaggtggtggcggtggaggcgcggctgttcttggaaacccgcagccaggtctccgggacctgggtctccgggcagggcaggtcccctaggcccttccgctgccgctgaggtgagagcccaggttcaccgccgcaaaggccttgatctgagccagattccctatataaatcttgtgaagcaccttaccagcgcttgtcccaatgtttgtcgtatcagtcgcttccatcacaccacccctgattccaagacgcacagcggcgaaaagtatactgatcctttcaaattagggtggagggacctgaagggcctctatgaggacataagaaaggaactgctgatctcaacgtccgagctgaaggaaatgtctgagtattatttcgatggaaagggcaaagcattcaggccaattatcgttgcccttatggctcgggcctgcaacatccatcacaacaactctaggcatgttcaagcctctcagcgagccatagctcttattgcggaaatgattcatacggcttccctcgtgcatgatgacgttattgacgatgcttcctcaagaagaggcaagcacaccgttaataaaatctggggcgaaaaaaaggcggtcttagccggagacctgattctaagcgctgccagcattgctcttgccaggatcggcaacactacagttatctcaatcctcactcaggttattgaagacctggtccggggcgagttcttgcaattgggttcaaaggagaatgaaaacgaaagattcgctcactacctggaaaagacctttaaaaaaaccgcctctctgattgcaaatagttgtaaggcggtctttccaaggaatgaatgctacgatcacgccactgtccagttcgcgtggcggtgtcgacaatcaagcaccgtgtgtacgactgaatag

SEQ ID NO: 129794 - DNA, 1248 bp, Artificial Sequence
  Description of Artificial Sequence: Synthetic coding sequence
atggcctcacgctggtggcgctggagacgggggtgctcttggaagccagccgcacgttcaccaggacccggctcacccggcagggcggggcctttggggcccagcgccgcagcagaagtccgcgcccaagtgcatcgacgcaaggggttagatttgagccaaatcccttacatcaaccttgtgaaacatctgaccagtgcctgtccaaacgtctgccgtatctccaggttccatcacacaacacccgactctaaaacccactcaggcgaaaagtacaccgacccgttcaagctgggttggagggacctgaaaggtctttacgaagatattaggaaggaattgctcatcagcactagcgaactcaaggagatgtccgaatactactttgatggtaaggggaaggcttttagacctatcattgtggcccttatggcaagggcatgtaatatacaccacaacaactctcgtcatgtacaggcctctcaacgcgctattgctctgatcgctgaaatgatccacaccgcctctctggtgcatgacgacgtgattgacgatgcaagctcacgccgaggcaagcacaccgtgaacaagatttggggcgagaaaaaggccgtgcttgccggagatcttatactatcagcagcatcaatcgcccttgcaagaatcggtaatactacagtgattagcatcctcacccaggtcattgaggatctggtgcgcggcgaatttctgcagcttggctccaaggaaaatgaaaatgaacgattcgcccattatctcgaaaagactttcaaaaaaacagcctcattaattgcaaatagctgtaaagctgttagcgtgctgggctgcccagaccccgttgtccacgagatcgcgtaccagtatggaaagaacgttggcattgcattccagctgatcgatgacgtgctggactttaccagctgctccgatcagatggggaagccaacctctgccgatctgaaactaggtctcgccacggggcctgtgctgtttgcatgtcagcagttccctgagatgaatgcgatgattatgagacgtttcagcttaccaggggacgttgatcgagcacgccaatacgtgctacagagtgatggcgtccagcaaacaacctatctggctcaacagtattgccatgaggctatcagggaaatttctaagctgaggccctcccccgagcgcgatgctcttatccaattaagtgaaattgtgctcacacgcgataagtag

SEQ ID NO: 129795 - DNA, 1131 bp, Artificial Sequence
  Description of Artificial Sequence: Synthetic coding sequence
atgcccgcccatgtgcacagaaggaaaggcctagaccttagccaaattccatatatcaatctggtcaaacatctgacttctgcttgcccaaatgtgtgccggataagtaggtttcaccacactacccccgattcaaagacccactccggagagaaatatactgacccattcaaactcggatggcgggacttgaagggcctctacgaagacattcgaaaggaattgctgatatctacatcagaattgaaggagatgagtgagtactattttgacggcaaagggaaagcctttcgccctatcatcgtagccctcatggctagggcctgcaatatccatcataataattcacgacatgtgcaagcttctcagcgggcaatcgccttgattgccgaaatgattcataccgccagcctcgtgcatgacgatgttattgacgacgcttcttcacgcagaggcaaacataccgtgaataagatttggggggagaagaaggccgtactggcaggagacctaatactttccgcagcatcaatagctttagctcggattggcaacaccacagttattagcatcttaacgcaggttatcgaagatctggtcaggggcgaattccttcaactcgggtctaaagaaaatgaaaacgagcggttcgcgcactacctggagaagacattcaagaaaacggcatctctcatcgcaaacagctgcaaggctgtctccgtactggggtgtcccgatcctgttgtgcacgaaatcgcctaccagtacggtaaaaacgttggcattgccttccagttaatcgatgatgtcctggattttacctcctgcagtgatcagatgggaaagcccacaagcgccgatctgaagttggggttggccactgggcccgtgttatttgcgtgccagcagtttcctgaaatgaacgccatgatcatgcgcagattttcgctgccgggtgacgtggatcgcgcccgacagtacgtcctccaatcagacggggtccaacagaccacttacctcgcccagcagtattgccacgaggcaattcgggaaatcagcaagctacggccatcccccgaaagagacgctcttatccaactgtccgagatcgttctaaccagggacaaatag

SEQ ID NO: 129796 - DNA, 723 bp, Artificial Sequence
  Description of Artificial Sequence: Synthetic coding sequence
atgaattttcggcaactcctgttgcatctgcctcgctatttgggtgcaagcggttcgccgcggagactctggtggagtcccagcctggataccataagcagtgtgggctcgtggcgagggcggtcgtcaaaatccccggcgcattggaatcaggtggtctccgaagcagagaagatcgtggggtaccccacctcctttatgtccctacgctgcctgctctcagatgagctgagcaacatcgcgatgcaggtgaggaagctagtcggtactcagcatccactcttgactactgctagagggctagtgcatgatagctggaattcacttcaactaagaggcctagtggttcttctcatctctaaggccgcgggccctagctctgtcaacacttcttgtcaaaactacgacatggtaagtggcatttattcttgccagaggagcctcgcagagatcaccgagctgatccacatagccttactggtacatcgaggaattgtaaaccttaacgagctgcagtcttcggatggcccccttaaggatatgcagttcggcaataagatcgcaattctgagtggagactttctgctggcaaatgcatgcaacggactcgctctattacaaaacaccaaatcctttagcttcaatggtcccattgccatttaccaaatgggggactgcgagagcgcatggattctatccaagcacccccgcgccctttcttag

SEQ ID NO: 129797 - DNA, 270 bp, Artificial Sequence
  Description of Artificial Sequence: Synthetic coding sequence
atggagttggcaaagcatgatgccgaagtccagaacatggcgttccaatatggcaagcatatggcaatgtcacataaaatcaatagcgatgtgcagccattcatcaaggagaaaacatctgattccatgacgtttaacctgaattctgcccctgtcgtcttgcatcaggaattccttggccgtgatctgtggattaagcagataggggagagcagctctacagaagttcaactcagtaatttccagcaaatgctgctcagcacactgtag

SEQ ID NO: 129798 - DNA, 1200 bp, Artificial Sequence
  Description of Artificial Sequence: Synthetic coding sequence
atgaattttcgccaactgcttctacatcttccacgttacctaggcgcttccggaagccctcgcaggctgtggtggtctccatctcttgatactatctcctcagttggatcctggagaggtcgtagctccaagtcgcccgcacattggaaccaggttgtatcagaagctgaaaagattgtggggtatcccacatcatttatgagtctcagatgtctgctgtcggacgagctgtcgaacatcgccatgcaggtgaggaagctcgtcggaacacagcatccgctgctgacaaccgccagaggcctcgtccacgatagttggaactcattgcaattgaggggtttggtggtcctcctgatctcaaaggccgccggaccttcttcagtcaatactagctgtcaaaactatgatatggtgtctgggatttacagttgccaacggtctctggccgagatcactgaattgattcacattgcattactggtgcacagaggtattgtgaatcttaacgagctccagtcctccgatggtcccctgaaggatatgcagtttggcaataagatagctatcctgtccggggattttcttctggcaaacgcctgtaatggattagcccttctgcagaacaccaaggtggttgaacttttagctagtgcgctcatggatctcgtccagggggtataccatgaaaattccacctccaaggagagttacattaccgacgacatcggaatttcaacttggaaagagcagacctttttatcacatggggccctgctggctaaatcctgtcaggcagccatggagctggcgaaacacgacgcggaggtgcagaatatggcattccagtacggaaagcatatggctatgtctcacaaaattaactctgacgtccagcccttcattaaggaaaaaacatctgattccatgactttcaatctcaacagcgcccctgtcgtgctccatcaggagttcctcggaagggacctgtggataaagcagattggcgaggcacaggagaaaggccggctagattatgctaagctgcgcgagaggatcaaagctgggaagggcgtgacatccgccatcgatttgtgcaggtatcatggaaacaaagcgctcgaggctctggagagctttcctcccagcgaagctagatctgccttagagaacattgtgttcgctgtcacacgcttttcctag

SEQ ID NO: 129799 - DNA, 243 bp, Artificial Sequence
  Description of Artificial Sequence: Synthetic coding sequence
gtccagaatatggcctttcagtacggaaaacatatggcaatgagccacaagattaacagcgacgtgcagcccttcattaaggagaaaacaagtgacagtatgacctttaacctgaactcggcacctgttgttctacaccaggagttccttggcagggatctgtggatcaagcagataggtgagtcttcatccactgaggtacaactctcaaacttccaacagatgctcttgtccactctgtag

SEQ ID NO: 129800 - DNA, 894 bp, Artificial Sequence
  Description of Artificial Sequence: Synthetic coding sequence
atgaattttcggcagctcttgttgcaccttccccgatatcttggggcatcaggttccccaagacggctgtggtggagcccaagcctagacaccatcagctctgtgggatcgtggagaggtaggagctccaagagccctgctcactggaaccaagtggtgagcgaggctgaaaaaatcgtggggtatccaactagctttatgtctcttcgttgcttgctgtcagatgaactgtctaatattgccatgcaagtccggaaactcgtgggaacacagcatccactgttgacaactgcccgcggattggtgcatgacagttggaattccctccagctgaggggtctggtggtccttttaatatcgaaggccgccggaccaagctcggtcaacacaagttgtcagaactacgatatggtgagcggtatctattcctgccaaagaagcctggccgagattacggagcttattcacatcgccctcttagtgcataggggaatagtaaatctaaacgagctgcaatccagcgatggccctctgaaggatatgcaattcggcaacaagatcgcaatcctgtcaggagatttccttctggccaacgcttgcaacggccttgctctgttgcagaatacaaaagtagtcgagctgctcgccagcgccctcatggatcttgtccagggagtataccacgaaaattctactagcaaagcacaagagaaaggaaggttagactatgcaaagttgcgcgagcgaatcaaagcgggaaagggcgtaacatccgccatcgacctgtgtcgttaccacgggaacaaggccctggaggctctagagtcatttccaccgagcgaagctcgctcggctttagagaacatcgtgttcgctgtcacgaggttctcctag

SEQ ID NO: 129801 - DNA, 882 bp, Artificial Sequence
  Description of Artificial Sequence: Synthetic coding sequence
atgggacgcgtggtcgcagagctggtgtcttcactgcttggcctgtggctcttgctgtgttcgtgcgggtgcccagagggggctgaattacgcgcaccgcccgataagatagccataattggagccgggatcgggggcacaagtgctgcttactacctgcgacagaagttcggaaaggatgtcaagatagacttattcgaaagggaggaagttggaggcagactggccaccatgatggtgcaaggacaggagtacgaagctggagggtcagtgattcatccccttaatctccatatgaagaggttcgtgaaggacctgggattgtcggcggtccaggcaagcgggggcttgctggggatctataatggcgagaccctggtgtttgaagaatcaaactggttcatcattaacgtcattaagttggtgtggaggtatggattccagagcctccgtatgcacatgtgggtcgaggacgtgcttgacaaatttatgagaatttacaggtatcaatcccacgactatgctttctcttctgtagaaaagttactgcacgcactggggggcgatgactttcttggcatgcttaacaggactcttctggagaccctccagaaggctggtttctccgagaaattcctcaacgaaatgatcgcaccagttatgcgcgtgaactacggccagtccaccgacatcaatgctttcgtcggagccgtctcacttagttgttccgacagcggcctctgggccgttgagggcggcaacaagctggtgtgctccggccttctccaggcgtcaaagagtaacctgatctctgggagcgtcatgtacattgaggagaaaacaaagacgaagtatacggtcttggggctgtgtccgttgtag

SEQ ID NO: 129802 - DNA, 1518 bp, Artificial Sequence
  Description of Artificial Sequence: Synthetic coding sequence
atgggtcgggtggttgcagagctggtgtcaagcctcctaggcctttggctcttactctgctcatgcggctgccctgagggagcggagctcagagcaccccccgacaagattgccatcatcggtgcggggattggaggaaccagcgcggcctactatctgaggcagaagttcggcaaagatgtgaagattgacctctttgaacgagaggaggtcggcgggcgtctcgcaactatgatggttcaagggcaagaatatgaggccgggggcagcgtcattcacccactgaacctgcatatgaaacggtttgtgaaagatctggggctttccgcggtgcaagcttccggcgggttacttggtatctacaatggtgagacgctggtcttcgaggagtcgaactggttcattatcaacgtaatcaagctcgtgtggcgctatggattccaatccctgaggatgcatatgtgggtggaggatgtcctggataagttcatgagaatatacaggtaccagagtcatgattatgcattttcaagcgtcgagaaattactgcatgccctggggggcgatgacttccttggcatgctgaatcgcacactgctcgagactctccagaaggcagggttttcggagaagtttttgaatgagatgattgcgcctgtaatgcgcgtgaattacggtcagagcactgacataaacgccttcgtgggcgccgtgagcctgtcctgtagtgattccggactgtgggcagtggagggagggaacaagcttgtttgttcaggcttgttgcaggcctccaaaagcaatcttatttctgggagcgtaatgtatattgaagaaaaaactaaaacgaaatatactggaaaccccacaaaaatgtacgaggtggtgtaccagatcgggaccgagacacgttccgacttttacgatatagttctggtggctaccccccttaacagaaaaatgagcaacataacctttctaaactttgatccccctatagaggaatttcaccaatactatcagcatattgttacaactctcgtgaaaggagaactgaatactagcatattttcttcaagacctattgataaattcggcctgaataccgtcctcacaaccgacaactccgacttattcatcaacagtattggtattgtgcctagcgtgcgagagaaagaagaccctgagccctctacagacggtacctatgtttggaaaatcttttctcaggagacactgacaaaggcacaaatcctgaaattattcctgagttacgactacgcagtaaagaagccttggctcgcctaccctcactataagccccccgagaagtgcccgtcgataatcttgcatgaccggctgtattacctaaatggaattgagtgtgcagcttccgccatggagatgagtgctatcgccgcacacaacgccgccctgttggcgtaccaccggtggaacggtcatacggacatgatcgatcaggacggtctttacgagaaactgaaaacagagctgtag

SEQ ID NO: 129803 - DNA, 1287 bp, Artificial Sequence
  Description of Artificial Sequence: Synthetic coding sequence
atgatggtgcagggacaagagtacgaggcaggcggcagtgtcatacatcccctgaacctgcatatgaagaggttcgtcaaagatttaggcctcagtgctgtgcaggcctccggaggcctgctgggaatttataacggagagactcttgtgtttgaggagtcaaactggtttatcatcaacgtcataaagcttgtttggcgttatggttttcagtcacttcgtatgcatatgtgggttgaagacgttctggacaagtttatgagaatctacaggtatcagtctcacgattatgctttttcttccgtggagaaactcttgcatgctttgggcggagacgactttcttggcatgttgaatcggactctgttagagactctgcagaaggcaggctttagcgaaaagtttttgaacgagatgattgcgcccgttatgagagttaactatggacagagtacagacatcaatgcttttgtgggcgccgtgagcctgagctgtagcgacagtggcttgtgggcagtcgagggcggtaacaagttagtctgtagcggtctgctacaggcctctaagtccaacctgattagcgggtccgtgatgtatatcgaggagaaaacaaaaaccaaatacacgggaaaccccaccaaaatgtacgaagtggtgtatcagataggcacagagacaaggagcgacttctatgacatagtgctagtggcgaccccgttaaatcgtaagatgagtaacattacctttctgaatttcgacccccctatcgaggaatttcaccagtattaccagcatatcgttactacacttgtaaagggcgagttgaacacctccatattttccagccggcctatcgataaattcggtctgaacacagtactgaccaccgacaatagcgacttatttattaattccatcggcatcgtgccctcagttagagaaaaagaggacccagaaccgagcacggacggcacatacgtctggaagatcttctcgcaagagacactgacaaaggcccaaatccttaaattgtttctttcttatgattatgctgtgaagaaaccgtggctggcgtatcctcattacaagccgccggagaagtgtcctagcataatcctccatgatcgtctgtattatctgaacggaattgagtgcgccgccagcgccatggagatgagcgcaattgccgcccataatgcagccttgcttgcctatcacagatggaatggacacactgatatgattgaccaggacggtctatatgagaagctgaagactgaactgtag

SEQ ID NO: 129804 - DNA, 1284 bp, Artificial Sequence
  Description of Artificial Sequence: Synthetic coding sequence
atggtacagggacaggaatacgaggcgggcggctctgtgatccatccactgaatttgcacatgaagaggttcgtcaaggacctcggacttagcgctgttcaggctagcggaggcctgctgggcatctataacggtgagactctggttttcgaagaatcaaattggttcatcatcaacgtgattaagctcgtttggaggtacgggtttcagtccctacgcatgcacatgtgggtggaggacgtgcttgacaagtttatgagaatttaccggtatcagtctcacgattacgctttttctagcgtcgagaagctcttacatgccttgggtggggatgatttcttgggcatgcttaaccggactttacttgaaacgctgcagaaggcaggttttagcgagaagtttctcaacgagatgatcgcacctgtgatgcgggtcaattatggacagagtaccgacatcaatgcgttcgttggagcggtgagcctgagttgcagtgattctggactttgggccgttgaggggggcaacaagctggtctgtagtggtctccttcaggcctctaaaagcaacctgatttcaggatccgtgatgtatatcgaggaaaagactaagactaaatacaccggaaaccccactaaaatgtatgaggttgtgtaccagatcggtactgagaccaggagtgatttttatgatatcgtgctggtcgcaaccccactgaatagaaagatgtccaatataacctttctgaattttgatcctcctattgaagaatttcaccagtattatcagcacatcgtcactacgcttgttaagggagaactgaacacctcaattttcagcagcaggcctattgataagtttggcctgaacacagtgctgacaacagacaattccgacctctttattaattcaattggtattgtgccctccgtgagagaaaaagaggaccccgagcccagtactgacgggacttacgtgtggaagatctttagccaggaaaccctcactaaggcccagattctgaagctgtttttaagttacgattacgcagtcaaaaagccatggctcgcttatccccattacaaaccccctgagaaatgcccctccattattctgcacgaccgactgtactacttgaacggaattgaatgcgcagcctccgcgatggagatgagcgccatagcagcccacaacgcggcccttctggcctaccatcggtggaacgggcacaccgatatgatcgaccaggacggactgtacgagaagcttaaaaccgagctgtag

SEQ ID NO: 129805 - DNA, 1485 bp, Artificial Sequence
  Description of Artificial Sequence: Synthetic coding sequence
atggctagagccgctcccctgctggccgccttaacagctctcctagctgctgcagctgcaggtggggacgctccgcccggaaagattgctgtcgtcggggctgggatcggaggtagcgcagtagcacattttctgcaacagcatttcggtcctagagttcagattgacgtctacgagaagggaaccgtgggcggcaggctcgccaccatctctgtgaacaagcagcattatgagtccggagcagcctcatttcactctctgagcctgcacatgcaggattttgtgaagctgcttggcttgaggcatcggcgagaggtagtgggccgtagtgcaatatttggtggggagcattttatgttggaggaaactgactggtatctgctgaacctgttccgcctgtggtggcactatggtatttcattcttgcgccttcagatgtgggtggaggaggtgatggaaaagtttatgagaatttataaataccaggctcatggatatgccttttccggcgtcgaggagttattatattcgcttggggaaagcacatttgtcaacatgactcagcacagcgtagccgaaagcctcctgcaggtcggcgttacgcagcgttttatagacgatgtggttagcgccgtgctgagggcatcatacgggcagagtgccgcaatgcctgcattcgcaggggctatgtcgctcgctggagctcaggggagcctttggtctgtggagggcggaaacaagctcgtatgcagtggacttctgaagctgaccaaagccaacgtcatccatgccacagttacctccgtgactctgcacagcaccgaagggaaggcactttatcaggtcgcttacgagaatgaggtgggtaacagtagcgatttctatgacatcgtggtgatagctacgccattacaccttgataacagtagctcaaacttaacgttcgccgggtttcatcctcctatagacgatgtacaggggagctttcagcctactgtggttagtctggtccacggctaccttaactcttcttactttggatttcccgacccaaaactgtttccgttcgcaaatatactgaccacagatttcccttcctttttctgcacgctggacaacatctgtcctgtgaatatctccgcttctttcaggcgtaagcaaccccaagaggcagccgtttggcgagtgcagagccctaagcctttgttccggacccagctgaaaacactctttcgttcatactacagcgtgcagaccgcagagtggcaggcacaccccctgtacggatccaggcctaccttgcctagatttgcgttacatgaccagctcttttatctgaacgcactcgagtgggcggcctcatccgtggaggtcatggccgtggcggccaaaaatgttgctctgttggcctataatcgctggtatcaggatctagacaaaatagaccagaaagatctcatgcataaagtcaagacggagctttag

SEQ ID NO: 129806 - DNA, 531 bp, Artificial Sequence
  Description of Artificial Sequence: Synthetic coding sequence
atgaaagtgctcttatgtgacctgcttcttctgtctctgttcagttctgtgttcagtagctgccagcgagactgcctcacatgccaggagaagctccaccccgcactggactcctttgatctcgaggtgtgtatcctcgaatgcgaggagaaagtgttcccctcccctctgtggacaccatgcactaaggtgatggctagaagttcctggcagttatctcctgctgcgcctgagcacgtggccgctgcactttaccagcccagagcatctgagatgcagcatcttcgcagaatgccacgtgtgaggtcactttttcaagaacaggaagaacctgaaccaggaatggaggaggccggagagatggagcagaaacagttgcaaaagagattcggggggttcacaggggcacgaaaatcagcccgcaagctggctaatcagaagcgcttttccgaattcatgaggcagtacctggtattgtcaatgcaatcatctcaacggaggagaacacttcatcagaacggcaatgtgtag

SEQ ID NO: 129807 - DNA, 465 bp, Artificial Sequence
  Description of Artificial Sequence: Synthetic coding sequence
atgaaggtgctcctctgtgatctactactactgtctctattctccagtgtgttttcctcatgtcaacgcgactgcctgacctgccaagagaaactccatccggctttagatagtttcgacctggaagtctgtatactcgagtgcgaggagaaggtgtttccctctcctctgtggaccccttgcactaaggtgatggcccgcagctcatggcagctgtcccctgcggccccggagcacgtggccgccgctttgtaccaacccagggctagcgaaatgcagcacctgaggcggatgcctagggtgaggtcactctttcaggagcaggaagagccagagccgggcatggaggaggccggtgagatggaacagaagcaactgcagaaacggttcggcggcttcaccggggccaggaagtccgcacggaagctcgccaaccagaaacgctttagcgagtttatgcgctag

SEQ ID NO: 129808 - DNA, 1230 bp, Artificial Sequence
  Description of Artificial Sequence: Synthetic coding sequence
atgacggaactgcccgctccattaagttatttccagaacgcccaaatgtcagaggataaccatctcagtaacaccgtcaggtcacagaacgacaacagagagcgtcaggaacacaatgaccggaggtcccttgggcacccagagcctctttcaaacggacggccacagggcaacagccgtcaggtggtcgagcaggacgaagaggaagatgaggagctgaccctgaaatatggggcaaagcacgtgatcatgttgttcgtgcctgtaactctgtgcatggtggtggtggttgctaccatcaaatctgtcagcttttacacaagaaaagatgggcagctgatctacactccatttaccgaggatactgagaccgtggggcagagggcactccactcaattctcaatgctgctattatgattagcgtcatcgttgtcatgactattttactggttgttctgtacaagtatcggtgttacaaagtgatccacgcgtggctcatcatatcctccttacttctactcttttttttctcattcatctacctgggcgaggtattcaagacttataatgttgctgtagactatatcactgtggccctcttaatttggaactttggagtggtgggcatgatcagcattcactggaaaggccccctcaggctacaacaggcctatctgattatgattagcgccctcatggcgctggtcttcatcaagtacctgcctgaatggaccgcctggctgatcttagcggtgatcagtgtctacgacctggtggcggtcctctgcccgaaagggccgctgagaatgctggtggagaccgctcaggagagaaacgaaactctgtttcccgcactgatctatagcagcaccatggtgtggctggtgaatatggcagagggggaccctgaagcacagaggagagtgtccaaaaattctaagtataacgcagagagaggcgtgaaactcggcctaggggactttatattttactcagtccttgtgggaaaggctagcgcgacggcctccggcgactggaataccaccattgcctgcttcgtggctattctaatcggattgtgcctgacattgctgctgctagcgatcttcaagaaggctctgcctgccctcccgatcagcatcacatttgggctcgtgttttatttcgctactgactatctcgttcagcctttcatggatcagctcgccttccatcaattctacatctag

SEQ ID NO: 129809 - DNA, 1404 bp, Artificial Sequence
  Description of Artificial Sequence: Synthetic coding sequence
atgactgagttacccgcccccctgtcctacttccagaacgcccagatgtccgaagacaaccacctgagtaacactgtaaggtcccaaaatgataaccgggaaaggcaagagcacaacgacaggcgcagcctgggtcaccctgagcccttatcaaatggacgcccgcaggggaacagtaggcaagttgtggagcaggacgaggaagaggacgaggaactcactttgaagtacggagcaaagcatgtgataatgctgttcgtacctgtgactctgtgtatggtggtggtggtggctactattaagagcgtctccttctatacacgtaaagacggtcagttgatctatacaccttttaccgaggacacagagactgttgggcagcgagccctgcactcaatccttaacgctgctatcatgatttcagtcatcgttgtcatgacaatcctgttggtggtgctatacaagtataggtgctacaaggtcattcacgcctggttaatcattagctcgctcttactcctcttcttctttagttttatatatttaggtgaggtgtttaaaacgtataatgtcgccgtggattatattacggtggccctcctcatatggaactttggagtggttggcatgatttccatacactggaaggggcccctgcgactccagcaggcttatttgatcatgataagcgccctcatggcccttgttttcattaagtatcttcctgaatggacagcatggctgatcctcgctgtcattagcgtatacgatttggttgcagtgctgtgtcccaaaggaccactccgaatgcttgtcgagactgcccaggagcgaaacgagacccttttccccgccctaatttactcatccaccatggtgtggctagtaaacatggccgaaggggaccctgaagcgcagcggagagtatccaagaactcaaaatacaatgccgaaagcacagagagagaatcacaggacacagtagctgagaacgacgacggcggattctcagaggaatgggaagcccagcgagacagccatttaggtcctcacagatccacacccgagtctcgggcagccgttcaggaactgtcttcttccatcctggcgggggaggatcccgaagagcgtggcgtgaagctgggactgggagatttcatcttctactcagtgctagttggaaaggcttccgcaaccgcctcaggcgattggaacacaactattgcatgcttcgttgccatcctcatcggtctgtgtctcacattacttctactcgcaatcttcaaaaaagcccttccagctctgccaatttcaatcacatttggcctagtgttctattttgcaacagattaccttgtgcagccctttatggatcagcttgcatttcatcagttctatatatag

SEQ ID NO: 129810 - DNA, 1137 bp, Artificial Sequence
  Description of Artificial Sequence: Synthetic coding sequence
atgactgagctgcccgcaccacttagctattttcaaaacgcacagatgtcggaagataaccatttaagcaataccgtgcggagtcagaacgataacagggagaggcaagaacacaatgaccgcagatccctggggcacccagaacctctttcaaacggaagacctcaaggcaactctaggcaggtggttgagcaagacgaggaggaagacgaagaactgacactgaagtacggcgctaagcatgtgatcatgctgttcgtccccgtcacgctctgcatggtagtcgtcgtcgcaacaatcaaatccgtgagcttctatacgagaaaagacgggcaattaatctatacccccttcaccgaagatacagagactgtgggccaacgggccctccacagtatcctgaatgcagccatcatgattagcgtgattgtggtaatgaccattctgctagtggtattatacaagtatcgctgttataaagtaatccacgcgtggctcattatcagttccttgctcctgttattctttttctctttcatctatctgggagaggtctttaagacgtacaacgtggcagtggactacattactgtcgccttactcatctggaactttggagttgtcggaatgatcagcatacactggaagggtccactgagactccaacaggcatatcttattatgatctcagcactcatggctctggtcttcattaaatacctcccagagtggactgcctggcttatactagccgtgattagcgtctacgacttggtcgcagtcctttgccctaagggcccattgcggatgctagtggaaacagcccaggaaagaaacgaaaccttattccccgcactcatatactcaagcaccatggtttggctagtgaacatggccgaaggggatcccgaagctcaacgcagggtttctaagaactccaagtacaatgccgagagggcctgcttgcctccggctgccatcaacctgttatcaatcgcacctatggccccacgactgtttatgccaaagggtgcctgccgcccaaccgcccagaaaggatcacacaagaccctgctgcagcgcatgatgatggccgggtctgttcgcaacggtaagccacgagggaccgtgatatag

SEQ ID NO: 129811 - DNA, 1392 bp, Artificial Sequence
  Description of Artificial Sequence: Synthetic coding sequence
atgaccgagttacccgccccactctcttatttccaaaacgctcagatgtccgaggacaatcatctgagcaacactaatgacaatagagagcggcaggagcataacgaccgccgcagcttgggtcaccccgagcctctatcaaatggaagaccccagggcaattcccgccaggtcgtcgagcaagacgaggaggaggacgaggaattaactttgaagtacggagccaagcatgtaattatgctattcgttccagttaccctttgtatggtcgttgtcgtcgcaactatcaagtcggtctccttctatacgagaaaagatggacaattgatttacactccattcacggaggacactgaaaccgtggggcagagagccctccactcaatcttaaatgctgctatcatgattagcgtcatagttgtgatgacaattctgctagtcgtgttgtacaaatacagatgctacaaagtcatccacgcatggctgatcattagcagcctgcttttgctcttctttttcagctttatctatctcggtgaagtattcaagacctataacgtggccgtcgattatatcaccgtcgctctcctgatctggaactttggagtggttggtatgatttctatccattggaagggcccactccgcctacagcaggcctatcttatcatgatctccgcgcttatggctcttgttttcattaaatacttaccagagtggacagcttggcttattcttgccgtgatctccgtatacgatctcgtcgccgtcctttgcccaaaaggaccccttcgtatgctggtcgaaactgcccaggagcggaatgaaaccctcttccctgcacttatctattcctccacaatggtgtggctggtgaatatggcagaaggcgaccccgaggcccagcgcagagtgtctaaaaacagtaagtataacgccgaaagcactgaaagagaaagtcaggatacggtggcggaaaacgatgacggcggattctctgaggaatgggaggcacagcgtgattcccatctaggtccacatcgcagtacgccagagagccgggcggccgtgcaggagctatcatctagcatcctggcaggtgaggacccagaagaacggggggtgaaacttggcctaggcgacttcattttctattccgtgcttgtcggtaaggcatcggcaaccgcttctggagactggaacacaactattgcatgctttgtggccatcttgatcggcctctgtctcacgctcctcctgttggctatcttcaagaaggcactccccgctctcccaatcagtataactttcggtttagtgttctactttgccaccgactacctggttcagccctttatggaccagctcgcctttcaccaattttatatttag

SEQ ID NO: 129812 - DNA, 555 bp, Artificial Sequence
  Description of Artificial Sequence: Synthetic coding sequence
atgaccgaactgcccgcaccccttagctactttcaaaatgcccagatgtccgaagacaatcatctctctaacaccgtgagatctcagaacgacaaccgcgagcgacaggagcacaatgaccgacgatccctgggtcaccctgaaccccttagcaacggacggccacagggcaacagccgccaagtagtagagcaagacgaagaggaagatgaggagttaacattaaagtatggtgcaaagcatgtgatcatgttatttgtccccgtcactctctgtatggtagtggtggtcgccacaattaagtctgtgagtttttacacacggaaggacggtcagctgatctatactccttttactgaagacactgagactgttggccagcgggctctacacagcattctgaatgctgcaattatgataagtgtcatcgtggtgatgacaattctactggtcgttctgtacaagtatcggtgctataaagtgtctatgcgccaccggagcctgcttagcaccttgtttttcttgtggcttggcatcctcgtcactgtcacatag

SEQ ID NO: 129813 - DNA, 1392 bp, Artificial Sequence
  Description of Artificial Sequence: Synthetic coding sequence
atgaccgaactcccagctccactgtcttattttcagaacgctcagatgagtgaggacaaccatttgagtaacaccaatgataacagggaaaggcaggagcataacgatcggcggagccttggacatccagagcccctgtcaaacggccggccacaaggcaattccaggcaggtagtggaacaggatgaagaggaggacgaagagctcactcttaagtacggggcgaaacacgtcatcatgttattcgtgcctgtgaccctgtgcatggtggttgtagtggctaccattaaatctgttagcttttataccagaaaagatggtcagctcatttatacgccattcacagaagatactgaaactgtaggccagagagctcttcatagcatcctgaacgccgcaatcatgatttccgtaattgtagttatgacaattctgcttgtcgtcctctacaagtacagatgctacaaggtgattcatgcgtggctgatcatctccagtctactgttactctttttctttagttttatctatctgggggaggttttcaagacttacaacgtagccgtggattacatcacagtggctcttctgatctggaacttcggggttgtgggcatgatctcaattcactggaagggcccactgaggctacaacaagcttacctgatcatgataagcgcactcatggccctggtgttcatcaaatatctgcccgagtggaccgcctggctaatccttgccgtgatttccgtctacgatttggttgcagtattgtgccccaaggggccactcagaatgttggtggagacagctcaggagcgaaatgagaccctttttccagcacttatctattcttctaccatggtttggttagttaacatggcagaaggcgatcccgaggcccagagacgcgttagcaaaaacagcaagtataatgctgagtccacagaacgcgagagtcaggatactgtagccgagaatgatgacggcgggttctccgaagaatgggaggcgcagagggattctcaccttggcccccatcgatcaacccctgaatcacgcgcagcagtacaagagctgtcgagctcaatactggccggggaggaccctgaagaacgcggcgtcaaacttggcctaggggactttatattctattcagtgctggtcggaaaggcctcagccaccgccagtggcgactggaacactacaatcgcttgctttgtagcaatcctgattggtctgtgccttaccctgttgctgcttgctatattcaagaaggcactgcccgcgctccctatcagcatcactttcgggctggtgttctatttcgccaccgactacctggtccagcctttcatggaccagctggcctttcaccagttctacatctag

SEQ ID NO: 129814 - DNA, 279 bp, Artificial Sequence
  Description of Artificial Sequence: Synthetic coding sequence
atgacagagcttcctgcgccactatcgtactttcagaatgcgcagatgtcagaagacaaccatctgtcaaatacgaacgataatagagaacgacaggaacacaacgacagacggagcctaggacaccctgagccgctgtctaatggtaggccccaggggaatagccgtcaggttgtagagcaggacgaggaagaggacgaggagctgacactgaagtacggagcaaagcatgtaattatgctttttgtcccggtcaccctctgtatggtggtggtgtag

SEQ ID NO: 129815 - DNA, 444 bp, Artificial Sequence
  Description of Artificial Sequence: Synthetic coding sequence
atgaccgagcttcccgcacccctgtcatactttcagaatgcccagatgtccgaggataatcacctgtccaacaccaacgacaaccgtgagagacaagagcacaatgatcggagatcactgggccaccctgaaccactttctaacggcagacctcaagggaattccagacaagtggtggagcaggatgaagaggaggatgaggagcttaccctcaaatacggcgccaaacatgttatcatgttattcgtgcccgtgacactgtgcatggtggtcgttgtcgccaccattaaaagcgtgtcattctacacccgaaaggacgggcaactcatatacacacccttcaccgaagacacagagaccgtgggacaacgcgccctccacagtatcttgaatgctgccattatgatttccgtgattgtcgtcatgaccatcctgctggtgtag

SEQ ID NO: 129816 - DNA, 330 bp, Artificial Sequence
  Description of Artificial Sequence: Synthetic coding sequence
atgacggaactcccggctcctttgtcatacttccagaatgctcaaatgagcgaagataatcatctgagtaataccgtgaggtcccagaacgacaatcgcgagcggcaggaacataacgaccgccggtccctcgggcaccccgagcctctcagtaatggccggccccaaggcaattctcggcaggtcgtcgaacaggatgaagaagaggacgaggagttaacgctcaaatacggagcaaagcatgtgatcatgctctttgtcccagtgaccttatgcatggtggttgtggtcgctacaatcaaatcggtgtccttttacacgcgtaagtag

SEQ ID NO: 129817 - DNA, 468 bp, Artificial Sequence
  Description of Artificial Sequence: Synthetic coding sequence
atgaccgagctccccgctcccttaagctactttcaaaacgcgcagatgtcagaggataatcacttgtcaaatactgtacggtcacagaacgacaatcgtgagcgccaggaacacaatgaccgccgttcactgggccaccccgaacctcttagtaatggtcggccacaaggaaactccaggcaagtggtggagcaagacgaggaggaagatgaggaactgacattgaagtacggagcaaagcatgtgatcatgctgttcgtcccagtaaccctgtgcatggtggtggtcgtcgcaaccattaagagtgttagtttctacactcggaaagacggtcagcttatctataccccctttaccgaggatacagaaacagtggggcagcgggctctccactcaatactcaacgctgccattatgatctccgttattgttgttatgactatacttctggttgttctgtataaatag

SEQ ID NO: 129818 - DNA, 177 bp, Artificial Sequence
  Description of Artificial Sequence: Synthetic coding sequence
atgaccgagctgccagccccactgtcttacttccagaatgctcagatgagtgaagacaatcatctttccaataccaacgacaatcgcgagaggcaggagcacaatgatcggcggtccttagggcatccagagccactctccaatggacgaccacaggggaatagtaggcaggtgtag

SEQ ID NO: 129819 - DNA, 279 bp, Artificial Sequence
  Description of Artificial Sequence: Synthetic coding sequence
atgactgaattacctgctccattatcttattttcagaatgctcaaatgagcgaggacaatcacctctctaacaccaacgataaccgagaacgccaggaacataacgatcgtaggtccctgggccaccccgaacccctctcaaatggcagaccccaggggaactcccgtcaggtcgtcgagcaggatgaggaagaagatgaagaactcacactgaagtacggcgccaagcatgtgattatgctgttcgtgcccgtgacattgtgtatggtggttgtgtag

SEQ ID NO: 129820 - DNA, 192 bp, Artificial Sequence
  Description of Artificial Sequence: Synthetic coding sequence
atgaccgagttgcccgcgccgcttagctactttcagaatgcccagatgtcggaagacaaccatttgtccaataccaacgacaaccgggagagacaggaacataatgatcgacgcagcctaggacaccctgagccactttccaatggccggcctcaaggcaattcacggcaggtcgtcgagcaggatgagtag

SEQ ID NO: 129821 - DNA, 276 bp, Artificial Sequence
  Description of Artificial Sequence: Synthetic coding sequence
atgaccgagctcccagcacccctgagctattttcaaaacgcacagatgagtgaagataaccacctgtcaaacacgaacgataatcgggagagacaggagcataatgatcggcgctctttgggacatccagagcccctatcaaacggacgcccgcagggaaattcacgccaagtggttgaacaggatgaggaggaagatgaggagctcactctgaagtatggtgccaaacacgtaatcatgttgttcgtacccgtgacgctgtgtatggtagtctag

SEQ ID NO: 129822 - DNA, 189 bp, Artificial Sequence
  Description of Artificial Sequence: Synthetic coding sequence
atgaccgaattgccagccccactgtcctatttccaaaacgcccagatgtctgaagacaatcatctctctaacacaaacgataacagagagcggcaggagcacaatgataggaggtctctgggtcacccagaacccctgtccaatgggcgacctcagggaaactctaggcaagtggtagagcaggactag

SEQ ID NO: 129823 - DNA, 300 bp, Artificial Sequence
  Description of Artificial Sequence: Synthetic coding sequence
atgactgagcttccggcgcccctgagttacttccaaaacgctcagatgtctgaagacaaccacttatctaatactgtgcgatcacagaacgataatcgggaacgacaggaacataatgatcggcggagcctggggcatcccgagcccttgagcaacgggcgaccccagggtaacagtcgccaggtcgtggaacaagacgaagaggaagacgaagagttgactctcaaatatggcgcaaagcacgtcattatgctgttcgtgcctgttaccctgtgcatggtggtggtggtcgccacttag

SEQ ID NO: 129824 - DNA, 408 bp, Artificial Sequence
  Description of Artificial Sequence: Synthetic coding sequence
atgaccgagcttcctgcccctctgagctacttccagaatgcgcaaatgagcgaggataaccatttatctaataccaatgacaatagggaaaggcaggagcataacgacagaagaagcttgggccaccctgagccattgtctaatggacgcccacagggcaactcccgccaggtcgtcgagcaggacgaggaggaagatgaagaactcacgctcaagtacggcgccaagcatgtgatcatgctgtttgtccccgttactctctgtatggtagtggtcgtggctacaataaaatccgtgagtttctatactagaaaagacggacagctgatctatacgcccttcacggaggacacggagaccgtggggcaaagagcattacacagcatactgaacgctgcaattatgtag

SEQ ID NO: 129825 - DNA, 330 bp, Artificial Sequence
  Description of Artificial Sequence: Synthetic coding sequence
atgaccgaacttccagcccctcttagctatttccagaacgcgcagatgagtgaagacaatcatctgagcaacactaatgataatagagagcgacaggagcacaatgacaggcgtagtcttgggcatccggaacctctctctaatggccggccacaggggaatagcagacaggtggtggagcaggatgaggaggaagacgaagaactgaccctcaaatatggagccaaacacgtcatcatgctgtttgttcccgtaaccctttgtatggtggtcgttgtggcaactataaagagcgtctctttctacacccggaaggatggtcaactgtag

SEQ ID NO: 129826 - DNA, 1248 bp, Artificial Sequence
  Description of Artificial Sequence: Synthetic coding sequence
atgcttaccttcatggcatcagactccgaagaggaagtatgtgatgaacgcaccagcctcatgtctgctgagagccccacccccagaagctgtcaggaaggtagacaaggccccgaagacggcgaaaatacagctcagtggagatcgcaggaaaatgaagaagacggggaggaggaccccgacagatacgtctgcagcggcgtccccgggaggccacccggtctagaggaggaacttaccctgaaatacggcgcgaagcatgtcattatgctgtttgtgcccgtcacactgtgtatgattgttgtagtggcaacaatcaaatccgttaggttctatactgaaaaaaacgggcaacttatttatactccctttacggaagataccccttctgtggggcagcgtctgttgaattctgtgctcaacactctcataatgatatccgtaattgtcgttatgactatcttccttgtcgtgctgtataaatatcgctgttataagtttatccatggttggctgattatgtccagcctcatgttgctcttcctgtttacctatatctacctcggcgaggtgctaaagacttacaatgtagcaatggattatcctaccctcttgctgaccgtatggaattttggcgctgtaggaatggtgtgcatccactggaaagggcctctagtcctacagcaggcttacctgattatgatttctgcccttatggccctcgtcttcataaagtatctacccgaatggtctgcgtgggtgatactgggcgctatatctgtgtatgccgcgatggtttggacagtcggcatggctaaactggacccttcctcacaaggtgcgctccagctcccctatgatccggaaatggaagaagattcatatgattcctttggagagcctagctaccctgaggtatttgaaccccctctcaccggatatccaggcgaagaactggaggaagaagaggagaggggggtgaaactcggtctcggggactttatcttttactctgtgctggtggggaaagcggccgcaacaggtagcggcgactggaatactaccttggcctgtttcgtggccatattaattgggctctgcctgaccttactccttctagcggtgtttaagaaagccctccctgcactgcccatttccattactttcgggcttatcttttatttctctacggacaacctggtaagacccttcatggacactttagcaagtcaccaattgtatatttag

SEQ ID NO: 129827 - DNA, 1446 bp, Artificial Sequence
  Description of Artificial Sequence: Synthetic coding sequence
atgttggctggaaccgtgagattcgctagacactgcctaaaattctttccagcccagaagccagcttgcgtagattttggcgcctcacggggccgcgccatgctcacttttatggccagtgacagcgaggaagaggtctgcgatgagcggacatctctgatgtctgctgaaagccctacacccaggtcgtgtcaggagggccggcagggtccagaggatggagagaatacagcacagtggaggagccaggaaaacgaggaagatggtgaagaggacccagatcggtacgtatgcagcggcgtccctgggcggccccctgggctggaagaagaactgaccctcaagtacggtgcaaagcacgtgattatgctcttcgttccggttaccctgtgcatgatcgtagtagtagccacgatcaaaagcgtgcggttctacaccgaaaaaaatgggcagctcatctatactcctttcactgaggacacacctagtgtgggtcagcgcctccttaactcagtgttgaatacactgattatgatttctgtgattgtggtcatgactatctttcttgtggttctgtataagtacaggtgctacaaatttatccacgggtggctgataatgtcctctctgatgctactctttttatttacatatatatacctgggtgaggtgctgaagacatataacgtagctatggactatccgactctgctgcttaccgtgtggaatttcggcgcggtgggcatggtgtgcattcattggaagggcccgctggtcttgcaacaggcctacctaatcatgatatctgctcttatggccctggtgttcattaagtatctgccggagtggtccgcctgggtgatactgggggccatttccgtgtatgacctcgttgccgtgctgtgccccaagggtcctctccggatgttagtggagaccgcacaggagaggaacgaaccaatcttcccggctttaatttatagcagtgccatggtgtggacagtggggatggcgaagcttgatccaagcagtcagggcgctttgcagctcccttatgacccagaaatggaggaggactcgtacgattcattcggggaaccgagttacccagaggtgtttgagccgccgctgacaggctacccaggcgaggaacttgaggaagaggaagaacgaggggtcaaacttgggctcggcgatttcattttctattctgtgctggttgggaaagctgccgccactggcagcggagactggaacaccacattggcatgctttgtggctatcctgataggactttgcctgaccctactgttgctagcagtgttcaagaaggctctcccagcactacctataagtatcaccttcggcttgatcttctatttctccaccgataacttagtgaggccattcatggatactctggcctctcaccagttgtacatctag

SEQ ID NO: 129828 - DNA, 1347 bp, Artificial Sequence
  Description of Artificial Sequence: Synthetic coding sequence
atgcttacctttatggcatcagattcagaggaagaagtctgtgatgagagaacaagtcttatgagcgcagagtctccaaccccgagatcgtgtcaagagggaagacagggccccgaagatggagaaaacacagcccagtggagatcgcaggagaatgaagaggacggtgaggaggatcctgacaggtatgtctgttcaggtgtacccggcagaccaccaggcctggaagaggagctcaccttgaaatatggggccaagcacgtaattatgctttttgtgccagtgacgttgtgtatgatcgtggtcgtggccactattaagtcagttcgcttctacacagagaagaatgggcaactgatctatactcctttcacagaggacacacccagcgtcggtcagcgcttgctgaactctgtcctgaacactctgattatgatttctgtgatcgtggttatgaccatctttcttgtcgttttgtataaatacagatgttataagttcatccatggctggctgattatgagttctctaatgttgctgttcctgtttacttatatatacttgggagaagttctcaaaacttataatgtggccatggactatcctacactacttctgaccgtttggaacttcggcgctgtcggaatggtgtgtatccactggaagggaccccttgtgctacagcaagcatacctaatcatgatctctgcactgatggccctggtgttcatcaaatacttgcctgagtggtctgcatgggtgatcctgggagctatttcagtttatgatttggtcgccgtgctgtgtccaaaaggaccgctgagaatgttagttgagactgctcaggaacggaatgagcccatcttcccagctttgatttatagtagcgcaatggtgtggactgtcggaatggcaaagcttgaccctagcagtcagggagccctgcagctcccctacgatcccgagatggaggaggacagttatgatagtttcggagagccaagttatccagaagtcttcgagccgccccttacaggataccccggtgaggagttggaggaggaagaggagagaggtgtgaaactcgggcttggagactttattttctactcggtgctagtgggcaaagctgcagcaactgggtccggagattggaacacgactctggcctgcttcgtggcaattttgataggcctgtgcttaaccctgctgttgctggccgtgttcaagaaagccctccccgcacttccaattagtataaccttcgggctgatattctatttttctacggacaacctagtgagaccctttatggacacactggcaagtcaccagctgtacatatag

SEQ ID NO: 129829 - DNA, 1446 bp, Artificial Sequence
  Description of Artificial Sequence: Synthetic coding sequence
atgctcgccgggaccgtgagatttgcccggcattgtttgaaatttttccccgcacaaaaacctgcgtgtgtggactttggcgctagccggggccgagccatgctgacttttatggcttcagactccgaagaagaggtatgcgatgagcggacgagcctcatgagtgccgagtcgcctacacctcgttcctgccaggaggggaggcagggacctgaagacggcgagaacacagctcaatggcgtagccaggaaaatgaagaggatggtgaagaagaccccgacagatatgtctgcagtggcgtgcccggccggccgcccggcctcgaggaggaactcacgcttaagtatggtgccaaacatgttatcatgttgtttgtaccggttaccttatgtatgattgttgtggtggccacgataaaatcggtgcgcttctacaccgagaaaaacggccagctcatctatacgccctttaccgaggatacaccctctgtggggcagaggcttttaaactcagtgttaaatactctcatcatgatatccgtgattgttgtgatgactatatttctcgtggttttgtataagtatagatgctataaatttattcatgggtggctgatcatgtcttccctgatgctcctgtttttgttcacgtacatttacctgggggaggttcttaaaacttataacgtggccatggattatcccacattgctgctgactgtgtggaacttcggggcggttggcatggtctgcatccactggaaggggcccttagttctccagcaggcctatttgattatgatctccgctttgatggccttagtctttatcaagtacctgcctgagtggtctgcctgggtcatcctgggcgcaatctctgtgtacgatttggttgcggtgctgtgtcccaaggggccccttagaatgctggtggagacagctcaggagagaaatgagcccatctttccagccctgatctatagttcggctatggtatggaccgtggggatggcaaagctcgacccatcatcccagggagccctgcagttaccctacgatcccgagatggaggaggacagttacgattcctttggcgagcccagctaccccgaagtcttcgagcccccattaactggatacccaggagaggagctcgaagaagaggaggaaaggggggtgaagttggggctgggggacttcatcttttactcagtgctggtcggaaaggctgctgccactggcagcggtgattggaatacaacattggcctgtttcgtagctatcctcattggtctctgtctgactttgcttctcctggcagtgtttaaaaaggccctccccgcactgcccatcagcatcacttttgggttaattttttatttctcgacggacaatctcgttcgtccttttatggataccctggcatcgcaccaattatacatttag

SEQ ID NO: 129830 - DNA, 1344 bp, Artificial Sequence
  Description of Artificial Sequence: Synthetic coding sequence
atgctaacattcatggcaagcgattctgaggaagaggtctgcgacgaaaggacatcactgatgtccgcggagagcccgacaccaaggtcgtgtcaagagggtcgccaagggccggaagatggggagaataccgcacagtggcggagtcaggaaaatgaggaagacggagaagaggaccccgaccggtatgtgtgtagtggggttccaggtcgccctccaggtctcgaagaggaactcaccctaaaatacggcgccaaacacgtgattatgttgtttgtccccgtgactctctgtatgattgtcgtggtcgctaccataaagtctgtccgtttttacaccgaaaaaaacggacagctaatctatacacccttcaccgaggacaccccatccgtcggccagcgcctactgaacagcgtgttgaacaccctgatcatgatttcagtaattgtcgttatgactatcttcttggtagtcctatataaataccggtgctacaagttcatccacggttggcttatcatgtcctcgcttatgcttctgttcctctttacctatatttacttgggcgaagtactcaagacgtacaatgtcgccatggattacccaacgttgctactcactgtctggaattttggggccgtgggtatggtgtgtatccactggaaaggccctctggttttgcagcaagcatatttgatcatgatctctgctctgatggccctggtttttatcaaatacctgccagagtggtctgcctgggtgatacttggggccatcagcgtgtacgacctggtagccgtgttgtgcccgaaggggccccttcggatgctagtggaaaccgcccaagaacgcaatgaaccaattttccccgcccttatatacagtagcgcaatggtctggacagtaggaatggccaagcttgatcctagcagccagggcgccctacaactgccttacgaccccgaaatggaggactcatacgactccttcggcgaaccatcttacccagaggtatttgaacctcccctgacaggatacccaggagaagaactggaggaagaggaagaaagaggtgtcaaactggggttaggagatttcatcttttattccgtccttgtcggaaaggccgcggctaccgggtctggtgactggaacacaaccctcgcttgtttcgtagccattctgattggactatgtttgacactgctactcctggctgtctttaagaaagccttgcctgccctgcctatctccatcaccttcggattaatcttttactttagcaccgataatcttgtccggccgttcatggatacgctagcaagccaccagctgtacatctag

SEQ ID NO: 129831 - DNA, 390 bp, Artificial Sequence
  Description of Artificial Sequence: Synthetic coding sequence
atgctgacatttatggcctccgattccgaggaggaagtttgtgacgaaagaacttctctgatgagcgctgagagcccaactcccagatcatgccaggaaggccggcaggggcccgaggacggggagaatacagcgcagtggcgaagtcaggagaatgaagaagacggcgaagaggaccctgatcgatacgtctgcagcggggtgcctggacggccacccggacttgaagaagagctaactttgaaatacggggcgaaacatgttatcatgctgttcgtgcccgtcactctatgtatgattgttgtggtggctactatcaagtctgtgcgattctatactgagaaaaatggccagcttatttacactcctttcacagaggacacaccatag

SEQ ID NO: 129832 - DNA, 66 bp, Artificial Sequence
  Description of Artificial Sequence: Synthetic coding sequence
atgctgacattcatggcttcagatagtgaggaggaagtgtgcgatgaacggacgtccctcatgtag

SEQ ID NO: 129833 - DNA, 990 bp, Artificial Sequence
  Description of Artificial Sequence: Synthetic coding sequence
atggcctggcgcggctgggcacagcgcggctgggggtgtggccaggcgtggggtgccagcgttggtggaagaagctgtgaagaacttactgctgttctcacaccgcctcagcttctgggccgccggttcaactttttcatccagcagaagtgcgggtttcggaaagctccacggaaggttgaaccacgaagatcagacccaggcactagtggtgaggcctacaagcgatccgccctcatacctcctgtagaagaaaccgtgttctatccgtcaccatatcccattaggagccttattaagcctctgttttttactgttggattcacaggatgtgcttttggatccgccgctatttggcagtatgaatcactcaagtctcgggtgcagagttatttcgatggaatcaaagccgactggttagatagcatcaggccccagaaagaaggcgatttccggaaagagatcaacaagtggtggaacaaccttagtgatggacagcgcacagtaacgggaatcattgccgccaatgtactcgtcttttgtttgtggcgagtgccttctctccagcggacgatgatccgctacttcacgtcgaacccagcatcatctgtgatttcaaactttgtatcctatgtggggaaggtggccactgggcgctacgggccctctctgggcgcctctggagccataatgactgtgctagctgcagtgtgcacaaagattcccgaaggccgtctggccattatcttcctgccaatgtttactttcaccgccgggaatgcgctaaaggcaattattgcgatggacacagccggcatgatactcgggtggaaattttttgatcatgctgcacacctgggcggcgccttatttggcatatggtacgtcacgtatggacacgagcttatatggaagaaccgtgaaccgctggtgaaaatctggcacgaaatcaggacaaacggccctaaaaaaggcggcggtagcaagtag

SEQ ID NO: 129834 - DNA, 1140 bp, Artificial Sequence
  Description of Artificial Sequence: Synthetic coding sequence
atggcctggagaggatgggcccaaagaggatgggggtgtggccaagcatggggggcttcagtcggaggaagatcgtgcgaggaactgacagccgtcctcaccccccctcagctcctgggcaggcggttcaacttctttattcaacagaagtgtggcttccgcaaagctcctagaaaggtagagccacgcagatctgatcctgggacctctggcgaggcatataaacgatcggctctcatccctcccgtcgaggaaactgtattctatccttccccctaccccattaggtcactaatcaagccccttttttttacagtgggcttcaccggctgcgcattcgggtccgccgctatctggcaatacgagtctctgaagtcccgcgtgcaaagctatttcgatggcattaaagcagactggctggatagtatccgcccacagaaggaaggggatttcaggaaggagattaataagtggtggaacaatctgagtgacggccaacgcactgtcaccggcatcatcgccgcgaatgtgctagtgttctgtctgtggagggtgccgagtctgcagaggacgatgattcgctacttcacaagtaatccggccagcaaggtcctttgtagcccaatgctgctatctacattttcacactttagtctgttccacatggcggctaatatgtatgtgctgtggtctttttcatcatcaattgttaatatactgggccaggagcaattcatggctgtatatctgagtgccggcgtgataagcaatttcgtcagttatgtgggcaaggtcgcaactggccggtacggacccagcttaggtgcaagcggtgcaatcatgactgtcttagcggccgtgtgcaccaagattccagaggggaggctggccattatcttccttccgatgttcactttcactgctggaaacgctctcaaggccattatagctatggataccgcaggcatgattctgggctggaaatttttcgaccacgccgcacaccttggaggcgcactattcggaatctggtatgttacttacggacacgagcttatctggaagaacagggagcctctggtgaagatttggcacgagatcagaacgaacgggcctaaaaagggtggggggtcgaagtag

SEQ ID NO: 129835 - DNA, 663 bp, Artificial Sequence
  Description of Artificial Sequence: Synthetic coding sequence
atggcaagcgccacagatagcagatacggccaaaaagaatcatcagaccagaacttcgattacatgtttaaaatattgatcattggcaattcttcagtgggcaaaacatcatttttatttcggtacgcggacgacagtttcaccccggcttttgtgagcactgtcgggattgatttcaaggtaaaaaccatataccgcaatgacaaaaggataaaattgcaaatctgggatacagctggacaagagcgctaccggacaatcacgaccgcctactaccggggcgccatgggctttatactaatgtatgacatcactaacgaagagagttttaatgccgtgcaagattggtctactcagattaaaacatacagctgggataacgcacaggtcctgctagtggggaacaagtgcgacatggaagacgagcgagttgtgtcttccgagcgaggtaggcagctggctgatcatcttggcttcgagtttttcgaggccagcgccaaggataatatcaatgtgaaacagaccttcgagagattggtggatgtgatctgcgagaaaatgtcagagagcctggatactgcggatcccgccgtgaccggggctaagcaggggcctcagctttctgaccagcaggtacccccccatcaagactgtgcctgctag

SEQ ID NO: 129836 - DNA, 306 bp, Artificial Sequence
  Description of Artificial Sequence: Synthetic coding sequence
atgaatttggagagagtgtctaatgaggagaagctcaatctttgccgaaaatactatctgggaggcttcgcgtttctacccttcctgtggctggtcaatattttctggttttttagagaagcctttttggtgccggcgtataccgagcagtcacagatcaaaggctacgtgtggagatcagctgtcgggtttctgttctgggtgatcgtgctcacaagctggatcacaatcttccaaatctatagaccccggtggggagccttgggagattaccttagcttcacaatcccacttggtacaccatag

SEQ ID NO: 129837 - DNA, 378 bp, Artificial Sequence
  Description of Artificial Sequence: Synthetic coding sequence
atggccaagtacctcgcacagatcatcgtgatgggggttcaagtagtgggacgtgcttttgctagagccctccgtcaagagttcgctgcctcaagggcagcagccgacgcacgtgggagagccggccaccgctcagcggccgccagcaatctcagcggcctgagtttgcaggaagcacagcagattctgaatgtcagcaaactgtctcccgaggaggtccagaagaactacgaacacttgtttaaggtcaacgacaaatccgttggtggatcgttttacctccaaagcaaagtggtacgcgcaaaagagagactcgatgaggagttaaagattcaggctcaggaggatagggagaaagggcagatgccccatacctag

SEQ ID NO: 129838 - DNA, 2496 bp, Artificial Sequence
  Description of Artificial Sequence: Synthetic coding sequence
atgcccctggagatggagcctaagatgagcaagctcgcctttggatgtcagcggtcctctacctccgacgacgacagtggctgtgctctggaagagtatgcctgggtacccccggggcttcggcccgagcagatccagctgtactttgcatgtttgcctgaggaaaaagttccctacgttaatagtccaggggagaagcatagaattaaacagttactgtatcagctgccccctcacgataatgaggtcaggtattgccagagcttgtccgaggaggaaaaaaaggaactgcaggtgttttctgctcagaggaaaaaggaagccctgggccgtggcactattaagcttctgagcagggcggtcatgcatgcggtatgcgagcagtgcggtcttaaaatcaatggaggggaggttgccgttttcgcgtcaagagctggccctggcgtctgctggcacccctcatgtttcgtttgtttcacttgtaacgaacttctggttgatctcatatacttctaccaggatggcaagatccattgtggccgccaccacgcggaattgcttaagccccggtgctccgcatgtgacgaaattatcttcgccgacgaatgcactgaggctgagggcagacactggcacatgaaacatttctgctgtctagagtgcgagacagtgttaggaggccagaggtatatcatgaaagatgggcgacctttttgctgtggctgtttcgaatctctgtatgcagagtactgtgaaacctgcggcgaacatattggagttgatcacgcccagatgacctatgatggccagcactggcatgccactgaggcctgcttctcctgcgcccagtgtaaggcttcactcttaggttgcccttttctccctaaacaagggcaaatctactgtagcaaaacctgctcccttggagaggacgttcacgcaagcgacagcagcgattccgcattccaaagcgcacgctcacgcgactctcggagatccgtaaggatgggcaagtcttccaggtccgcagaccagtgtcggcagagcctcctgctgtcacccgcccttaactataagtttccaggcctctcaggcaacgccgatgacacgctgtccaggaagttggacgacctttctttgtccagacaggggacctctttcgcctcagaggaattttggaaaggtcgggtggaacaggagactcccgaggaccctgaggaatgggccgatcacgaggactatatgacacagctgctcctaaaatttggcgacaagtccttgttccagcctcaaccgaacgaaatggacattcgggcttcagaacactggatctcagacaacatggttaagagtaagaccgagctgaaacagaacaaccagagcctggcatccaagaagtatcagtctgacatgtattgggcccagagccaggacggcctgggtgactctgcctacggatcgcaccctgggcccgcctcaagccggcgtctgcaggagcttgagttagaccacggcgcttctggatataaccatgatgaaacccaatggtatgaggactctctggaatgcctatccgatttaaaaccggaacagtcagtcagagacagtatggacagtctggctctgagcaacattactggcgctagtgttgatggggaaaacaaaccccgaccttccctttactctctgcaaaacttcgaggaaatggagactgaagattgtgagaagatgagcaatatggggaccctgaattcctcaatgctgcatcggagcgcagagtctctgaaaagcctaagttcggaactgtgtcccgagaaaatactgcccgaagagaaacctgtgcacttgcctgtgctacgcaggtctaagagccaatctagaccccagcaggtgaaatttagcgatgacgtgatagataacgggaactacgatatcgagatcaggcaaccaccaatgtccgagcggactcggcggcgcgtgtacaacttcgaagaacgcggtagcagaagccatcaccaccgaaggagacggtccaggaagagccgctcagataatgccctaaatctggtgacagagcgcaagtactcccccaaggatcggctcaggctgtatacgcccgacaactacgagaagtttatccagaataagtccgctagagaaattcaagcgtacatccagaatgcagatttgtatggccagtacgcccatgccacctccgactatggtcttcagaatccaggaatgaaccggtttcttggactctacggcgaagacgatgactcatggtgctcctcatcatccagcagctccgactcggaggaggagggatatttcttgggtcagccaatcccacagccaaggccccagcgcttcgcttactacaccgatgatctgtccagccctccttcagcccttcctaccccccaatttggtcagagaaccaccaagtccaagaagaagaaaggccataaaggaaaaaattgcattatctcctag

SEQ ID NO: 129839 - DNA, 2496 bp, Artificial Sequence
  Description of Artificial Sequence: Synthetic coding sequence
atgcctcttgagatggagccgaaaatgtctaagcttgccttcgggtgccagcggagctctacttccgatgatgactccggctgtgctctagaggaatatgcatgggttcccccggggttgcggcccgaacagatacagctgtattttgcctgcttaccagaggaaaaggtgccgtacgtgaactccccgggcgagaagcatcggataaagcagctgctgtatcagctacccccccacgacaatgaggtgcgatactgccagagtttatccgaggaggagaagaaagagttgcaggtgttttcagcacagcgaaagaaagaggccctgggccgcggtaccatcaagctcctgtcccgggcggtcatgcacgctgtgtgtgaacagtgcggtctcaaaatcaatggaggtgaggtcgcagtgttcgctagcagggccggcccgggggtatgttggcacccatcttgtttcgtgtgttttacgtgcaacgagctacttgtggatctgatctatttctatcaggatggaaaaatccactgcggccggcaccatgccgagctcctaaagcctcgctgctcagcttgcgacgagatcattttcgcggacgagtgtactgaggccgaaggccgccactggcacatgaagcatttttgctgcctggagtgcgaaaccgtcctaggtggacagagatatatcatgaaggatggccgacctttttgctgcggctgcttcgagtccctatacgccgagtactgcgagacttgcggtgagcacatcggtgtggaccacgctcagatgacttacgatggtcagcactggcacgctacagaggcctgtttctcttgcgctcagtgtaaagcttccctcctcggctgtccttttctgcctaagcagggacagatctattgcagtaaaacatgcagtctgggcgaagatgtgcacgcctccgatagcagcgacagcgcctttcagagcgcacgatcccgcgactcaaggcgaagcgttaggatgggcaagagcagtaggagcgctgaccagtgcaggcagtcactgttattgagcccagccttgaattataaatttcccggcctctctggaaacgctgatgacaccttaagcagaaagctagatgatctttctctcagccgtcagggcacctcttttgcctctgaggagttctggaaaggaagagtcgaacaagaaacgcccgaggacccagaggagtgggctgaccacgaagactatatgacccagttgcttcttaaattcggagacaaaagcttgttccagcctcaacctaatgagatggatattagggctagtgagcactggatcagcgataatatggtaaagtccaaaaccgaactaaagcagaacaaccagtccctggccagcaagaagtaccagagcgacatgtactgggctcagagccaagatggtttgggagattccgcatacgggtcccatccgggcccagcatcaagccgaaggctacaagaactggaactggatcatggagccagcggttataaccatgacgaaacgcagtggtacgaggactcactcgaatgcctcagcgacttaaagccggaacagtcagtaagggattccatggactctctggcactgagcaatatcaccggggcctccgtggacggcgaaaacaagccccggccttccttatactcgctccaaaatttcgaggagatggaaacggaggactgtgagaaaatgtctaacatgggaactcttaattccagtatgctgcacaggtctgcagagagcttgaagtctctgtcaagcgagttatgtcctgagaagatcctgcctgaggaaaaacccgttcacctgcccgtcttgagacggtcaaaatcgcagtcccgtccacaacaggtaaaattcagtgacgacgtgattgacaatggtaattatgacattgaaatccgtcagcccccaatgagcgagaggacacgcagaagagtatataacttcgaggagagaggaagcaggtctcatcatcataggcgccgacggtcaagaaaatctagaagcgataacgcgctgaatcttgtcacggagcgcaagtatagtccgaaagatcgcctgcgattatatactccggacaattacgaaaagtttattcaaaataaatcggcacgcgagatccaggcttacatccagaacgcagatctctatggccagtacgcccacgctacaagtgactacggtctgcagaatcccgggatgaaccggttcttggggctgtacggagaagacgatgactcatggtgttcatccagctccagttcaagtgattcagaggaagaagggtacttcctgggacagcctatccctcagccccgacctcagcggttcgcttattacactgacgacctttcaagcccgcctagcgccctgcctaccccacaatttggacaacggactaccaagtctaagaagaagaaagggcacaaaggaaaaaattgtatcatatcttag

SEQ ID NO: 129840 - DNA, 2496 bp, Artificial Sequence
  Description of Artificial Sequence: Synthetic coding sequence
atgcctttggaaatggagcccaaaatgagtaagttagcttttgggtgtcaacgctccagtacatcagacgacgactcaggatgcgctcttgaagagtatgcatgggtgccgccagggctccgcccggaacagattcagctgtacttcgcttgcctccccgaggagaaagtcccttacgtcaattcaccgggggaaaagcaccgaattaaacagctgctgtaccagctcccgccccacgacaacgaagttcgatattgtcaatccttatcggaggaagagaagaaggagctgcaggtgttttcggcccagagaaagaaggaggctctcggccgcggcaccataaagttactatctagagctgtaatgcacgctgtttgtgagcaatgcggtttaaagatcaatggcggagaggtagcggtgttcgcctccagagcaggacccggagtctgctggcacccgagctgtttcgtctgtttcacttgtaatgaactcctcgtggacctgatttacttttaccaggatggcaaaattcactgcggccgtcaccacgctgagctcctcaaaccaaggtgttctgcctgcgacgagatcatcttcgcagacgaatgcaccgaggctgagggtcgacattggcacatgaaacacttctgctgcctagaatgtgagaccgttttgggcgggcagcgctatatcatgaaggatgggaggccattctgttgcgggtgtttcgaatctctttatgcagaatattgtgagacctgcggcgagcatatcggagtagaccatgctcagatgacgtacgacggacagcactggcacgccactgaagcgtgttttagttgtgcgcagtgtaaagcttcactgttgggctgtcccttcctccccaaacagggtcagatctactgctcaaaaacttgctccctcggggaagatgtgcacgcctccgatagcagcgacagcgccttccagtcagcccgatcccgcgactctcggagatctgtgaggatggggaaatccagccgcagcgccgaccagtgtcgccagagtctgctgctgagcccagcactcaactataagttcccgggcctgagcgggaacgcggatgacacgctgtcccgaaaactcgacgacttaagcttatccaggcagggcaccagcttcgccagcgaggagttttggaaaggcagagtagaacaggagacccccgaagatcctgaggagtgggctgaccatgaagattacatgactcagctcctgctaaaatttggcgacaagtccctgtttcagccgcaacccaatgaaatggacattagagcatcagaacattggatctccgacaatatggtgaagagcaagacggaactcaagcaaaataatcaatctctggctagtaagaaataccagtccgatatgtactgggctcaatctcaggacggcctcggggatagtgcctacggcagccatcctggccccgcatctagtcggaggctccaggagcttgagttagatcatggggcgagtggttataaccacgacgaaacacagtggtatgaagactcgcttgaatgcttgtccgacttgaagccagagcagtctgtgagggatagcatggatagtctggcactgtcaaatatcacaggagcctcggtcgatggggaaaataaaccacggccaagtctatatagtttacaaaattttgaagaaatggagacggaggactgtgagaagatgagcaatatggggaccttaaatagctcgatgctgcacagatccgccgaatcactgaagtccttgtccagtgagctatgtccagaaaagatccttcccgaggaaaaaccagttcaccttcccgtcctgcgtaggtctaaatcgcagtcccgtccccagcaagtcaagttttctgatgacgtgatagacaacggtaattatgacatcgaaatcaggcagccacctatgagcgaacgaaccagaaggcgtgtgtacaactttgaagaaagggggagtagatcccaccaccaccgtcgccgacgatcaagaaaatccaggagcgataacgcccttaatttggtgaccgagaggaaatattccccaaaagataggctgaggctatacacccccgacaattacgagaaattcatccaaaataaatcagccagggagatccaggcctatatccaaaatgcagatctatatggccagtatgcccatgccacaagcgattacggactgcagaacccggggatgaaccggtttctgggtctgtatggggaggatgacgactcctggtgtagttcctcctcctccagctctgacagcgaggaagagggctacttccttggacagccaattccccagccacgcccccagagattcgcatattataccgatgacttgagctcaccacccagtgcattacctactcctcagttcggccagcgaacgactaagtctaagaaaaaaaaagggcacaaagggaagaattgtattatctcgtag

SEQ ID NO: 129841 - DNA, 333 bp, Artificial Sequence
  Description of Artificial Sequence: Synthetic coding sequence
atgcccctggaaatggagccaaagatgagcaaactggcctttggctgtcagcgctccagtacgtcggacgacgattctgggtgcgctctggaggaatacgcttgggtgcccccagggcttagacctgaacagattcagctctattttgcatgtctccccgaggagaaagttccctacgtcaacagcccaggagagaaacatagaattaagcaattgttgtaccagctccccccccacgacaatgaagtccgttattgtcagtcattgtctgaagaagaaaagaaggagcttcaagttttttccgctcagcgcaaaaaagaggctctcggctag

SEQ ID NO: 129842 - DNA, 2496 bp, Artificial Sequence
  Description of Artificial Sequence: Synthetic coding sequence
atgcccctcgaaatggagcctaagatgtccaagcttgccttcggttgccagcgcagttcaacaagtgatgatgactctggatgtgccctagaggagtacgcctgggtgcctcctggacttagaccagagcagatccagctgtactttgcatgcctgccggaagagaaagtgccttacgtgaattccccaggagaaaagcataggattaaacaattgctatatcagctcccaccccacgataatgaggtgcggtattgccagtctcttagcgaggaggaaaagaaggaacttcaggtgttctctgcgcagcgaaaaaaggaggcgctcggacgtggcactatcaaactgctgagcagagccgtgatgcatgccgtttgtgaacaatgtggactgaagattaatggcggcgaggtggccgtgtttgcatctcgcgccggtccaggagtctgttggcatcccagttgcttcgtgtgcttcacttgcaacgagctgctggtagatctgatatatttttaccaggacggcaaaatccactgcggtaggcatcacgccgagctactgaagccgcgatgctctgcttgcgatgagataatattcgctgacgagtgtaccgaagctgagggacggcattggcacatgaagcacttttgctgcctcgagtgtgagactgtgctgggcggccagagatatatcatgaaggacggccgtccattctgttgcggatgcttcgaaagtctttatgcagagtattgcgagacctgcggagaacacattggagtagaccacgcacaaatgacatacgacgggcagcactggcatgccaccgaggcttgctttagctgcgcccaatgtaaggcttcacttctggggtgtccttttctgcctaagcaagggcagatttactgctctaagacttgtagtctcggagaagacgtccatgcctcagactcgagtgactctgccttccagtcagcacgcagtagagattcaaggaggagtgttcggatgggcaaatcctcccggagcgcagaccagtgtcgccagtcactgttactctctccagctcttaattacaaatttcccgggttgtcaggaaacgctgacgacacattaagccgcaagctcgatgacctatccctctcgagacaaggaacctcctttgcctccgaggaattttggaagggacgagttgaacaggagacccctgaggacccggaggagtgggctgatcacgaggactacatgacccagttgctcctgaagttcggggataaatctttgtttcagccccaacccaatgaaatggatatccgggcatccgagcactggatttctgataatatggtgaaaagcaagaccgaactgaaacagaacaatcaaagccttgctagcaagaaataccagagtgacatgtactgggcacaatcccaggacggtctcggggattctgcatatggttcgcatccaggccccgcttcatccaggagattgcaggagctggaacttgaccatggggcctccgggtataatcatgatgagacgcagtggtatgaggactcattggagtgccttagtgacctaaagccagagcagagtgtaagagattccatggatagccttgccctcagcaatatcaccggcgctagtgtggatggcgagaataaacccagacccagtctctactcactgcagaattttgaggagatggagaccgaggactgcgagaaaatgtccaatatgggcactttgaactctagtatgttgcatcggagtgcagaatctttgaaatccctttcaagcgaactgtgccccgagaagatcttgcctgaagagaaaccagttcacctgccagttctcagacgctcaaaatcacaatctcgccctcagcaggtaaaatttagcgacgacgtgatagacaatggaaattatgatatcgagatcaggcagccaccaatgtcggaacggacccggaggcgagtatataactttgaggaacggggcagccgctcgcaccaccatagacgtaggcgctcaagaaagtcccggtccgacaacgcactcaatctggtgaccgaacgtaagtatagcccaaaggataggctgcggctgtacaccccagacaactatgaaaaattcatccagaataaatctgcgagagaaatccaggcttatatccaaaacgcagatctgtacgggcagtacgcccacgccacctcagattatgggctccaaaatcccggaatgaatcgctttctgggcctctacggcgaggatgatgattcctggtgtagctcatctagttcttcatcggatagcgaggaagaaggctacttcctgggacaacctattcctcagccgcgcccacaacgatttgcttattatacagatgacctctcttctcccccatctgctttaccaaccccacaattcggacagcgtaccactaagagtaagaaaaaaaaagggcacaaggggaaaaattgcattatcagttag

SEQ ID NO: 129843 - DNA, 360 bp, Artificial Sequence
  Description of Artificial Sequence: Synthetic coding sequence
atgcccctcgagatggaacctaaaatgtctaagcttgcctttgggtgtcaacggtcttccacttcagacgacgattctggttgtgctctcgaggaatatgcttgggttccccctgggcttcgaccagagcagatccagctgtacttcgcctgtctgcctgaggaaaaagtgccatatgtgaattcccccggagagaagcacagaattaagcaactgctctaccagctcccccctcacgataatgaggttcgttactgccagtccctgagcgaggaagaaaagaaggaactccaggtgttttcagcacagcgcaagaaggaggctctaggtcgaggaaccattaagctactgagtaggtag

SEQ ID NO: 129844 - DNA, 480 bp, Artificial Sequence
  Description of Artificial Sequence: Synthetic coding sequence
atgcccctggaaatggaaccaaaaatgagcaaactggccttcggttgtcagcgaagctcgaccagtgacgacgatagtggctgcgcccttgaggagtacgcttgggtccctcccggccttaggcctgagcaaattcagttatactttgcctgcctgcccgaggagaaggtgccgtacgtgaactctcccggagagaaacacaggatcaagcagctcctgtaccaactgccaccacacgacaatgaggtaagatactgtcagtccctgagtgaggaagagaagaaggaactccaagtgttttccgcccagcggaaaaaagaagctctcggccgggggaccatcaaactactatctagagctgtcatgcacgccgtttgcgagcaatgcggtctaaagatcaatggcggggaagtggctgtgtttgcgagtcgagccggtccgggcgtgtgctggcatccttcttgcttcgtctgtttctag

SEQ ID NO: 129845 - DNA, 2496 bp, Artificial Sequence
  Description of Artificial Sequence: Synthetic coding sequence
atgcccctagagatggaacccaagatgtccaagttagcattcggctgtcagcggagctctacctcagatgatgacagcgggtgcgccttggaggaatacgcctgggtgccccctgggctgagaccagagcagatacagttatacttcgcatgcctgccagaggagaaagtgccctacgttaactccccaggcgagaaacataggatcaagcagttgctttatcaacttccgccccacgataatgaggtccgatactgtcagagcctttccgaggaagaaaaaaaggaactccaggtgttttcggcccagcggaaaaaagaagctctgggtagaggtactattaaactgttgtctcgagctgttatgcacgccgtatgtgagcagtgcgggctgaagattaatgggggtgaggttgctgttttcgcttcgcgggccggcccaggggtctgctggcaccccagctgtttcgtttgcttcacatgcaacgagctgctggtcgacctgatctatttttaccaggacgggaagatccactgtgggagacaccatgctgagctcctgaagcccaggtgttccgcttgtgacgaaatcatttttgctgatgaatgcactgaagccgagggtcgacattggcatatgaagcatttttgttgcctcgaatgtgagaccgtcctgggcggacagaggtacatcatgaaggatgggagacctttttgctgcggctgctttgagagcctgtacgccgaatactgcgagacttgcggagaacacattggagtcgatcatgcacagatgacctatgatgggcagcattggcacgccaccgaagcctgcttctcctgcgcccagtgtaaagcctctctgctgggatgccccttcttaccaaagcagggacagatctattgctctaagacttgttcacttggagaagatgtgcacgcgagcgattcaagcgactccgcattccagtccgcccgcagcagagacagccgaaggtcagttcgtatgggcaaaagctctaggtcagcagaccaatgtcgccagtcacttctgttgagtccagcactaaattacaagtttccgggcctttccggcaatgccgatgacaccctttcccgaaagctcgacgatctgtcactgagccggcaagggactagttttgccagcgaggaattttggaaaggacgagtcgaacaagagacaccggaagatcccgaggaatgggcggatcatgaagactacatgacccagctcctcctcaaatttggggacaaatccttgttccagcctcagccaaatgaaatggacataagagctagtgaacactggatcagtgacaacatggttaagagcaagaccgagctgaagcagaacaaccagtccctcgcatccaagaagtaccagagcgatatgtattgggcccaatctcaagacggattgggggactccgcatatggaagtcacccaggtcctgcaagctcccgaagactgcaggagctggagctggatcacggggcttccgggtacaaccacgacgagacacagtggtatgaggacagtctcgagtgcttgagcgacctgaagcccgaacagagcgtgcgggactctatggattcactagccctatccaatatcaccggcgctagcgtagacggcgagaacaagccccgcccgtccttgtactcgttgcaaaactttgaagagatggaaactgaagattgtgaaaaaatgtcaaacatgggcacactgaactcctccatgctgcacaggtcagccgagtccttgaaatcacttagctctgaattatgccccgaaaagatcctgcctgaggaaaaaccagttcaccttcctgtcctgcgtagatccaagagccagagcagacctcagcaggtaaaatttagcgatgatgtcatcgataacgggaactatgacatcgagattcgtcagccacctatgagcgaacgcactaggagaagagtgtataatttcgaggaacgggggtctaggagtcatcaccataggcgccggagatcccggaagagccgttccgacaacgccctaaacttggtgacagaaagaaagtatagtccaaaggaccgcctgcgactctacacccctgacaattatgaaaaattcatacaaaataagtccgcccgcgagatacaggcttacatccagaatgccgacttatacggccagtacgcgcatgccacctctgattatggacttcagaacccagggatgaacaggttcctgggactttacggcgaggacgatgattcctggtgcagttcatctagttcaagctcagactcagaggaagaaggatacttcctcggccagcccatcccacaaccccggccccagcggttcgcttattacaccgacgacctgtccagccctccttctgctttgccaactccccaattcgggcaacggacgacgaagtctaagaagaaaaaaggccacaagggaaaaaactgtattatcagctag

SEQ ID NO: 129846 - DNA, 2535 bp, Artificial Sequence
  Description of Artificial Sequence: Synthetic coding sequence
atggtgaccgtcatgccgctcgagatggaaaaaaccatctccaagctgatgttcgacttccaacgcaacagcacttcggacgatgactctggatgcgctctggaagagtatgcttgggtacctcccggcctcaaaccagagcaggttcaccagtattacagttgcctacccgaggagaaggtcccttatgtcaactctccaggtgagaagctgcgcatcaaacagttgctccaccagcttcctccacacgataacgaggtgcgttactgtaatagcctcgacgaggaggagaagagggagctcaaactgtttagttcacagcgcaagagggagaaccttggacgtggaaatgtccggccatttcccgttactatgacaggcgctatctgcgagcagtgcgggggccagataaatggcggcgatatcgccgtgttcgccagtcgcgccggacacggggtgtgctggcatcccccatgtttcgtctgtactgtttgcaatgagctgttagtagacctaatttatttctaccaggacggcaagatttactgcggacgacaccatgctgaatgtctgaagcctcgttgcgctgcttgcgacgaaattatatttgctgatgagtgtactgaagccgagggaaggcactggcatatgaaacatttctgctgtttcgaatgtgagacggtgctaggcggacaaagatacataatgaaagagggacgaccatactgctgtcactgcttcgaaagcctgtacgctgagtactgtgatacgtgcgcccagcacatcgggatcgatcagggacagatgacatacgatgggcaacactggcacgctactgaaacttgtttttgctgtgcccattgtaaaaagtcactcttgggccgaccgttcctgcccaagcagggccagatcttctgttcaagggcttgttccgctggcgaggaccccaacggaagtgatagcagcgattcggcattccagaacgctcgggccaaggaatcccgaagatcagccaagataggcaaaaacaaggggaagactgaggaacctatgcttaatcagcacagtcagctgcaagtgtcctctaatcgcctatctgcagacgtggatcctctgtctctgcaaatggatatgctgtcactgtcatctcagaccccttctctaaatagagaccccatttggaggagcagagaggagccctaccactacggcaacaaaatggagcaaaatcaaacccagtcaccactgcaacttttgtctcagtgcaacatcagaaccagctattcccccggaggtcaaggcgccggagcacagcctgagatgtgggggaagcacttttctaaccctaaaaggtcctcgagcctcgcaatgaccggacatgcggggtcctttatcaaggagtgtcgtgaagactactaccctggcaggttacgcagccaggaatcatattctgacatgagttctcagtctttcagcgagactagaggtagcattcaggtccccaagtatgaggaggaggaggaggaggagggaggcctgtcaacacagcagtgcagaacacggcaccccatctcttctcttaaatacacagaggacatgacgccaaccgagcagaccccaaggggcagcatggagagcctagccttaagtaatgctaccgggctgagcgccgacggcggggcgaaaaggcaagagcacttatccaggttttctatgccagatctgagcaaagacagtggtatgaatgtcagcgagaagctgagtaatatgggaacactaaacagtagtatgcaatttcgctcggctgaatccgttaggtcacttcttagcgctcaacagtatcaagagatggagggtaatctgcaccagctttcaaatcctatcggatacagagacctgcaatcccatggaagaatgcatcagtcattcgacttcgacggcggcatggccggaagcaagctgcccgggcaggaaggtgtgaggattcagcccatgtccgagaggacccgtaggagggccacttctagggacgacaacaggcggttccggccccaccgttcaagacggtcccgaagaagccgttcagacaatgcgttacatttagcatccgaaagagaggccatctcccgccttaaggatcgccctcctctgagagctcgcgaggattacgatcaatttatgcgacagcgttcctttcaggagtctatgggccacggatccagacgtgatttatatggccagtgtcctaggacagtttctgatctagccctgcaaaatgctttcggggatagatggggcccatacttcgctgagtacgattggtgttctacgtgctctagcagctccgaatcggataacgagggctattttctgggggagcctattccccagcctgccagattgaggtacgttacatccgacgagctattgcacaaatactcaagttatggcctcccaaagagcagtactctgggcgggcgcggacagttacacagcagaaagaggcagaaatcgaaaaattgtatcatatcctag

SEQ ID NO: 129847 - DNA, 453 bp, Artificial Sequence
  Description of Artificial Sequence: Synthetic coding sequence
atggtaaccgtaatgccgctcgagatggagaagactattagcaagctgatgttcgattttcagaggaatagcacttcagacgatgattctgggtgtgcgttggaggagtacgcttgggtcccacccgggctgaaaccagaacaggtgcatcaatattacagctgtctgcccgaggagaaggtgccgtatgttaattccccaggagaaaagctgcggatcaagcagttgctgcatcagctcccgccccatgataacgaagtccgttactgcaacagcttagacgaggaagagaaacgggaactgaagcttttttcgtctcagagaaaacgcgaaaacctcggaagagggaacgtgaggccattcccggtgaccatgactggcgccatctgcgaacagtgtggtggccagatcaacggcggggacatcgccgtttttgcgagcagggccgggtag

SEQ ID NO: 129848 - DNA, 1263 bp, Artificial Sequence
  Description of Artificial Sequence: Synthetic coding sequence
atggaaactttcgatccaaccgagctgccagagctacttaagctgtactaccggaggttgtttccctattcacagtactatagatggttaaactacgggggggtcattaagaactattttcagcacagagaattcagcttcaccctcaaggatgacatctatatccggtaccagtcgtttaacaatcagagtgacctagaaaaggagatgcagaaaatgaacccttacaaaattgatatcggagcagtctatagtcaccgcccgaaccagcataacacggtgaaactgggtgcctttcaggctcaggaaaaggaactcgttttcgatatcgacatgacagactacgacgacgttcgccgctgttgctccagtgctgatatctgtccgaagtgttggacacttatgacgatggctatacgcattatcgatagagcattgaaagaagattttggctttaagcacagactgtgggtgtactcagggcgaagaggcgtgcactgctgggtgtgcgatgaatctgtgagaaaactgtcatctgctgtccggtccggcattgtcgaatacctctcactggtgaagggtggccaggatgttaagaagaaggtgcacctgagcgaaaaaatccacccattcattaggaagagtatcaacattattaagaaatactttgaagagtacgccttggtcaatcaagatatcctcgaaaataaggaatcgtgggacaagatcctcgctctggtgccagagacgattcatgatgagctgcagcagtcctttcagaagtcgcacaattccctacagagatgggagcacctgaagaaggtcgcttcgagatatcagaataatattaaaaacgacaagtacggcccgtggttggagtgggagataatgctccagtattgctttcctcgcctagacattaatgtaagtaagggcattaatcatcttctgaagagcccattcagcgtgcatccaaagactggacgaatctccgtgcccatcgacctgcaaaaagtggaccaatttgacccatttactgtgcctacaattagcttcatttgtcgcgagctcgatgcgatatcgaccaacgaagaggaaaaagaggaaaacgaagcagagtctgacgtgaagcaccggacaagggactataaaaaaactagcctagctccttatgtcaaagtgtttgaacactttctggagaacctcgacaagtcaaggaagggagaacttctcaaaaagtctgaccttcagaaggatttttag

SEQ ID NO: 129849 - DNA, 1284 bp, Artificial Sequence
  Description of Artificial Sequence: Synthetic coding sequence
atggagacattcgacccaaccgaattaccggagctcctcaagctgtattatagacggctgttcccatattcacagtattacagatggctgaactacggtggtgttataaagaactatttccagcacagggagttctcctttactctgaaagacgacatctatataagataccagtcgtttaacaatcagagcgacctggagaaggagatgcagaaaatgaatccctacaaaatcgatatcggcgcggtctactcccacaggcctaatcagcacaatactgtcaaattgggagcctttcaggcccaggagaaggaactggtattcgatatcgatatgactgactatgacgatgtccggcgctgttgttcctccgccgatatctgcccaaaatgttggaccttgatgacaatggccattcgcattatcgatcgcgctctcaagggcaaagacttcggatttaagcacagattatgggtgtatagcgggcggcgcggggtgcactgctgggtctgtgatgaatcggtgagaaagctctcatcagctgtgaggagcggtatcgtcgagtacctatctctggtgaaaggcggccaggatgttaaaaaaaaggtacacttgtccgaaaagattcacccattcataaggaaaagtattaatatcatcaagaaatatttcgaggagtacgccctggttaatcaggatatacttgaaaacaaggaaagttgggacaagatcttagccctgatgggtttgttcctaaacgatccaagccccattcacgatgagcttcagcagtcattccaaaaatcccacaacagcttacagaggtgggaacatttaaagaaggtggcttcccgatatcaaaataatatcaagaacgataaatacgggccttggcttgagtgggaaatcatgctgcagtactgttttccacggttagatattaacgtgagtaaaggcatcaatcacctgttaaagagccctttctctgtgcatcccaaaaccggtcgcatttcagtaccaatcgatttgcagaaggtggatcagttcgaccccttcactgtgcccacaatctcctttatctgccgggagctcgatgccattagtaccaatgaggaggaaaaagaagagaacgaggcggaaagcgatgtgaagcatcggacacgggattacaagaagacctcccttgcaccttatgtgaaagtgtttgaacactttctcgagaacctggataagtcgcggaagggcgaactcctgaagaaaagcgacctccaaaaggacttttag

SEQ ID NO: 129850 - DNA, 762 bp, Artificial Sequence
  Description of Artificial Sequence: Synthetic coding sequence
atggccaatctggggtgttggatgcttgtgctgttcgtggccacttggagcgacctcggactgtgcaaaaaacgcccaaagcccgggggctggaacacggggggatcaagataccctggccagggaagtcctggaggtaaccgctacccaccacagggcgggggagggtggggacagccgcacggtggtggctggggccagccccacgggggcggctgggggcaacctcacgggggcggctggggccagcctcacggtggcggttgggggcagggcggagggacacattcgcagtggaacaagccctcaaagccaaagaccaatatgaaacacatggcaggcgccgctgctgcgggcgctgtcgtcggcggcctgggcggctacatgttgggttctgccatgtctcgaccaataattcattttgggtcggattacgaggatcgctattaccgggagaacatgcacagataccctaatcaagtgtattaccggccgatggatgagtattccaatcagaataatttcgtccacgattgcgtaaatatcactataaagcagcacactgtgactactactacaaaaggggagaattttaccgagacagatgtcaagatgatggaaagagtcgttgagcaaatgtgcatcacacagtatgaaagagaatcgcaggcctactaccaaaggggtagcagcatggtgctgtttagcagtccccccgtcatcctgctgatttcttttctcatcttcctcatcgtgggatag

SEQ ID NO: 129851 - DNA, 750 bp, Artificial Sequence
  Description of Artificial Sequence: Synthetic coding sequence
atggccaacctgggctgctggatgctggtgcttttcgtcgcaacctggtcagatttggggctgtgtaagaagcgccccaaaccgggagggtggaataccggcgggtcaagatacccaggccaggggagccccggcggcaaccggtatccaccgcaaggaggcggagggtggggacaaccacacggaggcgggtggggccagcctcacggaggcggctggggccagccgcacggtggcggttgggggcagccccacggtggtggatgggggcaggggggcgggactcattctcaatggaacaagcccagtaagccgaaaactaacatgaagcatatggcgggggccgctgccgcgggggctgttgtgggggggctgggcgggtacatgttaggcagtgcaatgtcccgcccaataatccatttcggtagcgactacgaggaccggtattatagagaaaatatgcaccggtatcccaatcaagtgtactatagacccatggacgagtacagcaaccagaacaactttgtccatgattgcgttaatatcaccatcaagcagcacacagtgactactacgactaagggagaaaattttactgagacagacgtcaagatgatggaacgcgtggtcgagcagatgtgcatcacccagtatgagcgtgagagccaagcatactatcaacgcggttcatctatggtgttgttttcctccccccccgtgattctgctgatttccttcctgattttctag

SEQ ID NO: 129852 - DNA, 762 bp, Artificial Sequence
  Description of Artificial Sequence: Synthetic coding sequence
atggcgaatttaggatgttggatgttggttttgtttgtggccacatggtccgatctggggctatgtaagaagcggccaaaaccgggcggttggaatacaggtggcagccgataccctggacaagggtctcccggaggaaatagatatcctcctcagggcggaggcgggtgggggcaacctcacggaggggggtggggacagcctcatggggggggctggggacagccacatgggggtggatggggacagcctcacggaggagggtggggccaaggcggcggaacccacagtcagtggaataaaccaagtaagcccaaaaccaacatgaaacacatggcaggcgccgcggccgccggtgctgttgtgggcggcctgggcggctacatgctgggctctgccatgagtcggcccattatccactttggcagcgattatgaggatcgctattaccgggagaacatgcaccgctaccctaaccaagtctactacagaccgatggacgagtacagcaatcagaataacttcgtgcatgattgtgtgaatattacaattaaacagcacaccgttacgaccacaacgaaaggcgaaaactttaccgaaaccgacgtgaagatgatggagcgcgtggtcgaacagatgtgcataacgcagtacgaacgcgaatcccaggcttactatcagcgcgggagctccatggtgctgtttagctctccaccagtcattttacttatctcattcttgatctttttgattgtgggttag

SEQ ID NO: 129853 - DNA, 579 bp, Artificial Sequence
  Description of Artificial Sequence: Synthetic coding sequence
atggaacattggggccagcctcatggaggaggttggggccagccacacggcggcggctggggacagcctcacggcggaggctggggtcagggcggcgggacccactcccaatggaataagccctctaagccaaaaactaacatgaaacatatggcaggcgccgcagctgccggtgccgtggtgggcggcctgggcgggtacatgctgggatccgctatgagcaggccaatcatacattttggctcagactatgaagaccggtactatcgcgagaacatgcaccgctatccaaatcaggtgtactacaggcccatggacgaatactcaaatcagaataactttgtccacgactgcgtcaatataactattaaacagcacaccgtcacgactacgaccaagggtgagaactttactgaaaccgatgtgaaaatgatggaaagagtggtcgagcagatgtgtatcacgcagtacgaacgcgaaagtcaggcgtattaccagcgcgggagtagcatggtcctgttttcgtctccacctgtgattttattgatctccttcttaattttccttatcgtaggttag

SEQ ID NO: 129854 - DNA, 654 bp, Artificial Sequence
  Description of Artificial Sequence: Synthetic coding sequence
atggccaacctgggctgttggatgctcgtcttatttgttgccacgtggagtgatttaggtctctgcaaaaagagacctaaacccggaggttggaatactggcgggtctaggtacccgggccagggttcaccgggcggtaaccgatacccaccgcaaggcggcggcggctggggccagcctcacggcggcggctgggggcaacctcacggggggggctggggccagcctcatggggggggctggggccagccccatggcggcgggtggggccagggcggtgggacccattctcagtggaataaaccatctaaaccaaagaccaacatgaagcatatggctggcgccgccgcagccggggccgttgtgggtgggctcgggggatatatgttgggatccgctatgtctcgacctataatccacttcgggtcagattacgaagatagatactacagggagaacatgcacaggtaccccaatcaggtctattatcgccccatggacgagtacagcaaccagaataacttcgttcatgattgcgttaatattactatcaagcaacacactgtgacaacaacgacgaagggagagaatttcaccgagaccgatgtaaaaatgatggaaagagtggttgaacagatgtgtattacccaatag

SEQ ID NO: 129855 - DNA, 531 bp, Artificial Sequence
  Description of Artificial Sequence: Synthetic coding sequence
atgcggaagcatttgtcctggtggtggttggcgacggtgtgcatgctccttttcagccacctaagcgcagttcagacccgaggaataaaacacagaatcaaatggaataggaaagcgctgccaagcacagcgcaaatcaccgaagcgcaggtagccgaaaatcgacctggcgcatttatcaaacagggccggaagttagatatcgatttcggcgcggagggtaatcgctactatgaggcaaattactggcagttcccagacggtattcactataacggatgctctgaggctaatgtcacaaaagaagccttcgtgaccggttgcataaacgccacccaagccgcaaaccaaggagagttccagaaacctgataataagctgcatcagcaggtcctttggcggcttgtacaagagttatgcagtctaaagcattgtgagttttggttggagagaggcgccgggctgcgagtgaccatgcaccagcccgttttgctctgcctgctggcgctgatttggctgactgttaagtag

SEQ ID NO: 129856 - DNA, 1023 bp, Artificial Sequence
  Description of Artificial Sequence: Synthetic coding sequence
atggctacgggtggctaccgaacttctagcggactaggaggcagtacgacggactttctcgaagagtggaaagcaaaaagagaaaagatgagagccaagcaaaacccgcccggcccagcccctccggggggcggttctagcgatgcagcgggaaagccgccagctggggctctggggacgccggccgccgccgctgcaaacgagctgaataataacctcccagggggcgccccggccgccccagcggtcccaggccctgggggggtcaactgtgccgtgggatctgcaatgctgacccgggccgcccctggtccccgtaggagcgaagacgagcccccagcagcgagcgcctccgcggcacccccccctcagcgggacgaagaagagcccgacggggttcctgaaaagggcaagtcctcaggccctagtgcccgcaagggcaagggccaaatagaaaaaaggaaactgagggaaaagcggcggagtaccggcgtcgtcaacattccagcagcagaatgcctcgatgagtatgaggacgacgaagcaggtcaaaaggagcgcaagcgggaagacgcgatcacccagcagaatactattcaaaacgaagccgtgaaccttttagacccaggatcctcatatctgctgcaggagcctccaagaacagtgtccgggagatacaaatctactacctcagtctcagaggaggatgtgtctagtcggtactctagaacggaccgctcaggtttcccccgctataatagggacgccaacgtttccggcactctggtttcttcctctacgctggagaaaaagattgaagatctcgagaaggaggtagtaagggagcggcaagagaatctgcgactggtccggctgatgcaagataaagaagaaatgatcggaaaactgaaggaggaaatcgatctattgaacagggacttggatgatatcgaagatgagaatgaacagctgaagcaggagaacaagacattactgaaagtggtcggacagttgacccgatag

SEQ ID NO: 129857 - DNA, 231 bp, Artificial Sequence
  Description of Artificial Sequence: Synthetic coding sequence
atggccactggaggatacaggacctcttccggcctgggggggtcgacgaccgacttcctcgaggaatggaaggctaagcgtgagaagatgcgtgcaaagcagaatcctccgggacccgcccctcccggcggaggaagtagcgatgctgcgggcaagccgccagcaggggctctggggacacctgcggcagccgccgcaaatgagctgaacaacaacctccctggcgggtag

SEQ ID NO: 129858 - DNA, 195 bp, Artificial Sequence
  Description of Artificial Sequence: Synthetic coding sequence
atggctacaggcggatatagaaccagcagtggcctcggaggcagcaccactgatttcctcgaggagtggaaggcaaagcgcgagaagatgagagcgaaacagaatccaccgggaccagctccccctggcggcggaagctccgatgctgcgggtaagccacctgccggagctctcgggacccccgcagcggcctag

SEQ ID NO: 129859 - DNA, 663 bp, Artificial Sequence
  Description of Artificial Sequence: Synthetic coding sequence
atgaaaagcgtgatctaccatgccctgagtcagaaagaagccaacgattccgacgtgcagccatccggagctcagagggctgaggctttcgtgcgagcttttctgaaacgttccacaccacgaatgtctccgcaagctcgcgaggatcagctgcagaggaaagccgtagtgctggagtactttaccagacacaagagaaaggagaaaaagaaaaaggccaaaggcttgagtgctcggcaacgtagggagctgcgactgttcgatataaaacccgagcagcagcgatattccctcttcttgcccctccacgaattatggaaacagtacataagagacctgtgctccggtctaaaacccgacacccagccccaaatgatccaggcaaagctgttgaaagcagacttgcacggcgcgatcatcagcgtgacaaaaagtaaatgccccagctacgtggggatcacaggcatcctgctccaagagacaaaacatatcttcaaaataatcacaaaggaggacagattaaaagtgattcccaagctcaattgcgtcttcacagtggagactgacgggttcatctcttatatctacgggtctaagtttcagctgcgcagctccgaacgaagcgctaaaaagttcaaggctaaagggaccatcgatctgtag

SEQ ID NO: 129860 - DNA, 1695 bp, Artificial Sequence
  Description of Artificial Sequence: Synthetic coding sequence
atgtcatcccacggcaactctctgttccttagggaaagtggacagcgactgggtcgcgtcggttggctgcagagattacaggaaagcctccagcagcgtgctctgaggacccgtcttcgtctgcaaaccatgaccctggagcacgtgctgcggttccttcgcaggaacgccttcatactgttgacagtgtccgccgttgtgataggggtgagcttggcattcgccctgcggccctaccaactcacgtacagacagatcaagtactttagctttccaggagagctgctcatgcgtatgctccaaatgttagttcttccgcttattgtctccagtctggtgaccggcatggcaagccttgacaacaaagctaccggaaggatgggcatgcgagcggccgtgtattatatggttactacaatcattgctgttttcattgggattctaatggtgaccattatacatccaggcaaagggagcaaggagggtctgcatcgcgaaggtcgcatcgagaccatcccgacagcagatgcattcatggatctcatcagaaatatgttccctcccaatctcgttgaagcctgtttcaagcagttcaaaacgcagtatagtacacgagttgtgaccaggactatggtgagaactgagaacggtagcgagcccggtgcctccatgccccctcctttctccgtagaaaatgggacctccttcttagagaatgtaactcgcgcactggggaccctgcaagaaatgcttagctttgaagagactgtgcccgtaccgggctctgcaaacggaatcaacgcgctgggcctggtggtgttcagtgtggccttcggactggtaattggagggatgaaacataaaggcagggtcctgcgggattttttcgactcgttgaacgaagccataatgcgcttggtgggcattattatttggtatgcgccagtggggatcctattcctcattgcgggaaaaatcctcgagatggaggacatggccgtgctgggcggccagctgggcatgtacaccctgacagtaatcgtgggcctgtttctccacgctggcattgtgcttccacttatctattttttggttacccaccgtaacccatttccttttattggcggcatgctgcaggccctgataaccgccatggggacctcatctagttccgccacactcccaatcacgtttagatgcctggaggagggcctcggtgttgataggaggattacgaggtttgtcctcccggtaggggccacggttaatatggatggcactgctctgtacgaagcacttgctgctatttttattgctcaggtcaataactatgaactcaacctgggccagattacaaccatctccatcacagcaaccgctgccagtgttggggcagcaggaataccccaggccggattagtgacaatggtgattgtgctcactagcgtggggctacccaccgaggacattacactcataattgctgtggattggtttttagaccggctgaggactatgaccaatgtgctcggagatagcatcggggccgccgttatcgaacaccttagtcagagggaactggaactgcaggaggcagagctgactctgccttcgctgggcaagccctacaagagtctgatggcacaagaaaagggggcctcaaggggacggggaggcaacgaatccgccatgtag

SEQ ID NO: 129861 - DNA, 420 bp, Artificial Sequence
  Description of Artificial Sequence: Synthetic coding sequence
atgcattgtctcagaaagagacggatgacaccaatgtctagatactcattgttccttccactgcacgaattgtggaaacagtatattcgcgatctctgttcagggttgaaacctgatactcaacctcagatgatccaggccaagctcctgaaagctgatctgcatggcgctatcattagcgtaacaaaaagtaaatgtccttcctatgtcggcatcacaggtatattattacaggagaccaaacatatttttaagataatcactaaggaagatcgattaaaagtaattccgaaactgaactgcgtgtttacagtcgaaacggatgggttcatcagctatatttacggctcaaaattccaattacggagctcagagcggtctgccaaaaagtttaaggccaaggggacaatcgatctctag

SEQ ID NO: 129862 - DNA, 342 bp, Artificial Sequence
  Description of Artificial Sequence: Synthetic coding sequence
atggtccgattcaagcaccggtacctactttgtgagctggtgagcgacgacccccgctgtaggctctctctcgacgaccgggtgctgtccagcttggtgcgtgacacgattgcgcgcgtgcatggtacgttcggtgccgcagcttgtagcatagggttcgctggaactattaggacgtgccagaaatttctcattcagtacaaccggcgccagttattgatactcttgcagaactgtacagatgagggcgaacgagaggcgattcaaaaaagcgtgactaggtcctgcctgctcgaggaagaggaggagagtggagaggaagctgcggaagccatggaatag

SEQ ID NO: 129863 - DNA, 492 bp, Artificial Sequence
  Description of Artificial Sequence: Synthetic coding sequence
atggtccggtttaagcacagatatctcctctgcgagctggtcagcgatgaccccaggtgtcgcttatctttggacgatcgggtgctgtcaagcctcgtgcgggatactatcgccagagtgcacggcacctttggcgccgcagcttgctccatcgggttcgcagtgcgttacttgaacgcctacacaggcattgtcttactgagatgccggaaagaattctaccagttggtctggagcgccctgcctttcataacatatctcgagaataaaggccatcggtacccatgcttttttaataccctgcacgtgggaggcaccattaggacttgtcagaaattcctcattcagtataatcggcgccagctactaattctgctgcagaactgcaccgacgagggggagagggaggctatacagaagagcgtcacaaggtcttgtctactggaagaggaggaagagagcggagaggaagcggctgaagccatggagtag

SEQ ID NO: 129864 - DNA, 423 bp, Artificial Sequence
  Description of Artificial Sequence: Synthetic coding sequence
atggctgagaaccgcgagccaagaggggctgtggaagctgaactggaccctgttgaatacactttgagaaaaagactcccttcaagattaccaagaagaccaaatgatatctatgtgaatatgaaaaccgactttaaagcccagctggcacgttgccagaagcttttagacggcggcgccaggggccagaatgcctgctccgagatttatattcacggcctcgggctggctattaatagggccataaacattgccctacagttacaggccggaagctttggaagtcttcaggtcgctgccaatacctcaacagttgagctggtagacgagctcgaacccgaaacagatacacgggagcccctaactcgtatacgcaacaactctgccattcatatccgggtgttccgagtcacacccaaatag

SEQ ID NO: 129865 - DNA, 414 bp, Artificial Sequence
  Description of Artificial Sequence: Synthetic coding sequence
atggcggagaatcgagagcccaggggagcagtggaggcagagctggatccagtggaatacacgctgcgaaagcgtttgccgagtaggctcccccggcgccctaatgacatatatgtcaatatgaagaccgacttcaaagcccaattagccaggtgtcagaaactactcgatggcggtgcccgaggacaaaacgcttgttccgagatttacattcatggcctgggcctggctataaacagggcgattaacatagcattgcagttgcaggctggatcttttggctcgctccaggtcgctgccaatacctcgaccgtagagttagtggacgaattggaacccgagacagacacccgggagccactgaccaggatccgaaacaactctgctatacacatccgagtattccgggtgtag

SEQ ID NO: 129866 - DNA, 708 bp, Artificial Sequence
  Description of Artificial Sequence: Synthetic coding sequence
atgaggaggggcgcgccacaagaccaggagctggtcggccccggaccaccaggacgcggttcccgtggagcccctccacctctgggcccagtggtcccagtcctcgtatttcctcccgatcttgtgtttagggccgatcagcgcagtggccccagacagcttctcaccctctataaccctaccggtacagccttgaggtttagggtgctttgtactgccccagcaaaatataccgtgttcgacgccgagggctatgtgaaaccacagagctgcatcgacattgttatccgacacgtggcgcctattcctagccattatgatgtgcaagaccgctttaggattgagctgtccgaggagggcgcggagggccgggtggttggaaggaaggatatcaccagtattctgagagctcccgcttaccccctggagctgcagggacagccagatccagcccctagacccggccccccagcaggcacacctccgcctaccgcgcggcattttcaagaacaccccagacagcaacttgcaacaagtagctttctgctgttcctgttgacaggcatagtgagcgtggcctttttactcctccctctgcctgacgagttgggcagccagttgcctcaggtgctgcatgtatcactcggtcagaaacttgtagcggcatatgtgctcggactactcacaatggtgtttctgagaacttag

SEQ ID NO: 129867 - DNA, 1248 bp, Artificial Sequence
  Description of Artificial Sequence: Synthetic coding sequence
atgagaggtgcgaatgcctgggcccctctgtgtctgctgttagcagctgcgactcagctctctcgtcagcagtctcctgagcggccagtattcacttgtggcggtatcctgaccggtgaatcaggcttcatcgggagcgagggatttcccggagtgtatccccctaattctaagtgcacttggaagatcactgtgccagagggcaaggtggtggttctgaacttcagattcatcgacctggaaagcgataatctctgccgctacgattttgtggacgtttacaatggccacgcaaacgggcagaggatcggtaggttctgtggaacgtttcggcctggggcccttgtgagctctggaaataagatgatggtgcaaatgatcagcgacgcaaacacggccggtaacggctttatggctatgttctccgccgccgaacctaatgaaagaggggaccagtactgcggagggctgttagatcgcccttccggctccttcaagaccccgaactggcctgaccgcgattaccctgcaggggttacttgcgtatggcacatcgtcgcgcccaagaatcagttgattgagctgaagttcgagaaatttgacgtggagcgggacaattactgccgctacgattacgtcgccgtgttcaacggcggcgaggtcaatgatgcccggcgcattggcaaatactgcggagacagcccccctgctcccatcgtgtcagagcggaacgagctcttgattcagtttctgagcgatttatcacttactgccgacggatttattggccactacatattccgccccaaaaagctacctacgacaacagagcaacccgtcacaaccacatttccagttacaaccggcctgaaaccaacggtcgcgctgtgccagcagaaatgtaggagaacaggaacactggaggggaattattgctccagcgattttgtcctcgcgggcacggtcatcaccactattaccagagatggcagcttacacgccacagtatcaatcatcaacatctataaagaaggaaatcttgctatacagcaggccggaaagaacatgtccgccaggctgactgtagtttgcaaacagtgtcctttgcttcggagggggctgaactatataattatgggccaggtgggcgaagacggcaggggaaagataatgcccaacagttttatcatgatgtttaagactaagaaccagaaactactggacgcgctaaagaacaaacagtgttag

SEQ ID NO: 129868 - DNA, 2184 bp, Artificial Sequence
  Description of Artificial Sequence: Synthetic coding sequence
atgcgacccctgcttcttttggccctgctaggttggctgttgctggctgaagccaagggggatgctaagcccgaggacaatctactggttctgactgtggctacaaaggaaaccgaaggttttcggaggttcaagcgttccgcacagtttttcaattataagatccaggccttgggacttggggaagactggaacgtcgaaaaggggacaagtgctgggggtggccagaaagtgaggctcctcaaaaaggccctggaaaaacatgccgataaggaggacttagttattttgttcgccgactcttacgatgtcttgttcgccagtggcccgagagaattgctcaagaagttccgccaggcaaggtctcaggtggtttttagtgctgaggaactcatctaccctgacaggcggcttgagaccaaatacccagtcgtgagcgacggcaagagatttctggggtcagggggcttcatcgggtatgcgccaaatcttagtaagctcgtggccgaatgggagggacaagactcggactccgaccagctcttctacacgaaaatatttctggaccctgagaaaagagagcagattaacatcactcttgaccaccgatgcaggatatttcaaaatttggatggggccctggacgaagtggttctgaagttcgagatgggacacgtgagagccagaaaccttgcctacgatacattacctgtgctcattcacgggaacggacctacaaaacttcaacttaactatctgggcaattacatccctcgattttggacttttgaaaccggatgtacagtgtgtgacgagggccttcggagtttaaagggaatcggtgatgaagctctgcctaccgttctggttggtgtctttatagagcaacccactccttttgtgtccctgttcttccaacgcttgctccggctccactacccccagaagcatatgcggctgttcattcataaccacgagcagcaccataaagcccaagttgaggaattcctcgcacaacatgggtcagaataccaatccgtgaaactcgtgggcccagaggtgagaatggcaaatgccgatgcgcgaaacatgggcgccgacctctgtcgccaggaccggtcctgcacatattacttctccgtggatgccgacgtggcccttacagaaccaaattcattgagactcctgattcagcagaataaaaatgttatcgctcccctaatgacacgccacgggaggctttggtcaaatttttggggtgctctgtctgcggacggatactacgcaaggagtgaagactacgtggatattgtgcaaggcagacgcgtcggggtgtggaatgtgccttacatcagcaacatttatctgattaagggtagcgctctccgtggggaattacagagttccgatctgttccatcactccaagctggatcccgacatggcattttgcgccaacattaggcagcaggacgtctttatgtttttgaccaaccggcacacactggggcacttactgtcgctggattcctatcgcaccacccacctccataatgacttatgggaggtcttctcaaatcccgaggactggaaggaaaagtacatccatcagaactatacaaaggcactcgccgggaaactggtggaaacaccgtgtcccgacgtgtactggttccctatttttaccgaagttgcttgcgatgagttggtggaggaaatggagcactttggacagtggagcctgggtaacaacaaggacaatagaattcaagggggttacgagaatgttcctacgattgatatccatatgaatcagattggcttcgagagggagtggcacaagttcctgttggagtacatagcccctatgacggaaaaactgtaccccgggtattatacaagggcccaatttgatttggcttttgtggtgagatacaagccagatgaacaaccctctcttatgccccatcatgacgcctccactttcacaattaatattgccctgaatcgggtgggagttgattatgagggcggcggctgccggttcttacgttacaattgtagtattcgtgctccgcgtaaaggctggacactgatgcaccccgggcggctcacccactaccatgaaggcctgccaaccacccgtggaacacgatacatagctgtgtctttcgtcgatccatag

SEQ ID NO: 129869 - DNA, 600 bp, Artificial Sequence
  Description of Artificial Sequence: Synthetic coding sequence
atgcggccactgctgctgctggcgttgctggggtggctgctattagccgaggccaaaggggatgctaagccagaagacaatctcctggtgctcacagtggccacaaaagaaacagaagggtttcggcggttcaagagaagcgcccagttcttcaactacaagatacaggccctggggctgggggaagattggaatgtggaaaagggcacctcagccggtggtggacagaaagtcagactgctgaagaaggcattagaaaagcacgctgataaggaggacctagttattctgttcgccgattcttatgacgtgttatttgcttccggtccaagggagctcctcaagaaattccgacaagcgaggtcacaggtggtgttttcggcagaggaactcatctatcctgataggcgattggagaccaaataccctgttgtcagcgatggcaaacgatttctgggctccggcgggtttattggttacgctccaaacttgagcaaacttgtggccgaatgggaagggcaagactctgattccgatcagctgttttatacaaaaatttttttagaccctgagaagcgtgtgtctagactgcacagctag

SEQ ID NO: 129870 - DNA, 2325 bp, Artificial Sequence
  Description of Artificial Sequence: Synthetic coding sequence
atgcgcccactgcttctgcttgccctgttaggctggctgctgctcgccgaagccaagggcgatgctaagcctgaggcgccctgttgtcaggaggggttgcgcgctgggggctcgggctctctgcacctggggcgggacttcaccgtgctggctggcgcccgaggcagtccctcaccgtctgtcagctccatacctaggttttggatccctggctcggataaccttcttgtattgacagtggcaacaaaagagacagaaggttttcgccgcttcaaacgttcagctcagtttttcaattataaaattcaggccttgggcctaggagaggattggaacgtagagaaggggacaagcgccggtggagggcagaaggtgcgcctgcttaagaaagctctagaaaagcatgctgacaaagaggatttagtaatactgttcgccgactcttatgatgtgctcttcgcatctgggcctagggagttactcaaaaagtttcgccaagcacgctcccaggtcgtcttttccgccgaagaactaatatatccagaccggaggcttgagactaagtatccagttgtgtctgacggaaagcggttcctggggtccggcggctttattggctatgcaccgaacttatcaaagctggtggcagaatgggagggtcaagactccgacagtgatcagttattttatacaaaaatttttctggatcctgaaaaacgggaacagataaacatcacattggatcatcgatgtcggatatttcagaatcttgacggggcactggatgaggtggttctcaaatttgagatggggcatgtgagagcacggaacctggcctacgacactctccccgtattgattcatggcaatggtccgacaaagctgcagctgaattatttgggtaactatatccctcggttctggacatttgagactgggtgtaccgtttgtgatgaaggcctccgctctctgaaggggatcggggatgaggcgttaccgaccgtacttgtgggagtttttatcgagcagccgacgcccttcgtgagtttgttctttcagagattactccgtctccattacccccagaaacatatgcgactgtttatccacaaccacgaacagcaccacaaagcccaggttgaagagttcttagcccagcatgggtccgaataccaatccgttaagcttgtggggccggaagtgcggatggcaaacgctgacgcgcgaaatatgggggcagacctgtgccgccaagacagatcgtgcacgtactatttctcggtggatgctgacgtcgcccttaccgaaccgaattccttaaggctgctgatccagcagaataagaacgttatcgctcctctcatgacaagacacggccgcctgtggagtaacttctggggggcattgtccgccgatggatattacgcaaggtcagaggattatgtcgacatagttcaaggcaggcgcgtcggagtttggaacgttccctacatctcaaacatttacctgatcaagggttcggcattgcgcggcgaactacaaagtagcgacttatttcaccactcaaagctcgatcccgatatggccttttgtgcgaacattcgccagcaagatgtattcatgtttcttaccaacagacacaccttaggacatttgttgtcgctggattcctataggaccacccacttacataatgatctgtgggaggtctttagcaaccccgaggactggaaagagaagtacattcaccagaattataccaaggccctcgcaggcaaacttgtcgaaaccccttgccctgacgtatactggttccctatttttaccgaggtcgcttgtgacgagctggtagaggagatggagcacttcggccaatggagtctcggtaataacaaagacaacaggatccaaggcggctatgaaaacgtcccaacaattgatatccacatgaatcagatcggctttgaacgcgaatggcataagttcttgctcgaatacattgctcctatgactgaaaagttgtacccaggatattatacaagagcgcagtttgatctcgccttcgtggtccgctataaaccggacgaacagccttccctcatgccccaccacgatgcttcgacgtttaccatcaatattgctctgaatagggtaggtgttgattacgaggggggtgggtgccggtttctacgatacaactgctcaatacgagccccgcggaaggggtggaccctgatgcaccccgggcgcttaactcactaccacgagggccttccgacaacacgcggaacccggtatatagcagtgagctttgtcgatccatag

SEQ ID NO: 129871 - DNA, 1176 bp, Artificial Sequence
  Description of Artificial Sequence: Synthetic coding sequence
atgcggcctttgctgctgctggccctcctgggctggctgttgctggccgaggcaaagggtgatgctaaacccgaagataatttgctcgtcctgaccgtcgccaccaaggaaaccgaggggttccggcgcttcaagaggagcgcccagtttttcaactataagatacaagccctgggcttaggtgaagactggaacgtggagaaaggtacttcggcgggaggaggacagaaagtcagactcctaaaaaaggctctcgaaaaacatgctgacaaggaggatttagtgatcttgttcgcagattcttatgacgtgctttttgcttccggtccgcgcgagcttcttaagaagtttaggcaagctcggtcacaggtggtgttctcagctgaagaactgatctatcccgaccgcaggcttgagactaagtatcccgtggtgtccgacggaaaacgctttctcctggaggatgttttcatgtttctgaccaacaggcacacacttggtcatctcttgagcctcgactcatacagaactacgcacctgcataacgatctgtgggaggtgttctctaacccggaagactggaaagagaagtacattcaccagaactataccaaggcactggcaggtaaacttgtagaaaccccgtgtcccgacgtctattggtttcccatctttacggaggtggcttgcgacgagctggtcgaggaaatggagcattttgggcagtggtcactgggcaataacaaagacaacaggatccagggaggttacgagaatgtccctaccatcgatattcacatgaatcagatcggtttcgaaagagagtggcataaatttctcctggaatacatcgcacctatgacggagaaactgtacccaggctactacacccgcgcccaattcgacctggccttcgtggtgaggtataagcctgacgaacagccctctctgatgcctcaccacgatgcctctacgttcaccattaatatcgctctcaatcgtgtcggcgtcgattacgaaggaggaggctgtagattcctgagatacaactgtagtatacgcgctccaaggaagggctggacacttatgcaccccggcaggctgacgcactatcacgaaggtttgcctacaacaagaggaactcgctatatcgcagtttccttcgtggatccttag

SEQ ID NO: 129872 - DNA, 852 bp, Artificial Sequence
  Description of Artificial Sequence: Synthetic coding sequence
atgagacctttgctgcttctggctctgctggggtggttactactcgccgaagccaagggcgatgcaaaacctgaagacaatctcctggtcttaactgtggcaacaaaagaaaccgagggctttcggagattcaaacggtcagcacaatttttcaattacaaaatccaagcactgggactgggagaggattggaacgtggagaagggaacatctgccggcggtggccagaaagtccgccttttaaaaaaggcactggagaaacacgccgacaaggaagatctggtcattctgttcgctgactcatatgatgtcttgtttgcatccggcccaagggagttgctcaaaaagttccgccaggcccggtcgcaggtcgtgtttagtgcggaggagttgatttacccagatcggcggctcgagaccaaatacccagtagtgtctgacggcaagcgatttctcggatccggaggttttattgggtacgccccaaacctgtcgaagttagtagcggagtgggagggtcaggactccgactccgatcagttgttctacaccaaaattttcctggacccagaaaagagagagcagattaacataaccctggatcaccggtgccgcatcttccagaacctcgatggtgctcttgtttccccctggggacaggggcacttgcctggagcttgttacgagttgaccgcaagcgttctgaccagcgaactctccgtgatgccctcgtttccagctgtcgtgctgcagctaaattatcttgggaattacatcccacgtttctggactttcgagacagggtgcacggtgtgcgacgaaggcctccgctccctcaagggcatcggatag

SEQ ID NO: 129873 - DNA, 678 bp, Artificial Sequence
  Description of Artificial Sequence: Synthetic coding sequence
atgagacccctacttctgctggccctcttaggttggctgctgttagctgaggccaagggtgatgccaaaccagaagctccttgctgccaggaaggactgagagctgggggatcaggcagcctgcaccttggaagggattttacagtgctggcaggggctaggggatcacccagccctagcgtgagttcaatacctaggttctggatacccggctcagataatctgcttgttttaactgtggctaccaaggagacagaaggctttcggaggttcaaaagaagcgcccagttttttaattacaagatccaggcacttggcctaggtgaggactggaacgtcgaaaagggtacctccgctggtggcggacaaaaggtgaggctattaaagaaagctctggagaagcacgctgataaagaggatttggtcattctgttcgcggacagctacgacgttcttttcgcttctggcccacgggagctgctcaagaagttcagacaggccaggagccaggtcgtattctctgctgaagagctcatttacccagaccggaggctggagactaagtatcctgttgtgagtgatgggaagcgcttcttgggatcaggaggctttatcggctatgcccccaatcttagcaagctggtagctgagtgggaaggacaggacagtgactcctag

SEQ ID NO: 129874 - DNA, 2277 bp, Artificial Sequence
  Description of Artificial Sequence: Synthetic coding sequence
atgggcggctgcactgttaaacctcagttactgctgctggccctcgttctgcatccctggaacccttgtctcggcgccgactctgagaagccatctagtattccgacagacaaattgctggtgatcacagtggctactaaggaatccgacggattccatagatttatgcagtctgctaagtattttaattacacggtgaaggtgctcggccagggcgaagaatggaggggaggggacggaatcaattctataggaggggggcaaaaagtacgtctgatgaaagaggttatggaacattacgcagaccaagacgatctggtcgtcatgtttactgaatgtttcgacgtgatttttgctgggggtccagaggaggtcctgaaaaaatttcagaaagccaaccacaaggtcgtattcgcggcagatggaattctgtggccagataagcgcctggctgacaaatacccggtagttcatatcgggaagcggtacctgaacagcgggggattcatcggctatgctccctacgtaaacagaatagtgcagcagtggaacctgcaggataacgacgacgaccagctgttttatacaaaggtgtacatagatcctttgaagcgagaagctattaacatcacccttgatcacaaatgcaaaatttttcagactctgaatggcgcagtggacgaggtcgtactgaaatttgaaaacggcaaggcccgcgccaagaataccttttacgaaactctgcctgtcgcgataaatggcaatggtcctacaaaaatccttctaaactacttcgggaattacgtgccaaattcctggactcaggataatgggtgcaccttatgcgagttcgataccgtggacctgtccgccgtcgatgtgcaccctaatgtttcaatcggcgtcttcattgagcagccgactccattccttccgagattcctcgacatcctactcacgcttgactatccaaaggaagccctcaagctgtttattcataataaagaggtttaccatgagaaagacataaaggtgtttttcgacaaggccaagcatgagattaaaactatcaagatcgtgggtccagaagaaaatttgagccaggctgaagcccgcaacatgggcatggatttctgtcggcaggatgaaaagtgtgactattatttttccgttgacgcggatgtcgtcctgacgaacccccggacgctgaaaatcctgattgaacaaaaccgcaaaatcatcgctccattagtcactcgacacggcaagctctggtcaaatttttggggggcactttccccagatggttattatgctcgcagtgaggactacgtcgacattgtgcagggtaatcgcgtgggcgtgtggaacgttccctacatggcaaatgtgtacctgatcaaggggaaaacactgcgaagcgaaatgaatgagcgcaattacttcgtccgagacaagttggacccagacatggccctgtgtcggaacgctcgagagatgacactccagcgggagaaggactcacctacaccggaaacatttcagatgttgagcccgcccaaaggcgtctttatgtacatcagtaatcgacacgaattcggacggctgttgtccactgctaattataacacctcccattacaacaatgatctctggcagattttcgaaaaccccgttgactggaaagaaaaatatatcaaccgggattatagtaaaatatttaccgaaaatatcgtcgagcagccctgtcccgacgtcttttggttcccaatcttttcagaaaaagcctgcgacgagttagttgaggaaatggagcactacggcaagtggagcggaggtaagcaccacgattcacggatatccggaggatacgagaacgtgccaacggatgacatccacatgaagcaagtggacctggagaacgtgtggctgcacttcattagagaatttatagctcctgtgacactgaaggtgttcgccgggtactacaccaagggcttcgccctgcttaattttgtggttaagtacagtcccgagagacagagaagcctccggccccaccacgacgctagcacgttcaccatcaacatagccttaaacaacgtgggcgaagacttccagggaggtggctgtaagtttctgaggtacaactgctcaattgagtccccacgcaaagggtggtcatttatgcaccctggccggctcacacaccttcacgaaggacttcctgtcaagaatggcacacgctatatcgcagtgagttttattgacccctag

SEQ ID NO: 129875 - DNA, 2214 bp, Artificial Sequence
  Description of Artificial Sequence: Synthetic coding sequence
atggggggctgtacagtcaaaccccagctccttcttctcgctctggtgttacacccttggaacccctgtctaggtgccgactctgagaagccttcaagtatcccgacagacaagctgcttgtgataacagttgctaccaaagagagcgacggctttcacagattcatgcagtctgctaaatactttaactacacagtgaaagtccttgggcaaggagaagagtggcggggcggcgatggtattaatagcatcggtggggggcagaaagtccggcttatgaaagaagtgatggagcattatgccgatcaggacgatctggtcgtaatgtttaccgaatgctttgacgtcatatttgcaggaggaccagaggaggtcctaaagaagttccagaaagccaatcacaaagtggtcttcgccgccgatggcatcttatggcctgataagcgattagctgacaagtaccctgtggtccacatcggcaagagataccttaattccggaggctttattggttacgctccgtacgttaaccggatcgttcagcagtggaatctgcaggataatgacgatgaccagctattttacaccaaggtctatattgaccctcttaagcgcgaggcaattaatatcactctggaccacaagtgtaagatcttccagacactcaacggcgcggttgatgaggtcgtcctaaaattcgagaatggaaaagccagggccaagaacacattttacgaaacgctgcccgtcgctatcaatggtaacggtccaaccaagatactgttgaattactttgggaattacgttcctaactcgtggactcaagataacgggtgtaccttatgtgagttcgacacagtagatctttcagccgttgatgtccaccccaacgtatcgatcggggttttcatagaacagccaacgccatttctccctaggtttctagacatcctcctgacactggactatcccaaggaagcattgaagttgtttattcataacaaggaggtgtaccacgagaaggacattaaagtatttttcgacaaagcaaaacatgaaatcaagacaattaaaatcgtcggtcctgaggaaaacctgagtcaagcggaggctcggaacatgggaatggatttctgccggcaggatgagaaatgtgattattactttagcgtcgacgctgatgtggttcttactaaccccaggactctgaaaatcttgatcgagcagaaccgtaaaatcatagcgccactggtaaccagacatggcaaattgtggtccaacttttggggcgctctcagccctgatgggtattacgcaagatctgaggattacgtggatatcgtgcagggcaatcgggtcggagtctggaacgtcccttatatggctaatgtctacctgattaaggggaaaaccctccgctccgagatgaacgagcgtaattactttgttagagataaactggacccagatatggctctctgtaggaatgctcgcgaaatgggtgtcttcatgtatatcagcaacaggcacgagttcggcaggctgctgtctactgctaactataacaccagtcactacaataatgatctgtggcaaatctttgagaatccagtggactggaaggagaagtatatcaaccgggactactcaaaaattttcaccgagaacatagttgagcagccatgcccagatgttttctggtttcctatcttctcagagaaggcgtgcgacgagctggttgaagagatggaacactacggaaagtggtccggcggcaaacaccatgactccagaatctccggaggatacgagaacgtgcccacggatgacatccatatgaaacaagttgacctggagaatgtttggctccacttcatccgggaattcatcgcccctgtaactttaaaggttttcgctggatactacacaaagggctttgccttgcttaacttcgtggtcaagtattcaccagaaagacagcgatcgctgcgtccgcaccacgacgcttctacattcaccattaacattgccctgaacaacgtgggcgaggatttccagggtggggggtgtaaattccttcgctataattgttccatcgagtctccaaggaagggctggtcattcatgcatcctggtcgcctaacacatttacacgagggtctccccgtaaagaacggtacgcggtacatcgctgtctcctttatcgatccctag

SEQ ID NO: 129876 - DNA, 1257 bp, Artificial Sequence
  Description of Artificial Sequence: Synthetic coding sequence
atgttagagaaccacattctccataagcgtatctacatactaacctttttctcccaacagatctttatcttgtgtcatgcacatttcatcttcttttttacagtacgggacttttgtcggcaagacgagaagtgcgactattatttcagcgtcgacgcggatgtggtgcttactaacccaagaacactgaagatcttgatcgaacagaatagaaagatcatcgctcctcttgttacacgtcacggtaagctgtggtccaatttttggggcgccctgtcccccgatgggtattatgcaagatccgaggattacgtcgatatcgtgcaggggaaccgagttggcgtgtggaacgtgccctacatggccaatgtctatctgatcaaggggaagacacttagaagcgaaatgaatgagagaaactacttcgttcgggacaaactggacccagatatggctctgtgccggaacgcgagagaaatgactcttcaacgcgaaaaagattctcccacccccgaaacattccagatgctgtcgccacccaagggtgtttttatgtacatatctaataggcatgagttcggcagactgctatcaacagcaaattacaacacatcgcactacaataacgacctttggcagatctttgagaaccctgtggactggaaagagaaatatatcaacagagactactctaagatctttacagagaatatcgtggagcagccgtgccccgacgtgttttggtttccaatatttagtgagaaggcctgcgacgagcttgtcgaagagatggagcattacgggaaatggtctggtggaaaacatcacgactctcgtatctccggcgggtacgagaatgtccctaccgacgacattcacatgaagcaagtggatctggaaaacgtgtggctgcactttattcgtgagtttatagccccagtgacactgaaggttttcgcggggtattatacaaaaggctttgcgctccttaatttcgtggtcaagtacagccctgaaaggcagcgatcccttcggcctcaccacgacgcttccacctttactatcaatattgcattgaacaatgtgggcgaagacttccagggcggcggatgtaagtttcttcggtataactgctctatcgaaagcccgaggaaaggatggagctttatgcacccgggaagattgacccacctgcacgagggtctgcccgtgaagaatggaaccaggtacattgctgtgagctttatagatccatag

SEQ ID NO: 129877 - DNA, 2112 bp, Artificial Sequence
  Description of Artificial Sequence: Synthetic coding sequence
atgcagagcgctaagtactttaactacacagtgaaggtgctgggccagggagaggaatggcggggtggcgacggcattaacagcattggtggcggccaaaaagtcaggctgatgaaggaagtgatggagcactatgcagaccaagatgacctggtggtcatgttcaccgaatgttttgacgtcattttcgctgggggccctgaagaagtgttaaagaaattccaaaaggctaaccataaagtcgtcttcgccgcggatggcatcctgtggcccgataagcggcttgccgataaatatccagtggtacacatagggaaaagatacctcaacagcggcggcttcattggttatgcgccttatgtcaatcggattgtccagcagtggaacctccaggataatgacgatgatcagctattctacactaaggtctacatagacccactgaagcgcgaggctatcaatattacactggaccacaagtgcaagatttttcaaacgttaaacggggccgtggacgaagtggtcctgaaatttgagaacggtaaggcaagggcgaagaacacgttctacgagacgctccccgtcgccatcaacggcaacggtcccacaaaaattttgctcaactatttcggtaactacgtacctaatagctggacacaagacaacggctgtacactctgtgagttcgataccgtggatctttccgccgtcgacgtccacccgaatgtgtctattggtgttttcatcgagcagcccactcccttcttgccaaggtttttggatatcctgctgaccctggactacccgaaagaagccttaaagctctttatccataataaggaagtgtatcatgaaaaggatatcaaggtcttcttcgacaaagccaagcatgagataaagacaataaagattgtaggccctgaggagaatctgtcccaggctgaagccaggaacatgggaatggacttctgccgtcaggatgaaaaatgcgattactacttctccgtcgacgccgacgttgttttgacaaatccacgcaccctcaaaatcctgatcgagcaaaatcgaaagatcattgcacccttagtgacgaggcatggcaagctctggagcaacttctggggcgcattgtctcccgacggttattatgcacggagcgaggattatgtcgatatcgtccaaggcaaccgcgtgggggtttggaatgttccctatatggcaaacgtgtatcttattaaggggaagactctcaggagcgagatgaatgaacgtaactatttcgtgcgggacaaactggatcctgatatggctctgtgtcgcaacgcccgtgagatgaccctccagcgggagaaggatagccctactccagagaccttccagatgctatccccgcccaaaggcgtgtttatgtatatcagtaatagacatgagtttgggcggctgctctccacagctaattataacacatcccattataataatgacttgtggcaaatcttcgaaaatccagtggactggaaggagaagtacatcaaccgcgactatagcaagattttcactgagaacattgttgaacagccctgccctgatgtgttctggttccctatctttagcgagaaggcgtgtgatgaactggttgaggagatggagcactatgggaaatggtcgggagggaagcatcatgacagcaggatctctggagggtacgagaacgtccctacagacgatatccatatgaagcaggtggatttggagaacgtttggcttcatttcatcagggaattcattgcaccagtaactctcaaggtgttcgccggctactacaccaaaggatttgccctattgaattttgtggttaaatattctcctgagagacagcgctctctaagacctcatcacgacgcctccacattcactattaacattgccctgaataatgtcggggaggactttcagggcggaggatgcaaattcctgcggtataattgctcaatagagtctccaagaaagggctggagtttcatgcaccctggccgtctcacacacctgcacgaaggactacccgtgaaaaatgggaccaggtacatcgctgtttctttcatcgatccatag

SEQ ID NO: 129878 - DNA, 1092 bp, Artificial Sequence
  Description of Artificial Sequence: Synthetic coding sequence
atggcgagcaagtcctggttaaattttttaacttttctgtgtggctccgccatcgggtttctgttgtgctcccagctcttttccattttgcttggggagaaagtggatacccagcccaatgtcttgcacaacgacccccacgctcgccacagcgatgacaatggccaaaatcatcttgaaggacaaatgaattttaatgccgattcatctcagcacaaggatgagaataccgatatcgccgagaatctttaccagaaggtccggattctgtgttgggtcatgacgggcccccaaaatcttgagaaaaaagccaagcacgtgaaagcaacgtgggcgcagcgatgcaacaaagtgctgtttatgtccagcgaggagaacaaggatttccccgccgttggcttgaaaacaaaagaggggcgagaccagttatactggaaaactatcaaagctttccagtacgttcatgaacactatttagaggatgctgactggttcctgaaagccgacgatgatacatatgtgatcctcgataacctccggtggctgctcagtaaatacgaccctgaggaaccgatctattttggtcgccgttttaagccctatgtgaagcagggctatatgagtgggggtgctggatatgttctgtccaaggaggcattaaagagattcgttgacgcctttaagacagataagtgcactcacagctcttcaattgaagacctggccttaggccggtgcatggagataatgaatgtcgaggccggggacagccgcgacactatcggtaaggaaaccttccaccccttcgtgcctgaacatcacttaattaaggggtatctgccccggacgttctggtactggaactacaattactatccacccgtcgagggccccgggtgttgttccgacttagctgtgtctttccattatgttgactccacaacaatgtatgagcttgagtatctggtgtatcaccttagaccctacggttacctctatagatatcaaccaaccctcccagaaagaattcttaaagagattagccaggccaataagaatgaggacaccaaggtgaaactggggaacccctag

SEQ ID NO: 129879 - DNA, 231 bp, Artificial Sequence
  Description of Artificial Sequence: Synthetic coding sequence
atgacgagctctggtcccgggccacgcttcctgctactcctgccgctcttgctaccgcccgctgcaagtgcttccgatagaccaaggggccgagatccggttaatcctgaaaaactcctggtgattaccgtggccactgctgagaccgagggttacttaagatttctgcgctcagccgaatttttcaattatacggtacgcaccctggggctgggtgaagagtggcggtag

SEQ ID NO: 129880 - DNA, 732 bp, Artificial Sequence
  Description of Artificial Sequence: Synthetic coding sequence
atggagaagtacgccgacagagaagatatgataatcatgtttgtggacagttatgatgtgattttggcgggaagccctacagagttgttgaaaaagttcgtccaatctggaagccgcttgttgttctccgctgagtctttctgttggcctgaatggggcctggccgaacagtaccccgaggtgggcactggtaaaaggtttctaaacagcggcggattcatcgggtttgcaaccaccatccaccagatcgtcaggcagtggaagtacaaagatgatgacgacgatcagctgttctacacgagactctacttggaccctggcctacgggagaagctctctctgaatttggatcacaaaagcagaattttccagaacctaaacggcgcactagacgaagtggtgctgaagttcgacagaaatagagtgcgcatcaggaatgtggcctatgatacgttgccgatcgtagttcatggaaacggaccaactaaacttcagctgaactacctgggcaattatgtgcccaacggttggacgcccgaggggggttgcggtttctgtaaccaggacaggagaaccctgccaggtggaccggcctcgccccctggggtgtcgggacgcgtgtgtggcacagcctactcagtgtccgcccccttacctgccgctgctgccacccctggcctctctcctcggcagggacatccatttcctgcgcagcagcggggactgccctag

SEQ ID NO: 129881 - DNA, 1740 bp, Artificial Sequence
  Description of Artificial Sequence: Synthetic coding sequence
atggcagccaagagcgatggagccgctgcttctgcaagccccgatcccgagggggctgccgggggcgctcgggggagcgctggcgggagaggcgaagccgctgccgccgccggtccaccgggcgttgtgggagccggtgggcccggccctcgctacgagctgagggactgctgttgggtgctctgcgcgttactcgttttttttagtgatggcgctactgacctttggttggcagcttcctattacctccagaatcaacatacatatttcagcctgactctgttgttcgtgctgctgccgtccctggtggttcagctgctttcctttcgctggtttgtgtacgactacagtgaacccgcagggagccccggaccggcagtgtccaccaaggactcagttgcaggcggtgcagcaatatctaccaaggattcagcaggggcatttcgcaccaaagaaggttcccccgagcctggcccccagccagccccgagtagcgcttctgcctatagaaggcgctgctgccgcctatgcatctggctgctccagacgctcgtgcacttactgcagcttggccaggtctggagatatttgcgcgcactctatctcgggttacagtcccgctggaggggggagaggctccgtcggcacttctattggcagatgctcttcgaatctgcggatgtatcaatgctccgcctgctggaaacatttcttcgttcagcacctcaactggtactccagctgtcattattggtgcatcgggggggcgcccctgatctactcccagctctttcaacctctgcctcactcgttagtttggcgtggacactggccagctaccagaaggtgctgagagattctcgcgatgataaacgcccactgtcttataagggggctgtcgctcaggtgctgtggcatctgttttccattgctgccaggggtctggcctttgcattgttcgcatccgtgtataagctttatttcggtatatttatcgtggcgcactggtgcgtaatgactttttgggtgatccagggagaaaccgacttctgcatgagtaaatgggaggaaattatctacaacatggttgtgggaattatctacatcttttgctggtttaacgtgaaagagggacggagtagacggagaatgacactctatcactgcattgttctgctagaaaatgctgctctaaccgggttctggtactccagccgcaatttctccaccgatttctattctctcatcatggtgtgcgttgtggcatcttccttcgctcttggtatcttcttcatgtgcgtatattattgtcttctgcaccccaacggccccatgctaggcccgcaggcccccggctgcatcttcagaaaggcttccgaaccatgtgggccccctgccgatgccattactagcccccctcggtctctgccccgaaccactggggccgagcgggacggagcctcagccggcgaacgcgcggggacaccaacccctccagtcttccaggtacgccctgggctcccacctactcccgtggcccgcacgctacgcactgagggacccgtaatccggatcgatttgccgcgcaaaaagtaccctgcctgggatgcccacttcatagacaggaggctgaggaaaactatcctcgctctcgagtattcttcacctgctacgcccagactccagtacaggagcgtcggaacctcacaggaattgctggagtacgaaaccacggtgtag

SEQ ID NO: 129882 - DNA, 765 bp, Artificial Sequence
  Description of Artificial Sequence: Synthetic coding sequence
atggcatggcaaggactggtattggcggcatgcttgctgatgttcccatcaacaacggcagactgcctgtctcgatgctctctgtgcgccgtgaagacccaggatgggccgaagccgattaaccctctgatctgtagtctgcagtgccaagctgccttgctgccttctgaggagtgggagaggtgccagtcctttctcagtttttttacaccgtccacactgggtctcaacgacaaggaagatttgggttctaaatccgtgggagaaggtccctatagcgaactggccaaattatctgggtcctttctgaaggaactagagaaaagcaaatttcttccctctatcagcactaaggaaaacacactgtccaaatctctggaggagaagctgagaggtctctctgacggattccgcgagggtgccgagtcagaattaatgagggatgcacaacttaatgatggcgcaatggaaaccggcacattgtacttggctgaagaggacccaaaggagcaggttaaacgatatggaggattcctccggaaataccctaaacgctcaagtgaagtcgcaggtgaaggggatggtgactctatgggccacgaggatctatacaaacggtacggagggtttctgcggagaattaggcctaaactgaagtgggacaatcaaaagcgctatggcggtttcctgcgccgccagtttaaagtggttactagatcgcaggaggatccaaacgcctactcaggtgagctgtttgatgcttag

SEQ ID NO: 129883 - DNA, 765 bp, Artificial Sequence
  Description of Artificial Sequence: Synthetic coding sequence
atggcatggcagggcctcgtacttgctgcgtgcctgctcatgttcccaagcactactgctgattgcttgtccagatgttctttgtgtgctgtaaagacccaagatggacccaagccaattaatcccctcatttgttccctccaatgccaggccgcgcttctgccttcagaggagtgggaacgctgtcagagtttcttgtccttctttaccccatcaacactggggctgaacgacaaagaagatttggggtcaaaatcagtcggggaagggccatactctgaactggcaaaactgtctgggtcattcctgaaggagctcgagaagtccaaattcctcccctctatatctactaaagagaacactctctcaaaaagcctggaggaaaagctccgtggcttatctgatggtttccgagagggggctgagtcagagctaatgagggatgcccagctcaacgatggcgcaatggagaccggtacactctacctggccgaagaggatccaaaggagcaagtaaaaagatatggaggatttctgaggaaataccccaagagatcctcagaggtggcgggcgaaggcgatggagatagtatgggacacgaggacctgtataagcggtacggcggtttcttacggcggatacggcctaaattgaagtgggacaaccagaaacgctatggcggtttccttcggcgccaattcaaggtcgttacaagaagtcaggaggaccccaacgcatactccggagagctgttcgacgcctag

SEQ ID NO: 129884 - DNA, 804 bp, Artificial Sequence
  Description of Artificial Sequence: Synthetic coding sequence
atggcccgtttcctcaccctgtgcacttggttactgctgctgggtcccgggctgttggccacagtcagagctgaatgctcccaggattgtgccacttgttcttaccggctcgtgcgccctgccgacattaacttccttgcttgcgtgatggaatgtgaaggaaagctcccctctctcaagatttgggagacttgtaaagaactgctgcagctttcgaagccagagctaccccaagacggcacgtccactctgcgcgagaatagcaagccagaggaaagtcatctgttagctaagcgatacggcggcttcatgaaaaggtacgggggcttcatgaagaaaatggacgaactctatcccatggagcccgaggaagaggcaaacgggagtgaaattctggccaaacgctacggcggcttcatgaaaaaagatgccgaggaggatgactccctagcaaactcctccgacttgcttaaagaattgctagaaacaggggataatcgagaacgaagtcaccaccaggacggttctgacaatgaagaggaggtgtcaaaacggtatgggggcttcatgcgcgggttaaagagaagcccgcagctcgaagacgaggccaaggagctgcagaaacgatacggcggcttcatgcgacgagtcggcagaccagagtggtggatggactaccaaaagcggtatggaggtttcctcaaaaggttcgcggaggccctacccagcgatgaggagggggaatcttactccaaggaggtgccagagatggagaagcgatacggcgggttcatgcggttttag

SEQ ID NO: 129885 - DNA, 804 bp, Artificial Sequence
  Description of Artificial Sequence: Synthetic coding sequence
atggcacgcttcctcacactgtgcacatggctgctcctgctaggacccgggctcctggcgacagtgagggccgagtgttcccaagactgcgccacctgcagttacaggctggtacggcccgccgatatcaattttctagcgtgtgttatggagtgcgaaggtaaattgccatcactgaaaatatgggaaacctgcaaggagcttctccagctgtccaaacccgagctcccacaggacgggacaagcaccctaagggaaaatagcaaacccgaggagagtcacctgcttgcgaaaagatacggaggattcatgaagcgctacggaggctttatgaaaaagatggatgaactctaccctatggagcccgaggaagaagcaaacggctctgagatccttgcaaaaagatacggaggtttcatgaagaaagatgccgaagaagacgattccctagctaactcttctgacctcctgaaggagctattagagaccggtgataacagggagcgcagtcaccatcaggacggtagtgacaatgaagaggaggtcagcaaacgttatgggggcttcatgcggggacttaaaagatcgcctcaactggaggatgaagccaaggaactccaaaaaagatatggcggcttcatgcggcgcgtgggccgtccggagtggtggatggactatcagaagaggtacggcggctttctcaagagatttgctgaggccttgcctagcgatgaggaaggggagagttattccaaagaagttcccgagatggagaaacggtatggcggattcatgaggttttag

SEQ ID NO: 129886 - DNA, 318 bp, Artificial Sequence
  Description of Artificial Sequence: Synthetic coding sequence
atggcccggttcctgaccctgtgtacgtggcttctcttgctgggccccgggctgctggccaccgttagggctgagtgctcccaggactgtgcaacctgcagttatcggctggtgaggcctgccgacattaacttccttgcctgtgtaatggagtgcgagggcaaattgccgagtctgaagatatgggagacgtgtaaggaactgctccagctgagtaaacccgagctcccacaagatgggacaagtaccctccgagaaaattcaaagcctgaagaaagccatttgctcgctaaaaggtacggcggtttcatgaagtag

SEQ ID NO: 129887 - DNA, 570 bp, Artificial Sequence
  Description of Artificial Sequence: Synthetic coding sequence
atggctaggttcctcaccctgtgtacctggctgttgctgctggggcctggcctcctggctaccgtgagggctgagtgttcccaagattgcgctacctgtagctatcgtctagtgaggcccgccgacataaactttctcgcttgcgtaatggagtgtgaaggtaaactgccgagcctgaagatctgggagacttgtaaagagctgctccagctttcaaaacctgagctgccacaggacggcacctctactcttagagagaattctaagcccgaggaaagccatctgctggctaagcggtacgggggcttcatgaaacgctatggggggttcatgaaaaaaatggatgaactctaccccatggaaccagaagaagaagccaacgggtccgaaatccttgctaaacggtacggaggcttcatgaaaaaggacgccgaggaggacgacagtctcgccaactccagcgatctgctgaaggaattacttgaaacaggggataaccgcgagcggagccaccaccaggatggatctgacaacgaagaggaaaaaaagaagaagaaaagaaaggaatag

SEQ ID NO: 129888 - DNA, 423 bp, Artificial Sequence
  Description of Artificial Sequence: Synthetic coding sequence
atggctggttggcagtcttacgtggacaacctcatgtgcgacggctgctgccaagaagcagcgatcgtgggatactgcgatgccaagtatgtgtgggctgcaactgcaggaggggttttccagagtataacacccatcgagatcgatatgatcgttggcaaagacagagagggcttttttactaacgggctgactctaggcgcaaaaaagtgtagcgttataagagatagcttatacgtggacggcgactgtacaatggacatcagaaccaagagccaggggggcgaacccacctataacgtggctgttgggagggctggaagagttctagtttttgtgatgggcaaagaaggagttcatggtggaggactcaacaagaaggcctacagtatggcaaagtatttacgggatagtggtttctag

SEQ ID NO: 129889 - DNA, 423 bp, Artificial Sequence
  Description of Artificial Sequence: Synthetic coding sequence
atggcaggatggcagagttatgtggacaatctcatgtgtgacggatgttgccaggaagcagctatcgtaggttactgtgacgcaaagtatgtgtgggccgctactgctggaggggtattccagagtattactccgatcgagatcgatatgattgtgggaaaggatcgagagggcttcttcaccaatggtctgactctcggcgctaagaaatgtagcgtgatcagagactcactgtacgtagatggcgactgtaccatggacattcgcacaaagagtcagggaggagagcctacctataacgttgcggtggggcgggcgggcagggcccttgtcattgtgatgggaaaggagggggtccacggtggaacattgaataaaaaagcctacgaacttgccctgtacctccgccgctccgacgtgtag

SEQ ID NO: 129890 - DNA, 414 bp, Artificial Sequence
  Description of Artificial Sequence: Synthetic coding sequence
atgggagactggaaagtgtatatctcagccgtgctcagagatcagaggatagatgatgtcgccatcgtgggtcatgctgataattcatgtgtgtgggcctctcgccctggcgggctgctcgccgccatctccccacaggaagttggggtgctgaccggaccagatcggcatacattcctgcaggcaggattatccgtcggcgggcgtcgctgctgcgtgattcgcgaccatctgttggcggagggcgatggtgttctggatgccaggaccaagggtctcgacgcgcgagcggtatgtgtcgggagggctccccgcgccttgctggtgctgatggggagacgcggcgttcacggcggcatcctgaacaagaccgttcatgaattgataagaggacttagaatgcaaggggcgtag

SEQ ID NO: 129891 - DNA, 1167 bp, Artificial Sequence
  Description of Artificial Sequence: Synthetic coding sequence
atgaaatggatggtagtagtcttggtatgcctgcagctcctcgaggccgccgtcgttaaagtgcccctgaagaaatttaagtctattcgcgagactatgaaagaaaaggggttgctcggggagttcctccggacacataagtacgacccagcctggaagtatcggttcggcgacctcagtgttacctatgaacccatggcctacatggatgccgcctatttcggggaaataagcatcggcactcctccacagaatttcctcgtcctgtttgacacaggatcctctaacctgtgggttccaagtgtgtattgccagagtcaggcttgcacaagccactctcgttttaatcccagcgaaagcagcacctacagcacgaatgggcagaccttcagcctccaatacggatccggctccctgacgggcttcttcgggtatgacactctcacagtgcagagcatacaggtgcctaatcaggagttcggactgtcagagaatgaacccggcaccaacttcgtttacgctcaattcgacggaattatgggcctggcatacccggcactgagtgtggatgaagccactacggccatgcagggcatggtgcaggaaggggccctgacaagtcctgtcttctcagtgtaccttagtaaccagcaaggctccagcggaggagccgtcgtttttggcggagtggacagtagtttatacaccggacaaatttattgggctcccgtgactcaggagctgtactggcagattggaatagaggagttcttgattgggggccaggccagtggctggtgctcagaggggtgtcaggcgatcgttgacactgggacgagtctcctgactgtgcctcagcaatatatgtctgctctgctgcaagcgacaggggcacaggaggatgagtacggccagtttttagtaaactgtaatagcatccagaatctgccttctctcactttcattatcaatggcgtagagtttccactgccaccaagcagctacatcttgtccaacaacggatattgtactgtgggagtcgagcccacctacttgagctcccagaatgggcagcctctgtggattctaggggacgttttcctgcgcagctactatagtgtctatgacctggggaacaatcgtgtcggattcgccactgcggcctag

SEQ ID NO: 129892 - DNA, 315 bp, Artificial Sequence
  Description of Artificial Sequence: Synthetic coding sequence
atgaagtggatggtagtggtgctggtctgtctgcagcttcttgaggcggcagtcgtcaaggtgcccctcaagaagttcaagtctataagagagacaatgaaagaaaagggtctgctcggggaatttttacgaacccataaatacgacccggcttggaagtaccgctttggggatctctcagtgacctacgaacccatggcgtatatggatgcggcgtactttggagaaatatccattggcaccccaccgcaaaactttctagtactgtttgatacgggctcctctcctctccccctggaccccgccccctcctag

SEQ ID NO: 129893 - DNA, 411 bp, Artificial Sequence
  Description of Artificial Sequence: Synthetic coding sequence
atgaagtggatggtggtggtgctagtttgtctccaactgttggaggccgccgtggtgaaagttcccttgaagaagtttaagtcgatccgagaaacaatgaaggaaaagggattgttgggtgaattcctccggacacataagtacgaccctgcttggaagtatcgctttggcgacctcagtgtcacctacgagccaatggcatatatggatgtgcagtcaatccaggtgccgaaccaggagtttggtctgtcggagaatgagccgggcacaaacttcgtctacgctcagttcgacgggattatgggtctggcttatcccgcgctgtcagtggatgaagccacaacagcaatgcagggtatggtccaggagggagcactcacatcccccgtcttctccgtgtatctgtcttag

SEQ ID NO: 129894 - DNA, 948 bp, Artificial Sequence
  Description of Artificial Sequence: Synthetic coding sequence
atgaaatggatggtcgtggttctggtgtgtctccaactgctggaggcagccgtcgtcaaagtgccgctgaagaagttcaaaagcattcgcgagactatgaaagagaaaggcctcctcggggagttccttcgcacgcacaagtatgacccagcgtggaagtacagattcggtgatctttccgtcacttacgaacccatggcatatatggacgcagcctacttcggcgaaatttcaataggcacaccaccccagaatttccttgtactattcgacaccgggtccagtaatttgtgggtgcccagtgtctattgtcaatctcaggcctgtacctctcacagcagattcaatccttccgagagttccacatattcaacgaatggtcaaacgttctctctacaatacggcagcggtagcttgacaggtttcttcgggtatgatacactgactgtgcagtccatccaggtcccaaatcaggagttcgggctatccgaaaacgagcctggcaccaacttcgtgtacgcacagtttgatggcataatggggcttgcctacccagccctctctgtagatgaagccacgacggccatgcagggaatggttcaggagggagctctgacctctcccgtgtttagcgtatatctttcaaacttggtcctggaaagttcggggctgggcccactcctcactcctagcagagcagcaccaccttccagtactctgcagctccccgagaaacctctggaacagacctggaatatactaaccccctttaccaaaacactcccagtgtcgaacctcagcagaaaggtgacttcttgggctggtgtgggcatccccgtcacatgcctgccagaggccgggtccggcggagaacggagagccgaatgtggcctaggagttccgacaacgagaggcccgcctcgctctcagcatcactcaggtgcttag

SEQ ID NO: 129895 - DNA, 543 bp, Artificial Sequence
  Description of Artificial Sequence: Synthetic coding sequence
atgctctgcttattattaacactcggtgtcgccctggtttgcggagtccctgctatggacatcccacagaccaagcaggatctggagctgcctaaactcgccggcacctggcattccatggcgatggccacaaataatataagcctcatggcaaccctaaaggctcctttgagggtgcatattaccagtctgttgccaacaccggaagacaacctggagattgtgctgcatcggtgggaaaataatagctgcgttgagaaaaaagtgctaggagaaaagacagagaacccaaagaagttcaaaattaactacaccgttgcaaatgaagccactctcctggacaccgactacgacaatttcttgtttctgtgcttgcaggataccacaacacctatacagtctatgatgtgccagtacctagcaagagtgctcgtggaagatgacgagatcatgcaggggtttatccgggcctttcgacccttgccaaggcacctgtggtacctgctcgacttaaaacagatggaggaaccgtgccgattctag

SEQ ID NO: 129896 - DNA, 261 bp, Artificial Sequence
  Description of Artificial Sequence: Synthetic coding sequence
atgttatgcctgctgctgaccctgggtgtcgctctcgtatgtggtgtacccgccatggatatccctcaaactaaacaagatctggagcttcccaaagacacgacaaccccaattcaatcaatgatgtgccaatacctcgcacgggtgctggtcgaagatgacgagattatgcaggggttcatcagagcgtttcgacccctccctagacacctgtggtatctgcttgacctgaaacagatggaagccccttgttggctgtag

SEQ ID NO: 129897 - DNA, 543 bp, Artificial Sequence
  Description of Artificial Sequence: Synthetic coding sequence
atgctctgtctcctgcttaccctgggcgtggctctggtttgtggggtcccagcgatggatatccctcaaaccaaacaggatttggagctaccaaagctcgctgggacatggcacagcatggcgatggcaaccaacaatatctctctcatggcaacattgaaggccccactccgcgtgcacatcactagtctgctgccaacccccgaagataacctcgagattgtcctgcatcgctgggaaaacaactcatgcgttgagaagaaagtactgggcgagaaaactgagaatcccaagaaattcaaaataaattatacagtggcaaatgaggcaactttgctggatacagattacgataatttcctgtttctgtgtctacaggacactacgaccccaatacaatccatgatgtgtcagtatctagcacgagtgctggttgaggatgatgagatcatgcaggggtttatccgagccttccggccgttacctcggcacctctggtatctcctggacctgaagcaaatggaggaaccttgcagattctag

SEQ ID NO: 129898 - DNA, 438 bp, Artificial Sequence
  Description of Artificial Sequence: Synthetic coding sequence
atgctctgcctcctactgaccctgggcgtggccttggtatgtggcgtgcctgctatggacattccccagaccaagcaggacctagaactgcctaaggcaccgctacgagtccacattacatctctgctcccaacacccgaggacaatcttgagattgtgctgcacagatgggagaacaattcctgcgtggaaaaaaaggtcttgggcgagaagaccgagaatcccaagaagttcaagatcaattgcaaagcctccggggccccacagctgagctggaaaccacagggacccagaaccgatcctgcatcaagtaccgctagagtcttggtggaggacgatgagatcatgcaggggtttattagagccttccgcccacttccacgccatttatggtacttgttggacctgaagcagatggaagagccctgccggttctag

SEQ ID NO: 129899 - DNA, 399 bp, Artificial Sequence
  Description of Artificial Sequence: Synthetic coding sequence
ttgatggccacgctgaaagcccctctgagggttcacataactagtctgttgcctactcccgaggataatctggagatcgtgttacataggtgggagaacaattcctgcgtggagaagaaggtcctgggagagaaaactgaaaatcccaagaaatttaagatcaattacacagtggccaacgaggcgacactgttggacaccgactatgacaactttctgttcctctgtttgcaagataccaccacgcccattcagagcatgatgtgccagtacctcgccagagtgctggttgaagatgacgagataatgcagggcttcattcgggccttccgccctctgcctcgacacctctggtatctgttggacctgaagcagatggaggagccctgccgcttttag

SEQ ID NO: 129900 - DNA, 396 bp, Artificial Sequence
  Description of Artificial Sequence: Synthetic coding sequence
tgagtgcctgccatggatattccgcagactaagcaggacttggagctgccgaaagccccactgcgcgtccatattactagcctcctgccaactcccgaagacaatcttgagatcgtgctccatcgttgggaaaacaacagctgtgttgagaaaaaagtgctgggcgagaagaccgaaaaccctaagaagttcaagatcaattgcaaggcctctggtgcccctcagctctcctggaagcctcaggggccccgaaccgaccccgcatcctcaaccgcacgggtgctcgtggaggacgacgagattatgcagggatttattcgcgccttccgcccactgccccgccacctctggtacctgctggacttaaagcagatggaggagccttgcagattttag

SEQ ID NO: 129901 - DNA, 381 bp, Artificial Sequence
  Description of Artificial Sequence: Synthetic coding sequence
taaccactgcgtgtgcatatcacatccctgctacctacacctgaggataacctcgagattgtgctgcaccgttgggagaacaattcttgcgtggagaaaaaagttctcggagagaaaactgaaaaccccaaaaaattcaaaattaactatacagtggcgaatgaggcgacgctgctcgatactgattatgacaacttcctgttcctgtgcctgcaggacaccacaaccccgatccagtctatgatgtgccagtatctggcacgcgtgctagttgaagacgatgaaatcatgcagggctttattcgcgccttcagaccgcttcctagacatctttggtatttactcgatctcaaacaaatggaagagccatgtaggttttag

SEQ ID NO: 129902 - DNA, 102 bp, Artificial Sequence
  Description of Artificial Sequence: Synthetic coding sequence
tgagaaatcatgcaaggattcattcgcgcatttaggccactcccccggcacctgtggtatttgttagaccttaaacaaatggaggaaccttgtcggttttag

SEQ ID NO: 129903 - DNA, 543 bp, Artificial Sequence
  Description of Artificial Sequence: Synthetic coding sequence
atgttgtgtctcctgctgacactgggtgtggcactcgtgtgtggtgtgcctgcgatggacattccacagacaaaacaggatctagagttaccaaaactggcgggcacttggcatagcatggctatggccactaataatatttccttaatggcgacattgaaggctccactgcgcgtacacatcacctcactgctgccaacccccgaagacaacctcgagattgtgcttcaccgatgggagaataatagctgcgtggaaaagaaggtgctgggggaaaaaactgaaaacccgaaaaagttcaagattaattacacagttgctaacgaggcgacactgctcgataccgactatgataatttcctttttctgtgtctgcaggacaccacaaccccgatccagagcatgatgtgtcagtatcttgctcgagttcttgtggaggacgatgaaattatgcagggctttatccgcgccttccggccccttcccaggcacctgtggtaccttctggacctcaagcagatggaagagccttgtaggttttag

SEQ ID NO: 129904 - DNA, 510 bp, Artificial Sequence
  Description of Artificial Sequence: Synthetic coding sequence
atgctgtgtctgcttctgactttaggcgtagcactcgtgtgcggggtgcccgccatggatattccccagaccaagcaggacctggaactgcccaaactggctggtacttggcattcaatggccatggccacaaacaatatttccttgatggcgacgttgaaggcaccactccgcgtccacatcacgagccttctgccaacccccgaggacaacctcgagattgttctgcacaggtgggaaaataattcatgtgtcgagaaaaaggtgcttggggagaaaaccgagaacccaaagaaatttaagattaactatacggtcgccaacgaagcaacgctgcttgacaccgactacgacaactttcttttcctctgcttgcaagatacaaccacacccatccagagtatgatgtgccagtaccttgaaagctggtggcggacgatgagatcctgtagagactcgtccggcctgtctggaccatgccccggcacatatgggacgtgctggacttag

SEQ ID NO: 129905 - DNA, 2274 bp, Artificial Sequence
  Description of Artificial Sequence: Synthetic coding sequence
atgtcaagaaagatttccaaagagtccaagaaggtcaacatttcctcatccctcgagagtgaggatatttcactcgaaaccaccgttccaaccgacgatatcagctcatccgaggagagggaagggaaagtcaggatcacccgacagctcatcgagcggaaggagctgctgcataatatccaactactgaaaattgaactgtcacaaaaaactatgatgatagacaaccttaaagtggattatctcacaaaaatcgaagagctggaagaaaagttgaacgacgccctacaccagaaacagttgttaaccctgaggctcgataaccagctcgcatttcagcagaaggacgctagtaaataccaggagttgatgaaacaggaaatggaaaccattctgctgcgccagaagcagcttgaagaaacgaatctgcagcttagagagaaggccggcgacgtgcgccggaatctgcgagactttgaactgaccgaagagcagtacatcaaactcaaagcatttcctgaggatcagcttagcattcccgagtacgtaagtgtgcgcttctacgagctggtgaatccccttcgcaaggagatctgcgagctgcaagttaaaaagaatatcctggccgaggaattgagcaccaataagaatcagctgaaacaactgaccgaaacatatgaggaagacaggaagaactattcagaggtgcaaattcgatgccagaggctggctttggagctcgctgacactaaacagctgatccaacagggagattaccggcaggagaattatgacaaagttaagagtgagcgcgacgccttggagcaggaagtcatcgaactcagacgcaaacatgagatactggaggcctctcacatgatacagacaaaagagcggagcgaactgtctaaggaggtagttacattagaacagactgtaactttgttacagaaggacaaagagtacttgaaccgacagaatatggaactctccgtcaggtgtgcccatgaagaggatagattggagagactccaggcccaactggaagagtcaaagaaggctcgagaagaaatgtacgaaaagtacgtggcgtccagagaccattacaagacggagtacgaaaacaaactgcatgatgaacttgagcaaattagactgaaaaccaatcaagagattgatcagctgagaaacgccagcagggagatgtacgagcgggaaaatcgcaatttgagagaagcacgagacaacgcagtggctgaaaaggaaagagccgtgatggccgagaaagatgctctggaaaaacacgaccaactgcttgaccgataccgcgagctccagttgagcacagagtctaaagtgactgagttcctgcaccagtccaaacttaagagcttcgagagtgagcgcgtgcagttgctgcaggaagagactgcacggaacctgacccagtgccaactcgaatgcgagaaatatcagaagaagctcgaggtcctgacgaaggaattctactcactgcaggcaagctcagaaaagcggatcacagagcttcaggcacagaactcagagcatcaggcgaggctggacatctacgagaagctggagaaggaactcgacgaaattattatgcagactgccgagattgaaaacgaagacgaagctgagagagttctcttctcctatggatacggcgctaatgtgccaaccacagcaaaacggaggctaaagcagtcggtacacctggctcgcagggttctccagttggaaaagcagaattcgctgatacttaaggacctggagcacagaaaggatcaggttactcagctttctcaggagctggatagagctaattccctcctgaatcagacacagcagccatatcgttacttgatcgagagtgtgagacagcgggattctaagatcgattctctcacggaaagtattgcgcaacttgagaaggatgtcagtaacctgaataaggaaaagtcggcactcctgcagactaagaatcaaatggcactcgacctcgagcagttgctgaatcatcgtgaagaactcgcagccatgaaacagatacttgtgaagatgcatagcaagcacagcgagaattcattactgctgactaagactgaacccaagcacgtgacggagaaccagaaatccaaaactctcaatgtccccaaggagcatgaagataacatttttacaccaaaacccacattattcactaaaaaggaggccccagagtggagcaaaaagcagaaaatgaagacatag

SEQ ID NO: 129906 - DNA, 651 bp, Artificial Sequence
  Description of Artificial Sequence: Synthetic coding sequence
ttccggacagcgaaagttgagaatgaggatgaggccgaacgggtcttattcagctatgggtatggggctaatgttcctacaacagccaaacgccggctaaagcagagtgttcacctggccagacgggtcctccagctggagaaacagaattctctgatcctgaaagacctcgagcataggaaggaccaagtgacacagcttagccaggagctggatagagccaacagtttactgaaccagacacagcagccttataggtaccttatcgaatctgtgaggcagagggatagcaaaatcgattcactgacagagtctattgcacaattggagaaagatgtgtctaacctgaataaggagaaaagcgcactgttgcaaactaagaaccagatggctctagatctggagcagttgctaaaccatcgtgaggagttggccgccatgaagcagatactcgtgaagatgcattccaaacacagcgaaaatagtcttctgctcaccaagacggagcctaagcatgtgactgaaaatcaaaagagcaaaactttgaacgttccaaaggagcacgaggacaacatctttacccccaaaccgaccctgttcaccaagaaggaagcgcccgaatggtcaaagaaacagaaaatgaaaacatag

SEQ ID NO: 129907 - DNA, 1245 bp, Artificial Sequence
  Description of Artificial Sequence: Synthetic coding sequence
atgagtagaaaaatctccaaagagagtaagaaggtgaacattagctcttccctggagtctgaggacatcagcctggaaaccaccgtgccaacagacgacatctcctcatcggaagaacgtgaaggtaaagtcagaataacacggcagctgattgagcgaaaggaattgttgcacaatattcagctcctaaagattgaactgagtcagaagacgatgatgattgacaatctgaaagtggattacctcacaaagattgaagagctggaggaaaagctgaatgacgcactgcatcagaaacagttactgaccctccgcctggacaaccaactggcctttcagcagaaggatgctagtaagtaccaagagctaatgaaacaggaaatggaaacaatcctcttgcgccagaaacagctggaagagacaaacctgcagctgagggaaaaagccggcgatgttcggcgtaatctccgagatttcgaactaacagaagagcagtacatcaaactaaaggcctttccagaagaccagctatcgattccagagtatgtttctgtcagattctacgaactggttaaccctttgcgtaaggaaatctgtgagcttcaggtaaagaaaaatattctcgccgaggagttgagtactaataaaaaccaactgaaacaactgaccgagacttacgaggaagatcgcaagaattactcagaagtgcaaattcggtgccagagactggctctagagctggcagataccaagcagctcatacagcagggtgattaccgacaagagaattatgacaaggttaaaagcgagcgcgacgcgctcgaacaagaagtgattgaattgagacgaaaacacgagatattggaggctagccacatgattcagaccaaagagaggtctgaactgtccaaagaagtggtcaccctcgagcagacggtaacactgctgcagaaagataaagaatacttgaataggcagaacatggaactctctgtgcgatgtgctcacgaggaagaccggctggagagactgcaggcccagctggaggagtccaaaaaagcccgcgaagaaatgtacgagaagtatgtcgcgtcaagggaccactacaagactgaatatgagaacaagctgcatgatgaactggagcagatccgactgaaaacaaaccaagaaattgatcagctaagaaatgcgtctcgggaaatgtatgagcgggaaaatcggaagaagaggaagaaaaaatag

SEQ ID NO: 129908 - DNA, 1734 bp, Artificial Sequence
  Description of Artificial Sequence: Synthetic coding sequence
atgaccgaactagctggtgcatcgtcgtcctgttgtcatcgcccggctggacgcggggccatgcagtctgtcctgcaccacttccagagactgcgaggaagggagggaggtagccacttcattaacaccagctcccctcggggagaagccaagatgtcaatcaccagcgacgaagtgaattttctggtgtataggtacctgcaggaatcagggttctcacactccgcctttacgttcgggatcgaatcccatattagccagtctaacatcaacggtactctagtaccacccgccgccctgatctccattctgcaaaaggggttgcagtacgtggaagcagagattagcattaatgaagatggcactgtttttgacgggcgccctattgagtcgttgagcctcatcgatgcagtaatgcccgacgtcgtccagacccgacagcaagctttcagggaaaagctggcacagcagcaagctagtgccgctgccgcagctgcagccgccacagctgccgctaccgccgccactactaccagcgctggcgtgagtcaccagaacccatctaaaaacagagaggcgaccgtgaatggcgaagagaatagggcccatagcgtgaataaccatgctaaaccaatggaaatcgatggggaggtggagattcccagttcaaaggccacagtccttcgcggtcacgaatcggaagtcttcatctgcgcctggaatcctgtgtccgatctcctggcttccggcagcggagactcaaccgcccgaatctggaatcttaatgaaaactcaaacggaggatccacccaattggtgctgcgccactgcatacgagaaggaggccacgacgtcccgagtaataaggacgtcacgtctcttgattggaacaccaacggaactttgctggctacgggatcctatgacggcttcgcccgcatctggaccgaggatggtaacctggcatcaactttgggccagcataaaggccccatctttgcactaaagtggaatcggaaggggaactatatcctttcagccggcgtggataagactaccattatctgggacgcgcacacaggtgaagccaagcagcagttcccattccatagtgcccccgcgcttgatgtcgactggcagaacaataccacatttgcatcatgtagtaccgatatgtgtatccacgtgtgtcggttaggatgtgaccggcccgtgaagacattccaggggcacactaacgaagtgaacgccatcaagtgggatccatctgggatgctcctggcctcgtgtagtgatgacatgaccttgaaaatctggtccatgaaacaggaggtctgcatccacgacttacaggcccacaacaaggaaatttataccatcaaatggtcccctaccggccccgccacttccaaccccaacagcaacatcatgcttgcttcagcatcttttgatagtaccgtgcgcttgtgggatattgaaagaggggtgtgcacgcacaccctcactaagcaccaggaacccgtgtactccgtcgcattctcccccgatggcaagtatctggcttccggctcttttgataagtgtgtgcatatttggaatactcagtccggtaacctagtccactcgtaccgcggcacgggcgggattttcgaggtctgctggaacgctaggggagataaggtgggggccagcgcctcagatggctcagtctgcgtgttggatctgcgcaagtag

SEQ ID NO: 129909 - DNA, 432 bp, Artificial Sequence
  Description of Artificial Sequence: Synthetic coding sequence
atggcagctgaggatgtggttgcaactggagcagaccccagcgacttggagagcggaggattgctccacgagattttcacttccccactaaatttattactgttaggcttatgcatctttctgctgtataagattgtcaggggtgaccaaccagctgccagcggcgattccgacgacgatgagccacctcccctgccccggctaaaacgtagagattttactccagccgagcttaggcgctttgacggggtacaagacccaaggattctcatggctattaacggaaaggtgtttgatgtgaccaaaggacggaaattctacgggccagttaagtatcatcacgttggtaaactgttaaaagaaggtgaagaacctacagtgtattccgacgaggaggagcccaaggatgaaagtgcgcgtaaaaatgattag

SEQ ID NO: 129910 - DNA, 672 bp, Artificial Sequence
  Description of Artificial Sequence: Synthetic coding sequence
atggccgccggcgacggggacgtcaagctggggacacttggaagtggttccgaaagctctaacgacggtggaagcgagtctcctggggatgctggcgccgcagccgaaggcggtggatgggcagcagctgcattagcattgttgaccggagggggcgaaatgttgttaaacgttgctttagtcgccctcgtgctgctcggcgcatacaggctgtgggtgcggtggggtaggcgaggactgggcgcgggagcaggagccggtgaggagagccctgcaacatctctaccccggatgaaaaaaagagatttttccctggaacaactacggcaatacgatggaagtcgtaacccacggatcctgctagccgtgaacggtaaagttttcgatgtgactaaaggatctaagttctacggccccgctggcccatatggaatctttgccggccgcgacgcctcacgcggtctcgcgaccttctgcctcgacaaagacgcactgcgcgacgagtatgacgaccttagtgacctaaatgctgttcagatggagtccgtgcgggagtgggagatgcagttcaaggaaaaatatgattatgttggaaggctgctaaagccaggggaagagccttccgagtacacagacgaagaggataccaaggatcacaataaacaggactag

SEQ ID NO: 129911 - DNA, 402 bp, Artificial Sequence
  Description of Artificial Sequence: Synthetic coding sequence
atggctgccggagacggagacgttaagcttggcaccttaggctcaggtagtgaatcttctaacgatggcggcagtgagtcacctggagacgcaggagctgctgccgaagggggtgggtgggccgccgccgccctggcgttgttgacaggaggcggtgaaatgctgctcaatgtggccctggtggccctcgtactgctgggagcgtaccgactgtgggtgcgctggggccgaagaggtctcggagctggagctggggccggtcttcagcttggggccgccgccccggttcggagacttccgcaacccgctcacccagctcggggacaatgggagtctctgcgtcgggatcaacggcagcaggttctgagacccgggggcagcatctggaacatttgctggtag

SEQ ID NO: 129912 - DNA, 744 bp, Artificial Sequence
  Description of Artificial Sequence: Synthetic coding sequence
atgggcggagctggcaggggcgttggcgaaggacgaggccgcggaggcggcggtcgcaggtggcgggcggtgatggcagccggggacggagatgtgaagttgggtactctgggctcggggtccgagagctctaacgacgggggtagtgagtctccaggggacgccggcgccgcagccgagggcggtgggtgggccgccgccgccttagcgcttctcacagggggaggagaaatgctgctgaacgtggccctggtagctctcgtgctgcttggggcatatagactttgggtcagatgggggcgaaggggactcggggctggggcgggggccggagaggagagccctgccaccagtctgcctcgcatgaaaaagcgggatttctcgctagaacagctcagacagtacgatggttccagaaatccaaggatactactggctgtcaacggcaaagtgttcgatgttacaaagggatccaaattttatggaccagccggcccatatggaatttttgccggtagggacgcatctagaggtcttgccaccttttgtttggacaaggacgctctgcgtgacgagtatgatgatttgagcgacttaaacgctgtgcagatggagagtgtgcgcgaatgggagatgcaattcaaggaaaaatatgactacgtgggccgcctcctgaaacccggcgaggagccctcggagtacaccgatgaggaggatacgaaagatcataacaagcaggattag

SEQ ID NO: 129913 - DNA, 1041 bp, Artificial Sequence
  Description of Artificial Sequence: Synthetic coding sequence
atggccatggcacagaaactgagccacctgctccctagcctccgacaggtgatacaagaaccccagctaagcttacagcccgagcctgtttttaccgtcgacagagctgaagtaccccccctgttctggaagccttatatctatgcgggttataggcccttgcatcagacttggcggttttatttccggacactgtttcaacagcacaacgaggctgtcaacgtgtggactcacctgctggccgcgctcgtactcctgcttaggctggctttgttcgtggagaccgtggacttttggggcgacccccacgccctcccacttttcattatagtcttggcatcctttacttatctttctttttcagctctggctcatctgctgcaggctaagagtgaattttggcactatagcttctttttcctggattacgtaggggtagccgtctaccagtttggaagtgcgctggcccatttctactatgctatcgagcccgcatggcacgcccaggtccaagcggtgtttttgcccatggccgctttcctggcatggttgagctgtattgggagctgttataataaatacatccaaaaacctggactgctgggtcgaacctgtcaagaagtgccatccgtcctggcttatgcgctcgacatcagtcccgtcgtgcatcgtatattcgtgagcagcgacccaacgaccgacgatcccgcccttttatatcacaaatgtcaggttgtgttcttcctccttgctgcggcattcttcagcacattcatgcccgaacgttggtttcccggctcctgtcacgtgttcggtcagggacatcagctcttccatatctttctcgtcctgtgtacgctggcacagttagaagctgtggctctcgactacgaagcaaggcggcccatatacgagccactgcacacacactggcctcataattttagtggtttgttcctgttgacagtcggctcaagcattcttaccgcctttcttctgtcgcaattagttcaaagaaaacttgaccagaagaccaagtag

SEQ ID NO: 129914 - DNA, 867 bp, Artificial Sequence
  Description of Artificial Sequence: Synthetic coding sequence
atgcagatcccccaggctccttggcctgtggtctgggcggtgctgcagttgggctggcggcctggatggttcttagacagcccggatcgcccatggaacccccctacctttagtccagctttgctagtggtcacggaaggagataatgccaccttcacttgctcattcagcaatacttccgaatcattcgttttgaactggtatcgtatgtctccaagcaatcagacagataaacttgcagcctttcctgaagaccgttcacagcctggtcaggactgtcggttccgggtgacgcagcttcctaacgggcgggattttcatatgtccgtcgtgcgagccaggaggaacgatagcggaacttatctttgcggcgccatttccctcgcccccaaggcccaaatcaaagagagcctacgagccgaactccgcgttactgaaagaagggctgaggtgcccacagcccatccctctccaagtcctagacccgctggacagttccagaccttagtcgtgggtgtggtcggcggcctgctgggctccttggttttgcttgtgtgggttctagctgttatttgctcaagggccgcccgtggcactattggtgccagacgcacaggacaacctcttaaggaggatcctagtgctgttccagttttttctgtcgattacggagagcttgattttcagtggcgagaaaagactcccgagcccccagtcccctgcgtgcccgaacagaccgaatacgcaacaatcgtctttccgtcagggatgggaacgagttctccagcccgacgaggctctgccgacggacccagaagcgctcagcctctgagacccgaagacgggcactgttcttggcctctgtag

SEQ ID NO: 129915 - DNA, 540 bp, Artificial Sequence
  Description of Artificial Sequence: Synthetic coding sequence
atgcagatccctcaggccccctggcctgtcgtgtgggccgtcctacagctgggctggagaccaggatggtttctggacagccccgaccgcccttggaaccccccaacattttcgcctgcactcctggtggttactgaaggcgacaatgcgacattcacatgttccttttccaatacctccgagagcttcgttctgaattggtatcggatgtccccttctaatcaaaccgacaaactggcggctttccccgaagaccgtagtcagccaggtcaggattgccggtttcgagtgacccagctccccaacggacgcgactttcacatgagcgtggtccgcgccaggcggaatgactccggcacgtacttgtgtggggccatcagtcttgcgccgaaggctcagattaaggaatccctccgagcagaactccgggtgactggtaccatcggcgcccggcggactggccagcctctgaaggaagatccttcagctgtgccggtcttctccgttgattacggtgagctggacttccagtggcggtag

SEQ ID NO: 129916 - DNA, 639 bp, Artificial Sequence
  Description of Artificial Sequence: Synthetic coding sequence
atgcgaatgaccatggaggagatgaagaacgaggccgagaccacttctatggtctccatgcctctctacgcagtcatgtacccagttttcaacgaactggaacgcgtaaatctatctgctgctcagacacttagagctgccttcataaaggccgagaaagagaaccctgggttaactcaagacataattatgaaaattttggagaagaaatcagtggaggtgaatttcacagagagtctgttaagaatggctgccgatgatgtggaggagtatatgattgagcggcccgagcccgagttccaagacctgaatgaaaaagctcgcgcattgaaacagatactttccaaaataccagatgagattaatgacagagtgcggttcttacagaccataaaggatatcgctagcgcaatcaaggagttactggacaccgtcaacaatgtgttcaaaaaataccaataccagaacaggcgggcgctggagcatcaaaagaaagaatttgttaagtattcaaagtccttttccgacaccctgaagacttattttaaggacggaaaggccattaatgtgtttgtgagcgcaaatagattgatccatcaaaccaacctgatccttcagacattcaaaaccgtggcgtag

SEQ ID NO: 129917 - DNA, 639 bp, Artificial Sequence
  Description of Artificial Sequence: Synthetic coding sequence
atgagaatgactatggaggaaatgaagaatgaggccgagaccacctccatggtgtccatgcccctgtacgcggtcatgtaccccgtatttaatgagctggaacgagttaacctgagtgccgcccagacattgcgggctgctttcattaaggcagagaaagagaatccgggccttacccaggacattatcatgaagattctagaaaagaaatccgtcgaggtgaactttaccgaatcactgctgaggatggcggctgatgatgtagaggagtatatgattgaacgtccagaacctgaattccaggacttaaacgagaaggcacgagcccttaagcagatactgtctaaaattccggatgagattaatgatcgcgtgcgatttcttcagaccataaaagatattgcttccgcgatcaaagagctcctcgacactgtgaacaacgtcttcaagaagtaccagtaccaaaatcgcagggcgcttgaacatcagaagaaagagtttgtgaaatatagtaagtccttctcagatacgctgaagacctacttcaaggacggcaaggccatcaacgtatttgtcagcgccaatcgtctgatccatcagacaaatctgatcctgcagacctttaaaacggtggcttag

SEQ ID NO: 129918 - DNA, 441 bp, Artificial Sequence
  Description of Artificial Sequence: Synthetic coding sequence
atgcgtatgactatggaggaaatgaaaaacgaagcagagaccacttcaatggtaagcatgcctctgtacgcggtgatgtaccccgtgtttaacgagcttgaaagagttaacctaagcgcagcccagaccctgcgggcagccttcattaaggctgagaaggagaaccctggactgacccaagatattatcatgaagattcttgaaaagaaaagtgtggaagtaaattttaccgagagtttgctcaggatggctgctgacgatgtggaggaatatatgatcgagaggccagagcccgagtttcaggatctaaacgagaaggcacgggctctgaagcagatcctgagtaaaattcctgacgaaattaacgaccgcgtgcgattcctgcagactatcaaggacatcgctagcgccattaaagagttacttgataccgtgaattag

SEQ ID NO: 129919 - DNA, 240 bp, Artificial Sequence
  Description of Artificial Sequence: Synthetic coding sequence
atgagaatgacgatggaagagatgaagaatgaagcagagacaacctccatggtaagcatgcccctgtacgctgtcatgtaccccgtgtttaacgagcttgagcgcgtaaacctgtccgccgcgcagactttacgggccgctttcattaaggccgaaaaagagaaccctggcttaactcaggatataataatgaagatcctggaaaaaaagtccgttgaggtcaactttaccgagtcttag

SEQ ID NO: 129920 - DNA, 639 bp, Artificial Sequence
  Description of Artificial Sequence: Synthetic coding sequence
atgcggatgaccatggaagaaatgaagaacgaagctgaaaccaccagcatggtttcaatgcctctgtatgctgtcatgtacccagtctttaacgagctggagagggtgaatctgtccgcggcccagacattgcgagccgcttttattaaggccgaaaaggaaaatcccgggctcacacaggacataatcatgaaaatattggagaagaaaagcgtggaggtgaactttacagaatccctcctccgcatggcggcggacgacgttgaggaatacatgattgagcgacctgaaccggagtttcaagacttgaatgagaaggcccgggcactgaagcagatcctgagcaagatacctgatgagatcaacgaccgtgtgcgcttcttgcagacaattaaagatatagctagcgcgatcaaggagttattggatacagtgaataacgttttcaaaaagtaccaataccagaataggcgtgcactagaacaccagaagaaggaatttgtgaagtacagcaagtccttctctgatacactgaagacctacttcaaggacggaaaggccattaacgtgttcgtaagcgccaaccgcctcattcaccagacaaacctcattctacaaacctttaagaccgtggcatag

SEQ ID NO: 129921 - DNA, 639 bp, Artificial Sequence
  Description of Artificial Sequence: Synthetic coding sequence
atgcgcatgactatggaggaaatgaaaaatgaagcagaaactaccagtatggttagcatgcccctgtacgccgttatgtacccagtgttcaatgaacttgaaagggtgaatcttagcgctgcacagacattacgggctgcattcattaaagcggagaaggagaatccaggactcacccaggacattatcatgaagattctcgaaaaaaaatcagtggaagtgaattttaccgaatccctgctcagaatggcagccgacgacgtcgaagagtatatgattgagcgccctgaacccgagtttcaggacttgaacgagaaagcacgcgccctgaagcagatactaagtaaaatcccagacgagatcaacgatcgggtaagattcctccagactataaaggacatcgcaagcgccatcaaggagttgttggataccgttaacaacgtgttcaaaaagtatcagtatcagaacagacgggccttggaacaccagaagaaggaattcgtgaagtactccaaatcatttagtgacactctgaaaacatattttaaggacggaaaggcaatcaatgtgttcgtctcagcaaaccgcttgatccatcagacaaatctgattctccaaactttcaagactgtagcatag

SEQ ID NO: 129922 - DNA, 609 bp, Artificial Sequence
  Description of Artificial Sequence: Synthetic coding sequence
atgcgcatgaccatggaggagatgaaaaatgaagccgagacaactagtatggtgtcaatgcccctatacgctgtgatgtaccccgtctttaacgagctggaacgggtcaatctgagtgccgcccagacccttcgggctgcctttattaaagccgaaaaagagaatccagggcttacacaagatattatcatgaaaattctcgaaaagaaaagcgtcgaagtcaacttcacagagagcctcttgaggatggcagctgatgacgtggaggagtacatgatcgaacgtcctgaaccagaattccaggacttgaatgaaaaggcccgcgctctcaagcagatcttgagcaagatccctgatgaaattaacgaccgcgtcaggttcctccaaacaataaaagatattgcctctgcaataaaagagttattggataccgtgaataacgtctttaagaagtaccagtaccagaaccggcgggcccttgaacatcagaagaaagagtttgtcaaatatagtaaaagcttttctgacaccttgaaaacttattttaaggatggaaaggcgattaatgtctttgtgagtgccaatcgcctcatccaccagactaactag

SEQ ID NO: 129923 - DNA, 561 bp, Artificial Sequence
  Description of Artificial Sequence: Synthetic coding sequence
atgcgcatgactatggaagagatgaagaacgaggcagaaacgacaagtatggtgtccatgcctctgtatgccgtgatgtacccagtgtttaatgaactggagagagtaaacttgagtgctgcccagacactgcgtgccgcatttattaaagccgaaaaagagaacccagggctgacccaggacataatcatgaagatactcgaaaagaaatctgtggaggtgaacttcactgagtcactcttgagaatggctgccgatgacgtggaggaatacatgattgaaaggcctgagcctgagtttcaagacctcaacgaaaaggctagggctttaaaacagatcctgagcaaaatacccgacgaaatcaacgaccgggtcaggttcttacagacaatcaaggacattgcctcagctatcaaggagctcctggatacagtgaacaatgtgttcaaaaagtaccaatatcagaatcgccgagcactggaacaccagaaaaaggaattcgtcaagtattcaaagtccttcagcgacacactcaaaacctatttcaaagacggaaagtag

SEQ ID NO: 129924 - DNA, 405 bp, Artificial Sequence
  Description of Artificial Sequence: Synthetic coding sequence
atgcgtatgactatggaagaaatgaagaacgaggccgagactacaagcatggtgagtatgccactatatgctgtaatgtaccccgtatttaacgaactggaacgggtgaacctgagtgccgcgcagaccctcagggctgcattcattaaggctgagaaggaaaatcccggtctcacgcaagacattataatgaaaatcctggaaaaaaaaagcgtggaagtcaacttcacagagtctctgttaaggatggcagccgatgacgtcgaggagtacatgatcgagcgccccgaacccgaattccaggatctgaatgagaaggcacgggctttaaagcagatcctttctaagatcccagacgagatcaatgacagggttcgctttctccagacgatcaaggatatctag

SEQ ID NO: 129925 - DNA, 639 bp, Artificial Sequence
  Description of Artificial Sequence: Synthetic coding sequence
atgcgaatgacgatggaagagatgaagaatgaggctgagactacctccatggtaagtatgcccttgtatgctgtgatgtaccccgttttcaacgagctggagcgggtgaacctgagcgctgcacagactctgagggctgctttcatcaaggctgagaaggaaaatcccggcctaactcaggatattatcatgaagatcctggagaaaaaaagcgtggaagtgaattttacagagtccttactccgcatggcagccgacgatgtcgaggaatacatgatcgagcgccccgagccagagtttcaggacctgaatgagaaagcgcgggccctgaagcagatcctcagtaaaattccggatgaaattaacgatcgcgtgcgattcctgcaaaccattaaggacatcgcttcagctatcaaggagcttctggacactgttaataacgtgttcaagaaataccagtaccagaaccgtagggcactggaacatcaaaaaaaggaatttgtcaaatacagcaagtccttctctgacactctgaaaacctactttaaagacggcaaagccattaacgtgttcgtctctgcgaatagactgatacatcagaccaacctgattttacagactttcaaaaccgttgcctag

SEQ ID NO: 129926 - DNA, 5616 bp, Artificial Sequence
  Description of Artificial Sequence: Synthetic coding sequence
atggccaacttagaagagagttttcccagaggaggcacccgtaaaatccacaaacctgagaaagcgttccagcaatcagttgagcaggataatctgttcgatatttccaccgaggaaggatccaccaaaagaaagaaaagccaaaagggaccagctaaaacgaagaaattgaaaatcgaaaagcgcgagagcagcaagtctgcccgagaaaagtttgaaattctttccgttgaatctttatgcgaagggatgcgaatcctcggctgcgtgaaagaggtcaacgagcttgagttggtgatttccctgcccaacggactccaagggttcgtgcaggtcacagaaatatgtgatgcatacacgaaaaaattgaacgaacaggttacccaagaacagcctctgaaggatcttctacatttgcccgaattgttttctcccgggatgttggttcgctgcgtggtaagttctttggggatcactgaccgcggcaagaaaagcgtcaagctgtccctgaaccccaaaaatgtcaacagggtgctgagtgccgaggcccttaaacctggaatgctgctgactggcaccgtgtcttctttggaggatcatgggtacttggtggatattggcgttgatgggacaagagcctttttacctctccttaaggcgcaggagtacatacgacagaagaacaagggcgctaaattgaaagtgggtcagtacctgaattgcattgtcgagaaggttaagggcaacgggggagtggttagtctgagcgttggacacagtgaagtgtcaactgctattgctacagagcaacagtcttggaatttaaacaacttgctcccgggtttagtggtcaaagcgcaggtgcagaaggtgacaccatttggactgactctgaattttcttactttcttcactggtgtggttgattttatgcatctggacccaaaaaaggccggtacatacttctctaatcaggctgtaagagcatgtattctttgtgtccatcccagaactagagttgtgcatctgtcgctgcggcccatttttttgcagccaggacgccctctcacacgcctctcttgtcaaaacctgggagctgtgttggacgacgtccctgttcagggtttcttcaaaaaggccggagccactttccggcttaaggacggggtgctcgcttatgctaggctctctcacctcagcgatagtaaaaacgtattcaatcccgaggctttcaagcctggcaatacgcacaagtgcaggattatagattattctcaaatggatgaactagcattactatcgctccgcacttcaattatagaagcacagtatctcaggtaccatgacatagagccaggagctgttgttaaaggcaccgtactgaccattaagtcctacggaatgctggtgaaggtcggcgaacagatgagaggtctggtgcctcccatgcacctcgctgatattctgatgaaaaacccagaaaaaaaatatcacatcggagatgaagtgaagtgtcgagtacttctgtgtgacccggaggcaaagaagctgatgatgaccctgaaaaagaccctgattgagagcaaactgccagtgatcacctgttatgctgacgccaagcccgggttgcagacacacgggttcatcatccgagtgaaggattacggctgcattgtgaaattttacaataacgtccagggactggttcccaaacacgaactcagtaccgaatacatcccagatccagaaagagtcttttacactggtcaagtcgtcaaggtcgtggttctcaattgcgaacctagtaaggaaagaatgcttctatcctttaaactgtcttccgatcccgagcccaagaaagagccagccggacattctcaaaagaagggaaaggccatcaacattggacagctggtcgatgtgaaggtgctggagaagacaaaagacggacttgaagtggctgtattgcctcataatatacgggcctttctgcctacatcccatctgagtgaccatgttgccaacggacccctgctccatcactggcttcaggccggggacatattgcatcgggttctgtgcctgagtcaatccgaaggccgtgtgctgctttgccgcaaaccagcactggtgagtacagtcgagggcggacaggaccccaaaaacttttcagagattcaccccggaatgctccttatcggattcgtgaaatctatcaaagactacggagtgtttattcagttcccttctgggctttctggcctggcccctaaggctataatgtctgataaattcgtcaccagtacatccgaccatttcgtcgaagggcagacagtcgccgcaaaggtgacaaatgtcgacgaagaaaagcaacgaatgctgctttctctgaggttatcggattgtgggcttggagatctcgccatcactagccttttactgctcaatcagtgcttggaagaattacagggagtgagatcattgatgtccaaccgcgattccgtcctgatccagacgttagcagagatgactccggggatgttcctggacctggtcgtgcaagaggtgctggaggatggctctgtcgtcttctcaggtgggcccgttccggacctggtattaaaggcctcccgataccatcgtgccgggcaggaggtggagagcggtcagaaaaaaaaagtagtgatactgaacgtggacttgttaaagcttgaggtacacgtatccctccaccaggacctcgtcaataggaaggcacgcaagcttagaaagggcagcgaacaccaggcaatagtgcagcatttagagaagagcttcgccatcgctagtttagtggagacgggtcacctcgccgcgttctcgctgactagccatctcaacgacacttttcgcttcgactctgagaaacttcaggttggtcaaggagtctctctgaccctgaagaccaccgagcctggcgtaacaggtctgctccttgccgtggagggccccgccgccaaaagaaccatgaggcccacacaaaaggattcagaaaccgtcgatgaagatgaggaggttgaccccgctctgacagttggcactattaagaaacacacgctgagcatcggcgacatggtcactggaaccgtgaagagcatcaaacccacccatgtagttgtgacactagaggatggtattattggctgtatccacgcatcccacatccttgatgatgtgcccgaaggaacctcccctacaaccaagctgaaggtcggaaaaaccgtgacggcgagagttatcggaggaagagacatgaagacattcaagtacttacctatctcccatccccggttcgtaagaaccatcccagaattgagtgtgcgacctagcgagctggaagacgggcacactgccctcaatacgcactcggtcagtcctatggaaaaaatcaaacagtatcaggccggtcagaccgttacctgtttcctgaaaaagtacaatgtggtgaaaaaatggctggaggtggaaattgctcctgatattcggggaaggattccgcttctgcttacctcactcagcttcaaggtgctcaaacaccctgataagaagtttcgcgtgggacaggcgttgcgagctaccgtggttggccccgattcaagtaaaacactgctgtgtctttcactgacaggcccacacaaactggaggagggcgaggttgccatgggcagggttgtcaaggtgaccccaaacgagggactgaccgttagtttcccctttggcaagatcggaacagtctctatttttcatatgagtgattcttattccgaaacacctctagaggacttcgtgcctcagaaggtagtccgctgctacattctttctaccgcagataacgtccttaccttaagcctgcgaagttcccggaccaaccctgagaccaaaagcaaagtggaagaccccgaaatcaactctattcaggatataaaggagggccaacttttgcgtggctacgtgggctcgattcaaccgcacggagtcttttttaggttaggaccctctgtggttgggctagcccggtactcccatgtgtcgcagcatagtcctagtaaaaaggctttatataacaagcatctgcccgagggtaaactgttaaccgctcgggtcctacgcctcaatcatcaaaagaatctcgtagaactgagtttcctgcccggcgacaccggaaagccagacgtgctgagcgcctccttagaaggacagctcactaagcaggaggaacgcaagacagaagcagaggaacgggatcagaagggagagaagaaaaatcagaagcgcaacgaaaagaagaatcagaagggccaggaagaggtggaaatgccgtctaaagaaaagcagcagccccaaaagccccaggctcagaagagaggaggccgggagtgtcgagagtctggatccgaacaagaacgagtgtctaagaaacccaagaaagccggcttgtccgaagaagatgactctctcgtggacgtctactacagagaaggcaaggaggaggcagaagagaccaacgtgttaccaaaggagaaacagaccaagccagctgaggcaccacgccttcagctgtccagcggattcgcctggaacgttggactcgattctttgacgcctgctctaccccccctcgccgagagttctgactccgaagaggacgagaaaccacatcaggcaacaattaagaagtccaaaaaggagcgagaactcgaaaagcaaaaggcagagaaagaactcagcaggatcgaagaagccttgatggatcccggtaggcagcctgaaagtgctgacgatttcgataggcttgtactatcgtctccaaatagttcaatcctgtggctacagtatatggcattccacctgcaagcgactgagatcgaaaaggcgagggctgtcgccgagcgcgccctaaagacaatctcattccgggaagagcaggagaagctgaatgtgtgggtggccctattgaacctggaaaatatgtatggctcacaggagtctcttactaaagtgtttgagcgcgcagtgcagtataacgagcctctgaaggtctttctgcacctagccgacatttacgccaaaagcgagaagttccaggaagctggagagctgtacaaccgaatgttgaaacggtttaggcaggagaaggccgtgtggattaagtatggtgcatttctgcttcggcggagccaggcagcagcgagtcacagggtgctgcagagggctttggaatgcctgccttcaaaagagcacgtggacgtgattgccaagttcgcccagctggagtttcagcttggcgacgccgaaagggccaaggccatttttgaaaataccctgagtacgtatcctaagaggaccgacgtgtggagcgtgtacatagacatgaccattaaacacggatcccagaaagatgtccgagacatttttgagcgggtgatccacctgtccctggccccaaagagaatgaagttttttttcaagagatacttagattacgagaagcagcatggaactgaaaaagacgtacaggcagtgaaggcaaaggccctggagtatgtggaagctaagtcctctgtgctcgaagactag

SEQ ID NO: 129927 - DNA, 3705 bp, Artificial Sequence
  Description of Artificial Sequence: Synthetic coding sequence
atggccaatctagaggagtcctttcccagaggggggacccgcaaaattcataagccagaaaaagcctttcagcaatcggtagagcaggacaatctgttcgacattagcacagaggaaggtagcaccaagcgcaaaaaaagtcagaagggcccagccaagacgaagaagctgaaaatagagaagcgagaatcaagcaagagtgccagagagaagttcgagattttatccgtggagagcctctgcgagggcatgagaattttgggatgcgtgaaggaggtgaatgagctagaactagtgataagcttacccaatgggctccaaggcttcgtacaggtcacagaaatttgtgatgcctacaccaaaaaactcaacgaacaagtcactcaggagcaacccctgaaggatctactgcatttgcctgaactgttttccccaggcatgttagtacggtgcgtggtctcaagcctgggaatcacagaccgcgggaaaaaatccgtgaaactctctctcaatcccaagaacgtcaaccgcgtcctaagtgcggaagccctgaagccagggatgctcctaacggggaccgtaagttccttggaagatcatggctatctcgtagatatcggggtggatgggacacgcgcgtttctgccattactcaaagcacaagagtacataaggcaaaaaaacaaaggagcaaagctgaaagtcggccaatacttgaattgcatcgtcgagaaggtaaaggggaatggcggtgtggtctcactctctgtcgggcatagcgaggtgtcgactgccatcgcgacggagcagcagtcttggaacctcaacaacctccttcccgggttggtcgtaaaagctcaggtgcaaaaggttacaccttttgggctcaccctgaacttcctgactttctttactggggtggtggacttcatgcatctcgatccaaagaaggcaggcacatacttttccaaccaagccgttagggcctgcatcctgtgcgtccaccccaggacccgagttgttcacttgagcctacgtcccattttcctccagcccggacggcccctgacgcgcctgagctgccagaacttaggagccgttctcgacgatgtgccagtccaaggtttctttaagaaagccggagcaacttttcgtctgaaggatggagtcctggcatacgctagattatctcatctgtcagactctaaaaatgtctttaatccagaggcgttcaagccgggcaacactcataaatgcagaatcattgactacagccaaatggatgagctcgcccttctgagcctgagaacatctattatcgaggctcaatacttgagataccacgacatcgagccaggagcagtggtcaaggggacagtcctgactatcaagtcttacggcatgctggtgaaagttggcgagcagatgagaggcctcgtccctccgatgcatttagctgacatcctgatgaaaaatcccgaaaaaaagtaccatataggagacgaggttaaatgcagggttctcctgtgtgatcctgaggccaaaaaacttatgatgacactcaagaagactctgatcgagtctaagctgcctgtgatcacatgctatgcagatgccaaaccggggctgcaaacccacgggttcattattagagtgaaggattacggctgcattgttaaattctacaacaacgtacagggactggtacccaagcatgagttgtcgacagaatatattccggacccagagcgggtattctacaccggacaggttgtgaaggtcgtcgttttgaactgtgagccttccaaagagagaatgctactgtccttcaaattgagcagcgatccagagccaaagaaggagccagccgggcattcacagaagaagggaaaggcaataaacatagggcagctagttgatgtgaaggtgctggaaaagacgaaagatggtctggaagtggcagttctgccacataacatccgggcgttcctacctacatcccatctctctgatcatgttgctaatggccctctgctccatcactggctccaggccggagatatcttgcaccgcgtcctgtgtctgagccaatctgaaggcagggtcctgctctgtagaaaaccagccctggtgtcgaccgtggagggtggacaggatcctaaaaatttttccgagattcaccccggaatgctcctgattgggtttgtaaaatccataaaagattatggcgtgttcatacagttcccatcaggcctcagcgggctggccccaaaggccatcatgagcgataagttcgtcacgagcacaagtgaccatttcgtcgagggccagactgtggcagctaaggtgactaacgtagacgaagaaaagcagcgcatgttgttgagcttacgcttgagtgactgtggattgggcgatctcgcaatcacatctttactactgctgaaccagtgcctcgaggagctgcagggtgtccggtctctcatgagcaacagagactcagtcctgatccagactctggcagagatgactcccgggatgtttctcgatctcgtggtgcaagaggtactggaagacggttccgtggttttttccggcggtcccgtccccgacctggtgctcaaagccagtcgatatcacagagcaggacaggaggtcgaaagtggtcaaaagaaaaaggttgtgattctgaacgtcgacctgctgaaactcgaggtgcacgtgtcacttcatcaagacctggtgaatcgcaaggcacgcaaactgcgcaagggatccgaacatcaggctatcgtgcagcatctcgagaaatcatttgctatcgcatcactggtagaaaccggacaccttgccgctttcagtctgaccagccatctgaatgacactttcagattcgattcagagaagctacaggtgggacagggagtgagcttaacgctgaaaaccacagaacctggtgtcacaggcctgctgctggctgtggagggacccgctgcaaaacgtactatgcgcccaactcagaaggattccgaaacggtggatgaagacgaggaagtggacccggcactgaccgtcggaactattaaaaaacacacacttagcattggggacatggtgacaggtaccgtgaaaagtattaagcccacacacgtggttgtgaccctagaagatggcatcatcggctgtatacacgcgtcccatatactggacgacgttccagagggcacttctccaacaacaaagctgaaggtcggaaagaccgtgacggctcgggttatcggtgggcgtgatatgaaaacattcaagtacctacccatttcgcatccgaggtttgtcagaacaatccccgagttgtcggtgagaccttcagagttagaggatgggcacaccgcccttaatacacactccgtctcaccaatggagaaaattaagcaatatcaagccggacttagtgaggaggacgacagcctggtggacgtttactacagggaaggtaaagaggaagctgaagagacaaatgttcttcccaaagaaaagcaaacgaaaccagccgaagcccctcgcctgcagctgagctctggcttcgcttggaacgtgggtcttgatagcctaaccccggcgctgcctcccctcgccgagtcttcagatagtgaagaagatgaaaaaccacaccaagctacacagattaagaaatccaaaaagtag

SEQ ID NO: 129928 - DNA, 936 bp, Artificial Sequence
  Description of Artificial Sequence: Synthetic coding sequence
atggccgccgccggcgcccggcctgtggagctgggcttcgcagagtcagcccctgcttggagactgaggtcagaacagtttccatctaaggtgtacgcaccactgccggggcgacctgatgcctttcatcggtgtatcttcctgttctgttgtcgcgagcaaccatgttgtgctggactgcgggtgttcagaaaccaactaccccggaagaacgacttttatagttacgaaccgccctccgagaatccaccacctgaaactggtgagtctgtatgcctgcaactgaagtccggtgcgcatctttgccgggtgtgtgggtgcctggggcctaagacgtgctctcgctgtcataaggcctattattgcagcaaagagcaccagaccctcgattggcgtctgggccacaagcaggcctgtgctcagcctgaccaccttgaccacatcattcctgaccataacttcctgttccccgaattcgagatagtaattgaaacagaggatgagataatgcccgaggtggtagagaaggaggactactccgagatcatcggaagcatgggtgaagccctggaagaagagctcgacagcatggccaagcacgaaagtcgcgaggacaagatatttcagaagtttaagacacagatcgccctggaacctgagcagattctcagatacggaagggggatcgcccccatttggatctcaggcgaaaatatcccgcaggagaaagacatccccgattgtccctgcggggcaaagcgtatcctcgaatttcaggtaatgccgcagctcctcaactacctgaaagctgatcggttgggaaaatccatcgactggggtatccttgcagttttcacttgcgcggaatcctgttcgttaggcaccggttatacggaagaatttgtgtggaaacaggatgtcacagatacaccttag

SEQ ID NO: 129929 - DNA, 687 bp, Artificial Sequence
  Description of Artificial Sequence: Synthetic coding sequence
atggccgctgctggtgctcggcccgtggagctgggctttgctgagtccgcccccgcctggagactcagaagcgagcagtttccgtctaaagtaggcggtcgccctgcctggctgggtgctgcaggattaccaggaccacaggcattagcttgcgaattatgcggacgcccattgagttttctgttacaggtgtacgccccactccccgggaggccagacgcattccacagatgcatatttctattttgctgtagagagcaaccttgctgtgcgggactgcgcgtcttcaggaatcaactccctcggaagaatgacttctactcttacgagcccccttcagagaatccccctcctgaaacaggagagagcgtatgcttgcagcttaagagcggcgcccacttatgcagggtctgcggatgtttaggtcccaagacctgtagtcgctgtcacaaagcttattattgttcaaaagaacaccagacactagattggaggctgggccacaaacaggcttgtgcacagcctgaccatctcgaccatattattcccgaccataacttcctctttccagagtttgaaatcgtgatcgagaccgaagatgaaatcatgcctgaggttgtagagaaggaggattacagtgagatcatcggatccatgggtaagcagttccaggatttcatccattag

SEQ ID NO: 129930 - DNA, 1035 bp, Artificial Sequence
  Description of Artificial Sequence: Synthetic coding sequence
atggctgctgccggggcgaggcctgtcgaactgggctttgccgagtctgcccccgcttggcgcctgaggtctgaacagttcccctccaaggtcggggggagaccggcgtggcttggggcagccggtcttcccggcccacaggcattagcctgtgagctgtgcggacggccgttaagcttccttctgcaggtctatgcacccctgcccggtaggcccgacgcctttcatcgctgcatctttttgttttgttgtagggagcagccctgttgcgctggcctgagggtctttcgcaaccaactcccccgaaagaacgatttttactcctacgagccaccgtcagagaatccacctccagagactggagagtccgtgtgccttcagctgaagtcaggggcacacctgtgtcgtgtttgtggttgtttgggaccgaaaacctgtagtcgttgtcataaagcttattattgctcaaaggagcatcagactttggattggagactgggacacaaacaggcctgtgcccagcctgaccatcttgaccacataataccagaccacaactttctatttcccgagttcgagatcgttattgaaacagaggatgaaatcatgcctgaggtggtcgagaaagaagactattccgaaatcatcgggagcatgggggaagctctcgaggaggaattggacagcatggccaagcacgaaagccgggaagacaagatttttcagaaattcaagacccagattgctttagagcctgagcagatccttcggtatgggagaggcatcgcgccaatatggatttctggcgagaacattcctcaagaaaaagatattccggactgtccctgtggggcaaagaggatcctggagttccaagtgatgcctcagctgcttaactatctgaaggctgaccggctcggaaagtcaatcgactgggggatcctggccgtcttcacatgtgctgagtcttgcagcctaggcaccggctatacagaggagttcgtgtggaagcaagacgtaacagatactccctag

SEQ ID NO: 129931 - DNA, 588 bp, Artificial Sequence
  Description of Artificial Sequence: Synthetic coding sequence
atggcggcggctggggctcggcccgtagagctgggattcgccgagtccgcgcccgcctggagactccggagcgagcaattcccatccaaagtatacgccccactccctggtcgtcctgatgccttccatagatgcatttttctgttttgctgtcgtgaacagccttgttgcgcaggccttagggtctttcgaaaccagttgccccggaagaatgacttctattcttacgagccaccatccgaaaaccccccgcccgaaactggcgagtcagtttgcttacagctgaaaagcggcgctcatctctgccgtgtctgtggatgtttggggcccaagacttgtagtaggtgtcacaaggcctactactgctccaaggagcaccagacactcgactggcgtttgggccacaagcaggcatgtgcccagccggaccatttggaccatattatccctgatcacaacttcctcttccctgaatttgaaattgtgatcgagaccgaggacgagattatgcctgaggtcgtggaaaaagaggactatagcgaaatcatcggatcaatgggtaaacagttccaggactttattcattag

SEQ ID NO: 129932 - DNA, 567 bp, Artificial Sequence
  Description of Artificial Sequence: Synthetic coding sequence
atggctgcagctggcgcacggcccgttgaacttggcttcgctgagtctgccccagcttggaggctgcgttctgagcaattcccaagcaaggtatacgccccgttgcccggacgcccagatgccttccatagatgcatctttttattctgttgcagagaacagccttgctgtgcaggacttcgtgtttttcgcaaccagctaccccggaagaacgacttttactcctacgagccaccgtccgagaacccccccccagagaccggcgagtccgtctgtctacagctaaagtcaggcgcacatctttgtcgcgtgtgcgggtgcctcggaccaaagacatgcagccgctgccataaggcgtactattgctctaaggagcatcaaacactcgactggcggctgggacacaaacaggcgtgcgcccaaccagatcacctggaccatattatccctgaccataattttctgttcccagagttcgagattgtaatcgagacagaagatgagataatgcctgaagtggtcgagaaagaagactattccgaaattattggctcaatgggcatatag

SEQ ID NO: 129933 - DNA, 2607 bp, Artificial Sequence
  Description of Artificial Sequence: Synthetic coding sequence
atggccacttttatttccgtgcagctgaaaaaaacgagcgaggttgacttggccaagcctctggtgaaatttatccagcagacctatccatcaggtggcgaagaacaggcccaatattgcagggcagctgaggagctcagcaagctcagaagagctgcagtgggtaggcctttagataagcatgagggggcacttgaaacactgttaaggtattacgatcagatctgtagcatcgaaccaaagttccccttcagtgagaaccagatatgcctaaccttcacttggaaggacgccttcgataagggatctctctttggaggctccgtgaagctggccctggcatccctaggttacgaaaagtcttgtgtgttatttaactgcgccgccttggcaagtcagattgcggctgagcagaatctcgacaacgacgaagggctcaagatagccgcaaagcattaccaatttgcctcaggagcttttctccatataaaagagaccgtcctgtctgctcttagtcgcgaacctaccgtggacatatccccagataccgtggggacacttagtttgattatgctcgctcaggcgcaggaagtgttcttcttgaaagcaacaagggataaaatgaaagacgcaattattgcaaagttggccaaccaggccgctgattactttggggacgccttcaaacagtgccagtataaagatacactgccaaaggaggtctttccagtgctcgccgcaaagcattgcataatgcaggcgaatgcagagtatcaccagtccattctggccaaacaacagaagaagtttggtgaggagatcgcccgcctccagcacgctgccgagctgatcaaaacagtggccagccgatacgatgagtacgtaaacgttaaagacttcagcgacaaaatcaaccgcgccctagcagcggctaaaaaagataatgacttcatatatcacgacagggtaccagacctgaaagacctggatccaatcgggaaggctacacttgttaagtcaacccccgtcaacgttcccatctcccagaagttcaccgacctcttcgagaagatggtccccgtctctgtacaacagtccttggctgcttataatcagagaaaggcagatctcgtgaacagatccatagcccagatgagggaggcaacgacacttgcaaacggtgtcttagcgtctttaaatctcccagcagcgatcgaagacgtttcaggagataccgtgccccaatccattctgactaaatcacggagtgtgattgagcagggaggaatccaaaccgtggatcagctgatcaaggaattgcctgaactgctccagagaaacagggaaatcctggacgagagcctgaggctcttggacgaggaagaagccactgataacgacctgagagctaaatttaaagagcggtggcaaagaacaccctctaacgagctctacaaaccattaagagctgagggcaccaactttcggacagttctcgacaaagcagtccaagctgacggtcaagttaaggagtgttatcagtcccaccgcgacacaatagtgctcctttgtaaaccggagcctgagctgaatgcagccataccttcagctaacccggcaaagaccatgcagggatccgaagttgtcaacgtgctgaagagtctcctctccaatctggacgaagtcaaaaaggaaagagagggcttggaaaatgacctcaaaagcgtgaatttcgatatgacctcaaaatttctgacggctctggctcaggatggcgtcattaatgaggaggcactgtccgtgaccgagttggatcgggtttacggcggactgacaacaaaagttcaggaatcccttaagaagcaggagggccttctgaaaaacatccaagtttctcatcaggagtttagtaagatgaagcagagcaataatgaagccaatctgagggaggaggtgctaaaaaaccttgctactgcatacgacaattttgttgaattggtggcaaatctgaaggagggaaccaagttctataacgagctaaccgagatcctggtgcgcttccagaataagtgcagcgacatcgtcttcgctcgaaaaacggagcgagacgaactgctgaaggacctgcaacagtcgatcgctcgggagccttctgccccatccattccaacccccgcctaccagagttctcccgccgggggccatgcgcctacacctcctacacccgcgccccgtactatgcctcccacgaaaccacagcctcctgcccgcccaccgcctcctgttcttcccgccaaccgagctccctcagcaacagcgccttcacctgtcggagccgggacagctgctccagcccccagccagaccccgggaagcgctccgcccccacaagcgcagggtccgccataccctacatatccaggatatcccggatattgccagatgcctatgcctatgggttataacccctacgcctacggtcagtacaacatgccttacccccctgtgtatcaccagagtccggggcaggctccgtacccgggaccccaacagcccagctatccgttccctcagcccccgcagcagagctactatccccaacagtag

SEQ ID NO: 129934 - DNA, 2622 bp, Artificial Sequence
  Description of Artificial Sequence: Synthetic coding sequence
atggctacatttatctcagtccagctgaaaaagacaagtgaggtggacctggcaaaaccactggtaaaattcattcaacagacatacccaagcggcggggaggaacaagcccagtattgtagagccgctgaggaacttagtaagcttagacgtgcagccgtgggaaggcccttggataaacatgaaggagctcttgagacccttctccgatactacgatcaaatatgcagcatcgagcccaaattcccgttttctgaaaaccaaatttgcctgacattcacatggaaagacgcgttcgacaaaggaagtctgttcggcggatctgtcaagttagccctggcctccctcggctatgaaaaatcctgtgttttatttaactgtgccgcccttgcctcacagatcgcggccgagcaaaacctggacaatgacgagggcctgaagatcgcagctaagcactatcaatttgcaagcggggccttcctacacatcaaagagacagttctctcagccctcagtcgtgaaccgactgtggacatcagccctgatacagtgggaacactctctctaatcatgctcgcccaggcccaggaggtgtttttcctgaaggccactcgagacaagatgaaggacgccattatcgctaagctggcaaaccaggcggccgattacttcggcgacgccttcaaacagtgtcagtacaaggacaccctccctaagtacttttactttcaggaggtgtttcctgtgctggctgcaaagcattgcattatgcaggcgaatgccgagtaccaccagtcgattctggctaagcagcagaagaaatttggcgaggaaatcgccagattacaacacgccgccgaactcataaaaacagtggcgagcagatatgatgagtacgttaacgtgaaggatttcagtgataagataaaccgcgccctagccgccgccaagaaagataacgatttcatttaccatgacagagtacccgatttaaaagacctcgacccaataggtaaggccactctagtgaagtctactccagtgaacgtgcccatctctcagaagtttaccgacctgttcgagaagatggtaccagtaagtgtccaacaaagcctagctgcatataaccagcggaaggccgacctggtaaacaggagcatcgcgcagatgcgagaggccaccactcttgcaaacggggtgcttgccagcttaaatctgcctgccgctatcgaggatgtgagcggcgataccgtcccacagtcaattcttacaaagagtagatccgtcattgaacagggagggatccagacagtggatcagttaattaaagagctacccgagcttcttcagaggaatcgggaaatcctcgatgagtccctcagactgctggatgaagaggaggcaaccgataacgacctccgcgcaaaatttaaggaaaggtggcagcggaccccctcgaatgagctttataaacctcttcgcgccgaggggactaatttcaggaccgtgctcgacaaagctgtccaggcagacggacaggtgaaggagtgctatcagtctcaccgggacactatcgtgctgctctgtaagccggagccggaacttaatgcagcaatcccctctgctaatcccgccaagactatgcaggggagcgaggtagtcaatgtactcaaatcattattgtccaaccttgatgaggttaaaaaggagcgggagggcctggaaaatgacttgaagtcagttaacttcgacatgacttcaaagttcctgactgcgcttgcccaagatggcgtcatcaatgaagaggcactctctgtgaccgagctggaccgagtgtacggcggattaacaacaaaggttcaggaatcactcaagaaacaagaagggttgcttaagaacatccaggtgagtcatcaggaattttctaagatgaagcagtcgaataacgaggccaacctcagggaggaagttctgaagaaccttgccacagcctatgataacttcgtagaactggtggccaaccttaaagagggcacaaaattttataatgagttgaccgagatcctcgtcaggttccaaaataaatgttctgacattgttttcgcccggaagaccgagagagatgaactgcttaaggatctccaacaaagcatcgcccgagaaccatccgctccttccattcccacgcctgcttaccagtcaagccctgccggcggtcacgccccaacgccgcctaccccagccccccgaacaatgccacctaccaagccacagcctccagctcgcccaccaccccctgtgcttccggccaacagagctccatctgctactgctcctagtccggttggcgctggaaccgcggctcccgcaccctcacagacccccggtagtgcaccgcctccgcaggctcaggggccaccatatcctacctaccctgggtacccaggttattgccaaatgcctatgcccatgggctacaatccctacgcctatggccagtataatatgccctaccccccagtctaccaccagtctcctgggcaggctccatatcccggcccccaacagccgtcttacccgtttccacagccaccacagcagagttattatccgcagcagtag

SEQ ID NO: 129935 - DNA, 1458 bp, Artificial Sequence
  Description of Artificial Sequence: Synthetic coding sequence
atggcactgccaccttttttcggccagggtagaccgggccctccaccacctcagcctcccccaccagccccctttggatgtccaccaccacctctcccatctccagccttccccccacccctgccccagaggccgggaccttttcccggggcgtccgcaccattcctgcaacccccattggcactgcagcctcgtgcaagcgcggaggccagccggggagggggcggcgccggggctttttaccccgtccctcctcccccactcccaccgccacccccccaatgtaggcccttccctggcaccgatgcaggcgagcgaccacgtccccctcctcctggccctggccccccttggagccccaggtggccggaggcccctcctcctcccgcagacgtattaggtgacgctgccctccagcgcttgagagatagacaatggcttgaggcggttttcggtacaccccgacgggcaggatgccccgtgccgcaaagaacccatgctggccctagcctcggcgaagtgagagcaaggctccttcgtgctctgagactcgtccggcgactgagaggtctatcacaggccctgcgggaagctgaagcagacggtgcagcttgggtactgctctactcccagactgcccctctgcgggccgagctggcagagcgcctgcagcccctgactcaagcagcatacgtgggagaagctagaagaaggctggaacgtgtacgcaggagacggctaaggctgagggagagagcgagggaacgtgaagctgagagggaggccgaagccgccagggctgttgagcgcgagcaagaaattgacaggtggagggtcaagtgcgtgcaggaggtggaggaaaaaaagcgggagcaggagctcaaggctgccgctgatggggtgttgagcgaggtacgtaagaagcaagccgatactaaacggatggtggatatcctccgggcattggagaagttgcgaaagctccggaaggaggcagccgccagaaagggtgtctgcccccccgcttctgcagatgagacgttcacacaccacctgcagcgcctgcgcaagctgatcaagaagcgttccgagctctatgaggcagaggagagggctcttagggtgatgctagagggagagcaggaggaagaacggaagcgagagctcgagaagaagcagaggaaggagaaggagaaaatcttgcttcagaaacgggagatcgaaagcaagttatttggcgatccggacgagttcccattagcacacctccttgaaccctttaggcagtactacctgcaagcagagcatagccttcctgctctgatccagatccgccatgactgggaccagtatctcgtgccatcagatcaccccaaggggaactttgtgccgcagggatgggtcctgcccccactgccatcaaatgacatatgggctactgcggtcaaactgcattag

SEQ ID NO: 129936 - DNA, 840 bp, Artificial Sequence
  Description of Artificial Sequence: Synthetic coding sequence
ctcatgagaagtcactcagacagctgccatttttccaagcacttgcggcgggaacatggacccgctacgatcctcagacctggaagcccccgtccgccaccgcccccaagtttctcactcaggcggttacgggagcgcgctagggagcgggaggcggagagggaagcagaggccgcaagagccgtggaacgggagcaagaaatcgaccgatggcgcgttaaatgtgttcaggaggtagaggagaagaagagagaacaagaattgaaagcggccgcggatggagtgttgtccgaagtccgcaaaaagcaagctgataccaaaagaatggtggatattttacgcgccctggaaaagctgcggaaactgagaaaagaggccgcagcacgtaagggggtctgcccaccagcaagcgctgacgaaacattcacacatcacttgcagagattgcggaaactgatcaaaaagcggtccgaattgtacgaagccgaggagcgggctctgagagtgatgcttgagggcgagcaggaagaagaaagaaagagagagctagagaaaaaacagaggaaagagaaggagaaaatcctgctgcagaaacgcgaaatcgaaagtaagctgttcggcgaccccgatgaatttcccctggctcacctgctggagccattcaggcagtactatctgcaggcagaacatagcctgcccgcacttattcaaatccggcacgattgggatcaatatttagtgccctccgaccacccaaaaggaaactttgtaccgcaggggtgggtgctcccaccattgccatcaaacgatatctgggccacggccgtgaagctgcactag

SEQ ID NO: 129937 - DNA, 813 bp, Artificial Sequence
  Description of Artificial Sequence: Synthetic coding sequence
tcccactccgattcgtgtcacttttcaaagcatctgagacgggagcatggccctgcaacgattttacggcccggcagcccacgccggcggagactgaggttacgcgaaagggctagagaacgcgaggctgagcgtgaagccgaggccgcgcgcgccgtagagcgggagcaggagattgatcggtggcgtgttaaatgtgtacaggaggttgaagagaagaagcgggagcaggaacttaaggccgcagctgacggcgttctgtcggaggttcgaaaaaaacaagctgatacgaagcgtatggtggacatactacgtgcacttgagaagcttagaaaattaaggaaagaagcggcggctcggaaaggggtttgccccccggcatcagctgacgagaccttcactcaccatctacagcgcttgagaaaattaatcaaaaaaagaagtgaactatacgaggccgaagagagggcactcagggtgatgcttgaaggtgaacaggaggaggagaggaagagggagttagaaaaaaaacagaggaaggagaaggagaagatcctgctgcaaaagcgcgaaattgaaagcaagcttttcggggaccctgatgaattccccctggcacacttgctcgaaccctttcgtcagtattatttgcaggcggagcattcccttcctgccttgatccagataagacatgattgggatcagtacctggtacctagcgatcaccccaaagggaactttgttccacaaggatgggtcttaccaccattgccttccaacgatatctgggcgactgctgtcaagcttcactag

SEQ ID NO: 129938 - DNA, 165 bp, Artificial Sequence
  Description of Artificial Sequence: Synthetic coding sequence
atgtgtacaaccttgtttctcctcagtactctcgccatgttgtggcgaaggagatttgccaaccgagtgcagcctgagccttcggacgtcgatggagcagccaggggatcttcgctggatgctgatccccagtcctcgggcagggaaaaagaaccacttaagtag

SEQ ID NO: 129939 - DNA, 246 bp, Artificial Sequence
  Description of Artificial Sequence: Synthetic coding sequence
atgactcggaccgagagccccgcgacctggatgggtcagctgggcgccgccgcgtggatgcgcacgcttagtcctcaggcagcacaggtgctggttcgaccactcgctcaagaagatgccgtaggggcagctgctgccgcccgcggacgaatggggggaagctccacccgagaagtgcctagggcacacccagtgaccggttgctccgcggaaattattaacaagaaatgtcagctggacctctag

SEQ ID NO: 129940 - DNA, 819 bp, Artificial Sequence
  Description of Artificial Sequence: Synthetic coding sequence
atggccgcaaaggtgtttgagtcaatcggcaagttcggattggccctggcggttgcaggaggagtggtgaattctgccctttataacgtagatgctggacacagagctgtgatcttcgaccggtttcgtggtgtgcaagacatcgtggttggggaaggcacccatttcttaataccgtgggtgcagaagccaattattttcgattgcagaagccggccaaggaacgtgccggttatcaccggatccaaagacctgcagaatgttaatattaccctcaggattctgttccggcccgtggctagccagttgcctagaatctttacgagtatcggcgaagattacgatgaacgcgttctgccatcaatcacaacagaaatcttgaagagcgtggtagctcggtttgatgctggggaactgattacccagagggagttagtttcccgtcaggtatccgatgatctgacagagcgggctgctaccttcggcctgatcctcgatgacgtgagtctcactcatctgaccttcggcaaagaatttacagaagccgtcgaagctaaacaggtcgctcagcaggaggccgagagagcccggtttgtcgtcgagaaggcagaacaacagaagaaagccgcgatcatctccgctgaaggagattcgaaggccgccgagctcatcgcaaatagtctggccactgccggggatggccttattgagctgcgaaagcttgaagcagccgaagacatcgcttatcagttaagcagatcaagaaacattacctatctgcccgccgggcagagcgttctccttcaactcccccagtag

SEQ ID NO: 129941 - DNA, 741 bp, Artificial Sequence
  Description of Artificial Sequence: Synthetic coding sequence
atggccgctaaggtgtttgagtctattggcaaatttggattggctctggccgtggccggcggcgtagttaattccgccctgtacaatgtcgatgccgggcaccgggcggtcattttcgacaggttccgcggcgtacaggacattgtcgtgggcgagggtacgcatttcctcattccttgggtgcagaaacccattatattcgactgccgcagccgtccaaggaatgtacccgtaattactggcagtaaggatcttcaaaatgtcaatatcacactcaggatactattcagacccgtcgcatctcagttgcctagaatattcacctcaataggtgaagactatgacgaacgcgtactgcccagcatcactactgaaatcctgaaatcagtggtggcccggttcgatgcgggtgaactcataactcaacgtgagctcgtttcccgccaggtatcggacgacttaacagagagggcagcaacatttggcctgatcctggacgatgtcagtctgactcatctgaccttcggcaaggaattcaccgaggccgtagaagctaagcaagtcgcccagcaggaggccgagcgggcacgcttcgtggttgagaaagccgagcagcagaagaaagctgcgatcatctctgccgaaggagactctaaggctgccgaacttatcgcaaattcccttgctacagccggtgacggtctcattgagctgagaaagctggaggcagctgaggactag

SEQ ID NO: 129942 - DNA, 375 bp, Artificial Sequence
  Description of Artificial Sequence: Synthetic coding sequence
atggcagctaaagtgtttgaatctatcgggaagtttggtctggctctggccgtagccggtggggtagtgaactccgcactctataatgttgatgctggtcacagagccgttatttttgaccgctttagaggggtgcaggatatcgttgtgggcgaaggcactcattttctcatcccttgggtccaaaaaccaatcatttttgactgtaggtctcgacccagaaacgttcccgtaatcactgggtctaaggatctgcaaaacgtgaatattaccttacgcatcttgtttaggccagtcgcctcccagctgccacgaatctttacgagtatcggtgaggactacgatgagcgagtcttacccagcattaccacttag

SEQ ID NO: 129943 - DNA, 606 bp, Artificial Sequence
  Description of Artificial Sequence: Synthetic coding sequence
atggccgccaaggtcttcgagagtatcggcaagttcggcctggccctcgctgtcgcggggggggtagtaaacagcgctctctacaatgtggacgccgggcacagagctgtgatttttgataggtttcgtggtgtccaggacatagtggtgggggaggggacgcattttctgatcccttgggtgcaaaaacctatcattttcgattgtagatcccgaccacgcaatgtcccagtcattacgggcagtaaggacctgcaaaatgtaaacatcactttgcgtatcctgtttcggcccgtagcgtcacagctcccccgcatttttacgtctataggcgaagattacgatgagcgggtcctaccctcaatcaccactgaaatcctaaaatcagtggttgctcgctttgatgcaggggagcttatcactcagcgggagttggtgagcagacaggtttccgatgaccttacagaacgagcagcgaccttcggcctcattcttgatgatgtcagcctgacgcacctgaccttcgggaaggagttcacagaagccgtggaggccaaacaagttgcccagcaggaagccgaacgggcacgctttgtggtcgaatag

SEQ ID NO: 129944 - DNA, 645 bp, Artificial Sequence
  Description of Artificial Sequence: Synthetic coding sequence
atggccgccaaggtcttcgaatcaatcggtaagttcggtctcgctctcgcagtggccggcggagtggttaatagtgctctttataatgttgacgcaggccacagagccgtcatctttgataggttccgaggtgtgcaggatatagtcgtgggggagggcacgcatttccttattccgtgggtgcagaagcctattatttttgattgcagatcccggccaagaaatgtgcccgtcatcaccggcagcaaagacctgcagaacgtgaacatcacattgcggatcctgtttcggccggtggcctcccagctgcccaggatcttcacctccatcggagaggattacgacgaacgagttctgccttccataaccacggagatacttaaatcagtggttgctaggtttgacgcaggcgaactaattacacagcgagaactcgtgagtagacaggtgtcggacgatctgacagaacgtgcagcgacatttggcctgatcctcgatgatgtttcccttacacatctgacttttgggaaggagtttacggaggctgttgaagccaagcaagtggcgcagcaggaagccgagagggcaagattcgtcgtcgaaaaagccgaacaacagaaaaaggcggctattatctccgcgtag

SEQ ID NO: 129945 - DNA, 468 bp, Artificial Sequence
  Description of Artificial Sequence: Synthetic coding sequence
atggctgctaaggtgttcgaatccattggaaaattcggtttagccctggcagtggccggaggcgttgtcaactcggcactctataatgtcgatgcaggacatcgagcagttatttttgaccggttccgcggcgtgcaggatatagtcgtcggcgagggcacacacttcctcatcccatgggtgcagaagcctattattttcgattgccgctcccgaccgaggaacgtgccagtcatcaccggcagcaaggacttgcagaatgtcaacattaccttgaggatactcttccgaccggtcgcatcccagctgccaagaatcttcacaagcatcggggaggactacgacgagcgggtccttcctagcatcactacagagattttgaagtcagtagtcgctcggttcgatgccggcgagctgattacctacctacccgctgggcagtctgttctcctgcagctgcctcagtag

SEQ ID NO: 129946 - DNA, 615 bp, Artificial Sequence
  Description of Artificial Sequence: Synthetic coding sequence
atggccgccaaggtatttgagagtataggaaagttcggcctggcactggccgtggccggaggggtcgtcaattctgccctgtataatgtggatgctggccatcgggccgtcatctttgacaggttccggggtgtgcaggacattgtcgtcggtgagggcacacactttctaatcccatgggtgcagaaacctatcatattcgattgtcgctctagacctcgtaacgtacccgtaatcactggctctaaagatctgcagaacgtcaatatcaccctccgcattctctttcggccggttgcctctcaactgccgagaattttcacttctattggagaggactacgatgagagggtgctgccatctattaccactgagattctgaagtcggtggtggcaaggtttgatgccggggaattaataactcaaagagagctggtgtcccggcaggtgtcagacgatttgaccgagcgggctgcaacgttcggcctaatcctggacgacgtgagcctcacgcacctgacatttggtaaggagtttactgaagctgtcgaagctaagcaagtggctcagcaggaggctgaaagagctcgattcgtcgttgaaaaggtgagttag

SEQ ID NO: 129947 - DNA, 900 bp, Artificial Sequence
  Description of Artificial Sequence: Synthetic coding sequence
atggcacagaacctaaaggatctggccggccggctgcccgcagggccgcggggcatgggcaccgccctaaagctgttgttgggggctggcgcagttgcctatggcgttcgagagagcgtgttcaccgttgaaggtggacacagggcaatatttttcaaccgcattgggggagttcagcaggacactatactggctgaggggttgcacttcagaattccatggttccagtaccccattatatacgacatccgggctcggcctagaaaaatttccagccccaccggctccaaggacctgcagatggtaaacatatcactgcgagttctgtctagacccaacgcccaggaactgccttcaatgtatcagcgccttgggttagactacgaggagcgcgtactgccctccatcgtgaacgaggtgttgaaatcagttgttgccaaatttaatgcctcccaactcatcacccaacgcgcccaggtgagcctgctaattagacgcgagttgaccgagcgagcaaaggacttttccttaattctggatgacgtggctattaccgaactgagtttctcgcgtgaatacaccgcagccgtagaagctaaacaggtcgcccaacaggaggcgcagcgcgctcagtttctggtcgagaaggcaaagcaggaacagagacaaaagatcgtgcaggccgagggcgaggccgaggcagctaagatgttgggggaggctttgagcaaaaacccaggatatatcaagttgcgcaaaattagggccgcccaaaatatatctaagacaattgcaactagccagaaccgcatctaccttacagctgacaatttggttcttaacctgcaggatgaaagcttcacgcggtactcggactctctgataaagggaaagaaatag

SEQ ID NO: 129948 - DNA, 786 bp, Artificial Sequence
  Description of Artificial Sequence: Synthetic coding sequence
atggcccagaacctcaaagatctagccggaagactgcccgctggtccccggggaatgggaaccgctctcaaactgttgctgggcgcaggagcagtggcgtacggagtgcgggagtccgtgttcacggtcgagggagggcatagagcaatttttttcaaccgcataggcggcgtacagcaggacacgatcctggcagaagggttgcacttcaggataccatggttccaatatcccatcatctatgacatccgagcacggccacgcaaaatcagttctccaaccggctcaaaggacctgcagatggtgaacataagtctgcgtgttctgagccgcccaaatgcccaggagttaccgtccatgtaccagagacttgggctcgattacgaagagagggtcttaccttctattgtgaatgaggtgctgaagagcgtggtggccaagttcaacgcgagccaattaatcactcaacgtgcccaggtgtctctgctgataagacgcgaactgactgagagagctaaagatttttcacttatcctcgacgacgttgctataactgaactgtccttctcgcgggagtatactgccgccgtggaggcaaaacaagtggctctgtcaaagaacccgggctatataaagctgaggaagattcgcgcagcccaaaacatatcaaagacaattgccacaagccagaaccgtatttacctcaccgctgacaatctcgttttgaacctgcaggacgagagtttcacccggggctccgatagcctgattaagggcaagaaatag

SEQ ID NO: 129949 - DNA, 900 bp, Artificial Sequence
  Description of Artificial Sequence: Synthetic coding sequence
atggcccagaatttgaaggatctggccggccgactaccggcaggcccccgcggcatgggcaccgccctgaagcttctgctcggcgccggggcagtggcgtacggggttagagaatcggtgtttactgttgaggggggtcatagggcgatattttttaatcgcatcgggggtgtgcagcaggacaccattctcgccgaggggctgcactttcgaatcccctggttccaatatccgattatttatgacatccgcgcccgcccaagaaaaatcagttctccgactggctctaaggatctccagatggtgaatatttcactacgggtcctttcccgaccaaacgctcaggaactgccttccatgtatcagcgcctgggtctggattacgaggaacgtgttctgccatctatagtgaacgaagttctgaagagtgtggtggccaagttcaatgcttcccagttgattacccagagggcccaggttagcctcctgatcaggcgcgagctgactgaacgggcaaaggacttctctctgatccttgacgatgtcgcaataacggagcttagcttctcccgagaatacaccgccgccgtggaggccaaacaggttgcgcagcaggaagctcagagggcacagttcctggttgagaaggccaagcaggaacagcgacagaaaatcgttcaggcggagggggaggctgaagcggccaaaatgcttggcgaggcactttcaaagaacccaggctacataaagctgcggaagattcgggctgctcagaatatctctaagacaatcgctaccagccagaaccgtatttatttgacggccgataaccttgtgcttaatctgcaggacgagagttttacccgtggtagcgattcactgattaaggggaagaagtag

SEQ ID NO: 129950 - DNA, 642 bp, Artificial Sequence
  Description of Artificial Sequence: Synthetic coding sequence
atggcgcagaacttaaaagatctcgccggaaggctaccagctggcccaagaggcatgggaaccgctctgaaacttctgcttggagccggtgctgtagcttacggtgtacgggagagtgtatttacagtggagggtggtcacagggctatcttcttcaaccgtattggcggagttcagcaggacacaatcctggccgagggcctgcattttcgcattccctggtttcaataccctatcatatatgatatccgggctagaccccgtaagatcagcagccctactgggtcaaaggatcttcagatggtgaatataagccttagggtgctgtcaagacctaacgcacaggagctgccatcaatgtaccagagattgggactcgattacgaagagcgtgtgttgccctccatcgttaacgaggtgctgaaatcagtggtggcgaagttcaacgcctcgcagctgatcacacaacgcgctcaggttagtctgctgatacgccgcgaattgaccgagcgagccaaggacttctctcttatcctagacgatgtggccatcacagaactatcattctcacgagaatataccgccgccgtcgaggccaagcaggttggggagagtcaagagccctggggggagggattttag

SEQ ID NO: 129951 - DNA, 318 bp, Artificial Sequence
  Description of Artificial Sequence: Synthetic coding sequence
atgaggggtgctacccgggtgagtattatgctgctgctggtgaccgttagtgactgtgctgtgattacgggcgcatgtgagcgcgacgtgcagtgtggagcgggcacatgctgcgcaatatcgttgtggctcagagggctgcggatgtgtactccactcggccgggaaggtgaggagtgccaccccggctcacacaaggtgcccttttttaggaagcgcaaacaccatacatgtccttgtcttcccaatttactgtgcagtcggtttcccgacggtcgatatagatgttccatggatctgaagaatattaacttctag

SEQ ID NO: 129952 - DNA, 390 bp, Artificial Sequence
  Description of Artificial Sequence: Synthetic coding sequence
atgcggtcattgtgctgtgctccgctcctgctgctgcttttgctgcctcctctgctgctgacccctcgcgcaggggatgctgccgtgattaccggagcttgcgataaggattctcagtgcggaggcggaatgtgctgtgctgtgtctatctgggtcaagtcaatccgcatctgcacaccgatgggaaaactaggggattcttgtcatccccttactcgcaagaataacttcggcaacggacgtcaggagcggcgtaagagaaagcgcagtaaaagaaagaaagaggtcccattctttgggcggcgcatgcatcacacatgtccctgccttcccggcctcgcatgtctgcggacctcatttaatagattcatctgcttagctcaaaagtag

SEQ ID NO: 129953 - DNA, 327 bp, Artificial Sequence
  Description of Artificial Sequence: Synthetic coding sequence
atgcgatcactgtgctgtgctccactcttgttacttctgctgctcccgcccctgctgctgacgcccagggcaggcgatgccgccgtcataacaggcgcctgtgacaaagatagccagtgcgggggagggatgtgctgcgccgtctccatctgggtgaaatctattcggatctgcactccgatgggcaaactcggtgattcctgccaccccctgacccgtaaagtcccattctttggccgacgcatgcaccatacctgcccttgtctgcctggcctcgcttgccttcgcacttcttttaatcgttttatttgcctcgcccagaaatag

SEQ ID NO: 129954 - DNA, 705 bp, Artificial Sequence
  Description of Artificial Sequence: Synthetic coding sequence
atgcgtgcgcccctttgcctgctgctgcttgtcgctcatgctgtggatatgctcgctttgaaccgaaggaagaaacaggtgggaacaggtctgggtgggaactgcactgggtgcatcatttgttctgaggaaaatggatgtagcacatgtcagcagagactctttctgtttatacggcgcgagggaatcagacaatacggcaagtgcctgcatgactgcccccccgggtacttcgggattcgcggccaggaggtcaaccggtgcaagaagtgtggggccacgtgcgagtcctgcttcagtcaggatttttgcattcggtgcaaaagacagttttacctctataagggcaagtgccttccgacttgtcctccgggtaccctcgcccaccagaacacaagggaatgccagggagagtgcgagctgggaccttggggcggatggtctccgtgtacacataacggtaagacatgtggaagcgcttggggacttgagagccgggttagagaggccgggagggctgggcacgaggaggccgccacatgtcaggtgctgtctgaatcccgaaaatgtccaatccaacggccctgtccgggggaacgaagccctggccaaaagaagggcagaaaggaccgtaggccgagaaaggatcgtaagctcgatcggagactggacgtcagacctagacagccagggctgcaaccatag

SEQ ID NO: 129955 - DNA, 1155 bp, Artificial Sequence
  Description of Artificial Sequence: Synthetic coding sequence
atggctgctcagaatggaaacactagctttactcccaatttcaaccccccccaggatcacgctagcagcctgtcttttaacttctcttatggggactatgacctgccgatggatgaggacgaagatatgacaaaaacccgcaccttcttcgctgccaagatcgtaattgggattgctttggccgggatcatgcttgtgtgcgggatcgggaacttcgtgttcattgccgccctcactaggtacaagaaattacgtaatttgaccaacctcctgattgccaaccttgcaatttctgacttccttgtagcgataatatgctgtcctttcgagatggattattacgtcgttagacaactgtcatgggagcatgggcacgttctctgtgctagcgtaaactatttgagaacagtctcgctgtacgtgagcaccaacgctctgctcgcaatagctattgataggtaccttgctattgtgcaccctctaaaacctaggatgaactaccagacagcatcgttccttatagcccttgtctggatggttagcattctaatcgctataccttcagcctacttcgctacggagacggtgctctttatcgttaagtctcaagaaaagatcttctgtggacaaatctggccagttgatcagcagctctattacaagagttacttcttattcattttcggcgtggaattcgtgggacctgtggtgaccatgaccctgtgttacgcacgtatctcgcgcgagctgtggtttaaggccgttcccggatttcagaccgaacagatacggaaacggctgagatgccggaggaagactgtgctcgtcttaatgtgcatcctgactgcctacgtgctgtgctgggctcccttctatggcttcaccatcgtccgcgatttcttccccacagtgtttgttaaggagaaacactacttgacagccttctatgtcgtggagtgtatagccatgtccaactctatgatcaacacagtgtgcttcgtgacagtcaagaataacacaatgaaatatttcaagaagatgatgttacttcattggcggccatcccagcgcggatcaaaatcatcagcagacttggacttacgcaccaatggagtgcctaccacagaagaggtggattgcatcagactcaaatag

SEQ ID NO: 129956 - DNA, 684 bp, Artificial Sequence
  Description of Artificial Sequence: Synthetic coding sequence
atgaatattaagggcagcccatggaaggggagcttgttgctgcttctcgtttctaacctgctcctgtgtcaaagcgtagccccactgcccatttgcccaggaggtgccgccaggtgtcaggtgacactgcgcgacctgttcgatagagctgtggtcctgagccactacatccataatctcagctctgagatgttcagcgagtttgataagcggtacacccacgggcgggggttcatcacaaaggcaattaacagctgccatactagctcactcgcaactcctgaggacaaggagcaagcccaacagatgaatcaaaaagatttcttgtcgctgattgtctcaatactgaggtcctggaacgagccattgtaccacctggtgactgaggtgcgggggatgcaggaagcaccagaagccattttgtctaaggctgttgagattgaagagcagaccaaaagactgctggagggaatggagcttatcgtcagccaggtccatcctgagaccaaggagaatgagatctaccccgtgtggtccggactgccaagcctgcagatggccgacgaagaatcgcgtctgagtgcatactacaatcttcttcattgcctgagacgagatagccacaagatagataattaccttaagctgctgaaatgccgcattatccacaacaacaattgctag

SEQ ID NO: 129957 - DNA, 591 bp, Artificial Sequence
  Description of Artificial Sequence: Synthetic coding sequence
atgaatatcaaaggatctccctggaagggatcactgctccttctgctggtatctaacctgctattaagccactatatccataatttgtcttccgagatgttctccgagttcgataagcgatatacccacggtagggggtttatcacgaaagcgataaattcatgccacacatcaagcctcgccacgcctgaggataaggagcaggcccaacaaatgaatcagaaggatttcctgagtttgattgtctccattcttagatcctggaacgaaccactgtaccacctggtcacagaagtgcgtgggatgcaagaggctcccgaggctattctttccaaggccgtggagattgaggagcagaccaagcggcttcttgaaggtatggagctaattgtgagccaggttcaccccgagactaaggaaaacgaaatttatcctgtttggagcggcctgcccagcctccaaatggcggatgaagagagccgactgtcagcgtactataatctgctgcattgccttcgacgagattcccacaagattgacaattatctgaagctgttgaaatgtcgaatcattcataataataattgttag

SEQ ID NO: 129958 - DNA, 1545 bp, Artificial Sequence
  Description of Artificial Sequence: Synthetic coding sequence
atgacactcatttggcggcatttgctccggcccctgtgcctggtgacatctgctccccgtatcctggaaatgcatccctttctgagtctgggcacttcccggacgtctgtgactaagctgagccttcataccaagccccgaatgccaccatgtgattttatgcccgagcgataccagtcccttggctataacagagtgctggaaatccacaaagaacatctgtccccagtcgtcacagcatacttccagaaacctctgttattacaccaggggcacatggaatggctgttcgatgccgagggcagcaggtatctggatttcttcagcggaattgtcaccgtgtctgtgggccactgccaccccaaggttaacgcagtcgctcagaagcagttgggcaggctgtggcatacaagcacagtattcttccacccacctatgcatgagtacgccgagaagctggcagccctactgccggaaccattgaaggtaatctttctggtgaacagcggctctgaggccaatgagctggccatgctcatggccagagcacattccaataacattgatatcatctcttttcgaggcgcttatcacggctgttcgccatacaccctgggcttaacgaacgtgggaacttataagatggagttgccgggaggcaccggctgccagccaactatgtgtcctgatgttttccgaggaccgtggggaggtagtcattgtcgagacagtcctgttcaaaccattcgaaagtgctcatgtgcaccggactgctgccaggctaaagatcagtatattgagcagttcaaagacacgctgtcaacatccgtggctaagtcaattgctggatttttcgccgagcctatccaaggtgtgaacggagtggtgcagtatccaaaaggcttcttaaaggaggccttcgagctggtcagggctagaggcggtgtttgtattgccgacgaggtccagacagggttcgggaggctggggtcccacttttggggttttcagactcacgacgtgcttcccgatatagtaactatggccaaaggcatagggaatggcttccctatggcagccgtcatcacaacacctgagatagcaaaatcgctggccaaatgcttgcagcatttcaatacatttggagggaatccgatggcatgcgccatcgggtcagccgtcctggaagtgattaaagaagagaaccttcaggaaaactcacaagaagttggcacttacatgctactgaagtttgctaagctccgtgacgagtttgagatagtgggagatgtgagaggaaagggtcttatgatcggaatcgagatggtgcaagacaaaattagctgccggccacttcctcgggaggaggtgaaccagatccacgaggactgcaagcacatgggcctgctggtgggccgagggtccatctttagtcagaccttccgcatcgctccgtcaatgtgtattactaaaccagaggtggatttcgctgtggaggtattcagatctgcccttacccagcatatggaacgccgcgcgaagtag

SEQ ID NO: 129959 - DNA, 1050 bp, Artificial Sequence
  Description of Artificial Sequence: Synthetic coding sequence
atgaaagaaaatgtggcctccgccactgtattcacactgttactctttctcaatacgtgcctcctcaacggccaactacctcccgggaagccagaaatctttaagtgtaggagtcctaacaaagagacttttacttgctggtggcgacccggtacggacgggggcctccctactaattattccctcacttaccaccgagagggggagaccctcatgcacgaatgtcccgattatattaccgggggccctaacagttgtcatttcggcaaacagtacaccagtatgtggagaacgtatattatgatggttaacgccactaatcagatggggtcctctttcagcgatgagctgtacgtcgatgttacatatatcgtccaacccgacccaccactggagctggccgtagaagtgaagcaacctgaggatcggaaaccgtatctctggatcaaatggagccctccaacattgatagacttgaaaaccggatggtttactctgctgtatgaaatccgactcaaaccggagaaagcagccgagtgggaaatacatttcgcagggcaacagactgaattcaagattctgtctttgcacccaggacaaaaatatctggtgcaagtgcggtgcaagcccgaccatgggtattggagtgcctggtctccagctactttcattcaaatcccctctgactttaccatgaacgatacgacagtctggataagtgtagcagttttgagcgccgtgatttgcctcatcatcgtgtgggcggtggccctaaagggctatagcatggtgacttgtatctttcctcctgtccctggccctaaaatcaagggtttcgacgcccatctgctcgaaaagggaaagtcagaagaactgctatctgctctgggttgccaggacttcccacccactagcgattatgaggatttactggttgagtatctagaggtagatgatagcgaggatcagcacctaatgtccgtacatagcaaagaacacccatcacaggagcgcgagcagaggcaggcgcaggaggccagagattcctag

SEQ ID NO: 129960 - DNA, 1566 bp, Artificial Sequence
  Description of Artificial Sequence: Synthetic coding sequence
atgaaagagaacgttgcaagcgctacggtgtttacactactgctatttttgaacacatgcctgctgaatgttcagccagatccaccactggagttagcagtggaagtcaagcagccagaggaccgtaaaccatacctatggataaaatggagcccacccaccctgatagatttaaaaaccggatggtttaccttgctgtatgagatcagacttaaacctgagaaagccgccgagtgggagattcactttgcgggacagcaaacagaattcaaaattttatccctgcatccaggacagaagtatctcgtgcaggttaggtgcaagccagaccacgggtactggtcagcgtggtctcccgccacgttcatacaaatccccagtgacttcactatgaatgacacgactgtctggattagtgtcgcagtactcagcgcagtcatctgcctcataattgtctgggccgtggccctgaaggggtactcaatggttacatgtatctttcccccagtgccgggacccaagatcaaggggttcgacgcgcacctgctcgagaagggcaagtcagaagaacttctttccgcgttagggtgccaggatttccctcccacatccgattacgaggacctacttgttgaatacctcgaggtggatgatagcgaagatcagcacctgatgtcggtccacagcaaggagcaccccagccagggtatgaaaccaacatacctggatcccgacactgattctggaagagggagctgcgactccccatctctcttaagtgagaagtgcgaggaaccacaagctaacccttccaccttttatgaccccgaggtgatcgagaagccggagaacccggagacaacccatacttgggacccccaatgtattagcatggagggtaagataccttacttccacgcgggcgggagcaaatgctctacctggcccctgccgcagccaagtcagcataacccaaggtcctcctaccataacataaccgatgtctgcgagctggcggtgggccctgcaggagctccggccactctcctgaatgaggctggtaaggacgccctcaagtctagccagactatcaaatcaagggaagaagggaaggctacacaacagagagaagtcgaaagttttcattccgaaaccgatcaggataccccttggttgctcccccaggaaaaaacaccattcggctctgctaaacctctcgattacgtcgaaatacacaaggttaataaggacggggccctgtcccttctaccaaagcagcgggagaattccggcaagccaaagaaacctgggactcccgaaaacaataaggagtatgcaaaagtctccggagttatggacaacaatattctggtgctggtccctgacccgcatgctaagaatgtggcttgttttgaagagagtgctaaagaggccccgccgtccctggagcagaatcaggccgagaaggcactggctaacttcaccgcaactagctccaagtgtcgattacaattaggcggcctcgactatttagaccctgcctgcttcactcactcctttcactag

SEQ ID NO: 129961 - DNA, 807 bp, Artificial Sequence
  Description of Artificial Sequence: Synthetic coding sequence
atgaaagaaaacgttgcttcagccactgtcttcaccctgttgcttttcttaaacacatgcctgctgaatggccagctgccgccagggaagccagagattttcaagtgtcggagtccaaacaaagaaaccttcacctgctggtggcgtccagggaccgacggcggactgcctacaaattacagcttgacgtaccaccgagagggggaaactttgatgcatgaatgtcctgattacattaccggggggcccaactcctgtcattttggtaaacagtataccagtatgtggaggacctacatcatgatggttaatgcaacaaaccagatgggatcctcctttagcgatgaactgtacgtcgacgtgacctatatagttcagccagacccacctctggaactcgcggtggaggtaaaacagccagaggaccggaaaccttacctttggattaaatggtcccctccaactctgatcgacctcaaaactgggtggtttaccctcctttatgagataaggttaaagcccgagaaggccgctgaatgggagattcactttgccggccaacagaccgagtttaagatcctaagtcttcacccgggccagaagtatttggtgcaagtaaggtgcaaacccgatcacggatattggtctgcttggtcccctgccacatttattcagatacctagtggcgatccattaatgttaggcgcctcccattataagaatctgaagagctaccgacccagaaagatttctagccagggccgccttgctgtgttcaccaaggccacccttaccaccgtacagtag

SEQ ID NO: 129962 - DNA, 1869 bp, Artificial Sequence
  Description of Artificial Sequence: Synthetic coding sequence
atgaaggagaacgtggccagtgctacagtgttcacgctgttgttgttcctgaacacttgtctgttaaacgggcagcttccaccaggaaagcctgaaattttcaagtgtagaagcccaaacaaggaaacttttacatgctggtggcggcccggcactgacggcggactccctacaaattacagccttacataccacagagagggtgaaactctgatgcacgagtgcccagattatatcactggcggcccaaattcttgtcatttcggcaagcagtacacaagtatgtggagaacttacatcatgatggttaacgctacgaaccaaatgggtagttctttctctgacgagctatacgtagacgttacttatattgtgcagccagatccaccactggagctcgccgtcgaagtgaagcagccagaggacagaaaaccatacctgtggattaagtggtctccccccacactcatagatctgaagacaggttggtttacgttactgtacgagatcagactaaagcctgagaaagccgccgagtgggagatccattttgcggggcagcagactgagtttaagatcctctctcttcacccaggccagaaatacttggtgcaggtccgttgcaaacccgaccacggttactggtccgcttggtcacctgcaacatttattcaaatcccctccgatttcactatgaatgacacgacagtgtggatcagtgtagcggtactatctgcggttatttgccttatcattgtctgggcagtagctctcaagggatatagcatggtcacgtgcatttttccgcccgttcctggccctaaaatcaaaggctttgacgcgcacctgctggagaagggtaagagcgaagaactgttatcggcgctgggatgccaggattttccccccactagcgattacgaggatttgctcgtggagtatctggaagtggatgacagtgaagaccaacacttgatgtcagtgcactctaaggaacacccatcccagggaatgaagcccacctacttagacccagatactgattccggtcgcgggagctgtgattccccatcccttctgagcgaaaagtgtgaggagccacaggcgaacccatcaaccttttatgatccagaggtgattgagaaaccagagaacccagaaaccacgcacacctgggatccgcagtgtatatccatggagggcaagataccttacttccacgccgggggttccaagtgctcaacctggcctttgccccaaccaagccagcacaatcccagatcctcctaccacaatattactgacgtgtgtgaactggccgtcgggcctgccggggcaccagcaacactgctaaacgaagccggtaaagacgcactgaaaagcagccaaaccatcaagtcacgcgaagaagggaaggcgactcaacaacgagaggtagaatcgttccacagcgagaccgaccaggacacgccttggctcctgccacaagagaaaacacccttcggttcagccaagccactggactatgttgaaatccataaggtaaacaaggacggcgccctgtcgctcctccctaagcaacgggaaaactccggcaaaccaaaaaagccgggaaccccagaaaataataaggagtatgccaaggtatcgggtgttatggacaacaatattctggtgctggtgccagatccacacgccaaaaacgtcgcttgttttgaggagtctgccaaggaagcgcctccctcattggaacagaatcaggctgaaaaggcactggccaacttcaccgccacaagcagtaagtgccggctgcagctcggcgggctggattacttggacccagcatgctttacgcactccttccattag

SEQ ID NO: 129963 - DNA, 594 bp, Artificial Sequence
  Description of Artificial Sequence: Synthetic coding sequence
atgcatgaatgtccagactatataacaggcggaccaaactcttgtcatttcggaaagcagtataccagcatgtggaggacttatatcatgatggtgaacgccacaaatcagatggggtcctccttttccgatgaactgtacgtcgacgtcacctatatcgtgcagcctgacccacctctggaactggcagtcgaggtgaagcagcccgaggaccgcaaaccctatctttggatcaaatggtcaccacccactctcatcgaccttaaaaccggttggttcactctcctgtatgaaatccggttaaaacctgagaaagccgcagagtgggaaatccacttcgcaggacagcaaacagaatttaagattctcagtttgcaccctggccagaaatatcttgtgcaagttaggtgcaagccagaccacgggtattggtccgcctggagccctgcaacatttatccaaatcccgagtggggatccactcatgctgggtgcctcccactacaagaacctgaagtcatatagaccacgcaaaataagcagccagggtaggttggctgtgtttacaaaggctacgctgaccactgtacagtag

SEQ ID NO: 129964 - DNA, 312 bp, Artificial Sequence
  Description of Artificial Sequence: Synthetic coding sequence
atgaaggagaatgtggcatcagctacagtttttacgctcctgttgtttctgaatacatgtctgttgaacggccagctgccccctggcaaaccagagattttcaagtgtcggtcacccaataaggaaacgtttacttgctggtggcgcccggggactgatggaggcttgccaactaactacagtctgacctatcaccgggaaggcgaaactctgatgcatgaatgccctgactatataactgggggaccaaactcttgtcacttcggcaaacagtacacatctatgtggaggacatatatcatgatggtgtag

SEQ ID NO: 129965 - DNA, 189 bp, Artificial Sequence
  Description of Artificial Sequence: Synthetic coding sequence
atgaaagagaatgtggcctccgcgacagtgtttaccttgctgctgttcctaaacacctgcctgttgaatgggcaactgccaccagggaagccggaaatatttaaatgtcggtcccctaataaggaaacttttacttgctggtggaggcctggaacggatgggggactcccgaccaattacagcctttag

SEQ ID NO: 129966 - DNA, 336 bp, Artificial Sequence
  Description of Artificial Sequence: Synthetic coding sequence
atgaaagagaacgtggcatccgccacagtgtttacattactgctttttcttaatacctgcctgctaaacggtcaactcccgcctggcaaaccggagattttcaaatgcaggtcccctaataaggaaacattcacctgctggtggaggccaggcacggatgggggcctgccaaccaattactcgttgacttaccaccgagaaggcgaaacactaatgcacgaatgccccgattacattaccggcgggccaaatagttgccatttcggaaaacagtacactagtatgtggaggacttacatcatgatggtgaacgcgacaaaccagatgggcagttag

SEQ ID NO: 129967 - DNA, 1566 bp, Artificial Sequence
  Description of Artificial Sequence: Synthetic coding sequence
atgaaggagaatgtggcttccgcaaccgtttttaccttgctcctctttctaaacacctgtctgttgaatgtgcagcctgacccacctcttgagttggccgttgaggtgaagcaaccagaggataggaaaccatacctctggatcaagtggtcccctcccacgctaattgaccttaagacaggttggtttactcttctctacgaaatacgccttaagccagagaaagcagcagagtgggagattcattttgccggccagcagacagagttcaagatcttgtctctgcatcctgggcaaaagtacctcgttcaggtgcgctgtaaacccgaccacggatactggtccgcctggagccccgcaacctttattcaaattccgtccgacttcaccatgaacgatactactgtttggatttctgtggccgtcctgtccgctgttatttgtctgatcattgtgtgggccgtggctttaaaagggtactcaatggtcacctgtatcttcccccccgtcccaggccctaaaataaaagggttcgatgcacacctgcttgaaaaggggaaaagtgaagaattgcttagtgcgctgggctgccaagactttcccccaacttctgactacgaggacctcctggtggaatatcttgaggtcgatgactcagaggaccagcacctgatgtccgttcactccaaagagcatccctcccagggtatgaagcccacctacctcgacccagatacggattcaggccgcggatcatgtgactccccctccttgctgtcagagaaatgcgaggagccgcaggcgaacccctccacattttatgacccagaagtgattgagaaaccagagaatccagaaacaacacacacttgggatccccagtgtattagcatggaaggtaagattccatactttcacgctggggggtctaagtgctcgacttggcccctcccacagcctagtcagcacaatcctcggtcgagttaccataatattacagatgtttgtgaattagctgtaggccccgccggcgccccagctacactcttgaatgaagccggcaaggatgcgttgaagtcctctcagactatcaagtcccgagaggagggcaaagctacgcagcagcgcgaggttgagagtttccactcggaaaccgatcaggacactccctggctcctacctcaggagaagacaccttttggaagtgcaaagcccttggactatgtggagatccataaggtgaataaggacggggccctgtcccttctacctaaacaaagagagaactctggcaagccaaaaaaacctggcacacccgagaataacaaagaatatgctaaggtctcaggagtaatggacaacaatatactggtactggtgcctgacccgcatgcgaaaaacgttgcttgtttcgaggaaagcgcaaaggaggcacctccatctctggagcagaatcaggctgagaaggcccttgccaatttcacagcgacctcttctaagtgcagactccagttgggtggccttgactatcttgacccagcttgttttacacattccttccactag

SEQ ID NO: 129968 - DNA, 867 bp, Artificial Sequence
  Description of Artificial Sequence: Synthetic coding sequence
atgaaagagaacgtggccagtgccacagtattcaccctgctcctgtttctcaacacctgccttctcaatgggcaactgccgcctgggaagccagagattttcaaatgtaggtctccaaacaaggaaacatttacatgctggtggcgaccaggaacagacggcggcctgccaacaaattactccttgacataccatcgcgagggcgagaccctcatgcacgaatgtccagactacatcactgggggccctaacagctgccacttcggaaagcagtatacatccatgtggcgtacctatatcatgatggtgaatgctaccaatcagatggggtcctctttcagtgatgagctctacgtggatgtcacctatatcgttcagcccgatcctccacttgagctcgccgtcgaggtgaaacagccggaagatcggaaaccgtacctgtggattaagtggagtccaccaacgctaattgacctgaagacaggatggttcaccctgctctatgaaattagactgaagccggagaaggccgctgaatgggagatccactttgctggccagcagactgaatttaagatccttagcttgcaccctggccagaaatatctggtgcaagtgcgctgcaagccggaccacgggtactggagtgcctggtctcccgccacattcatacaaatacctagcgactttaccatgaatgatacaacggtgtggatcagcgtagctgtgctgtccgctgtgatctgtcttataatagtctgggctgttgcactgaaagggtactcgatggtgacttgtatctttccccctgtccctggcccaaagataaagggattcgatgcccatttgctggaggttaccccatag

SEQ ID NO: 129969 - DNA, 363 bp, Artificial Sequence
  Description of Artificial Sequence: Synthetic coding sequence
atgaaagaaaacgtagcctctgcgactgtgttcactctgcttctgttccttaatacatgtctcttgaatggccaactgcctcccggtaaacccgaaatattcaagtgcagaagcccaaacaaggagactttcacctgttggtggcgacctggcacagacggaggcttgcctactaattatagcctcacctaccatagggaaggcgagaccttgatgcatgagtgccccgattatatcaccggggggcccaatagttgtcattttggcaagcagtacactagtatgtggagaacctatatcatgatggttaatgctaccaaccaaatggggtccagcttctccgacgaactctacgtcgattag

SEQ ID NO: 129970 - DNA, 105 bp, Artificial Sequence
  Description of Artificial Sequence: Synthetic coding sequence
atgaaggagaacgtcgcgtctgcaacggttttcactctgctactgtttctgaatacctgtctgttaaacggtcaacttccgccgggcaagcccgagatcttctag

SEQ ID NO: 129971 - DNA, 930 bp, Artificial Sequence
  Description of Artificial Sequence: Synthetic coding sequence
atgaaggaaaatgtagcgagtgccacggtctttacactgttgcttttcctgaacacatgtttgttaaatgggcaattgccgcccggcaagcccgagatctttaaatgccgcagccccaataaagagacgttcacgtgctggtggcggcctggtacagatgggggtctgcctacaaactactcattgacataccatagggagggggagaccctcatgcacgagtgtccagattacatcacaggaggccctaattcatgtcactttggaaagcaatatacatccatgtggaggacgtatatcatgatggtcaacgcaacaaatcagatgggaagcagcttcagcgatgaactctacgtggacgtgacgtacatcgtgcagcctgacccaccgttggaacttgcggtggaagtgaagcagccagaagatagaaaaccctatctgtggattaaatggagccctccaaccctcatcgacctcaaaaccggatggtttaccctcttgtacgagatccggctcaaacctgaaaaggccgcagaatgggaaattcactttgctggacaacagacagagtttaagatactttcccttcacccgggccagaaatacctcgtacaagtgaggtgcaagcccgaccacggctactggtctgcatggtctcccgcaacttttattcagatccccagtgatttcacaatgaacgataccactgtttggataagcgtggctgtactgagtgccgtgatatgtctgattatcgtttgggcagttgccctgaaagggtattctatggtgacctgcatctttccacctgtaccaggccccaaaatcaaaggctttgatgcccacttactggaagaccgcctttgcacgcccgggcgctgctgcgtgtctactggtttgaccgacctggattacagctgtagcacctag

SEQ ID NO: 129972 - DNA, 1254 bp, Artificial Sequence
  Description of Artificial Sequence: Synthetic coding sequence
atgggccggcgaagggcccccgaattataccgcgccccatttccgttgtacgcacttcaggttgatccctcaaccgggttactgattgccgccggcgggggcggggcagccaaaacgggcataaagaacggggtgcactttcttcagcttgagctcatcaatgggcgcttgtctgcaagcctattgcattcccacgacacagagacaagggctaccatgaatctagcgcttgctggcgacattctagctgccggacaggacgcacactgccagctacttagatttcaggcccaccagcagcaggggaacaaagccgaaaaagccgggagcaaagaacaggggccacgccagcggaagggcgccgctccggccgagaagaaatgcggtgcagaaacacagcacgagggccttgagttacgggtggagaacctgcaagcggtgcagacagatttctcttcagaccctcttcagaaggtggtctgcttcaaccacgataacaccttgctggctacagggggaacagacggttacgttagggtctggaaagtgccttcactggagaaggtactggaatttaaggcacacgaaggggagattgaggatctggctctagggcctgatggaaagctcgtcaccgtgggccgcgacttaaaggcctctgtttggcaaaaggaccaactcgtgactcagctccactggcaggaaaacgggcccacattctcttcaacgccttatagatatcaagcttgtcgcttcggtcaagtgccggaccagcccgccggcctgcggctgttcaccgtccagattcctcacaaaagactgcggcaacccccgccttgctatcttacagcgtgggacgggtccaacttcttgccactgcggaccaagtcttgtggccacgaagttgtgagctgcctggacgtgagtgagtcagggacattcctgggtctggggaccgtaaccggctcagtggcaatctatattgccttttcgctgcagtgcctgtactacgttcgggaagctcatgggattgtcgtcaccgatgtggccttcttacccgaaaaaggccgaggcccggaactgctggggagtcatgagaccgcactgtttagcgtcgcagttgatagccgttgccaactgcaccttctccccagcaggaggagtgtccctgtctggttactgttgctgctttgcgttggcctgatcattgtcactatcctgctgcttcagagcgcgtttcctgggttcctatag

SEQ ID NO: 129973 - DNA, 1254 bp, Artificial Sequence
  Description of Artificial Sequence: Synthetic coding sequence
atgggtcgaagacgggctcctgaattataccgcgccccctttccattgtacgcgctgcaggtggatccctctaccggcctgctcatcgccgcaggcggtgggggggcggcgaaaactggaatcaaaaatggggtgcattttctgcagcttgaactgatcaatggacggttgagcgcgtccctcttgcacagtcacgataccgaaacccgcgctaccatgaacctggccttggcaggagatatcctggctgcgggccaggacgcacattgccaactcctccggtttcaggctcaccagcagcagggcaataaggctgagaaggctggaagcaaggagcagggccccagacaacgtaagggggccgcccccgccgagaagaagtgcggggccgaaacccagcacgagggtttggagctgcgggtcgaaaacttacaggccgtgcagactgactttagtagtgaccccctgcagaaagtcgtgtgctttaatcatgacaataccctcctcgcgaccggcgggaccgacggctatgtaagggtgtggaaagtgccctcactggagaaggtgctcgagtttaaggcacacgaaggtgaaatcgaggaccttgccctgggccctgacggcaagctcgtgaccgtggggcgggacctcaaggcctcagtttggcagaaggatcagttggtcacccagctccattggcaggagaacggacccactttttcctctaccccctaccggtatcaggcgtgcaggttcggtcaggtgcctgatcagccagcgggcctccgcctctttaccgtacaaattccccataaacgactccgccagcctcctccttgttatctgaccgcctgggacggttccaacttcctacccctgcgtacaaaatcttgcggccacgaggtggtgtcctgtctggacgtaagcgagagcgggactttccttgggctggggacagtgaccggcagcgtggcaatttacatcgctttttcacttcagtgcctttactacgtccgggaagcgcatggcattgtggttaccgacgttgcctttttgccagaaaaagggagaggtcccgagctgctggggtctcacgagaccgccctgttttctgtggccgttgactccaggtgccagttacacctcctcccgagccgccgatccgtccctgtttggctcctcctgctcctgtgcgtgggcctgatcattgtcaccattttgctgttgcagtccgcatttccaggattcctctag

SEQ ID NO: 129974 - DNA, 441 bp, Artificial Sequence
  Description of Artificial Sequence: Synthetic coding sequence
atgagattactacagctgctgtttcgcgctagcccagccacgcttctcctggtgctatgtttgcagttaggagcgaataaagcccaagacaatacgaggaaaatcatcattaaaaatttcgacatacccaagtccgttcgtccaaatgacgaggttactgccgtattggccgtccagacggagctaaaggagtgtatggtggtaaagacctatttgatcagcagtattcccctgcagggcgcctttaattataagtatactgcgtgcctatgtgatgacaaccctaagacattctactgggatttctatacgaatcgcacggtgcagatcgctgccgtggtggatgtcatcagggagcttggaatctgccctgatgatgccgccgtgatcccaatcaagaacaacaggttttataccattgagatcctgaaggtagaatag

SEQ ID NO: 129975 - DNA, 1185 bp, Artificial Sequence
  Description of Artificial Sequence: Synthetic coding sequence
atgtccggagaggatgaacagcaggagcaaactattgctgaggatctagtcgtgactaaatataagatggggggcgatatcgctaacagggttttgcggagcctggtggaggcctcatcaagcggagttagcgtgctgagtctttgtgaaaagggggacgctatgattatggaggaaactggaaagatttttaaaaaagaaaaggagatgaagaagggtatcgcttttcccaccagcatttcagtcaataactgtgtttgccatttctcacccctgaaatctgatcaggattatatcttgaaagaaggagacttagtcaaaattgatctcggcgtccatgtggacgggttcatagccaatgtggcgcatactttcgtggtggacgtcgctcaaggtacacaggtgaccgggcggaaagccgatgtgattaaagccgcccacttgtgtgccgaggccgcactgcgcctggtgaaaccgggtaaccagaatactcaagtgactgaggcatggaataaggtggcacactccttcaactgtacaccaattgaagggatgttgagccatcaactgaaacagcacgtcatcgatggagagaaaactattattcagaaccccaccgaccaacagaaaaaggaccacgaaaaggctgagttcgaagtgcacgaggtgtacgccgtcgatgtcctggtgagttcaggcgaaggaaaagctaaagacgctggccaacggaccacaatctacaaaagagacccctcaaaacaatacggtctcaaaatgaaaacaagtcgagctttcttctcagaagtagagaggagattcgacgccatgccatttacgttaagggcctttgaagacgaaaagaaggcaaggatgggagtcgtagagtgcgcgaagcacgagctgctgcagccgtttaatgtgttatacgaaaaagaaggggaatttgtcgcacagtttaagttcactgtcctgctcatgcctaatggacctatgcgaataaccagcggaccattcgaaccggatttgtataaaagtgagatggaagttcaggacgctgagctcaaggctctgttacaatcaagcgcatcacgtaagacacagaaaaagaagaaaaaaaaagcttctaagacagccgaaaacgccacttccggcgagactctggaagagaacgaagcaggcgactag

SEQ ID NO: 129976 - DNA, 1218 bp, Artificial Sequence
  Description of Artificial Sequence: Synthetic coding sequence
gcatgccctgcaccacaacccgctagatcgcaactgctggctttagcctgtctgcccgctcccctgctggccagagctttcgccagacctctgctcgaggaccggggcgactccgatcacagccccgaagacctggtggtgactaagtacaaaatgggaggcgatatagctaatcgcgtgctccggtccttggtagaagccagcagttccggggtcagtgtgctgagtctttgtgagaagggggacgctatgatcatggaagagacaggaaaaatttttaaaaaagaaaaggagatgaaaaaaggcatcgcttttcccacatcaataagcgtgaacaactgcgtatgccacttttcccctctcaagagcgaccaggattatatactgaaagagggggacttggttaagatcgaccttggagttcacgtcgacggcttcatcgctaacgtggcccatacattcgttgtggatgttgcccaaggaacacaggtcacaggacgcaaggcagatgtgattaaggctgctcatttgtgcgccgaagcagctctccgtctcgtgaagccaggtaatcaaaacacccaggttacggaggcttggaataaagtagctcacagtttcaactgcactcctattgagggaatgctgtctcaccaactcaagcagcacgtcatcgacggtgagaagaccataatccaaaaccctaccgaccagcaaaagaaggatcatgagaaagccgaattcgaggttcacgaagtgtacgcagtggacgtgcttgttagtagtggtgaaggcaaagccaaagatgctggacagcgcactactatatataagcgcgacccttcgaagcagtatggtctcaaaatgaagacgtcccgcgctttcttctccgaagtggaacgcagatttgacgcaatgccgttcaccctcagggcatttgaggatgaaaagaaagctaggatgggggtggtggaatgtgctaagcatgaactgctgcagccgtttaatgtattgtatgagaaggaaggagagttcgtggcccaatttaagtttaccgttctgctgatgcctaacggacccatgagaattacctctgggcccttcgagccagacctgtacaagtccgagatggaagtgcaggatgctgagttgaaggcccttttgcagtcaagcgccagtagaaagacccaaaagaaaaagaagaagaagaagaaaaagtag

SEQ ID NO: 129977 - DNA, 738 bp, Artificial Sequence
  Description of Artificial Sequence: Synthetic coding sequence
atgacaagaatgttacaaaggatggacgtgctggctaagaaggccaccgaaatgggcgtgcgcttgatggtagatgcagaacagacgtatttccaaccagccatctcacgcttgacattggagatgcagcgcaagttcaacgtggagaaacccctgatatttaacacctaccagtgctacctgaaggacgcctatgacaacgttacgctggacgtagagctggctcggcgagaaggttggtgtttcggagccaaactcgtgcggggcgcttaccttgctcaagagcgagccagagctgccgagatcggctacgaagacccgatcaatccgacatatgaagctactaacgccatgtatcatcgttgcctagattatgtgctcgaagagctcaagcataatgccaaggcaaaagttatggttgcgtctcataacgaagacactgtaagatttgccttaaggcgcatggaggaactgggcttacaccccgctgatcaccgagtgtattttggccagctcctaggcatgtgcgatcagatcagcttccctctgggccaggccgggtatcctgtgtataagtacgttccttacggtcctgtgatggaggtattgccctatctgagcagacgagccttggagaactcttcactgatgaagggcacacacagggagaggcagctcctgtggctggagctgctgaggcggctgcgcaccggaaatcttttccatcggccagcatag

SEQ ID NO: 129978 - DNA, 1803 bp, Artificial Sequence
  Description of Artificial Sequence: Synthetic coding sequence
atggctttaagacgggcactgcctgctctccgtccttgcattccacgctttgtccctttgtcaacagctccagcaagcagggagcaaccggcggccgggccggctgccgtgcctggaggaggatccgcaacagccgtgcggccacccgtgcccgccgtagactttgggaatgcccaagaagcttaccgctcaaggaggacgtgggagctggcgcgcagtctgttagtcctgaggctgtgtgcgtggcctgccctccttgcacgtcacgaacagcttctgtacgtgagtaggaagctgcttgggcagaggctgtttaacaagctgatgaagatgacattttatggacatttcgtggctggcgaggatcaggaatccatccagcctctgctgagacactaccgagcctttggagtgtcagcgatcttagactatggggtcgaggaggatctcagcccagaggaggctgaacataaagagatggaaagttgtacttccgccgcagagcgggatggttccggaacaaacaagcgcgacaaacagtatcaggcccattgggccttcggggaccgacgtaatggcgtgatcagcgcgagaacctatttttacgccaacgaggccaaatgcgactcccacatggagacattcttacgctgtatcgaggccagcgggcgcgtttccgatgatggcttcatcgccatcaagctgaccgctctcggacgtccccaattcttactgcagttcagcgaggttcttgcaaagtggcgctgcttttttcaccaaatggcagtcgagcagggtcaggccgggcttgccgctatggacaccaaattagaagttgctgtgctgcaggagtcagtggctaagttaggcatcgcctcgcgcgccgagatcgaggactggtttactgctgagacacttggcgtgtccgggaccatggatctccttgattggtcatccctcattgactcccgtaccaagttgtccaagcacctcgttgtaccaaatgcgcagactggacagctcgaacctttgctttcacggttcaccgaggaggaggaactacaaatgacccgtatgctgcagaggatggacgtgctagcaaagaaggcaacagagatgggagtgcggctgatggtggacgctgagcagacctattttcaaccagccatatccagacttactctggaaatgcagcggaaatttaatgttgagaaacccctaatattcaacacgtaccagtgctacctgaaggacgcatacgataacgtcacattagatgtcgaactggctcggagggagggatggtgtttcggcgcaaaacttgttaggggtgcttatctggcgcaggaacgagccagggctgccgagattggctacgaggaccccattaatccaacttacgaagcgaccaatgccatgtatcatcgctgcttagattacgtcctagaggagcttaagcacaatgctaaggcgaaggtgatggttgccagccataacgaagacacagtgaggttcgcgcttcgccgtatggaggaactcggtttgcaccccgcagaccaccgtgtgtactttgggcaactgttaggcatgtgtgatcagatatccttccccttaggacaagcgggttaccctgtgtataagtacgtgccctacggccccgttatggaggttctaccctacttgagcaggagagccttggaaaattcaagtctgatgaaagggacgcatcgcgagaggcagctcctctggctagagttactgaggagactgcggacagggaacctgtttcacagacccgcatag

SEQ ID NO: 129979 - DNA, 1479 bp, Artificial Sequence
  Description of Artificial Sequence: Synthetic coding sequence
atgaagatgacattttacggccatttcgttgcaggcgaagaccaggaatctatccagcccctgctacgccactatagggcctttggtgtctccgcgatcctcgactatggggtggaagaggatttatccccagaggaggccgagcataaagagatggaaagctgtacttccgccgccgaacgggatggctccgggaccaacaagcgggacaagcaataccaggcccattgggcttttggagaccgccgcaacggagtgattagtgccagaacctacttctacgccaatgaagctaagtgcgatagccacatggagaccttcctgcgctgcattgaggcttcaggacgcgtttccgatgacggttttatcgcaattaagctaactgctcttgggagaccacagtttctgttgcagttttcggaggtactcgctaaatggcgctgtttctttcaccaaatggccgtcgaacagggtcaagccgggttggctgccatggatactaaacttgaagtggccgtgctccaagaaagcgtcgcaaagttaggaatcgccagcagggcagagatcgaggactggttcacggcagagactctgggagtgagtggtaccatggacctcctcgactggtcttcccttatcgatagtcgaaccaagctctccaagcatctagtggtaccaaacgctcaaacgggacagctggaacctctcctgtccagattcactgaggaggaggaactccagatgacacgcatgttgcagaggatggatgttttagccaaaaaggctaccgaaatgggcgttcggctaatggtggatgcagagcaaacctattttcagcctgctattagccgcctgaccttggaaatgcaacgtaaattcaacgtggagaagccactgatcttcaatacataccaatgttacctgaaggatgcttatgacaacgtgacactcgacgttgagctcgcaagaagggaaggctggtgcttcggagccaaactggtgagaggtgcatatttggctcaggagagagctcgggctgccgagatcggctatgaagatcccatcaatccaacatatgaagccacaaatgcaatgtaccaccgctgcctggattacgtgttagaggaacttaaacacaatgctaaggcaaaagtgatggtggctagtcacaacgaagacaccgtccgctttgcactacgtcgcatggaggaattagggctgcatccggccgatcaccgggtgtatttcggccagctccttggaatgtgtgaccagattagttttcccctcggacaagccggataccccgtgtataagtatgtaccttatggccccgtgatggaagtgctcccatacctgagccgcagggcactggagaattcatcactgatgaagggtacacacagggaaagacagctcctttggcttgagcttctccgccggctccgcactggaaatctctttcaccgtcccgcctag

SEQ ID NO: 129980 - DNA, 1611 bp, Artificial Sequence
  Description of Artificial Sequence: Synthetic coding sequence
atgtcccccagagttgtctctaatagtagtgtactcgccagtcaatcagtgggtatcaccaacgtgaggacagtgttcagcaacgtgttcaataacacaaccgcattccctatcttaaggggcagcaattgtcataagatcactgctcctggtctgggtaagggacagcttgttaacctcttgccgcccgagaacctgccttggtgtggagggagccagggccccagaatgctgcggacctgctacgtgttgtgttcccaggctggccccccttcacggggttggcagtcactctccttcgacggtggagccttccacctgaagggaaccggagagctaacacgcgctttgttagttcttcgtttatgtgcatggccaccactagtcacacatggactcctcctgcaggcttggagcagacgccttctcggcagcagattgagtggcgcattcctgagggcttccgtttacgggcaattcgtagccggtgaaaccgctgaggaggtgaaagggtgtgtgcaacagctcaggacattgagcctgcggccattgctcgccgtgcctaccgaagaggagccggattccgcagccaaatctggcgaggcatggtatgaaggaaatctgggagccatgttgaggtgtgtggacctgtcccgaggtctgctggaacccccatctctagccgaagccagtcttatgcaactgaaagtaaccgcccttacgagtactcgcctgtgcaaggagctggccagctgggtgaggcggccaggggcaagtcttgaactgtcacctgagcggttggccgaggccatggattcagggcagaacttacaggtgtcctgcctgaatgcagaacagaaccagcatttgcgcgcgagcttgagccgcctccatcgcgtggcccagtatgcccgagcccagcacgtgaggttgcttgtcgatgccgaatacacctccctcaacccagccctttcactcctcgttgccgctctggccgtgaggtggaactcgccaggagaggggggaccttgggtgtggaacacatatcaagcttgtctgaaggacacttttgaacgcttgggtcgagatgccgaagccgcacaccgcgccggcttggcctttggggttaaactggtcaggggagcatatctcgacaaggagagggccgtggctcagttgcacggtatggaagacccaacccaacccgactacgaagcaacaagtcagagttacagtcgttgccttgaactgatgcttacgcatgtagcacgccacgggccgatgtgccatctgatggtcgctagccacaatgaagaatccgtaaggcaagctaccaagagaatgtgggagctcggaattcctctggacggaaccgtgtgtttcgggcaactactgggaatgtgtgaccacgtctctctggcactggggcaggctggctatgtggtgtataaatccatcccctatggctccctcgaggaggtgattccttatctgattcgtagggctcaagagaataggagtgtgctgcagggcgcccggagggagcaggagcttttgagccaggagctttggcgtcggctgttgccgggatgtcgcaggatcccacactag

SEQ ID NO: 129981 - DNA, 762 bp, Artificial Sequence
  Description of Artificial Sequence: Synthetic coding sequence
atgcccggacggactgaaggtggctcatggctccggaacgctgccgccgcggatgttttgaggaacctcccagaagtggagtggagagagcctcaacactgctgcccacctacacctagaaagagaaagcagaatccccgcgtgccactgccgcattatccacccaacccagccgccgccatcgctgccgacactatgccaaagcgtaagaagcaaaaccaccaccagcctccaacacagcagcagccgccactgcccgagcgggaagagactggtgatgaggaagacgggtcccctattggtccaccaagtctgttgggtcctcctcctatggctaacggcaagcccggggacccaaagagtgctctccatcgtggacctcctggctctagggggccgcttataccaccactgctgtcattgcctccgccaccgtggggacgggggccaatcagaaggggacttggccctagatcaagcccttacggccggggctggtggggggtgaacgccgagcccccgtttccaggccctgggcatggcggaccaacccgtggatcgtttcacaaggaacagagaaatcccaggcggttgaagtcctggtcactcataaaaaatacctgcccccccaaagacgatccccaagtgatggaagataaatccgacaggccagtgtgcagacattttgcgaagaaggggcactgtaggtatgaggacctctgcgccttttatcatccaggcgttaacggaccccccctttag

SEQ ID NO: 129982 - DNA, 504 bp, Artificial Sequence
  Description of Artificial Sequence: Synthetic coding sequence
atgcccaaaaggaaaaaacaaaaccatcaccagccccccacccagcagcagccccctctgccagagcgcgaagaaacaggcgatgaggaggacgggtcaccaatcgctctccatagagggcctccgggaagcagaggacctctgattccaccacttttaagtctgccaccgcccccatgggggagagggcccatccggcgaggcctgggcccccggtcatcgccttatggccgaggttggtggggagttaatgctgagcctccctttccaggcccgggccacggaggacctacccgcggatcctttcacaaggagcaaaggaacccccgtcgtctaaagtcatggtccctgatcaaaaacacttgtccacccaaagatgaccctcaggtgatggaagataaatctgaccggcccgtatgtaggcatttcgccaaaaaggggcactgtcgctatgaggatctttgcgccttttaccaccctggagtgaatggaccgccactgtag

SEQ ID NO: 129983 - DNA, 567 bp, Artificial Sequence
  Description of Artificial Sequence: Synthetic coding sequence
atgcctaagcgaaaaaaacagaaccatcaccagccacctacccagcagcagcctcctctcccagaacgggaggagacaggcgacgaagaggatgggtccccaatcgggccaccttctctcctagggccccctcctatggccaatggcaaacccggcgacccaaaaagcgcccttcacagggggccgcctggctcccgaggcccgctgattccacccctgctgtccctcccaccccccccatgggggaggggccctatacgcaggggactcggcccacgatcttccccttacggtcgcggatggtggggagtaaatgccgagcccccttttccaggaccagggcatggaggtccaactcgcggttctttccacaaggagcagcgcaacccccgtaggctgaagtcttggtcattgatcaaaaacacgtgtccgccaaaggacgatccacaggtcatggaggacaagtcagacagacctgtgtgtaggcactttgcgaagaagggacattgccgctacgaagacctttgtgctttttatcaccctggcgttaacgggccgcccctctag

SEQ ID NO: 129984 - DNA, 567 bp, Artificial Sequence
  Description of Artificial Sequence: Synthetic coding sequence
atgcccaaaaggaaaaagcagaaccatcaccagccccccacacagcagcagcctccactgccagagagggaagagacgggcgacgaagaagacgggtcaccgatcgggcctccatccctactgggcccgcctccgatggctaatggaaaacccggggatccaaaatcggcgctccacaggggccctcctggtagccggggccccctgatcccaccactcttatcactcccccctccaccgtgggggcgtggccctatcaggcgaggcctcggccccagaagcagtccgtacggaagaggctggtggggagtgaatgccgagccaccttttccagggcccggacacgggggccccactagggggtcgttccataaggagcaacgtaatccacggcgtctgaagtcgtggtcacttattaaaaatacatgtcccccaaaagacgacccacaggttatggaggacaaaagcgaccggccggtctgccgacacttcgccaaaaagggccattgtaggtacgaggacctctgcgcattttaccaccctggtgtcaacggtccacccctctag

SEQ ID NO: 129985 - DNA, 504 bp, Artificial Sequence
  Description of Artificial Sequence: Synthetic coding sequence
atgccgaagaggaagaagcaaaatcatcatcagcctcccactcagcagcaacccccgttgcccgaacgagaggagaccggtgacgaagaggacggctcacctatcgccctgcatagaggaccacctggatcacgggggccattaataccgcccttactcagcctccctccgcctccttggggaaggggtccaatccgccgtgggttgggcccccgttctagcccatacggacgcggatggtggggagtaaatgctgaacccccattccccggccctggtcatggcggacccacaagaggatcattccataaggaacaaaggaatcccagacggctcaaaagctggagtctcataaagaatacgtgtcctccaaaggatgatccgcaggtcatggaagacaaaagtgacaggcccgtgtgccggcacttcgctaaaaagggacactgtagatacgaggatctgtgtgcgttttaccatcctggcgtcaacggacccccactttag

SEQ ID NO: 129986 - DNA, 504 bp, Artificial Sequence
  Description of Artificial Sequence: Synthetic coding sequence
atgccaaaaagaaaaaagcaaaatcaccaccagccccctacacagcagcaacctccattgcccgagcgggaagagaccggcgacgaagaggacggctcacccattgcgttgcaccggggccctccagggagccggggcccattgatccccccactattatctcttcctcctcccccgtggggccgcggccctatcaggagaggccttggtcctcgcagcagcccctatggccgcgggtggtggggagtcaacgcggaacctcccttcccaggcccgggccatggcgggcccacccgggggagttttcataaggagcagagaaatccacgccggttgaagtcctggagcctcataaagaacacctgcccaccaaaggatgatccccaagtgatggaagataaaagcgaccgtccggtttgccgccatttcgctaagaagggccattgccggtacgaggatctctgcgccttctaccacccaggtgtgaatgggcctccactgtag

SEQ ID NO: 129987 - DNA, 504 bp, Artificial Sequence
  Description of Artificial Sequence: Synthetic coding sequence
atgcccaaacgaaaaaaacagaatcatcatcaaccgccaactcagcaacaaccgcccctgccagaaagagaagaaacaggggacgaagaggatgggtcccccattgcacttcatcggggtccacctggttcaaggggacctctgatcccacccctgttgtcattacccccgccgccatggggccgcggccccatcagacgcggccttggcccccgctcttcaccatacgggcgaggctggtggggcgttaatgccgagccaccattccccgggcccggccatggtgggcctacccgtggatcgtttcacaaggagcagcggaatccccgtcggctgaagtcctggagcttgatcaaaaacacttgtcccccaaaggacgatccgcaggtcatggaagataaaagtgaccggcctgtttgtaggcactttgccaagaagggccactgtcggtacgaagacttatgtgccttctaccatcccggagttaacggcccacctctctag

SEQ ID NO: 129988 - DNA, 567 bp, Artificial Sequence
  Description of Artificial Sequence: Synthetic coding sequence
atgcctaaacgcaagaagcagaatcatcatcagccacccacccagcagcagccacctctgccagagagagaggaaaccggcgatgaggaggatggatctccaatcggccccccgagtctcctgggccctccgcctatggcaaatggtaaaccgggggatcctaagagcgcccttcatcgggggccccccggtagcagggggcccctaatccctccactgctctccctccctccccctccttggggacgcggaccgatcaggagagggctgggccctcgatcctctccgtacggccgggggtggtggggcgtcaacgctgaacctccttttcctggaccagggcacggcggcccaacacgaggtagctttcataaggaacagcgcaatccacgccgacttaaatcctggagcctgatcaagaatacttgcccaccgaaagatgaccctcaggtgatggaggacaagtctgatcgtccagtctgcaggcactttgccaagaagggccactgcagatacgaggacctctgcgcattctaccatcccggtgtgaatggcccacctctctag

SEQ ID NO: 129989 - DNA, 567 bp, Artificial Sequence
  Description of Artificial Sequence: Synthetic coding sequence
atgccaaaacggaagaagcagaaccatcaccagcctcctacccagcagcagccacccctgcctgagagagaagagacgggagatgaagaggatggcagccctattggcccgccatctttgctgggccccccacctatggccaacggcaagcccggggacccaaaatcagctctgcacagagggccgccaggaagtcggggacctcttattcccccactcctctccctaccacctcccccgtggggaaggggaccaatcagacgcggactgggacccagaagttctccttacgggcgaggctggtggggcgtgaacgccgaacccccctttcccgggccgggccacggcgggccgacccgaggaagcttccacaaggaacagagaaaccctaggagactgaaaagttggagtctcattaaaaacacttgcccacccaaggacgatccacaagtcatggaggataaatcagatcgccctgtctgtagacattttgcaaaaaagggccattgtcgttatgaggatttgtgtgctttctatcatcccggtgtgaacgggccacctctgtag

SEQ ID NO: 129990 - DNA, 504 bp, Artificial Sequence
  Description of Artificial Sequence: Synthetic coding sequence
atgccgaaaagaaagaagcagaaccatcaccaacctcccacgcagcagcaaccaccactccccgaaagagaggaaaccggagatgaagaggatgggtctccgattgctctccatcgcggtccacccgggagcagaggacctttaattcccccacttctctctcttccgcctccaccttgggggcgcggtcccatacggcgaggacttggccccagatcgtccccttatggtcgtggttggtggggggtgaacgccgaaccaccttttcctgggcctggtcatggtggccctacgcgcggtagtttccacaaagaacaacgaaaccctaggcgtttaaagtcttggtcactaattaagaatacctgtcctcccaaggatgatccacaggtgatggaggataagagcgaccgcccagtgtgtcgccattttgctaaaaagggtcattgtagatacgaagacctatgtgccttttatcaccccggcgtgaatggccctccactgtag

SEQ ID NO: 129991 - DNA, 504 bp, Artificial Sequence
  Description of Artificial Sequence: Synthetic coding sequence
atgccaaaacgcaagaagcagaaccaccatcagccgccgacacagcagcaacccccgctgcccgagagggaagagaccggagacgaggaggatggcagtcccatcgctttgcaccgggggcctcccggcagtaggggcccactcattcctccactcctgagcttacctccacccccgtggggacggggccccattaggaggggactaggacctaggtcctctccctacgggagagggtggtggggcgtgaatgccgagccaccattccctggaccgggacacggaggccccacacgcggctcatttcataaagagcaacgtaaccctcggagactgaaatcttggagccttatcaagaatacgtgcccaccaaaagatgatccacaagtcatggaagacaagtccgaccgacccgtctgccgtcacttcgctaagaaagggcattgtaggtacgaagacctctgcgccttttatcatcctggggtgaatgggccgccactgtag

SEQ ID NO: 129992 - DNA, 504 bp, Artificial Sequence
  Description of Artificial Sequence: Synthetic coding sequence
atgccgaagaggaagaaacagaaccaccatcagccacctacccagcaacagcccccgctcccagagcgggaggaaaccggggatgaggaggatggctcacccattgccctccatcggggcccacccggctctcggggccccttaatcccacccctgctgtccctgcctccacctccttgggggaggggccctatcagaagaggtttaggccctcgtagctcgccttatgggcgcggttggtggggtgtcaatgctgagccccccttcccgggaccaggccatggcggccccaccagagggagtttccataaagaacagcgaaaccctcggaggttgaagagttggagtctgattaagaacacctgcccccctaaggacgatcctcaagttatggaggacaagtcagatagaccagtttgccgacattttgcgaagaaggggcactgtcgttacgaagacctctgtgccttctaccacccaggggtcaatggtcctcctctgtag

SEQ ID NO: 129993 - DNA, 567 bp, Artificial Sequence
  Description of Artificial Sequence: Synthetic coding sequence
atgccgaagaggaagaagcagaaccaccaccagccacctactcagcagcagcctccccttcctgaaagagaggagacaggagatgaagaggatggttctcccatcggaccaccctccctcctagggcctccccccatggccaatggcaaacccggcgaccctaaatccgctttacaccggggaccacctggcagccgcggccccctgattcctccactgctgagcctgccaccacccccatgggggcggggccccattagacggggccttgggccaaggtcaagcccttatggaagaggatggtggggagttaacgcagaaccccccttcccaggacctgggcacgggggacctacacgcggatcctttcataaggagcagaggaatcccaggcgcttgaaaagctggtccctgatcaagaacacatgtccacccaaggatgaccctcaggtaatggaggataagtccgatcggcccgtgtgccgccacttcgccaagaaaggccactgcagatacgaggacttgtgcgccttttaccacccgggagtgaacgggcccccactgtag

SEQ ID NO: 129994 - DNA, 567 bp, Artificial Sequence
  Description of Artificial Sequence: Synthetic coding sequence
atgccaaaacggaagaagcagaaccaccaccagccaccaactcagcaacaaccccccctcccagaaagggaggagacgggtgatgaggaagatgggagccctattgggccaccctcactgctcgggccacccccaatggcaaatgggaagccgggcgaccccaagtctgcacttcaccgcgggcctccgggatcgcgggggcccttgattcccccgctcctgtccctgcctccccccccttggggaagaggcccaattcgacgtggcttgggcccgcgctcctcaccatacggacggggatggtggggtgtaaatgccgagcccccgtttccagggcctggccacggaggacctaccagagggagcttccataaagaacaacggaatcctcgtaggttaaagtcctggtccttgattaagaacacgtgcccccctaaggacgatccccaagtcatggaagacaagagcgatagaccagtgtgtaggcactttgccaagaagggccattgccggtacgaggatttatgcgcattttaccatcctggggttaacggccccccactttag

SEQ ID NO: 129995 - DNA, 567 bp, Artificial Sequence
  Description of Artificial Sequence: Synthetic coding sequence
atgcccaagcgtaaaaaacagaaccaccaccaaccacccactcagcagcagcctccattgcctgaacgggaggaaactggagacgaggaagacggctctcccatcggccccccttcactgctgggtcctccccctatggctaatggcaagcccggcgacccaaaatccgccctccatcgcggccccccaggatcacggggtccccttataccgcccctgctctcactgcccccccccccctgggggcggggcccaattagacgaggactgggacctagaagttccccttatggacggggctggtggggggtgaacgccgagcctccgtttcccgggcccgggcatgggggtcccactcgcggttcctttcacaaggaacaacgcaatccaaggagattaaaatcctggtccctcatcaagaacacgtgtcctcccaaagacgacccacaggtaatggaagataagagcgacaggcccgtctgcagacatttcgccaagaagggacactgccgatatgaggacctgtgtgcattctatcaccccggcgttaacggtccacccctgtag

SEQ ID NO: 129996 - DNA, 762 bp, Artificial Sequence
  Description of Artificial Sequence: Synthetic coding sequence
atgccggggcgcacggagggtggcagctggttacgcaacgcagcggcagccgacgtgttgcggaacctaccagaagtggagtggcgtgagccacagcactgctgtccacctactcccaggaaacggaaacagaaccctcgggtacctctgcctcactaccctccgaatcctgccgccgccatcgccgcagataccatgccgaagaggaagaaacagaatcatcaccagccacccacacagcagcagccaccgctgcccgaacgagaagagacaggagacgaggaagacgggagtcctatcgggcctcccagtctccttgggcccccccctatggcaaacggaaaaccgggagacccaaagagtgccctgcatagagggccaccaggcagccgcggcccactgatcccgcccctcctgagcctacctcctccaccttggggcaggggccctatccggcgggggttaggtccaaggagctctccttacggacggggatggtggggagtgaatgctgagcccccctttcctggccctggccacggggggcctacacgaggctcttttcacaaggaacagaggaatccccgcaggctgaagtcctggagcctgatcaagaatacctgccctccaaaggacgacccccaggtcatggaggataaaagtgatcgcccagtatgcaggcactttgcaaagaaaggacattgtagatatgaggatctgtgcgcattctaccatcctggcgtgaatggcccgcccctgtag

SEQ ID NO: 129997 - DNA, 762 bp, Artificial Sequence
  Description of Artificial Sequence: Synthetic coding sequence
atgcccggtaggacagagggaggctcttggctgagaaatgccgctgccgctgatgttctcagaaatttgcccgaagtcgagtggcgggaacctcagcactgctgcccacctacaccacgaaaacgcaagcagaacccaagagtcccactgcctcattacccgccgaacccagcggcagcgattgccgcggacactatgcccaaaaggaaaaaacagaaccaccatcaaccgccgacccaacagcaacctcccctcccagagagggaagagacaggagacgaagaggacgggagtcccattggcccaccttccctgctgggacccccccccatggccaacggcaagcctggcgatccgaaaagtgcactccaccgcggccctcccggcagtagaggcccacttattcctcctctcttgagcttgcctcctcccccctggggtcgtggccctattcgacgaggtttaggacctaggagttcaccttacggtcgcggatggtggggggtgaacgccgagccccccttccctggacctggacacgggggcccaacccggggctcttttcacaaggaacagcggaatccacgccgactcaaaagctggagcctgataaagaacacctgtcccccaaaggacgatccgcaggttatggaagacaagagcgaccgccctgtctgtcggcacttcgctaagaaaggacattgccggtacgaagatctgtgtgcattttaccatcccggggtgaatgggccaccattatag

SEQ ID NO: 129998 - DNA, 762 bp, Artificial Sequence
  Description of Artificial Sequence: Synthetic coding sequence
atgccaggtcgcacagaaggcggttcgtggttgcggaatgcagcggcagcggacgttctgcgaaacctgcccgaggttgagtggagagagccgcagcattgctgtccccccacccccaggaagcgcaaacaaaatccacgggtgcctctccctcattatcccccaaaccctgccgcggccatagccgccgacacgatgccaaagagaaagaaacaaaaccaccaccagcctcccacgcaacagcagcctcctctacctgagcgcgaagagaccggggatgaagaggacggatctccaataggccctccttccttgctggggccacccccaatggccaacggaaagcctggagacccaaagtctgctctccacaggggtcctcccggttcacgaggacccttgatacctcctcttctgtctctgcctcctccgccgtgggggcgtggcccaattcgaaggggactggggccaagatcatccccctatggccggggttggtggggcgtcaatgccgagccccctttccccggtcctggccatggcggccctacccggggtagcttccacaaagagcagcggaatccccgacgtctaaagtcatggtcattaatcaagaacacttgccctccaaaggacgatccccaggttatggaggataaatcagatcgcccagtttgccgccactttgccaagaaagggcattgccgctacgaggatttgtgcgcgttttaccatcctggggttaatggtccgccactctag

SEQ ID NO: 129999 - DNA, 762 bp, Artificial Sequence
  Description of Artificial Sequence: Synthetic coding sequence
atgccaggacggaccgagggcgggtcatggctcagaaacgcggccgcagcggatgtactgaggaacctgccggaggtggagtggcgagagcctcagcattgttgtcctcccactccccggaagaggaagcagaaccctcgggtgcccttacctcattatccgcccaatcccgcggccgccatcgccgccgataccatgccaaagaggaaaaaacaaaaccatcatcagccaccaacccaacagcagcctcctttgcccgagcgggaggaaacaggtgacgaggaggatggtagccccattggccctccctcactcctggggcccccacctatggcaaacggcaaaccaggagatcccaaaagtgccctgcatcggggaccaccaggcagtcgtggacctcttatccctccactcctaagccttccaccccccccttggggtcgcggccctattagaaggggcctgggcccacgcagttctccctatggacgcggatggtggggtgtcaatgccgaaccaccattccctggtccgggtcacggggggccgactcgagggagctttcacaaggaacagagaaatccccgtcgcttgaagtcttggagtctcattaagaatacctgtccccccaaggatgacccccaggtaatggaggataagagtgataggcccgtgtgtcgacacttcgccaagaaaggccactgtagatacgaggacctgtgcgccttttaccaccccggggtaaatgggccccctctgtag

SEQ ID NO: 130000 - DNA, 762 bp, Artificial Sequence
  Description of Artificial Sequence: Synthetic coding sequence
atgcccggacggaccgagggtggatcctggctcaggaatgctgccgctgctgatgtgctgaggaatttaccagaagtggaatggcgggagccgcaacactgttgtcctccgacaccccgaaagaggaaacaaaacccccgtgtgccacttcctcattatcccccaaaccccgctgctgctatcgcggctgatactatgcccaagcgcaagaagcagaaccaccaccagccaccaacacagcaacagccgccgctgcccgagcgggaggagacaggtgatgaggaggacgggtccccaattggcccgccaagcctgctgggaccacctccaatggcgaatggtaaaccaggagaccccaagtccgctctgcaccgcggcccccccggatctcggggcccactcatcccccctttgttatcgttacccccccccccttggggcaggggacccatccgccggggcctgggccctcgttctagcccatatggtcgcggctggtggggcgtcaacgcagagcctcctttccctggacccggccacggcggccccactcggggatcctttcacaaagagcaaagaaatccccgcagactcaagtcctggtcccttatcaagaatacctgcccccctaaggatgatcctcaggtgatggaagataagagcgataggcctgtctgtcgacattttgccaaaaaggggcattgcagatacgaagacctgtgtgctttttaccaccccggcgtgaacggcccccccctatag

SEQ ID NO: 130001 - DNA, 762 bp, Artificial Sequence
  Description of Artificial Sequence: Synthetic coding sequence
atgccggggaggaccgaaggcggatcctggctaaggaacgccgcagcagcagatgttctgcgcaatctgcccgaggtggaatggcgagaaccacagcattgttgtccccccacacctagaaagcgtaaacagaaccctcgggtcccgctgcctcattaccccccgaatccagctgctgctatcgccgccgatactatgcccaaacgtaagaagcagaatcatcaccagcctcccacccagcagcagccgcccctgcctgagcgcgaagagaccggcgacgaagaggatgggtctcctattgggccaccttcactgctggggcctcctcctatggctaatggaaagcctggcgatcccaaaagtgccctgcaccgaggcccccctggcagtcgaggacctctcattccccctctcctgtctttaccccctccaccatgggggagaggtccaattcgacggggcctgggtccacggtctagcccctacggaagaggctggtggggggtcaatgcggagccccccttccctggacctggccatggaggacccacccgcggttccttccacaaagagcaacgaaaccctcggcgcctgaagagttggtcgttgattaagaacacatgtcctccgaaagacgatccacaggtgatggaggacaaatcggacagacctgtttgccgccattttgccaagaagggccactgtaggtacgaagatctgtgtgcattctaccaccccggggtaaatggcccgccactgtag

SEQ ID NO: 130002 - DNA, 1344 bp, Artificial Sequence
  Description of Artificial Sequence: Synthetic coding sequence
atgagatccgtgtcttatgttcaaagagtggcccttgaattcagcggtagtctttttccgcacgcgatctgcttgggggacgtcgataatgacaccctgaatgaattagtcgtaggagacactagcggaaaagtctcagtgtacaagaacgacgatagcagaccatggttgacatgctcttgtcaagggatgttaacatgtgttggagtgggggacgtgtgcaataagggaaaaaacctcttggtggcagtgtctgccgaaggatggtttcatctgttcgatctgacacctgccaaggttctggatgcatccggacatcacgaaactttgattggtgaggaacaacggcccgtctttaaacagcacatccccgccaataccaaggtcatgctgatttcagacattgacggggatgggtgcagagaactggtggtagggtatacagatagagttgtccgcgccttccggtgggaggaactgggcgagggacctgaacatctgaccggccagttagtttcactgaaaaaatggatgcttgagggccaagttgatagtttgtcagtgacgctaggcccgcttggattacccgaattaatggtcagccagccagggtgcgcatatgcaattctcctgtgcacttggaaaaaagacaccggcagccccccagcatctgaaggaccaacagacggctcccgcgagacacctgccgccagggatgtcgtgttgcaccagactagcgggcgcattcacaataagaacgtttctacccatctcattggaaatattaagcaaggacacggcactgaatcctcaggctcaggcttgtttgctctatgcactctggatgggacgctgaaactgatggaggagatggaggaggccgacaaacttttgtggtcagttcaggtagatcatcagctgttcgccttggaaaaactggacgtcacagggaatggtcacgaggaggttgttgcttgcgcgtgggatggtcaaacttacattatcgatcacaaccggacggtggtgcggtttcaggtggatgagaacattcgtgccttttgtgctggcctgtatgcgtgcaaggaagggcgaaacagtccttgcctagtgtatgtgaccttcaaccagaagatctacgtatactgggaggtgcaactcgaacgcatggaatcaactaacctggtgaaactcctggaaacaaagcctgagtatcattcgcttctgcaggaacttggagtggacccagatgaccttccagtgacaagggccctgcttcaccagaccctgtaccatcccgaccaacctccccagtgtgctcctagttccctgcaggaccccacatag

SEQ ID NO: 130003 - DNA, 381 bp, Artificial Sequence
  Description of Artificial Sequence: Synthetic coding sequence
atgctcctggtcctgctctctgtggtcttactcgcactgtcctccgcccagtccacagataatgacgtgaattatgaagacttcacatttactatccccgacgtggaggattcttacctcgatccactggttattgtggtgactaaaatgatggtgctgtcccgagaccatcagaaccaggaagctattaccgccattctgccacacctgctgttcaaaatttcaaatgaccaccccgacgaggataccgtgaacagcctctaccccgactttctcctgtctgcttgccgaaagcatcaccactctagcagaggaactgatcaacaggacattccacgctccaaccactcaggcaacctggaattttcaggtcgtaaatag

SEQ ID NO: 130004 - DNA, 198 bp, Artificial Sequence
  Description of Artificial Sequence: Synthetic coding sequence
atgctattagttctcttaagtgtagttctactcgccctgagcagtgctcaaagtactgacaatgacgtcaattatgaggacttcaccttcaccatccccgcctgtcgaaagcaccaccacagttctcgtgggaccgatcagcaggatatccctaggagcaatcactcaggtaatctagaattttctggtcgtaaatag

SEQ ID NO: 130005 - DNA, 696 bp, Artificial Sequence
  Description of Artificial Sequence: Synthetic coding sequence
atggccgtgttcctggaggcaaaagacgcccactcagtcctgaaacggtttcccagagctaatgaattcttagaagaattgaggcagggtacgattgagcgcgagtgcatggaggagatctgctcatacgaggaggtcaaagaggtcttcgaaaataaggaaaaaacgatggagttctggaaggggtatcctaacgctgtctattcagtcagagacccatcacaatcgtccgacgcaatgtacgtggttgtcccattgctcggcgttgctctattgatagtgatcgcactattcataatctggcgatgtcagttgcagaaagctacaaggcaccatccatcctacgcccagaaccgctatctggcttcgcgagccgggcacactcttccccgcgtcatggtctatcgcggaacggtgcactctcagggggaaccttcaggccacagggaagctgcaaattccccccaggtggttctggggcctagcagaggaggaaggaccacagtgcgactagaaagcactctttaccttcctgagttgtctctgagccggcttagctctaccacccctccccctagctacgaggaggttacagcacctcaggagtccagctccgaggaggcttccgtgtcgtattccgatcctccaccgaaatacgaagaaattgtggccgccaaccccggcgcagataagtag

SEQ ID NO: 130006 - DNA, 309 bp, Artificial Sequence
  Description of Artificial Sequence: Synthetic coding sequence
atggcaggattatcccgcgctcttagctctgtgttcctagaagccaaagatgcccactcagtcttgaaaagattccccagggcgaatgaatttctggaggaactccgacagggcaccattgagagagagtgcatggaagagatctgctcctatgaagaagtcaaggaggtctttgagaacaaggagaagacagcctgcaccaccctcggactggtgctcggcgttggagtcgctagcggaatcgccagaaccgggcccggcaatgccgaccaatctgaggccagaaaggacacccagccgaaggcatag

SEQ ID NO: 130007 - DNA, 276 bp, Artificial Sequence
  Description of Artificial Sequence: Synthetic coding sequence
gacccttctcagtcgagcgatgctatgtacgtggtggttcccctgctgggtgtcgccctcctgatcgtgattgccttgttcattatctggcgctgtcaactgcaaaaggccacacggcaccatccctcctatgctcagaaccggagatgtttcgcagtccggctggcagctccatctttcgcctccaagtactcaaatgtcggagcctttccattcaggctgtgggccgccagtttgtcgttagcaagaatatatctcactaacattccaaaatag

SEQ ID NO: 130008 - DNA, 159 bp, Artificial Sequence
  Description of Artificial Sequence: Synthetic coding sequence
atggctgttttcctcgaggccaaggacgctcactcagttctcaagaggttcccacgggctaacgagttcctggaagaactgcgccaaggcactatcgaacgcgaatgcatggaagaaatttgctcatatgaggaggttaaagaggtgtttgagaattag

SEQ ID NO: 130009 - DNA, 696 bp, Artificial Sequence
  Description of Artificial Sequence: Synthetic coding sequence
atggctgtctttctggaagctaaagacgcccactcggtacttaaacgcttccctcgagcaaacgagtttctggaagagctccggcaaggcaccatcgaacgcgagtgtatggaagaaatctgctcttacgaggaggtcaaggaggtcttcgagaacaaagaaaagaccatggaattctggaagggataccctaatgctgtgtactcagtgcgggacccatcccagtcctccgatgcgatgtatgttgtggtccctctgctgggagtggctttgctgattgtcatagctctgttcataatctggcgatgccaactgcagaaggcgactaggcaccatcccagttacgcccagaaccgctacctggcctcccgggccgggcacactctgcctcgggtcatggtgtaccgcggcacagtacactcccagggagaaccaagcggccatcgggaggccgccaattcccctcaggtggtgcttggaccctcgagaggggggcgaaccacggtccgactggagagcacactgtatttaccagagctctctctttctaggcttagctcaaccactccacctccatcctacgaagaggttacggccccccaggagtccagttcagaagaggctagcgtgtcctacagcgatccgccccccaaatatgaggaaatagtagccgcaaatcctggggctgacaaatag

SEQ ID NO: 130010 - DNA, 681 bp, Artificial Sequence
  Description of Artificial Sequence: Synthetic coding sequence
atgtttactctcctcgtcctactgagtcaactaccaaccgtcacactggggttcccccactgcgcgagagggcccaaggcttcaaagcacgccggcgaggaggtgtttacaagcaaggaagaagcaaacttcttcatccacaggcggctactatacaaccgctttgatctggagttgtttactccaggaaacttggagagagaatgcaacgaggagctgtgtaattacgaggaagccagagagattttcgtcgatgaggacaagaccatagctttttggcaagagtacagcgccaagggaccaactacaaaaagtgacggcaatagagagaagatcgatgtgatgggcttgctgaccggtctcattgcggcgggagtcttcttggtcatcttcgggcttctggggtattatctttgtattaccaagtgtaataggttgcaacacccatgcagcagcgccgtgtatgagcgcggacggcacactccgtctatcatctttagaaggcctgaggaggccgccctgagccctttaccgccaagcgtcgaagatgcaggcctaccgtcctatgaacaggccgttgcactgacacggaagcattctgtatcccctcctccaccgtatccaggacataccaaaggtttcagggtgtttaagaagtctatgtccctgccttctcactag

SEQ ID NO: 130011 - DNA, 375 bp, Artificial Sequence
  Description of Artificial Sequence: Synthetic coding sequence
atgcttctgcgcgacctggttctccgccgaggttgctgttggagtagtctattgttgcactgtgccctgcaccctctgtgggggtttgtgcaggttactcatggagaaccccagaaaagttgtagcaaggtcactgactcctgcagacacgtttgtcagtgccggccccctcctcctctgcctcctcccccaccaccccccccacccccacgcttactgtccgctccggcacccaatagcacctcttgcccgaccgaggagagctggtggtcaggactggtgataatcatcgccgtgtgctgcgcttccctggtgttcctcacagtgctggttataatatgctacaaagcaatcaaacggaatcatgcgatctag

SEQ ID NO: 130012 - DNA, 462 bp, Artificial Sequence
  Description of Artificial Sequence: Synthetic coding sequence
atgctactgagagatctcgtcctaagacgcgggtgctgttggtcctctctccttctgcattgcgcgttgcaccccctgtggggatttgtgcaggtgacccatggggagccacaaaaatcttgctccaaagtaactgactcttgccggcatgtgtgccagtgcaggccgccgcctccgctgcctcctccccctccaccacctcctccacctagactgctcagcgctccagctccgaattccacctcttgccccaccgaggaatcgtggtggagcggcctggtgattattattgctgtgtgctgcgcaagcttggtatttctgacagtcttagtgattatttgctataaggcaattaaacgcaaacctttgcgcaaggatgagaatggcacctctgttgccgaataccccatgagcgcatcacagagcaataaaggcgtagatgtcaataatgcagtggtgtag

SEQ ID NO: 130013 - DNA, 462 bp, Artificial Sequence
  Description of Artificial Sequence: Synthetic coding sequence
atgctgctccgcgatctcgtgctgagacgcgggtgctgctggtcttctctgctgctgcactgtgcgcttcaccctctctgggggttcgtgcaggtcacccatggtgaacctcagaaatcatgctccaaagtgacagactcgtgccggcacgtgtgccagtgccgacccccccccccgctcccaccaccacctcctcccccccctcctccgcgtctcctatctgcccccgcccctaacagcacttcatgccccaccgaggagtcctggtggtctgggctcgttataattatcgccgtctgctgtgcctcccttgtttttctgacagtcttggtcatcatttgttataaggctatcaagcgcaagcccctcaggaaagacgagaacggaacctctgtcgccgagtacccaatgtccgctagccagagtaataaaggggtggatgtcaataacgccgtggtgtag

SEQ ID NO: 130014 - DNA, 828 bp, Artificial Sequence
  Description of Artificial Sequence: Synthetic coding sequence
atgtggcgcgccggctctatgagcgctgagctgggggttggatgtgccctgagggccgtgaacgagcgtgttcaacaggctgtggcgcgcaggccccgagatctgcctgctatccagccgcgtctggtcgccgtttccaaaaccaagcctgcggacatggtaatagaggcctatggtcatggacaacgaaccttcggagagaactacgtgcaagagctgttggagaaagcctcaaatccaaagatcttaagcctgtgcccggagatcaagtggcatttcatcggtcacctccagaagcagaatgtgaacaaactcatggctgttccaaacctattcatgctggagactgtggacagtgtcaagcttgccgacaaggtcaattccagctggcaacggaagggcagccccgaacggttgaaagtgatggtccagataaatacatctggagaggagtccaaacacgggctgccaccttcggagaccatcgcgatcgtggagcacattaatgccaagtgcccaaatttagaatttgtagggctgatgacgattggtagctttgggcacgatctgtcacagggccccaaccccgactttcagctgctgcttagtctgcgggaggaactgtgcaagaagcttaacatccctgcagaccaggtcgaactcagcatggggatgagcgccgacttccagcacgctgtggaagtaggctcgacaaacgtgcgcatcggatcgacaatttttggcgaaagggattacagcaaaaagcctaccccagacaagtgcgcggccgatgtcaaagcccccttggaggttgctcaagaacactag

SEQ ID NO: 130015 - DNA, 1149 bp, Artificial Sequence
  Description of Artificial Sequence: Synthetic coding sequence
atgcgcagtcctctgtgctggttgctaccccttctgatcttagcctctgtggcacagggtcagcctacccgccgcccccgcccaggcacagggcctggtaggcggcctagaccacgccctcgccctacgccaagcttcccccagcccgatgagcctgctgaacccacggacctgcccccgcctctccctcctggccctccctcgatttttccagactgccctcgcgagtgctattgtcctccagatttcccctccgcactgtattgcgactcgagaaaccttcgaaaggtgcccgtgatccctccacgcattcattacctgtatctgcagaataatttcatcacggaactgcctgtcgagtcttttcagaatgcaactggtctgcgctggatcaatctcgacaacaaccgcatccggaagattgaccaaagggttctggagaagctgccaggcctggtctttctctacatggaaaaaaatcagttggaggaggtaccatccgctctgccgaggaacctggagcagctgcgactgtcccaaaaccatatctccagaattcctcccggtgttttttccaagctcgaaaatctactcttgctcgatttgcaacataatcgattatccgatggcgtgttcaaaccggatactttccacggcctcaaaaatttgatgcagctgaatctcgcccacaacatccttaggaagatgccccctcgcgtgccgaccgccatccatcagctgtacctcgattctaataaaatagagactataccaaacgggtactttaagagtttccccaacctggcctttattagactgaattataacaaactgacagaccgcggtttgcctaaaaacagtttcaatatcagtaatctgttggtgctgcatctgagtcacaatcggatttccagcgtgccagccatcaacaatcggctggagcacctctacttgaacaacaatagcatcgaaaagattaatgggactcaaatctgcccaaacgacctggtcgcattccacgatttctcctctgatctggagaacgtccctcatctgagatacttgcgcctcgacggaaattacttgaaaccccctatccctttagacctaatgatgtgctttcgcttgttgcaaagtgtggtgatctag

SEQ ID NO: 130016 - DNA, 1002 bp, Artificial Sequence
  Description of Artificial Sequence: Synthetic coding sequence
atggaagatcttgaggaggacgtgcgctttatcgtggatgaaaccttggattttggcggcttaagtccctcagatagccgcgaggaggaagacataacggtactggtcactcccgaaaagcccctgcgacggggattaagccaccggagtgacccaaatgcagttgctcccgcaccgcagggcgtgcgactgtccctggggcccctttcaccagagaaattagaagagattctggatgaagcaaacagactcgcggcacagctcgaacagtgcgcgctccaagatagagaatctgcgggtgagggcctgggaccacgcagagtgaagcccagcccacggcgcgagacgtttgttttaaaggacagccccgtccgggacctgctgcccaccgttaattctctgacgcggtctactcccagcccatctagcctgacaccacggctacgatctaacgaccgcaaaggctctgtccgagcccttagggccacgagtggcaagcggccttcgaacatgaaacgggagagtcctacatgcaatcttttcccagcgtccaaatcacccgcctcatcccctctgaccaggagcacacctccagtacgtggccgtgcgggcccttctggccgtgctgctgccagcccacctacccctatacgatcagtgctcgccccgcagccatctacgagtaattctcagaggctgccccgtccccagggggctgccgccaagtcgtccagccagctcccgattcctagtgccatcccccgccctgctagccggatgccacttacctcccgctccgtcccaccgggccgcggcgctctgccacccgactccctatctacgcggaaaggactccctcggccctcaaccgccggccacagggttcgggagtccggccacaaagtgcctgtcagccagagacttaacctccctgtgatgggcgctacacgtagcaatctgcaaccccctcgcaaagtggcggtccccgggcctacgaggtag

SEQ ID NO: 130017 - DNA, 933 bp, Artificial Sequence
  Description of Artificial Sequence: Synthetic coding sequence
atggaggatttagaagaggatgtgcggttcattgtggatgagaccctggatttcggcggattaagcccatctgactctcgcgaggaagaagacatcactgtcttagtaactcctgagaagcccttgcggagagggctgtctcacagaagtgacccaaatgcagtcgcccccgcgccccagggggtaaggctcagcttgggacccttatctcctgagaagctggaggagatcctggacgaggcaaatcgcctagctgcgcagcttgaacagtgtgcactccaggatagggaatctgcaggagaaggtctcgggcctaggcgagtcaaaccgtctcctcggcgcgagacgttcgtccttaaagattcacccgtgagggacctgctgccaactgtcaattccctgacccgatctacgccttctccatctagcctaaccccacggctcagaagtaatgatcgtaagggctccgtcagagcgcttcgggcaacttcaggtaagcgcccaagcaatatgaagagagagagtcccacgtgcaacttgttcccggcatcaaagtcacccgcctcttcacccctcacacgctctacgcccccggtccgtggacgcgctggaccttctggcagagccgctgccagcgaagagacccgagcggccaaactgagagcctgtcaacctaatgccacccatcagcccgagtgcgcgacctggcagcggtgtccgacatccgggttttctgtaaacagtaaacgtgcctctaagacaaaacactgccgcacccaatccgccggcaagtggacacaagggtcgtgcttccccgcaaccaaatcctcctgtcatggatgccactcgcagcagtccgccgcaccacaggagtctggtagcccgaggacttatcaggttaagagaagtggacagcaggccagacttcagtag

SEQ ID NO: 130018 - DNA, 1002 bp, Artificial Sequence
  Description of Artificial Sequence: Synthetic coding sequence
atggaagatttggaggaggacgtgcgtttcatcgttgatgaaacactggacttcggaggactgagtcctagcgattcaagggaagaggaagatattaccgttttggtcactcctgaaaaacccttacgtagggggctgagccaccgcagtgatccaaacgcagtcgcccccgcaccccaaggcgttagactgtcccttggccctctctctcctgagaaattggaggagatattagacgaagccaaccggctcgccgctcagcttgagcagtgtgcactgcaagaccgcgagtctgccggagaaggcttaggtcctaggagggttaagccttccccgcgcagagagacttttgtgttgaaagattctccggtcagagacttgttaccaacagtgaattcgctcacaaggagcacaccgtcccccagctccttgacaccacgcctccggtcaaatgataggaagggctctgtgcgtgcacttcgagccactagcgggaagcgtccatcaaatatgaagcgagagagtccaacatgcaacctattcccagcaagtaagtcccccgcttcctcccctctgaccaggagtacccctcctgtgcgtggaagggccggcccctctgggagggcggccgccagtccacctactcccatccgctccgttctcgccccccagccctctacatccaatagtcagagactccctcgcccacagggcgctgcagctaaatccagtagtcagcttccaataccatccgctattcctcgtcccgccagtcgaatgccactgacgagcaggtctgttcctcctggacggggagcgctcccacctgattcactctcaactcgtaaaggcttgcctcggccttccacagcaggccacagagttagggagtcaggacataaggtgcctgtctcccagagactgaatctgcctgtgatgggagccacccgatcaaacttgcagccaccaaggaaagttgctgtgccaggtcccaccagatag

SEQ ID NO: 130019 - DNA, 1002 bp, Artificial Sequence
  Description of Artificial Sequence: Synthetic coding sequence
atggaagacctggaggaggacgttcgcttcatcgtggatgagacactggacttcggcggactctctccttccgatagcagagaggaggaagacatcaccgtattggtgactccggaaaagcctcttagacgcggtctgagtcaccggagtgatcctaatgccgtggccccggcaccccagggcgttagactgagcctgggccccctgtccccagaaaagctggaggagattttagacgaggccaaccgactggccgcccagctagaacagtgtgctcttcaggacagagagtctgcaggtgaaggactggggccacgccgtgttaagccatctcctcgcagggaaacctttgtactgaaggactctccggttcgggacctcttgccaactgtaaatagtctgactaggtctactccttcccctagctctctgacccccagactccggtccaacgatcggaagggaagcgttagggcgctcagggctacatccgggaaacggccctctaacatgaagcgcgaaagccctacatgtaacttgttccccgcctctaagtcgccagcgtcgagccctcttacccgaagcactccacccgtccggggccgcgccgggcctagtggtagggctgcggcctctccccccacccctatcaggtccgtcttggcgccccagcctagcacatccaatagtcagcggttacctcggcctcagggggcggccgccaagagttcctcgcagcttccaatcccctccgcaatccccagaccagcttcccgaatgcccctcactagcaggtcggtgcccccaggtagaggagctctgccccccgattctctgtctaccaggaagggtctccctaggccttctacagctgggcaccgagttcgcgagtcgggacataaggtcccagtcagccagagactcaacctccctgtcatgggcgcaacaagatctaatctgcaacctcctcgaaaggtggcagtaccagggcccactcgctag

SEQ ID NO: 130020 - DNA, 1002 bp, Artificial Sequence
  Description of Artificial Sequence: Synthetic coding sequence
atggaggacctggaggaggacgtgcggttcatagtcgatgagacacttgacttcggaggactgtcccctagcgattcgcgcgaggaggaggatattacagtgctggtaacaccggagaaacctctgagaagagggcttagccacaggtctgacccaaacgctgtcgcgcccgccccccaaggcgtccggctgtctcttgggccactctcccccgagaaactggaggaaattctggacgaagcaaaccggttggctgcccaactggagcagtgtgcactgcaggatcgcgaaagcgccggagaaggactgggcccaagaagagtcaagccatcccccagacgcgaaaccttcgtgttaaaggacagccctgtgcgcgacctgctgccgacagtaaatagcctgactagatctacgccctccccgtctagcttgacgccaagactgaggtctaatgacagaaaaggaagtgtgagggctctgagagccacgagcggcaagcggccttcgaacatgaagagagagtccccgacatgcaacttattccctgcttccaagagccccgcatcttctccgctgactcggagtacacctcctgtcaggggcagagccggtcctagtggccgtgctgccgctagcccacccactccaattcgatctgtgttagcacctcagccttctacctcaaacagccagcgactcccgcgcccacagggggcagcggccaagtcttctagccaattgcccatcccaagcgctatcccgaggcctgccagtagaatgcctctcacaagccggagtgtcccacctgggaggggtgcacttcccccagacagcctcagcaccagaaagggtctccctcgtccaagtacggctggacacagagttcgggagtccgggcataaagtcccagtgtcacagcgactcaacttacctgtgatgggcgctactaggtcgaacctccagcccccccgaaaagtggcagtgcccggcccgacacgctag

SEQ ID NO: 130021 - DNA, 666 bp, Artificial Sequence
  Description of Artificial Sequence: Synthetic coding sequence
atggaagacctggaggaagacgttcgttttatcgtggatgagacactggattttggtggactgagcccctcagatagccgtgaggaggaagatatcacggttctcgtgactcctgagaagcccctccgtagggggctatcacacagatccgatccgaatgcagtggcccctgccccccagggcgtgaggctgagcctgggaccactgtccccagagaaacttgaggagattctggacgaagccaatcgactggctgcccagcttgaacagtgcgctctgcaggatagagagtccgcaggcgaagggctggggccgagaagggttaagcccagcccgcgccgggaaacgttcgtcctcaaagatagccctgtgagggaccttttgcccacggtgaattcacttactcgctccacccctagtccgagcagccttacccctcgactgcgaagtaacgacaggaagggaagcgtccgggcgttgagggcaacatcaggcaaacgaccatccaatatgaagcgggagtccccgacttgcaatctgttcccagcctccaaaagcccggcgtccagtccactgacccgctccacacccccggttcgaggtagagccggaccttccggtagggccgctgcatcagaggaaacccgcgcggcaaagctcagatag

SEQ ID NO: 130022 - DNA, 699 bp, Artificial Sequence
  Description of Artificial Sequence: Synthetic coding sequence
atggaagatctggaagaggatgtcagattcatcgtggacgaaacgctggacttcggtggactgagcccgagcgacagtcgtgaggaggaagatatcacagtgctggttacccccgagaaacctctgcgacgaggactgtcccaccgtagcgatccaaacgccgtcgcccccgcacctcagggagttcggctgtccttaggcccactctcccccgagaagcttgaagagatcttagatgaagcaaatagattggctgctcagttggagcaatgtgccctacaggacagggagtcggcaggagaggggttaggcccgaggcgggtgaagcccagccctcgacgtgagacctttgttctcaaggatagccctgtgcgcgatcttctgccgacagtgaatagcctcacaaggagtacaccttcaccatcatccctcacccccaggcttaggagtaatgaccgcaaaggctccgtgcgggcccttagggctacatcaggcaagcgcccgtctaatatgaaacgcgaatcccccacttgtaacctgtttcccgccagcaagtccccggcttctagcccccttacccgttctacccctcctgtgcgcggcagggcaggcccttcaggccgagccgcagcctcaccacccacacctatcagaagcgtactggccccacagccatctacatcgaactctcagcggtag

SEQ ID NO: 130023 - DNA, 1092 bp, Artificial Sequence
  Description of Artificial Sequence: Synthetic coding sequence
atggaggacctggaagaggatgtcagattcatcgttgatgagacactggattttgggggtctgagcccctctgactctagggaagaggaggacattaccgtgcttgtaacacctgagaaaccattgagacgtggcctcagccaccggagcgaccccaacgccgtggctcccgccccgcagggggttcgcctcagcctcggcccactgtctcctgagaagctggaggagatcctcgatgaggcgaaccggctggccgcccagcttgaacagtgtgccttacaagaccgtgagtctgcaggggaaggactcggtcctcgccgcgttaaaccttcccctcggagggaaacctttgttctgaaagattcacctgtgcgcgacctcctgcccacagtgaattctctgacccggtcgacgcctagtcccagctctctgacgccacgactacgctccaacgatcgtaagggctccgtgcgggcgctcagagcgaccagcggcaagcggccttcaaacatgaagagggaatcccccacatgcaacttgtttcctgcttctaagtccccggcatccagtccgctcacaagaagtacacctcctgtgcgtggcagagctggcccttccggccgcgccgctgcatctgaggaaacccgggccgcaaagttgagagtctcaggttctggcgagtttgttggtctaacactcaagttcctgcatccctcccctccaggcccacccactccgattcgttcagtcctggcaccacaacctagcacgtccaacagccagaggctgcccagaccccagggcgcagccgccaagtcttcctcccaactgccaatcccaagtgccattcctagaccagccagcagaatgccactcacatctaggagcgtgcccccaggccgtggagcgttgccgccagattcactgtccaccagaaagggcctgcctcgcccttctacggcaggtcacagggtgcgcgaaagtggacacaaagtccccgttagccagaggctgaatctgccggtgatgggcgctaccagatcaaacctccaacctccccggaaggtggcggtaccgggaccaactcggtag

SEQ ID NO: 130024 - DNA, 273 bp, Artificial Sequence
  Description of Artificial Sequence: Synthetic coding sequence
atgcgccgcctccttttggtgacatcattagtggttgtgctcttgtgggaggctggagcagtgcctgcaccaaaagtgcccatcaaaatgcaggttaaacattggcccagtgaacaggacccagagaaagcctggggcgctcgggtcgtagagccccccgaaaaggacgatcaattggtcgtcctctttcccgtccagaagcccaaattgctaacgacggaggagaagcctcggggtactaaggcatggatggaatcacgagcaaggccatag

SEQ ID NO: 130025 - DNA, 459 bp, Artificial Sequence
  Description of Artificial Sequence: Synthetic coding sequence
atgagacgtctgctgctggtgacatctttagtggtcgtgcttctctgggaggcaggagccgtgcccgccccaaaagtgccaattaagatgcaggtcaaacactggcccagtgaacaggatccagagaatagggcatggggggcaagggttgttgagccacccgaaaaggatgaccagctggtcgttctattccccgtacagaagccgaagctgctgactaccgaagagaagccaagaggccaaggtcggggacccatcctacccgggacgaaagcctggatggagactgaagacaccctgggacatgttctgtctcccgagccagaccacgatagcttgtaccatcctcccccagaggaggaccagggcgaggaacgtcccaggctgtgggtaatgcctaatcatcaggtgctcttaggacccgaggaggatcaggaccacatctaccatccacagtag

SEQ ID NO: 130026 - DNA, 456 bp, Artificial Sequence
  Description of Artificial Sequence: Synthetic coding sequence
atgcgacgccttttgcttgtgacgagtctggtggttgtgctgctgtgggaggccggcgcggtgccagcaccgaaggtgcctatcaaaatgcaggttaagcactggccctcggagcaggacccagaaaaagcgtggggcgctagggttgtagaacctcctgagaaggatgatcagttggtggtgctctttcccgtccaaaagcccaagctgcttactactgaggaaaagcccaggggacagggacgagggcctatcctgccggggaccaaggcctggatggagactgaggacaccctcggccacgtcttgagtcctgaaccggatcacgattccttgtatcacccaccgcctgaggaagaccagggcgaggaacgaccacgactgtgggttatgccaaaccatcaggtgctactgggtccggaagaagatcaggaccacatttatcacccacagtag

SEQ ID NO: 130027 - DNA, 429 bp, Artificial Sequence
  Description of Artificial Sequence: Synthetic coding sequence
atgaggaggctcctcctagtgacttccttggtggtggtgttgttgtgggaggcaggtgcggtaccagcgcctaaggtgcctataaagatgcaggtaaaacactggccaagtgaacaagacccagaaaaggcctggggcgcccgcgtggtagaaccccccgagaaagatgatcagctggtcgtgctcttcccagttcagaagcccaaactgctaactactgaggagaaaccaagaggaactaaagcttggatggaaactgaggatacgctggggcatgtcttaagcccagagccggaccatgattctctctaccatcccccacccgaggaggaccagggcgaagagcggcccagactttgggtgatgcccaatcatcaggtcctcctgggtccagaggaggaccaggatcatatttatcacccccagtag

SEQ ID NO: 130028 - DNA, 6474 bp, Artificial Sequence
  Description of Artificial Sequence: Synthetic coding sequence
atgagtgaccgcagcgggcctacagcgaagggcaaggacggcaaaaaatattcatctcttaacctgttcgatacgtacaaaggaaaatctctggaaatccagaaacccgcagtcgctccaaggcatggcctgcagagccttggaaaagtggcaatcgcgaggaggatgccaccacccgctaatctgccctccctgaaagcagagaataagggaaacgatccgaatgtttcactcgttccaaaggacggcacgggatgggctagcaagcaggagcaaagtgaccccaagtctagcgacgccagcacagcgcagccaccggaaagccagcccctgccagcgtcccagacccccgcctcaaatcagccgaagcgtccacccgctgccccagagaacaccccactggtgccatcaggagtgaagagctgggcacaggcctccgtgacgcacggcgctcacggggatggcgggcgtgcatcctcgttgctgtcacggttcagtagagaagaattccccacactccaggcagcaggcgatcaggataaagctgcaaaggaaagagagtctgccgagcagagttccggaccaggcccctcccttcggcctcaaaattcaacaacttggagagatggagggggacgcggcccagacgaactggaaggtcctgactccaagctgcaccatggacacgaccctcggggcggattacaaccctcaggcccaccacaattccccccttaccgcggcatgatgcccccatttatgtacccaccttacctgccgttcccgcccccatacggccctcagggcccgtacagataccccacacctgatggcccatctcgattccctagagtcgcggggccccggggcagtgggccccctatgcgcctggtggaaccagtcgggcggccatccatactgaaagaggataatctgaaggaattcgaccagctggatcaggagaatgatgatgggtgggccggtgcccacgaggaggttgattacacagagaagctgaaatttagtgatgaagaggacggaagagactccgatgaagaaggtgcagaaggccatcgagactcacagagtgcctctggcgaagagagacctccagaggctgatggtaagaagggcaactccccaaacagtgagccacccaccccaaagacagcatgggctgaaacaagcagacctccagagaccgagcctgggccaccggcccccaagcccccgctcccccctcctcatcggggaccagccgggaattggggccctccaggcgactatccagatcgcggcgggcctccctgcaaacctcccgctcctgaagatgaggatgaagcctggcgccagagacgaaaacagtcatcgtcggaaatcagcctcgctgtcgaacgcgctcgccggcgccgcgaggaggaggaaaggagaatgcaggaggagcgcagagcggcttgcgctgagaagctgaagcgcctcgacgaaaagttcggcgcccctgacaaacggctgaaagccgagccagccgcccctcccgctgccccctctacacctgcccctccgccggccgtgcccaaagagctgcctgccccacctgccccccccccagcctcagctcctacaccagagaccgagccggaagagccggctcaggcaccgccggcccagtcgacccccactcccggcgtagctgccgcacctaccttagtcagcggaggaggtagcacatcctccacaagctcgggatcgtttgaagctagtccggtggagccccaacttccatctaaggagggccctgagccacctgaggaagtgcccccacccacaacaccgcccgtccctaaagtagagccgaagggggacggcattggtccgacacgacagcctccttcacagggacttggttaccccaaatatcagaaatcgctgcccccacgttttcaacgtcaacagcaagagcagctacttaaacaacagcagcagcaccaatggcagcaacatcagcaaggctccgccccccccacccccgtgcccccttccccaccccagcccgtgaccctaggggccgttcccgctccacaggctcccccccccccacccaaagctctctaccccggcgccctggggagacctcctcctatgcctcccatgaacttcgatcctaggtggatgatgatccctccttatgtcgatccacgcctgctgcagggtcgaccgccattagatttttacccgccaggcgtgcacccttcaggcctcgtcccacgcgaacgtagcgatagcggcggatccagcagtgagcctttcgatcgacacgccccagcaatgttacgggagagggggacgcccccggtggacccaaaacttgcatgggtcggtgacgtgtttactgcgacacccgcggagccaagacccttaacctccccattacggcaggccgccgacgaggacgataaggggatgagaagcgagactcctccggtgcccccgcctccgccttacctggctagctatcctggcttccccgagaatggcgccccaggaccacccattagcagattccctttggaggagccagggccccgccctctaccatggccacccggatctgatgaggtcgctaagatccaaaccccaccgccaaaaaaagaaccacctaaagaggaaacagcccagctgaccggacccgaagcaggcaggaagcctgccagaggcgtaggctctggagggcagggtccacccccaccacgaagggaatcgaggacggagaccagatgggggcccagacccggctcctcacgtcgggggatccctcctgaggagcccggtgcccccccgcggagggcggggccaatcaagaagccacctccacctactaaagtcgaggagttgcctcccaagccactggagcagggggatgagacccctaagccgcctaaaccagatccactcaaaatcacaaagggaaagctgggcggtccgaaagaaactccgcctaatggcaatctcagccccgccccaaggctgcggcgtgattattcatacgagcgcgtggggccaacctcatgtcgcggtaggggtcgcggggagtatttcgcacggggtaggggttttcgcgggacctacggagggaggggtcgtggggcacggtctagggaattccgatcctatagagagttccgaggcgacgatggccggggaggcgggaccggtgggcccaaccacccacccgcccctcgagggcgtactgcatccgaaacgcgatccgagggatctgagtatgaggagatacccaagaggcggaggcaaagagggagtgagactgggtcggaaacccacgagtcagacctagcaccgtcagacaaggaggcccctaccccgaaggaaggaacgctgacccaagttccacttgctcctccccctcccggagctccaccttccccagcaccagcccgcttcacagcacggggcggcagggtgtttactcctagaggtgtcccgtcacgaagggggagaggtggcggaaggcctcctcctcaggtctgtcctgggtggtctcccccagcaaaaagtcttgctcccaagaagcccccaacgggccctttgccaccgagtaaggagccacttaaggaaaaattgattcctggtcctctctctccagtcgcaagaggtggctcaaatggtggcagcaacgttggtatggaagacggcgaaaggcctcgacgtaggcgtcacgggcgcgcccagcagcaagataagccccccaggttcagacgtctcaagcaggagcgggagaatgcagcccgtgggagcgaggggaagccatctctgaccttgcctgcgagcgcaccaggaccagaggaggccttgacgaccgtgacagtggctcctgccccccggagagctgccgctaagagtcctgacttgtccaatcagaatagtgaccaagccaacgaggaatgggagactgcgtcagagtcctccgatttcacttccgagcgcagaggagataaggaagcacctccaccagttctgctgactcccaaagcagtaggcacacccgggggaggcggagggggggccgtaccgggcatatcagccatgagccgcggtgacctatctcaaagggctaaggatctgtccaagagatccttttcatcccagcggcccggaatggagagacaaaatcggcgtccaggccctggaggaaaagcaggatcatctgggtctagtagtggtggcggtggtggtggaccaggcggccgcacgggacctgggaggggcgataaacggtcttggccttctccaaaaaaccggtcacgtccccctgaagagcggccccccggattaccactgccaccacctcctccctcctcctccgcggtcttccgccttgaccaggtgattcactccaaccccgccggcatacaacaggctctggctcagctctccagccgacaggggtccgtgaccgcccctggaggtcatccccggcataagccgggcctgccgcaggcaccacaagggccaagccctcgtcctccgacacggtatgaacctcagagggttaactccgggctgtccagtgacccgcatttcgaggagccaggccctatggtgagaggtgtggggggaacacccagagacagtgcgggggtgagtccctttccaccaaagcgcagggaacgccctcccaggaagcccgaactgctgcaggaggagagcctgcctccaccccattcttccggctttctgggctcaaagcctgaaggccctggcccccaggctgaatccagggatacgggaacagaggcgcttacaccccacatctggaaccgtctgcacacagccacatccagaaagagctacaggccaagttcgatggagccttggatggagccactcagtccgttcgaggatgtcgcaggcacagaaatgagtcagagtgacagtggtgtcgacctctctggagactctcaggtatccagtggaccatgcagtcagagatcatcccctgacggagggctaaagggcgcggctgaaggaccccccaaaagaccaggcggaagctctccactaaacgccgtcccttgtgaggggccacctggatcagagccacctcgccggcctccccccgcaccccatgatggtgacaggaaggagctgcctagggagcagcctctgccaccagggcctatcgggacggagcgatcgcagcgcactgatcggggtacggagccgggacctattcgaccctcccatagaccaggaccacctgtgcagttcggaactagtgacaaagatagcgacctcagattggttgtgggtgacagcctgaaggcagaaaaagagttaactgccagcgtgactgaggccatccctgtgtcacgggactgggagctgcttccatccgctgcggcctcagctgaaccccaatctaaaaatcttgattccggtcattgcgtgcccgaaccctcttcgtcaggacaaagactctacccagaagtcttttacggctcagctggcccctcgagcagccaaatatcaggaggcgcaatggactcccagcttcaccctaacagtggcgggtttcgccctggcaccccttcactgcacccatatcgatctcaaccactctatctgccacctggtcccgcgcctccaagtgccctgctgagcggcctggcccttaaaggacaattcctcgattttagcacaatgcaggccaccgagctgggaaagctgccagcgggcggtgttctgtatcctcctccaagtttcctgtattcacctgcattctgccctagcccgctcccagacacctctctcctgcaggttcgccaggacctccccagtccttccgacttctattcaacgcccttgcaacccggtgggcaatcaggttttttaccttccggcgctcctgcacagcagatgctacttcccatggtcgacagtcagctgccagttgtaaacttcgggtcgctgcctccagccccccccccggcacctccaccgctgtcactgcttcctgtcggcccagccctccaacctccttctctcgctgtccggcccccacccgcacccgcgacgagagtcttaccgtctcctgcccgaccctttccagcctccctggggcgcgctgagctgcacccagttgagttgaaaccctttcaggactaccaaaagctgtcttcaaatcttggaggtccgggatcctctaggaccccccctactggccggtcgtttagtggcctcaattctcgcctgaaggctacacccagtacttactccggagtcttccgaacccaaagagttgacctctatcaacaggcatctcccccagatgccctaaggtggatcccaaaaccttgggagcgtactggcccgccccctcgggagggcccctcaaggagagccgaggaacctggttcaagaggagacaaggagccgggacttccgccccctaggtag

SEQ ID NO: 130029 - DNA, 4149 bp, Artificial Sequence
  Description of Artificial Sequence: Synthetic coding sequence
atgctgcgcgagcggggtacccctcctgtggatcccaagcttgcctgggtgggagatgtgtttaccgccaccccggccgaaccccgcccactaacatcccccttgagacaggcagccgatgaggatgacaaaggcatgcggtctgaaaccccccctgttccccctcctcccccatacctggccagctacccaggttttccagaaaatggcgcccctggccctcctatctcacgctttccgctcgaggaacctgggccccgaccactgccttggcctccaggttccgacgaagtggctaagatccaaacccccccaccaaaaaaggagccccctaaagaagaaacagcccaactgacaggtccggaggctggaaggaaacctgctagaggcgtggggtccgggggccaaggtcctccaccgccccggcgcgagagtcgaacagaaaccaggtggggcccccggcccgggtcatcgaggaggggtatacctcccgaggagcccggagctccgccaaggcgcgcaggacccataaaaaagccacctccaccaacaaaggtggaagaactgccacctaaacccttagaacagggtgacgagaccccaaaaccacctaagccagatccccttaagatcaccaaggggaagctgggaggtcccaaagaaaccccccccaacggcaatctaagtccagcacctagactgcgaagagactatagctacgagcgggtaggacccacctcgtgcagagggcgtggtcggggggaatatttcgcccgcggacgcggattccgtggtacttacggcggacgtgggcggggggccagatcccgagaattccgttcatatcgtgagtttcggggcgacgatggaagaggcgggggcaccggcggccccaaccacccccccgctcctaggggccggactgcctccgaaactagatccgagggcagcgagtacgaggaaattccaaagaggagacggcagcggggatcagaaaccggcagtgagacacacgaaagtgatctggcaccttctgacaaagaagctccaactcctaaagaagggacgctgacacaggtgccactggcccctccaccaccaggggcccctcccagtcccgcaccagccaggtttaccgctagaggaggtcgggtgtttactcccaggggagtaccatcacgacgaggacgtggcggagggagacccccaccacaggtttgccccggatggtcccctcccgctaaaagtttggccccaaagaagcctcctaccggccccctgccgccgtccaaggagcctctcaaggaaaaactgattcccggacctctcagcccagtcgcccgggggggtagcaatggagggtccaacgtgggcatggaagatggggagcggcctcggcggcgacggcacgggagggcacaacagcaggataaacccccaaggttccgtcgcttaaagcaggagagagagaatgctgccaggggatccgaaggaaaacccagccttacactccccgccagcgctcccggacccgaagaagctttaactacggtcaccgtcgcccccgccccgagaagagcagccgcaaagagccccgacctgagcaaccagaattcggatcaggccaacgaagaatgggaaacagcgagcgaatcctcagacttcactagcgaaagaaggggcgacaaagaggcacctccccccgtgctgcttactcccaaggccgtggggacacctggaggcgggggggggggagcagtgcctggaatcagcgcaatgagtcgtggggacctgagccaaagggctaaagacctcagcaaaaggagcttctccagccagagacctgggatggagcgacagaacagaagacctggtcctggcgggaaagcaggaagttccggctccagttccggagggggcggagggggtcccggcggccgaaccggacccggcaggggagacaagcgatcttggccctcgcccaagaatcggagtcgcccacccgaagaaagacccccaggtctgcccctccctccaccaccaccttctagcagtgcagtttttaggctggaccaagttattcactccaatccagctggaatccagcaggccctcgcccagctgtccagtagacagggcagtgtcaccgctcctggagggcacccacgccataaacccgggcttccccaggcccctcagggtccttccccacgacctcccacgagatacgagccacaacgggtaaatagcggactttcatccgatccccactttgaggagcctggtccaatggtgagaggagttggagggacccccagggattctgcaggtgtcagcccttttccccccaagagaagagagcgccccccaaggaaacccgaattgcttcaggaggaatctctgccgccacctcacagctctgggttcttagggagcaagcccgagggaccaggcccacaagcagagtctcgcgatacgggtaccgaagctctaaccccccatatttggaacaggctgcatactgctacatcacgtaagagctatagacccagtagcatggaaccatggatggagccccttagcccctttgaagatgtagccggaacagagatgagccaaagtgatagcggggttgacctgtctggcgattctcaggtctctagcggtccctgctctcagcgcagctctccagatggcgggctcaagggtgctgctgaggggccacccaagaggcctggtggcagctccccactgaacgccgtcccatgcgagggccctcctggtagtgagccaccgcggcgcccccctcccgcccctcatgacggggatcgtaaggagctccctagggaacagcccttgccccctggccccattgggacagaacgctcacagcgcactgacagaggcactgaacctggacccattcgcccgtcacacagaccaggcccaccagtgcagtttggcacatctgataaggattctgatttgcggctcgtggtgggtgatagcctgaaggctgagaaggagctgactgcttctgtaaccgaagctattcccgtttctagagattgggagctgctgccttctgctgccgcatccgctgagcctcaatccaaaaacctcgacagtggccattgtgtccctgagccctcctcttcagggcaacgcctgtatcccgaagtgttctatggaagcgctggccccagctcaagccagatatctggtggcgccatggattctcagttacaccctaattcaggcggctttcgcccgggcacaccttcactgcacccttaccgaagccaaccactgtatctgcctcctgggccggctcccccgtccgctcttctgagcgggctggctctcaagggccagttcttggatttcagtaccatgcaggctaccgagcttggcaagctgcccgctggtggagtgctctacccgccaccgtcttttctctattcacctgccttttgccctagccccttaccagataccagtctgttgcaggtgagacaagacctaccttcgccttccgacttctactcaactccgctccaaccaggcgggcaatctggcttcctcccgtcaggggctcctgctcagcaaatgttgctgccaatggtggattctcaactgccagtcgtaaacttcgggtcactgccccctgcccctccccccgctccaccaccactgagcttgctgccagtggggcctgccttacagcccccttctctggccgtccgccccccaccggctcctgcaacgagggtgctcccgtcccctgcccgaccattcccagcctcactaggccgtgctgagttgcatcccgtagagctcaagccgtttcaggattatcaaaagctgtcctctaacctcggtggccctggaagctcccgaactccccccactggacgcagtttcagtggcctgaatagccggctgaaagccaccccatctacttactctggagtattccgcacacagcgcgttgacctgtaccagcaagcgtcccctccagacgccctgagatggatccccaaaccttgggaaagaactggtcctcccccccgggaagggccatctcgacgggccgaagaacccggaagcaggggagacaaggagcccgggctccctccacctcggtag

SEQ ID NO: 130030 - DNA, 6474 bp, Artificial Sequence
  Description of Artificial Sequence: Synthetic coding sequence
atgtccgaccgctccggacccacagccaaaggcaaagatggaaagaaatatagctcactgaatctctttgatacatacaagggcaaatctttagaaattcagaagccagctgtggcaccacggcacgggctgcagtcgctaggaaaagtggccattgctagaaggatgccaccccccgctaacctgccaagcctgaaagcggagaacaaaggaaacgaccccaatgtgagtttggtccctaaggacggcacgggctgggcctcaaaacaggagcaaagcgaccctaaaagctccgatgcttcaactgcgcagccacccgaatcccaaccactgcccgcatcgcaaacaccagcatctaaccagcctaagcgtcctcccgcagcccctgagaatactccactcgtgccttcaggcgtgaaatcatgggcacaggctagcgtaactcatggagcccatggcgatggaggccgggcctcctctctcctgtcccgattctcgagagaagagtttcctacattgcaggccgccggagaccaggataaagctgcgaaagagcgcgaatcagcggaacagtcaagcggaccggggcctagcttgagacctcagaatagtacaacgtggagggacggcgggggccgcggtcctgacgagctcgagggccctgacagtaaattacaccacggccacgacccacggggtggtcttcagccctctggcccgcctcagtttccaccttatagagggatgatgccacccttcatgtatcctccatatttgcccttcccccctccttacgggccacaggggccataccgctaccccacccccgatgggcctagtcgtttccctagagtcgctggaccccgcgggagcgggcccccgatgcgtctcgtggagcctgtagggcgccctagcattctgaaggaagacaatctgaaggaattcgatcaactggatcaagagaacgacgatggctgggccggagcccacgaggaggttgactataccgaaaagttaaaattttccgacgaagaggacggccgggactctgacgaagagggtgctgaaggacatagggactcgcagtcagcatccggagaagagcggcctcctgaggctgatggcaagaaaggaaactccccaaacagtgagcctcctacgccaaaaacggcctgggccgaaacgtcacggccaccagaaacggagcccggtccgccggctcctaaacctcccctacccccacctcacaggggccctgcgggaaactggggtccaccaggcgattatcccgaccgagggggtccaccttgtaagcctcccgcccctgaagacgaagatgaagcatggcgccagcggcgcaaacaatctagcagcgagatcagcttggcagttgaacgtgcccgtcggcggagggaagaagaggagaggaggatgcaggaagaaaggcgcgctgcctgcgccgagaagttgaagcgcctagacgaaaaattcggagctcctgataaaagattgaaagcagagcctgcggcccctcccgccgccccaagtactccagcgcctccgcctgctgtgccaaaagagctgccagcaccgcccgccccaccccctgcttccgccccaaccccggaaacagaacccgaggaaccggcccaagctccaccggcacagtcgacgcctacccctggggtggcggctgccccaacgttggttagcggcggagggagtacatcgagtaccagttccgggagcttcgaagccagccccgtggagccacagcttccatccaaggagggccctgagcccccagaggaagtgcctccccccactacacctcctgttccaaaggtcgagccaaagggagacggtataggcccaaccagacaacccccaagccaaggattgggctaccccaaatatcagaaaagcttacccccacgcttccagagacaacaacaagaacagcttttaaagcagcagcagcaacaccagtggcaacagcaccaacagggaagcgcccctccaacacctgtccctccaagcccaccgcaaccagtgactctgggagccgtccccgctccacaggcgccccccccaccaccaaaagccttgtatcctggggctcttgggagacctccccctatgccacctatgaacttcgatcctagatggatgatgattcctccttacgtcgatcctcggctgctccaggggcggccacctcttgacttctatcccccaggcgtacatccctccggtctcgtgcctagggagcggtccgattctggaggcagctccagtgaaccgttcgaccggcatgcgccagccatgctgcgtgagagaggaactccgcctgtcgatccaaagcttgcctgggtcggcgacgtgttcactgctaccccagctgaacctcggcccctgacgagtcctctcaggcaggccgctgatgaggatgacaaaggaatgcggtcagaaaccccacctgttccacctcctcctccgtatctcgcctcttaccctggattcccagagaatggagcaccaggccctccgatcagcagattccccctggaagaacccggaccacgacccctgccctggcctcctgggagcgacgaggttgccaagatccagacaccacccccgaagaaggaaccccctaaagaggaaacagcccagctcactggccccgaggcagggcgcaagccagcacggggcgtgggcagtggcggtcagggcccacctcctcccagaagggagtccagaacagaaacacggtgggggcctaggccggggagttctcggcgaggaattccgcctgaagagcccggagctcccccccgccgggccggccccatcaagaaacctcccccaccaacgaaggtggaagagctgcccccaaagccactcgagcagggcgatgaaacccctaagcctcctaagcctgaccccctgaagattacgaagggaaagctgggcggacctaaggagactccaccaaatgggaacctctcccccgccccccgtttacgccgtgactattcttacgagcgggtgggtcccacaagttgtaggggcaggggccggggtgaatatttcgctcgcggcagggggttccggggcacctacgggggcaggggacgtggcgcacgatctcgcgaatttagaagctaccgagaattccgcggggatgatggccggggcgggggaacagggggtccaaatcatcctcctgcacctaggggccggactgccagcgagacccgatccgagggctctgagtatgaagagatacctaagcggcggagacagcgtggctcagaaactggctccgagactcacgagtccgatttagccccctctgacaaggaagcacccacacccaaggagggcaccctcacccaagtgcccctggcccccccccccccaggggcacccccctctccggccccagctcgtttcacagctaggggcggccgtgtgtttaccccacgcggggtaccgtccaggcgcggcagaggaggaggcagaccacctcctcaagtatgtcccggctggtcacctcccgctaagagcctggccccaaagaaacctcccaccgggcccttaccaccctccaaagagcctctgaaggaaaagcttatcccaggacccttgtctccagttgccaggggcggaagcaatggtggctctaatgtcggaatggaagatggtgagaggcctcggagacgccgacatggcagggcgcagcaacaagataagcctcctcgctttagaagactaaaacaggagcgcgagaacgcagcccggggcagtgagggtaaaccatcgctgacattgcccgcatcagcccctggacctgaggaagccttgacaaccgtgacagtcgccccagcccctagacgcgcggctgccaaatcaccagacctgagtaatcaaaattccgaccaggccaatgaggagtgggaaactgcgagcgaatctagtgatttcacgtcggaacgccggggggataaagaagctccccctcccgtcctgcttactccaaaagcagtgggtacacccggcggaggaggagggggcgccgtgcctggcatttccgctatgtcaagaggggacctctctcaaagagccaaagatctatccaagaggagcttttcatctcagcgtcccggcatggaaaggcagaatagacgtccgggccctggcgggaaggcaggctccagtggctccagctctgggggcggtggcggaggtccaggaggtcggaccggacctgggagaggcgacaagcggagttggccatctcctaaaaatagaagtagaccacccgaggagaggccacctggcctccccctcccccctccccccccttccagctccgcggtgtttcgcctggatcaagtaatacacagcaacccagccgggattcagcaggcactcgcacaattgagtagtaggcagggttccgtaacagccccaggaggacatcctcggcataagcccgggttaccccaggcccctcagggaccctctccccggcctcctacacggtatgaacctcagcgggtgaattctggtctgagctccgatcctcattttgaagaaccaggtcctatggttcgtggagtgggcggcactccccgcgattcagctggtgtgtcgccatttcccccaaagcggcgtgagcggccaccacgaaagcccgagctcctgcaagaagagagcttaccgcctccgcactcatccggcttcctcggatctaagccagagggaccaggaccccaggccgagagccgagacactggcaccgaggccctgaccccccacatttggaacaggcttcacacggccacttctcgaaagtcatatagaccctcatcaatggaaccatggatggagcctctgagtccattcgaggacgttgccggaactgaaatgagccagtccgacagcggtgtagacctttctggtgattctcaggtgtctagcgggccttgttcacaaaggtccagtcccgacggcggtcttaagggtgcagccgagggacctccaaagcgccccggcggaagctcaccacttaatgcagtgccttgtgagggaccccctggctccgaacccccccggagacccccccccgccccgcacgacggcgacagaaaggaattgccacgagaacagccgctgcccccaggccctattggaacagaacgctcccagcggactgaccgaggtacagaaccggggcccataagacctagtcacaggcctggacccccagtgcaatttggcactagtgataaggacagcgacttgagactcgtcgtaggggatagtctgaaggcagagaaagaactcaccgcaagcgtaactgaggccatccctgtctctcgggactgggagctccttcccagtgcggccgcctcagccgagccacaatcgaaaaacttggatagcggccactgcgtcccagaaccgagctccagtggtcagcgtctgtaccctgaggtgttctacggttccgctgggccaagctcctcccaaataagtggcggggccatggatagccagctacatcccaatagtggcgggttccgacccggtacgccatccttacacccttaccgatcacaaccactgtaccttcctcctggccccgcaccccccagcgcactgctcagcggtttggctcttaaaggacaattcctcgatttctccaccatgcaggccacggaactaggtaagttgccagccggcggggtcctctatccacccccgtcctttctatatagcccagccttctgcccgagcccgctgccggacacaagtttgttacaggtcagacaagatctaccatcccccagtgacttctattccactcctttgcagcctggcggccagtccggattcttgccctcaggagctccagcacaacagatgctcctccccatggtggattcacagctcccggtcgtaaactttggatctttaccaccggcaccaccacccgctccccccccgttaagcctgttgccggtgggcccagcactccagcctccgtccctggcagtgcgcccgcctccagcccctgccacccgcgttttgccttctcctgccaggccttttcccgcctcgctggggcgcgccgagcttcaccccgtcgagcttaagccttttcaggattaccagaaactgagcagcaatctgggtggccctgggtcgtcaagaaccccacccaccggacgatctttctctgggttgaactctcgcctcaaggctactccgtcgacctactcaggagtattccgaacccagcgagtcgacttgtatcaacaagcatctccgcccgacgccctgcggtggattccgaaaccttgggagcgcacaggccctccacccagggagggaccctctaggcgcgcagaagaaccaggatcacgaggcgacaaagaaccgggcctcccccccccccgctag

SEQ ID NO: 130031 - DNA, 6474 bp, Artificial Sequence
  Description of Artificial Sequence: Synthetic coding sequence
atgtctgacagatcaggccctactgctaaagggaaggatggcaaaaagtactcttctctgaatctgtttgatacctacaaagggaagagtctagagattcaaaagcctgcggtcgcgcctaggcatggcctacagagcctggggaaggttgccattgccagacggatgcccccacctgcaaaccttcctagtctgaaagctgagaacaaagggaatgacccaaacgtcagcctggtaccgaaagacgggaccgggtgggcttccaaacaagaacagagcgatccgaagtccagcgatgcatctaccgctcaaccccctgaatctcaaccacttccagctagccagactccggcgagcaaccaacccaagcgccctccagcagctcctgagaatacccctcttgtcccgagcggtgttaaaagttgggctcaagcctctgtgacccacggggcacatggcgacggcggtcgagcttcatctctactaagtcgcttcagtagagaggagttccccacactgcaagccgccggcgaccaggacaaagccgcaaaagagcgcgaaagcgccgaacagtcaagtggtcccgggccctcactccgacctcagaacagcaccacgtggcgcgacggcggggggcgcgggcccgacgagcttgaggggcctgacagtaagttgcaccatggtcacgatccccgtggaggcctgcagccgtccggccctccccagttccccccctaccgaggcatgatgcctcccttcatgtacccgccttatctgccatttccacccccttacggcccgcaagggccttaccgctaccccacacctgacggaccaagtcggttccctcgcgtggctggccctcggggaagcggacctcctatgaggctcgtggagccagtcgggcgaccctctatcctgaaggaggataacttgaaagaattcgatcagctggaccaggaaaatgacgacggatgggccggggctcacgaggaagtcgactatacagagaagttaaagttttccgacgaggaagatggtagagacagcgacgaagagggagccgagggacatcgggactctcaaagcgccagcggtgaagaacgtccgcccgaagcagatggtaagaaggggaattcaccaaactctgaacctccaacccccaaaactgcttgggctgagacgtctaggccgcctgaaactgagccgggaccacccgctcccaagccccctctgccgccacctcaccgcggacctgcgggcaactggggccctcctggggattacccggatcggggcggccctccctgcaaaccccctgctcctgaggatgaagatgaggcctggcgacagaggcgcaaacagtcttcatccgagatatctctcgcggtggagcgtgcacggaggcggcgggaagaggaggagaggcgcatgcaagaggagcggagggccgcatgtgccgaaaagctcaaacgactggatgaaaagtttggagctcccgacaagcgactcaaggctgagcccgccgctcctcctgccgcgcccagcacccctgcccccccaccagcggttcctaaggaacttccagccccaccagcacccccaccagcttccgctcccacacctgaaaaagagcccgaagagcccgcccaggccccccctgcccagagcacacctacacccggcgtagctgccgctcctacattggtcagtggtggtggtagcacttctagtactagcagcggaagcttcgaagcatctccagttgaacctcagctcccgtccaaggaaggcccagagccccccgaggaagtgcctccccctacgacaccaccggttcctaaggtcgaaccaaagggggacggaatcggccccacccggcagcccccttcccaggggctgggttacccaaagtaccaaaagtccctgcctcctaggttccagagacagcagcaagagcagctgttgaagcagcagcagcagcatcaatggcaacagcatcaacaggggagtgccccaccaacccccgtgcctcccagccctccacaacctgtcactcttggtgcagtaccagcacctcaagctcctccacctccacctaaggccctctacccaggagccctgggacgcccgccccccatgccccccatgaattttgacccccggtggatgatgattccgccatatgtggatcctaggctcctccagggccgcccacccttagatttttatccccccggggttcacccatccggtctggttccacgtgagcgatccgactcaggcgggagtagttccgaaccttttgatcgacatgcccccgcaatgctccgcgagaggggcacaccgcccgtcgaccccaagcttgcgtgggtcggagacgtgttcactgcaacacccgctgaaccacgacctctcacaagtcctctgcgccaggccgcagacgaggacgataagggcatgcgttccgaaacgcctcccgtgccacccccccccccgtatctggcctcttaccctgggttccccgagaacggtgcacccggccccccaatctcccgatttcccctggaggagccaggtccaagacccctgccatggcctccaggcagtgatgaggtggccaagatccagactcctccccctaaaaaagaacctcctaaagaagagacagctcagctgaccggccccgaagctggcaggaaacctgctagaggagtgggctcaggagggcagggaccccccccaccccgtagggagtcgagaactgagactcggtggggcccgcgtccgggcagtagcaggcgcgggatcccacccgaagaaccaggtgccccaccgcggcgcgcgggccccattaaaaagcctccgccccctacgaaagtggaagaattgccgcccaaaccactggagcaaggggacgagaccccaaaaccaccaaagcctgatcctctgaagattaccaagggtaagctagggggaccaaaggaaaccccaccgaacggcaacctgtctccagctccaaggctgagacgggactactcctacgagcgcgtcggtccaactagttgtcgaggccgaggcagaggggagtattttgcccggggcagaggctttagaggaacctacggtggtagaggcaggggcgccagatcaagagagttccggtcctatcgggagttccgaggcgacgacggacgcggcggaggtacaggaggcccaaaccacccccccgctccgcggggccggacagcctccgagacaaggtctgagggttcagagtacgaagaaataccaaagaggcgacgccaaaggggcagtgagaccggatccgaaacccatgaatccgatcttgctccaagcgataaagaagcacctacgcccaaagaggggacgcttacccaggtacccctggcccctccccccccaggcgctcctccaagccctgcacctgctcggtttaccgcccgtggcgggagggtctttacccctcggggggtaccctccaggcgcggtcgaggcggaggacggccccctcctcaggtgtgccccggatggtccccacctgcaaagagtctggcacctaaaaagcctccgaccgggcccctgcctccatccaaggagcctctgaaggagaaactcattcctgggcccctgagtcctgtggctcgtgggggcagcaacggtggaagcaatgttggcatggaggacggcgaacgtcctagaaggcgacgccacggccgagcacagcaacaagataagccacccagattcagaagattaaaacaggaaagagagaatgcggctcggggaagtgagggaaaaccaagcctcacattgcctgcatcagcacccggccccgaagaagctctgactacagtgaccgtggccccggcgccacgtagggccgccgccaaatcaccagacttgagtaaccaaaattccgaccaggccaatgaggaatgggaaacagcatcagagtcgagtgacttcacatccgagagacggggagataaggaggcccctccgcctgtcttgcttactcccaaggccgtgggcacaccaggaggcggaggggggggggctgttcctggaatatctgctatgagccgaggcgatttatcccagagggcgaaggacctgtccaaacgtagtttcagttcacagcgcccaggtatggagaggcagaatcggcggcccggcccaggaggtaaagccggctcctcgggttcctcgtccgggggggggggcgggggaccgggcgggcgcaccggtccaggacgcggggataagcgttcgtggccctcccctaaaaaccgctctagaccccccgaagagaggccacctggcctgcctcttccccccccccccccgtcctcttccgccgtcttccgccttgatcaagtgatacacagtaaccctgccggaatccaacaggcactcgcacagctgtcctcacgccagggctccgtgactgcacccggggggcatccacgccacaagccgggacctcctcaggccccccagggcccaagtccacggccaccgactcgctacgagcctcagagggtcaactctgggctaagttctgacccacacttcgaagaaccaggtccaatggttcgcggggtcggcggaacaccaagggatagcgcgggagtctctcccttcccaccaaaaaggagagagcggccaccccggaaacctgagctcctacaagaggaatccctgccacctccacacagcagcggctttctaggatccaaacccgaaggcccggggcctcaagccgaaagccgtgatactggtacagaggcgttgacccctcacatctggaacagactgcacaccgccactagcagaaaatcgtacagacccagcagcatggagccatggatggagcccctgagcccttttgaggatgtggctggcacagagatgtctcagagcgacagtggggtggatctcagcggagattctcaagttagtagtggcccgtgttcgcagcgctccagccccgacggcggcctgaagggagccgccgaaggcccccctaaacgtcccggagggtcttcccctctgaacgccgtaccttgcgaaggcccaccgggttcagaacccccccgcagacctcctccagctcctcatgatggggacaggaaggagctgcctcgcgaacaaccgcttccacccggccccattggaacagagcgaagtcagcacaccgaccgcgggactgagcctggtcccataagaccctcccaccgtcctggccctcctgtgcagttcggcacatcagataaggactctgatctacgattggtcgttggagattccttgaaggccgaaaaagagcttactgcgagtgtaaccgaagccatcccggtttcccgcgactgggagctgctgccctccgctgccgctagcgctgagcctcaatccaaaaacctggactctgggcattgtgtacctgaaccatcctcatcaggtcaacgattgtaccctgaggttttttatggcagcgccggacccagctcttctcagatctctggcggggctatggattcacagctgcatccgaattcagggggctttaggcctggcacaccaagtctgcacccttacaggtcacagcctttgtatttacctccggggccagccccaccttcggccctgctgtccggtgttgcattgaagggacagtttctggatttctccaccatgcaggccacggagctgggaaagttgccagcgggcggcgtgttgtatcctcccccgtcctttctgtattcgccggccttctgcccttcacccctgcctgatacatccctgctgcaggtgcgccaggacttgccttcccctagcgacttttattccacccctttacaaccgggcgggcagagcgggtttctcccctctggagcccctgcccagcagatgttactgcccatggtggactcccaattgcccgtggttaactttggtagcctcccacccgcacccccaccagccccaccctccctcagcctgctcccagtcgggccggcactccagccacccagcttggccgttagaccccctccagcccccgccacgcgagtcttgcctagccccgccaggcccttcccggcaagtttaggtcgagctgagcttcatccagtggagctaaagccattccaagattatcaaaagttgagttctaacctcgggggccctggatcctctcgtaccccgcctaccggcagatcttttagtggtttaaacagccgccttaaggccaccccaagcacctattctggcgtttttcgcacacagagggtggatctataccagcaggcctcccctcccgatgcgttgcggtggatccctaaaccatgggaaagaacgggacccccccctcgggagggccctagtcggagggccgaagagccaggcagcaggggagataaagagccaggcttgccccccccgcgctag

SEQ ID NO: 130032 - DNA, 6474 bp, Artificial Sequence
  Description of Artificial Sequence: Synthetic coding sequence
atgtctgaccgaagtggtcccaccgctaaaggcaaagatggtaaaaagtattcttctctaaacctctttgacacctataagggaaagtcactggagatccagaagcccgccgtcgccccacgtcatggcctccagagcctgggcaaagtagcaatcgctcgtagaatgccaccccccgcgaatctccctagccttaaggccgagaataagggtaacgacccgaacgtcagcctagttcccaaggatggaaccggatgggcatccaagcaggaacagagcgaccctaaaagtagtgacgcaagtacagcccagcctcccgagtctcaacctctccccgcctcacagacccctgcatctaatcaaccaaaaagaccacccgccgcaccagagaatacacctctcgtgccatcaggggttaaatcttgggctcaggccagcgtaactcacggcgcccacggagatggtggtcgggcgagctccttgctgagccgtttctcacgtgaggaatttcccacgttacaggctgcaggagaccaggataaagccgccaaagagcgagaatcagcggaacagtcatccggtcctgggccatctctgagaccccaaaatagtaccacctggagggacggagggggcagggggcccgacgagctcgagggacccgatagtaaattgcaccatggccacgaccccagaggggggctacagccaagtggtcctcctcagttccccccataccgtgggatgatgcctcccttcatgtacccaccttatctccctttccctcctccatacggtccccagggaccctataggtaccctacacccgatggaccgtccaggttccctagagttgcaggcccccgtgggagcggacctccaatgcgcctagtggaaccagttggtcgccccagcattttaaaggaagataacctgaaagaattcgaccagttagaccaggagaacgacgatggttgggcaggggcccatgaagaagtggactacactgagaagcttaaattctcggacgaagaagacggtcgggatagtgatgaggaaggggcggaaggccacagggacagccagtcggcttccggagaggaacggccccccgaagcggatggcaagaaggggaactcaccaaactctgagccacccaccccaaagacagcgtgggccgaaaccagtagaccccccgaaaccgaacccggcccacctgcacctaaaccccccctgcccccacctcaccggggccccgcgggcaactgggggccgccgggggactacccagaccgagggggccccccatgcaaacctccagcacctgaagatgaggacgaagcgtggcgtcagcggcgtaagcaatcaagttccgaaattagcttggccgtggaaagggcacgtcgacggagagaggaggaggagaggcgaatgcaggaggaacgtcgagccgcgtgtgccgagaagctgaaaaggcttgacgagaagttcggggctcccgataagcgcctaaaggccgaaccagctgcccctcccgccgctccatcgacgcccgctcccccgcccgctgtgcccaaggaacttcccgcacccccggcccccccacctgcgtccgcccctactcccgaaaaggagcccgaagaacctgcacaagcaccccctgcacaaagcacacctaccccaggtgtggccgccgctcccacactggtctcaggaggaggctctacaagctccacttcgtcaggcagcttcgaagcgagtcctgtcgaaccccagttgccctccaaagaaggtccagaaccacccgaagaggttcccccccctacgacaccccccgttcccaaagtagaacctaagggcgacggcattgggcccactcgacagccacctagtcagggcttggggtacccgaaataccagaagagtctgccaccgcggtttcagaggcagcagcaagagcagctgctaaagcagcagcaacaacaccaatggcagcaacaccagcagggaagcgcccctcccacaccggttcctcccagtccaccccaaccagtgactttgggcgcggttccagccccacaggctccaccacctccccctaaggccctgtacccaggagcacttgggagacccccacccatgcctccaatgaactttgaccctcgctggatgatgatccccccctacgtcgacccgaggctcctgcagggtcggcctcctttggacttctaccccccaggcgttcatcccagtgggctggtgccacgcgaaaggtcagactctgggggatcctccagtgagccttttgacaggcacgcaccagctatgctgcgcgagcgaggaactccacctgtagaccctaaactagcatgggtcggcgatgtctttactgccacaccagctgaacctcggcccctcacttcacctttacggcaagcagccgacgaggacgataagggcatgcgaagcgaaacgccgcctgttcctcccccccccccctacttggcgtcctatcccggcttccccgagaatggggctccgggccccccaataagcagattcccactagaagagccaggaccgagaccccttccgtggccacccggttcagatgaggtcgccaagatccagacaccaccacctaaaaaagagccacccaaggaagaaaccgcccagctcacaggacccgaagccgggagaaagcccgctagaggagttgggagcggtggccagggtcctcctcccccacgacgcgagagtcgcaccgagaccaggtggggcccacggcccgggtcaagtaggcggggcatcccccccgaggaaccaggggctccgccgaggagggcaggacctattaagaaaccaccacccccgacaaaggtggaagaactgcctccaaaaccccttgagcagggagacgaaacgcctaagcccccgaaaccagaccccctgaagattactaaggggaaactcggcgggccaaaggagacacctccgaatggtaatctgtctcctgctccaagactccgtagagattattcatatgaaagagtgggccccacctcctgtcgcgggcgcggccgtggtgagtattttgcccgcggccggggatttagaggaacatacggcggacgcggcagaggcgcacgtagtcgcgagtttaggtcctatcgggaatttcggggagatgatggtcgtgggggggggacggggggccctaaccatccccccgctcctcgggggagaaccgcctctgagactcgcagcgaaggaagtgaatatgaggaaatcccaaagcggcgccgccagcgcggaagcgaaacgggttcagagacacatgaatctgacctagctccatccgacaaagaggcaccaaccccaaaggaaggcacactgacacaagtgccccttgcccccccaccccccggggcccctccgtcgccggcgcctgctcgcttcactgcaaggggaggaagagtcttcaccccgcgtggggtcccctcacggagagggcggggcggtgggcgaccccctcctcaggtttgccccggttggtctccccccgcaaaaagtttagctccgaagaaacccccaacaggcccgttgcccccgtccaaggagcccctcaaggaaaaactcatcccggggccactcagccccgtcgccagggggggatctaacggcggaagcaatgtaggcatggaggacggcgagcgaccaaggaggcggcgccatggtcgagcacagcagcaagataaacctccgcgcttccggcgcctgaagcaggaaagggagaacgctgcgcgaggcagcgagggcaaacctagccttacgctgcctgcgagcgcccctggcccagaggaggctcttacaaccgtcacagtggcacctgcaccccgcagggccgcagccaagtctcccgacttatcgaaccagaactctgatcaggcaaatgaagagtgggagactgcatcagaaagtagcgattttactagcgagaggaggggcgacaaggaagcaccgccccccgttctgctcacccctaaagctgtaggtacacccggcgggggaggggggggcgctgtccccggaatcagtgccatgagtagaggggatctaagtcaaagggccaaggatctgagcaagcgcagctttagctcgcagagacctgggatggagcggcagaaccgtcgccctggccctgggggaaaggctgggtcttccggctctagttccggtggtggggggggcggccccggcggacggaccggaccggggaggggagataagagatcctggccaagccctaagaatcgctccagaccacctgaggagcggccaccaggcctgcccctgccccctccaccccccagctccagcgccgtgttccggctggatcaggtcatccattctaatcccgcgggaattcagcaggccctggctcagctgtcgtcacgccagggcagcgtgacagctcctggtggccacccacggcacaagcccgggccaccacaggcccctcagggcccatccccacgccctcctactagatacgagccacagagagtcaacagcgggcttagctcggacccccatttcgaagagcctggtccaatggtgcgcggcgtcggtgggacgccacgcgattcagctggagtgtcccccttcccaccgaaaaggcgagaaagaccgccacggaagccagagttactacaggaggaatccttgccacctccccactcttccggcttcttagggagcaagcccgaaggcccaggtccgcaggcagagtctcgcgacactgggacggaagcgctaacaccacacatctggaacagactccatacagccacatctcggaagtcttatcgaccatcatcaatggagccttggatggagcccctgagcccttttgaagatgtggccgggacagaaatgtcccagtccgattcaggagtcgacttatcaggcgactcccaggtgtctagcgggccctgcagccagcgttcgagcccagacgggggactgaagggagcagctgagggccccccaaagagacccggaggttcgtcgccactcaatgctgtgccgtgcgaggggccacccggaagcgagccaccccgacgcccacctccagcccctcatgacggggaccggaaggagttacctcgggaacagcccttgccaccagggcccatcggaaccgagagaagtcagcatacagacaggggtacagagcctgggcccatcaggcccagtcaccggcccgggccccctgtgcagttcggcacctccgataaggacagtgatctcaggctcgtggttggggacagcttaaaggccgagaaggagctaaccgcctccgtgacagaggcgattcccgtgtctagggattgggaactgctgccaagcgcggccgcttccgcagaaccccagtcgaaaaacctcgattcagggcattgtgtgcccgagccctccagttctggccagcgtctgtatcctgaggtgttttacggctctgccggcccttccagtagtcaaattagcggaggtgctatggactctcagctgcatcccaattcaggcggctttaggccgggaacacctagtctacatccctatcgttctcagcctctatacctgcctcccggccccgcaccacccagcgcccttctatctggggtcgctctcaaggggcagtttctggattttagcaccatgcaagccactgaactcggtaaacttcccgcaggcggagtcttatacccacccccttcattcctgtactcacccgcgttctgtccatctccgctgcctgacactagtctgctgcaagtgagacaggacttaccttctcccagcgatttttatagtacccctctgcaaccaggaggccagagtggcttcctcccaagcggtgccccggcgcagcagatgctcctgccaatggtagactcccagctccctgtggttaatttcgggtccctgcccccagcaccacctcccgccccacctagcctctctttgttgccagtgggacctgccttacaacccccatccctcgccgtgcgcccaccccccgcaccggcgacacgagtcctaccatcccctgctaggccttttccagcatcactgggccgggcagagctccacccggtcgagctcaaaccgtttcaggattatcaaaaactgtcctcaaaccttggaggccccggaagctctcggacgccccctacagggcggtcttttagtgggttgaactctcgcctcaaggcaacgccgagcacgtatagcggcgtatttcgcacacagagggtcgacctgtaccagcaggcaagcccgcctgatgccttgcgctggatacctaaaccctgggagagaaccgggccaccgccgcgcgagggcccctcaaggcgtgctgaagagccaggcagtcggggagacaaggagccagggctgccacctcctcggtag

SEQ ID NO: 130033 - DNA, 6474 bp, Artificial Sequence
  Description of Artificial Sequence: Synthetic coding sequence
atgtcagaccgcagtggaccaaccgcaaaaggtaaagacgggaagaaatattccagtctgaacctgttcgacacctacaaaggaaagtcactagagatccagaagcccgctgtcgcaccccgccacggacttcagtctttaggcaaggtcgctattgcccgtcggatgccccccccagctaacctgcctagcttgaaggccgagaacaagggcaacgatcctaacgtgagtttggttcccaaggatggcacaggctgggctagcaaacaggaacaatccgaccctaagtctagtgacgcctccaccgctcaaccaccagaaagtcagccattaccagcttcacagacccccgcctccaatcagcccaagagacccccggcagcccccgaaaacaccccactggtgcccagtggggttaagagttgggctcaagcatccgtgacccacggcgctcacggtgacggaggaagggcttcttccctgctgtctcgattttctcgggaggaattccccacgcttcaggctgctggagatcaagataaagcagctaaagagcgcgagtccgctgagcagagcagcggacctggcccttccctgcgaccacagaactccacaacttggcgggacggagggggtagggggcccgacgaactggaagggccagactctaaattgcatcacgggcacgatcctcgtggcggtctacagccctccggcccaccacaattccccccataccggggcatgatgccacctttcatgtacccaccataccttccgtttcctccgccgtacggcccgcaggggccgtatagatatcctacaccagacggccccagccgctttccccgggtggctggtccacggggatctggaccccctatgcgcctggttgagccagtcgggaggccctccatcttgaaggaggacaatctgaaggagtttgaccagctcgatcaagaaaatgacgacggatgggctggggcccatgaggaggtggactacacagagaagctcaaatttagtgatgaggaggatggacgcgacagcgacgaagagggcgccgagggccatagagacagtcagtcagcttcgggtgaggagcgaccccctgaagccgacggtaagaaaggaaattcccctaatagcgaacctccaactcccaagaccgcatgggcggaaacttccagaccaccagaaactgaaccagggcccccagctccaaagcccccgctgccacccccacacagggggcctgcaggtaactggggccctcctggggattacccggatcgaggtggtccgccatgtaagccgccagcacccgaggatgaagatgaagcatggcggcagcggcggaagcagtcgagctccgagatttctctcgcagtggagcgtgcaaggcgccgccgagaggaagaagagcgtcgcatgcaggaggaacgacgggctgcctgtgctgagaagctgaaaaggctggacgagaaattcggtgctccagataagcgactgaaggccgaaccagctgctccgcctgcagccccatcaaccccggccccgcctccagcagtgccaaaggagttgccagcccccccagcaccccctccagccagtgcacctactccagaaacagaacctgaggagcccgcgcaggctcccccggcccagtctactccaactcctggcgtggctgctgctcccacgcttgtatcagggggggggagcaccagctctacctcatccgggtcatttgaggcatctccggtggagccccaactgccaagcaaggagggaccagaaccccccgaggaggtgccacccccgacaacccctccagtccctaaggtagagccgaagggtgacgggattggccccacacggcaaccccctagccaggggctcggctatcccaaatatcagaagagcctgccccctagattccaaaggcaacaacaagaacagctcctcaagcagcagcaacagcaccagtggcagcagcaccagcaaggttctgctccccctactcctgtgccaccctctcctcctcagccggtgacacttggagccgtccccgccccacaggctcctccaccacctccaaaggctctctaccctggcgcactgggcaggccacctcccatgcctcctatgaacttcgacccgcggtggatgatgataccaccatacgtagatccaagactccttcagggtcgtccaccactagatttttacccaccaggagttcacccttcggggctcgtgcctcgcgagagatccgacagcggtggtagtagttcagaacctttcgatagacatgcccctgcaatgctgagagagagaggaacaccacctgtggaccccaaactcgcctgggttggcgacgtctttacagctacgcccgcagagcctaggcctctgacaagccctctgaggcaagcagcggacgaagatgacaaggggatgaggagtgaaacacctccagtgccccctcctccaccgtacctggcctcatatcccgggtttcctgaaaacggcgccccaggaccacccatcagccgctttcctttggaggagcccgggcctagacctctgccctggcctcccggctcagacgaagttgccaaaattcaaacgcccccccccaaaaaggagccccctaaggaagaaactgctcagctgacgggtccagaggcgggcagaaaacccgcacgaggtgtgggtagcggtggccaggggccgccccctccccggcgggagagccggactgagactaggtggggacctcgccctggcagtagcaggcgcgggatccctcccgaagagcctggggccccacccagacgagctgggccgatcaagaaacccccaccgcctaccaaagtagaagaattgccaccaaaaccgctagaacaaggagacgagacccccaagccacctaagcctgatcccctgaagattaccaagggaaagcttggaggccctaaagaaacaccccctaacgggaatctctctccagcccccagactgcgtcgcgattattcttatgaacgcgtcggccctacaagttgtcgcggccgcgggagaggcgaatactttgcccgcgggagaggcttcagaggaacatatggaggcagaggtaggggcgccagatcccgtgagtttcgttcttacagggaatttcggggcgacgatggacgagggggtggaaccggcgggccaaatcacccccccgcgcctcggggcagaaccgcaagcgagaccagatccgagggctcggagtatgaagagataccaaaacgaagaaggcaacgagggtcagaaactggaagcgagactcatgagtccgatctcgctccttcagataaggaggcgccgacacccaaggagggcactcttactcaggtgcctttggctcccccacctcctggagctcccccgagccctgcccccgctcggtttacagccagaggcggcagggtgtttacccccaggggcgtacctagtagaagggggcggggaggaggccggccacctccccaagtgtgtcccggatggagtcctcccgcaaaatctttggctcccaaaaaaccacctaccggccctctcccgccgtctaaagagccacttaaggaaaagctcatccctggccccttgtcgccagttgccaggggaggcagcaatggtggcagcaacgtgggcatggaggacggcgaacgtccgagacgccgacggcacggacgcgcccagcagcaggataagcccccacgcttccgaagactaaagcaagaacgagagaacgcagcccggggttccgagggtaaaccatccctgactctgcctgcctctgcaccgggacctgaggaggcactgacaaccgtcactgtcgcacctgcaccaaggagggctgcagccaaatcccccgatttgtcaaatcagaactcggaccaggctaacgaggaatgggagacagccagcgagtcctcagactttacctccgaacgcagaggagataaagaagcccctcctcctgttctcttaacacctaaggccgtgggaacccccggtggcggaggggggggcgccgtgcccggaatttccgcaatgagtcgcggagatctgagtcagcgggctaaagacctgagtaaaaggtctttcagttcgcagcgccccggcatggaacgccagaaccgcagacctggccctggcggtaaagctgggagctccggttctagctctgggggtggcgggggtggccccggcggccgcacggggccgggtcgcggggacaaacgaagttggccttcccctaaaaatcggtctcggccccctgaggagagaccccccggacttccccttcctcccccaccaccctcttcatccgctgtgttcagattggaccaggtgatccattctaatcctgcaggcattcaacaggcgctggcacaactctcttccaggcagggctccgtgaccgcaccaggcggccaccctcggcataaaccaggactgccgcaggctccgcagggaccaagtccgcggccacctaccaggtatgagcctcagagggtcaattctgggctctcgtccgacccccatttcgaagaacccgggccgatggttcggggagtgggcgggacaccccgcgacagtgcaggcgtgtccccctttccgccaaagcgccgggagcgcccgccgcggaaacccgagttattacaggaggagtcccttcccccgccccactccagcggattcttgggatccaaaccagagggtcccggtccccaagcagaaagtcgcgacacagggactgaagctctaactccacacatatggaatcggctacatacagccaccagcaggaaatcttacagacccagcagtatggagccatggatggaaccccttagtccctttgaagatgtggccggcacggaaatgtcccagagcgattccggtgtggatttgagcggagactctcaggtctcttcaggcccatgtagtcagcggtcgagtcccgacggaggactgaagggcgccgctgaaggaccgccaaagaggcctggggggtcctcccctttaaatgctgtcccttgtgaaggcccccccgggtctgagcctcctcggcgtccacccccggcaccgcacgacggtgatcgaaaggaactgccaagggagcagccactgcctccaggccccatcggcactgaacgctcacagcggaccgatagaggcaccgagccaggcccaattagaccaagccatcgaccaggccctcctgtgcagtttggtactagtgacaaagactccgatctgcggctggtggtgggggatagcctcaaagcagagaaggagctcacggcaagcgttaccgaggccattcccgttagccgagactgggagctcttgccaagcgccgccgcctctgcggaaccacagtctaaaaacctggactcaggacattgcgttcccgagccctcaagtagtggtcagcgcctgtatcccgaggtattctacggcagcgctggcccaagctcttcacagatttccggcggagcaatggatagtcagcttcatccaaacagcggaggttttcggcccggtaccccgagtttacatccctatcggagccaaccattgtacttaccccccgggcctgcgccacccagcgctttgctgtcaggggtggcactcaaggggcagtttctcgatttctccacaatgcaggcaaccgaacttggtaagttacctgcggggggcgtgttgtatcctcccccttccttcctgtacagtcccgcattttgtccctcacctctgcccgatacatccctgttgcaggtgcgtcaggatctcccttcccctagcgacttctactccacacccctgcagcctggcggtcagtctggatttttaccgagcggggcacctgcgcagcagatgcttctcccaatggttgactcgcaactcccggttgtgaactttgggagccttcctccggcgcccccacccgcgcctccgccactgagcctcctcccagtcggcccagccttgcaacccccctctctggcagttcgtcctccaccagcacctgccacgagagttcttccatctcccgcacggcccttccccgccagtcttggccgggctgagttgcatcccgttgagctgaaaccatttcaagattatcaaaaactttcatccaacctgggtggacctggatcaagccgaacacctccaactggtagaagctttagtggacttaacagccgcctgaaagcaaccccctcaacgtatagcggggttttcaggactcaaagagttgatttataccaacaggccagcccgcccgacgccctaaggtggatccccaagccctgggaaaggactggtccacctcctcgggaagggccgtctcgtagagccgaagaacctggctctcgtggagataaagagcccggcctaccccctccccgatag

SEQ ID NO: 130034 - DNA, 6474 bp, Artificial Sequence
  Description of Artificial Sequence: Synthetic coding sequence
atgtccgatcgctctggacccaccgccaagggaaaagacggcaaaaaatacagctcgctcaacctcttcgatacctataaggggaagtcactggagattcagaaacccgctgtcgcacctcggcacggcctgcagtccttgggaaaggtcgctattgccaggcggatgccaccgcctgctaacctaccatccttgaaggctgaaaataagggaaacgacccaaacgtatcactcgtgcctaaagatggtacaggctgggctagtaaacaagagcagtcagatcctaagtcttctgatgcctctacggctcagcccttagaaagtcaaccgctccccgcatcccagacaccggccagcaatcagcccaagaggcccccagctgcccccgaaaataccccgctggttccaagcggggtgaaatcctgggcccaagcgtcagtgacacatggtgctcacggtgatggtgggagagcaagctctctactctcccggttcagccgggaagagttccccacactgcaggccgcaggggatcaggataaagctgccaaggaacgcgagtctgctgagcaatcttcagggccaggaccctctcttagaccccagaatagcacaacctggcgggatgggggggggcggggaccagatgagctggaaggccccgatagtaagctgcaccacggccatgacccaaggggaggcttgcagcccagtgggcccccccagtttccgccatacagaggcatgatgccaccgttcatgtatcctccctatttgccctttccccccccatatggaccccaggggccgtataggtaccccacccctgatggcccatcccgatttccaagagtggcgggcccccgaggaagtgggcctccaatgaggttagtggaaccagttgggcggccatccattctgaaggaagataatctgaaagaattcgatcagttagaccaggagaacgacgatggttgggcgggtgctcacgaggaggtggattataccgagaaactgaaattttctgacgaggaggatggcagagattctgatgaggaaggcgctgagggccatagggattcccagtctgccagcggagaagaacgccctcctgaagcagacggaaagaaagggaatagtcccaactccgaacccccaacacccaaaacggcatgggctgaaacctctaggccccctgagacagaacctgggccgcccgctcctaagcctccactgccacctcctcacaggggccctgctggtaactggggacctcccggggattatcccgatcgcgggggccctccctgcaaaccgccagctcctgaggacgaggatgaagcatggagacagagaagaaagcaatcttcatcagagataagcttggctgttgaacgggctagacgccgacgggaggaggaggaaaggagaatgcaggaagagagacgggcggcatgcgcagagaaactcaagcgcctggatgaaaaattcggagccccagacaagcgcctcaaggcagaacccgcagcaccgcccgcagcaccaagcacaccagcacccccacccgccgtgcctaaagagttacccgccccccccgcgccgcctccagcaagcgctcccacacccgagaaggagcctgaagagccagctcaggcccccccagcccaaagcacccccacacctggggttgctgctgccccaacactggtgtcaggaggtgggtcgacgtcatccacatcatcaggtagctttgaggctagtccagttgaaccccagctgccaagtaaggaagggccagaacctcccgaagaagtgcctcccccaactacccctcctgttcccaaagtggaaccgaagggagacgggatcggacctaccaggcagccccctagccaggggctgggatacccgaaatatcaaaaatcactgcccccaagatttcagcgccagcagcaggagcagcttctcaaacagcagcagcagcatcaatggcagcaacaccagcagggctctgccccccccactcctgtgccaccctcccccccccagccggtgaccctgggggctgtgccagccccacaggcccctcccccaccgcccaaggccttgtaccccggtgcacttggccgccctccgcccatgcccccaatgaatttcgaccctaggtggatgatgattcccccatatgtggatccaagattattacagggcaggccaccactagatttctatcctccaggagtacatccaagcggacttgtacccagagaaaggtcagactctggcggcagttcctccgagccattcgaccgacatgctccagcgatgctaagagagaggggtacacctccagttgatccgaagctcgcctgggtgggcgatgttttcactgcaacacccgcagagccaaggcccttaactagcccattacgccaagccgcagacgaggacgacaaggggatgagaagcgagacgccgcccgtgcctcccccacctccctacctcgcttcttatcctggattcccagagaacggcgcccccggtccccctatatctcggttccctctggaggagccgggccctcggccgctgccctggcctcctgggagtgatgaagtggccaaaattcagactccaccccctaaaaaagagcctcctaaagaggaaacagcccaactcacagggcccgaggcaggacggaagccggccagaggggtgggatctggcgggcagggccctccgcccccaagacgagagagccgaaccgaaacgcgctggggcccacgaccaggttcctcgaggcgaggaattccaccagaagagccaggggccccccctcgacgtgcaggccccatcaaaaaacctcccccacctaccaaggtcgaagagctgccccctaaacccctcgagcagggcgacgagactccaaagccaccaaaaccagacccacttaagattacaaaagggaaactggggggccctaaggagactcccccaaatggcaatctgtctcccgcccccagacttagaagagactacagctacgaacgggtcggcccaactagctgtcggggcagaggtcgtggggagtacttcgcccgagggagaggattccgtggaacctacggggggcgaggacgcggtgcccgtagccgcgagtttcggtcataccgcgaattccggggcgatgatgggaggggcgggggcaccggtggccctaatcatcctcccgctcctcggggccgcacagctagcgagacaaggagtgagggcagtgagtatgaggagattccaaaaaggagaaggcagcgtgggtccgaaacaggaagcgagacccatgaaagtgacctggctcccagcgataaagaggctcccactccgaaagaggggactctcacccaagtcccactggctcctccaccacctggcgcacccccgagccccgccccagccaggtttaccgcacggggggggcgagtcttcaccccgcggggagttcctagcaggcgcggtcgcgggggcgggagacccccgccccaagtctgccccgggtggtctccccctgctaaatctctggctcctaaaaagccacctactggtcccctccccccgagcaaggagcctttgaaagagaaactaattccaggcccactaagtcccgtcgcaaggggaggaagtaatggaggcagcaatgttggaatggaggatggggagcgccctcgccgccgacgacatggccgtgcgcagcagcaggacaagcctccgaggttcaggaggcttaaacaagaaagggaaaatgctgctagaggatccgagggaaagccgtctctgacactgcccgcctccgcacccgggcctgaagaggctttaactactgtgaccgtggctccagctccgaggagagccgctgccaagagcccagacctaagtaaccagaatagtgatcaggccaacgaagagtgggagaccgcctcagaatcatctgactttacaagcgagcgccggggcgataaggaagctccccccccagtcctcctgactcccaaggccgtcggaacacctgggggcggtggcggtggagcagtgcctggcatttcagccatgtctcgaggggacctgtcacagagggccaaagatctcagcaaacggtcattcagcagccagcgacctggaatggagaggcagaaccgacgccccgggcccggcggaaaagccggctccagcggatccagcagtggcgggggcggtggtggaccaggcggacgaaccggcccaggacgaggggacaaacggtcttggccatcaccgaagaacagaagtcgcccgccagaggagcggcccccagggctgcctctcccgccacctcctccctctagcagcgcagtattcagattggatcaagtgattcatagcaatccggcagggatccagcaagctctggcccagctcagttcgaggcaggggtcagttactgccccgggtgggcacccgcggcacaagcccgggccccctcaggctccacagggtccttcaccacgcccaccaactcggtatgagcctcaaagggtcaatagcggcctttccagcgacccgcacttcgaagaacctggcccaatggtgagaggcgtaggtggaactcccagggactccgcgggcgtgtcaccctttcccccaaaaaggcgtgaaagacctccaagaaagccagaacttctgcaggaagagagtctgccgcctccccattcctcagggttcttaggttccaaacccgaaggtccagggcctcaggccgaaagcagggatacggggactgaagccctcaccccccatatctggaaccgcttgcacacggccacttcccgtaaaagctataggccctcctccatggagccatggatggagccgctgtcacctttcgaggatgtggcaggtactgaaatgtcccagagtgactcaggcgtggacctatctggtgactcacaggttagctcaggtccctgctcgcaacgaagcagcccggacggtggattaaagggagctgcggagggacctcccaagcgcccaggtggttccagcccgctgaacgcagtcccatgtgaaggaccccccggctctgagccccctcgacggccccctccagcacctcacgatggggataggaaggagttgccccgtgagcagcccctgccccctgggccaattgggacagaacgttcacagagaactgatcggggaacggaaccgggtcctatccggcccagccaccggcccggaccccccgtgcagttcggtacatcagataaggactctgacttgcgtctggtagttggcgactctcttaaagcagagaaggaactcaccgctagtgtgacagaggctattcctgtttctcgcgattgggaactcctcccctccgccgcggcatccgccgagcctcagtccaaaaatctggatagtggtcattgcgtgcccgagccgagtagcagcggccagagactgtacccagaagtgttttatgggtccgcaggcccatcttcaagccagatcagcggaggggcaatggactcccagctccacccaaattcagggggatttagacccggtacaccatcactccatccgtaccgttctcagccattatacctgccgccggggcctgcaccaccttcggctctcctttcgggagttgccctgaaggggcaattcctcgatttcagcaccatgcaggcaacagagctagggaagctgccagcaggtggagtcctgtatccccctccaagttttttgtactctcccgcattctgtcctagtccgctacctgacacctctttattgcaagtccgtcaagatcttccctccccctctgacttttacagcactcccctccaacccggaggacagtctggattcctgccaagcggggctcccgctcagcagatgctactcccaatggtcgactcccagttgccagtagtaaactttggcagtctaccacccgctccaccccctgcgccgccccctttatcactactgccagtgggtccagctttgcagcccccatccttggcagtgcggccgccgccagccccagccacaagagtcttaccaagtccggcgcgcccattccccgcttccttgggcagagccgaattgcacccggtggagctgaagccgtttcaggattatcagaaactctctagcaatctgggaggccccggttcctcacgcacacccccgaccgggaggtccttctcaggcctcaactcccgcctcaaggcaacccccagcacgtattccggggtgtttcggacccagcgtgtggatctataccagcaggccagccctccagatgccttgcggtggattccaaaaccttgggagagaacaggacctcctccaagagaggggccctccaggagagctgaagaaccaggctctaggggcgataaagaaccaggactgccccccccaagatag

SEQ ID NO: 130035 - DNA, 6474 bp, Artificial Sequence
  Description of Artificial Sequence: Synthetic coding sequence
atgagcgatcgctctggacctacggctaaagggaaagacggtaagaagtacagctctcttaatttattcgacacctacaaagggaagtctttggagatccagaaaccagctgtggcacctagacacgggttacagtcgctcggcaaagtggctatcgcaaggcgaatgccaccgccagcgaatctcccctccctcaaagctgaaaacaaaggcaatgacccaaacgtgtctctggtgcctaaggatggcactggttgggcgagtaaacaggaacagagtgatcctaaaagttctgacgcttcaaccgcccagcctcctgaatcacagcctctccccgccagtcagactcctgcatcgaatcagcctaagcgacccccagcggcccctgagaacacccctttggtaccctctggggttaagtcatgggcccaggcctctgttacccatggcgcacacggagatggcggcagagcttcgtctctgctgagtagattcagccgcgaagaatttcctacgctccaggccgcgggcgatcaggataaagccgcgaaggaaagggagagcgcagagcagtcatcagggcccggcccatctctccggccacaaaatagcactacctggagagacggcggcgggcggggaccagatgagttggaaggcccagacagtaagctccatcatggccacgatccgcgagggggacttcaaccctctggtccaccccagtttccaccctaccgcggcatgatgccaccctttatgtatccgccatatctgccttttccacctccatacggccctcaagggccataccgatacccaactcccgatgggccctccaggttcccccgggtggctgggcctagaggatctggccccccaatgcgactcgtggagcctgtcgggaggccttccatcctcaaggaggacaacctgaaggaatttgaccaactcgaccaggagaacgatgacggttgggccggagctcatgaagaagttgattataccgaaaaactaaagttctctgatgaggaagacggcagggacagcgacgaggagggcgcagagggacaccgtgactcacagagcgccagcggcgaggaaagaccccccgaggccgatgggaaaaaaggaaactccccaaatagcgagcctcccacccctaaaactgcctgggcagaaacatcccggccacccgaaacggaacctggccctccagctccgaaaccaccgttgcctcctcctcaccgggggccagccgggaattgggggccccccggggattaccccgataggggcgggcccccgtgtaaaccccctgcccccgaggatgaagacgaagcttggagacagcggagaaaacagtcaagcagcgagattagtctggctgtggagcgcgcgagaaggaggcgagaagaggaggagagacggatgcaggaagagcgtagggctgcctgtgccgagaaactgaagaggctggacgagaagtttggggccccagacaagcggcttaaagctgaaccggccgcaccgcccgccgccccgtctactccggccccgccaccagccgtcccaaaagagctccccgcaccaccagccccccccccagcttctgcacccacaccagaaaaggaaccggaggagccagcccaggcccctcccgcgcagtctacgcccactccaggcgttgctgccgcccccacactagtaagtgggggcggctcaacaagtagcaccagtagcggctcctttgaggcctctccggtggagccacagctcccatccaaagaagggcccgaacctcccgaagaagtgccaccacccacaactcccccagtcccgaaggtcgaacctaagggggatggaattgggcctacaagacagcctccatcgcaaggtctgggctaccccaagtaccagaaaagtttgccccctagattccagaggcaacaacaggagcagctgttgaaacaacagcaacagcaccagtggcagcaacatcaacaggggtccgccccgcctactccagtccccccgagcccgccgcaaccggtaactttaggtgctgtgccagcacctcaggctcccccacctccacccaaagctctgtaccccggagctcttgggcgaccaccacctatgcccccaatgaatttcgatcccagatggatgatgatccctccttatgttgacccacgcctcctccagggccggccccccctagacttttatccacctggcgtccatccctccggcctggttcctcgagagcggagtgactctggcggctccagctccgagccgtttgaccgacacgctcctgccatgctgagagaacgtggcacccctcctgtcgaccctaagcttgcctgggtcggagatgtgttcaccgccaccccagcggaaccaaggccccttacaagtccgcttaggcaggccgccgatgaggatgacaaaggcatgaggtcggagacgccgcctgtcccccccccgccaccatacctcgcttcatacccgggtttccctgagaatggcgcgcccgggccaccaattagccgtttcccactagaggaaccgggtccgaggccactcccatggccccctggcagcgatgaagtagcgaagattcagacaccccctccgaagaaggagccaccgaaagaggagaccgcccaactaacgggcccagaggccggaagaaaacctgctagaggcgtcggctctggaggacaggggcccccccccccacggcgggaatcccgcaccgaaacgcggtggggcccgcgccctgggtcatccaggagaggcattcctcccgaagagcccggcgccccaccaaggcgcgctggccctattaaaaagcctccccctcccaccaaggttgaagaactcccacccaagccactcgagcaaggagatgagacgcctaagccaccgaaacctgacccgctcaaaataaccaagggcaaactggggggacctaaagaaaccccaccgaacggaaatctgagcccagcgccaagactgcgtcgcgattacagctacgagagggtgggcccaactagttgtcgtggcagaggacgcggagaatactttgcaagaggacgaggcttccgcggaacctacggcggaaggggcaggggagcaaggtctcgggaatttagaagctatcgagagtttagaggcgacgacgggaggggcgggggtacaggggggcccaatcaccccccagcacctcgcggtcgcacagcctccgagacacgttccgaagggagtgagtatgaggagattcctaagagacgcagacagcgcggctcggagaccggctccgaaacgcatgaatctgatcttgcccctagcgacaaagaggccccaacaccgaaggaggggaccctgacacaggtacctctcgcgccacccccccctggagcacccccaagcccagcccctgcgaggttcacagcacgcggggggcgagttttcacccctcgcggggtccctagtcgccgggggaggggcggcggtcggcccccaccacaggtgtgccctggttggtccccccccgctaagagcttagcaccaaagaagcctcccacagggcccctcccacccagcaaggaaccactgaaggaaaagctgattcctggacccctgtctccagttgctcggggtgggtccaatggaggctccaatgtggggatggaggacggcgagcggcccagaagacgtcgccatggcagggctcagcaacaagataaacctccacggttccgcaggctgaagcaggagagagaaaacgcggcgcgagggagcgaggggaaacctagcctaaccctccccgcctccgctcccggcccagaagaggcgctgactactgtgactgtggctccggcacctcgccgagctgcagccaaatccccagacctgtcaaatcagaattctgaccaggcaaacgaggagtgggagacagcatccgagagtagcgacttcacttcagaacgcaggggagacaaggaagccccacctcctgttctcttaactcctaaggcggtcggaacacccggagggggtggagggggcgcagtgcccggaatcagtgctatgtcgcgcggcgatctgtctcagcgggccaaggatctgagcaaaaggtccttcagtagccagcgcccgggaatggagcgccagaaccgtagacccggacccggaggcaaggccgggtcctctggctcatcatccggcggcgggggcggggggccaggagggcgtacaggtcccggacggggcgacaagaggagttggccaagcccaaagaaccgatcaagacctccagaagagaggccacctggtctccccttgcctcccccgcctccaagcagctccgccgttttcagattggatcaggtaattcatagtaatcccgctggcatacaacaggccctggcacagctctctagcaggcagggcagcgtgacggcccctgggggccacccacgccataaacccggtcctcctcaggcaccacagggtccatctccaagaccccccacccgttacgaaccacagcgggtgaatagtggattgtcttccgacccacactttgaggagccgggccccatggttcgaggagtgggaggaacaccgcgcgatagtgccggagtgtctccgtttcctcccaagcgaagggagcgaccaccaaggaagccggagttgctgcaagaagagagtcttcctcctccacatagttccggtttccttggcagcaaacctgaaggtcctggaccacaggcagaatcaagggatactgggaccgaagctctcacccctcacatctggaatcggctgcacacagcaacctccaggaagagttaccgcccctctagtatggaaccgtggatggaaccactttctcccttcgaggacgtggctggcaccgagatgagccagtctgactcaggggtggacctgagcggggacagtcaggtgtcttcagggccctgtagtcaaaggtccagtcctgacggcggcttaaaaggggcagcagagggccctcccaaaaggccaggaggcagtagcccgctcaatgccgtcccctgtgaggggccccctgggagtgagcccccacgaagacctcctccagccccacacgacggcgacaggaaggagctacctcgcgagcagccattgcccccgggcccaattgggaccgaacgatctcaacatactgacagaggaactgaacccggacccattcgacctagccatcgccctggtcctcctgtacaattcggcacctctgataaggacagcgacctccggcttgttgtgggcgacagtctaaaggccgagaaagagctgaccgcatcagtgaccgaggccatcccagtaagtcgagattgggaattgttaccctctgccgctgcaagcgccgagccacagagcaagaatctggattcaggtcactgcgttccagagcctagctcttccgggcagcgcctttatccagaagtgttctacgggtctgccggaccctctagcagccaaatcagtggaggcgctatggacagccagctgcacccaaattctggaggctttcgtcccggtacaccctcgttacacccgtataggtcccagcccttatacctgcctcctgggcctgccccaccttccgcccttttatccggcgttgcactgaaaggccagtttctggatttctcaaccatgcaggccacagaacttgggaaactgcccgctggcggggtgctgtatccgccgccaagctttttgtactcccctgctttctgccctagtccactccccgatacaagtctgctccaggtcaggcaggatttgccatctccttcagatttctacagcacacccctccagcccggaggacagagtggattcctcccaagtggtgcgcccgcacagcagatgttgcttccgatggtggatagtcaactgcctgttgttaatttcgggtcactaccaccagcccctccacctgcccccccttccttatcgctgctgcccgtgggccctgctctacagcctcctagccttgctgtgcggcctcccccggcacccgccacacgagtattgccatcaccagcccggccattccccgcttccctggggcgcgcagagcttcacccggtcgaactcaagccctttcaggactaccagaagctctcttctaatctgggaggacctggaagctcccggacaccacctacgggccgctcattttcggggctgaattcgcgattaaaagccacaccctcaacttactcaggggtattccgcacgcagcgggtagacctgtatcagcaggcctctccccctgatgccctgcggtggatcccgaaaccatgggaacgtacagggccccctcctagagaaggccctagtcgcagggccgaggagcccggctcccgcggtgacaaagagcccggtttgccacccccaagatag

SEQ ID NO: 130036 - DNA, 6450 bp, Artificial Sequence
  Description of Artificial Sequence: Synthetic coding sequence
atgtcagatcgctcagggcctacagcgaagggtaaggacggaaagaaatacagctcactcaatctattcgacacatataagggaaaaagcctcgaaattcagaaaccagccgtggcccctaggcatggtctgcagagtctgggtaaggtcgcgatcgcgaggcggatgccacctcccgcaaatcttccctcactcaaagccgaaaacaagggaaatgaccctaacgtgagcctagtgcctaaagacggcacgggctgggcttccaagcaggaacaatccgaccccaagtctagtgacgcctctactgcccaaccacctgaaagccagcctctgccggcttctcaaacccccgcttccaaccaaccaaagcgaccccctgctgcaccagaaaataccccactggtgccctctggcgtgaagagctgggcacaggccagcgtcacccacggagcacatggggacgggggtcgcgccagttcgctgttgagcagattttcccgcgaggagtttcccaccctccaggccgcgggggaccaggacaaagccgctaaagagagggaatctgcagaacaatccagcggtcctggcccaagtctgagacctcagaactctacaacttggagggacggcggtggccgaggacccgacgaattggaagggcccgattccaagctgcaccacggacacgacccccggggaggactgcaaccaagtgggccacctcaattccccccctaccgggggatgatgcccccttttatgtatccaccgtacttgccgtttccaccaccgtacggccctcagggcccctatagatacccaactcctgatggcccaagtagattccctcgagtagccgggcccaggggcagtgggccgccaatgagacttgtcgaacctgtaggaaggcccagcatactgaaggaggacaacctcaaggagtttgatcagctggaccaggaaaacgacgacgggtgggccggtgctcatgaggaggtcgattacaccgagaagcttaagttctctgatgaggaagacggtcgagactccgatgaagagggcgccgagggtcatagagattcgcaaagcgcatctggtgaagaacgccctcctgaggccgacggcaagaaggggaatagcccaaattcggagcccccaacacctaaaactgcctgggcggagacatccaggcccccagaaaccgaacccggcccccccgcccccaagccgcctctgccaccacctcaccgggggcccgcgggaaattggggaccgcctggtgattatcctgacagaggtggacccccctgcaagccaccggccccagaggacgaggatgaagcttggaggcagagaaggaagcagtctagtagtgaaatctctctcgcagttgagagggccagacggagacgggaagaggaggagcgtcgcatgcaagaagaaaggcgggccgcatgcgcagaaaagttgaaaagactggatgagaaattcggcgcgcccgataaaaggttgaaagccgagcctgctgcccctcctgccgcccccagcacaccagccccgccgcctgcggttccaaaagaactacccgcacccccagcacctccaccagcgagcgcacctactccagaaacagaaccagaggaacccgcccaggcccctccagctcagagcacacctacgcctggtgtcgcagcggcccctacgctggtgagcggcggcggatctaccagcagtacaagctcgggcagcttcgaggcctcaccagttgaaccacaactacctagtaaagagggcccagagccgcctgaagaagtgcccccccctacaacaccaccagtgcctaaggtagagccaaagggtgacggcatcggtcccacaagacagcctcctagccagggccttggctatcctaagtaccagaagtctctcccgccaagattccagcgtcaacaacaggagcaactcctcaagcagcagcagcagcatcaatggcagcagcaccagcagggaagcgccccacccacaccagtcccccccagtccgcctcaaccagttacactaggagctgttccagctccacaggcacccccccctcccccaaaagcattatacccaggagcactcggcaggcctccaccaatgccgcctatgaacttcgatccgaggtggatgatgattcctccctatgtagacccaagactgctgcagggtcgcccccccttagacttttacccaccgggggtgcacccaagtggccttgtgccaagggagcgcagcgatagcggcgggtcatcgtctgagcccttcgataggcacgcacccgctatgcttagggaaagagggacacctccagtggatcctaaactcgcttgggtgggggacgtatttacagccacccccgcggaaccccgccccctgacctccccattgaggcaagccgcagatgaggatgacaaaggaatgcgtagtgagacgcctcctgtgccaccgcctcctccttatctggcatcttatcctggcttccccgaaaacggggccccaggcccccctatttccaggtttccactggaggagccaggcccccgtcccctgccttggcctcccggatccgacgaagtggccaaaattcagacgccaccgcccaaaaaggagcctcccaaagaagagacagcacagctgacggggccagaggcaggtcggaaaccagccaggggagtcggctccgggggacaaggaccacccccacccagacgggagagccgcacggaaactagatgggggcccaggccaggatcctcccggaggggcatcccacccgaagaacctggcgcccctccaagaagggccggaccaattaaaaagcctccacctccgactaaggtggaagagttgcctccaaaacctctcgagcaaggtgacgaaactccaaaacccccaaagccagaccccctgaagataaccaaaggcaagcttggcggccctaaagagacacctcctaacggcaacctgtcgcccgcaccgaggctgagaagggactactcttatgagagagtgggaccaacttcgtgtcggggacggggacgcggcgaatacttcgccagaggccgcggatttcggggcacttatggaggtcggggtagaggtgcggcaggcaatagtgcagttaccgaatcatttgaagagatgatgggggtcgaggtaggacagggcgaccagacgaccctgctgttaccagaggcggccctccctgcacgccatggagcccgggtccagagcatgcggaagtcaccatcaggcgccgggtccggtgcccagaaacaagctgctagaccaatgagagtcatttggctgctgcagactagaaggctgccccacccccggcgagagcacagcccgagatccagatccccgacaactaggagccccacatttcctgctcccgcccggtttacacctggcgtgggggagtcatcactcccagaaggcatttctccagggcctcgacggcgggagccacctcaggtgtgccccggatggagccctccagctaaatccctggctcccaaaaagccacccaccggacctctcccccctagcaaagaacccctgaaggagaaactaattcccggaccactctcacctgtggccaggggaggcagcaacggagggtcaaacgttggtatggaggatggagagagacctcgtaggaggaggcacggtcgcgctcagcaacaggataaaccaccccgttttaggcgtctcaaacaggagcgtgagaatgcagcccgtggctccgaaggaaagccatccctgactttgccagcatctgccccaggccccgaagaggccttgaccaccgttaccgtagctcccgcaccgcgcagggccgccgccaaaagcccagacctgtccaaccagaatagcgatcaagccaatgaggagtgggagaccgcctcagagagctctgattttactagcgaaagacgaggcgacaaagaagccccccctcccgtcctgcttaccccaaaggcggttggaacgcctggtggcggcggcgggggggccgtccccgggatctccgcaatgtcaaggggcgatctcagccagagagccaaggatctgagcaagaggtccttttctagccagaggccaggtatggaacggcagaacaggcggccaggcccgggaggcaaggccggatcaagcgggagctctagtggtggaggcggaggtggacccggaggccgcacagggccaggccgcggcgataaacgttcctggccttcacccaagaacaggtcccggccccctgaggaacggcctcccggactgccactgccaccaccaccccctagcagctccgccgtttttcgattggatcaggtgatccactccaatccagctggtatccagcaggccctggcacagttgtctagccggcaggggagtgtcacagctccgggcggccatccaagacataagcctggcctgccacaagccccacaggggcctagcccgaggcccccgactcggtacgagccacagcgtgtcaactctggcttatcttcagatccgcactttgaagagcctgggcccatggtcaggggagtcggcggaacccctagagattcggctggggtcagccccttccctccaaaacgcagagagaggccgcctcgcaaacctgagctgctgcaggaagagagcttgccaccaccacattcttccggctttttaggctcaaaacctgaaggccctggaccccaagcggagagccgagataccggaacagaggctctgactccacacatttggaatcgtctacacaccgctaccagccgcaaatcttataggccaagctctatggaaccttggatggagcccttgtcacctttcgaagacgttgccggcacagagatgagtcagtcagactcgggcgtcgacctgtccggcgacagccaagtgtcgtcaggaccttgctcccaacggtcttcaccagacggcggacttaaaggtgccgctgagggaccacccaagcggccaggaggttcttctccactgaatgccgtgccatgcgagggacctccgggttcagagccgcccaggcgtcctccacccgcccctcacgatggagacaggaaggagctgcccagggaacagccgctcccgcctgggcccattgggactgaaaggagccagcggacggatcggggtaccgaacccgggcccatcaggccatctcacaggccagggcctccagtgcagttcggcaccagtgacaaagattctgacctgcgtctggttgtgggggacagtctgaaagccgaaaaggaactgacggcttctgttactgaggctattccggtctctagggattgggagctgctgccttctgcagccgcctcagcagagccgcagagcaaaaatcttgactccggacattgcgttcctgagccctcatctagcggccaaagattataccccgaggtgttctacgggtccgccggccccagcagcagtcagatttccggtgggcatggactgtccatcacttccaaacagtggcgtagacccggcactccttccctgcatccttacagaagccagcctctttatctgccacctggtccggctccaccatcagccctgctctcgggactggcgcttaaaggtcaatttttagattttagtacaatgcaggccaccgaactaggaaaattgcccgcagggggtgtattgtatcctccgcccagctttctttactctccagccttctgcccttctcctcttcccgacacttctctgttacaggtaagacaggacctgccttcccctagcgacttttactcaaccccacttcaacccggaggccaatctgggtttctcccctctggagctcccgctcagcagatgctgctgcccatggtggatagccagttaccagtggtaaatttcggaagcctaccacccgcacctcctcccgctccccccccactgagtctactgccagttggaccggcgcttcaaccacccagcctggccgtccgaccaccccccgcccccgccacgcgggtccttcccagtccagcccgccccttcccagccagtctgggccgggccgaactacaccccgttgagcttaaaccattccaggattatcagaagctctccagcaacctagggggtcctgggagttctcgcactcctccgactggaaggagcttctccgggctcaattcgagactcaaagccacaccctccacatacagtggggtctttcgcactcagcgcgttgatctgtatcagcaggcctctccccctgatgccctgaggtggatcccaaagccttgggaaaggaccgggcctcccccaagagaagggcccagtagaagggctgaagagccgggctctcggggagataaagagcctggactgccaccaccaaggtag

SEQ ID NO: 130037 - DNA, 6474 bp, Artificial Sequence
  Description of Artificial Sequence: Synthetic coding sequence
atgagcgaccgaagtggcccaactgcgaaaggcaaggatggaaaaaagtattccagcctgaatttgttcgatacttacaaggggaagagcctcgagattcagaagccagcagtagcccccagacacggcctacagagccttggcaaggtagccatagcacggagaatgccaccacccgccaacctgcctagtctgaaggccgagaacaaaggtaacgatccaaatgtgtctttggtgcccaaggatggtactggatgggcgagcaaacaggaacagtccgacccaaagtctagtgatgcctcaacagcacagcccccagagagccagcccctgcctgcatctcagacaccagcgtctaaccagccaaagcgacccccagccgcaccggaaaacacccccttggttcccagtggcgtgaagtcctgggcccaggcttccgtgactcacggagcccacggcgacggaggcagagcctcatcccttctctcccgtttctcccgggaagagtttccaacgttacaagctgcgggagatcaagataaagcagccaaggagcgcgagagcgctgagcagtcatcaggccctggcccgtctttgcgtccgcaaaacagcaccacttggagggacggaggggggaggggtccagacgagctggaaggccctgacagcaaattgcatcatggccacgatcctcgcggcggtctgcagccttctgggccacctcagttccctccttacagaggcatgatgccgcccttcatgtatccaccataccttcccttcccccctccttacgggcctcaggggccctacaggtatcctacacctgatggcccaagcagattccctcgggttgcaggccctagaggctctggccccccaatgcgcttggtggaacctgtgggccggccctcgattctcaaggaagataatctcaaggagttcgaccagctcgatcaggaaaatgatgatgggtgggcaggagcccacgaggaagtcgactataccgagaaattgaaattctccgatgaagaggatggccgggattctgacgaggagggcgccgaaggtcatcgcgactcccagtccgcctcaggggaagagaggcctccagaagccgatggcaaaaaggggaattccccaaactctgagccacctacccccaagacagcctgggctgaaacctcccggccacccgagaccgagcccggtccgcccgctcccaagcccccattgcctcctcctcaccgcggacccgcaggaaattgggggccccccggtgactatccggatcggggagggcccccctgcaagcccccagcacctgaggatgaggatgaggcctggcgccaaaggcgcaaacagtcctcatcggagatctcactggccgtcgagagagctcggcgccgcagagaagaagaggagcgcaggatgcaggaggaacggagggccgcgtgtgctgaaaagttgaaacggctagatgaaaaattcggagctcctgacaaaagactgaaagctgagcctgcagcgccgccagctgcacccagcactcccgcgcctccgcccgccgtcccaaaggaactgccagcccccccggcacctccgcctgcttccgcacctactccggaaaaggagcctgaagagcctgcacaggcccctcctgctcaatccacaccaactccgggagtggccgctgctccaactctggtatccggcggcggatcaacctcaagcacatcctccggttctttcgaagcctctcccgtagaaccccaacttccatccaaggaggggcctgagcctcccgaggaggtccctcccccgaccactccacccgtcccaaaagtcgaacctaaaggagacggaataggccctactagacagccaccgtctcaaggactcggatatcccaagtaccagaagagtctccccccccgtttccagcggcagcaacaggagcaactgttaaagcagcagcagcagcaccagtggcagcagcatcagcagggctccgctcctcctaccccagtacccccttcacccccgcagcccgtcacccttggtgccgttccagcgccccaagctccaccaccgcctcccaaggccctgtaccctggcgcattaggccgtcctccaccaatgcctcctatgaacttcgacccaagatggatgatgattccaccttatgtggatcctcgattgctacagggacggccacccctggacttctatcccccaggcgtccatcctagcgggctagtgccccgtgaaaggtctgatagcggggggagttcaagcgaacccttcgaccgccatgccccagccatgcttagagagagaggtactccgcctgtcgatcctaaactagcttgggtcggggacgtgttcactgctacaccagccgaaccccggccattgacgagccctctgcgccaggccgcagatgaagatgacaagggcatgagatctgagaccccacccgtgccgccccctcccccttatttggcctcttatcccggattccctgagaatggtgcgcctggtcctcctatctctcgcttccccttggaagagcccgggccccgacccctgccatggccgccaggctctgacgaggtggccaaaatccagactcccccaccaaagaaggaaccgccaaaggaggagacagcccagctcaccggtccagaagccgggcgcaaaccggccagaggggtcggctcaggaggccagggcccacctccacctcggagggaaagcaggactgagacgcgctgggggcctagacctgggtcttctcgacgaggaatacccccagaggagccaggtgccccacccaggagggcgggaccaattaagaaaccacctcctccgactaaggtggaggaactgccaccgaaacccctggaacagggggatgaaacgccaaagcctcctaaacctgacccccttaaaattactaagggcaagctaggaggtcccaaggagaccccgcctaatgggaatctttctcccgctcccaggttgcgtagggattatagttatgagcgagtggggcctaccagctgcagaggcaggggtcgaggagaatacttcgctcggggacgagggtttaggggcacttatggcgggcggggtcggggcgctcggtcccgggaatttagaagctaccgtgagttcagaggcgatgatggaaggggcggcggtactggcgggcccaaccatccccctgcacctagagggaggactgcttctgaaactagatcggaaggctctgagtacgaagaaattccaaaacgcaggcgacagagaggttctgagaccggaagcgaaacccacgagagtgacctcgcaccatctgataaagaggccccaactccgaaagaagggacattgactcaagttccactggcccctcctccaccgggcgcccccccgagtcccgcccccgctcggtttaccgcgcgtggtggacgggtatttactccacgcggcgtgccctcaagacgcggaagaggcggtggccgacccccaccgcaagtgtgtccgggatggagcccgccggcaaaatcgctggctcctaaaaagccaccaaccgggcccttacctccttctaaagaacccctgaaagagaagctgatccctggaccgttatcccccgtcgcacgcggcggaagcaacggaggaagcaatgtcgggatggaggatggagaacgcccgcgcagaagaagacatggtagagcccagcagcaagataaacctccccggtttagaagacttaagcaggagcgcgagaacgcagcaagggggagcgagggaaagccctcactgactcttcccgcaagcgctccaggcccggaagaagcccttacaacagtgacggttgctcctgcaccaagaagggcagcagcaaaatctccggatcttagtaatcaaaactccgaccaggcaaatgaagaatgggagaccgcatccgagtcctcagatttcacaagcgaacgccgcggggataaagaagccccaccaccagtgttgctgacccccaaagctgtgggcacccctggaggagggggaggtggcgccgttcctggaatctccgcgatgagtcgcggagatttgagtcagcgcgccaaggatctctccaaacggtctttctcatcacaaagacctgggatggagagacagaaccgacgtcccggccccgggggcaaggcaggcagctctggaagcagtagtggagggggtggcggcggtcccggggggaggacaggtccagggcgtggcgacaagaggtcatggcctagccctaagaaccggtctagacctccagaagagcggcctcccggactgccgttgcctcccccaccaccatcttccagtgcagtttttagattggaccaagtgattcattctaacccggcaggaatccagcaggccctggcccagctctcctcccgtcaggggagcgtaacagcgccggggggccatccccgccataagccgggccctcctcaggcgccgcagggcccatcaccccggccacccactcgctatgagccgcaaagagtgaactctggcctttccagtgatccgcatttcgaagaacctgggcctatggtcagaggtgtgggcggcaccccccgggactcagcaggcgtgtccccgttcccccccaaacgtcgagagaggccgcctcgaaagcctgaactcctccaagaggagtccctgccacccccacattcatctgggttcctcgggtcgaaaccggaaggtccaggacctcaggccgagagcagggatactggcacagaagcactgactcctcacatctggaataggctgcataccgctaccagccgtaaatcctacaggccgagtagcatggagccctggatggagcctctatctcccttcgaagatgtcgcaggcaccgaaatgtctcagtccgacagcggtgtggacctctctggagactcacaagtcagctctggcccatgcagtcagcgatctagtccagacggaggacttaaaggtgcagccgagggcccaccaaagcgtcctggcgggtcttccccccttaacgcagtaccatgtgaagggcctcccggctctgaaccaccacgcaggcccccaccagccccccacgacggcgatcgcaaggaactgccgagagagcagcccctcccgccggggcccattggaacagagaggtctcagcacacagatcgtgggacggaaccaggccctatcagaccatcccaccggcccggcccccccgttcagttcggaacaagtgacaaggactctgatctgaggctggtagtcggggactcactgaaggcggaaaaagagctgaccgcttccgttacagaagcgatcccagtgagtagggattgggagcttctgccaagcgctgcagccagtgccgagccgcagtccaaaaacctcgatagcgggcactgtgtgcctgaacctagttcatcaggccagcggctgtacccagaggttttctatggaagcgcggggcccagttcatcccagatatctggaggggccatggactctcagctccatcctaatagtggcgggttccgcccaggcacacctagtctgcatccctaccggtcacagcctctgtacctgcctccaggcccggcacctcccagcgcacttctgtccggggtggcccttaaaggccagttcctggatttcagcaccatgcaggccaccgagctgggcaaactgccggccgggggagttctttacccaccaccgagttttctgtactcaccggccttttgcccttcaccgttgcctgatacctccctactgcaagtaagacaagatctgcccagcccatcggacttttatagcacccccctgcagccaggaggccagagtggatttttgcccagtggagcccctgctcagcagatgctgctgccaatggtggatagccagctccccgtcgttaactttgggagcctgcccccagcacctcctcccgctccccccagtctctctctcctacctgtgggcccagcgcttcaacctccctccttggccgtgcggcctcccccggctcccgctactagagtgttaccctctcctgcccggcctttccctgccagcctcggcagggccgagctgcatcccgtggaactgaagccctttcaggattatcagaaactgtcctctaacctgggtgggccaggttcgtcaagaactccgcctactggccgatcattttccggcttgaactctcgcttaaaagcgacccctagcacatactccggcgtttttcggactcaaagagtggatttgtatcagcaggccagtccacctgatgctcttaggtggattccaaaaccttgggaaaggactggacctcccccacgcgagggaccatcccggcgtgcagaagaaccggggagtagaggagacaaagagccaggactgccgcccccacgctag

SEQ ID NO: 130038 - DNA, 6474 bp, Artificial Sequence
  Description of Artificial Sequence: Synthetic coding sequence
atgtccgacagatccggtccaacagccaaaggtaaggacggaaaaaaatatagctctttgaacctgtttgacacctataagggtaaatccctggagatccagaagcctgccgtggcaccgcgccacggactgcagtctttgggtaaggtggctatagcaagacgaatgccacctcccgcgaaccttccttccttgaaggctgagaataaggggaacgacccaaatgtttcgctggtgccaaaagacgggaccggctgggcttccaaacaggaacaatccgatccaaagagttcagatgcatccacagcgcagccacctgaaagccaacctcttcctgcaagccagacacccgcctccaaccagcccaaaaggccccccgcggccccggagaacacacctctggttccttcaggtgttaaatcctgggcacaggccagcgttacccatggggcacacggggacggcgggagagccagctccctgctaagcagattctcacgtgaagagtttcccacacttcaagctgcaggcgaccaggataaggcagccaaggaaagagaaagtgcggagcagtcttctggccctgggccaagcctgcgtcctcaaaactccaccacttggagagacgggggcggtagggggcctgatgagttggaggggcctgattccaagctgcatcacggccacgatcccagggggggactccagccctctggacctcctcagtttcccccctacagggggatgatgccaccgtttatgtacccaccttaccttcctttccctcccccttacggcccgcaaggcccttataggtatcctactcctgatggtcctagcaggttccctcgggttgctggcccaagggggagtggccctcctatgagactcgtcgagcccgtgggccgacccagtatcctgaaggaagataatttgaaagaattcgaccagttggatcaggagaatgatgatggctgggccggcgcgcacgaggaggtggactatacagagaagctgaaattctccgatgaagaagatggaagggattcagacgaagagggagccgagggacaccgggactcccagtctgcctctggcgaggaaaggcctcccgaagcagacggcaagaagggtaactctcccaactcggagcctccgactccaaaaactgcttgggccgagacatctcggccccccgagacagagcccggcccgcccgcacctaagccacctctgccccctccccatcggggccctgccggtaactgggggccacccggcgattacccagacagaggggggcctccctgtaaacctcctgctcctgaagacgaagatgaagcatggaggcagcgaagaaagcagagctccagcgagatcagcctcgccgtggagcgcgccaggcgtagacgcgaggaggaagaaaggcgcatgcaggaagagcgcagagccgcgtgcgccgagaagcttaaacgccttgatgaaaagttcggcgcacctgacaaaaggttgaaagccgaaccggcagctcctccggcagcaccatctacccccgctcctccaccagccgtgccaaaggagctcccggccccaccagctcctccccctgccagcgcccctacaccagaaaaagagcctgaggagcccgcccaggcacctcctgcgcagtccactcccacccctggcgtggccgctgcaccaaccctagtaagcggagggggttccacctcatcaacatcctcaggctcctttgaagcttctccggtcgaacctcagctaccctcaaaagaaggtccagaaccccccgaggaagtcccccccccaacgactcccccggtccctaaggttgaacctaagggagacgggatcggccctacacggcagccgccatcccagggcctggggtatccaaagtaccaaaagtcgctaccacctcgttttcagcgccagcagcaagagcagctcttgaaacagcagcagcagcatcagtggcagcaacaccaacaggggagcgcacctcccaccccagtgcctccatctccaccacagcctgtgactctgggcgcagttcccgctcctcaagcaccacccccccccccaaaagcactctacccaggggccctcggacgacctcccccaatgccaccaatgaacttcgatccgaggtggatgatgattcctccttacgtggacccccgattgcttcagggccggccacccctcgacttctatccacctggggtccacccctccggactggtacctcgtgagcggtccgattcggggggaagtagctctgagccattcgaccggcacgctcctgccatgctccgagagcgaggaactccgccagttgaccccaagttagcctgggtcggtgatgttttcacggccactccagccgaacctcgcccgctgaccagccctctacggcaagcggcagatgaggatgacaagggcatgagatcagagacgcctccagtgccacccccccctccatacctggccagctacccggggttccctgaaaatggggcaccaggtcctcctatatcacggtttcctcttgaagagccagggcctaggccactcccatggccccccggatccgatgaagtcgcaaaaattcagaccccacctccaaaaaaggagcctcccaaggaggagacagctcagctgaccggccccgaagcaggacgtaagcctgccagaggagttggcagtggcggacagggaccacctccgccccggagagagtctagaacagaaactcgttggggaccaagaccagggtccagccgccgtggaattccacctgaggagcctggtgctcccccgcggcgtgccggccccattaaaaagccccctccccccaccaaggtagaagagttacccccgaagcccctggaacagggggatgaaactcccaagccccccaagcccgaccccctgaaaattacaaaagggaagcttggcggccccaaagagacgcctcccaatggaaacctttcacctgcccctagactgaggcgggactacagctatgagcgcgtaggccctaccagctgccgaggccgggggcgaggggagtactttgcccgcgggcggggcttccggggtacctatggtggcagaggtaggggggcgcgctctagagagttcagaagctacagggagtttagaggcgacgatggtagaggtggtggtacaggcggaccaaatcacccgcccgcacctcgcggccggactgcctcagaaaccagaagcgaaggatcagagtatgaagagattcccaagaggaggcggcagcgcgggtccgaaacagggtccgaaacacacgagtccgacctagcgccatcagacaaggaagcaccaacaccaaaggaaggtacgctgacccaggtccccttagcacctcctccccccggtgcccctccctccccagcgccggccagattcaccgcccgggggggcagggtcttcacaccaaggggtgtgccctcacggagaggccgcggaggaggcagaccgccaccccaggtgtgtccgggatggtccccacccgccaagtcccttgccccaaagaaaccaccaaccggcccactgcccccgagcaaagagcctctcaaggagaagcttattcccggacccctcagccctgtagccaggggcgggtctaatgggggcagcaacgtcggcatggaagacggcgaaagaccccgcaggaggagacacggccgcgcacaacagcaggacaagcctcctaggtttagacgcttgaagcaggagagagaaaacgcggcgcgaggctcagagggaaaaccttcactcacgctccctgcctcagcacccggacccgaggaggctttaacgaccgtgacagttgcacctgcaccccgacgagccgcggcaaagtctcccgatctaagcaatcagaactccgaccaggcaaacgaagagtgggagaccgcctcagaatcctccgattttaccagtgaaaggaggggagataaggaagcccctcctcccgtgttgctgacccctaaagccgtcgggactcccgggggtggcggtggaggcgccgtgccaggaatctcagctatgtctcgtggagacctgtctcaacgagctaaggacctaagtaaacgtagcttttccagccagcggccgggaatggaaaggcagaatcgacgaccgggacctggcggaaaagccggaagctccggatccagttcgggagggggcggcggcggcccaggcggacgcactggaccagggaggggggacaaaagaagctggccttctcctaagaatcgttcaagaccccctgaggaacgtccacctggcctgccgctaccacccccccctccaagttcaagtgcagttttccgactggatcaggtcatccactcaaaccccgcgggcattcagcaagccctggcgcagctttcttcaagacaggggagcgttaccgcccctggagggcatcccaggcataagcctggtcctccccaggccccacagggtccgagccccaggcctccaaccagatatgaaccccagcgtgttaatagtggcttgtcctcagacccgcatttcgaagagcccggaccaatggtccgcggcgtaggcggaacgcctcgcgattccgctggcgtctcacccttcccgcctaaacgcagggagagaccaccacgcaaacctgaactgctgcaagaggagagtctgccaccgccacattcttctggcttcttgggctcaaagcctgagggtccaggcccacaggcagagtcgagggacacaggcaccgaggccctgacaccacatatctggaacaggttacacaccgctacttcacggaagtcttaccggccatcaagcatggagccctggatggaaccgttgagtccctttgaggatgtagcaggaactgagatgagccagagcgatagtggcgtggacttatccggcgacagtcaagtgagctctggaccatgctcacagcgcagctctcccgacggaggcctcaaaggagctgcggagggaccccctaagagaccaggtgggagctctcccctgaatgcggtgccctgtgaaggtcccccagggagtgagccgccacgccggcctcctccggcgccccatgacggggaccgcaaagaattgccccgcgaacaacctttgccccccgggccaattggtactgaacggtcccaacataccgaccgggggacagaacccggtcccatacgccctagccaccgtcccgggccacccgtgcaattcggcaccagtgacaaagacagtgatcttaggctggttgtgggtgactctctgaaggctgaaaaggaacttacagcctccgtgacagaggccatacctgtctctagagactgggaacttctgccatctgctgctgcaagcgctgagccccagtccaagaatctggatagtggccattgcgtgcctgagcccagtagctccggccagaggttgtatcctgaggtgttttacggtagcgcaggtccctccagctctcaaatctctggaggtgctatggattctcagctgcaccccaactccggcggtttcagacctggcacgcctagcctgcacccctatcggtcgcaacctctatatctgccacctggacccgctccaccatccgctttgctgtcaggtgtagcactaaaaggccaattcctggattttagtaccatgcaggctacagagctgggaaagttgcctgcaggaggagtgctgtacccaccaccttcgttcctatatagcccagctttctgcccttcaccgttacccgatacctctttacttcaggttcggcaggacctaccctctccttccgacttttactctacacccttgcaaccagggggacagagcggttttttgccttcaggcgcccccgctcaacagatgttgctgcctatggtagatagccaactgccagtcgtaaactttggatcactgccacccgcccccccccctgccccaccaagtctatcactgcttcccgtcgggccagctctccaaccccctagcctggcggtgcgcccaccccctgctccggcaactagggtgctcccttcacctgcccgcccattccctgcttccctgggacgcgccgaattgcatcctgtggagctgaaaccattccaggactaccagaaactaagttccaatctgggggggccaggatcctcaaggacacctcccaccggccggtcctttagtggcttgaattcccgcctgaaagccacgcccagtacatatagcggggtcttccggacccagcgggttgacctttaccagcaggcatcccctcccgacgcgctccgttggatccccaagccatgggagcgcacaggcccgccgcctcgggagggcccatctcgaagagcagaggaaccaggttccaggggagacaaagagcccggactcccacctccacgctag

SEQ ID NO: 130039 - DNA, 6474 bp, Artificial Sequence
  Description of Artificial Sequence: Synthetic coding sequence
atgtcagaccgatccgggccaacagctaaagggaaggatggaaaaaagtattccagtttaaacctttttgacacttacaaggggaaaagcctggagatccagaaacctgccgtggctccacgacacggactccaatctctgggcaaagtggccatcgctaggcggatgcccccgcctgctaacttgcccagccttaaggccgagaacaaaggaaacgatcctaatgtgtctctggtccctaaggacggaacaggttgggcctccaagcaggaacagagcgacccaaaatcttcagacgcatctaccgcacagccgccggaatctcagccactgccagccagtcaaacacctgcctccaaccagccaaagcgccctcccgccgcccctgagaatacgccgctagttccatccggcgttaagtcttgggctcaggcaagcgtgactcatggggctcatggcgatggagggcgcgccagctcgctgctcagcaggttttcgagagaagaatttccgaccctccaggctgccggcgaccaggacaaggcagcaaaagagcgtgaatcagctgaacagtcatcagggccaggaccttccctacgcccacagaacagcacaacatggcgcgacgggggggggagaggtccggacgagctggagggaccagactcaaagctccatcacggccatgacccaaggggaggactgcagccttctggcccaccccagtttcctccatacaggggaatgatgcccccctttatgtacccgccctatctgccttttccccctccctatggcccacaaggcccgtacagatacccaacgcccgatggaccctcaaggttcccccgggtggcaggccccagaggatcagggcctcccatgcgtttggtagagccagtgggtagacctagcatattgaaagaggataatctgaaagagtttgaccaattggatcaggaaaacgatgatgggtgggccggcgcccacgaggaagttgattatacagaaaagctgaaattttcagatgaggaggatggccgcgatagcgatgaagaaggagcagaaggccaccgagatagtcaatctgcttccggggaggaacgaccccctgaagccgacggaaaaaaaggaaacagcccaaatagtgagccgcccactccaaagacggcttgggccgagacaagtcgaccccctgagactgagcctgggccccccgcacccaagcctccactgcctcccccacaccgggggcccgcaggaaattgggggccacctggggattatccggaccgaggcggcccaccctgcaaaccgcctgctccagaggatgaagacgaggcatggagacagcgcagaaagcaaagctcctcggagattagcttagcagttgaaagggcccggcggagacgagaagaagaggagagacgcatgcaagaagaaaggcgcgccgcttgtgcggaaaagctgaagcgacttgacgagaagttcggcgcacctgataagcgcctgaaggctgagcctgctgcaccaccagccgctccttcaacccctgcacctcctcccgcagtgcccaaagagttaccggctccccctgcacccccacctgcatcggccccgaccccagagaaggagcccgaagagcccgctcaggccccgcctgctcagagtacgccgactcccggtgttgccgccgcccctaccctggtcagtggcggcggctctacatcctctacatcctctgggagtttcgaggcttctcccgtcgagccacaactgccaagtaaagaaggccctgagccacccgaggaggtgccaccccccacaacaccacctgtgccaaaggttgagccaaagggagatggtatcgggcccactcgtcagccaccctcacagggattaggctatcccaaataccagaagtcactgcccccccgctttcagagacagcagcaggagcagttactgaaacagcaacagcagcaccagtggcagcaacatcaacagggctctgctccccccaccccggtgcccccctcaccaccccagccggtgactctcggggctgttccagcgccacaggccccaccgcccccccccaaagcgctgtaccccggtgccctaggtcgccctccacctatgcccccaatgaacttcgaccctcgatggatgatgatacctccttatgttgatcctagactgctgcagggaaggcctcctctcgatttctatccccctggtgtgcacccctctggcctagtgccaagggaacgctccgactcaggcggaagttccagcgagcctttcgatcgccacgctccggcgatgcttagagagagaggaaccccgcctgtggatccaaaactggcgtgggtcggagacgtttttaccgccaccccggccgagcccagaccattgacgagcccactcagacaggcagccgatgaggatgacaaagggatgcgttcagagacaccacctgtacctccaccacctccatatctcgcctcctacccagggtttccagagaatggagccccgggcccgcctatcagtcgattccccttggaggaaccaggacctagaccattgccgtggccacccggcagtgatgaggtggccaagatacaaacccctcctcctaaaaaggagccgcccaaagaagagacagcgcagctcacaggtcccgaagccgggcggaagccggccagaggagtcggctcggggggacagggacctccgcctccacggagagagtctcgcaccgaaacacggtggggacctaggccaggctcttctcgtcgcggcattccccctgaggagccaggtgccccccccaggcgggctggtccgataaagaagccgcctcctcctacaaaggtcgaagaattaccacctaaaccgctggagcaaggcgatgaaaccccaaaacctcccaagcctgatccattaaaaataacaaaaggaaaactgggcggtcccaaagaaactccacctaatggaaacctctccccagcacctcgcctgcgcagggattatagctatgagcgggtcggccctacatcctgtagaggccgcggacggggggagtactttgcacgaggtagggggttcagaggaacctatggcggtagggggagaggtgcgcgctctcgcgagtttcgctcgtacagagaatttagaggagacgatgggaggggcgggggaactgggggaccaaaccacccccccgcgccacgaggacgcacggcaagtgagaccagatcagagggatctgaatatgaggaaattcctaaaagaaggagacagagggggagcgagaccgggagtgagacgcatgaatccgacctggcccctagcgacaaagaggccccgacccctaaggaaggcactttaacccaggtcccactggcgcctcctccacccggagctccccctagtcctgcacctgcacgctttacagcgcgaggcggcagggtgttcaccccgcggggagtacccagccgaagaggacgcggcggtggaagacctccccctcaggtgtgtcccggatggtcaccgcccgcaaagtctctggcacctaagaaaccaccaaccggaccactgccgcccagtaaagaacccttgaaagaaaagttgatccccgggccattgtctccagtggctcgcggcggtagcaatggaggatccaatgttgggatggaagatggcgaacgtccacggcggaggagacacgggagagcccagcaacaggacaaacctccccgatttaggcgcctcaagcaggagagggagaatgccgctcgaggctccgaggggaaaccttcccttacactgccagcctccgcgcctgggccggaggaggcactgacaactgtcacagtggcacctgcaccaagaagagctgcagccaagtcccccgatctgagcaatcagaacagcgatcaggctaacgaggagtgggagacggcctccgagtccagtgacttcacttctgaacgaagaggcgataaggaagcgcctccaccagtgttgctcaccccgaaagctgtcggtacgccgggcggcggcggtggaggtgcggtgccaggcattagtgctatgtcccgaggggatctctcccagcgtgcaaaggatctcagtaagaggtcatttagcagtcagcggcctgggatggagcggcagaatagaaggcccgggcccggaggcaaagccggatcatccgggagctctagcggggggggcggagggggcccaggcggccggaccgggccgggaagaggcgataaaagatcttggccgtctcctaaaaatcgatctagacctcccgaggagcggccccccggattgcccctcccacctccccccccttcatcctccgcagtcttcaggctggaccaagtcattcacagtaaccctgccggaatacagcaggcactagcccagcttagcagcagacaggggtccgtgacagctcctggggggcaccctcgacacaagcccggccctcctcaggcacctcagggcccatcgcccagacccccaactcgctacgagcctcagcgggtcaatagtggactgtcttccgacccccattttgaggaacccggacctatggttagaggcgtgggcggcaccccgagagatagcgccggcgttagcccattccctcctaaacgacgagagagaccacctagaaagcccgaactgctgcaggaagaatcactgccccccccgcacagctcaggctttttggggagcaagcccgaaggtcctggcccacaggctgagtcaagagacaccggcactgaggcactcacacctcatatctggaaccgcctgcatacggctacctccaggaaaagttaccgccccagctccatggagccctggatggagcccctgagtccattcgaggatgtggccggcaccgaaatgagccagtcagacagtggagtcgatctgtccggtgatagtcaggtaagttccggaccttgctcccaacgaagctctcccgacggtggactgaaaggcgcggcagaggggccccccaagcgacctgggggaagcagtcctctcaatgctgtgccttgtgagggtccaccaggatcagagcccccccgccgcccccctccagccccccatgacggcgaccgtaaagagctgccacgggagcagcctcttccgcccggccccatcgggacggagcgcagtcagcggacagataggggaacagaaccaggccctattcgaccttcacatagaccaggaccacctgtccaatttggcacctcggacaaagatagcgatcttaggctcgttgtcggagactcccttaaggcagaaaaggaactgacagcgagtgtgaccgaagccatcccagtgtcccgggactgggagctgctgccctccgccgctgcttcggctgaaccccaatctaaaaaccttgactcagggcactgtgtcccagaaccatcttcttcgggacaacgtctgtatcccgaagtgttctatggatctgctggtccctcctctagccagataagcggaggcgcaatggacagccagctgcaccccaattccgggggctttcggcctggcactcccagcctgcacccctacaggagccaacctctatatctccccccaggaccagccccaccatctgctctgctgtctggcgtggctctgaaaggacagttcctggacttctccacaatgcaggccactgagttgggtaagttacctgctggcggcgtcctttatccacccccatcattcctctattcccccgccttttgcccctctcctctgcctgacacctctctcctgcaggtccgccaggaccttccctcaccgtcagatttttattcgacccctctacagccgggaggtcagagtggcttcctaccatccggggccccagcacaacagatgctcttacctatggtggacagccagctcccagtagtcaacttcggtagccttcctcccgcccccccacccgctccccccccactgagcctgctgcccgtcggtcccgccttgcagcctccttccctcgctgtgcgcccccccccggcccccgccacccgtgtcctgccctctcctgctcggcctttccccgcaagcctcggcagggcagaattgcaccccgtcgagctcaaaccttttcaggactatcagaagctctcctctaatctgggaggacccggttccagtagaacacctcccacgggacgatcattcagcgggctcaattctagactcaaggctactccctccacctacagcggggtttttagaactcagagggtggatctgtaccaacaggcctcaccacccgatgccctcagatggatccctaaaccttgggagcggaccgggccgcctcctcgagagggccccagcagacgggctgaggaacctggaagcagaggcgacaaagagcctggcttgccgccgcctagatag

SEQ ID NO: 130040 - DNA, 6417 bp, Artificial Sequence
  Description of Artificial Sequence: Synthetic coding sequence
atgagtgaccgtagcggcccgacagccaaggggaaggacggtaaaaaatacagctcccttaatttgtttgatacatataagggaaagagtctggaaatccaaaagccagctgtcgctcctcggcacggcctgcagtctcttggaaaggtagctatcgcccgccggatgccacctccggccaacttgccatctctgaaggctgagaataagggcaatgaccccaacgttagtctcgtgccaaaagatggcactggctgggcctccaagcaggaacagtcagacccaaagtcctccgacgccagcaccgctcaacctcctgagtcacagccactgccggcctcccagactcctgcctcaaatcagccaaaaaggcccccagccgcccctgagaacaccccgctagttccttccggcgtcaaatcttgggctcaggcatccgtaacacatggggcccacggtgacggcgggcgcgcctctagccttctttcccgtttttctcgggaagagtttcctactctacaggcagctggagatcaagataaagctgccaaggagagagaatcagcggaacagtcttccgggcccggaccaagcttgcggccgcagaacagtactacatggcgggacggcggggggcggggtccggacgaactagaaggcccagatagcaagctgcaccacggacacgatccccgcggtggtctacagccaagcggtcccccccaattccccccttacaggggcatgatgccccccttcatgtatccgccttaccttcccttccctccgccgtacggacctcagggcccataccggtaccctacccctgatggaccgagcaggttcccaagagtagctgggccccgaggctccggtcctcctatgcgtctcgtcgaacctgtgggccggccaagtatactcaaggaggacaatctgaaagagtttgaccagctggaccaggagaatgacgatggatgggccggcgcccacgaggaagtagattatactgagaagctcaaattctctgacgaggaggacgggcgcgattccgacgaggagggggccgaaggccatcgagactcacaatccgcatcaggtgaggagcgtcctccggaggctgacggaaaaaaaggaaactctcccaactcagaaccacccacacccaagaccgcttgggctgaaacttcccggcccccggagacagaaccaggtccacccgctcccaagccacccctgcccccacccggggattatccggaccggggagggccaccctgtaagccacccgctccggaagatgaggatgaagcttggagacaaagaagaaaacaatcatcttcagagatatccctggcggtcgagcgagcacgccggcgtcgagaggaggaggaacgccggatgcaggaagaaagacgggctgcttgtgcggagaagcttaagcggttggacgagaaatttggtgctccggacaaacgcctgaaggcagaaccggcagcacccccagcagccccatccacacccgcacccccaccagccgttcctaaggaattgccagccccaccagccccaccccccgcaagcgcccctacgccagagactgagcccgaggaaccggcccaggccccccccgcacagtctacaccaacccctggtgtggcggccgcaccgacgctggtatcaggcggcgggtcgaccagcagcacaagctcaggctcatttgaggccagtcctgtcgaaccacagttgccgtccaaagaaggaccagagccacccgaagaggtccctccacccacaaccccaccagtgcctaaggtcgagcccaaaggagacggcattgggcccacccgacagcctccttctcagggcttaggctaccccaagtaccagaagagcctgcctccacgctttcagagacagcagcaagagcagctactaaagcaacagcagcagcatcaatggcagcagcatcaacaaggttcagctccgcccacacctgttccaccgtcacctccgcagccggtgacactgggcgccgtccccgctccccaggctcctccccccccccctaaggccctataccccggcgcgctggggagaccaccccctatgcctcccatgaatttcgaccctcgttggatgatgatacccccatacgttgatcctcgcctactacagggacgtccgcccctcgatttttatccccctggtgttcatccctccggccttgtgccccgtgaacgctctgattctggaggatcttcgagcgaaccatttgatcgccatgcacccgccatgcttagagagcgtggaacgcccccagtagatcctaagttagcttgggtcggagacgtgttcacagctacacccgccgagcctaggcccttgacatcacctcttcgacaagcggctgacgaggatgacaagggaatgagatctgaaaccccacccgttccccctccccctccatacttggcaagctatcccggctttcccgaaaacggcgctccaggacctcctatctccaggttccctcttgaagagccaggccctcgccccctgccatggcccccgggcagcgatgaagtggccaagatacagacacccccccccaagaaggaacctccgaaggaggagacagcccagctcaccgggcccgaagcgggtagaaagccagccaggggggtaggctctggcggtcaggggcccccccccccaaggagagagagcagaaccgagactcgctggggtcccaggcccggcagttctagacgggggattcctcccgaagagcccggcgctcctccgcgcagggccgggccaattaaaaaaccccccccaccgaccaaagtcgaagaactccccccaaagcccttggagcagggcgatgagacacctaagccgccaaaacccgatcccttgaaaataaccaaaggaaagctgggtggccctaaggagacgccccccaatgggaacctctcacccgcccctaggctccggcgagattactcttatgaacgggtgggacctaccagctgtcgaggacggggtagaggtgagtacttcgcacgtgggcggggctttcgaggtacctacggggggcgcgggcggggggccgccggcaatagcgccgtcaccgagagctttgaagagatgatgggcgtggaggtcggccagggtgatcagaccacgctgttattaccggaagccgccctgccggcacgtcacggggcaagggtccaatctatgcgcaaatctcctagtggcgccggctctggggcacagaaacaggccgcccgtcctatgagagtgatctggctgttgcagactcgccggctgcctcatccaaggagagagcacagcccaagaagcagatcaccaaccactaggtcacccactttcccagcccccgcacgttttacaccaggtgtgggcgagagctcactgccagaagggatcagccctggccctcgccgcagagaacccccacaagtgtgtcccggctggtctccccccgcaaaatcgctcgcccccaagaagccacctaccggacctctccctccttccaaagagcctctgaaggagaaacttattcccgggccactctcccctgtagccagaggtggatcgaatgggggttctaacgttggaatggaagacggggaaagacccaggagaagaaggcacgggcgcgctcagcagcaggacaagccccctagatttcgccgcctgaaacaggagagagagaatgcggctagaggttccgagggtaagccgagcctgacactccctgctagcgcacccggtccagaagaagcactgacaactgtgaccgtcgccccagccccccgaagggcagctgctaaatctccagacctgagtaaccaaaatagcgaccaggcaaatgaagaatgggagactgccagcgagtcctctgacttcacatccgagcgacggggggataaagaggcccctcccccagttcttctcacccctaaggcagtaggaactcccggtggcgggggcggtggggctgttcctggaatcagtgctatgtcccgaggtgacctcagccagagagcaaaggatctaagcaagcggagcttctcaagtcagagacccgggatggagcgtcagaatagacgtcccggcccggggggaaaggccggatcatcgggaagttctagcggggggggtggcggcggtcctggcggtcggactggacccggccgcggagataagcgatcctggccctcaccaaaaaatagatcacgccctcccgaagaacggcctcccggcctgccactccctccgcccccaccgtcatctagcgcggttttccggctggaccaggtgattcacagtaacccggctggtattcagcaagcccttgcccagttaagcagtcgccagggctccgtgacggccccaggcgggcatccccgacacaaaccaggcctgccacaggcaccacagggtccatcacctcggcccccaaccagatacgagccacagcgggtgaatagcgggctctcttctgatcctcactttgaggagccaggccctatggtaagaggagtcggcggtacgcccagagatagcgccggggtttctcccttccctcctaagcggagagagcgaccacccaggaaaccagaactgctgcaggaagaatctcttccccccccccattcatcgggattcttgggatcaaagccagagggaccagggccacaggcggaatctcgcgatacaggaacagaggcgctcacacctcatatctggaaccgactgcacactgctacgtccaggaagtcttataggccctcaagcatggagccttggatggagcccctttcccccttcgaggacgtcgctggaacagagatgtctcagagcgatagcggagttgacctgagcggagacagccaggtaagctcaggcccttgttcccaacgctcatcccccgacggcggtctgaagggtgcagccgaagggcccccaaaacggcctggcgggagtagccccctcaatgccgttccctgcgaagggccacccggctccgagccccccagacgacctccccccgcaccgcatgacggagatcggaaagagttacctagagaacaacccttgccgccaggacccataggaaccgagcgatcacagaggaccgacagggggaccgagcctggcccaattcgcccctcccaccgtccgggacctcccgtacagttcggcacgtcagataaagatagcgatctccgcctcgttgtgggagatagtctgaaggctgagaaggagctgaccgcatcggtgaccgaagcgataccggtatcccgagactgggagctgctgccgtccgcagcagctagtgccgagccccaaagcaagaacctggacagcggccattgcgttcctgaacctagcagtagcgggcaaagactttatcctgaggtgttctacggcagtgctggcccctcgtccagccaaattagcggagggcatggcttaagcattacctcaaaacagtggcggaggccagggacaccctccctgcacccttacagaagccagcctctctatctgccacccggaccggccccgcccagcgcgctgctgtcaggtctcgccctgaagggtcagttcctggacttctccacgatgcaggctacagagcttgggaaactccccgctggcggcgtgctctacccccctcccagcttcttgtactcccccgccttttgcccgagtcctctgccggatactagcctgctgcaggtacggcaggacctgccatccccttctgatttttacagcacaccgctacagcctggcggacagagcggctttttaccctctggcgccccagcacagcagatgttgctccctatggtcgattcccagttgcccgtggtgaatttcggttctctccccccggccccacccccagctccgcccccactatctcttctgcccgtagggcctgccctccagcctccatccctggctgtgagacctcccccggcccctgccaccagggtcttaccctccccagccagaccgttcccagctagtctggggcgggccgaactacacccggttgagttaaagcctttccaggattatcagaagctttctagcaacctaggcgggccggggagttccaggacccctcctacgggacgcagctttagtggcctgaattctaggctcaaggctactccatctacttattcaggggtcttcagaacccaacgcgtcgacctgtaccagcaggcttcccctccagatgcactccggtggatcccaaaaccatgggagcggacaggcccaccgcctagagaagggccgtcccgacgggcggaagaacccggctcgcgcggagacaaggaaccaggcctgccacccccacgctag

SEQ ID NO: 130041 - DNA, 6474 bp, Artificial Sequence
  Description of Artificial Sequence: Synthetic coding sequence
atgtcagatcggtccgggcccaccgccaaagggaaggacggcaaaaagtattcttctctcaaccttttcgatacgtataaaggtaagagcctggaaatccaaaaacctgcagtggccccacgccacggactacagagccttggcaaagtcgctattgctaggcgaatgcccccccccgctaacctgccctccttgaaggccgaaaacaagggcaacgaccctaacgtcagcctggtccccaaagacggaacagggtgggcctccaaacaagaacagtctgatccgaagtctagcgacgcctccaccgcccagccgccggagtcccagcctctgcctgcctcccagacaccagcatccaatcagcccaagcgaccccccgccgcacccgagaacactccgctcgttccatcgggagtgaaatcctgggctcaagcctccgttacacacggagcccacggagacgggggccgcgccagctccctactttctcggttctcccgcgaagaatttcctaccctgcaagccgctggagaccaggataaagccgccaaggagcgggaatccgccgagcaatcatcaggacctggaccaagtcttcgacctcaaaatagtactacctggagagatggcggcggcagaggaccagacgaacttgagggccctgactccaaactgcaccatggacacgacccaagaggcggcctgcagccctccggccctccccagtttcctccctatcgtgggatgatgccccctttcatgtatccaccctacttgccctttcccccaccttacggtccgcagggcccctatagataccctacgccggatggacccagtcgatttcctagggtggcagggccccggggaagcggccctccgatgcggctggtagaacctgttggaaggcccagcattttaaaggaagacaatttgaaggaattcgatcagctggaccaggaaaacgatgatggttgggcaggagcccacgaggaggtcgactacacagaaaaactcaaatttagtgacgaggaggacggccgggactctgacgaggaaggtgcagaggggcacagagactcacaatcagcaagtggcgaagagcggccacctgaagccgacggtaaaaagggaaacagcccaaattctgagcctcccactccaaagacagcctgggccgaaacgagtcggccacctgagacggaaccaggcccccctgcccccaagcctccgttaccaccccctcatcgtggccctgctggcaactggggtccccctggggactatcccgacaggggtgggcctccctgtaagccccctgcacccgaggatgaagatgaagcctggaggcagagaaggaaacagtctagcagtgaaattagtttagcagtggaacgcgcccgaagaagaagagaggaggaagagcggaggatgcaggaggagcgacgggccgcttgcgcagaaaagctgaagcgcctggacgagaaattcggggcaccggataagcggttgaaggccgagcccgccgcccccccagccgcacctagtactcctgctccgccacctgctgtcccaaaggaactgcccgctccccccgcccccccccccgccagcgccccgacgccggagaaagagccagaagagccggcccaagccccacctgcccagagcacgccaactcctggcgtggctgcagcacctaccttagtgagtgggggtggctcaacttccagcacatcctccggtagtttcgaggcttcccctgtggaaccacaactccccagtaaagagggccccgagcctcctgaggaagttcctcccccaacaaccccgcccgttccgaaagtggaacccaagggagacggtatcggcccaacccgccagccacctagtcaggggttgggctacccgaaataccagaagagcttaccccccagattccagaggcaacagcaggagcagctgctgaaacagcagcaacaacaccagtggcaacagcatcagcagggctccgcgccacctacacctgttcctccaagcccaccccagcccgtgacactgggcgctgtccctgccccccaggcaccaccccctccacctaaagccctttaccccggggccttgggtaggccaccacccatgccccccatgaactttgatccccgctggatgatgattcccccatacgtcgaccctcgtcttctgcagggacgaccacccctggacttctatcctccgggcgtacatccttctgggttggtgccgcgtgagcggtctgatagcggtgggtcaagctctgagccctttgatcgccatgctcccgcaatgttaagggaacgggggacacccccggtggatcctaagttggcgtgggtgggagatgtgttcaccgctacacctgcagagcctcgtccgctcactagtcccctcagacaggcagctgacgaggacgataagggcatgaggtcagaaaccccccctgtgcctcctcctcccccatacctagccagctatccaggctttccagagaacggggcccctgggcctccaatttctcgcttccctctagaagagcccggtccccgacctctgccgtggcctccgggcagtgacgaggtggctaaaattcaaacacctccacctaagaaggagcctcccaaggaagaaacggctcagcttactggcccggaagcaggtaggaagccggccagaggcgtaggctccggcggtcaggggcccccgccgccccggcgggaatccaggacagagaccagatgggggccaagacctggaagctcccgccgggggatcccccccgaagagccaggtgcccctccccggcgcgctggtcccattaaaaagcccccacctccaaccaaagtggaagagctccctccaaaaccacttgagcagggcgatgagaccccaaagcctcccaagcccgatcctctgaaaattacaaaagggaagctcggaggtccgaaagaaacccctccaaatggtaatctgagccccgccccaaggcttcgcagagactacagctacgagagggttgggcctacaagctgcaggggccgtggccggggagagtattttgcacgcggcaggggctttcgcggcacctacggagggagaggaaggggcgcaaggtcgagagagttcagaagttatcgtgaatttaggggcgatgatggtcgggggggtggcactggaggaccgaaccacccccccgcgccccgcgggcgtaccgcttccgaaacgcgctcagagggatcagaatatgaggagatccctaagagaaggcggcagagagggagcgagactggctcagagacgcacgagtcagacttggcacccagtgataaagaagcgcccacaccaaaggagggaacactgacccaggttcctctcgcacctcctcctccaggagctccaccctcaccagcacctgcgaggtttactgcgcgcgggggaagggttttcactccccgaggagtaccctcccggcgcgggcgcggcggaggtagacctcctccgcaggtctgcccgggatggtccccgcccgctaagtctcttgccccgaaaaagccaccaacaggacccctaccccccagtaaggaaccactcaaggaaaaactcatccctggccctctgtctcctgtcgcccgcggtggcagcaatggcggatcaaacgtgggaatggaagatggcgaacgacccaggcggcgcaggcatgggagggcccagcagcaagataagccgccacggtttagacggctaaagcaggagagagagaatgcggcaaggggcagcgagggaaagcccagcctgacccttcccgcaagcgcgcccggccccgaagaggcacttactaccgtcacagtcgcccccgcccctcggcgtgccgccgcaaagagccctgacctgagcaaccagaactccgatcaggcaaacgaagagtgggagacagctagcgaaagttccgatttcactagcgagaggagaggggacaaggaggcccctcctccggtgctgttaactcctaaggccgtcggtacccccggaggcggcggtggaggagccgtgcctggaatatcggccatgtcaaggggagacctaagccaacgggcaaaagatcttagcaaacggagtttttcctcccagcgtcccgggatggagcgccaaaacaggcgtcccggcccgggaggaaaagccggcagctccggctcatcatctggcgggggcggtggtggccccgggggacggactggccccggtaggggggataagcggagctggcctagcccaaaaaatcggagccgtccacccgaagagagacctcctggcttgcctttgcctccccccccgcctagctcatctgccgtttttcggttggaccaggtcattcactctaacccagccgggatccagcaggccttggctcagctgagtagtcgccaaggttccgtgacagccccaggcgggcatccaaggcacaaacctgggccaccacaggcaccccaggggccctcgcccagacctccgactaggtacgaaccacaacgggtaaacagtggcctttcttctgatccacatttcgaggagccgggtcctatggtccggggcgtgggtggaacacctcgtgattcagcaggggtgtcaccctttcccccaaaaagacgggagcgacctccgcggaagcccgaactgttgcaggaagagagcctgcctccaccccattccagtggatttctcggatccaagcccgagggacccggaccgcaggccgagtcccgggatactgggacggaggcactgaccccccatatctggaaccgactgcataccgcaacctcgaggaagtcctataggccctctagcatggagccctggatggaacctctgtcccctttcgaagacgtggctggaaccgagatgtcccaatcagattctggcgtggatctatcaggagattcccaagtgagctcgggcccctgcagccagcggagctctccagatggcggattaaaaggcgccgctgagggcccacccaagcgccctggcggatcgagtcctttgaacgcagtgccttgtgagggacctcctggctcagagccacctcggaggcctccccctgctccacacgatggggatcgaaaggagctcccacgcgagcaacctctcccacccgggcccattgggaccgagagaagtcagcacactgataggggcacggaacccgggcccatcaggccctcacatcggcctgggcctccagtgcagttcggtaccagcgacaaagactctgacctgagactcgtggtgggcgatagcctcaaggctgagaaggagttgacggcctcagtgactgaagcaatcccagtttctagggattgggagcttcttccaagtgccgcagcttcagcggagcctcagtctaagaacctggacagcggccactgcgttcccgagccctcaagcagcggccagcgcctgtacccagaagtcttctatggaagtgctggaccttcatcatctcagatatcaggtggagccatggatagccaactccaccctaactcaggcgggtttcgtcccggaactcccagcctgcacccttaccggagtcagcccttatatctgccacccgggcccgcccctccctctgcgttactcagtggcgtcgctctcaaggggcagtttctggacttcagtactatgcaggcgaccgaactgggaaagttgcccgcaggaggagtcctctatccacctccatcatttctctatagtcccgctttttgtccgtcacccctgcctgacactagcctcttgcaagtgcgacaggacctacccagtcccagcgacttctacagcacccccctacagcccgggggccagagcggcttccttcctagtggggcgcccgcacagcagatgctgcttccaatggtcgactctcagcttcccgtcgtgaacttcgggagtttaccgcccgccccccctccagctccaccaagtctgagcttgctgcccgtggggcccgctctgcagcccccctccctcgctgtgaggccccctcctgctccagctactcgtgtgttacccagccctgcaaggccctttcccgcctccctgggccgagcggagctacatcctgtggagctgaagccctttcaggattaccaaaaattgtcttcaaatctcggtggacctggttcaagtcggactcctccaacgggccggtccttctccggtttgaattcccgcctcaaggctaccccgtccacctattccggggtgtttcgcacccagcgggtggatctctatcaacaagcctcgccacctgacgcgctaaggtggatcccaaagccctgggagcggactggcccccctcctcgcgagggaccgtcccgtcgcgccgaagaaccggggtctcggggagataaggagccgggactcccccctcccaggtag

SEQ ID NO: 130042 - DNA, 6474 bp, Artificial Sequence
  Description of Artificial Sequence: Synthetic coding sequence
atgtccgatcgatccggcccaaccgctaagggcaaggatgggaagaaatactcttctctcaacctgttcgacacctataaaggtaaatcactagagatccagaagcccgccgtggccccgaggcatggattgcaatcacttggcaaagtcgcaatcgcaagaaggatgcctcctcccgctaacctgcccagcctgaaggccgagaataagggtaatgatccaaacgtctccctcgtaccaaaggacgggaccggctgggcctctaaacaagagcaaagtgacccgaagtcttcagatgcctctactgctcagcctctggagtcacagccgctgccggcatctcaaacccccgcctcaaatcagcctaaacggccgcccgccgccccagaaaatacacctctcgttccctctggcgtaaaatcctgggcccaggcttcagtcacccacggggcccacggcgacggcgggcgagcatcctccctgctgtctagattttctcgggaggaattcccaacactgcaggccgccggggatcaggataaggctgcaaaggagcgggaatcagctgagcagagtagcggcccaggtccttccctgagaccacagaactcaactacctggagggacggcgggggtcgtggacctgatgaactcgagggtcctgacagcaaactgcaccatggccacgaccctcgaggggggcttcagcccagcggcccaccgcagttcccgccatatcgcgggatgatgcccccttttatgtacccaccttacctccctttcccacctccatacgggcctcagggtccataccgctaccctactcctgacgggccctcacgcttcccccgggtggccggtccacgcgggtccggcccccccatgagattagtggaaccagtgggccggcctagtattttaaaagaggataatctgaaagaattcgaccagttggatcaagagaacgacgacgggtgggctggagcccatgaagaggttgattataccgagaaacttaaattctctgacgaagaagacggccgcgatagtgacgaggaaggcgccgagggccatcgcgactcacaaagcgcgagcggcgaggagagaccccccgaggcagacggaaagaagggaaactcaccaaacagcgagcctcctacgcccaagactgcttgggcggagacgtcacgcccacctgagacagaacctggaccccccgcccccaaaccgcccctgccgccaccgcataggggcccagcgggcaactggggcccccctggcgactatcccgataggggcggaccaccttgtaagcctccggcccctgaagatgaagacgaggcgtggagacagcgcaggaagcagagttcctctgaaatcagcctggcagtcgagcgcgctaggagacgccgggaagaggaagaaaggaggatgcaggaagagaggcgcgccgcctgtgcagagaagctcaagcgcctagatgagaaattcggggccccagataaaagattaaaagcggagccagctgccccccctgctgcaccatctactccagccccacccccagcagttcctaaagagctccccgcaccacctgcccctccaccagcttccgcaccaaccccagagaaggaaccagaagagcctgctcaagccccaccagcgcaaagcacccctacacctggcgtcgccgctgcaccgaccctggtgtctggcgggggctccaccagctcgacctcatccggctcatttgaggcaagccccgttgagccacagcttcccagcaaggaaggccccgaacctcccgaagaagtgcctcccccaacaactccccccgtgccaaaggtcgaacccaagggcgacggaatcggtcctacacgccaaccaccgtcacaaggcctgggatatcctaaataccaaaagtccctccccccacgcttccagcggcaacaacaggagcagctgctcaagcaacagcagcaacatcagtggcagcagcatcaacagggtagcgctccccccactcccgtgccaccctctcccccacagcccgttactctcggcgcggttccagccccacaggcaccccccccacccccaaaggccctgtaccccggtgctctgggccgtccacccccgatgccaccaatgaactttgaccctagatggatgatgattcccccctacgtggacccaaggttattgcagggacgccccccactggacttctatccacccggtgtccacccttcagggttagtgccgagagagcggtccgactctgggggctcctcttccgagccttttgaccggcatgcccccgcgatgctccgtgaacgagggacaccgcctgttgatccgaaactcgcatgggtgggtgacgtgtttactgcgacacccgccgaacccaggccactcacttcccccctccggcaagccgctgatgaggacgacaagggcatgagatcagagactcctccagtacccccgccaccaccatacttggcctcttacccgggattccctgagaatggagcaccagggccccctatatcaagatttccgctggaggaacccggacctagacctttaccctggcccccaggctcggacgaggtggcaaagatccagacaccacccccaaagaaagagccacccaaagaggaaactgcccagctcacggggcccgaggcaggaagaaaacctgcccggggagtcgggagcggcggacaggggccacccccaccccgacgggagtcacgaacggagacgagatggggcccacggcccggctcttcacgccgtggaattcctccagaagaacctggagcacctccaagacgggccggccctattaaaaaacccccgccacccaccaaggttgaggaactccccccaaaaccccttgaacagggcgatgagacccctaagccacctaagccagaccctctgaaaattactaaaggcaaactcggaggccccaaggagactccccctaatggaaatctctcaccggccccacggctgagacgtgattacagttatgaacgggtaggtccgaccagctgcaggggacgtggacggggagaatatttcgctcgtggccgcggttttcgaggaacatacggtggccgagggcggggggcccgtagcagggagttccggtcttacagagaatttcggggggacgacggccgcggcgggggcaccggagggccaaaccaccctcctgctccccggggccggaccgctagtgagacccggtctgagggatccgagtacgaagaaatcccaaaacggagacggcagagaggttctgagaccggatcagagactcatgaatcggacctggccccttcagacaaggaggcccccaccccgaaagagggcacgctcactcaggtacccctggccccccccccccccggagctcccccttcaccagcccctgcgcgttttaccgccaggggagggcgggtgtttacacccagaggggttccctcccgccgaggtcgcggcggcggaaggccacctcctcaggtgtgtccgggttggagcccccccgccaagtcccttgccccaaagaaaccccctacaggcccactacccccttccaaggagcccctcaaagagaaactcattcctggtcccctctctcccgtggcccgcggcggatcaaatggcggaagcaatgtcgggatggaggatggagagcgacctcgaaggcgccgccatggcagagcccaacagcaggataagccacctcgctttcgtcgactgaaacaagaaagggagaatgctgcccggggctctgagggcaagccttccctgacactcccagccagcgctccgggccctgaggaggctctgaccaccgtcaccgtcgcacccgcccctcgtcgagcagccgccaagtcaccagacctgtcaaaccagaacagcgaccaggctaatgaggagtgggagactgcatcagagagtagtgattttacctctgagcggcggggagacaaggaagcgcctccaccagttctgctgaccccaaaagccgtgggaactccaggggggggaggagggggagccgtgcccggcatatccgcgatgtcccgtggcgacttaagccagagggccaaggatctcagcaagcgtagctttagctcccaacggcctggtatggaacgtcagaatagacggcctggccctggtggtaaggccgggtcttcggggtcatcttcaggcggaggggggggaggtcctggcgggcgcacggggcctgggaggggtgataagcgatcatggccatctcctaagaaccgatcacggcccccggaggagcgacctcctggcctgccccttcctccaccacctccatcgagctcggccgtgttccggctggaccaggtaatccacagtaatcccgcaggtatccaacaggctttggctcaactgtcctcccggcaggggagtgttacagctcctggcggacatccacgccacaaaccaggacccccgcaggccccccaagggcccagccctcgcccccccaccagatatgagccccagagagtcaactccggactctccagcgatccgcacttcgaggagccagggccaatggtgagaggtgtgggcggaacccccagggattctgccggcgtctccccattcccgcccaagagacgtgagcgacccccccggaaacctgaactgcttcaggaagaaagtctgcctcccccccactcaagcggctttctgggatctaagcccgaaggtccaggcccgcaggcagaatccagggatacgggcaccgaggctctgaccccacatatatggaatcgattacacacggcaactagccggaagtcttacagaccatcatccatggagccatggatggaacctctgagcccattcgaggacgtggctggaactgagatgagtcagagtgatagtggtgtggatctgtccggcgatagccaggtctctagcggaccttgctcacaacggagctctcccgacggtggactcaaaggagctgctgaagggccacccaagcgcccaggcggttcctcgccattgaacgccgttccttgcgaggggccgcctggtagcgagcctccgagacgaccaccaccggccccccacgatggcgatcgcaaggagttacctagagaacagcccctgcctcctggtccaatcggcactgaaagaagccagaggactgaccgcggcaccgagcccggccccatccggccatctcaccggcccggacccccagttcaattcggaactagcgacaaggatagtgacctcagactggttgtgggggactccttaaaagctgaaaaagaactcacagcatccgtcaccgaagccattcccgtctctagagactgggagctgcttcctagtgctgccgctagcgccgagccccagtctaaaaacctggactccgggcactgtgtgccagagcctagtagttccggacagagactgtatccagaggtgttttacggatcagcaggcccttccagctcgcaaatctctgggggggccatggattcacagttgcaccccaatagtgggggctttcggccaggcaccccctccttacatccctatcgcagtcaacctctgtatctgccgccaggcccagccccacctagcgccctgctctccggggtcgccctcaagggccagttcctggacttcagcaccatgcaagcgacagaactgggaaaacttccggccggaggggttctgtacccgcctcccagcttcttgtacagccccgcattctgtccctcaccccttcctgacacctcccttcttcaagtacgccaagacctaccttcaccctccgatttctacagcacccctctccagcctggggggcagtccgggttcctccctagcggtgcccccgcacagcagatgttgctgccaatggtggacagccagttgcccgtggtgaacttcggatctttacctcctgcccctccaccggccccccccccattgtccctgctgccagtcggcccagccctccagcccccgtcactcgctgtgagacccccccctgcgccggctacgcgtgtgttgccctccccagcaagacccttccctgcctctctgggccgagccgaactgcatcccgtcgagctgaagccctttcaggattatcagaaactctcgtctaatctgggcgggccagggtcctccagaacccctcccactggccgttctttttctggattaaactctcgactgaaagcaacccctagtacctactcaggagtgttccgaactcaacgggtggacttgtatcagcaggcgagcccacctgacgcactgaggtggatccctaagccctgggagagaacagggcccccacctagagagggacctagccggcgggccgaggagcccggatctaggggggataaggaacccgggcttccaccaccccggtag

SEQ ID NO: 130043 - DNA, 6474 bp, Artificial Sequence
  Description of Artificial Sequence: Synthetic coding sequence
atgtccgatcgttctgggcctaccgccaaggggaaggacggaaaaaagtattcctcacttaacctgtttgacacctataaaggcaagtccctcgaaatccagaagcccgccgtcgcccctagacacggtttgcaatctttgggcaaggttgccatcgcaaggcggatgccaccccctgccaatcttccctccctgaaagcggaaaataaggggaacgatcctaacgtgagcctggttccaaaggacggaaccgggtgggctagcaagcaagaacagagcgaccctaagtccagcgatgcctccaccgctcagccaccggagtcccaacccttgcccgcctctcagaccccagcctcaaatcagcctaagaggcctccagcagctccagagaatacgccacttgtcccatccggcgttaaatcatgggcacaggcttctgtaacacacggagcgcacggtgacgggggtagagctagtagcctgctgagcaggttctcccgtgaagaattccctaccctacaggcagcgggagaccaagataaagccgctaaggaacgagaatctgctgagcagtctagcggccccgggcccagcttgagaccccagaactctaccacctggagggatggaggaggtcgcgggcccgacgagctcgaaggaccagactccaagctgcaccacggacatgaccccagaggaggactgcaaccgtcgggtcccccacaattcccaccgtacagaggcatgatgcctccattcatgtaccctccctatctgccattcccccccccatatggaccacagggaccgtaccggtatcccacccccgacggccctagcagattcccccgggtggccggtccgcgaggaagcggcccccctatgcgcttggttgagccggtgggacggcctagcatattgaaagaagacaacctgaaagagtttgaccaattagaccaagaaaacgatgacggttgggccggagcccacgaggaggtagattataccgaaaaacttaaattctcggacgaggaggacggacgggactctgacgaagagggagcagagggacaccgggattcccagtccgcttcaggggaagagaggccacccgaagccgatggaaagaagggaaattcccccaacagtgagccccccacccctaaaaccgcatgggctgagacgagcagacctccggaaaccgaacccgggccaccggccccaaaaccccctcttcctcccccccataggggacccgccggaaattgggggccgccaggcgattaccccgaccgggggggacctccttgcaagcccccggcaccagaagatgaagatgaagcctggcgtcaacgaaggaagcagtccagctccgagatctccctggctgtggaacgggcaaggcggcgcagggaagaagaagagaggcgaatgcaggaggaacggcgcgcggcctgtgccgaaaaattgaagagactggacgaaaagttcggagcccccgacaaaaggttgaaggctgagcccgctgctccccccgccgctccatccacacccgcgccaccccccgccgttcccaaagagctccctgccccacccgcaccaccacccgcttcggcacctacgcccgaaaaggagcccgaggaaccggctcaagccccccctgcacagagtactcctactccaggcgtcgctgccgctcccacgctggtttccggcggagggtcaaccagtagcacaagttctggctcttttgaggccagtcctgtggaacctcagttgccctcaaaggaaggtccggagccgccggaggaagtgccacctcctaccactccaccagttccaaaggtcgagcccaagggagacggaattggacctactcggcagccgccttctcagggactcgggtaccccaaataccagaaatcccttccgcctcgctttcagcgtcagcagcaagagcagctgctcaagcagcagcagcagcatcagtggcagcagcaccaacagggctccgcaccgcccacgcccgtaccaccgtcgccacctcagccagtgaccttgggcgcagtgccagccccacaggccccaccgccacctcccaaggccctgtatcccggggccctgggcagacctccacctatgcctcccatgaactttgatccccgctggatgatgatacctccgtacgtcgaccctcgcctgttacagggccggccaccgctagacttttatcccccaggcgttcacccaagtggcctggttccgagagaacgttccgatagcggcggcagtagtagcgagccatttgaccgtcatgccccggccatgctccgcgagcgggggacacctccagtggacccaaagttggcttgggtgggtgacgtgtttaccgctacaccagccgagccccgccccctgaccagtcccttgcggcaggctgccgatgaagacgataaaggcatgcgatccgaaaccccaccagtgccaccacccccaccttacttagcttcttatccaggatttcccgagaatggggctccaggaccacccataagcagattccctctggaggagcccgggcctaggcccctaccatggccacccggctctgatgaggtggccaagatacagacgccccccccaaagaaagagcctcctaaagaagaaactgctcagctgacaggcccggaggcaggtcgaaagccggcacggggggtggggtcagggggccaaggcccgcctcctcctcgtcgagagagccggacggagaccagatggggcccgaggccgggcagcagccggcgaggaatacctccagaagagcctggggctccgcccaggagggctggtcccattaaaaaacccccgccacctaccaaggtcgaggagctgcccccaaagccacttgaacagggggatgaaactcccaagccccccaaaccagaccctttgaaaataacaaagggcaagctgggcggacctaaagagacgcccccaaatgggaatttaagtccagcacccaggctacgaagggattactcttacgagcgggttggtcctacaagctgtagggggcggggccgaggagagtactttgcgcgcgggaggggcttcaggggaacatacggtggacgaggcagaggggcccgatcacgggagttcagatcttatcgcgaatttcgcggagacgacggcagaggtggcggtacaggagggcctaatcaccccccagctccgcgtggacgcacggcttcagagaccaggtccgagggatcagaatatgaagagattcctaaaagacggcgtcagagaggctctgagaccggctcggagacacacgagtcggatctcgctccgtcagacaaggaggcaccaaccccaaaggagggtacgctgacacaggtgcctttagcgccaccccctcctggcgcccccccttctccggcccccgccagattcaccgcgcgtggggggagagtctttaccccaagaggtgtcccgtctcgcagggggcgcggaggaggtcgccccccaccacaagtctgtcccggttggtcacccccagctaagtccctggctccaaaaaaacctcccacggggccgctgcctccctcgaaggagcccctcaaggagaaattgatcccgggtccactgtcccccgtcgcccgggggggctcgaacggggggtctaacgtgggcatggaagatggagaacgcccccgaagacgccggcacggcagggcacagcaacaagataagccgccgaggtttagacgtctgaaacaggaaagggagaatgccgctcgaggaagcgaaggtaagccgtccttgacattaccagcttcagctcccggcccagaggaagccctcactacagttactgttgctcccgctccccggcgggccgccgccaaaagccctgatttgtccaaccagaacagtgaccaggcaaatgaagaatgggagaccgctagcgagagtagcgatttcacctcggagcgccgtggcgacaaggaggccccaccaccagtgttgctgacaccaaaagccgtcggcacgccaggtggagggggcggtggagctgtgccagggatatcggcaatgagcagaggagatttgagtcaaagagccaaggatctgtctaaaaggtcttttagctcccagcggcctgggatggaacgacagaaccgtcgacctggccccggggggaaggctgggagttctggctcaagctctgggggaggcgggggtgggccaggaggacgtacaggaccaggacgcggagacaaacggtcttggccttcacccaagaacagatctaggccacctgaagagaggcctccaggtctgcccctgccaccccctccaccatcgtcctctgctgtctttcggctggaccaggtaatccattccaacccagcaggcatccagcaagccctggcgcaattgtctagcagacaggggtctgtgaccgcaccgggggggcatccgcgccataagcctggcccacctcaggccccccagggcccaagcccgcggcccccgacacgttacgaaccacaaagggtgaacagtggattgtcctccgatccgcacttcgaagaaccgggccctatggtgcgcggggtcggaggcaccccaagagattccgcaggggtctcccccttcccacctaaaaggcgagaaaggcctcccaggaagcctgagctgttgcaggaagaaagtctgccccctccccattcctcaggcttcctcggttccaaacctgaaggacccggaccccaggctgaatcacgtgacactggcacggaagccctcacaccccacatatggaataggctgcacaccgctacgagccggaagtcatatcgtccgagctccatggagccttggatggagccactgtcgcctttcgaagacgtagcaggcacagagatgagtcagagcgacagtggagttgatctttcaggcgacagccaggtgagttcaggaccttgtagccagagaagttctcctgatgggggccttaagggagccgctgagggccctcccaagagacccggcggaagctctccactcaatgccgttccatgtgaaggacctccaggaagcgagcccccaagaagaccgccccccgcaccacacgatggcgataggaaagaactaccacgagaacagcctctccctccaggacccattggcaccgagaggagccaaaggactgacagagggacagagcccggaccaatacggccaagtcatagaccgggaccaccggtacagtttggtaccagcgacaaggacagtgatttaaggctcgttgtaggggattcactaaaggctgaaaaggagctaactgcgtctgtgacagaagccattccagttagcagagactgggagctgttgcccagcgctgccgcctccgccgagcctcagagtaagaatctagactctgggcactgtgttcccgagccctcctcctcggggcaacgcttgtaccctgaagtgttctacgggtctgccggcccgagtagcagtcaaatatctgggggcgcaatggactcccagctgcaccctaatagcggtggtttccgccccggcaccccatctctgcacccttacaggagtcaacccttgtatctgcctcctggaccagctcctccttcagcactgctgtcaggcgttgcattgaaagggcaattcctcgattttagtactatgcaagccactgaactcggcaagctccccgctgggggagttctgtacccacccccatctttcctgtacagccctgccttctgccccagtccattacccgacacatctcttcttcaggttagacaggacttgccctccccctctgacttttattctacgccattacaacctgggggccagtccggtttcctgccctcgggcgctccagctcaacaaatgctcctcccaatggttgactctcaactgcctgtggtgaatttcggaagccttccaccagccccccccccagcaccccccccactaagcctcctgccagtgggccccgccctccagccacccagtctggccgtgaggccaccaccggcgcctgccacccgcgtcttaccctctcccgcaaggccgtttccagccagcctgggccgagcggagctgcatcctgtggagctcaagccatttcaggactaccaaaagctgagtagtaatctgggtggccctggaagttctcgcacacctccaacgggaaggtcattctccggcctgaacagccgcctcaaggcaactccttccacttacagtggtgtgtttcggacccagcgcgtagacctataccagcaagccagcccgccagatgccctgcgttggatccctaaaccttgggaacgaactggtccacccccacgggagggaccttccaggagagcagaggagcctggatcaaggggggacaaggagcctggactaccccctcctagatag

SEQ ID NO: 130044 - DNA, 6474 bp, Artificial Sequence
  Description of Artificial Sequence: Synthetic coding sequence
atgtcagatagatctggaccaaccgccaagggcaaggatggcaaaaagtattcatcactgaacctgtttgatacatacaaaggaaaaagcttagaaattcagaagccagctgtcgctccacggcacggcctgcagtccctaggtaaagtcgcgatcgcccgccgtatgcctcccccagcgaacctcccatcattgaaggcggaaaacaagggtaacgaccctaacgtttccctggtgcctaaagatgggactggctgggctagcaaacaggagcagtctgacccgaagtcctctgacgcgtctactgcccagcctccagaaagccagcccttgcccgcatcacaaactcctgcctccaaccagcctaaaagaccacctgcagctcctgagaatacccccctggtgccaagcggcgtgaagagctgggcccaggcctctgtgactcatggggcgcacggagacggtggtcgcgcctcctccttgctgagtagatttagcagggaggaattcccaaccctgcaggctgcaggagatcaggacaaagctgcgaaggagagagaatcagcggagcagagtagtggccctggcccgagtctgagaccgcagaactccacgacatggcgcgacggaggaggtagaggcccggacgagttagaaggcccagactctaagctgcaccacgggcatgaccctagaggaggtctgcagccctcaggtccacctcaatttcccccctatcgcggtatgatgcctcccttcatgtatcccccctatctccccttccctcctccatacggacctcaagggccgtatcggtacccgacacccgacgggccttctagatttcccagagtggccggacctcgtggtagtgggccccctatgcggctagtcgaaccggttggacggccgagcatcttgaaggaagataatttaaaggagttcgaccagctggatcaagaaaatgacgacggatgggcaggcgcacatgaagaggttgattacaccgagaagctcaagttctccgacgaagaggacggcagggactccgatgaggaaggagcagaaggtcatagagattcccagtctgctagtggagaggagagacccccagaggcagacgggaagaagggcaatagtccaaattcagagccccctaccccaaaaaccgcttgggccgaaacctccaggcctcccgagaccgaacctggaccccccgcccccaaacccccgctgcccccccctcacaggggtccagcaggaaactggggcccccctggagattaccctgatagaggcggcccaccatgcaagcccccggcccccgaagatgaggacgaagcatggaggcagaggcgcaagcagagttcatctgaaataagtctggcagtagaaagggctcggcggagacgagaagaagaggaaaggaggatgcaggaggagaggagagctgcgtgcgcagagaagcttaaaagactggatgagaagttcggggccccagacaaaaggctcaaggccgaacctgccgctccaccggccgcaccttcgaccccggcaccacctcctgcggtgcctaaagaactgcccgctccccctgctccaccacccgcctcagcgcctacccctgagaccgaacctgaggagcccgcccaagctcccccagcgcagtcgactcctacacccggcgtggccgctgctcccacactcgtaagtggggggggatctacctcttcaaccagctctggcagtttcgaggcctcaccggtcgagccgcagttgccatctaaagagggaccggagcccccagaagaagtcccgccccctaccacacctccagtgcccaaggtggaacctaaaggcgatgggattgggcccacccggcagcctccttcccaggggctgggataccctaagtaccaaaaaagcctgcccccccgcttccagcgccagcaacaggaacagttgctcaagcagcagcaacagcatcagtggcaacagcaccagcaggggtccgccccacctaccccggtacctccatctcctccccagcccgtgactctgggagccgtgcctgctcctcaggcgccgccccctccccccaaggccctttaccctggagcccttgggaggcctccacccatgccccccatgaactttgatccaaggtggatgatgatccctccctatgtggacccccgattgttacaaggccggccgcctctggacttttacccccctggcgtgcacccctcaggcctggtgcctcgagagcgatccgattccggcggctcttcgtcggagcctttcgacagacacgcccctgccatgttgcgagagaggggcaccccccccgtggatcctaaactggcctgggtgggcgatgtgtttactgccacaccagcagaaccccgtccgctcacatcacctctgcgccaggccgccgatgaagatgataaagggatgagatcggagactcctccggtgcctccaccacccccctacctagcttcctatcccgggttccctgaaaacggcgcccctggccctccaatatcacgtttccctctcgaagagcccggcccccggccgctaccatggccacccggctctgatgaagtggcgaaaattcagaccccgcctcccaaaaaggagccgcccaaggaggaaaccgctcagctcactggtcctgaggccggccggaagccagcccgcggagtgggttcaggcgggcagggtccaccacctcctaggagggaaagcagaaccgaaacccggtgggggccccgacccggtagtagtagaagaggtatcccgcctgaggaacctggggccccaccaaggagggcgggtccaataaagaaaccccctccacctaccaaagtcgaggaattgccacctaaacctttggagcaaggggatgaaactcccaagccacccaaacccgatcccttgaagatcaccaagggcaagctgggaggccccaaagagactcctcctaacggtaaccttagcccggccccacggctgcgccgcgattactcctacgaacgggtgggcccaaccagctgcagaggccgcggccgcggggagtatttcgctaggggccgcggctttcgcgggacatatggcggcagaggcaggggggcaagatcaagggagtttaggtcttacagagaatttcgaggtgacgatggacgagggggggggaccggaggccctaatcatccgcctgctcctcggggccggaccgcaagtgaaacgcgatctgagggttccgagtacgaggaaatacccaagcggcgtaggcaacgaggatctgaaaccggctcggaaacccatgagtccgatctagccccttctgacaaggaggcccctacaccgaaagagggaacactgacacaggtacccttggctccccccccacctggggcccccccctcgccagcccctgccagattcacagccaggggcggtcgagtctttacgccaagaggcgttccctcccgccgaggtcgggggggcgggagacctcctccccaagtctgcccaggatggagtccaccagcaaagtcgctcgctcctaagaaaccacctacaggaccactgccaccttcgaaggagccactgaaggagaagctgattccaggaccgctgtcacccgtggcccgcgggggcagcaacgggggcagcaatgtggggatggaagatggcgaaagaccgcgtcggagaagacacgggcgggcccaacagcaggataaacctccccgatttcgaagactgaagcaagaacgtgaaaatgcagcccgaggcagcgaaggcaagcctagcctcaccctgcccgcttccgccccagggcctgaagaggctttgactaccgtgaccgtggcacctgcccccaggcgcgctgccgccaagagccctgatctgagtaatcaaaattccgatcaggcaaacgaggagtgggaaactgccagtgaatcttctgacttcacctccgagcgccgtggcgacaaagaggcccctcccccagtcctcttaaccccaaaggctgtgggcacacctggcggcggtggtggaggcgctgtaccaggtatctcagcgatgtcccgaggcgacctgagccagcgagcgaaagaccttagtaagcgtagcttctccagccaaagaccaggcatggagagacaaaacaggagaccaggaccgggtggcaaggccggctcttctggatcaagcagcggagggggtgggggagggcccgggggtaggaccggcccagggagaggtgacaaaagatcctggccaagtcccaagaacaggagtaggcccccagaagaaagacctcctggccttccgcttccgccaccccctcctagcagcagcgctgtgtttaggttagaccaagtcattcactctaatcctgctgggattcagcaagccttggcccaactcagcagcagacagggaagtgtgacagcccctggcggccatccccggcataagcccgggctgccacaagccccccagggaccatccccacgccctcctactaggtacgaacctcagcgcgtaaatagtggtctgagttctgatccccattttgaggaacccggaccaatggttcgtggtgtcggaggcacgcctcgcgactctgcgggcgttagcccattccctccaaagagacgcgagaggccacctagaaagcctgagctgttacaggaggagtctctacctccaccccacagttccggcttcctgggctctaagcccgagggccccggtcctcaggctgaatcccgcgacacgggtacagaggcactaaccccgcacatctggaacaggctccacactgcgacctcaaggaaatcatatcgcccaagctctatggaaccgtggatggagccactctctcctttcgaagacgtggccggcacggaaatgagtcagagcgactctggcgtagatctgtccggcgattctcaagtaagtagtgggccttgcagccagaggtccagcccagatgggggcttgaagggagccgcagaggggcctccgaaaaggccagggggaagctctcctcttaatgcagttccctgtgagggcccgccggggtctgaacccccgcgcagaccccccccagcaccacatgatggggataggaaagagctccccagagaacaacccctgcctccggggcctatcgggacggagcgcagccagaggaccgaccgggggaccgaacctggaccaatcagaccttcacataggcccggccctcccgtgcagttcggaacctccgacaaggatagtgatctgaggctggtcgtcggagacagcctgaaagcggaaaaagaactgaccgctagcgtgactgaggccatacctgtgagccgcgactgggagcttttgcctagcgcggcagcaagcgcagagcctcagtctaagaatctggatagcggccactgcgttcccgagccctccagcagcggacaacggctgtacccggaggtgttctacggctccgccggcccgtcatcctcccagatttctggcggcgccatggattcgcagctgcacccaaattcaggcgggttccgacctggaaccccgagcttgcatccttacaggtcccaaccactttatctgccccccgggccggcgcctccttccgctcttttgtcaggcgtggcattgaagggccagttcctagactttagtactatgcaggctacagagttaggcaagctgccggccggaggcgtactgtacccgcctccatcctttctttactccccggcgttctgtccatccccactcccggatacaagcctcctccaggttagacaagatctgccttccccttcagacttttactcgactcccctccagccaggcgggcaatcgggattcttaccatccggagccccagcccaacagatgctactgccaatggttgatagtcagctgcccgtagtaaacttcggaagccttccacccgcgcccccacccgcaccacctcctctctctcttttgccagtcgggcccgccctgcagcctccttcattggcagttcgtccgccgcctgcccctgccactcgcgtgttaccttcccccgctagacccttccccgcttctctgggccgagcagagcttcaccccgtcgaattgaaaccatttcaggactaccaaaagctgtcatctaacctgggcgggcccgggtccagcagaaccccaccaacagggagaagcttcagtggtctcaatagccgtctgaaggccacaccctcaacctattccggtgtatttcgtacacagagagtggacctctatcagcaggcctcgccacccgacgcactgcgctggattccaaaaccgtgggagcggacagggccccctccaagagaaggcccctcccggcgcgcagaggaacctgggtcccgaggagataaggagcccgggctccctccgcctagatag

SEQ ID NO: 130045 - DNA, 6450 bp, Artificial Sequence
  Description of Artificial Sequence: Synthetic coding sequence
atgtctgatcggtcaggtcctactgcaaagggaaaagacggaaaaaagtactcttcacttaacctgtttgacacctataagggaaagtctttagaaattcagaagcccgccgtcgcacctcgccacggattgcagtctcttggcaaagtagccatagctagacgcatgccaccaccagccaacctaccctccctgaaggctgagaataaggggaacgatcctaatgtgtccctggtaccgaaggacggcactggatgggccagtaaacaggaacaatctgacccaaaaagttcagatgcttccacagcacagcctccagagtcccaaccactgcccgccagccagaccccagctagcaaccaacctaagaggcctcctgcagcaccagagaatacaccccttgtgccctcaggagtgaaatcttgggctcaggccagcgttacccatggcgcacacggcgacggtgggcgagccagttctttgctgagcagattctcacgagaagaattcccaactcttcaagcagctggcgaccaggacaaggcagccaaggaacgcgagtccgctgaacagagcagtgggccgggcccaagtctccggccccaaaacagcaccacatggcgtgacggtggggggcggggtccagatgagctggaaggtcctgactctaagctgcaccacgggcatgatccccgtggtggccttcagccaagtggccctccacagttccctccctacagaggaatgatgcctccatttatgtatccaccatatctgccatttccacctccgtatggtccccaagggccataccgttatcccacgcccgacgggcccagccgctttccccgggtggccgggccgcgggggagcgggccacccatgagactagttgagcctgtgggcaggccaagcatcctcaaggaggataacctgaaggagtttgatcagctcgatcaagagaatgacgacggctgggcaggcgcacacgaagaagtggattacacagagaagcttaagttcagtgatgaggaggatggtagagactccgacgaagagggggcggaggggcatagggacagtcaaagcgctagtggggaagagaggcctccagaggctgatggcaagaaaggtaactccccaaactcagaacccccgactccaaagacagcctgggccgagacatccaggccacctgaaaccgaacccggtccaccagctcccaaaccacccttaccacctccgcaccgtggccccgccggaaactggggcccgcctggcgattaccctgataggggtggtccgccatgtaagccgcctgctcccgaggacgaggacgaggcgtggaggcagcgccggaagcaaagctcttccgagatttccttggccgtggagcgcgctaggcgtcgtagagaagaagaggagcgtcgcatgcaggaggaaaggcgtgccgcgtgcgctgagaagcttaaacgactggacgagaagttcggcgctcccgataagaggctgaaggctgaacctgccgctccaccagccgctccaagcacacccgccccccctcctgcagttcctaaggaattgcccgccccccctgcccctccgccagcatccgccccgaccccagaaacagagccagaagagcctgctcaggcccccccagcccagtccacccctaccccaggtgttgccgccgcaccaactttagtaagcggagggggatccacttcctcaacatcctccggctcatttgaggcgtccccggtagagccccaactgccttccaaagagggtccagagccccctgaagaagtccccccacccacgaccccgcctgtgcccaaggtagagcctaaaggggacggtatcggtcctacaagacaacccccttcccaggggcttgggtatccaaagtatcagaaatccctgcctcctagattccaacgccagcagcaggagcagctgctgaaacagcagcagcagcaccaatggcagcagcaccagcagggatccgctcccccaaccccagtgccaccatccccccctcagccagtgaccctgggagctgtccctgcgccccaggctccaccaccacctcccaaggctctgtacccaggcgcactggggagacctccaccaatgcctcctatgaatttcgacccgaggtggatgatgatccccccatatgtcgacccacgcctgcttcaggggcggcctccactggacttctatcctcccggagtccacccctctggcctggtgccccgcgaaaggagcgactcgggcggcagctcgtcagagccgttcgatcggcacgccccagcaatgctccgagagaggggcacgcctcccgtcgaccccaaactggcgtgggtgggggacgtgtttacagctacacccgccgagccaagaccattgacttctccgctgaggcaggccgcagatgaagacgacaaaggtatgagaagtgagacacctcccgtgcctccgccgcccccatatctggcctcctaccccgggttccccgaaaacggcgcacccgggcctccaattagccggttcccactcgaagagccaggtcctcggccccttccctggccaccaggtagtgacgaggtagctaagattcagacgcccccccctaagaaagaaccccctaaagaggaaactgcccagctgactggccccgaagccggtcggaaacctgctaggggtgttgggtcaggcggccaaggaccaccacccccgcggcgtgaaagcaggaccgagacacgctgggggcctagaccgggcagcagccgacgcggtatccccccggaagaacctggggcaccacctcggcgggctgggccaatcaagaagccccccccaccaacaaaagttgaggagctgcccccaaaacctttagaacagggagatgagacacccaaaccacccaagcccgacccgcttaagattacaaaagggaagctcggtgggccaaaagaaacaccaccaaatggcaatttgagccctgccccgcggctgcgccgggactactcctacgagagggtcggccctaccagctgtcgtgggcgcggccgaggcgagtatttcgcgcgtggacggggtttccggggaacctatgggggccgcggccggggcgctgccgggaacagtgccgtgacagagtcttttgaagagatgatgggcgtcgaggtcgggcagggcgatcagacgactctactcctgccagaagcagcactgccggcccgccatggagccagggtgcagtctatgaggaagagcccttctggcgctgggtcaggtgctcaaaagcaagctgcaagacctatgcgcgtcatctggctactgcaaacaaggagacttccccacccaaggcgcgagcactcccccagatctcgatctcccaccactcgatcacccacgtttcctgctcccgctagattcactcccggcgtgggggagagctcacttccagagggcatctcccccggaccccgacgtcgcgaaccacctcaggtatgccccgggtggagtccgccagccaaatcactggcccctaaaaagccaccaacagggcctctgcccccttccaaagagcccctgaaggagaagctcattcccggaccactctctcccgtagcaaggggggggtccaacggagggagcaacgtgggaatggaggacggcgaacgcccgcgacggagacggcacggccgagcgcaacaacaggataaaccgcctagattccgacgcctgaaacaggagcgcgaaaacgcagccaggggctctgagggcaaaccgtccttgaccctgcctgctagcgctccaggcccagaggaagccctgactaccgtcaccgtcgcgcctgccccccggagagcagcggccaagtccccagatctgtccaatcagaattcagatcaggccaacgaggagtgggagaccgctagcgagagtagcgactttacatccgagagaaggggggataaggaggcccccccacccgtgctactgacaccaaaagctgtgggcacccccggcggcggcggggggggagccgtgcccggcatctccgctatgtctcgcggagacttgtcccagcgcgccaaagatttatctaaacgctccttttccagtcagaggcctggcatggagcgccagaaccgccggcctggtccaggcggaaaagccgggtcttccgggagctccagcggggggggcggcgggggtccgggcggcagaaccggcccggggagaggcgataagcggtcctggccatctcctaaaaacagaagccgtccaccagaggaacgcccacccggtttgcccttacccccccccccaccctcttcctctgccgtgttcagattggatcaggttatccactccaatcctgccggcatccagcaggccctcgctcagctgtcctctcgccaggggagtgttactgcacctgggggacatccccgccacaagccagggctccctcaagctccacaaggcccttctccccggcctcccacccgctacgagccccagcgagttaatagcggtctgagttcagacccccattttgaagaacctggccccatggtcaggggggtggggggtacacctagagatagcgccggggtatcacccttcccgcctaaaagaagggaacgtccccctcggaaaccagagctgctacaggaagaatctctgcctcctccacacagcagtgggtttttgggttctaagccagagggaccaggcccccaagcagaatctagagacacaggaacggaagcattgaccccccatatctggaacaggttacacacagctaccagccgaaaatcgtacagaccaagctctatggaaccatggatggagccactaagccctttcgaggatgtcgctggcacagagatgtcacagtcagattctggagtggacctctccggcgatagtcaagtatcatcaggaccctgttctcagcgatcctcacctgacggcgggctcaaaggtgcagctgaaggcccgcccaagcggcctggagggtcaagcccactcaatgccgtgccctgcgagggacccccagggagcgaaccccccagacgccctcctcctgcgcctcacgacggagacaggaaggaactgcctagagagcagccacttcctccaggacccattgggacggaaagaagccaaaggacagatcggggcaccgaaccgggacctattcggccgtctcacagacccggcccccctgtccagttcggtacctcagataaagactcagacctcagattggtggtgggagactccttgaaggcagagaaagagttgactgcatcagtgacggaagcaatccccgtgtccagagactgggaattgctcccgtccgctgcggcaagtgctgaacctcagtccaaaaatctcgattcagggcactgcgtgcccgaacccagcagctccgggcagagactgtatccagaagtgttttacgggtcggccgggccaagcagctctcagatctctggaggccacggtctatccatcacttctaagcaatggcgccgccctggcacaccttccctccatccttaccgtagccagccactgtatctgccaccagggcccgcccctcccagtgctctgctttcaggtgtggcccttaaagggcagtttctggatttctcaacaatgcaggctacagagttaggaaagctgccggccggtggggttctttatccaccacctagttttctgtattcccccgcgttctgcccatcaccgctgccagatacttccctcctgcaggtacggcaagaccttccctcacccagcgacttctacagcactcccttgcagcccggtggccagtcaggattcttgccatcaggggcccctgcccagcaaatgctgctgcctatggttgactcccagttgcctgtggttaacttcggcagtctgcccccggcccctccacccgccccgccccctctgagcttgctgccggtcggcccagcactgcagcccccctctttggcagtacgccctcctcccgccccagctacgagagttctgccatcaccggcaagaccatttcctgcctccctgggtagggcagaattacaccctgtcgagctgaagccgttccaggattatcagaagctgtcatctaatctcggaggacccggctccagcaggactccccccacaggacggtcatttagtgggttgaattcccgattgaaagcaaccccttccacttattccggggtgttccgcacacagagagttgatctctatcagcaggctagcccaccagatgcgctcagatggatccccaaaccatgggaaagaacaggtccccccccacgcgaggggccatcccgtagagcagaggagccagggagtcggggagataaggaaccaggcttaccacctcccagatag

SEQ ID NO: 130046 - DNA, 1650 bp, Artificial Sequence
  Description of Artificial Sequence: Synthetic coding sequence
atgtctgatcggtcaggccctaccgcaaaagggaaggacggcaaaaaatacagctcgttaaaccttttcgacacatacaaaggaaaaagtctcgagattcagaagccagccgtggctccgagacacggccttcagtcactgggaaaggtagctatcgctcggaggatgcccccacccgcaaatctgccatcgttaaaggcagagaataaggggaacgacccgaacgtctcactagtgccaaaggacggcaccggttgggcctccaagcaagaacagtccgacccaaaatcatcagatgcatctaccgcccaaccccccgagtcccaacctctgcctgcctctcagacccccgccagtaaccagccaaagcgccccccagcagcccctgagaacactccactggtgccaagtggggtgaagagctgggcccaggcttctgtaacccacggtgcgcacggcgatgggggcagggcaagctctttactcagtagattctcacgggaagaattccctacgctccaagccgcaggagaccaggataaagccgccaaggagagggagagcgcagaacaatccagtggacctgggccaagcttacggccacagaactcaactacgtggcgcgatggcggcgggcgtggccccgatgagctagaaggtccagacagcaagctgcaccacggacatgatccgaggggcggtcttcaaccctcagggccgccacagtttcccccataccgaggcatgatgccaccttttatgtaccccccctacctgccatttcccccgccatatgggccccaggggccctatcgctaccctacccctgatgggccgagcaggtttccaagagtggcgggccctagagggtctggcccccctatgcggcttgtggaaccagttggacgcccatccatcctgaaggaggacaacctgaaggagttcgaccagcttgaccaggagaatgatgacggctgggcaggagctcatgaagaagtggattataccgagaaacttaagttctcagacgaggaggatgggagggattccgacgaggagggtgccgaaggccatagggattctcagtctgctagcggcgaagagagacctcctgaagccgacgggaagaagggtaacagtcctaacagtgaacctccaaccccaaagactgcatgggccgagacatctcgcccgccagaaaccgagcctggaccaccggctcccaaacctccccttccaccaccccatagggggcccgctggcaactgggggccgcccggagactaccctgacaggggggggccgccttgtaaacccccggcccccgaagatgaagacgaagcatggagacagcggcgaaagcagtcctcttctgagatttccttggccgtagaacgcgctagacgaagacgtgaagaagaagaacggcgcatgcaggaggagagacgggccgcttgtgctgaaaagttgaagagactggatgaaaaatttggcgctcctgacaagagactgaaggccgaacccgctgcacctcctgccgctcccagtacacccgcgccacccccggccgcctctgaggtgcctctcatggaggactccaggggacagcagcgcgatccaccccgaggcttagaggcccctcatccctag

SEQ ID NO: 130047 - DNA, 6417 bp, Artificial Sequence
  Description of Artificial Sequence: Synthetic coding sequence
atgagcgacaggagtggaccaacggcaaagggcaaggacgggaaaaagtattcgtcactgaaccttttcgacacctataagggcaagtctctggagattcagaagcccgcggtcgctccaagacatggcctacagtctcttggaaaggttgcaattgccaggcggatgcctccaccagctaatttaccctctttgaaggccgagaataaagggaatgacccgaatgtctcacttgtgcccaaggacggcacaggctgggcctccaagcaagaacagtctgatccaaagtctagtgacgccagcaccgcgcagccccctgagagccagcctctcccagctagccagactcctgcatctaatcaacctaaaaggccccctgcagcccccgagaacaccccactggtgccatcaggtgtgaaatcttgggcacaggcatccgtaacacacggggctcacggcgatggaggccgggcctcgtctctactctcccggttctcacgagaggagtttccaacgttgcaggctgccggcgatcaggacaaggccgccaaggaaagagaaagcgccgaacaatccagcggccctggccccagtctacgaccccaaaacagcacgacttggcgagatggcgggggacggggaccagacgagctggaggggcccgattctaaactccaccatgggcatgatccacggggcggcctgcagccaagtggaccacctcagttcccaccttacaggggaatgatgccaccttttatgtatccaccatatttgccattcccacccccctacggtcctcagggcccctatcgctaccccactccagacggacccagcaggttcccaagagtggcaggcccccgcggtagtggtccacctatgaggctggtggaaccagtgggccgtcctagtatccttaaagaagataatctcaaggagtttgaccaactcgaccaggagaacgacgacgggtgggccggtgcccatgaagaagttgactacacagagaagctaaagttttctgacgaagaggatggtagagactctgatgaggagggagctgagggccatagagactcacagtctgcctccggtgaggaacgccctccggaagctgatggaaagaaaggcaacagccctaattcagagccacccacacctaagaccgcttgggcagagacctccagaccacctgaaactgagcccggacctcctgctccaaaaccaccacttcctccaccgggagattatccagacaggggtggtcccccatgcaagcctccagcccccgaagatgaagatgaggcatggcggcaacgcagaaagcagagctcctcagaaatttctttagctgtagagcgtgcgcgacggagaagggaagaggaggagagaagaatgcaggaggagaggagagcggcgtgcgctgagaagctaaaacgcctggatgaaaagttcggcgccccagacaagagattgaaggccgaaccggccgccccaccggccgctccctcaactcccgcgcctccgccagccgtcccgaaggagttgcctgccccgcccgccccgccccccgcatccgctcctactccagagaaggagcccgaggaaccagctcaggctcctcccgcccagtcaaccccaactcccggggtcgccgcggcgccgactctcgtgtccgggggcggaagtactagctcaacctcatcgggaagttttgaggcgtctcccgtggaaccccagttgccttctaaagagggacccgaaccccctgaggaggtgccacctcccaccaccccacccgtgccgaaggtggaacccaagggggatggcatcggcccgacgaggcagcctccctctcagggactgggctatccaaagtaccagaagtcccttccccctcggttccagagacagcaacaagaacaacttctgaaacagcagcagcagcaccaatggcaacagcaccagcaagggtcagccccacctacgcccgttcccccaagcccccctcagcccgtgacactgggcgccgttcccgctccccaagcccccccgccgcccccaaaagctctataccccggcgccctcgggcggcctccccccatgccgccaatgaacttcgacccgcgatggatgatgattcctccgtatgtagacccccggctcttgcagggcaggccaccccttgatttttatccaccaggggtgcatccctcagggcttgtaccacgcgagaggtcagactcaggggggtcgagcagcgaacccttcgataggcacgctccagcaatgctgcgagaaaggggcacacctcctgtggatcccaaattagcttgggtaggcgacgtgttcactgcaacccctgctgagcctcgtccattgacatcgcctctgaggcaggccgcggacgaggatgacaaaggcatgcggtctgaaacccccccagttccgccaccgcctccgtatctggcttcctacccaggctttcctgaaaacggagcaccagggcccccaatctctcgattcccactggaggaaccaggtcccagacccctgccttggccgccaggttccgacgaggttgctaaaatccagacccctcctccaaagaaagaaccaccgaaagaagagactgcgcagctcaccggccctgaggcaggccggaagccagctagaggagtgggtagcggcggccaaggacccccaccaccgcggagggagagccgcactgagacacggtgggggcccaggccaggaagctcaagaaggggtatcccaccagaggagcctggagcacccccacgccgcgctggaccgatcaagaagcccccgcctcccaccaaagtggaggagcttcctccgaaaccgcttgaacagggcgacgaaacacccaaaccgccaaagccagatccactgaagataacaaaagggaaactcgggggtcccaaggagacgcctcccaacgggaacttgtctcccgctccacggctccgtcgcgactatagttacgaaagagtgggccctacttcttgtcgtggaagaggcagaggtgagtacttcgccagaggccggggattccgcggcacatatggaggacgcggaaggggcgccgcgggcaacagtgccgttacggagtctttcgaggaaatgatgggcgtcgaagtcggacagggcgatcagacaacacttctgctgccagaagccgcgcttccagctcgtcacggggctcgcgtgcagtccatgcgcaaatctccgagtggcgccgggtcaggagctcagaaacaggctgccaggcccatgagagtgatatggctgcttcagacacgccgcttaccccaccctcgccgcgaacatagtcccagaagtcgatctccaaccacaagaagcccaactttcccagctccagctcggttcactcccggagtgggagagtcttctttgccggaaggaatctccccaggtcccagaaggagagagccccctcaagtatgccccggctggagccctccagcaaagagcctcgccccgaaaaaaccacccactggccctctacccccttccaaggaaccccttaaagagaagcttatcccaggtccgctgtcaccagtagcaagggggggctcaaacggcgggtccaacgtgggaatggaggatggtgagagacctaggagaaggcgtcatggtagagctcagcagcaggataagccaccgagattccggcggcttaagcaggaaagagagaatgctgctcgtgggtctgaaggaaaaccttcactgaccctgcctgcctcagcgccgggccccgaggaggctttgaccacagtcactgttgcaccggcacctaggagagctgcagcgaaatcccctgacctcagcaatcagaatagtgaccaggccaacgaggagtgggaaacagcctcagagtcatcagactttacttcagaacgtaggggggataaggaagcaccaccccctgtgctcctgacaccaaaagccgtggggactccggggggtggcggcggaggagcggtacccggaatctctgccatgtctcgcggcgatctgagccagcgggcaaaggacttgtcaaagaggtctttctcgtctcagcgtccgggcatggaaagacagaatcggcgccccggaccaggcggcaaagctggcagctcagggagctctagtggcggaggcggagggggccctggaggtcggaccgggccgggccgcggagataagaggtcttggcctagtcctaagaacaggagtcggccaccggaagaacgacctcctggcctccccctgccaccaccacctccgtctagctccgcggtgttccggcttgaccaagtgatccatagcaatcccgccgggatccagcaggcgctggcccaattgtcgtcccgccaggggtcagtgaccgctcctggcggacatcctcggcacaaacccggtccacctcaggctccgcagggtccctctccacgacccccgactaggtacgagccccagcgggtgaactccggacttagttctgatcctcattttgaggaacctggccccatggttcgcggggttgggggaacaccacgcgatagcgcaggcgtctctccgtttccccccaagcgacgtgaaaggccaccgcgcaaacccgaactgcttcaagaagagtcactgccgccgccgcattcctctggtttcctagggtcaaaacccgagggtcctggtccacaggctgaatctagggacactgggaccgaagcgctgactccacatatttggaaccggctccataccgccacatcgcggaaatcctaccggcccagtagcatggagccctggatggaacctctttcacctttcgaagacgtggctgggaccgagatgtcccaaagtgactccggagtggatctcagcggagacagccaggtaagttcagggccttgtagtcagaggtcttcaccagatggcggtctgaaaggggccgcagaaggcccacctaaacgccctggagggtcttcgcctttgaacgctgtgccctgcgaaggcccaccaggaagcgaacccccccgaaggccacctcctgccccacatgacggtgatagaaaggaactcccaagggaacagccactgccgcccgggccgatcggaaccgagagaagccagcacacagaccggggaactgagccaggcccgattcgacccagccatcgcccaggtccacctgtgcagtttggtacgagcgataaggactcggatctcagactcgttgtcggcgacagtctcaaagccgaaaaagaactcacagctagtgtaaccgaggctattcccgtgtcgagggattgggaacttttaccgtctgccgctgcctcagcagagccccagagcaagaacctggactccggacactgcgtgccagaacccagcagctcaggtcagcgactgtaccctgaagtgttttacgggagtgccgggcccagttcgtctcaaataagtggcggccatggcctgtcagtcacgtcgaaacaatggcggcgtcctggcacaccgagtttacatccttatcgctctcagcctttatatttgccccctgggcctgcaccccccagtgcactgctgagcggggtcgctcttaagggtcaatttctcgactttagtactatgcaggcaaccgaactggggaagctgccggctggtggagtactctaccctcctcctagtttcttgtactcccctgctttctgcccctcacctctgcccgacacctctctcttgcaggtacgccaggacctgccctcgccttcggacttctactcaacccccctgcagccaggcggccagtctggattccttccaagtggcgctccagctcaacagatgttattgcccatggtggactcccagttgcctgttgtcaatttcggtagtctgccgcccgcccctcccccagctcctccctctctgtccttgcttccggtaggtcccgcacttcaaccaccatctcttgcggtgcgccccccccctgctccagctacacgtgtgctgccttcacccgctcgcccctttcccgcatccctaggacgcgccgaactgcatcctgtggaacttaagccattccaggattaccagaaattaagctcaaatttggggggtcctggaagctccagaacacccccaaccggtcgatcattctctggccttaattctcgccttaaggccaccccctcaacgtatagtggggtgtttaggacccagagagttgacttataccagcaggcgtcgcctccagatgcattacgctggattccaaagccctgggaacgtacaggccctcctccccgggagggtccctcacggcgggctgaagagcctggttcaagaggcgataaggagcctggacttccaccgccacgctag

SEQ ID NO: 130048 - DNA, 6450 bp, Artificial Sequence
  Description of Artificial Sequence: Synthetic coding sequence
atgtccgatagaagcgggccgaccgccaaagggaaggatgggaagaaatacagcagcctcaacctctttgatacctataaagggaagagtctggaaatacaaaagcctgccgtcgccccccgccacgggcttcagagccttggcaaagtggcaatcgcacggaggatgcctcccccagccaatttaccaagtctgaaagcggagaacaagggaaacgaccccaatgtgtcattggtgcccaaggatggcacaggatgggcctcaaaacaggaacagagtgacccgaagagctcggatgcttctactgcccagccccccgaatcccagccactcccggccagccagacacccgcctcaaatcaacctaagcgcccccccgccgcccctgaaaataccccgttagtacctagcggggttaagtcatgggctcaagctagcgtgacacacggggcacacggagatggagggcgagcaagcagtttgctgagccggttttctcgagaggagttcccaaccctgcaggcagcgggggaccaggataaagctgccaaggagagggagtcagcagagcagtcatccgggcccggtcccagccttaggccacagaactcaaccacatggcgagatggcggagggcgagggcccgacgagctagaagggcccgatagtaagcttcatcatggacacgatcctcgcggcggcttacagcctagcggccctccacaatttccaccttatagaggcatgatgcccccatttatgtatccaccttatcttcccttcccacctccttacgggccccaaggtccctatagataccccacgccggacgggccatctcgctttccccgggtagccggtcctcgaggtagcggcccacctatgagacttgtggaacctgtcggccggccaagcattctgaaggaggacaatctgaaggagtttgaccagctggatcaggagaatgatgatggttgggccggcgcccacgaagaggtggattacacggagaagctgaagttcagcgacgaagaggatggccgtgactcagatgaggagggggccgagggacatagagactcccagagcgcatcaggagaggagagaccccctgaagccgacggcaaaaagggcaattctccaaacagcgaaccccccacgccaaaaactgcctgggccgaaacatcacgaccccccgagactgaacccggcccaccggctccgaagccgcctctgccacccccccacagaggtccagccgggaattggggcccccccggcgattacccagataggggcggtcctccctgtaagccccctgctcctgaggacgaggatgaggcctggcgccagaggcggaaacagtcctcctccgaaattagtctcgctgtggagagggcccgacgacgccgggaggaggaggagaggaggatgcaggaagagcggagggccgcctgtgcagagaagctcaaacgccttgacgagaaattcggagcaccagataagaggctgaaagccgaacccgctgctccccccgccgctccctcaactcctgctcctccccctgccgtgcccaaggagcttccagccccccccgcacccccaccggcatctgcccccacccctgagaaggaacctgaggagcccgcccaggctcctcccgcccagagcacacctacccccggcgttgccgcagcccctacgctggtctcaggcggcggatcaaccagttccacatccagtggttcatttgaggcctcccccgtggagccccaactgcccagcaaggaagggcccgaacccccagaggaggtaccgccacctaccacccccccggtgcccaaggtggaacctaagggggatggaattgggcccacacgtcagcctccttcacaaggcctgggctatcccaagtatcagaagtctctccctcctagatttcagcgacagcagcaagagcagctgctcaagcagcaacagcagcatcagtggcagcagcatcagcagggaagcgctccccctacaccggtccctccttctccaccccagcctgtgacactcggcgctgttccagccccacaggccccaccccccccccccaaggccttgtaccccggggctctgggcagacctccgcccatgccacccatgaattttgatccaagatggatgatgatccccccctatgtggacccccggctgctccaagggagaccgccactggatttctatcccccgggtgttcacccctcaggtctggttcctagggagcgctccgattctggcggttcaagctctgagccattcgacagacacgcaccagcgatgcttcgagaacgtggcactccccccgtagatcctaagttggcatgggtgggggacgtctttacggctacgcctgccgaaccgaggcccttaacatccccgctgcgccaagctgccgatgaggacgataagggaatgcggagcgagacccctcccgtgccgccacctcccccttatctcgcttcatacccaggctttcccgagaatggcgcccccggaccaccaataagccggttccctcttgaggagccagggccacgaccactgccttggccacccgggagtgacgaggtcgcaaaaattcagacaccacctcccaaaaaggagccaccaaaggaagaaaccgcccaactgacaggacccgaagccggtcgaaaaccagcacgcggcgtcggcagtggcggacagggccctccaccgcctagacgcgaatccagaaccgagactaggtggggtccgcgcccaggcagctctagacgagggatccctcctgaggaacccggagcgcctccccgcagggccggccctattaagaaacccccgccaccaacaaaggtggaggaactgccccctaaacccctagagcagggagacgagacacccaaacctcccaagccggatccattaaaaatcactaagggcaagcttggggggccaaaagaaacacctcctaatggaaacttatcacccgcgccaagactgcgaagggactactcctacgaaagagttgggcccacctcgtgccggggcaggggacgaggggagtacttcgctcgcggcaggggatttcgggggacctatggcggaagaggtagaggggcagcgggaaattcggcggtcaccgagtcctttgaggagatgatgggggtagaggtcggacagggagaccagactacgcttttgttgccagaggctgcccttcccgcgcgccatggggcacgcgtgcaatccatgcgaaagtctccttcaggcgccggcagcggagcacagaaacaagccgcaagacctatgcgggtgatttggcttctgcaaacacgtaggctgccacacccgaggcgggagcactcccctcgcagcaggtcacctaccaccaggtctccgacattccccgcccccgctagatttaccccgggcgtcggtgaaagctctcttcccgaaggtatttcacctgggcccaggaggagagaacctcctcaggtctgtcccggatggtctccgcccgctaaaagcctcgctccaaaaaagccccccacaggccccttacccccatccaaagagccgttaaaagagaaattaattccaggccctttgtcacccgtagctaggggaggaagtaacgggggcagcaatgtcggcatggaagatggagaacggcccaggcgtaggcggcatggccgggcgcagcagcaggacaaacctccgcgcttccgcagactgaaacaggaacgggaaaacgcagccagaggatccgagggcaagccctccttaacacttcctgccagcgcgccaggaccggaagaagctctaacaaccgtgactgtagctccagccccacgcagagccgctgccaagagccctgatctatctaaccaaaatagcgatcaagccaatgaagagtgggagaccgcctccgagtcttcagacttcacaagtgagcgaaggggagacaaggaggcgccaccgccggtgcttttgactccgaaggccgtaggcacccctggaggaggaggcggtggagccgtgcctggaattagcgcaatgtcgcgcggcgacctcagtcagcgcgcaaaagaccttagcaagaggagtttcagttctcaacgccctgggatggagagacagaaccggcgccccggcccaggcgggaaggctggcagcagcggctctagctcaggcggcggcggcggagggccaggaggaagaaccgggcctggaagaggagataagaggtcatggccgtcccccaagaaccgctctcgccccccggaagagcgaccccctggtctccctcttccgccacccccaccaagctcttcagctgtctttcgcctcgatcaggtgatccactcaaacccagctgggatacagcaggcattggcccagctaagcagcagacagggttccgtgactgctcctggaggacatcccagacataagccgggccctccacaggcaccccagggaccctcgcctcggccccctacccgttatgagcctcagagagtaaattccggactcagcagtgatccacactttgaggagcctggtcctatggtccgtggagtggggggtaccccccgagacagcgctggagtgtcaccctttcccccaaagcgtagagagagaccccctcggaagccagagttgctgcaagaagaaagtttgccccctccccattcatctggtttcttaggatcaaagcctgagggccccgggccccaagctgaaagtcgggacacagggactgaggctttgacaccccatatttggaaccgtcttcacacggccactagtcggaagagctatagaccaagctcaatggagccctggatggagcctttgagcccgtttgaagacgtggccgggacggaaatgtcccagtccgattctggcgtggacctcagtggggatagccaagtatcatccgggccatgtagtcagcggtcttctcccgatggaggtctcaagggggcagccgagggtcctcctaaaagaccagggggctctagtccgctgaatgctgttccatgcgagggacctccagggtcggaaccaccacgtcgccctccaccagccccccacgacggagatcggaaggaattgccgcgagaacagcctctccctcctggccctatcggcaccgagagatctcagcatactgatcgaggtacggaacccggacctatccggccctctcacagacccggacccccggtgcagttcggcacatccgataaagactccgacctgaggctcgtcgtcggagattccttaaaggccgaaaaagaactgacggcgtcagtgactgaagcaatccctgtgtcacgtgactgggaactccttccttcggctgccgctagcgccgagccgcaaagcaaaaacttggactctggtcactgcgtgccagaaccctccagcagtggccagcggctctacccagaggtgttttatggatctgctggaccatcttctagccagataagtgggggccatggattgtccgtgacttctaagcagtggcgccggccagggactcctagcttacacccataccggtcgcagcccctttacctgcctcccggccctgccccaccgtcggccctgctctcaggagttgccctgaagggtcaattcttggacttctccacaatgcaggcaaccgagctaggaaaactgccagcaggaggggtgctgtacccccctcccagctttttatactcaccagccttctgccccagccctctgcccgatactagcctgctccaggtccggcaggacctgccctccccctccgacttctactcaacaccacttcagcccggaggacagtctggattcctcccatcaggtgcacctgcacaacagatgctgctccctatggtcgattctcaactgcctgtggtcaacttcggctctctgccaccggctcctcctcccgcgccgccctccctaagccttctacctgtcggccccgcactccagccaccgtctctcgccgtgcggccgccacctgcccctgctactcgtgtgctgccatcaccagcacgcccttttcctgcgtcgctgggcagggccgagctgcatcctgtggagctgaaaccattccaagactatcagaagttatcgagcaatttgggcgggccggggagttctcgtacgccacctacagggagatccttttcgggtttgaactccagactgaaagccacaccttccacctactcaggagtgttccggacgcagcgggttgacttgtatcagcaggcatcaccaccagatgctctgcgttggatcccaaaaccatgggagagaaccggcccacctccccgggaaggcccctccaggcgggctgaggagcctgggtctcgtggcgacaaggagccagggctgccccctccccgttag

SEQ ID NO: 130049 - DNA, 1650 bp, Artificial Sequence
  Description of Artificial Sequence: Synthetic coding sequence
atgagcgataggagcggaccaactgctaagggcaaagacgggaagaagtactcatccctcaacctgtttgacacttataaaggaaagtcactggagattcagaagcctgcagtagcgccccggcacggactgcaatccctgggaaaagttgcaatcgccaggcgcatgccaccacctgccaacctgccatccctgaaggcagagaacaaggggaacgacccaaacgtctccctggtgccaaaggatggcactggctgggctagcaaacaagagcagtcagaccctaagagctcagacgcttctactgcacagccacccgaatcgcaacccctgccagcctcacaaacacctgcttcaaaccagcctaaaagaccccccgcagcaccagagaacaccccactggttccatccggagtgaagtcatgggcacaggcatctgtcacccacggagcccatggcgacggcgggcgtgcgtccagtctgctgagtcgattttccagagaagagtttcctacacttcaggctgccggcgatcaagataaggccgcaaaggagcgcgagtcggcagagcaatcgagtggtcctggtcctagtctaaggccacagaacagcacgacttggagggatggaggcggtagaggccccgatgaactcgagggacctgattccaagctccaccacggccacgaccctaggggtggattacaaccatctggccctccccagtttccaccatacaggggcatgatgccgccattcatgtaccccccctatctcccgttccctcctccttacggcccccagggaccatataggtatcccacacccgatggccccagcagattccctcgtgtcgcgggccctcggggctcgggacctccaatgaggttggtggagcccgtcgggagaccctctatcctgaaggaggacaacctgaaagagttcgatcagcttgaccaggaaaacgacgacggctgggccggcgcacatgaagaagtggactacaccgagaaacttaagtttagcgacgaggaggacgggcgagactctgatgaagaaggggccgaggggcacagggacagccagtctgcctctggcgaagaaagaccaccagaggcagatggaaaaaaggggaatagccctaattcagagcctcctaccccaaagaccgcttgggctgagactagtaggccccctgagacggagccaggaccgcctgcccccaaaccaccactgccaccacctcatagaggacctgccgggaattggggtccccctggtgattatcctgaccgcggaggaccaccatgtaagccaccggcaccagaggacgaggatgaagcctggcgccagcgaagaaagcagtctagtagcgaaatctctttggccgttgaacgcgctaggcgcagacgggaggaagaggagagacggatgcaggaagaacggcgggccgcctgtgcagagaagcttaagaggctagacgagaaatttggcgcacccgataaaaggctgaaagccgagcccgccgctcccccagccgctcccagtacacctgcccctccacccgcagctagcgaggtgcctttgatggaggacagtagaggtcaacagagggaccctccacgtggtttggaggcgccacacccctag

SEQ ID NO: 130050 - DNA, 1650 bp, Artificial Sequence
  Description of Artificial Sequence: Synthetic coding sequence
atgtccgacagatcgggtccaacggcgaagggaaaagatggcaaaaagtacagttcactgaacctgttcgatacctataaagggaagagccttgaaatccaaaagcccgccgtagcaccccgtcacggccttcagagccttgggaaggtcgccattgctcgccgcatgccccctcccgccaatctgcctagcctcaaagctgaaaacaagggaaatgacccgaatgtgtcacttgtgccaaaggatggtaccggctgggctagcaaacaggagcagtcagacccaaaaagctccgatgcttccacagcccagccgcccgagagccagcccctgccggcttcacagacacctgcttcaaaccaaccaaagcggccgcctgcggctccagaaaatacccctctggtgccgagtggagtcaaatcttgggcacaggcatccgtgacccacggcgcgcacggagatggcggtagagcgtcatccctgctgagcaggttttctcgtgaagaattcccaacactgcaggcggccggggaccaggataaggcagccaaggagagagaatcggcggagcagtcctcagggcccggaccttccctccgccctcagaacagcaccacttggagagacggtggggggaggggtccagacgagctcgaaggcccagactctaagcttcaccacgggcatgatccacgcgggggcttgcagccctcaggaccaccgcagttcccaccctacagaggtatgatgccccccttcatgtacccaccatatctgcctttccctcctccatatgggcctcaggggccatatcgctatcctaccccggatggcccctctcgcttcccccgagtggccggccccagagggtctgggccacccatgagactggtggagccagtaggtcgccctagcattctgaaagaagacaatctgaaggagttcgaccagctagatcaagagaatgatgatgggtgggctggcgctcacgaagaagttgactacactgaaaagttgaaatttagcgatgaggaagacggacgggactcagatgaagaaggtgccgaaggccaccgcgattctcagagcgcctccggcgaagaacggcctccagaggctgacggaaaaaaaggcaactcccctaactctgagcccccaacccccaagactgcttgggctgagactagcagaccgcccgagaccgagccgggcccacctgcccccaaacctccgctcccacctccccaccgcgggccagccggcaactggggccccccaggagactatcccgatagggggggtccaccatgcaaaccccccgcccccgaggatgaagatgaggcctggagacaaagacggaagcagtcaagctcagaaatcagtctcgcagtggaacgggcccgacggagaagagaggaggaggagaggagaatgcaagaagagcggcgggcagcctgtgctgaaaagctgaaacggctggacgagaagtttggtgctcccgacaagaggctgaaagcggaacccgccgccccacctgccgccccaagtactccggctccgccccctgccgcatccgaggtgccgttgatggaggattcacgcggccaacagcgtgaccctcctcgcggactggaggccccacatccatag

SEQ ID NO: 130051 - DNA, 4149 bp, Artificial Sequence
  Description of Artificial Sequence: Synthetic coding sequence
atgctgcgtgagcgcggcactccaccagtcgatcccaagctcgcctgggtcggtgatgtcttcaccgccacacccgctgagccaaggcccttgacctccccactgagacaggctgctgatgaagacgacaaaggaatgcgctctgaaaccccccctgtgccacctccgcccccttatttggcctcttaccccggcttcccagagaatggagcaccaggaccccctatttctagatttcccctggaagagcctggaccacggcctctgccctggccacctggatccgacgaagtcgcaaaaattcagactccacctcctaaaaaagagcccccaaaggaggagaccgcacagttaacaggacctgaagcaggaagaaagcccgctcgcggggtagggtcaggcggccagggcccaccgccgcctcgccgggaaagtcggaccgagacgcgttggggcccccgccccggatcgtcccggcgggggattccccctgaagaaccaggagccccccctcggcgggcaggaccaattaaaaagcctccgccacccacaaaagttgaagagctacctcccaagcctctggaacagggggatgaaactcccaaaccaccaaagcccgatcccctgaagattaccaaaggcaagctgggcgggcccaaggagactccgcccaatggtaatctaagtccagccccacgcctccggcgcgactactcgtatgagagagtcggtcctacatcctgcaggggacgtggaaggggggagtactttgctcgaggccgcggatttcggggcacatacggagggagaggcaggggagccagatcgcgggagtttagaagttatcgcgagttcaggggagatgatggccgcggcgggggcaccggagggccaaaccatcccccagcacccaggggcaggacggcctcagagacgcgctccgagggctcagaatatgaagaaattcccaagcggcggagacaacggggcagtgagacagggagcgagactcacgaatcagacttggctccttccgacaaagaggctcccactcctaaggagggcaccttgacgcaagtgccgctagcaccaccaccccccggggctcctccttctccagctcctgcacggtttaccgctagaggcggcagagtgtttaccccccggggcgtaccttcacgcagggggcggggaggcggacgaccaccacctcaggtttgtccagggtggtccccacccgccaagtcactcgcacccaagaaaccacctacaggacccctccctccctccaaggagccattgaaggagaaactcattcccggacctttgagtcccgtcgcccgcggcgggtccaacggaggtagtaacgtaggaatggaagacggagagagacccagacgacggagacacgggcgagcccagcagcaggacaagcccccccgatttcgccggctcaaacaggagagggagaacgctgccagagggtctgaaggcaaaccctctctaactttacctgccagcgcccccgggccagaggaggctctcaccacggtcactgtggcgcccgctcctaggcgggccgccgccaaatcacctgatttgagcaatcaaaatagtgatcaggccaatgaagagtgggagacagcctcggagagcagtgactttaccagtgaaagacggggcgataaagaggcccctccccccgtgttgctcactcctaaagccgttggcaccccaggcggcggcggcggaggggccgtacccggcatttctgccatgtcaagaggggacctcagccagcgtgcaaaagacctgagcaagcggagtttctcgtcccagagacccggaatggagcggcagaacagacgcccagggcccggcggtaaggctgggtcctccggctcttcaagcggaggaggcggcggagggccaggcgggcggaccggtcctggcagaggagataaaaggtcatggccttccccaaaaaatcggagccggccacccgaagagcggcctccggggcttcccttgccaccgccaccaccctcctccagtgcagtgtttaggttagaccaggtcattcatagcaatcccgccgggatacagcaggcccttgctcagcttagcagtaggcaggggtcagtcactgctcccgggggacatccacgacacaagccgggacctcctcaggctccccaaggcccctcccccagaccacccactaggtacgagccccagagagttaattcaggactgtcctctgacccgcactttgaggagcctgggccaatggtgaggggggtaggtggcaccccacgcgattcagccggggtgtcacctttccctcccaaaaggcgtgagcgacctccacgcaaaccggagctgctgcaagaggagtcactgccgccacctcactctagcggattcctggggtctaagcccgagggacccggcccccaggcggagtcaagagacacgggtactgaggcccttacgccacacatctggaacaggctgcatacagccacctcgcgcaagtcataccgaccaagctccatggagccctggatggagcctctctccccttttgaggacgtcgctggcactgaaatgtcacagagcgattcaggcgtggatttgtccggagatagccaggttagctcaggcccctgctcccagagaagttctcccgatggtgggctaaagggggccgccgaggggccccccaagaggccagggggctccagccccctgaatgccgttccatgcgaaggccccccaggatctgaacctcctcgtcgacccccccctgcaccacacgatggcgatcgcaaggaactgccccgagagcagcccctgcccccaggcccaattggcaccgagaggtcccagcacacggatagaggcactgagcccggacccataagaccaagccaccggccaggacctccagttcagtttggtacatccgacaaagacagcgacttgaggctggtggtgggcgattctttgaaggctgagaaagaactcacggcttctgtgaccgaagcgatccccgtctcacgtgactgggaactgttaccaagtgctgcagcctcagccgagccacagagtaaaaatttggattctggacattgcgttcccgagcccagttcctcaggacagaggctttaccccgaggtcttttacggttccgccggcccttcctctagccagattagcggtggggcaatggactcccagctgcatcccaattccggtggattcaggcccggcacaccgagcttacatccatatcggagccagcccttgtacctgccacctggaccggctcccccttctgcccttctgtcgggtgttgcgttgaagggtcagtttctggacttctccacaatgcaagccacagagttgggcaaactccccgcagggggagtgctgtacccgccaccctcattcctgtacagtccagcattctgtccctccccacttccggacacaagccttctgcaggttagacaggaccttccgagtccaagcgacttctattccacgccactccagccgggcgggcaatctgggttcttgccttctggtgctcccgcccaacagatgttactgccaatggtggacagtcagcttcctgtggtgaactttggctctctgccaccggccccaccgccagcgcctccgtccctgagcttgctcccagtgggcccggctttgcagcctccctctctggctgtgcgccctccaccggctcccgccactcgcgtcctgccctctcctgcgcggcctttcccagcctctctggggagagcagagctgcacccagttgagttgaagccctttcaggactaccaaaaactcagctccaatctagggggtccagggtcttccaggacacctccaactgggaggtccttcagtggcctgaactcccgcctgaaggctactccctcgacttattccggggtgttccgcacccagagagttgatttgtaccagcaggcttctccccccgacgctctgcggtggattcccaagccctgggaacggacggggccccctcccagagaggggcctagtcgtcgggcggaagagcccggtagtaggggtgacaaggagcctgggcttcccccaccccgatag

SEQ ID NO: 130052 - DNA, 6417 bp, Artificial Sequence
  Description of Artificial Sequence: Synthetic coding sequence
atgtccgacagatcagggccaaccgctaagggaaaggatgggaaaaaatactcctctctgaacctttttgacacctacaaagggaagtccctggaaattcagaaacctgcagtggccccacgtcatgggctgcaaagcctaggaaaggtcgccatcgcacgcaggatgccacctcccgcgaacctgccttctctcaaagccgagaataaaggcaatgacccaaacgtaagcctggtgccaaaggacggaaccggatgggcctctaagcaggaacagtccgatcccaagtcgagtgatgcttctacagcacagcctctggagtctcaacccctgcccgcatcccagactccagcttctaaccagcccaaaaggccacctgcagcaccagaaaatacacccctggtcccaagtggcgttaagtcttgggcccaagcgtctgtgacccatggggctcacggagacggcggtagggcaagcagtttgctgagtcgattctcccgtgaagaattccctactctgcaggcggctggcgatcaggacaaagccgcaaaagaacgcgaaagtgcagagcagtcaagtggcccaggtcccagtctgcgaccacagaactctacgacctggcgagacggcggtggaaggggccccgatgagctggagggcccagactctaaattacaccatgggcacgacccacggggtggacttcagccctccggcccacctcagtttcccccctatagaggcatgatgccgccctttatgtacccaccatatctgcccttcccccccccctacggaccacagggaccctatagatacccaacccccgacggcccttctcgcttccctagggtcgccggtcctagaggcagcggccctcccatgcggcttgtggaaccggtgggacgccctagcattctgaaagaggacaacctgaaggagttcgatcagctggatcaggagaatgacgatgggtgggcaggcgcacatgaggaggttgattatactgaaaagttgaaattttcggatgaagaggacggacgggactcagacgaagagggggcagagggacaccgagactcacagtccgctagtggagaggagaggccaccagaagccgacggaaaaaaaggcaacagccccaacagcgagcccccaacacccaagaccgcttgggccgagacctcccggccgcccgagaccgaacccggcccacctgctcccaagcccccgctgccccctcctggagattaccccgatcggggcggccccccttgtaagcccccagcacccgaagatgaagatgaagcttggagacaacgccgcaaacagagcagctccgagatttcactggccgtggaacgcgccaggcggcgcagggaggaagaggagcggagaatgcaggaggaacgccgggctgcctgcgcagagaagcttaagcgcctggacgaaaaatttggggccccagacaagaggctgaaagcagaacctgcagctcccccggctgctcctagcacgcctgctcctccacctgcagtgcctaaagagcttccagcccctcccgccccaccacccgccagcgccccaacccccgaaaaagagccagaggaacctgcgcaggctcctccagctcagagcacacccacgcctggagtggccgctgctcctactctggtgagcggaggcggttccacgtctagtacctcctctggctcttttgaagcgagtcccgttgagccccagttgccatctaaagaaggccccgagcccccggaggaggtgcctcctccaaccactcccccagtcccaaaagttgaaccaaagggagatggtatcggcccaacccggcagccaccctcccaaggcctgggataccctaaataccagaaaagcctgcccccgcgttttcagaggcagcagcaggagcagcttctgaaacagcagcaacagcaccagtggcagcaacaccagcaagggtccgctcctcccacccctgtgccaccctcccccccacagcctgtgactctcggagctgtaccagcgcctcaggcaccgccaccgccccccaaggcactctaccccggcgccctgggacggcccccccctatgccccccatgaatttcgaccctcgatggatgatgattcctccctacgttgatcccaggctgctgcaggggcggcccccactggacttctacccccctggagtgcatccaagcgggctggttccacgcgagcgttctgatagcggtggttcctccagcgagcctttcgatcgacacgcgccagctatgctgcgcgagcgggggacacccccagtcgatcctaagctggcctgggtaggtgacgtgttcaccgctactcctgctgagccccgccctctcacttctcctttaaggcaagccgcggacgaagatgacaaaggaatgcgatctgaaaccccccctgtgccccccccacctccatacctagcttcataccccgggttcccagagaatggggcacctgggcctcctatatctcgcttccctctggaagagcccgggcccaggcccctgccatggccgcctggatcggatgaggttgcgaagattcagacacctccccccaagaaggagcctccgaaagaggaaaccgcccagctgaccggcccagaagccggacgcaagcctgctcgcggagtgggcagcggaggccagggacctccccctccccggcgcgaatcacgcacagagacacggtggggtcctaggcccggttcctcgcgtagaggaattcctccggaggagcctggcgctccaccgcggagagctggacccatcaaaaagccacctcccccaacaaaagtcgaagaactgccaccaaaacctctagagcagggggatgagactcccaaacccccgaagcccgacccacttaagattactaaggggaagctgggtgggccaaaagaaactcctcctaatggaaacctcagccccgcccctcgacttagacgggattatagttatgaacgagtgggaccaacttcttgtcgtggcagagggcggggcgagtatttcgctcgagggcgcgggtttagaggaacctacggaggcaggggcagaggcgcagctggcaatagcgctgtcaccgagtcattcgaggaaatgatgggggtcgaggtaggtcagggggaccaaaccaccctactgctgccggaagcagcactccccgctcgccatggagctagggtccaaagcatgcggaagtctcctagcggcgccggctcaggggctcaaaagcaggcagctagaccaatgagagtgatctggctgctgcagacaaggcggttgccgcacccccggcgtgagcattccccacgctcaagaagtccaactaccagatcccccacattccctgccccagccagattcacacccggggttggagagtccagcctgccagagggtataagccccgggcccaggcggcgggaaccaccccaggtttgcccgggttggagccctcccgctaagtcactcgcacccaagaagcctcccactggacctcttccgcctagtaaagagcctctgaaggaaaaattgattccagggcccctgtccccggtggccaggggtggcagcaacggaggcagtaacgtggggatggaggacggtgagcgaccgagacgtaggcggcacggccgcgctcaacaacaagataagcccccaagattccgtaggctcaaacaggagagggagaatgccgcccgcggatcagagggtaaacctagcttgaccttgccagcatccgctcccggtccagaggaggctctgactactgttacagtggctccagcgccgcgaagggctgccgcaaagtctccggatttgtcaaatcaaaacagcgatcaggcaaacgaggagtgggaaaccgcctccgagtcttcagatttcacttccgaacgaaggggtgacaaagaggctccccctcccgtcctgctcacacccaaagccgtgggcacgccgggcggaggcggtgggggcgccgtgcccggaatctccgcaatgagtcggggagacttatcccagagggctaaggacttaagtaagagatctttcagttcacagcgcccgggaatggaacgccaaaataggcgtcctggccctgggggcaaggccggcagttctggaagcagctcaggtgggggaggtggcggtcctggaggcagaaccggtcctggccgcggcgataagaggtcatggccatctcctaagaaccgcagtcgacctcctgaagagcggccacctgggctgccgctcccccctcctcctccttcctcctctgccgtgttccgcctcgatcaggttattcattcaaacccagcagggatacagcaggctctggcccagcttagcagcagacaaggatccgtgaccgctcccggaggccaccccaggcataagccgggcccaccacaggctccccagggcccgtccccccgtcccccgacccggtacgaaccccagcgggtgaactcaggcctatccagtgacccccacttcgaagaaccaggacctatggtgagaggtgtcggggggacgcctagggacagcgccggagtttctccattcccgccaaagaggagggagcgccctcctcgaaaacctgagctcctgcaggaggaaagcttgcccccacctcacagttcagggtttcttgggtccaaaccagagggaccgggtcctcaggccgagtcccgcgacacaggcactgaggccctaacacctcacatatggaatcgactgcacacagctacatcacgcaagagctataggccatcgtccatggagccatggatggagcccttgtctccgttcgaagacgtggcaggaactgaaatgtctcagagtgacagtggcgtcgatctgtctggggacagccaggtcagcagcggcccctgtagtcagagatcttccccagacggtggactgaaaggagccgcagagggacctccgaagagacccgggggctcatcacctctaaatgctgtgccttgtgagggtccccctggtagtgagccaccccggagacccccaccagccccacacgacggggaccgaaaggaactgccaagggagcaaccattgccgcctggccctatcggcacggagaggtcgcagcgcaccgatcgggggacagagccaggaccaataaggccaagccaccggcccgggccacccgtccagttcgggacaagcgataaagacagtgatctcaggctggtcgtgggcgacagtctgaaggctgaaaaggagttgacagcttcggtcacggaggccattccagtttccagagactgggagcttcttccgagcgctgccgcctccgccgaaccccagtcgaagaacctcgactccggacattgcgtgcccgagcccagttcgtctgggcagcggctgtacccagaagtgttctatgggtcagccgggccatccagcagccagatctcgggggggcatggtctctcaatcacgtccaagcagtggcgacggccaggcaccccctccctgcacccatacagatcccagcccctttacctgccgcccgggcccgcaccgcccagcgccctactgtccggagtagctcttaagggccaattcttggacttttctaccatgcaggctacagagctcggcaagctcccagcggggggcgtcttgtacccacctccctctttcctgtattcaccagcattctgcccatctcccctgcctgatacctcccttcttcaggtgaggcaggacctgcccagcccttctgacttttactccactccgctccagccagggggccagagcgggtttctccctagtggagcaccagcgcaacagatgctccttcccatggtggactctcagcttcctgttgtcaatttcggaagcctgccccctgcccctcctccagcccccccacccctcagcttgctgcccgtgggccctgccctgcagcccccttccctggcagtcagaccaccgcctgcccctgctactcgggtgctgccctctccagcaaggccattccctgccagtctggggcgcgctgaactacaccccgtggaattaaagccctttcaggactatcaaaaactttcaagcaacctcgggggccccggaagtagcaggacccctcccactggtcgctctttctctggcttgaactccagactcaaggcaacaccctccacttacagtggagttttccggacccaaagggtcgatttgtaccagcaggcctctccgccagacgcattgcgctggatcccaaagccttgggagcggacaggtcccccaccaagggaagggccctctaggcgggcagaggagccaggaagcagaggggataaggagccaggtctgccccccccaaggtag

SEQ ID NO: 130053 - DNA, 6417 bp, Artificial Sequence
  Description of Artificial Sequence: Synthetic coding sequence
atgtctgacaggtctgggccgacagcaaaaggcaaggatggcaaaaagtactccagcctgaacttatttgacacttataaaggaaaatcacttgaaatccaaaagccagccgttgcccccaggcacggactgcagtctctgggcaaggtggccattgcccggagaatgcccccccccgctaatctcccatcgctgaaggcggaaaacaagggaaatgacccgaatgtgtcactcgtgcctaaggacggcactggctgggccagcaagcaggagcagtctgacccaaagtcttccgatgcttccactgcccagccccctgaatcccagcccctgcccgccagccagactccggcgtccaaccagccaaaaaggccacctgcggcccccgaaaacactcctctggtgccctccggtgtgaagtcttgggctcaggcctcagttactcacggggcacacggcgatggggggagggcctcatcccttctaagtaggttttcaagggaagaatttcctaccctgcaggccgctggcgatcaagacaaggctgcaaaagagagggagagtgccgaacagtcctcagggcccggcccgagcctacgacctcagaattccaccacgtggagggatggcggaggacgggggccagacgagctcgaggggcctgacagcaagctgcaccatggtcacgaccctagaggaggactgcagccgtcagggcccccgcaatttcctccatatcggggaatgatgccaccattcatgtatcctccctatttaccgttccccccaccctacgggccgcagggcccgtataggtaccctaccccagatgggccctcgcgcttccccagggtggcggggccacgagggagtggacctcccatgaggctggtggagcctgttggacgaccatccattctgaaagaggacaatctcaaagagtttgaccaacttgaccaggaaaatgacgatggatgggcgggtgctcacgaggaggtcgactacactgagaagctgaagttttccgatgaagaagatggaagggattcagatgaggagggcgccgagggccacagggactctcagtccgcaagtggcgaagaaagaccccccgaggccgacggaaaaaagggaaactcccctaattcagaaccccccactcctaaaacagcctgggcagagacgtcccgccccccagaaaccgagcctgggcctccagcgccaaaaccgcctttgccacctcctggggattacccagacagagggggcccaccttgcaagccgcccgctcccgaggatgaggatgaggcctggcgccaacggcgaaagcagtcttcttcagagatttcactcgcagtagaacgggcacgccgcaggcgggaggaggaggaaagaaggatgcaggaagagcgtcgcgccgcctgcgcagagaaactaaaacgcctcgatgaaaagttcggcgcacctgacaagagactgaaggcggaacctgcagcccctcccgctgccccgagcaccccagcgccacccccagccgtcccaaaagagctccccgcacctcccgctccacctcccgcctcagcaccgactccggagaaggaaccagaggaaccagcacaggcgccacccgcacagtctaccccaactcctggcgtggccgccgcgcctactctggtctctgggggagggtccaccagctctaccagtagcggcagcttcgaggcttcccccgtggaaccccagctcccatccaaagaggggcccgaacccccggaagaggtcccaccaccgaccacaccccccgtgccaaaggtcgaaccaaagggagatggcatcggacccacgagacagcctccatcacagggactgggataccccaagtatcagaagtctctacccccccggtttcagaggcaacagcaagagcagttactgaagcaacaacagcaacatcagtggcagcagcatcagcaagggtcagctcctcccacaccggtgcctccctctccgccccagccagtcactctaggtgctgtgcctgccccccaggccccccccccaccgcccaaggctctttaccctggcgctctagggagacccccgccgatgcctccaatgaattttgatccccgctggatgatgatccccccctatgtggacccacggcttcttcaaggccggcctcctctggacttttaccctccaggggtccatccctctggcctggttccaagagaaagaagcgacagcggtggctcgtcatctgagccgtttgaccgccacgcaccggctatgttgcgcgaacgaggaacgccacccgtagaccctaaactggcatgggtcggagacgtctttaccgcgacgccggccgagccacggccacttacatctcctttaaggcaagctgcggatgaagacgacaagggcatgaggagtgaaacaccaccggttccccctcctcctccctacctggcgagctacccgggatttcctgaaaatggggcacccgggccaccaatttccaggttcccgttggaggagcctgggccccggcctctgccctggcctcctggcagtgacgaggtcgccaaaatccaaacccctccaccgaaaaaagaaccacctaaagaggaaacagcccagttaactggtcccgaggcaggaaggaaacctgcccggggggtggggtccggcgggcaggggccccccccacctagacgcgaatcgagaacagagacccgatgggggcctcgacctggatcatcaaggaggggaatccccccagaggagcctggagcgcctccccggagagctgggcccattaaaaaaccaccgcctccaaccaaggtcgaggagctccctcccaaaccccttgagcagggggatgaaaccccgaaaccccctaagcctgaccctctgaaaataaccaagggaaagttgggtgggccaaaggaaacacctccaaatggaaatctctcgcctgcaccccggctgcgaagggactactcctacgaaagggtgggaccaacgagctgtcgcggtagaggccgaggggagtattttgcacgggggcgcggcttccgggggacctatggcggacggggcaggggcgccgcaggtaactccgccgtcacggaatcttttgaagagatgatgggggtggaggtgggccaaggcgaccagacaacactactcttgcccgaagctgcccttcccgcccggcacggcgcgcgggttcagagcatgcggaagtccccatcaggcgccgggtcaggagcgcagaagcaagctgccaggcctatgcgggttatctggcttctgcaaacaagacggctgccccaccctcgccgggagcactccccaaggtcccgatcccccactacgaggagtcctacattcccagctcctgcccgattcacccccggcgtaggggagagcagcttgcccgaggggatctcacccgggcctcggcgtcgcgagccacctcaggtgtgtcccggatggtctcctccagcaaagtccctggctcccaagaagccaccgaccggccccctgcccccctcaaaggagccgctgaaggagaagctcatacccggtcccctctccccggtcgcccgaggtggcagcaatggcgggtccaacgtcggaatggaggatggggagaggcctagacgcagacgacacggacgggcacagcagcaagataaacctcccagattcagacggcttaaacaggagagggagaacgcagctaggggtagtgaaggcaaaccatctctcaccctcccagcttccgccccaggccccgaagaagcattgacaactgtgacagtggcgcctgccccccggagggctgccgccaagtccccagacttgagtaatcagaattccgaccaggccaacgaggaatgggaaacggccagtgagtcatccgacttcacttctgaacggcgtggagataaggaagcaccgccgcccgttctcttaacgcctaaggccgtcgggacgccagggggcggcggcggcggcgcagttcctggtatttctgcaatgagcaggggggacttgtcacagagagcaaaagatctgtctaagcgttctttctccagccagaggcccggaatggagagacaaaaccgccggcccgggcctgggggcaaggcaggctccagcgggagttccagtggggggggtggagggggacctggtggccgtactggcccaggccgtggggacaaaaggagttggcccagtcccaagaatagatccaggccccccgaggagcgcccaccgggcctaccgctccctccgccacccccatccagcagcgcagtttttaggcttgatcaggtaattcatagtaatcctgcgggcatccagcaggcacttgcgcagttatcttctaggcagggatccgtgactgccccgggaggtcatccccggcataaacctggacccccccaagctccccaaggaccaagccccagaccacccacccgctatgagccacagagggtgaatagcggtctctccagcgacccgcacttcgaagaaccaggcccaatggtacggggggtggggggcacaccacgcgactccgccggggtgtcaccctttccacccaagcgacgggaacgcccacccaggaagccagaactgctccaggaggagtctttaccgcccccacactcaagcgggtttctcggttctaagcctgaagggccagggcctcaggcagagtctcgcgacacaggaactgaagcgctcacaccacatatctggaaccggctgcatacggccacgtctcggaagtcctacagaccgtccagcatggaaccctggatggaaccactttctccttttgaggacgtggctggtacggaaatgtcccagagcgacagtggagttgacttgtctggtgatagccaggtgagcagtggtccatgttcacagcgtagcagtcccgacggcggactgaaaggcgccgcagaggggccccccaaaaggccaggaggatcctcacccctcaatgctgtgccctgtgaaggaccacccgggtcagaaccgccccggaggcccccgcctgcaccacacgacggcgaccgcaaagagttacctagggagcagcccctacctcctgggcccataggtaccgaacgatcccagcacacagatcgggggaccgagccaggccctatccgaccgtctcaccgacccggccctccagtacagttcggtacgagtgacaaggactccgatctgaggttagttgtgggcgactcactgaaggccgagaaggagctcacagccagtgtcaccgaggcaatccctgtctctcgcgattgggagcttttgccctctgcggccgcctctgcagaacctcaatcaaaaaatctcgacagcgggcactgcgtgcccgaaccttctagcagcggacagaggttgtaccccgaggtgttctatggctctgctggtccttccagctcacagatcagcggtggacatggcttgtccgtcacgtccaagcagtggcggcgccctggcactccctcactgcatccctatcgcagccagcccttgtatctgcctcccggacccgccccacctagcgctctcttatctggcgtggctttaaagggtcagttcttggattttagtacaatgcaagcaaccgaactcggcaagttacctgctggtggggtcctttacccgcctccctctttcctgtattctcctgctttctgtccctcgcctctgcccgatacttcattgctgcaggtcaggcaggacctcccttccccctccgatttctattccacacctctgcaacctgggggtcagtccggattccttccttcgggggctccagcccagcaaatgctgttgcctatggtagattctcagctgcctgtcgttaacttcggatccctccctcccgcaccaccacccgcccccccctcactgtccctcctcccagttggtcccgccctgcagcctccttccctggcggtgcgcccgccccccgctcctgctacacgcgtattgccatcacccgccagaccttttccagcctctctcggtcgggccgaactgcatcccgtggaactcaaacctttccaggactaccaaaaattgtcaagcaatctcggcggtcctggttcaagtagaactcctcccaccggaaggagcttctctggactgaactcccgcttaaaggctaccccaagcacctacagcggcgtctttcgtactcagagagtagacttgtaccagcaggcctctcccccagacgccctccggtggattcccaagccctgggagaggactggccccccgcccagagaagggccaagcagacgagcggaggaacctggatcacggggcgataaagagcctggactgcctcctcccaggtag

SEQ ID NO: 130054 - DNA, 6417 bp, Artificial Sequence
  Description of Artificial Sequence: Synthetic coding sequence
atgagcgaccggtctggtcctacagcaaagggtaaggacgggaaaaaatactcttctctcaacctgtttgatacatacaagggaaagtcgctagaaatccaaaagccagctgtcgccccaaggcacggtttgcaatcattaggcaaagtggccatcgctagacgtatgccccccccagcaaacttaccatcactcaaggccgagaataaaggaaatgaccctaacgtgtcactggtcccaaaagacggtaccggatgggcctcgaaacaggagcagtcagacccaaagagcagtgatgcctccaccgcacagcctccagagtcccagccgttgccagcaagccagactcccgcgagcaatcagcccaagcgtccaccagctgccccagagaatacccccctggtcccttctggggtgaagtcatgggcacaggcctctgttacacacggcgcccatggggatggtggccgcgcaagctccctgttgtctagattttcccgggaagagttccctaccctgcaggccgctggcgaccaggacaaagccgccaaggaaagagagtccgcagaacagtcctccggtccaggacctagcctgcgaccccagaatagcaccacctggcgggacggaggcgggcggggacctgatgagctggagggccccgattccaagctccatcatgggcatgacccgaggggcggcttgcagcctagcgggccaccccagtttccaccatatagggggatgatgcctcctttcatgtaccccccttaccttcccttcccaccgccgtacggccctcagggcccatatagatacccaactccagacggccctagccggttccctcgggtagcagggccccggggatccgggccccccatgcgactagtggagccggtcgggcgtcccagcatcttgaaagaggataatttgaaagagtttgaccagctcgatcaagaaaatgatgacggctgggctggggctcacgaggaggttgactatactgagaagctaaagttcagcgatgaggaggatggcagagatagcgacgaggaaggagccgagggccatcgggattcacaatctgcatccggagaggaaaggcctcccgaggcagacggaaagaaaggcaatagccccaattctgagccacccaccccaaagaccgcctgggcagagacaagccggccaccggagaccgagcctggacccccagcacccaaaccacctctgccccctccgggggactaccccgacagagggggcccaccctgcaagcctccagcccctgaagatgaagatgaggcctggcgccaacgccgcaagcaatcaagcagcgagattagcctggccgtagaaagggcgcggcggagacgggaagaagaggaaaggagaatgcaagaggagcggagagccgcctgtgccgagaagttaaagaggctggacgaaaagttcggtgctcctgataagcgcttaaaagccgagcctgccgcaccgcccgcagccccatctactcctgctccgcctcccgccgtgcccaaggaattaccggcccctcccgcacccccgcccgcatcggcccctaccccagagacggaacctgaggagcccgcccaagctccgcctgcccagtccacccccacacccggggtggctgcggcgccaacactggtgagtgggggcggcagcacaagttccacatcttcaggttcgtttgaggcctcccctgtcgagccccagctgccttccaaggaagggcctgaaccacctgaagaggtgcctcctcctacaactccccctgtgcccaaagtggaacccaaaggcgatggaattggaccaacacgccagccacctagccagggattagggtatccgaaataccagaagtcgctgcctcctaggtttcagcgacaacaacaggagcagctcctcaaacagcagcagcagcaccagtggcaacaacaccagcagggctcagctcccccaaccccggtgcctccgtcccctccccagcccgttacactaggcgctgtgccagctccgcaggccccaccgcccccccccaaagctttatacccaggagcattggggaggccccctcccatgccgcccatgaattttgatccccggtggatgatgatccctccctacgtcgatccacgactgctgcagggtcgcccaccacttgacttctacccacctggggtgcatccatcaggcttggttcctcgggagagatcagattctggaggatcctcctctgagccatttgatcgccacgcccctgccatgctccgggagagagggacacctcctgtcgatcctaagctggcttgggtgggcgatgtcttcactgccacgccggcagaaccccgcccattgacatcccctttgcgacaggccgcagacgaagacgacaagggcatgagaagcgagacaccccctgtccctcctccccccccttaccttgccagctatcccggcttccccgaaaacggcgccccggggcccccaatctccagatttccactggaggaacccgggccgaggcctcttccttggccacccgggagcgatgaggtcgcgaaaatccagacccctcctcctaagaaagagcccccaaaagaagagaccgcccagctgactggcccagaagccggccgtaaaccagcccggggagtgggctcagggggccaggggcctccgcccccaaggagagaaagtcgcactgaaactaggtggggtccaaggcccggtagctcacgtagagggatcccacctgaggagcccggcgcaccacctcgaagggccgggccaatcaaaaaacctccccccccgacaaaagtggaggagcttccgcccaagccacttgagcagggtgacgagacaccaaagccaccaaagcccgatcctctcaaaatcacaaagggcaaactcgggggccctaaggaaacaccccccaatgggaacctgagtcctgccccaaggctgcgccgcgactactcatatgagagggtgggccccacgtcctgccgcgggcgcgggcgcggggaatattttgctagaggccggggatttagagggacctacggtggtagaggccgcggcgcggcaggcaatagcgctgtgacagagagctttgaagagatgatgggcgttgaggtcggccaaggagatcaaaccacactgcttctgcccgaggctgccttgcctgccaggcacggggctagggttcagtctatgcgaaagtctcccagcggagcagggtccggggcacagaaacaggccgcaaggcccatgagagtcatatggctattgcaaacgagacggctgccccatcctcgaagggagcactcaccccgctccaggagtccaaccacacgtagtccaaccttccccgcccctgcaagattcacgcccggagtgggggagtcgagtctgcccgaaggaatcagccctgggccgaggcgcagggaaccccctcaggtctgcccaggctggtctccgcctgcaaaaagtctggctcctaagaagcctccaactgggcccctccccccgagtaaggagcctctgaaggaaaagctgattcccggaccactctccccagttgccagaggcggaagcaatggcgggagcaacgtgggaatggaggatggcgagcgcccaagacgccggcgccatggcagagcacagcaacaggacaaaccgccgaggttcagacggcttaaacaagaaagggagaacgcggcaagagggtccgagggcaagccctctctgactctgcctgcttcagcccctggacccgaagaggcactaacaacagtgaccgtggctcccgcaccgagacgcgccgcagctaaatctcctgacctgagtaatcagaatagcgatcaagcaaacgaagaatgggaaacagcctctgagtcctcggacttcacttctgagagacgtggtgataaggaggcacctccccccgttctgctaacaccgaaggcagtaggaacccccggaggaggcggaggcggcgccgtccctggaataagcgcgatgtccagaggcgacctgagccaacgggccaaggatctctccaagcggtcatttagctcacagcgcccgggtatggagaggcagaaccgaagaccaggccctggtggcaaggctggtagcagcggcagttcatcaggcggtggcggaggaggccctgggggacgcacagggcccggaaggggggacaagcgatcctggcctagcccgaagaatcgttcccgacctccagaagagagaccccctggtctgccactgccaccacctccgccttctagtagtgcggtgttcagactagaccaggtcatacacagcaacccggccggaattcaacaagctctggcccaactgtctagtaggcagggcagtgtaacagccccaggggggcatccgcgccataagcccggacttccacaggcccctcaaggacctagtccacgaccccctacgaggtacgagccacagagggtgaattctggcctcagctccgatcctcattttgaagagcccggaccgatggttagaggtgtaggcggcacaccccgagattcagccggtgtttctccattcccgcccaagcgccgcgagagaccccctcggaagcccgaacttctgcaggaagagagtctgccacctccacatagctctggatttctgggatcaaaacccgaagggcccggaccacaggctgagagtagagacactggaacggaagctctcacacctcacatatggaatcgtttacacaccgctaccagccgcaagagctatcgtcctagcagtatggagccctggatggaacccttgtcccccttcgaggacgtggcagggacggagatgagccagtccgattctggtgtcgacctgagtggcgacagccaggtgtcttccggcccctgtagtcaacggagctcgcccgacggtggactaaagggagcagcagagggccctccaaagcgtcctggtggtagctcccctttgaacgccgtgccatgcgaaggccctcctgggtcagagcctccacggcggccaccccctgccccgcacgacggcgatcgcaaggaactgccaagggaacagccactgccccccggacctataggcaccgagcggagccaacgaacagatcggggcaccgagccggggccaataaggccatcccatcgaccaggaccacccgtgcaattcggtaccagtgacaaagacagcgatctacgcctcgtcgtgggagacagtctgaaggcagagaaagagctaaccgcctcagtgactgaggccatccccgtgagcagagattgggaactccttccaagcgcagcagcttcggccgagccccagagcaagaatctcgattctggtcactgcgtgccggagccttcttcgtcaggacagaggctttacccagaggttttttacggctccgctggaccatctagttcccagatcagcgggggccacggcctgtcgattactagtaagcagtggcggagacctggtactcccagcctgcacccttaccgaagtcagcccctgtatttacctcctggtcccgcccccccttccgcactgctgtctggcgtcgcactgaagggacaattcctcgatttttcgaccatgcaagcaaccgagctgggaaagctaccagccggcggcgtgctgtacccaccacccagctttttatacagtcctgcattttgtccgagcccactgccagacactagcctcctgcaggttagacaggacctgccatcaccttctgatttctactcaacacctctgcagcccggcggtcaatccgggtttttaccatcaggagcgccagcccagcagatgctgctcccaatggtcgactcccagctgccagtggtgaattttggttccctgcccccggctccacccccagcaccaccaccattgtctcttctgcccgtgggtccggccctccagccaccatcgctggctgtgcgtccacctccagctcccgcaactagggtgctacctagtccggcgagacctttccctgcatcattgggccgcgcggagttgcacccagtggagctcaagccattccaggactaccagaagctgagctctaacctgggggggcccggctcatccaggacgccaccaaccggtcgatcgtttagtggtctcaacagtcggttgaaagctacgccttctacctattccggggtctttagaacacagcgagtggatctctaccagcaggcaagccctccagatgccctgcgctggatccccaaaccctgggagcgaaccggtccgccccctcgtgagggtccctctaggcgggctgaggagccaggaagtcggggagataaggagcccggcctgccaccgcctaggtag

SEQ ID NO: 130055 - DNA, 6417 bp, Artificial Sequence
  Description of Artificial Sequence: Synthetic coding sequence
atgagtgatcgcagcgggcccacagcaaagggcaaagacgggaaaaagtactcctcgctgaatttgtttgatacctataagggcaagagccttgagattcagaaacctgctgtggccccccgccacggcttgcagagtttgggcaaagtggcaattgcccgtaggatgccaccccctgccaacttaccatctcttaaggcagaaaataagggtaacgaccccaatgtgagtctcgtgcccaaggatggaacaggctgggcttccaagcaggaacagtccgatcctaagagtagcgacgcgtccaccgcgcagccccccgaatctcagccacttcccgcctcacagactccagcgtcgaaccagcccaaaagacctcccgctgctcccgaaaacactcccctcgtgccctcaggcgtaaaatcatgggcccaggcctctgtcactcacggggcacacggcgacggtggtagagcctccagcttgctgagccgttttagcagggaggagttcccaaccctgcaggcagccggcgatcaggacaaggcggctaaggagagggaaagcgctgaacagtcttctggtccaggcccgagtttacggccacagaattcaacgacctggagagacggaggcggcaggggccctgatgaactggagggacctgatagtaaactccatcatggacatgatcccagaggcggtctccaaccatctgggcccccccagttcccaccttaccggggtatgatgcctcctttcatgtaccctccgtacttgccctttccacctccctatggcccccagggtccataccggtaccccaccccagacggcccttccaggttccctcgggtggccggaccgcgcggatcaggacctcctatgcgactggtggaacctgtgggacgaccaagcattctcaaggaggacaatctcaaggaattcgaccaattagatcaggagaacgatgacggttgggcgggagctcatgaagaggtggactatacggagaaactgaaatttagcgacgaagaggatgggcgggacagcgacgaggagggagctgagggtcatagagatagccagtccgcgtccggggaggagcggcccccagaagctgacggtaagaagggcaattcgcccaatagtgagccacctactcccaagacggcttgggccgagacctccaggccccccgagaccgagcctggcccgccagccccgaaaccccccctgccccctcccggggactatcccgaccggggtggacccccttgcaaaccccccgcccccgaagacgaagatgaggcatggcggcagagacggaaacagagcagctctgagatctctttggccgtggagagagcccgacgccgccgcgaggaagaagaaagacgcatgcaggaggaaagaagggcagcatgcgccgaaaagctgaagagactggatgagaagtttggcgccccagacaaaagattgaaggcagaacccgctgctccaccagccgccccgagcacaccggccccccctcccgccgtgcctaaggagttgcctgccccgcccgctccaccacccgcctccgcccccacaccagagaaagaacctgaagaacccgcccaagccccgcccgcccagtctaccccgacacctggggtggctgccgcacctaccttagtctcagggggcggtagcactagcagcacctcttccggctcatttgaagcaagtcccgtcgagccccaattgcccagcaaagaaggcccagaaccacccgaggaggtgccgcctcccactacgccccctgtgccaaaggtggagcccaagggagacggaattggccctaccagacaaccaccatcacaaggactgggataccccaaatatcaaaaatctcttccgcctagattccaaaggcagcagcaagagcaactcctgaagcagcagcagcagcaccagtggcagcagcaccagcagggaagcgcacctcctacgccagtcccaccatctccacctcagccagtcacactgggggctgtccccgcaccccaggctccaccgccccctcccaaagccctgtaccccggcgcccttggcagacctcccccaatgcctcccatgaatttcgacccccgctggatgatgatcccaccctatgttgatcccaggttgctgcaaggcagacctccgttggacttctacccacccggggtgcacccgtctgggttggtcccccgagagcggtctgattccggcggctcctctagcgagcctttcgataggcatgcccccgccatgctccgtgagagaggcacccccccagtggaccctaaactagcgtgggtcggcgacgtgttcacagccactccggccgaacctcgccctctcacatctcctttacgtcaagccgctgacgaggatgataaagggatgcgttcagagactccacccgtgcccccaccgcccccttatttggcatcataccctggcttcccagaaaatggagccccaggccctcccatatcccgcttcccgcttgaggagccaggacctagacctttaccttggccacccgggtccgatgaggtggccaagattcagacacccccaccgaaaaaagagcccccaaaggaagagactgcacagctcacgggtcctgaggcaggtcggaaaccggcacgtggagtcgggtccggtggccagggcccgccccctccccgcagggagtctcgcaccgaaacaaggtgggggcctagacctggcagctcccgccgagggatccccccggaagagccaggagcccctccacggcgtgcagggccaataaaaaaaccacctcctcccactaaggtcgaggagctcccacccaagccattggagcagggcgacgaaactcctaagccccccaagccagaccctctgaaaattacaaaaggaaagctcggtggtcctaaagagactccgcccaacggaaatctgagcccggcgccaaggctgagacgcgattattcttacgaacgggtgggacctacaagttgccggggaaggggtcgaggcgagtacttcgcacgtggcagaggcttcagaggcacatacggggggagaggacggggcgcggcaggaaactcggccgtgaccgaatccttcgaggaaatgatgggggtcgaggttggacagggagatcaaaccaccctgctgctgccggaggcagccttgcctgcgcgtcatggggcaagggtccagagcatgaggaagtcgccatctggagctggatccggagctcagaagcaggccgccagacctatgcgtgtaatttggctcctgcaaacacgaaggctgccccaccctcggcgcgaacacagcccaaggagtcggtcccctacaacaaggagtcctacctttcctgcccccgctcgattcacccccggggtgggtgaaagctctctgcctgaaggtataagccccggacccagaaggcgtgaacctccgcaggtctgccccggctggtcccctccagctaagtctctggcccccaagaagccccctaccggacccctgccaccatccaaagaaccccttaaagagaaattgatcccgggcccacttagtcctgttgctcgcggcggctccaatgggggctccaacgtaggtatggaggacggcgagagacctcgacgtcggcggcatggtcgtgcacagcagcaggataagcctcccagatttaggaggctgaagcaggagcgtgaaaacgcggcaagggggtccgaaggcaaaccaagcttgactctgccagcctcagcaccaggacccgaggaagccctgaccaccgtgacagtagctccggctccacgcagagcggctgccaagtcaccagaccttagtaaccagaacagcgatcaggcaaacgaggaatgggaaaccgccagtgaatcttcagactttacatctgaacgcagaggcgataaggaagcaccccccccagtattgctaactccaaaggctgtgggcacccccggaggtggggggggaggcgccgttcctggaattagcgcaatgtcccggggcgatctgtcacagcgcgcaaaggacctgtctaagcggtctttttcctcccagcgtcccgggatggagagacagaatcgccgtccaggcccgggcggaaaggccggctcctccggcagttctagtgggggcggcggtggagggcctggtggacgaaccggacccggaaggggtgataaacgcagctggccatctccaaaaaatcggagccggcccccagaagaacgtccgccagggctcccactcccccccccccctcctagcagctccgccgtattcagattggaccaggtgatccactctaaccctgctggcatccagcaggcactggcgcaattgagttccagacagggctcggtcaccgcccccggaggccacccacgccacaagcctggccctcctcaggcacctcaaggccctagtcctcggccacctaccagatacgaaccccaaagggtgaactcaggcctatctagcgatccccacttcgaagagccaggccctatggtacgcggagtaggaggaactccaagggacagtgccggggtttccccatttccacctaaacggcgtgagcgaccgccaagaaagcctgagctcctgcaggaggagagcttgcctccaccacatagcagtgggtttctgggatctaaaccagaaggcccgggaccacaggctgagagccgcgatacaggaacagaagccttgactccacacatatggaaccgactgcacactgcgacatcacggaaaagttaccgcccctccagcatggagccctggatggagcctctctcaccattcgaagatgtggctggtacagaaatgagtcaaagtgactctggtgtagatctgtccggagactctcaggtttcttctggtccttgctcccaaaggagcagcccagacggcgggttaaagggcgctgccgaagggcctcctaagaggcctggtggatcttccccgttaaacgcggtgccatgcgaagggccgcccggatctgagccccctagacgaccaccgccggcacctcacgatggcgatagaaaagagttaccccgggagcagccactgccccccggccccattggaactgagcggagccaacacactgacaggggaactgaaccggggccaatccgcccgtcacatcgcccaggccctcctgtgcaatttggcaccagcgacaaggactctgatctgaggctggtggtgggtgacagtctaaaagccgaaaaagagcttacagcgagtgtgacagaggcgatcccagtgtctagggattgggagctcttgcctagcgctgctgcttcagccgaaccccagagcaagaatctggatagcggtcattgtgtgcccgaaccctcctcctctggacaacgcctctaccccgaggtgttttatgggtccgctggaccctcatcaagtcagatatctggggggcacggcttgtcagtcactagcaaacagtggcggagacctggaacaccgtctcttcacccctacagatcccaacctttatacctcccccctggtcccgccccaccgagcgcacttttatcaggggtggccttaaaggggcaattcttggatttctccaccatgcaggctaccgaactagggaagctccccgcaggcggagtgctgtaccctccaccatcctttctctatagccctgctttttgtcccagcccactgcctgacacaagcttactgcaggtgcggcaggatctgccctccccaagcgatttctacagcactccactgcagcctgggggccagagtggatttctcccatctggtgccccggcacagcagatgttactgcccatggtcgacagtcagctccctgtggtgaattttggcagcctgccccccgcccccccacctgcacccccttccctgagcctgctgccagtcggccccgcattgcagccccccagtcttgccgtgagacctcccccggcgcctgccacccgcgtgctccccagcccggcgaggccgtttcctgcctcgcttggacgtgccgaacttcatccagtggaactgaaaccattccaggactaccaaaaactgtcctccaacttggggggccccggcagcagtaggacgccccccaccggccgctctttttctggacttaatagtaggctcaaggccacaccttcaacctactccggcgtctttagaacccaaagagtggacttgtatcagcaggcgtccccccccgatgctctccgctggatccccaagccatgggagcggacgggaccaccccctcgtgagggcccgagccggagggccgaagagcctggatcgcgaggagataaggagcccggccttccgcccccacgatag

SEQ ID NO: 130056 - DNA, 6417 bp, Artificial Sequence
  Description of Artificial Sequence: Synthetic coding sequence
atgagtgaccgatctggcccgacagccaaaggtaaagatggcaaaaagtactcctcactgaatctttttgatacctacaaggggaagtctctcgagattcagaagccggccgtggccccacgtcacggcttgcaaagcctgggcaaagtggccatcgcccgtagaatgcctccccctgcaaatctgccgtccttgaaagcagaaaataaaggcaatgatcccaatgtttctctggtccctaaggatggaacaggctgggcttcaaagcaggagcaatccgatcctaagagctccgatgcttcaactgcccagcccccggaatcacagcctctgccggccagtcagactccagcatcgaaccagcccaaacggcctccagccgctcccgaaaatacgccgcttgtgccctcaggagtgaagtcatgggcacaggcatccgtcacacacggcgctcacggagatgggggacgggcatcctccctattgtctagattttctcgcgaggaattccctacccttcaggccgctggcgaccaagataaagccgctaaagaaagggagtcggccgagcagtcctcgggccctggccctagcttgcgacctcagaactcaaccacctggagagacggaggcggaaggggacccgatgagttagagggcccagactccaaactgcatcacggccatgatccccgcggaggcctccagcccagtgggccgccccagttcccaccgtatagaggaatgatgcccccgtttatgtaccccccgtatctgccctttcctcctccctatggcccccagggtccttatcggtacccgacccccgatggaccaagccgttttccaagagtggccggccctcgtgggtccggtccaccaatgaggctggtggagccagtgggcaggccatccatcctgaaggaagacaacctgaaggaattcgatcagttagatcaggaaaacgacgatgggtgggcgggcgctcacgaggaagtggactacactgaaaaactaaaattcagtgacgaagaagacggccgggactctgatgaggagggcgcagagggccatcgggactctcagagcgcgtctggcgaggagcggccccccgaggctgatggaaagaaaggcaattctcccaactcagagccccctacgcctaaaaccgcctgggctgagacaagcagacctcccgagaccgaaccaggacctccagctcccaagccgccactgccccccccaggcgattacccagatcggggcggtccgccgtgcaagcctcccgcccccgaagatgaggatgaagcctggcgacagcggcgaaaacaatcatctagcgaaatttcgctagccgtggagagggccagacggcgaagggaggaagaggaacgacggatgcaggaggaaaggcgtgcagcctgcgccgagaaactgaagaggctcgacgagaagtttggggcccctgacaaacgactgaaggccgaacccgccgcacctccagccgcccccagcacccccgcgccaccccccgctgttcccaaagagctgcctgcgcctcctgcaccaccacctgcatctgccccaactccagaaaaagagccagaggaaccagcccaggcccccccagcacaatccacccccacgcccggtgttgccgccgcacccactctagtctccggtggcggctccactagttccacttcgtccggatcctttgaggcaagcccagtggagccacaactgccttcaaaggagggccccgaaccccctgaggaggttcctccacccacaacaccgcctgtccccaaggtcgaaccgaagggagacggcatcggccctactcgacaaccaccatcccagggactgggttatccaaaataccagaaatctctgcctccaagattccagcgccagcagcaggaacagctcctgaagcagcagcagcagcatcaatggcaacagcaccagcagggaagcgctccacccactccagtgcccccctctccacctcaacctgtgacgctcggagcagtgcccgcacctcaggccccaccccccccccctaaggcactctaccccggagctcttggaagacccccccccatgcctcctatgaattttgaccccaggtggatgatgatacccccatatgtcgacccgaggctccttcaggggagaccgccactggatttctacccacctggggtgcaccctagtggactggtgcctcgcgagcgttcagattccggtggatcttccagtgagccctttgacagacatgcacctgcaatgttaagggagagaggaaccccccctgtggacccaaaattggcctgggtgggggacgtattcaccgcgacgcctgctgagccacgcccactgacatcccctctgaggcaagccgccgacgaggacgacaaaggtatgaggagcgaaactccccccgtaccacccccgcctccctatttggcctcataccccggcttccctgagaacggcgctcctgggccacccatttcccgttttccgctggaagagcccgggccccgccccctgccgtggccgccaggttcagacgaggtggccaagattcagaccccaccccctaagaaagagcctccaaaggaagagacagcccagctcaccggaccggaagccgggcggaagccagcccgtggcgttgggagcggtggacagggaccaccaccaccacgtagagagagtaggactgaaacaaggtggggtcctaggccaggcagcagccggaggggcattccacccgaggagccaggcgccccacctagaagggcgggccctatcaaaaagccgccacctcctaccaaggtagaagaattgcccccgaaacctcttgagcagggagatgagactcctaagcccccaaagcccgatccgctgaaaattactaaggggaagctgggcggacccaaagaaactccaccaaacggcaaccttagccctgcacccaggctgcgtagagactactcctacgagcgggtaggccctaccagctgtagagggagaggtcggggagaatacttcgcacggggacgcggctttcggggcacatacggaggacggggcaggggcgccgctggcaattccgccgtcaccgagtccttcgaagaaatgatgggcgtggaggttggtcagggcgaccagacaacactgctactccccgaagcagccctgcccgcccgccatggcgcacgagtacagtccatgaggaagtcaccgtctggggctgggtctggagcccagaagcaggccgcccgccctatgagagttatttggctactccagacaagacgattgcctcatcccagacgggaacactcgccaaggtcccgatctccaacaacacgttccccaacattccctgctccagctcgctttactcctggcgttggtgaatcctctctacctgaggggatttctcccggaccaaggaggcgggaaccaccacaggtgtgtccggggtggtccccgccagcaaaatcccttgcgccaaaaaagccccccacaggccccttgcctccatcgaaggaaccactcaaagagaagttgatccccgggccgttgtcccccgtggctcgtgggggaagcaatggcggttcaaacgtcggcatggaggacggtgaaagaccccggaggcggcgccacggtagagcccaacagcaggacaagcctccaaggttcaggagattaaagcaggaaagagagaatgctgcccgcggctccgaagggaagcctagcctgacccttccggcaagcgccccaggccctgaagaggccctgactaccgtgactgtggcccccgccccaaggagggcggccgctaaaagccctgacctaagcaatcagaactcggaccaagcaaacgaggagtgggagactgcgagtgaaagcagcgatttcaccagcgaacggcggggcgacaaggaagctccaccccctgtcttactgacacctaaggcagtgggtactcccggcggaggtggtggcggggcagtccccgggatcagtgctatgtcccgtggggatctgtctcagagagcgaaggatttatcgaaacgcagctttagctctcagcgtcccgggatggagcggcagaaccgcaggcccggacccgggggcaaagccgggtctagcggtagctcatccgggggtggtggcggcgggccaggcgggcgaacgggacccggtcgaggggataagagaagttggccgagccccaagaacaggtctcggcctcctgaagaaagacctcctgggcttccattgcccccacctcctccttcctcgagtgcggtgtttcgactcgatcaagtcatccatagcaatcccgccggcatccagcaggcattagcccaattgagctcgcgccagggctccgtcacagcacccggcggccatcccaggcacaaacctggtccaccccaggcacctcagggtccttctccccgcccgccgaccaggtacgaaccccagagagtaaattcaggcctgtctagcgatccacattttgaagagcctggaccgatggtgcgcggcgtgggaggaacaccccgggactctgccggagtgtctcctttcccacccaagagaagagagcggcctccacgtaaaccagaactcctacaggaagaaagtctgccccctcctcactcttcaggatttcttgggagcaaaccagaggggcccgggccccaggccgagtccagagataccgggaccgaggccttaactcctcacatctggaatagattacacactgctacaagccgcaagtcctaccgccccagctctatggagccctggatggagccattgagtccatttgaagacgtagccggcactgaaatgagccagtccgacagtggagtcgacctgtccggagactctcaggtttctagtgggccttgttcccagagaagctcaccggacggcggtctgaagggagcagccgagggtccacccaagagaccaggggggtccagccccttgaatgctgttccctgtgaaggcccacctggctcagagcctccacggcgacctccccccgcccctcacgatggggaccgtaaagaacttcctagagaacaaccccttcctcctggcccaatcggtacagagagatcccagcggacagaccgcggaacagaacccgggcccattagaccgtctcatcgtccaggacctcctgtccagtttggcacttccgacaaggattccgacttaagacttgtggtgggggatagcctgaaagccgagaaagaactaaccgcgtccgtcactgaggctatcccggtgagcagagactgggagcttctacctagcgcggccgcatctgccgaaccacagagcaagaaccttgattcggggcactgcgtgcccgaaccctcatcttcaggtcaaagattgtacccagaagtcttttacggctcagctggcccaagctcttcccagattagtggagggcacggcctgtctatcacaagtaagcagtggcgccggccaggcacgccaagtttgcatccgtacagaagtcaacctttgtacctgcctccaggaccggctcctcccagcgctttgctgtctggtgtcgctttaaaggggcaattcctcgatttcagcaccatgcaggcaaccgaactagggaaactccctgctggtggggtactttaccctccaccatctttcctatatagcccagcattttgtccatctcccctacccgacaccagtctgctccaggtgcgacaggacctgcctagcccctccgacttctactccaccccgctccaacccggcgggcagagtggcttcttgccatccggagcaccggctcagcaaatgctgctgccaatggttgattcccagctccccgtagtgaattttggcagtctgccacctgcccctccgcctgcacctccacctctcagcctcttgccagtggggccggccctccagcctcccagcctagccgtgaggcctccccccgctcccgccaccagggtccttcctagtcccgctagacctttccctgcgagcctaggacgcgctgagctacaccctgtggaactcaaacccttccaggattaccaaaagctctccagtaatctgggaggccctggcagcagccgcacgccaccgaccggtagatctttctcggggctaaactcaaggctgaaggctacaccatccacctactccggagtctttcggacccaaagagtcgatctgtaccaacaggcctctcctcccgatgctctaagatggatcccaaagccctgggagaggacagggccaccaccacgcgaagggccgagtagaagagccgaggaacctggaagccggggtgacaaagaacccgggttaccgcccccccgctag

SEQ ID NO: 130057 - DNA, 4149 bp, Artificial Sequence
  Description of Artificial Sequence: Synthetic coding sequence
atgctccgggagaggggcaccccgccagttgacccaaaattggcttgggtcggcgatgtctttaccgccactcccgctgaaccaaggccgctcacatctcccctccgccaggctgcggacgaagatgacaaaggaatgaggtctgaaacaccccccgtgccgccaccccctccttatctcgccagctatcccggattcccggagaacggggcgccaggtcctccaatatcacggtttcctctggaggagcccggccctcgcccactcccctggcccccagggtccgatgaagtcgctaagattcaaacaccccccccgaaaaaggagccacctaaagaagagactgcccagcttaccgggcctgaggcagggcgcaagcctgccaggggggtcggttccggtggtcaagggcccccaccccctcgccgcgaatcaaggacagagaccagatggggccctcgccccggatcctccaggagagggattccccctgaagagcctggcgctcctcccagacgcgcggggccaataaagaagcctccccctccaacaaaggtcgaagaactgccacccaaacccctggaacaaggggacgagaccccaaaacctccaaagccagatcctctcaaaatcacaaaagggaagcttggtgggcccaaggagacacctccaaacggaaatctgagccccgctcctcgtttaagaagagattactcatacgagcgcgtggggccaacttcgtgccgaggacgtgggagaggagaatatttcgctcgcggtagaggcttccgcggaacgtatggaggaaggggacgaggggcacgatcccgggaattccgctcttatagagagttccgcggcgatgacggcagaggagggggtaccggcggtccaaatcacccacctgccccacgtggaaggaccgccagtgagacgagatccgaaggatcagagtacgaagaaatccccaagaggcggcgacagcggggctccgaaaccggaagcgaaacacacgaatcagatctggccccttccgacaaggaggccccaactcccaaagaaggcactttaacgcaggtgcccctagcccccccgccgcctggggctccacccagccctgcgcccgccagatttacggccagggggggtagagtgtttactcctcggggggttccctcccgaagaggccgcgggggcggcagaccaccccctcaggtgtgtcccggctggagccctccagcaaaaagtctggcacccaagaagcccccaaccggaccgctgccaccatcaaaagagccacttaaggagaagctaattccggggcccctatcccctgtggctagaggaggaagcaatggaggctcgaatgtgggtatggaagacggcgagcgccctcgcagacgccgacacggaagagctcagcaacaagataagcccccccgttttagacgcttgaagcaggaacgagagaatgccgctcggggctccgaaggaaaaccaagtctgactctgcctgcatctgcgcccggtccagaagaagctctgacaacagttaccgtggcccccgctccgcgtcgcgctgcagccaagagtccagatttgagtaaccagaactcagaccaggcaaatgaagagtgggagaccgcatccgaaagttccgacttcacttcagagaggcgtggcgataaggaggctcctcctccagttctgttgacccccaaagcagtgggcaccccagggggaggtgggggcggcgccgtacccggcatcagcgcaatgtccagaggggatctgtcacaacgcgcaaaggacctgtcgaagagatcctttagctctcagcggcctgggatggagcggcaaaaccgcagaccaggcccaggcggaaaggcaggatcatcggggagctcctccggtggtggaggcggcggccccggaggccgcaccgggccaggccggggcgacaagagaagttggccaagcccaaagaaccgttctaggccccccgaggaacggccacctggcctgcccctaccgcctcccccgcctagttcgtcagccgtgttccggcttgaccaagtcattcattctaacccagccggcattcaacaggcactcgctcaactgtcttcccgacagggatcagtcaccgcacctggcggccacccacgtcacaagcccgggctgcctcaggcccctcagggcccttctcctagacccccaacacgctatgagccacagcgggttaattccggactgagctccgatccgcatttcgaggaacccggcccaatggtaaggggcgtgggcggaactccaagagacagcgctggtgtgagtccattcccccccaaaagacgggagcggccaccccgaaagccagagctgctccaagaggaatcactccctccgccacattccagtggttttctgggttccaagcccgaaggtccgggccctcaggcggaatctcgagacacaggcacggaagcactgacccctcacatttggaatcgcctgcacactgcgacaagtaggaagtcttatcggccatcgagcatggagccgtggatggaacccctctcgccatttgaagatgtagccggaaccgaaatgtctcagagcgactcgggtgtagatttaagcggcgactcacaggtgtcatctggcccttgcagccagcggagctccccagacggaggcctgaagggagcagccgagggcccaccaaaaagacccggcggaagcagtccacttaacgcagtcccttgcgagggacctcccggctcagagcctccgaggcgccctcctccagccccgcatgacggcgatagaaaagaattgcctcgagaacagcccctaccccctgggcctatcgggacagagcggagtcagcgtaccgatcgtggtaccgaaccgggccccattcgtccttcgcaccgcccaggcccaccggtgcaatttggaacatcggacaaagacagcgatctgaggctggtcgtgggcgatagcttaaaggccgagaaggaactaacggcgtcagtgaccgaagctatcccagtgtccagggactgggagctcctgccaagcgcggctgcatccgcagaaccgcagtcaaagaatctggattctgggcattgtgtgcccgaaccctccagttccggacagcggctctaccccgaagttttctatggttccgccgggcctagtagttcccaaatcagcggcggcgcaatggactcccagctacacccaaatagtggaggtttccgccccggaaccccctccctacacccttacagatcccaacccctgtatctgccaccaggacctgcccctccatccgccctcctcagcggggtcgccctgaagggccaatttctggactttagtactatgcaggctaccgagttagggaagcttcccgccggaggggtgctctatcccccacccagcttcctctattcccctgcattttgtccctcacccctcccagataccagcctgcttcaagtaaggcaggacttgccgagcccttcagatttttactcaaccccattacagcctggcggccagagtggattcctcccatcgggggcacctgcccaacagatgttgttacctatggtggactcccagctgccggtcgttaactttggaagccttcctcccgcgcctcccccagctcccccaccactgagcctcctccccgtgggtcctgccctccaacccccaagcttggccgtgcgtccaccacccgccccagcgacaagagtcctcccaagccctgcaagaccttttccagcctccctggggcgcgccgaacttcatcctgtagaactgaagccctttcaagattaccaaaaactgtcctctaacttagggggccccggaagtagcagaacccctcccactgggcgcagctttagtggactgaacagccgcctgaaagccacaccaagcacttattccggtgtttttcgaacgcagagagtggacctctaccagcaggcaagtccgcctgacgccctgcggtggataccaaagccctgggagcgcacaggtccaccgccgagagagggtccatcccgtcgggccgaggaaccgggcagccgcggggataaagagccaggtctgccgcctcctagatag

SEQ ID NO: 130058 - DNA, 6450 bp, Artificial Sequence
  Description of Artificial Sequence: Synthetic coding sequence
atgagtgaccgctctggacctaccgcaaagggcaaggacggaaaaaagtacagttccttaaatttgttcgatacctacaagggaaaaagtctcgaaatacagaaaccagccgtcgccccccggcacgggctccaaagcctcggaaaggtagcaatcgcccggagaatgccaccccctgccaatctaccctcacttaaagcggaaaacaaagggaatgatcctaacgtcagcctggtccctaaagacggaacgggatgggctagtaaacaggaacagtctgatcctaagtcctcagacgcatcaactgcccagcctccagaatcgcagcccctgcccgcctcacagacaccggccagtaatcagcctaagaggccccccgctgctcctgaaaacaccccactggtgccgtcgggcgtgaagagctgggcccaggccagcgtgacacacggagctcacggcgacggcggtcgagccagttcattgttatctagatttagtcgggaagagtttccgacattgcaggccgccggcgatcaggataaagcagctaaggagcgcgaaagtgcagaacaaagttcaggacccgggccaagtctgcgcccccaaaactctaccacctggagagacggtggaggaagagggcctgacgagctcgagggtccagatagcaaactgcatcatggccacgacccccggggaggcctccagccatccggccccccccaattccctccataccgagggatgatgccccctttcatgtaccccccttacttgcctttcccgccgccatacggcccgcaggggccttataggtatcccacccccgacggcccttcgagattccctcgtgtagccgggccacggggctcgggcccccccatgaggctggtagagcccgtgggacggcctagtattctaaaggaggacaacctgaaagagttcgatcaattggaccaggagaacgatgatggatgggcgggagcacacgaggaggtcgattatactgaaaagctgaaattctcagatgaggaggatgggagggactcagatgaagagggcgccgaggggcaccgcgacagccagtccgctagcggtgaggagcggccccccgaggcagacggcaaaaaaggcaactccccgaattccgaacctcccacccccaaaaccgcttgggccgaaacctctagacccccagaaaccgaacctggccctccggctccgaaaccccccctgcctccaccccatagagggccagcaggaaactggggccctcctggagactacccagacaggggcggccccccctgcaaaccgcccgctccggaggacgaagacgaggcctggcggcagagaaggaaacagtcttcgagcgagattagcttggctgttgagcgggcacgaagaaggcgggaagaagaggagcggagaatgcaggaggaaagacgcgccgcctgtgccgagaagctgaaaaggctagatgagaaattcggggcaccagataaacgcctgaaagctgaacctgctgcacctcctgcagcccccagcacacccgccccaccccccgcagtgccgaaggaactccctgctcctccagcgccaccacctgcatctgccccaacccctgaaaaggaacccgaagagcccgcacaggcccccccagctcagagtactcctaccccaggcgttgcggccgctcctacactggtctcgggggggggatccacatcttcaacctccagcggcagtttcgaagcgagcccagtggaaccacaactaccctctaaggagggcccagagcctcctgaagaagttccccccccaacgacccctcccgtgcccaaagtggagcctaagggggacggcatcggtcctacgagacagcccccgagtcagggactaggatatcctaaatatcagaagtctctgccccctagatttcagaggcagcagcaagagcagttacttaagcagcagcaacagcaccaatggcaacagcaccagcagggctccgcaccacctacccccgtgccaccaagtccacctcaacctgtcacactcggggcagtccccgccccacaggcacctccacctcctcccaaggccttataccccggagcattaggccgcccaccgcccatgccacccatgaatttcgatccacgttggatgatgatccccccatatgttgatccaagattgctgcagggcaggcctcctctagacttctaccccccaggtgttcatcccagcggactggttcccagggagcggtccgactccggagggagttcaagcgaacccttcgaccgccacgcccctgccatgttgagggagagaggcacacccccagtggatccaaagctggcttgggtcggtgacgtcttcaccgccactccagcggaacctcggcccttgacctcaccactgcgccaggcagccgacgaagacgacaaaggaatgagatctgaaaccccccccgtaccaccaccacctccctacctcgctagttacccgggatttccggagaatggcgcccccgggccacctatatcccggtttcccctggaagaaccagggccacgccctctgccttggccgcctggctctgacgaggtagccaaaattcagactccacccccgaagaaggaaccaccaaaggaagaaaccgcccagctgacaggcccagaagcaggccggaagccagcccggggggtgggatccggcggccagggcccaccacctccgcgccgagaatcaaggactgaaactcggtggggtcctcgacctggaagcagccggagagggatcccccccgaggaacctggtgcccctccaagaagggcggggcctataaagaagcctcctccgccaactaaggtcgaggagcttccacctaaacccctggaacaaggcgacgaaacacctaaaccccccaagcctgatcctctgaaaattactaaagggaagttaggcggtccaaaggagacccctcctaacgggaacttatcacctgctccgcgcctgcgccgggattattcatatgagcgcgtgggacctacgtcatgcagaggtaggggtaggggggagtacttcgcccgtggtcgaggcttccggggcacgtacggagggcgaggcaggggcgcagcagggaattctgctgtcactgaaagttttgaggagatgatgggcgtcgaagtgggccagggagatcagaccaccctccttcttcctgaagcagcactgcccgcaagacacggtgcaagagtgcaaagtatgagaaaaagtccatctggggcgggcagcggggcgcagaagcaggcagcacgcccaatgcgggttatctggctacttcagacaaggcggctccctcaccctcgaagggagcactctcccagatccaggagtccaaccactcgcagtcctacctttcctgcccctgccagattcacgccaggggtgggtgaaagcagcctgcctgagggcatttccccgggaccccgccggcgagaacccccccaagtctgccccggctggtcccccccggcaaaaagcctggcaccaaaaaaaccgcccaccgggcccctacctccctccaaggaaccactgaaggaaaaactgatcccaggaccattatcacccgtggcacgcggggggtctaatggaggctccaatgtgggtatggaagatggcgagcgaccacgccgaagacggcacggacgggctcagcaacaggacaagccaccacgattcagacgattgaagcaggagagggagaatgcagctcgcggatccgaaggcaaaccttccctgaccttgcccgccagtgcgcccgggcccgaagaggcccttacgactgtgaccgtcgcccctgccccgagacgtgccgcagcaaaatcaccagacctgtccaatcagaatagcgaccaggccaacgaggagtgggagacggcctccgaatcgtctgacttcacttctgagcgacgcggggacaaggaggcccctccccccgttctcctgacaccaaaggccgtgggaacacctggcggcggaggaggcggggccgtgccaggcatctctgcaatgagccgtggcgacctgtcacaacgtgccaaggacttatcaaaaaggagcttctctagtcagcggcctggcatggagaggcagaaccgcaggcctggtcctggaggaaaggccggttcttctggctcgtcttcaggtggtggaggaggtggacctggtggcagaaccggtccgggccgtggagacaagaggagctggcctagtcctaagaaccgcagccggcctccggaggagagaccaccaggcctgccactgccacctcccccaccatcctcgagcgctgtgttcaggctggaccaggttatacactctaacccagctggcatccagcaggctctggcccagctcagttcccggcagggctcagttaccgctcctggtggacacccgagacacaagccaggccctccccaggccccccagggcccatcgcccagaccgccgacccggtatgaaccacagcgtgtaaactcaggactatccagtgatccacacttcgaagagcccggtcccatggtacgcggagttggtggaacgccccgggattctgctggagtgagtcccttccctcctaagcggcgcgagcgcccaccacgaaagcctgaactgctgcaggaggagagcttgccacccccccacagttccggctttctggggtccaagcccgaggggcccggaccccaggccgagtctcgggacaccggaacagaggctttgacaccccacatttggaacagactgcatactgccacgtctcgcaagagctatagaccaagctctatggaaccctggatggaacccttgagcccgttcgaggacgtcgcaggcactgagatgagccagtccgactccggagtggatctctccggggatagtcaggtgagcagcgggccctgctctcagagaagctcaccggacgggggactgaaaggtgccgccgagggaccaccaaagcggcctgggggtagttcccctcttaacgccgtgccttgcgaaggcccccccggttctgagccacctcgccgaccaccccctgctccgcatgatggtgacaggaaagagctgcccagggagcagcctctcccacccggacctataggcactgagcgctcacagcgaactgataggggcactgaaccaggtcccatccggcctagccatcgacctggccctcccgtgcagttcgggacgtcggacaaggactctgatctaagactcgtggtcggggatagcttgaaagccgagaaagaactaacagccagtgtaactgaggcgatacccgtgagtcgcgactgggagctgctgccaagtgctgctgctagtgctgagccacaatcaaagaatctggattctggtcactgcgtccccgagcccagctcctccggccaacgactctacccggaagtgttttatggctccgcaggccccagtagcagccagatcagcggcggccacggcttgagcatcacctcgaaacaatggcgaagaccagggaccccctctcttcacccctatcgatcccagcccctgtacctcccaccaggacccgcgccaccgagcgcacttttatccggtgtcgcactgaaggggcagttcctagatttcagcacaatgcaggcaacggagttaggaaaactaccagccggcggcgtcttatatccacctccgtcctttctctattctcccgccttttgtcccagccccttacccgacacttcccttctgcaggtaagacaagatctcccttctccatcggacttttacagcaccccacttcagccaggcggccagagcggctttctgccctccggggccccagcccagcaaatgttgcttccaatggtggatagccagcttcctgtggtgaatttcggtagccttcccccagctccccctccagcacctcccccactctctcttctgcccgtggggcccgcactgcaacctccctccctggctgtgagaccaccccccgccccagcaacaagggtattgccttcaccagcacgccctttccctgctagcttaggtagagctgaattacatcctgtggagctgaagccgttccaagattaccaaaagctgtctagtaacctcggcgggcctgggtcctcacggactcctcccaccggcaggagcttctccggcctgaattcaagactgaaggcaactccttccacttactcaggcgtgttccggactcaacgcgttgatctctatcaacaagccagcccgcctgatgcactccggtggatacccaagccttgggaacggaccggccctcctccaagagagggaccgagccgaagggccgaggaacccggttctagaggtgacaaggagcccgggctacctccaccccggtag

SEQ ID NO: 130059 - DNA, 6450 bp, Artificial Sequence
  Description of Artificial Sequence: Synthetic coding sequence
atgagtgaccgcagcgggcctacagccaagggtaaggacggcaagaaatattcttctttaaatttgtttgatacctacaaaggcaagtccctggagatccagaagccggctgtggcaccccgacatggactgcaaagcttaggtaaagtcgctatcgctcgccggatgccgccaccggccaacctgccctcactgaaggccgaaaacaagggtaatgacccaaatgtgagcttggtccctaaagatggcaccgggtgggcatccaagcaagaacagtccgacccaaagagttcagacgcatcaacagcccagccactggagagccaaccccttccagcctctcagactcccgcttctaatcagcccaagcgcccaccagctgctccagagaacaccccactcgtgccctccggtgtcaagtcctgggcacaggccagcgtgactcacggggctcatggcgatggaggtagggcctcaagcttacttagccgcttttccagggaagagttcccaacactgcaggctgccggtgaccaagataaggcagccaaggagcgggagtctgcagagcagtcatccggacccggcccatccttacgacctcagaatagcacaacctggagggacggtggaggacgagggccagacgagttagaaggccccgactcaaaacttcaccatgggcacgacccacgcgggggtctccagccatctggccctccacagttcccgccgtacagggggatgatgccacctttcatgtacccaccgtacctgccattccctccaccatacgggcctcaggggccttataggtaccccacccctgacggaccttctaggttcccacgggttgctggcccccggggctctggccctcctatgaggctagtcgagcccgttggtagaccgagcattctcaaggaagataatttgaaagagtttgatcagttagaccaggagaacgacgatggctgggccggtgcccacgaagaggttgactatacggagaaattgaaattttccgatgaggaggacggccgcgatagcgacgaggaaggggccgagggccatagagattcacaatcagctagtggggaggagaggcctcccgaagccgatggaaagaagggaaacagtcccaacagtgaacctcccaccccaaaaactgcctgggctgagacctcaaggccccctgaaactgagcctgggcccccggcccccaagcccccactcccaccgccacatagaggccccgccggaaattgggggcctcccggagactaccccgatcggggcgggcccccgtgcaagcctcccgcccctgaagacgaggatgaggcctggagacagcgccgcaagcagagcagtagcgaaatttctctggcagtggaacgggcacgtcggcgtagagaggaagaggagcgtcggatgcaggaagagcgacgcgcagcctgtgctgagaaattgaaacgcctcgatgaaaaattcggagcacccgataagcgcctgaaggccgagcccgctgcgccacccgctgcgccctccacccctgccccgccgccagcagtgcctaaagagctgcccgccccccctgctcctcctcccgcgtccgccccaactcctgaaaaggagccagaggagcccgcacaggctccccccgcacagtccacaccaacaccgggagtcgccgcggcacccacactagtatccggtgggggaagtacctcatccacttcctcaggctcatttgaagcaagccctgtggagccacaactgccaagtaaggagggcccagaacccccagaagaggtgcctccaccgactacacctccagttcccaaagtggagcccaaaggtgatgggattggaccaacaagacaacccccgagtcagggtcttggctacccgaagtaccagaaatccctgccacctaggtttcaaaggcaacaacaggaacagctgcttaaacagcagcagcagcatcagtggcagcagcaccaacagggtagcgccccacctacccctgtgcctcctagcccccctcagcctgtcaccctaggggcagtgccggcaccccaggcccctcccccacctcctaaagccctgtatcctggagcacttggtcgcccaccccctatgccgccgatgaatttcgaccctagatggatgatgatacccccttatgttgacccccgcctgctccagggacgccctcctctcgacttctatcccccaggagtgcatccatccggattggtccccagggagcgctctgactccgggggctcctcatccgagccgttcgatcgccacgccccagccatgctcagagaaagaggaactcctcccgtggatcctaaacttgcctgggtaggcgacgtctttacagctacccccgctgagcctcgcccgttgacgtcacctttgaggcaggccgcagacgaggatgataaggggatgcgatccgagactcctccagtgccccctccccccccttacctggcaagctatccagggttccctgaaaacggggcccccggaccccctatctcacggttccctttggaggaacccggtccacggcccctgccttggccacccgggagcgacgaagtggcaaagatccagacccccccgcctaaaaaggagcctcccaaggaggagaccgcccagctaaccggcccagaagctggccgtaagcccgcccggggagttggcagcggcggccagggcccccctccacctagaagagagtcgcgcacagagactcggtggggtccacgccctggatctagtcgaagggggatccccccggaggaacctggcgcaccacctaggagggccggacctataaaaaagcctcctcccccaaccaaagtggaagagctcccacctaagcctttagagcaaggagatgagacacccaaacctccgaagcctgaccctctcaagatcacaaaggggaaactgggaggtcccaaggagacgcccccaaacggtaacttatcccccgcacctcggctgcggagggactacagttacgagagagtaggacccacatcctgcaggggcaggggtaggggggaatatttcgccagaggccgcggcttccgcggcacttatggaggaaggggtcggggagcagcgggaaattcggccgtcactgaatcatttgaagaaatgatgggggttgaagtgggacagggtgaccagacaactctcctgcttccagaggccgcacttcccgcgcgacacggggcccgggtccagagcatgcgaaaaagccccagcggggccgggagcggggcgcagaaacaggccgcccggcccatgagagtgatttggttattacagacacggcgactccctcatcctaggcgagagcactcgccaagatcacgatcacccactacccgcagcccgacctttcccgccccagctcgcttcacaccaggtgtgggcgagagctccctgcccgaaggaatttctccagggccccgccgccgtgaacctccccaggtgtgtccagggtggtctcctcccgccaagtctctcgccccaaaaaagccacccaccgggcccttgccaccatcgaaagagcccctgaaggagaagcttatcccagggcccttgagtccagtggctagagggggatcaaatggaggtagtaacgtggggatggaggacggcgagcgcccccgccgccgcaggcacggcagggcccagcagcaggacaaaccgccccgctttcgcagattaaagcaagagcgggagaacgcagcgcgtggttcggaagggaaaccttctctcaccctgcctgccagcgcaccaggaccagaagaggcgctgacgaccgtaacggtcgcacctgctcctcggagggctgctgccaagtctcctgacctaagcaaccagaattccgaccaggcgaatgaggagtgggagactgcaagcgaatcatctgacttcacatctgaacggcggggtgacaaggaggctcccccaccggttctgttgacaccaaaagcagtgggaacacctggcgggggtgggggtggcgccgtccccgggatcagcgcgatgtccaggggggacttgtcacagcgagccaaagatctctccaagcgatcatttagcagtcagcgacccggaatggaacgccaaaatcgacgacctggccctggcggtaaagccggaagttccggaagcagcagcggtggaggaggcgggggcccaggaggtcgtaccggcccaggtcggggcgacaagcgctcatggccatcccctaagaatcgtagtcgaccacccgaggaacggcctccaggactgccactgcccccccctcctccttccagcagcgccgtgtttcgtctggatcaagttatccactctaaccccgctgggatacagcaggccctggcccagctaagtagcaggcagggaagcgttaccgctcccggtggacacccgcgccataaaccaggccccccccaagcgccccagggcccatcaccacgcccccccacacggtatgagcctcagagggtcaattccggtctgagtagtgatcctcacttcgaggagcctggacccatggtcagaggagtaggaggcactccacgcgacagcgctggcgtgtcgcccttcccgcctaaaaggagggaacgtcccccgaggaaacccgaattgctccaggaagagtcgcttcccccaccacactcttccggcttcctggggtccaagcccgagggccccgggccccaggctgagagcagggacacaggcacagaggctctgacccctcatatctggaatagactccacacagcaacaagccgtaagagctaccggccaagcagcatggaaccgtggatggaacctctcagccctttcgaggacgtcgctggaactgagatgtcacagtccgacagcggagtggacctgagcggtgactcacaggtgagttccggcccctgctcacagcgttcatcccccgatggcgggctgaagggtgcagctgaggggccaccgaagaggccaggtggatcctcccctctgaacgccgtcccatgtgagggccctcccggatctgagccccctaggcggcctcctcccgccccacacgatggtgacagaaaagagctccctcgggagcagccactgcctcctgggcccattggcacggagagaagtcagcgcaccgacagaggaaccgaacccgggccgatccgcccaagtcacagaccgggcccgccggttcaattcggaacaagcgacaaggatagcgacctgcggttagttgttggggactccttgaaggccgaaaaggagctcaccgcttccgtcactgaagcaatcccagtctctcgggactgggaattactgccctccgccgctgcgtcagccgaaccacagagcaagaacctggatagcggacactgcgtgcccgagcctagtagcagcggccaacgcctttaccctgaagtgttttatggctctgcggggcctagctcttctcaaatttctggggggcatggcttgagcatcacttccaagcagtggagaaggccaggtactccctcactccacccctacagaagccaacccctttatctgccccccggtcccgccccaccctctgccttgttgagcggggttgcacttaagggccagtttttagattttagtaccatgcaggccacagagctgggtaagctgccagctggcggggtcctgtacccccctccaagttttttgtacagcccagcattttgcccctcccccttgcccgatacctcactgctgcaggtcagacaggacctcccaagtcccagcgatttttattctacacctttgcagcctggagggcagtccgggttcctcccctccggtgcgcctgcccaacagatgttactgccaatggtggattcccagctgccagtcgtgaactttggcagcctacctcctgctcctccgccggcccctccaccattaagtctcctgccagtcgggcccgcacttcagccaccatcactcgcagtgaggccgcctccagcgccagctaccagagtgctgccttcgccagctaggccttttccagcatctctcggtagggcagagttgcaccctgtggagttgaaaccattccaggattaccagaagctgtctagtaatctgggaggcccagggtcatccaggaccccaccaactggccggtctttttccggattaaacagccgtctgaaggccaccccgtccacttacagcggcgtgtttagaactcagcgcgtcgacctgtaccagcaggcaagcccacccgatgcactcaggtggatcccaaaaccctgggagaggactggcccccccccaagagaggggcctagccgccgagctgaagaacctggcagccgcggcgacaaggaacccggcctgccccccccgaggtag

SEQ ID NO: 130060 - DNA, 4149 bp, Artificial Sequence
  Description of Artificial Sequence: Synthetic coding sequence
atgctgagagagcgcgggacaccaccagttgatccaaaactcgcttgggttggagatgtcttcacagccacaccagcagagccaaggccattgacttcaccactgcgtcaggcagctgatgaggatgataaaggcatgaggtctgagacaccaccagttccacccccccctccgtatctggccagctacccaggctttcccgagaacggcgcacccggccccccaattagccgcttccccctcgaagagcctggcccccgtcctttaccctggcctcctgggtcagacgaagtggccaagatccagactccgccgcccaaaaaagaacctccaaaagaggagaccgctcagctgaccgggcccgaggccgggagaaaaccggcaaggggagtgggctctgggggacagggacccccacctccgcgccgcgagagcagaaccgagacccgatggggacccagaccaggatctagccgtagaggcattccacctgaagagcctggtgcccctccacggcgagccggaccaattaaaaaaccaccaccccctaccaaagtggaagagctcccccccaaaccactggagcaaggcgatgagacccctaagccacccaaacccgaccctctgaaaattacaaaaggaaagctgggcggacccaaagaaacacctcctaacggcaacctctctcccgctcccagactgaggcgagactactcctacgagcgcgtcggccccactagttgccgcggaagaggtcgcggcgagtatttcgcacgcgggcggggttttcgagggacatatggcggcaggggcagaggcgctcggtcccgcgagttccggtcttatagagaattccgtggggatgatgggagaggcggaggaaccggggggcccaaccaccctcctgccccacggggccggacagcatcagagacgagatcagagggtagtgaatatgaggagataccaaaaaggcggaggcagcggggcagtgagactggctccgaaacacacgaatcagacctggccccctcggataaggaagcccccactccgaaagaaggcactctaacccaggtccccctggccccccccccacccggtgccccacctagcccagctcccgctcggtttactgcccggggcggcagagttttcacaccgaggggcgtgccctcacgtcggggccggggtggcggacgaccccctccgcaagtgtgccctgggtggagtccacccgccaagtccctggcccctaagaaaccccccactggcccactcccccccagtaaggagcctctgaaagagaaactgatcccaggaccactaagcccggtggccagaggaggcagcaacggcggatcaaacgtgggcatggaggacggggaaaggccacgaagaaggcgacacggccgggcgcagcagcaggacaaacctcctcgcttccgccggctgaaacaggaacgcgagaatgccgctcgtggatctgaaggaaagccgtccctgaccctgcccgcaagcgcacccggccctgaggaagccctcacaaccgtgacggtagctcccgctccccgacgggctgctgcaaagtcgcctgatttgtctaaccaaaattccgaccaagccaacgaagagtgggagactgcaagcgagtcctccgactttacatcagaacggcgaggcgataaagaggcacctccccctgtgctgctgactccaaaggcagtgggaacccccggtggaggcggaggcggggccgtgccaggaatttcagccatgtccagaggggaccttagtcagcgggccaaggatctgtcaaaacgcagcttttcctctcaaaggcctgggatggagagacagaacagaaggcctggaccaggaggcaaagctggtagtagcgggtcgtctagcgggggcggcggggggggacccgggggcagaactggtccaggcaggggagacaaaaggagctggccttcacccaagaatcgaagccgaccacccgaagagcgccccccaggactccctttacctcctccccctcccagctcttctgctgtgttccgcctcgaccaggtgatacatagcaaccctgccggtatccagcaagcactggctcagctgagctcacggcaaggatctgttacggcccccggggggcacccaagacacaaacccgggccaccccaggcgccacagggaccctccccccgcccccccacaagatatgaaccacaacgagtgaatagcggcctgagctcagatcctcatttcgaggaacctgggcctatggtgcgcggcgtggggggcacaccacgtgacagtgccggtgtcagcccgtttccgccaaaaaggagggagcgcccgccacgtaagcctgaactgttgcaggaggaatctctgccccccccacattcatcaggattcctcgggtccaagcccgaagggcctgggccccaggcagaaagccgagacaccggtaccgaggccttgacgccgcacatctggaatcggttacacacagccacttcccgaaaatcttatagaccaagctccatggaaccctggatggaaccccttagtccctttgaggatgtggcaggaaccgaaatgagccagtctgattctggggtggatttaagtggggattctcaggtgtcatcaggaccttgctcacagaggtccagccccgatggcggtctcaagggggctgccgaaggaccccctaaacgccctggtggctcttcacctctgaacgctgtgccatgcgagggccctcccggtagcgaaccaccccgcaggcctcctcctgcaccccatgacggtgaccgcaaggaattaccacgagagcagcctctgccacccggcccaattggcacagaaagaagtcagaggaccgacaggggcaccgaacctggccccattaggccttcacatagaccgggccctccggtccagtttggtacctcagataaggactccgaccttcgcctcgtagtgggcgactcactgaaggccgaaaaggagctgacagcctccgtgactgaagctatcccagtgtcacgggactgggaacttctaccaagtgcggccgcatccgcggagccccagtccaagaaccttgattcagggcattgcgttccggaacctagctcttctggacagcggctttaccctgaggtattttacggctcagccggaccgagcagttcccagatctccggcggagccatggattcccagctgcatccaaactcaggagggttccgccctggaactccttctctgcatccttataggagccagcccctctacctgcctccgggccctgctcctccctcggcccttttgagcggtgtcgcccttaaggggcaattcctggacttttccaccatgcaagcaaccgaactgggaaaacttccagcagggggcgtcctgtatcctccaccgtcattcctctactcgcctgccttctgcccgagcccgcttcctgatacctctttattgcaagtgcgccaggatctccccagcccatctgatttctactccacccctctgcagcccggaggacagagcggcttcttgccctccggggcccctgctcaacaaatgttgcttcccatggttgattcccagctgcctgtcgtgaactttgggagcctcccacccgctccccctcctgcaccaccccctctctctcttctcccggtcggccccgccctacaacctccctcccttgctgtcagacccccaccagctccggccaccagagtgttgccaagccccgctcgcccatttccagcctctctcggaagggccgaacttcatcccgtggagctgaaaccgttccaggattaccaaaagctctcaagcaacctcggggggccagggagtagccgcacacctcccacgggccgtagcttttcaggcttgaattcccggttgaaggccacgccttcgacttactccggtgtgtttcgaactcaacgggtggatctataccagcaggcctctcctccggacgccctcaggtggattccgaaaccatgggaacggactggacctcctccccgcgaaggacccagtcggcgagccgaggagcccgggagtaggggggacaaggagcctggtttgcctcccccccgctag

SEQ ID NO: 130061 - DNA, 4149 bp, Artificial Sequence
  Description of Artificial Sequence: Synthetic coding sequence
atgcttcgagaaaggggcactccccctgtcgatccaaagttagcttgggtgggggacgtgtttactgctacacccgctgagccccgccctttaacaagtcctctaaggcaggccgccgacgaagatgacaaggggatgcgttcagagactccccccgtgcctcccccacctccttacttggcctcttaccccggctttcctgaaaatggagcaccagggccgcctatcagtcggtttcccctcgaagaacccggaccccgccccctgccttggccacccggcagtgacgaagtggccaagatccagacccccccgccgaagaaagagcctcctaaggaggagacagcccaactgacaggtccagaagccggacggaagccagccagaggcgtgggctcaggcggacagggccctccccctccgaggagagagtcacggacggaaactcgctggggccctcgccccgggtcaagcaggcgcggtattcctcccgaagagcccggagcgccgcctcggcgggcgggccctatcaagaagccacccccacccacaaaggtggaggagctaccaccaaaaccccttgaacagggcgacgagacacctaagcccccaaagccagatcctttgaagatcaccaagggaaagctgggcgggccaaaggaaacccctccaaatgggaatctctcccccgctcctaggctcagacgcgattacagctatgagagggtgggccccacctcctgtcgaggcagggggaggggcgagtacttcgcccggggcagggggtttcggggaacctacggtggacggggacgcggcgctagatcaagagaattcaggtcataccgagagttcaggggcgatgatggtaggggcggcgggaccgggggcccgaatcatccccccgccccccggggcaggacagcctctgaaactagaagtgaaggcagcgagtatgaagagatccccaagcggcggcgccagcggggaagcgagactggaagcgagactcacgagtctgacctggcaccttctgataaagaggccccaactccgaaggaaggcactctgacacaagtccctttggcccccccaccacctggagccccaccttcgccagcccctgcacgctttactgcccgtggcggtagagttttcacccccagaggggtgccatcacggcgcggcagaggcggcggaagaccccctccacaagtttgccccggatggtctcccccagccaagagcttggctccaaagaagccaccaactggccctttgcccccgtccaaggaaccattgaaagagaagcttatccccggaccactgtcacctgtggctaggggcggatcaaacggcggatcaaatgtaggcatggaagacggcgaaaggccgcgcaggcgcaggcatggaagggcccagcagcaagacaagccccctagatttcgacgtctgaaacaagaaagagaaaacgcggcgcgtggttcagaggggaaaccaagcctgacactgccagccagcgcgccgggacctgaagaggccctcaccactgtgacagtagctcccgcacccaggagggctgccgcgaagtcccccgatctcagtaatcagaatagcgatcaggccaacgaggagtgggagaccgcgagcgagagtagtgactttaccagtgaaaggagaggcgataaagaggcacctccgcctgtcttactcactccaaaggccgttggtactcctgggggagggggtggcggggctgtgccaggcattagtgctatgtctaggggcgatttgagccagcgtgccaaagacctttcaaagaggtcattcagttctcagagaccagggatggagagacaaaatcgacgacccggacctggaggtaaggcaggaagcagtggcagcagctctgggggaggcggtggagggcctggggggcgtacggggcccggtcggggcgacaagcgctcatggcccagtcccaaaaacagatcgcgccccccagaggaaaggccgcccgggctgccactgccacccccccctccgtcttcctctgccgtgttccgactggaccaggtgatccactccaatcctgcggggatccagcaagctctggcccagctcagctctcgccaaggatccgtgaccgctcccggcggacacccccgccataagcccgggccacctcaggcgccgcagggaccatcacctcgacctcctacccgttacgaacctcagcgcgtgaacagcgggctctcatccgacccccactttgaagaaccgggccccatggtgagaggagtgggaggaaccccccgagacagtgctggggtgagccctttccctccaaaacgccgggaaagacctcctcgaaagcccgagttactccaagaagagtccctcccccctcctcactcttctggatttttgggctctaaacctgaagggcctggaccccaggctgaaagtagggatacaggtaccgaggccctcacaccacatatttggaatcgtttacacacagccactagccggaagtcataccggcctagctcaatggaaccttggatggagccacttagccctttcgaggacgtggcagggacagaaatgagccaaagtgattccggcgtcgacctctcaggggatagtcaagtgtcctcagggccctgctcccagaggtcctctcctgacggaggcttaaaaggcgccgccgagggtcctcctaagaggcctggcggaagttccccacttaatgccgtgccttgcgaaggaccccccgggtcggaacctcccaggcgccctccgccagctcctcatgatggtgaccggaaggaattgccccgcgaacagcccctcccaccagggcccatagggactgaaaggtcccagagaaccgaccgcggcactgagcctggtcccattagaccaagtcaccggccgggcccacccgtccagttcggaacgagcgacaaagattccgatctacggctggtggtgggtgacagcttaaaagcagagaaagagcttacagccagcgtgaccgaggccattcctgtgagccgggactgggagctactgccttctgcggctgcgtccgccgagccacagtcgaaaaacctagattctggccattgtgtgcccgagccatctagttctggacagaggttgtatccagaagtgttctacggctctgccggcccctcctcgtcacagattagtggcggagcgatggattctcagttacatcctaacagcggcggattcagacctggaactccttctctacacccctatcggagtcagccactgtatctgcctcccgggccagcccctcctagcgccttactgtccggggtggcgctgaaaggacaatttttagatttttctacaatgcaggctacggagttgggaaaactgcctgctggaggagtactgtaccccccaccatccttcctttactcacccgcattctgtccctcccccttacccgacacctctctgcttcaggttcgccaggatctgcctagcccttcggacttctactctacacctctgcagccgggggggcagagtggatttttaccatcgggcgcgcctgcacagcaaatgctgctgcccatggtggattctcagctgcccgtggtcaatttcggaagcttgccccctgctcctccccctgccccccctcctctgtctcttcttcccgtggggccagccctccaacctccttcccttgcagtgaggccccccccagcgccagcgactcgagtgctccccagccccgcaaggccgtttcccgcaagcttgggccgcgctgagctgcatccagtggaactgaagcctttccaggactaccagaagctgtcgagcaacctcggcggacctgggtcaagccgcactcctccaacagggagaagtttttcagggctgaacagccggctgaaggccaccccctccacttatagcggcgtgttccggactcaaagagtggacctgtaccagcaggcttctcctcccgatgcactgaggtggatccccaaaccctgggaacgcaccgggcccccaccccgggaaggaccaagcaggcgagcagaagaaccaggctcacgcggcgacaaggagccaggtctgccccctccaagatag

SEQ ID NO: 130062 - DNA, 6450 bp, Artificial Sequence
  Description of Artificial Sequence: Synthetic coding sequence
atgagcgatcggtcaggacccaccgctaaaggtaaagatggtaagaagtattccagcctcaacctgttcgatacatacaaagggaagagcttggagatccagaaaccggccgtggcccctcgccacggtttgcagagcttgggcaaagtggcgattgcgcgccgaatgccccctccggcaaatctcccttctttgaaagctgaaaacaaagggaatgacccaaacgtgagcttagtaccaaaggacggtaccggttgggcaagcaaacaggagcagagcgaccccaagtcatcggatgcttctacagctcaacccccagagtcacagccgctgcccgcaagccagacaccagctagcaatcagcccaaacgaccccccgctgcgcctgaaaatactcctctagtgcctagcggagtgaaatcctgggcccaggcctccgttacgcatggagcgcacggggatggggggagggcttccagtttgctgtcccgtttttcaagagaggaattcccaactctgcaagctgcaggcgatcaggataaggccgctaaagagagggaatccgctgaacagagctctggtccaggcccctctctgaggcctcagaactctactacctggagagatggcggagggcggggcccagatgaactggagggaccagattcaaaactgcatcatgggcacgacccaagaggagggctgcagcctagtggcccaccccagttcccaccctacagaggcatgatgccaccgttcatgtatcctccatacctaccctttccccctccgtacggaccccagggcccataccgatatccaacgcctgacggcccaagccgatttcctagagttgcggggccgcgcggttctggcccgccaatgcggctcgtggaacctgtggggagacctagcatactgaaggaagataaccttaaggagttcgaccagctggatcaggaaaatgatgatggctgggctggggcccacgaggaggtcgattacacagagaaactgaaattttcagatgaggaggacggcagggattccgatgaggaaggtgccgagggtcatagagatagccagtcagcatctggggaggagcgacccccagaggccgatggcaagaagggcaatagcccgaatagtgaacccccaacgccaaaaactgcgtgggccgaaacctctagaccccctgagactgagcctggaccccccgctccaaagcccccgctgccccccccacacagaggcccagcgggtaattgggggcctcccggcgattatccagacagggggggaccgccttgcaaaccacccgctcccgaagatgaagacgaagcctggcggcagagaaggaaacagtccagcagtgaaatttcacttgctgtcgaacgtgctcggaggcgtcgagaggaagaggagagaaggatgcaggaagaaagaagagctgcctgcgccgaaaaattgaagaggctggacgagaaattcggagctcccgacaagaggttgaaggcagaaccggccgcccctcctgctgcgcccagtactcctgccccccctcctgcagttcctaaagagctgcccgcacctccggctcccccccccgcttccgctcctaccccagagaaagagcccgaagaaccagcacaggcgcctcctgcccagagtaccccaacacccggggtcgcagcagctccaacactggtgtccgggggtgggagcaccagctccacatccagcgggagtttcgaggcttcccccgtggaacctcaactgccgagtaaagaggggcctgagcctcctgaagaggtacctccccccaccacccccccagtgcccaaagtcgagccgaagggagatggaatcggcccaacgaggcagcccccgagccaggggctaggttatcccaaataccagaaaagcctgccgccacggttccagagacagcagcaggaacagctgctgaaacagcagcagcagcaccagtggcagcagcaccagcaagggtccgctccacctacgccagtaccaccctccccgccgcagcccgtaaccctgggtgctgtgccagcccctcaggccccaccaccccctccaaaagcattatacccaggcgcccttggtcgcccaccaccaatgccgcccatgaactttgatccgagatggatgatgattccgccatacgttgaccccagattgctccaagggcgaccccctcttgacttctacccccccggggtacacccttctgggctcgtgccccgggaacgcagcgactcgggcgggagttccagcgaacccttcgatagacacgctccggcaatgctaagggagcggggaacccctcccgtcgatcctaagcttgcatgggtgggggatgtgtttaccgctacccccgccgagcctcggccccttacgagccctctgcgacaggccgcggatgaagatgataaaggaatgagatccgagaccccgcccgttcctccaccacctccctaccttgcctcttaccccggctttcccgagaacggcgccccagggccgcccatttctagattccctctcgaggagccgggccccagacctctcccttggcccccagggagcgatgaggtggctaagatccagactccccctcctaagaaggagccacctaaagaagaaaccgcacagttgacaggaccggaagccggcaggaaacccgctagaggcgtcggttcaggggggcagggccccccaccacccagacgagagtctagaacagaaactcgctggggcccgagaccaggctccagtaggcgaggaattcctcccgaggagcccggggctcctccaagaagggccggcccaatcaagaagccaccacctcctacgaaggtggaggaactgccaccgaaacccctggagcagggagatgaaactccaaaaccccccaagcctgatcccctaaaaattaccaagggtaagcttggtgggcccaaggaaacgcccccgaacggaaatttatctcctgcaccccgcctacgacgggactactcatatgaacgggtggggccgacctcatgtcgagggcgagggagaggcgagtattttgcgcgcggcagagggttcagaggcacatatgggggccggggtaggggcgcagctggaaatagcgccgtgaccgaaagtttcgaagaaatgatgggtgtcgaagtcgggcagggcgatcagacaacgctcctcctgccagaggcagccctcccagcacgccacggcgccagagtgcagagcatgaggaaatcccccagtggagccgggagcggagctcagaaacaggccgcccgccctatgcgggtgatttggttattgcagacgagaaggcttccgcacccccggcgggaacactccccccgctccaggtccccaactacgcggagtcccacctttcccgctccggctcgctttacccccggggtcggtgagagctctcttcctgagggtatttctcccggccctcgaagacgggagccaccccaagtgtgcccaggctggagccctcctgctaagtccctcgctccgaagaagcctcccaccggccctctgccacccagtaaggagcccctgaaagaaaaactcatcccaggtcccctaagccctgtggctcgcggagggtcaaacggaggatctaacgtgggtatggaagatggcgagaggccccgcagaaggaggcatggcagggcacagcagcaagataagcctccaaggtttcgacggttgaagcaggagagagaaaatgctgctaggggcagcgagggcaaaccaagtctaacactaccagctagcgcaccgggacccgaggaggcattgactacagtgaccgttgccccagcaccaagacgcgctgccgccaagagccctgacctcagcaaccagaattcagatcaggccaacgaggaatgggagactgcttccgagtcaagcgatttcaccagcgaaagaaggggagataaagaggcccctccaccggtgttacttacacccaaggctgttggtactcccggtggaggaggcgggggcgccgtgccaggcatatctgcaatgagcaggggggatttatctcaacgagctaaagatctgtctaagcggagtttcagctcacagcggccgggtatggagcgtcagaatagaaggccaggacctggagggaaggccgggtcttccggatctagttcaggggggggcggcggaggacctgggggacgaactggccctggccggggggacaagagaagctggcccagtccaaagaaccgcagccgccccccagaggagagacctccggggctgcccttgcctcctccacccccctccagttccgccgtttttcggcttgaccaggtcatccacagtaatcctgccgggattcaacaagctctcgcccagttgtcttctcggcaaggctccgtaacggcccccgggggccatcccaggcataagccgggaccccctcaggcccctcagggacctagccctagaccacctacccggtacgaaccccagcgtgtgaactccggtctctcctctgaccctcacttcgaagaacccggcccgatggtgcgtggtgtaggcggcaccccccgggattctgcaggtgtcagtccatttccacccaaacgccgagaaagaccaccacgtaaaccagaacttctgcaggaagagtctctcccgccccctcatagcagtggctttttagggtcgaagccagagggacccggtccgcaggccgaatcaagagataccggtaccgaggccctgaccccccacatctggaatcgcctccacaccgcgacaagcaggaagtcatacagaccatcatctatggaaccctggatggagcccctgtcccccttcgaagacgtggccggcacagaaatgtcccaaagcgacagcggtgttgatttgtccggcgattctcaggtcagtagcggaccttgctcacagcgctcctccccagacggggggctgaagggcgccgctgaggggccaccaaaacggccaggaggctccagcccccttaatgccgttccttgcgagggcccgcctgggtcggaaccacctcgcaggcctccaccagccccgcatgacggagacaggaaagaactccctcgggagcaacctctgccacccggcccaatagggacagaacggagtcagcacacagatcgtggcactgaacctgggccaatccgacctagccatcggccagggccgccagttcagttcgggacatccgacaaggattccgatctgagactagttgtcggggatagcctcaaagcagaaaaagaactcacggcctcagtgacagaggccatccctgtttctcgcgattgggagctgctgccatccgccgccgcttccgcggaaccccagtcaaagaatcttgacagtgggcattgcgtcccagagccttcttccagtgggcaaagactgtatccagaggtgttttacggttcagcggggccctccagttctcagatcagtggaggacacgggcttagtgtcaccagcaagcagtggcggcgccccggcacaccttcactgcatccctaccgttcacagccactatatttgccacctggccctgcccctccctcagccctgttaagcggcgtcgcactcaaaggacaatttctcgacttcagcaccatgcaggctaccgaactgggcaaactgccagcaggcggcgtcctgtaccctccaccatcgtttctgtacagccccgccttttgtccttcacctttgcctgacacttctctgctgcaagtgagacaggacttgccctcacccagcgatttttattccacacccttgcagcccgggggacaaagtggatttctaccaagcggagccccagcacagcaaatgcttctccctatggttgacagccagctccctgtggtgaatttcggcagtctgccacctgcaccaccgcccgcaccacccagcctgagtttgctgcccgtgggccctgctcttcagcctcccagcctagctgtgcggccacctccagcaccagcaacacgggttctgccatcgccagcacggcccttccctgcatcgttaggccgggctgaactgcaccctgtcgagctgaaaccttttcaggattatcagaaactaagtagtaatttgggcgggcctggatcttctaggacgcctccaaccggaagatctttttcaggtttgaattcaagactcaaggccactccctcaacgtattcgggagtttttcgtacccaacgcgtcgatctttaccagcaggccagtccacctgacgccctgcgctggattccgaagccctgggaacgcacaggacccccacctagggagggtccgtcccgtcgcgcagaggagcccgggtccaggggagataaggagcccggccttcctcctccaagatag

SEQ ID NO: 130063 - DNA, 4149 bp, Artificial Sequence
  Description of Artificial Sequence: Synthetic coding sequence
atgctgcgggagcgagggacacctcccgtggatccaaagcttgcctgggtcggcgacgtgttcacggccactccggccgagccccggccacttaccagccccctgcgccaggcagctgatgaagatgacaaaggcatgcgctcagagaccccaccagtaccgcccccgccgccctatcttgccagctaccctggttttccggagaatggagcaccagggccgcccatatcgagatttccactagaggagccaggacccagacccctgccatggccgccaggtagtgacgaggttgcgaaaatccaaacccccccgcccaagaaggagccacctaaggaggagactgcccagctcacaggccccgaggctggcaggaagcctgctcgcggagtaggaagcgggggccagggccccccgccgccaagaagggagtctagaactgaaacgcgctggggaccccgacccggtagttctcgaaggggaatcccacccgaagaacccggagcgccccccagacgcgctggaccaatcaagaaaccacccccaccaacaaaggtggaggagctcccccctaaacccctggaacagggagacgagaccccgaagcctcctaaaccagacccactaaagatcactaagggaaaactgggcggccccaaggagactcctcccaacgggaatcttagtcctgccccccgactccgccgtgattactcctatgaaagagttggtcccacaagctgcagggggcgcgggcgcggtgaatatttcgcccggggtagggggtttcggggaacctacgggggcaggggaaggggagctcggtcacgggagtttcgtagctatcgggaatttcgcggagatgacggtagaggaggggggacaggcggacccaaccatccacctgccccccgtggaagaacagcgagcgagactagaagcgagggcagtgagtatgaggaaatccctaagcgtcggagacagagaggatccgagactggtagcgaaacgcacgagtccgatctggctccttctgataaagaggcacccaccccgaaggaaggtacattaacgcaggttccactggcccccccaccacccggcgctcctcccagccccgcccccgctcgctttactgccagagggggtcgggttttcacccctaggggagtcccctcacgaagaggacgaggtggcgggaggcctcccccccaggtttgccccggctggtccccgcccgcaaagtctttggccccaaagaagcctcccacgggcccgttgcccccatctaaagagccactgaaagagaaattaattcctgggcccttaagtcctgtagccagggggggctctaatggagggagcaatgttggcatggaagacggcgaacgcccaaggcgtcgcagacatgggcgagcacagcagcaagacaaacctcctcgtttccgaaggctgaagcaggagcgggagaatgcagccagaggatccgaggggaaaccctccctaacactgcctgctagtgcccctggtcccgaagaggcactcactactgtgacagtggccccagctccgagacgcgccgccgcaaaaagcccagacttgtccaaccagaactccgaccaggctaacgaagagtgggagactgcgagcgagtcatctgacttcacctccgagcgccggggagacaaggaggcccccccccccgtcctgttgaccccgaaagcagtaggcacccccggaggcggcggaggcggcgctgtgcccggaattagcgccatgtcgaggggcgatctatctcaaagggctaaggatctttccaagcggtccttctctagccagcggcctgggatggagcgacagaatcggcggccaggcccaggaggtaaagctgggtccagcggctcttcctctggaggcggggggggaggtcccggaggacgtacaggccccggcagaggtgataagcgctcatggccaagccctaagaaccggtctagaccaccagaggaaaggccccccggactacccctcccccccccacccccaagttcaagcgcggtgttccggcttgatcaggtcatccatagcaatcctgcaggcattcagcaggccttggcccaattatccagccggcaaggatccgttaccgcccctggcggtcacccccgccataagccaggccctccacaggccccacagggcccatcaccaaggccacccacacggtacgagccacaacgtgtgaatagcggcctgtccagcgacccccattttgaggagcccgggccaatggtccgaggtgtagggggtaccccccgggattcggctggcgtgagtccattccctcctaaacggagagaaagacctcccaggaaaccagaactgttgcaggaagaatctttgcctccccctcactccagcgggtttcttgggtctaaacccgaaggaccgggaccccaggccgaaagtcgcgacactggaacggaagcgctcacacctcacatttggaatcgtctgcatactgctacgagcagaaaatcctacaggccgtccagcatggagccttggatggaaccgttgagtcctttcgaggacgtggctggtactgagatgagtcaatccgattcaggggtagacctcagtggcgactctcaggttagctccgggccttgttcccaaaggagcagtcccgacggcggcctcaagggagccgctgagggtccacctaaaaggcccggcgggtcatccccattgaacgcggtaccgtgcgaggggccccccggctcagagcctcccagacgaccaccccccgccccacacgacggtgatcgaaaggaactaccccgggagcagcctctgccccccgggccaattggcacggaacgttcacaacacacagatcgagggactgagcccggcccgatcagaccctctcacagaccgggtcctcctgtacaatttggaacaagtgataaggacagcgacctcagattggtggtgggtgacagcctgaaggcagaaaaggaactcaccgcctccgttacagaagctattcctgttagtcgcgattgggagctcttgccatccgcagccgctagcgccgagccccagagcaaaaacttggacagcgggcattgcgtgccagagccatcttcctctggccagaggctttaccccgaggtgttttatgggagcgctggacctagcagttcacagatctccggaggtgccatggatagccagctgcaccctaacagtggaggttttcgcccaggaacaccctccctgcacccctaccgatcacaacctttatacctgccacctggacccgccccacctagcgccctgctatctggggtggccctgaaaggccaattcctggattttagtacaatgcaggcaactgaacttgggaaactgccggctggtggagttctctatcctccacccagtttcttatattctcccgcgttttgcccctcccccttgcctgacacttctcttctacaagtccggcaggaccttccatccccttcagatttctactcaactccgcttcaacctgggggtcaatctgggtttctaccgtctggtgctccagcgcaacagatgttactacctatggtcgactcccagctcccggtggtgaactttggctctcttcccccggctcctccacccgcccctccttcattaagcctgctgcccgtgggacctgccctgcagccaccctccttggctgtgcgacctccaccggccccggctacacgcgtcctgccatccccggctaggccctttcccgcatcattaggccgagctgagctccacccagtggagctcaaacccttccaggattatcagaagcttagcagtaacctggggggcccggggtccagcagaactccacccaccggtcgtagcttctccgggctcaattcccgactcaaggccacgccatcgacctactcaggcgtcttccgcacccagagggtcgatctgtaccaacaggcttcaccacctgacgctctcaggtggattccaaagccctgggagagaactggcccacctccacgggaaggaccatcccgtcgggctgaagagccggggtcccggggggataaagagccgggcctgcctcccccacgatag
